United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 17

SEQ ID NO: 684985 - DNA, 16 bp, Homo sapiens
tatgactaaagagaga

SEQ ID NO: 684986 - DNA, 17 bp, Homo sapiens
tatgagccagacaaatg

SEQ ID NO: 684987 - DNA, 13 bp, Homo sapiens
tatgcacttttag

SEQ ID NO: 684988 - DNA, 19 bp, Homo sapiens
tatgcacttttagaaatgc

SEQ ID NO: 684989 - DNA, 14 bp, Homo sapiens
tatgcattatatca

SEQ ID NO: 684990 - DNA, 15 bp, Homo sapiens
tatgccttaatttag

SEQ ID NO: 684991 - DNA, 15 bp, Homo sapiens
tatgctgatctttta

SEQ ID NO: 684992 - DNA, 17 bp, Homo sapiens
tatgctgatcttttaaa

SEQ ID NO: 684993 - DNA, 20 bp, Homo sapiens
tatgctgatcttttaaaatc

SEQ ID NO: 684994 - DNA, 20 bp, Homo sapiens
tatgcttgtaactaaaataa

SEQ ID NO: 684995 - DNA, 20 bp, Homo sapiens
tatggaacataaagttgtat

SEQ ID NO: 684996 - DNA, 22 bp, Homo sapiens
tatggatatatttgaaatagta

SEQ ID NO: 684997 - DNA, 18 bp, Homo sapiens
tatggatgatttaagtgt

SEQ ID NO: 684998 - DNA, 15 bp, Homo sapiens
tatggcatttctatt

SEQ ID NO: 684999 - DNA, 14 bp, Homo sapiens
tatggcttatttct

SEQ ID NO: 685000 - DNA, 15 bp, Homo sapiens
tatggcttatttcta

SEQ ID NO: 685001 - DNA, 16 bp, Homo sapiens
tatggcttcaccaaga

SEQ ID NO: 685002 - DNA, 19 bp, Homo sapiens
tatgggtgggattttgcaa

SEQ ID NO: 685003 - DNA, 17 bp, Homo sapiens
tatggtatatatacata

SEQ ID NO: 685004 - DNA, 22 bp, Homo sapiens
tatggtcttgagccagtaatct

SEQ ID NO: 685005 - DNA, 16 bp, Homo sapiens
tatgtaagaacacatt

SEQ ID NO: 685006 - DNA, 12 bp, Homo sapiens
tatgtagatgtg

SEQ ID NO: 685007 - DNA, 17 bp, Homo sapiens
tatgtagatgtgcattt

SEQ ID NO: 685008 - DNA, 17 bp, Homo sapiens
tatgtaggtaagactgt

SEQ ID NO: 685009 - DNA, 15 bp, Homo sapiens
tatgtgaaaaattaa

SEQ ID NO: 685010 - DNA, 18 bp, Homo sapiens
tatgtgaaatgctttctg

SEQ ID NO: 685011 - DNA, 19 bp, Homo sapiens
tatgtgacatttctcttcc

SEQ ID NO: 685012 - DNA, 20 bp, Homo sapiens
tatgtgaggtaattattgct

SEQ ID NO: 685013 - DNA, 23 bp, Homo sapiens
tatgtgagtgccttttgcagaag

SEQ ID NO: 685014 - DNA, 21 bp, Homo sapiens
tatgtgggatattgaatgtta

SEQ ID NO: 685015 - DNA, 12 bp, Homo sapiens
tatgtgtaaaga

SEQ ID NO: 685016 - DNA, 19 bp, Homo sapiens
tatgtgtgtaggttatctt

SEQ ID NO: 685017 - DNA, 20 bp, Homo sapiens
tatgtgtgtaggttatcttt

SEQ ID NO: 685018 - DNA, 16 bp, Homo sapiens
tatgttactattttct

SEQ ID NO: 685019 - DNA, 15 bp, Homo sapiens
tatgttcctcaaatc

SEQ ID NO: 685020 - DNA, 18 bp, Homo sapiens
tatgtttgctgattattt

SEQ ID NO: 685021 - DNA, 22 bp, Homo sapiens
tatgtttgctgattatttatga

SEQ ID NO: 685022 - DNA, 17 bp, Homo sapiens
tattaaaactaaatttc

SEQ ID NO: 685023 - DNA, 14 bp, Homo sapiens
tattaaagtattct

SEQ ID NO: 685024 - DNA, 19 bp, Homo sapiens
tattaaataataaagtatg

SEQ ID NO: 685025 - DNA, 15 bp, Homo sapiens
tattaaatcagttct

SEQ ID NO: 685026 - DNA, 14 bp, Homo sapiens
tattaagtaaaatc

SEQ ID NO: 685027 - DNA, 22 bp, Homo sapiens
tattaatattcagggtaaatag

SEQ ID NO: 685028 - DNA, 13 bp, Homo sapiens
gttgtatgtttgc

SEQ ID NO: 685029 - DNA, 14 bp, Homo sapiens
gttgtcaagaatag

SEQ ID NO: 685030 - DNA, 23 bp, Homo sapiens
gttgttgcatatagttaaactga

SEQ ID NO: 685031 - DNA, 15 bp, Homo sapiens
gttgttgtggaagca

SEQ ID NO: 685032 - DNA, 23 bp, Homo sapiens
gttgtttgaggcaaattaactgt

SEQ ID NO: 685033 - DNA, 15 bp, Homo sapiens
gtttaaaagccatgt

SEQ ID NO: 685034 - DNA, 15 bp, Homo sapiens
gtttaattcagcaga

SEQ ID NO: 685035 - DNA, 13 bp, Homo sapiens
gtttacctttctc

SEQ ID NO: 685036 - DNA, 23 bp, Homo sapiens
gtttataatgaagaacactgtag

SEQ ID NO: 685037 - DNA, 23 bp, Homo sapiens
gtttatactgtatttctaagaag

SEQ ID NO: 685038 - DNA, 21 bp, Homo sapiens
gtttattataaagcttaaatt

SEQ ID NO: 685039 - DNA, 16 bp, Homo sapiens
gtttcaagaaaatctt

SEQ ID NO: 685040 - DNA, 12 bp, Homo sapiens
gtttcagtttga

SEQ ID NO: 685041 - DNA, 23 bp, Homo sapiens
gtttcatgtagccagcagaactg

SEQ ID NO: 685042 - DNA, 14 bp, Homo sapiens
gtttccagggaggg

SEQ ID NO: 685043 - DNA, 16 bp, Homo sapiens
gtttcctatttaatac

SEQ ID NO: 685044 - DNA, 18 bp, Homo sapiens
gtttcctatttaatacag

SEQ ID NO: 685045 - DNA, 17 bp, Homo sapiens
gtttcctggttccgttt

SEQ ID NO: 685046 - DNA, 15 bp, Homo sapiens
gtttctcctgagcta

SEQ ID NO: 685047 - DNA, 18 bp, Homo sapiens
gtttctcctgagctagga

SEQ ID NO: 685048 - DNA, 19 bp, Homo sapiens
gtttctccttttcctatcc

SEQ ID NO: 685049 - DNA, 14 bp, Homo sapiens
gtttctctccctcc

SEQ ID NO: 685050 - DNA, 16 bp, Homo sapiens
gtttctgggtcctgaa

SEQ ID NO: 685051 - DNA, 23 bp, Homo sapiens
gtttctgggtcctgaagaattaa

SEQ ID NO: 685052 - DNA, 22 bp, Homo sapiens
gtttctgtttataatgaagaac

SEQ ID NO: 685053 - DNA, 19 bp, Homo sapiens
gtttgaggcaaattaactg

SEQ ID NO: 685054 - DNA, 15 bp, Homo sapiens
gtttgctgattattt

SEQ ID NO: 685055 - DNA, 15 bp, Homo sapiens
gtttgcttgaatgct

SEQ ID NO: 685056 - DNA, 17 bp, Homo sapiens
gtttggaaaagtggcgt

SEQ ID NO: 685057 - DNA, 14 bp, Homo sapiens
gtttggacagctga

SEQ ID NO: 685058 - DNA, 21 bp, Homo sapiens
gtttggactgcagaagcaagg

SEQ ID NO: 685059 - DNA, 15 bp, Homo sapiens
gtttggcaaggaaag

SEQ ID NO: 685060 - DNA, 19 bp, Homo sapiens
gtttggtaaatgtttcttt

SEQ ID NO: 685061 - DNA, 14 bp, Homo sapiens
gtttgtctatttta

SEQ ID NO: 685062 - DNA, 15 bp, Homo sapiens
gtttgtctattttaa

SEQ ID NO: 685063 - DNA, 19 bp, Homo sapiens
gtttgtctattttaaaata

SEQ ID NO: 685064 - DNA, 19 bp, Homo sapiens
gtttgtggcgtctccctcg

SEQ ID NO: 685065 - DNA, 19 bp, Homo sapiens
gttttaactttaatacagc

SEQ ID NO: 685066 - DNA, 20 bp, Homo sapiens
gttttaccaagtgctgtctt

SEQ ID NO: 685067 - DNA, 21 bp, Homo sapiens
gttttactcctttttattcat

SEQ ID NO: 685068 - DNA, 18 bp, Homo sapiens
gttttatgctactgaact

SEQ ID NO: 685069 - DNA, 20 bp, Homo sapiens
gttttcattcattggtgaag

SEQ ID NO: 685070 - DNA, 19 bp, Homo sapiens
gttttccatgatttagcaa

SEQ ID NO: 685071 - DNA, 22 bp, Homo sapiens
gttttccatgatttagcaagca

SEQ ID NO: 685072 - DNA, 16 bp, Homo sapiens
gttttggactccatct

SEQ ID NO: 685073 - DNA, 20 bp, Homo sapiens
gttttgtttggcaaggaaag

SEQ ID NO: 685074 - DNA, 18 bp, Homo sapiens
gtttttaaatgaggatta

SEQ ID NO: 685075 - DNA, 13 bp, Homo sapiens
gtttttaatttga

SEQ ID NO: 685076 - DNA, 14 bp, Homo sapiens
gtttttaatttgat

SEQ ID NO: 685077 - DNA, 13 bp, Homo sapiens
gtttttatttttg

SEQ ID NO: 685078 - DNA, 18 bp, Homo sapiens
gtttttctttttccacaa

SEQ ID NO: 685079 - DNA, 15 bp, Homo sapiens
gtttttgacagcctt

SEQ ID NO: 685080 - DNA, 12 bp, Homo sapiens
gtttttgctctc

SEQ ID NO: 685081 - DNA, 21 bp, Homo sapiens
gtttttggatctggcattgaa

SEQ ID NO: 685082 - DNA, 18 bp, Homo sapiens
taaaaaacactaaacatt

SEQ ID NO: 685083 - DNA, 16 bp, Homo sapiens
taaaaaatcagaacaa

SEQ ID NO: 685084 - DNA, 11 bp, Homo sapiens
taaaaaatgtc

SEQ ID NO: 685085 - DNA, 14 bp, Homo sapiens
taaaaaattttaaa

SEQ ID NO: 685086 - DNA, 17 bp, Homo sapiens
taaaaacaaatgagttt

SEQ ID NO: 685087 - DNA, 17 bp, Homo sapiens
taaaaacaagtcatttt

SEQ ID NO: 685088 - DNA, 15 bp, Homo sapiens
taaaaacataacata

SEQ ID NO: 685089 - DNA, 22 bp, Homo sapiens
taaaaactcttcagtgcaaatt

SEQ ID NO: 685090 - DNA, 18 bp, Homo sapiens
taaaaagaaattaatatg

SEQ ID NO: 685091 - DNA, 16 bp, Homo sapiens
taaaaagagtaatttc

SEQ ID NO: 685092 - DNA, 20 bp, Homo sapiens
taaaaatgtaggctttcatg

SEQ ID NO: 685093 - DNA, 22 bp, Homo sapiens
taaaaattacctttaattttaa

SEQ ID NO: 685094 - DNA, 15 bp, Homo sapiens
taaaacaaatataca

SEQ ID NO: 685095 - DNA, 19 bp, Homo sapiens
taaaacaaatatacatttt

SEQ ID NO: 685096 - DNA, 15 bp, Homo sapiens
taaaacattaaaata

SEQ ID NO: 685097 - DNA, 19 bp, Homo sapiens
taaaacattaaaatataat

SEQ ID NO: 685098 - DNA, 13 bp, Homo sapiens
taaaacttctgct

SEQ ID NO: 685099 - DNA, 16 bp, Homo sapiens
taaaacttctgctcgt

SEQ ID NO: 685100 - DNA, 14 bp, Homo sapiens
taaaagcattttgt

SEQ ID NO: 685101 - DNA, 18 bp, Homo sapiens
taaaagcattttgtaata

SEQ ID NO: 685102 - DNA, 14 bp, Homo sapiens
taaaaggatggcaa

SEQ ID NO: 685103 - DNA, 21 bp, Homo sapiens
taaaaggtagagtcttacaat

SEQ ID NO: 685104 - DNA, 13 bp, Homo sapiens
taaaataaataat

SEQ ID NO: 685105 - DNA, 15 bp, Homo sapiens
taaaataattttgta

SEQ ID NO: 685106 - DNA, 16 bp, Homo sapiens
taaaataattttgtaa

SEQ ID NO: 685107 - DNA, 16 bp, Homo sapiens
taaaatagaataattc

SEQ ID NO: 685108 - DNA, 19 bp, Homo sapiens
taaaataggggatatttaa

SEQ ID NO: 685109 - DNA, 19 bp, Homo sapiens
taaaatatcataaagcatt

SEQ ID NO: 685110 - DNA, 15 bp, Homo sapiens
taaaatgccagtctc

SEQ ID NO: 685111 - DNA, 19 bp, Homo sapiens
taaaatgtaatttaaatga

SEQ ID NO: 685112 - DNA, 20 bp, Homo sapiens
taaaatgtaatttaaatgaa

SEQ ID NO: 685113 - DNA, 21 bp, Homo sapiens
taaaatgtaatttaaatgaaa

SEQ ID NO: 685114 - DNA, 21 bp, Homo sapiens
taaaatgtagaaacttaaaca

SEQ ID NO: 685115 - DNA, 17 bp, Homo sapiens
taaaatgtgtgccatat

SEQ ID NO: 685116 - DNA, 22 bp, Homo sapiens
taaaatgtttcattatgcactt

SEQ ID NO: 685117 - DNA, 21 bp, Homo sapiens
taaaattatatagctgctcct

SEQ ID NO: 685118 - DNA, 15 bp, Homo sapiens
taaaattatgagatt

SEQ ID NO: 685119 - DNA, 23 bp, Homo sapiens
taaaattgagtttgtagaacttt

SEQ ID NO: 685120 - DNA, 16 bp, Homo sapiens
taaaattgatattata

SEQ ID NO: 685121 - DNA, 15 bp, Homo sapiens
ggtcaccaagcagtg

SEQ ID NO: 685122 - DNA, 21 bp, Homo sapiens
ggtcagaggagcgcaggcagc

SEQ ID NO: 685123 - DNA, 11 bp, Homo sapiens
ggtcataaaat

SEQ ID NO: 685124 - DNA, 12 bp, Homo sapiens
ggtcataaaata

SEQ ID NO: 685125 - DNA, 14 bp, Homo sapiens
ggtcatcctgcccc

SEQ ID NO: 685126 - DNA, 19 bp, Homo sapiens
ggtcatgtttgcaggggtg

SEQ ID NO: 685127 - DNA, 18 bp, Homo sapiens
ggtccagtggatgccaca

SEQ ID NO: 685128 - DNA, 14 bp, Homo sapiens
ggtccccactgctg

SEQ ID NO: 685129 - DNA, 20 bp, Homo sapiens
ggtccccactgctgagctgg

SEQ ID NO: 685130 - DNA, 15 bp, Homo sapiens
ggtcctagtaagaag

SEQ ID NO: 685131 - DNA, 14 bp, Homo sapiens
ggtccttctccaca

SEQ ID NO: 685132 - DNA, 13 bp, Homo sapiens
ggtctcccctcct

SEQ ID NO: 685133 - DNA, 15 bp, Homo sapiens
ggtctccctggctcc

SEQ ID NO: 685134 - DNA, 16 bp, Homo sapiens
ggtctccctggctccc

SEQ ID NO: 685135 - DNA, 17 bp, Homo sapiens
ggtctccctggctccct

SEQ ID NO: 685136 - DNA, 17 bp, Homo sapiens
ggtctctccctcaggtg

SEQ ID NO: 685137 - DNA, 17 bp, Homo sapiens
ggtctgccttctgctga

SEQ ID NO: 685138 - DNA, 17 bp, Homo sapiens
ggtctggggacaggccc

SEQ ID NO: 685139 - DNA, 18 bp, Homo sapiens
ggtctggggacaggcccg

SEQ ID NO: 685140 - DNA, 15 bp, Homo sapiens
ggtctgtgtgaatgt

SEQ ID NO: 685141 - DNA, 22 bp, Homo sapiens
ggtcttcttacatgcatttgag

SEQ ID NO: 685142 - DNA, 13 bp, Homo sapiens
ggtgaaagaacaa

SEQ ID NO: 685143 - DNA, 18 bp, Homo sapiens
ggtgacagtcatcatcag

SEQ ID NO: 685144 - DNA, 12 bp, Homo sapiens
ggtgagaactct

SEQ ID NO: 685145 - DNA, 12 bp, Homo sapiens
ggtgatgactta

SEQ ID NO: 685146 - DNA, 18 bp, Homo sapiens
ggtgatgtagcccatcct

SEQ ID NO: 685147 - DNA, 11 bp, Homo sapiens
ggtgcagaggt

SEQ ID NO: 685148 - DNA, 19 bp, Homo sapiens
ggtgccctcgcctcctcct

SEQ ID NO: 685149 - DNA, 14 bp, Homo sapiens
ggtgctcctgcatc

SEQ ID NO: 685150 - DNA, 15 bp, Homo sapiens
ggtggaaggcagaca

SEQ ID NO: 685151 - DNA, 11 bp, Homo sapiens
ggtggcctcag

SEQ ID NO: 685152 - DNA, 22 bp, Homo sapiens
ggtggcggctgcacaacagccc

SEQ ID NO: 685153 - DNA, 11 bp, Homo sapiens
ggtgggacccc

SEQ ID NO: 685154 - DNA, 12 bp, Homo sapiens
ggtgggtgctca

SEQ ID NO: 685155 - DNA, 13 bp, Homo sapiens
ggtgggtgctcag

SEQ ID NO: 685156 - DNA, 14 bp, Homo sapiens
ggtgggtgctcaga

SEQ ID NO: 685157 - DNA, 14 bp, Homo sapiens
ggtggttcagacaa

SEQ ID NO: 685158 - DNA, 12 bp, Homo sapiens
ggtgtagccagg

SEQ ID NO: 685159 - DNA, 21 bp, Homo sapiens
ggtgtatcctggccctggggg

SEQ ID NO: 685160 - DNA, 13 bp, Homo sapiens
ggtgtatttaaac

SEQ ID NO: 685161 - DNA, 16 bp, Homo sapiens
ggtgtatttaaactat

SEQ ID NO: 685162 - DNA, 10 bp, Homo sapiens
ggtgtatttt

SEQ ID NO: 685163 - DNA, 12 bp, Homo sapiens
ggtgtcctgagc

SEQ ID NO: 685164 - DNA, 16 bp, Homo sapiens
ggtgtttgcttgaatg

SEQ ID NO: 685165 - DNA, 16 bp, Homo sapiens
ggttacagagacctat

SEQ ID NO: 685166 - DNA, 18 bp, Homo sapiens
ggttatctttttaaaaac

SEQ ID NO: 685167 - DNA, 18 bp, Homo sapiens
ggttcagacacagctctt

SEQ ID NO: 685168 - DNA, 21 bp, Homo sapiens
ggttccctgctgcgctgcttg

SEQ ID NO: 685169 - DNA, 19 bp, Homo sapiens
ggttcgttctgtactgtta

SEQ ID NO: 685170 - DNA, 18 bp, Homo sapiens
ggttctttcatttgcttt

SEQ ID NO: 685171 - DNA, 11 bp, Homo sapiens
ggttgtgtgtg

SEQ ID NO: 685172 - DNA, 15 bp, Homo sapiens
ggttgtgtgtgttct

SEQ ID NO: 685173 - DNA, 16 bp, Homo sapiens
ggtttctctccctcct

SEQ ID NO: 685174 - DNA, 14 bp, Homo sapiens
ggttttaaactttc

SEQ ID NO: 685175 - DNA, 13 bp, Homo sapiens
gtaaaaaatgtct

SEQ ID NO: 685176 - DNA, 23 bp, Homo sapiens
gtaaaaaatgtctcatgtcaatg

SEQ ID NO: 685177 - DNA, 22 bp, Homo sapiens
gtaaaacaataataataataaa

SEQ ID NO: 685178 - DNA, 17 bp, Homo sapiens
gtaaaacctgttctcca

SEQ ID NO: 685179 - DNA, 11 bp, Homo sapiens
gtaaaacttct

SEQ ID NO: 685180 - DNA, 16 bp, Homo sapiens
gtaaaagcattttgta

SEQ ID NO: 685181 - DNA, 16 bp, Homo sapiens
gtaaacttctgcaaca

SEQ ID NO: 685182 - DNA, 23 bp, Homo sapiens
gtaaagctatttatgggcccctg

SEQ ID NO: 685183 - DNA, 16 bp, Homo sapiens
gtaaagttatgtattt

SEQ ID NO: 685184 - DNA, 17 bp, Homo sapiens
gtaaataaactatttat

SEQ ID NO: 685185 - DNA, 23 bp, Homo sapiens
gtaaataaactatttatatcaca

SEQ ID NO: 685186 - DNA, 17 bp, Homo sapiens
gtaaataggaatcattc

SEQ ID NO: 685187 - DNA, 14 bp, Homo sapiens
gtaaatatatatgg

SEQ ID NO: 685188 - DNA, 16 bp, Homo sapiens
gtaaatcagaaagtaa

SEQ ID NO: 685189 - DNA, 16 bp, Homo sapiens
gtaaatcctgccattt

SEQ ID NO: 685190 - DNA, 19 bp, Homo sapiens
gtaaatcctgccatttaaa

SEQ ID NO: 685191 - DNA, 13 bp, Homo sapiens
gtaaatgaaactt

SEQ ID NO: 685192 - DNA, 15 bp, Homo sapiens
gtaaatgcatattaa

SEQ ID NO: 685193 - DNA, 13 bp, Homo sapiens
gtaactaaaataa

SEQ ID NO: 685194 - DNA, 14 bp, Homo sapiens
gtaactgctgaaaa

SEQ ID NO: 685195 - DNA, 13 bp, Homo sapiens
gtaacttatttga

SEQ ID NO: 685196 - DNA, 13 bp, Homo sapiens
gtaagaaatacag

SEQ ID NO: 685197 - DNA, 17 bp, Homo sapiens
gtaagaattcagaagac

SEQ ID NO: 685198 - DNA, 16 bp, Homo sapiens
gctgaagaattgaaaa

SEQ ID NO: 685199 - DNA, 20 bp, Homo sapiens
gctgaagtcaaaatatgtaa

SEQ ID NO: 685200 - DNA, 18 bp, Homo sapiens
gctgactctccagggagc

SEQ ID NO: 685201 - DNA, 14 bp, Homo sapiens
gctgactgaatgca

SEQ ID NO: 685202 - DNA, 11 bp, Homo sapiens
gctgagctggc

SEQ ID NO: 685203 - DNA, 16 bp, Homo sapiens
gctgaggcagggggat

SEQ ID NO: 685204 - DNA, 15 bp, Homo sapiens
gctgagtaaacataa

SEQ ID NO: 685205 - DNA, 20 bp, Homo sapiens
gctgagtgagtgggagagta

SEQ ID NO: 685206 - DNA, 19 bp, Homo sapiens
gctgatactgggtctgcga

SEQ ID NO: 685207 - DNA, 19 bp, Homo sapiens
gctgatcgtagaaaatttg

SEQ ID NO: 685208 - DNA, 18 bp, Homo sapiens
gctgcacaacagccctgc

SEQ ID NO: 685209 - DNA, 15 bp, Homo sapiens
gctgcattagaaaaa

SEQ ID NO: 685210 - DNA, 19 bp, Homo sapiens
gctgccagccttgagccct

SEQ ID NO: 685211 - DNA, 21 bp, Homo sapiens
gctgccagccttgagccctgg

SEQ ID NO: 685212 - DNA, 23 bp, Homo sapiens
gctgccagccttgagccctggct

SEQ ID NO: 685213 - DNA, 21 bp, Homo sapiens
gctgccatgtgaagagggaga

SEQ ID NO: 685214 - DNA, 18 bp, Homo sapiens
gctgccctgagaagctgc

SEQ ID NO: 685215 - DNA, 22 bp, Homo sapiens
gctgccctgagaagctgctcca

SEQ ID NO: 685216 - DNA, 13 bp, Homo sapiens
gctgcctcctgcg

SEQ ID NO: 685217 - DNA, 13 bp, Homo sapiens
gctgcctctgctc

SEQ ID NO: 685218 - DNA, 17 bp, Homo sapiens
gctgcctctgctccctc

SEQ ID NO: 685219 - DNA, 11 bp, Homo sapiens
gctgcctggca

SEQ ID NO: 685220 - DNA, 23 bp, Homo sapiens
gctgctatccccatctccctgcc

SEQ ID NO: 685221 - DNA, 19 bp, Homo sapiens
gctgctccaggcctgcagc

SEQ ID NO: 685222 - DNA, 22 bp, Homo sapiens
gctgctgatactgggtctgcga

SEQ ID NO: 685223 - DNA, 20 bp, Homo sapiens
gctggaaagcagagcctcct

SEQ ID NO: 685224 - DNA, 22 bp, Homo sapiens
gctggaaagcagagcctcctgg

SEQ ID NO: 685225 - DNA, 11 bp, Homo sapiens
gctggaagaat

SEQ ID NO: 685226 - DNA, 15 bp, Homo sapiens
gctggactattgtgc

SEQ ID NO: 685227 - DNA, 16 bp, Homo sapiens
gctggactattgtgcc

SEQ ID NO: 685228 - DNA, 16 bp, Homo sapiens
gctggagatcagcatg

SEQ ID NO: 685229 - DNA, 12 bp, Homo sapiens
gctggagcctgg

SEQ ID NO: 685230 - DNA, 20 bp, Homo sapiens
gctggcacgtgacaggctcg

SEQ ID NO: 685231 - DNA, 16 bp, Homo sapiens
gctggctcacagtaca

SEQ ID NO: 685232 - DNA, 17 bp, Homo sapiens
gctgggccatgtccaaa

SEQ ID NO: 685233 - DNA, 20 bp, Homo sapiens
gctgggccatgtccaaagag

SEQ ID NO: 685234 - DNA, 19 bp, Homo sapiens
gctgtcttgatgactgctg

SEQ ID NO: 685235 - DNA, 20 bp, Homo sapiens
gctgtcttgatgactgctga

SEQ ID NO: 685236 - DNA, 23 bp, Homo sapiens
gctgtgacaagccaatgtgaatt

SEQ ID NO: 685237 - DNA, 19 bp, Homo sapiens
gctgtgcaacggtctcctg

SEQ ID NO: 685238 - DNA, 18 bp, Homo sapiens
gctgtgcggatctctgga

SEQ ID NO: 685239 - DNA, 18 bp, Homo sapiens
gctgtgctccatatttga

SEQ ID NO: 685240 - DNA, 15 bp, Homo sapiens
gctgtgtgtcccagg

SEQ ID NO: 685241 - DNA, 23 bp, Homo sapiens
gctgtgtgtcccaggcagggaga

SEQ ID NO: 685242 - DNA, 23 bp, Homo sapiens
gctgttaggggttattggtgtaa

SEQ ID NO: 685243 - DNA, 19 bp, Homo sapiens
gctgttatttcttccctgc

SEQ ID NO: 685244 - DNA, 22 bp, Homo sapiens
gctgttatttcttccctgcttt

SEQ ID NO: 685245 - DNA, 12 bp, Homo sapiens
gctgttctgtgg

SEQ ID NO: 685246 - DNA, 17 bp, Homo sapiens
gctgtttgtcctgagat

SEQ ID NO: 685247 - DNA, 15 bp, Homo sapiens
gcttaaaaatcattg

SEQ ID NO: 685248 - DNA, 18 bp, Homo sapiens
gcttaatgctacatgtga

SEQ ID NO: 685249 - DNA, 18 bp, Homo sapiens
gcttaatggagttcttgt

SEQ ID NO: 685250 - DNA, 15 bp, Homo sapiens
gcttatatgtacttt

SEQ ID NO: 685251 - DNA, 18 bp, Homo sapiens
gcttatatgtacttttat

SEQ ID NO: 685252 - DNA, 18 bp, Homo sapiens
gcttatcaactaatgatt

SEQ ID NO: 685253 - DNA, 21 bp, Homo sapiens
gcttatctcttttatatttgt

SEQ ID NO: 685254 - DNA, 18 bp, Homo sapiens
gcttatgaaagaggcagc

SEQ ID NO: 685255 - DNA, 23 bp, Homo sapiens
gcttatgatagcaaatggcctca

SEQ ID NO: 685256 - DNA, 18 bp, Homo sapiens
gcttatttttaatttggg

SEQ ID NO: 685257 - DNA, 18 bp, Homo sapiens
gcttcagtaacaagtgtt

SEQ ID NO: 685258 - DNA, 17 bp, Homo sapiens
gcttccctgacttgctt

SEQ ID NO: 685259 - DNA, 18 bp, Homo sapiens
gcttcctgacaatcaact

SEQ ID NO: 685260 - DNA, 20 bp, Homo sapiens
gcttctccaggaagcccagg

SEQ ID NO: 685261 - DNA, 16 bp, Homo sapiens
ggcaaagtttaaatgt

SEQ ID NO: 685262 - DNA, 10 bp, Homo sapiens
ggcaaggaaa

SEQ ID NO: 685263 - DNA, 11 bp, Homo sapiens
ggcaaggaaag

SEQ ID NO: 685264 - DNA, 22 bp, Homo sapiens
ggcaaggaaaggggagaaggga

SEQ ID NO: 685265 - DNA, 16 bp, Homo sapiens
ggcacacactgaccac

SEQ ID NO: 685266 - DNA, 21 bp, Homo sapiens
ggcacacactgtgccccacaa

SEQ ID NO: 685267 - DNA, 19 bp, Homo sapiens
ggcacagctgggagcctgg

SEQ ID NO: 685268 - DNA, 12 bp, Homo sapiens
ggcacaggaggc

SEQ ID NO: 685269 - DNA, 23 bp, Homo sapiens
ggcacaggaggcaggcatggccc

SEQ ID NO: 685270 - DNA, 15 bp, Homo sapiens
ggcaccatccagctc

SEQ ID NO: 685271 - DNA, 17 bp, Homo sapiens
ggcaccatccagctccc

SEQ ID NO: 685272 - DNA, 12 bp, Homo sapiens
ggcacctcttcc

SEQ ID NO: 685273 - DNA, 14 bp, Homo sapiens
ggcactggcccagg

SEQ ID NO: 685274 - DNA, 11 bp, Homo sapiens
ggcagaagaga

SEQ ID NO: 685275 - DNA, 11 bp, Homo sapiens
ggcagaaggga

SEQ ID NO: 685276 - DNA, 14 bp, Homo sapiens
ggcagaagggaatt

SEQ ID NO: 685277 - DNA, 23 bp, Homo sapiens
ggcagagcagtctaaacagagtc

SEQ ID NO: 685278 - DNA, 15 bp, Homo sapiens
ggcagccagatggcc

SEQ ID NO: 685279 - DNA, 15 bp, Homo sapiens
ggcagcgcagggctg

SEQ ID NO: 685280 - DNA, 18 bp, Homo sapiens
ggcagcgcagggctggca

SEQ ID NO: 685281 - DNA, 20 bp, Homo sapiens
ggcagcgccaagtgcgtgcc

SEQ ID NO: 685282 - DNA, 11 bp, Homo sapiens
ggcagctgcct

SEQ ID NO: 685283 - DNA, 12 bp, Homo sapiens
ggcagctgcctc

SEQ ID NO: 685284 - DNA, 13 bp, Homo sapiens
ggcagctgcctct

SEQ ID NO: 685285 - DNA, 14 bp, Homo sapiens
ggcagctgcctctg

SEQ ID NO: 685286 - DNA, 15 bp, Homo sapiens
ggcagctgcctctgc

SEQ ID NO: 685287 - DNA, 22 bp, Homo sapiens
ggcaggactcctggcagggcca

SEQ ID NO: 685288 - DNA, 23 bp, Homo sapiens
ggcaggactcctggcagggccac

SEQ ID NO: 685289 - DNA, 15 bp, Homo sapiens
ggcaggaggatcact

SEQ ID NO: 685290 - DNA, 16 bp, Homo sapiens
ggcaggcatggccctg

SEQ ID NO: 685291 - DNA, 17 bp, Homo sapiens
ggcaggcatggccctgg

SEQ ID NO: 685292 - DNA, 18 bp, Homo sapiens
ggcaggcatggccctggg

SEQ ID NO: 685293 - DNA, 19 bp, Homo sapiens
ggcaggcggctcctcctca

SEQ ID NO: 685294 - DNA, 14 bp, Homo sapiens
ggcaggctgggcca

SEQ ID NO: 685295 - DNA, 16 bp, Homo sapiens
ggcaggctgggccatg

SEQ ID NO: 685296 - DNA, 17 bp, Homo sapiens
ggcagggagctgggccc

SEQ ID NO: 685297 - DNA, 19 bp, Homo sapiens
ggcagggccacctgcagga

SEQ ID NO: 685298 - DNA, 15 bp, Homo sapiens
ggcagtccatctagg

SEQ ID NO: 685299 - DNA, 11 bp, Homo sapiens
ggcagtccctt

SEQ ID NO: 685300 - DNA, 16 bp, Homo sapiens
ggcatggccctgggcg

SEQ ID NO: 685301 - DNA, 12 bp, Homo sapiens
ggccacatggcg

SEQ ID NO: 685302 - DNA, 13 bp, Homo sapiens
ggccacctgcagg

SEQ ID NO: 685303 - DNA, 14 bp, Homo sapiens
ggccacctgcagga

SEQ ID NO: 685304 - DNA, 16 bp, Homo sapiens
ggccacctgcaggacc

SEQ ID NO: 685305 - DNA, 13 bp, Homo sapiens
ggccagcgtggct

SEQ ID NO: 685306 - DNA, 17 bp, Homo sapiens
ggccagggctgccctga

SEQ ID NO: 685307 - DNA, 17 bp, Homo sapiens
ggccagggtctgtgtga

SEQ ID NO: 685308 - DNA, 23 bp, Homo sapiens
ggccagggtctgtgtgaatgtgg

SEQ ID NO: 685309 - DNA, 21 bp, Homo sapiens
ggccaggtcccagcttgagct

SEQ ID NO: 685310 - DNA, 14 bp, Homo sapiens
ggccagtggggcct

SEQ ID NO: 685311 - DNA, 14 bp, Homo sapiens
ggccatggctcagg

SEQ ID NO: 685312 - DNA, 22 bp, Homo sapiens
ggccatgtccaaagaggctgcc

SEQ ID NO: 685313 - DNA, 23 bp, Homo sapiens
ggccatgtccaaagaggctgccc

SEQ ID NO: 685314 - DNA, 21 bp, Homo sapiens
ggccatttccaagaggctgta

SEQ ID NO: 685315 - DNA, 21 bp, Homo sapiens
ggcccaaaggccttggacaac

SEQ ID NO: 685316 - DNA, 21 bp, Homo sapiens
ggcccaccttccccagaacca

SEQ ID NO: 685317 - DNA, 21 bp, Homo sapiens
ggcccagtgcatggtggccag

SEQ ID NO: 685318 - DNA, 22 bp, Homo sapiens
ggcccagtgcatggtggccaga

SEQ ID NO: 685319 - DNA, 18 bp, Homo sapiens
ggcccatagcagccagtt

SEQ ID NO: 685320 - DNA, 20 bp, Homo sapiens
ggccccacctcggcacacac

SEQ ID NO: 685321 - DNA, 21 bp, Homo sapiens
ggccccacctcggcacacact

SEQ ID NO: 685322 - DNA, 23 bp, Homo sapiens
ggccccacctcggcacacactgt

SEQ ID NO: 685323 - DNA, 23 bp, Homo sapiens
ggccccaggcctgtggctccctt

SEQ ID NO: 685324 - DNA, 13 bp, Homo sapiens
ggcccccaataaa

SEQ ID NO: 685325 - DNA, 21 bp, Homo sapiens
gcaccgtcctcagcagtccac

SEQ ID NO: 685326 - DNA, 14 bp, Homo sapiens
gcacctcttccttg

SEQ ID NO: 685327 - DNA, 20 bp, Homo sapiens
gcacctcttccttgatgttt

SEQ ID NO: 685328 - DNA, 18 bp, Homo sapiens
gcacctgtagtcccagct

SEQ ID NO: 685329 - DNA, 20 bp, Homo sapiens
gcaccttcactctccagggt

SEQ ID NO: 685330 - DNA, 18 bp, Homo sapiens
gcaccttgtgcctggggt

SEQ ID NO: 685331 - DNA, 16 bp, Homo sapiens
gcacgtgacaggctcg

SEQ ID NO: 685332 - DNA, 23 bp, Homo sapiens
gcactatgcccttttatataagt

SEQ ID NO: 685333 - DNA, 18 bp, Homo sapiens
gcactgaggtttttttgc

SEQ ID NO: 685334 - DNA, 18 bp, Homo sapiens
gcactgatgttgtgtttt

SEQ ID NO: 685335 - DNA, 18 bp, Homo sapiens
gcacttattgaccatttt

SEQ ID NO: 685336 - DNA, 16 bp, Homo sapiens
gcactttctaatgttt

SEQ ID NO: 685337 - DNA, 18 bp, Homo sapiens
gcagaaaataaaggaagc

SEQ ID NO: 685338 - DNA, 20 bp, Homo sapiens
gcagaagacgggaggggagg

SEQ ID NO: 685339 - DNA, 23 bp, Homo sapiens
gcagaagacgggaggggaggcat

SEQ ID NO: 685340 - DNA, 16 bp, Homo sapiens
gcagaagagaaaggac

SEQ ID NO: 685341 - DNA, 19 bp, Homo sapiens
gcagaatgtaagtgggccc

SEQ ID NO: 685342 - DNA, 15 bp, Homo sapiens
gcagacagcaggcag

SEQ ID NO: 685343 - DNA, 19 bp, Homo sapiens
gcagacccagtcccacact

SEQ ID NO: 685344 - DNA, 20 bp, Homo sapiens
gcagactggggcatcctgtg

SEQ ID NO: 685345 - DNA, 22 bp, Homo sapiens
gcagagaacagaactggaggca

SEQ ID NO: 685346 - DNA, 16 bp, Homo sapiens
gcagagatttctcatt

SEQ ID NO: 685347 - DNA, 14 bp, Homo sapiens
gcagaggaccaggg

SEQ ID NO: 685348 - DNA, 17 bp, Homo sapiens
gcagaggaccagggcct

SEQ ID NO: 685349 - DNA, 16 bp, Homo sapiens
gcagaggtaccctggg

SEQ ID NO: 685350 - DNA, 19 bp, Homo sapiens
gcagaggtaccctgggtgt

SEQ ID NO: 685351 - DNA, 14 bp, Homo sapiens
gcagagttttcatt

SEQ ID NO: 685352 - DNA, 22 bp, Homo sapiens
gcagataaaatgccagtctcat

SEQ ID NO: 685353 - DNA, 14 bp, Homo sapiens
gcagatactttgaa

SEQ ID NO: 685354 - DNA, 17 bp, Homo sapiens
gcagattgaaaaggaca

SEQ ID NO: 685355 - DNA, 16 bp, Homo sapiens
gcagcatggagagagg

SEQ ID NO: 685356 - DNA, 14 bp, Homo sapiens
gcagcattgaagta

SEQ ID NO: 685357 - DNA, 13 bp, Homo sapiens
gcagccagttcaa

SEQ ID NO: 685358 - DNA, 18 bp, Homo sapiens
gcagcgcagggctggcac

SEQ ID NO: 685359 - DNA, 11 bp, Homo sapiens
gcagctgcctc

SEQ ID NO: 685360 - DNA, 16 bp, Homo sapiens
gcagctgcctctgctc

SEQ ID NO: 685361 - DNA, 19 bp, Homo sapiens
gcagctgcctctgctccct

SEQ ID NO: 685362 - DNA, 15 bp, Homo sapiens
gcagctgtcccttgc

SEQ ID NO: 685363 - DNA, 17 bp, Homo sapiens
gcagcttctactcctgc

SEQ ID NO: 685364 - DNA, 17 bp, Homo sapiens
gcaggaccctgtcctgc

SEQ ID NO: 685365 - DNA, 14 bp, Homo sapiens
gcaggactcctggc

SEQ ID NO: 685366 - DNA, 16 bp, Homo sapiens
gcaggactcctggcag

SEQ ID NO: 685367 - DNA, 18 bp, Homo sapiens
gcaggaggatcacttgag

SEQ ID NO: 685368 - DNA, 12 bp, Homo sapiens
gcaggcagagtg

SEQ ID NO: 685369 - DNA, 13 bp, Homo sapiens
gcaggcagcgcag

SEQ ID NO: 685370 - DNA, 18 bp, Homo sapiens
gcaggcagcgcagggctg

SEQ ID NO: 685371 - DNA, 13 bp, Homo sapiens
gcaggcagcgcca

SEQ ID NO: 685372 - DNA, 13 bp, Homo sapiens
gcaggcatggccc

SEQ ID NO: 685373 - DNA, 15 bp, Homo sapiens
gcaggcggctcctcc

SEQ ID NO: 685374 - DNA, 16 bp, Homo sapiens
gcaggcggctcctcct

SEQ ID NO: 685375 - DNA, 11 bp, Homo sapiens
gcaggctgggc

SEQ ID NO: 685376 - DNA, 13 bp, Homo sapiens
gcaggctgggcca

SEQ ID NO: 685377 - DNA, 16 bp, Homo sapiens
gcagggaaggcctgac

SEQ ID NO: 685378 - DNA, 12 bp, Homo sapiens
gcagggcagcag

SEQ ID NO: 685379 - DNA, 17 bp, Homo sapiens
gcagggccacctgcagg

SEQ ID NO: 685380 - DNA, 18 bp, Homo sapiens
gcagggccacctgcagga

SEQ ID NO: 685381 - DNA, 21 bp, Homo sapiens
gcagggtctgtttggactgca

SEQ ID NO: 685382 - DNA, 14 bp, Homo sapiens
gcagtcatctactt

SEQ ID NO: 685383 - DNA, 17 bp, Homo sapiens
gcagtcatctacttttt

SEQ ID NO: 685384 - DNA, 20 bp, Homo sapiens
gcagtcccacactgtgcaga

SEQ ID NO: 685385 - DNA, 14 bp, Homo sapiens
gcagtccttactcc

SEQ ID NO: 685386 - DNA, 12 bp, Homo sapiens
gcagtcgcctgc

SEQ ID NO: 685387 - DNA, 16 bp, Homo sapiens
gcagtcgcctgcctgc

SEQ ID NO: 685388 - DNA, 22 bp, Homo sapiens
gcagtcgcctgcctgcagcagg

SEQ ID NO: 685389 - DNA, 18 bp, Homo sapiens
gcagtctttcttgaaatt

SEQ ID NO: 685390 - DNA, 13 bp, Homo sapiens
gcagtggcagaga

SEQ ID NO: 685391 - DNA, 20 bp, Homo sapiens
gcagtggccatcatcctccc

SEQ ID NO: 685392 - DNA, 16 bp, Homo sapiens
gcagtgtggccaggct

SEQ ID NO: 685393 - DNA, 17 bp, Homo sapiens
gcagtgtggccaggctg

SEQ ID NO: 685394 - DNA, 22 bp, Homo sapiens
gcagttagctgaagaattgaaa

SEQ ID NO: 685395 - DNA, 20 bp, Homo sapiens
gcagttatggtgatgactta

SEQ ID NO: 685396 - DNA, 13 bp, Homo sapiens
gcagttgcttgtg

SEQ ID NO: 685397 - DNA, 18 bp, Homo sapiens
gcagttgttgaggggagg

SEQ ID NO: 685398 - DNA, 21 bp, Homo sapiens
gcagttttgttttaaaactgg

SEQ ID NO: 685399 - DNA, 15 bp, Homo sapiens
gcataactgtagctc

SEQ ID NO: 685400 - DNA, 16 bp, Homo sapiens
gcataatagtcaattt

SEQ ID NO: 685401 - DNA, 23 bp, Homo sapiens
gcccgtgtagtccccaaccgtgt

SEQ ID NO: 685402 - DNA, 17 bp, Homo sapiens
gccctaagtggctgcct

SEQ ID NO: 685403 - DNA, 18 bp, Homo sapiens
gccctaagtggctgcctt

SEQ ID NO: 685404 - DNA, 13 bp, Homo sapiens
gccctcaagggtg

SEQ ID NO: 685405 - DNA, 15 bp, Homo sapiens
gccctcgcctcctcc

SEQ ID NO: 685406 - DNA, 20 bp, Homo sapiens
gccctcgcctcctcctcctg

SEQ ID NO: 685407 - DNA, 21 bp, Homo sapiens
gccctcgcctcctcctcctgc

SEQ ID NO: 685408 - DNA, 20 bp, Homo sapiens
gccctgagaagctgctccag

SEQ ID NO: 685409 - DNA, 23 bp, Homo sapiens
gccctggattggttggcaaacta

SEQ ID NO: 685410 - DNA, 17 bp, Homo sapiens
gccctgggggtctgggc

SEQ ID NO: 685411 - DNA, 14 bp, Homo sapiens
gccctgtgtgcagg

SEQ ID NO: 685412 - DNA, 15 bp, Homo sapiens
gccctgtgtgcaggt

SEQ ID NO: 685413 - DNA, 18 bp, Homo sapiens
gcccttccatgtgccttt

SEQ ID NO: 685414 - DNA, 22 bp, Homo sapiens
gcccttcctcctgcctttctca

SEQ ID NO: 685415 - DNA, 20 bp, Homo sapiens
gcccttgcaatcttctactt

SEQ ID NO: 685416 - DNA, 16 bp, Homo sapiens
gccgcgcgtccagctg

SEQ ID NO: 685417 - DNA, 16 bp, Homo sapiens
gccgctacctccctcc

SEQ ID NO: 685418 - DNA, 14 bp, Homo sapiens
gccgggcgcggtgg

SEQ ID NO: 685419 - DNA, 16 bp, Homo sapiens
gccgggcgcggtggct

SEQ ID NO: 685420 - DNA, 22 bp, Homo sapiens
gccgggcgcggtggctcacgcc

SEQ ID NO: 685421 - DNA, 18 bp, Homo sapiens
gccgtgtgagtgtgacag

SEQ ID NO: 685422 - DNA, 22 bp, Homo sapiens
gccgtgtgagtgtgacagggcc

SEQ ID NO: 685423 - DNA, 15 bp, Homo sapiens
gcctaaatttgtgct

SEQ ID NO: 685424 - DNA, 17 bp, Homo sapiens
gcctagcgatctctcct

SEQ ID NO: 685425 - DNA, 20 bp, Homo sapiens
gcctagcgatctctcctggc

SEQ ID NO: 685426 - DNA, 22 bp, Homo sapiens
gcctagcgatctctcctggcct

SEQ ID NO: 685427 - DNA, 13 bp, Homo sapiens
gcctatccgctgc

SEQ ID NO: 685428 - DNA, 18 bp, Homo sapiens
gcctatccgctgccagcc

SEQ ID NO: 685429 - DNA, 16 bp, Homo sapiens
gcctcacttcctttgc

SEQ ID NO: 685430 - DNA, 17 bp, Homo sapiens
gcctcacttcctttgcc

SEQ ID NO: 685431 - DNA, 20 bp, Homo sapiens
gcctcacttcctttgccctt

SEQ ID NO: 685432 - DNA, 18 bp, Homo sapiens
gcctcagaccccctcagc

SEQ ID NO: 685433 - DNA, 19 bp, Homo sapiens
gcctcagaccccctcagcc

SEQ ID NO: 685434 - DNA, 19 bp, Homo sapiens
gcctcatgtcaaatattta

SEQ ID NO: 685435 - DNA, 16 bp, Homo sapiens
gcctcattgtgtctcc

SEQ ID NO: 685436 - DNA, 21 bp, Homo sapiens
gcctccacatgctgcctggca

SEQ ID NO: 685437 - DNA, 23 bp, Homo sapiens
gcctccacatgctgcctggcaca

SEQ ID NO: 685438 - DNA, 15 bp, Homo sapiens
gcctccaggtgcaga

SEQ ID NO: 685439 - DNA, 21 bp, Homo sapiens
gcctccccctcccccattccc

SEQ ID NO: 685440 - DNA, 18 bp, Homo sapiens
gcctccgtcccctgccca

SEQ ID NO: 685441 - DNA, 16 bp, Homo sapiens
gcctcctcctcctgcc

SEQ ID NO: 685442 - DNA, 21 bp, Homo sapiens
gcctcctgcgccctgtgcccg

SEQ ID NO: 685443 - DNA, 14 bp, Homo sapiens
gcctcctgggaaca

SEQ ID NO: 685444 - DNA, 13 bp, Homo sapiens
gcctcctgtgggg

SEQ ID NO: 685445 - DNA, 13 bp, Homo sapiens
gcctcggcccctc

SEQ ID NO: 685446 - DNA, 16 bp, Homo sapiens
gcctctgaaaagtgtg

SEQ ID NO: 685447 - DNA, 15 bp, Homo sapiens
gcctgaaaaatggga

SEQ ID NO: 685448 - DNA, 16 bp, Homo sapiens
gcctgaaagccacaat

SEQ ID NO: 685449 - DNA, 11 bp, Homo sapiens
gcctgaataaa

SEQ ID NO: 685450 - DNA, 17 bp, Homo sapiens
gcctgacctttgggact

SEQ ID NO: 685451 - DNA, 19 bp, Homo sapiens
gcctgacttctgctggcat

SEQ ID NO: 685452 - DNA, 18 bp, Homo sapiens
gcctgagaagccccgaca

SEQ ID NO: 685453 - DNA, 15 bp, Homo sapiens
gagaaagaatttagt

SEQ ID NO: 685454 - DNA, 21 bp, Homo sapiens
gagaaccaaccagggaagctg

SEQ ID NO: 685455 - DNA, 12 bp, Homo sapiens
gagaagctgctc

SEQ ID NO: 685456 - DNA, 20 bp, Homo sapiens
gagaagggaatcctcctcca

SEQ ID NO: 685457 - DNA, 22 bp, Homo sapiens
gagaaggtcacaacccttctct

SEQ ID NO: 685458 - DNA, 13 bp, Homo sapiens
gagaaggtttatt

SEQ ID NO: 685459 - DNA, 15 bp, Homo sapiens
gagaaggtttattgt

SEQ ID NO: 685460 - DNA, 16 bp, Homo sapiens
gagaagttgtgaaaga

SEQ ID NO: 685461 - DNA, 21 bp, Homo sapiens
gagaatataccttatttattt

SEQ ID NO: 685462 - DNA, 22 bp, Homo sapiens
gagaatatttactaactaaata

SEQ ID NO: 685463 - DNA, 12 bp, Homo sapiens
gagaccatcctg

SEQ ID NO: 685464 - DNA, 14 bp, Homo sapiens
gagaccatcctggc

SEQ ID NO: 685465 - DNA, 15 bp, Homo sapiens
gagaccatcctggct

SEQ ID NO: 685466 - DNA, 16 bp, Homo sapiens
gagacctatgtaagaa

SEQ ID NO: 685467 - DNA, 15 bp, Homo sapiens
gagacctttcctctc

SEQ ID NO: 685468 - DNA, 20 bp, Homo sapiens
gagacgtttataaacagaaa

SEQ ID NO: 685469 - DNA, 20 bp, Homo sapiens
gagactctagggtccagtgg

SEQ ID NO: 685470 - DNA, 14 bp, Homo sapiens
gagactttctcctg

SEQ ID NO: 685471 - DNA, 17 bp, Homo sapiens
gagactttctcctggcc

SEQ ID NO: 685472 - DNA, 20 bp, Homo sapiens
gagagatgggccaggcagag

SEQ ID NO: 685473 - DNA, 19 bp, Homo sapiens
gagagctgtttttgacagc

SEQ ID NO: 685474 - DNA, 12 bp, Homo sapiens
gagagtctgaga

SEQ ID NO: 685475 - DNA, 20 bp, Homo sapiens
gagagttaataggagtattt

SEQ ID NO: 685476 - DNA, 20 bp, Homo sapiens
gagagttgttcccccagggg

SEQ ID NO: 685477 - DNA, 20 bp, Homo sapiens
gagataaaccaataaatcca

SEQ ID NO: 685478 - DNA, 21 bp, Homo sapiens
gagatcgtacctattgcactc

SEQ ID NO: 685479 - DNA, 16 bp, Homo sapiens
gagatctacacatgtt

SEQ ID NO: 685480 - DNA, 22 bp, Homo sapiens
gagatgagaaatgatgaaaagg

SEQ ID NO: 685481 - DNA, 20 bp, Homo sapiens
gagattctggtccctggaaa

SEQ ID NO: 685482 - DNA, 17 bp, Homo sapiens
gagattggttttcctgt

SEQ ID NO: 685483 - DNA, 15 bp, Homo sapiens
gagcagaggtggaaa

SEQ ID NO: 685484 - DNA, 14 bp, Homo sapiens
gagcagggaaggcc

SEQ ID NO: 685485 - DNA, 16 bp, Homo sapiens
gagcagggaaggcctg

SEQ ID NO: 685486 - DNA, 19 bp, Homo sapiens
gagcatgtttcacagtggc

SEQ ID NO: 685487 - DNA, 14 bp, Homo sapiens
gagccagactctgt

SEQ ID NO: 685488 - DNA, 14 bp, Homo sapiens
gagccagcagggca

SEQ ID NO: 685489 - DNA, 19 bp, Homo sapiens
gagccatttaaagaccaat

SEQ ID NO: 685490 - DNA, 14 bp, Homo sapiens
gagcccagagaaca

SEQ ID NO: 685491 - DNA, 14 bp, Homo sapiens
gagccctctcctcc

SEQ ID NO: 685492 - DNA, 23 bp, Homo sapiens
gagcctcctgggaacacatctgg

SEQ ID NO: 685493 - DNA, 16 bp, Homo sapiens
gagcctcgctttttca

SEQ ID NO: 685494 - DNA, 12 bp, Homo sapiens
gagccttttgct

SEQ ID NO: 685495 - DNA, 20 bp, Homo sapiens
gagcgcaggcagcgcagggc

SEQ ID NO: 685496 - DNA, 13 bp, Homo sapiens
gagcggaggttgc

SEQ ID NO: 685497 - DNA, 18 bp, Homo sapiens
gagctaagggtgggtgct

SEQ ID NO: 685498 - DNA, 14 bp, Homo sapiens
gagctaataaatct

SEQ ID NO: 685499 - DNA, 15 bp, Homo sapiens
gagctctgaaatctt

SEQ ID NO: 685500 - DNA, 21 bp, Homo sapiens
gagctgagatcgtgctactgc

SEQ ID NO: 685501 - DNA, 17 bp, Homo sapiens
gagctggcccttgggga

SEQ ID NO: 685502 - DNA, 19 bp, Homo sapiens
gagctgggcccgacatggc

SEQ ID NO: 685503 - DNA, 18 bp, Homo sapiens
gagctgtcaccaaggaaa

SEQ ID NO: 685504 - DNA, 21 bp, Homo sapiens
gagcttaatgctacatgtgag

SEQ ID NO: 685505 - DNA, 19 bp, Homo sapiens
gaggaaggaacagcaatgg

SEQ ID NO: 685506 - DNA, 20 bp, Homo sapiens
gaggagaaatgcaataactc

SEQ ID NO: 685507 - DNA, 22 bp, Homo sapiens
gaggaggatgtccctgggccag

SEQ ID NO: 685508 - DNA, 17 bp, Homo sapiens
gaggaggcctgcacagg

SEQ ID NO: 685509 - DNA, 22 bp, Homo sapiens
gaggaggcctgtcccaattctg

SEQ ID NO: 685510 - DNA, 20 bp, Homo sapiens
gaggagggtttgggcagagc

SEQ ID NO: 685511 - DNA, 21 bp, Homo sapiens
gaggagggtttgggcagagcg

SEQ ID NO: 685512 - DNA, 21 bp, Homo sapiens
gaggagtaaataattggaaaa

SEQ ID NO: 685513 - DNA, 17 bp, Homo sapiens
gaggcaaattaactgta

SEQ ID NO: 685514 - DNA, 22 bp, Homo sapiens
gaggcagcatggagagaggcct

SEQ ID NO: 685515 - DNA, 14 bp, Homo sapiens
gaggcagtccatct

SEQ ID NO: 685516 - DNA, 19 bp, Homo sapiens
gaggccctcctgtgctggg

SEQ ID NO: 685517 - DNA, 18 bp, Homo sapiens
gaggccctgcccaatgag

SEQ ID NO: 685518 - DNA, 20 bp, Homo sapiens
gaggcctgcgaccctggggg

SEQ ID NO: 685519 - DNA, 21 bp, Homo sapiens
gaggcgcacagtgtgagcccg

SEQ ID NO: 685520 - DNA, 14 bp, Homo sapiens
gagggagaagcatg

SEQ ID NO: 685521 - DNA, 11 bp, Homo sapiens
gagggaggccc

SEQ ID NO: 685522 - DNA, 12 bp, Homo sapiens
gagggaggcccc

SEQ ID NO: 685523 - DNA, 17 bp, Homo sapiens
gagggaggccccagggg

SEQ ID NO: 685524 - DNA, 18 bp, Homo sapiens
gagggcagactggggcat

SEQ ID NO: 685525 - DNA, 12 bp, Homo sapiens
gaggggaggcat

SEQ ID NO: 685526 - DNA, 21 bp, Homo sapiens
gaggggccggccctgtgtgca

SEQ ID NO: 685527 - DNA, 23 bp, Homo sapiens
gagggtcccggtgtatcctggcc

SEQ ID NO: 685528 - DNA, 18 bp, Homo sapiens
gagggtctcccctcctgc

SEQ ID NO: 685529 - DNA, 22 bp, Homo sapiens
gaggtcagggagtgctggctca

SEQ ID NO: 685530 - DNA, 21 bp, Homo sapiens
gaggtgattctcagggctgga

SEQ ID NO: 685531 - DNA, 15 bp, Homo sapiens
gagtaacttagaaaa

SEQ ID NO: 685532 - DNA, 18 bp, Homo sapiens
gagtaattcatctgtgaa

SEQ ID NO: 685533 - DNA, 19 bp, Homo sapiens
gagtaattcatctgtgaat

SEQ ID NO: 685534 - DNA, 23 bp, Homo sapiens
gagtaattcatctgtgaatctgc

SEQ ID NO: 685535 - DNA, 21 bp, Homo sapiens
gagtacaccctttccaggaat

SEQ ID NO: 685536 - DNA, 20 bp, Homo sapiens
gagtattgtttaaaatgtaa

SEQ ID NO: 685537 - DNA, 21 bp, Homo sapiens
gagtattgtttaaaatgtaat

SEQ ID NO: 685538 - DNA, 19 bp, Homo sapiens
gagtgaccagcacactgga

SEQ ID NO: 685539 - DNA, 14 bp, Homo sapiens
gagtgagacagact

SEQ ID NO: 685540 - DNA, 14 bp, Homo sapiens
gagtgagtgggaga

SEQ ID NO: 685541 - DNA, 14 bp, Homo sapiens
gagtgctggctcac

SEQ ID NO: 685542 - DNA, 20 bp, Homo sapiens
gagtggccccggctgcatga

SEQ ID NO: 685543 - DNA, 16 bp, Homo sapiens
gagtggttaggcagca

SEQ ID NO: 685544 - DNA, 15 bp, Homo sapiens
gagtgtgacagggcc

SEQ ID NO: 685545 - DNA, 16 bp, Homo sapiens
gagtgtgacagggcca

SEQ ID NO: 685546 - DNA, 19 bp, Homo sapiens
gagttaataggagtatttt

SEQ ID NO: 685547 - DNA, 22 bp, Homo sapiens
gagttcccttgaaactttggga

SEQ ID NO: 685548 - DNA, 22 bp, Homo sapiens
gagttccttatccctctcttcc

SEQ ID NO: 685549 - DNA, 23 bp, Homo sapiens
gagttccttatccctctcttccc

SEQ ID NO: 685550 - DNA, 22 bp, Homo sapiens
gataaaatgccagtctcattgt

SEQ ID NO: 685551 - DNA, 18 bp, Homo sapiens
gataaagaaaaaaatact

SEQ ID NO: 685552 - DNA, 22 bp, Homo sapiens
gataatatttttgtatttctct

SEQ ID NO: 685553 - DNA, 14 bp, Homo sapiens
gatacaggaattat

SEQ ID NO: 685554 - DNA, 18 bp, Homo sapiens
gataccaaggtacaactg

SEQ ID NO: 685555 - DNA, 13 bp, Homo sapiens
gatacctggagca

SEQ ID NO: 685556 - DNA, 16 bp, Homo sapiens
gatacttgaataacca

SEQ ID NO: 685557 - DNA, 13 bp, Homo sapiens
gataggtaaattt

SEQ ID NO: 685558 - DNA, 15 bp, Homo sapiens
gataggtaaattttt

SEQ ID NO: 685559 - DNA, 14 bp, Homo sapiens
gatagtaagcatag

SEQ ID NO: 685560 - DNA, 14 bp, Homo sapiens
gatataaaatgtgc

SEQ ID NO: 685561 - DNA, 14 bp, Homo sapiens
gatataaattttta

SEQ ID NO: 685562 - DNA, 15 bp, Homo sapiens
gatatactgcagctt

SEQ ID NO: 685563 - DNA, 15 bp, Homo sapiens
gatatactgtgtgct

SEQ ID NO: 685564 - DNA, 20 bp, Homo sapiens
gatatatttgaaatagtata

SEQ ID NO: 685565 - DNA, 17 bp, Homo sapiens
gatatctataaaataga

SEQ ID NO: 685566 - DNA, 23 bp, Homo sapiens
gatatctataaaatagatataaa

SEQ ID NO: 685567 - DNA, 12 bp, Homo sapiens
gatatgcttgta

SEQ ID NO: 685568 - DNA, 22 bp, Homo sapiens
gatatgcttgtaactaaaataa

SEQ ID NO: 685569 - DNA, 20 bp, Homo sapiens
gatatgtattcttttctcag

SEQ ID NO: 685570 - DNA, 22 bp, Homo sapiens
gatatgtctgctgagttggcct

SEQ ID NO: 685571 - DNA, 20 bp, Homo sapiens
gatattatattaaacataca

SEQ ID NO: 685572 - DNA, 23 bp, Homo sapiens
gatattattagaaattagaaaaa

SEQ ID NO: 685573 - DNA, 21 bp, Homo sapiens
gatattgaaggagaaaataga

SEQ ID NO: 685574 - DNA, 16 bp, Homo sapiens
gatattgaatgttaaa

SEQ ID NO: 685575 - DNA, 21 bp, Homo sapiens
gaagtgtataatataaaaaat

SEQ ID NO: 685576 - DNA, 14 bp, Homo sapiens
gaagtgtgctgtga

SEQ ID NO: 685577 - DNA, 21 bp, Homo sapiens
gaataaattatggcatttcta

SEQ ID NO: 685578 - DNA, 12 bp, Homo sapiens
gaataaggccca

SEQ ID NO: 685579 - DNA, 22 bp, Homo sapiens
gaataatgttttgggaaacact

SEQ ID NO: 685580 - DNA, 16 bp, Homo sapiens
gaataccacatcaaat

SEQ ID NO: 685581 - DNA, 22 bp, Homo sapiens
gaataccacatcaaataagaaa

SEQ ID NO: 685582 - DNA, 24 bp, Homo sapiens
gaatactttgcagcacagctgaga

SEQ ID NO: 685583 - DNA, 16 bp, Homo sapiens
gaatataccttattta

SEQ ID NO: 685584 - DNA, 17 bp, Homo sapiens
gaatatgacggaagaac

SEQ ID NO: 685585 - DNA, 20 bp, Homo sapiens
gaatcagtaatcacttttca

SEQ ID NO: 685586 - DNA, 20 bp, Homo sapiens
gaatccaaactcaacaagtg

SEQ ID NO: 685587 - DNA, 17 bp, Homo sapiens
gaatcccactgtatgat

SEQ ID NO: 685588 - DNA, 19 bp, Homo sapiens
gaatccccaacatgcactg

SEQ ID NO: 685589 - DNA, 10 bp, Homo sapiens
gaatcctcct

SEQ ID NO: 685590 - DNA, 20 bp, Homo sapiens
gaatcctgctcacaaaatca

SEQ ID NO: 685591 - DNA, 16 bp, Homo sapiens
gaatctgctttaatta

SEQ ID NO: 685592 - DNA, 15 bp, Homo sapiens
gaatgaatacagcat

SEQ ID NO: 685593 - DNA, 14 bp, Homo sapiens
gaatgaggaaaatt

SEQ ID NO: 685594 - DNA, 16 bp, Homo sapiens
gaatgaggaaaattct

SEQ ID NO: 685595 - DNA, 23 bp, Homo sapiens
gaatgaggaaaattcttaaaagg

SEQ ID NO: 685596 - DNA, 18 bp, Homo sapiens
gaatgtaactgctgaaaa

SEQ ID NO: 685597 - DNA, 17 bp, Homo sapiens
gaatgtatgtaatgtgt

SEQ ID NO: 685598 - DNA, 23 bp, Homo sapiens
gaatgttatcggattactgaatt

SEQ ID NO: 685599 - DNA, 16 bp, Homo sapiens
gaatgttgaaaagtaa

SEQ ID NO: 685600 - DNA, 17 bp, Homo sapiens
gaattaagatacaaatt

SEQ ID NO: 685601 - DNA, 19 bp, Homo sapiens
gaattaccaagaatatcct

SEQ ID NO: 685602 - DNA, 23 bp, Homo sapiens
gaattcagaagacccctgactca

SEQ ID NO: 685603 - DNA, 22 bp, Homo sapiens
gaattctaacattaaatcacag

SEQ ID NO: 685604 - DNA, 18 bp, Homo sapiens
gaattcttctgcaacatt

SEQ ID NO: 685605 - DNA, 11 bp, Homo sapiens
gaattgaaaaa

SEQ ID NO: 685606 - DNA, 13 bp, Homo sapiens
gaattgaaaaaca

SEQ ID NO: 685607 - DNA, 14 bp, Homo sapiens
gaattgaaaaacaa

SEQ ID NO: 685608 - DNA, 22 bp, Homo sapiens
gaattgaaaagtttttgtttgg

SEQ ID NO: 685609 - DNA, 14 bp, Homo sapiens
gaattgcagtcatt

SEQ ID NO: 685610 - DNA, 21 bp, Homo sapiens
gaattggaagttacatgctgt

SEQ ID NO: 685611 - DNA, 17 bp, Homo sapiens
gaatttagtattatcaa

SEQ ID NO: 685612 - DNA, 23 bp, Homo sapiens
gaatttgggagaagcaaatatag

SEQ ID NO: 685613 - DNA, 14 bp, Homo sapiens
gaattttaggaact

SEQ ID NO: 685614 - DNA, 21 bp, Homo sapiens
gaattttttgaatatgcctta

SEQ ID NO: 685615 - DNA, 12 bp, Homo sapiens
gacaaaaggaat

SEQ ID NO: 685616 - DNA, 21 bp, Homo sapiens
gacaaaatggggcagaagaga

SEQ ID NO: 685617 - DNA, 17 bp, Homo sapiens
gacaactgtgaagccac

SEQ ID NO: 685618 - DNA, 14 bp, Homo sapiens
gacaagagatctac

SEQ ID NO: 685619 - DNA, 17 bp, Homo sapiens
gacaatgttttcttcaa

SEQ ID NO: 685620 - DNA, 18 bp, Homo sapiens
gacaatgttttcttcaac

SEQ ID NO: 685621 - DNA, 17 bp, Homo sapiens
gacaattgtgaacatga

SEQ ID NO: 685622 - DNA, 15 bp, Homo sapiens
gacacaaattttcaa

SEQ ID NO: 685623 - DNA, 18 bp, Homo sapiens
gacacacggggctcgggc

SEQ ID NO: 685624 - DNA, 21 bp, Homo sapiens
gacacagctcttccagggcag

SEQ ID NO: 685625 - DNA, 16 bp, Homo sapiens
gacagaggggagcagt

SEQ ID NO: 685626 - DNA, 24 bp, Homo sapiens
gacagaggggagcagtggccatca

SEQ ID NO: 685627 - DNA, 17 bp, Homo sapiens
gacagcaggcagcgcca

SEQ ID NO: 685628 - DNA, 18 bp, Homo sapiens
gacagctgactgaatgca

SEQ ID NO: 685629 - DNA, 16 bp, Homo sapiens
gacaggcccgcttgct

SEQ ID NO: 685630 - DNA, 15 bp, Homo sapiens
gacaggcgcctgcca

SEQ ID NO: 685631 - DNA, 10 bp, Homo sapiens
gacagggcca

SEQ ID NO: 685632 - DNA, 17 bp, Homo sapiens
gacagtcatcatcaggg

SEQ ID NO: 685633 - DNA, 22 bp, Homo sapiens
gacagtgacctctctaggtgtg

SEQ ID NO: 685634 - DNA, 20 bp, Homo sapiens
gacagttgattcaacaaagt

SEQ ID NO: 685635 - DNA, 13 bp, Homo sapiens
gacagtttccaaa

SEQ ID NO: 685636 - DNA, 14 bp, Homo sapiens
gacataatttcagt

SEQ ID NO: 685637 - DNA, 23 bp, Homo sapiens
gacataatttcagtgggaaatat

SEQ ID NO: 685638 - DNA, 19 bp, Homo sapiens
gacatacctaccagtatta

SEQ ID NO: 685639 - DNA, 17 bp, Homo sapiens
gacatgcaataaaattt

SEQ ID NO: 685640 - DNA, 21 bp, Homo sapiens
gacatttgctgaactcagcac

SEQ ID NO: 685641 - DNA, 17 bp, Homo sapiens
gacatttgtttgctgta

SEQ ID NO: 685642 - DNA, 20 bp, Homo sapiens
gaccaatatatagtgggtac

SEQ ID NO: 685643 - DNA, 21 bp, Homo sapiens
gaccacagggttcaaaatgtc

SEQ ID NO: 685644 - DNA, 16 bp, Homo sapiens
gaccacccctctcgcc

SEQ ID NO: 685645 - DNA, 15 bp, Homo sapiens
gaccacttccagggg

SEQ ID NO: 685646 - DNA, 11 bp, Homo sapiens
gaccagggcct

SEQ ID NO: 685647 - DNA, 19 bp, Homo sapiens
gaccagggccttttctggc

SEQ ID NO: 685648 - DNA, 12 bp, Homo sapiens
gaccataatttt

SEQ ID NO: 685649 - DNA, 18 bp, Homo sapiens
gaccataattttttttaa

SEQ ID NO: 685650 - DNA, 17 bp, Homo sapiens
gaccatattacctggat

SEQ ID NO: 685651 - DNA, 12 bp, Homo sapiens
gaccatcctggc

SEQ ID NO: 685652 - DNA, 13 bp, Homo sapiens
gaccatcctggct

SEQ ID NO: 685653 - DNA, 15 bp, Homo sapiens
gaccattcaattagt

SEQ ID NO: 685654 - DNA, 14 bp, Homo sapiens
gacccagtcccaca

SEQ ID NO: 685655 - DNA, 16 bp, Homo sapiens
gacccagtcccacact

SEQ ID NO: 685656 - DNA, 10 bp, Homo sapiens
gacccagtgc

SEQ ID NO: 685657 - DNA, 13 bp, Homo sapiens
gacccagtgcaga

SEQ ID NO: 685658 - DNA, 18 bp, Homo sapiens
gacccccatctgagctgg

SEQ ID NO: 685659 - DNA, 15 bp, Homo sapiens
gacccgcaacaagta

SEQ ID NO: 685660 - DNA, 17 bp, Homo sapiens
gaccctcttgcccatcc

SEQ ID NO: 685661 - DNA, 11 bp, Homo sapiens
gaccctggggg

SEQ ID NO: 685662 - DNA, 12 bp, Homo sapiens
gaccctgtctca

SEQ ID NO: 685663 - DNA, 17 bp, Homo sapiens
gacctaaattagataaa

SEQ ID NO: 685664 - DNA, 20 bp, Homo sapiens
gacctccacacccgtgagaa

SEQ ID NO: 685665 - DNA, 15 bp, Homo sapiens
gacctggggcagata

SEQ ID NO: 685666 - DNA, 21 bp, Homo sapiens
gacctgtatatttgtaaagct

SEQ ID NO: 685667 - DNA, 14 bp, Homo sapiens
gaccttaaatgcaa

SEQ ID NO: 685668 - DNA, 16 bp, Homo sapiens
gacggccaagaatgta

SEQ ID NO: 685669 - DNA, 17 bp, Homo sapiens
gacggcgtttcaccatg

SEQ ID NO: 685670 - DNA, 12 bp, Homo sapiens
gacgggagggga

SEQ ID NO: 685671 - DNA, 15 bp, Homo sapiens
gacggtttccaggga

SEQ ID NO: 685672 - DNA, 22 bp, Homo sapiens
gacgtgctccgtagctctgctg

SEQ ID NO: 685673 - DNA, 17 bp, Homo sapiens
gactaaagagagaatgt

SEQ ID NO: 685674 - DNA, 18 bp, Homo sapiens
gactaaagagagaatgta

SEQ ID NO: 685675 - DNA, 19 bp, Homo sapiens
gactagaagattagaaact

SEQ ID NO: 685676 - DNA, 16 bp, Homo sapiens
gactagaggcttgcat

SEQ ID NO: 685677 - DNA, 16 bp, Homo sapiens
gactatctttgctgca

SEQ ID NO: 685678 - DNA, 14 bp, Homo sapiens
gactatttgctaat

SEQ ID NO: 685679 - DNA, 14 bp, Homo sapiens
gactcaagagaatt

SEQ ID NO: 685680 - DNA, 14 bp, Homo sapiens
gactcagtgcagat

SEQ ID NO: 685681 - DNA, 20 bp, Homo sapiens
gactcagtgcagatggagag

SEQ ID NO: 685682 - DNA, 19 bp, Homo sapiens
gactcctcagtccctcttc

SEQ ID NO: 685683 - DNA, 12 bp, Homo sapiens
gactcctggcag

SEQ ID NO: 685684 - DNA, 23 bp, Homo sapiens
gactgctattctagagcttttat

SEQ ID NO: 685685 - DNA, 13 bp, Homo sapiens
gactggaggaggc

SEQ ID NO: 685686 - DNA, 17 bp, Homo sapiens
gactgtacattatgaag

SEQ ID NO: 685687 - DNA, 18 bp, Homo sapiens
gactgtacattatgaaga

SEQ ID NO: 685688 - DNA, 16 bp, Homo sapiens
gactgtgccagaggcc

SEQ ID NO: 685689 - DNA, 18 bp, Homo sapiens
gacttattgccaaaaaca

SEQ ID NO: 685690 - DNA, 18 bp, Homo sapiens
gacttattttgtcttatt

SEQ ID NO: 685691 - DNA, 17 bp, Homo sapiens
gacttcaaagcaagctg

SEQ ID NO: 685692 - DNA, 22 bp, Homo sapiens
gacttcagggaaggtgaaacag

SEQ ID NO: 685693 - DNA, 17 bp, Homo sapiens
gactttatgtagttttt

SEQ ID NO: 685694 - DNA, 15 bp, Homo sapiens
gactttctcctggcc

SEQ ID NO: 685695 - DNA, 14 bp, Homo sapiens
gacttttttataca

SEQ ID NO: 685696 - DNA, 18 bp, Homo sapiens
gagaaaaatgctccccac

SEQ ID NO: 685697 - DNA, 17 bp, Homo sapiens
gagaaactgctgcagat

SEQ ID NO: 685698 - DNA, 19 bp, Homo sapiens
cggctcctcggactctgct

SEQ ID NO: 685699 - DNA, 13 bp, Homo sapiens
cggctgcacaaca

SEQ ID NO: 685700 - DNA, 19 bp, Homo sapiens
cgggacatcacagggtggg

SEQ ID NO: 685701 - DNA, 15 bp, Homo sapiens
cgggaggggaggcat

SEQ ID NO: 685702 - DNA, 16 bp, Homo sapiens
cgggcgcggtggctca

SEQ ID NO: 685703 - DNA, 13 bp, Homo sapiens
cggggaagtgctc

SEQ ID NO: 685704 - DNA, 17 bp, Homo sapiens
cgggtgtcacattcctg

SEQ ID NO: 685705 - DNA, 16 bp, Homo sapiens
cggtcagaggagcgca

SEQ ID NO: 685706 - DNA, 16 bp, Homo sapiens
cggtctcctgactggt

SEQ ID NO: 685707 - DNA, 20 bp, Homo sapiens
cggtggcggctgcacaacag

SEQ ID NO: 685708 - DNA, 13 bp, Homo sapiens
ttcagaaaaccta

SEQ ID NO: 685709 - DNA, 22 bp, Homo sapiens
ttcagaaatataacacattttt

SEQ ID NO: 685710 - DNA, 21 bp, Homo sapiens
ttcagacaagacagaggggag

SEQ ID NO: 685711 - DNA, 14 bp, Homo sapiens
ttcagacacagctc

SEQ ID NO: 685712 - DNA, 12 bp, Homo sapiens
ttcagaggctca

SEQ ID NO: 685713 - DNA, 16 bp, Homo sapiens
ttcagatcactgaatt

SEQ ID NO: 685714 - DNA, 14 bp, Homo sapiens
ttcagctctttcca

SEQ ID NO: 685715 - DNA, 16 bp, Homo sapiens
ttcagctctttccaaa

SEQ ID NO: 685716 - DNA, 15 bp, Homo sapiens
ttcaggcattccagg

SEQ ID NO: 685717 - DNA, 19 bp, Homo sapiens
ttcagggaaggtgaaacag

SEQ ID NO: 685718 - DNA, 21 bp, Homo sapiens
ttcagtgcaaattgtatctta

SEQ ID NO: 685719 - DNA, 13 bp, Homo sapiens
ttcagtgggaaat

SEQ ID NO: 685720 - DNA, 19 bp, Homo sapiens
ttcagttgcttgtcttctg

SEQ ID NO: 685721 - DNA, 21 bp, Homo sapiens
ttcagtttgaaaatattttgt

SEQ ID NO: 685722 - DNA, 16 bp, Homo sapiens
ttcataacttcctgta

SEQ ID NO: 685723 - DNA, 13 bp, Homo sapiens
ttcataatcagta

SEQ ID NO: 685724 - DNA, 18 bp, Homo sapiens
ttcatagagatttgtcta

SEQ ID NO: 685725 - DNA, 17 bp, Homo sapiens
ttcatatacaaacatgt

SEQ ID NO: 685726 - DNA, 21 bp, Homo sapiens
ttcatattttaaacagaggat

SEQ ID NO: 685727 - DNA, 17 bp, Homo sapiens
ttcatcattccctctca

SEQ ID NO: 685728 - DNA, 22 bp, Homo sapiens
ttcatcattgtttctgcatgaa

SEQ ID NO: 685729 - DNA, 23 bp, Homo sapiens
ttcatcattgtttctgcatgaat

SEQ ID NO: 685730 - DNA, 20 bp, Homo sapiens
ttcatccaacttatgttttt

SEQ ID NO: 685731 - DNA, 14 bp, Homo sapiens
ttcatccttctttc

SEQ ID NO: 685732 - DNA, 16 bp, Homo sapiens
ttcatctaccttttct

SEQ ID NO: 685733 - DNA, 14 bp, Homo sapiens
ttcatgcttgacat

SEQ ID NO: 685734 - DNA, 16 bp, Homo sapiens
ttcatgcttgacatac

SEQ ID NO: 685735 - DNA, 18 bp, Homo sapiens
ttcatgcttgacatacct

SEQ ID NO: 685736 - DNA, 19 bp, Homo sapiens
ttcatgcttgacataccta

SEQ ID NO: 685737 - DNA, 22 bp, Homo sapiens
ttcattatgcacttttagaaat

SEQ ID NO: 685738 - DNA, 12 bp, Homo sapiens
ttcattgtctct

SEQ ID NO: 685739 - DNA, 16 bp, Homo sapiens
ttcatttctaaattta

SEQ ID NO: 685740 - DNA, 17 bp, Homo sapiens
ttccaaatgcaatttga

SEQ ID NO: 685741 - DNA, 14 bp, Homo sapiens
ttccaagaggctgt

SEQ ID NO: 685742 - DNA, 15 bp, Homo sapiens
ttccaagcttcatat

SEQ ID NO: 685743 - DNA, 14 bp, Homo sapiens
ttccaaggaagcag

SEQ ID NO: 685744 - DNA, 15 bp, Homo sapiens
ttccaataaactatg

SEQ ID NO: 685745 - DNA, 13 bp, Homo sapiens
ttccacagaggac

SEQ ID NO: 685746 - DNA, 13 bp, Homo sapiens
ttccacagccgcc

SEQ ID NO: 685747 - DNA, 21 bp, Homo sapiens
ttccagaaccacacttgaaac

SEQ ID NO: 685748 - DNA, 16 bp, Homo sapiens
ttccagatctttcaga

SEQ ID NO: 685749 - DNA, 22 bp, Homo sapiens
ttccagcaattctcctgcctca

SEQ ID NO: 685750 - DNA, 20 bp, Homo sapiens
ttccaggctatgtataaaat

SEQ ID NO: 685751 - DNA, 15 bp, Homo sapiens
ttccagggaggggcc

SEQ ID NO: 685752 - DNA, 15 bp, Homo sapiens
ttccaggggaacctg

SEQ ID NO: 685753 - DNA, 16 bp, Homo sapiens
ttccaggtaacaggtg

SEQ ID NO: 685754 - DNA, 21 bp, Homo sapiens
ttccaggtaacaggtgtgtat

SEQ ID NO: 685755 - DNA, 18 bp, Homo sapiens
ttccatgatttagcaagc

SEQ ID NO: 685756 - DNA, 21 bp, Homo sapiens
ttccatgatttagcaagcaac

SEQ ID NO: 685757 - DNA, 14 bp, Homo sapiens
ttccatgtgccttt

SEQ ID NO: 685758 - DNA, 19 bp, Homo sapiens
ttccatgtgcctttctttg

SEQ ID NO: 685759 - DNA, 13 bp, Homo sapiens
ttccattgcttat

SEQ ID NO: 685760 - DNA, 14 bp, Homo sapiens
ttccccactccccc

SEQ ID NO: 685761 - DNA, 15 bp, Homo sapiens
ttccccactcccccg

SEQ ID NO: 685762 - DNA, 19 bp, Homo sapiens
ttccccttagaaacactgc

SEQ ID NO: 685763 - DNA, 12 bp, Homo sapiens
ttccccttccct

SEQ ID NO: 685764 - DNA, 15 bp, Homo sapiens
ttccccttcccttat

SEQ ID NO: 685765 - DNA, 19 bp, Homo sapiens
ttcccgcccagcctcactt

SEQ ID NO: 685766 - DNA, 20 bp, Homo sapiens
ttccctccatttttctccca

SEQ ID NO: 685767 - DNA, 17 bp, Homo sapiens
ttccctgacttgcttta

SEQ ID NO: 685768 - DNA, 18 bp, Homo sapiens
ttccctgctttgcatctt

SEQ ID NO: 685769 - DNA, 20 bp, Homo sapiens
ttccctggaactcctggcct

SEQ ID NO: 685770 - DNA, 15 bp, Homo sapiens
ttcccttattcctaa

SEQ ID NO: 685771 - DNA, 17 bp, Homo sapiens
ttccctttatttctctt

SEQ ID NO: 685772 - DNA, 14 bp, Homo sapiens
ttccgttgtctgtg

SEQ ID NO: 685773 - DNA, 19 bp, Homo sapiens
ttcctaacacagcatgtgt

SEQ ID NO: 685774 - DNA, 13 bp, Homo sapiens
ttcctaagccact

SEQ ID NO: 685775 - DNA, 21 bp, Homo sapiens
ttcctaatggctatttttgaa

SEQ ID NO: 685776 - DNA, 19 bp, Homo sapiens
ttcctactgacaacattat

SEQ ID NO: 685777 - DNA, 12 bp, Homo sapiens
ttcctcagctta

SEQ ID NO: 685778 - DNA, 18 bp, Homo sapiens
ttcctcctgcctttctca

SEQ ID NO: 685779 - DNA, 11 bp, Homo sapiens
ttcctcctgga

SEQ ID NO: 685780 - DNA, 12 bp, Homo sapiens
ttcctctcaccc

SEQ ID NO: 685781 - DNA, 14 bp, Homo sapiens
ttcctctgctcacc

SEQ ID NO: 685782 - DNA, 21 bp, Homo sapiens
ttcctgagatttcctcctggc

SEQ ID NO: 685783 - DNA, 24 bp, Homo sapiens
ttcctgtgaagtttaattgtctca

SEQ ID NO: 685784 - DNA, 15 bp, Homo sapiens
ttcctgtttccaggg

SEQ ID NO: 685785 - DNA, 16 bp, Homo sapiens
ttcctgtttccagggt

SEQ ID NO: 685786 - DNA, 17 bp, Homo sapiens
ttccttatccctctctt

SEQ ID NO: 685787 - DNA, 19 bp, Homo sapiens
ttccttatccctctcttcc

SEQ ID NO: 685788 - DNA, 23 bp, Homo sapiens
ttccttatccctctcttcccctt

SEQ ID NO: 685789 - DNA, 15 bp, Homo sapiens
ttcctttcatacctt

SEQ ID NO: 685790 - DNA, 13 bp, Homo sapiens
ttcctttgccctt

SEQ ID NO: 685791 - DNA, 14 bp, Homo sapiens
ttccttttaaagaa

SEQ ID NO: 685792 - DNA, 21 bp, Homo sapiens
ttccttttaaagaagctttat

SEQ ID NO: 685793 - DNA, 15 bp, Homo sapiens
ttcctttttcttcgc

SEQ ID NO: 685794 - DNA, 15 bp, Homo sapiens
ttcgctgaaattgct

SEQ ID NO: 685795 - DNA, 20 bp, Homo sapiens
ttcgtaacggccttgatccc

SEQ ID NO: 685796 - DNA, 15 bp, Homo sapiens
ttcgtgtactgcaaa

SEQ ID NO: 685797 - DNA, 17 bp, Homo sapiens
ttcgttgcacagctgtt

SEQ ID NO: 685798 - DNA, 23 bp, Homo sapiens
ttctaaatgcatatcctgagcca

SEQ ID NO: 685799 - DNA, 15 bp, Homo sapiens
ttctaagaagacatt

SEQ ID NO: 685800 - DNA, 16 bp, Homo sapiens
ttctaagaagacattt

SEQ ID NO: 685801 - DNA, 17 bp, Homo sapiens
ttctaagaagacatttt

SEQ ID NO: 685802 - DNA, 15 bp, Homo sapiens
ttctaatccttttcc

SEQ ID NO: 685803 - DNA, 17 bp, Homo sapiens
ttctacaattaatagtt

SEQ ID NO: 685804 - DNA, 13 bp, Homo sapiens
ttctacccttttc

SEQ ID NO: 685805 - DNA, 12 bp, Homo sapiens
ttctactcccct

SEQ ID NO: 685806 - DNA, 16 bp, Homo sapiens
ttctactcctgcctca

SEQ ID NO: 685807 - DNA, 19 bp, Homo sapiens
ttctatgacaaattcaaga

SEQ ID NO: 685808 - DNA, 12 bp, Homo sapiens
ttctcaatttca

SEQ ID NO: 685809 - DNA, 21 bp, Homo sapiens
ttctcacacacaactgtccat

SEQ ID NO: 685810 - DNA, 12 bp, Homo sapiens
ttctcagggctg

SEQ ID NO: 685811 - DNA, 22 bp, Homo sapiens
ttctcagggctggagcctgggg

SEQ ID NO: 685812 - DNA, 23 bp, Homo sapiens
ttctcagggctggagcctggggt

SEQ ID NO: 685813 - DNA, 14 bp, Homo sapiens
ttctcatgactcct

SEQ ID NO: 685814 - DNA, 20 bp, Homo sapiens
ttctcatgttaaatatttgt

SEQ ID NO: 685815 - DNA, 23 bp, Homo sapiens
ttgccattgaaggcttaattgac

SEQ ID NO: 685816 - DNA, 13 bp, Homo sapiens
ttgcccatcctga

SEQ ID NO: 685817 - DNA, 21 bp, Homo sapiens
ttgccccatccagacctggct

SEQ ID NO: 685818 - DNA, 20 bp, Homo sapiens
ttgcccctggctttgcctct

SEQ ID NO: 685819 - DNA, 15 bp, Homo sapiens
ttgcctccaggtgca

SEQ ID NO: 685820 - DNA, 20 bp, Homo sapiens
ttgcctccaggtgcagaggt

SEQ ID NO: 685821 - DNA, 17 bp, Homo sapiens
ttgcctctgccctggat

SEQ ID NO: 685822 - DNA, 20 bp, Homo sapiens
ttgcctgaggggaaagagag

SEQ ID NO: 685823 - DNA, 21 bp, Homo sapiens
ttgcctgaggggaaagagaga

SEQ ID NO: 685824 - DNA, 13 bp, Homo sapiens
ttgcctgcagggc

SEQ ID NO: 685825 - DNA, 15 bp, Homo sapiens
ttgcctgcagggcca

SEQ ID NO: 685826 - DNA, 16 bp, Homo sapiens
ttgccttgctgtttgt

SEQ ID NO: 685827 - DNA, 16 bp, Homo sapiens
ttgcgtctgaggcctg

SEQ ID NO: 685828 - DNA, 22 bp, Homo sapiens
ttgctaatcaaagccagggtct

SEQ ID NO: 685829 - DNA, 23 bp, Homo sapiens
ttgctatggcaggataagaaagc

SEQ ID NO: 685830 - DNA, 15 bp, Homo sapiens
ttgctatgttactat

SEQ ID NO: 685831 - DNA, 18 bp, Homo sapiens
ttgctatgttactatttt

SEQ ID NO: 685832 - DNA, 19 bp, Homo sapiens
ttgctatgttactattttc

SEQ ID NO: 685833 - DNA, 17 bp, Homo sapiens
ttgctcagagaaggaaa

SEQ ID NO: 685834 - DNA, 16 bp, Homo sapiens
ttgctctcctcatctc

SEQ ID NO: 685835 - DNA, 17 bp, Homo sapiens
ttgctctctgtgaccct

SEQ ID NO: 685836 - DNA, 11 bp, Homo sapiens
ttgctgaactc

SEQ ID NO: 685837 - DNA, 24 bp, Homo sapiens
ttgctgaactcagcacattcggga

SEQ ID NO: 685838 - DNA, 14 bp, Homo sapiens
ttgctgaattctaa

SEQ ID NO: 685839 - DNA, 19 bp, Homo sapiens
ttgctgcagtcatctactt

SEQ ID NO: 685840 - DNA, 20 bp, Homo sapiens
ttgctgccattacagaggta

SEQ ID NO: 685841 - DNA, 12 bp, Homo sapiens
ttgctgcttttt

SEQ ID NO: 685842 - DNA, 17 bp, Homo sapiens
ttgctgggccttttgtt

SEQ ID NO: 685843 - DNA, 21 bp, Homo sapiens
ttgctgtatgctgatcatcgc

SEQ ID NO: 685844 - DNA, 13 bp, Homo sapiens
ttgcttgaatgct

SEQ ID NO: 685845 - DNA, 16 bp, Homo sapiens
ttgcttgcctgcaggg

SEQ ID NO: 685846 - DNA, 14 bp, Homo sapiens
ttgcttgtcttctg

SEQ ID NO: 685847 - DNA, 12 bp, Homo sapiens
ttgctttcaatt

SEQ ID NO: 685848 - DNA, 15 bp, Homo sapiens
ttgctttggaaacac

SEQ ID NO: 685849 - DNA, 17 bp, Homo sapiens
ttgctttggaagtttta

SEQ ID NO: 685850 - DNA, 17 bp, Homo sapiens
ttggaactgcaatgaaa

SEQ ID NO: 685851 - DNA, 23 bp, Homo sapiens
ttggaagagacaaagatttcttc

SEQ ID NO: 685852 - DNA, 14 bp, Homo sapiens
ttggaaggagaggg

SEQ ID NO: 685853 - DNA, 22 bp, Homo sapiens
ttggagaccctgcaaacagaac

SEQ ID NO: 685854 - DNA, 17 bp, Homo sapiens
ttggatcttgaatgtgg

SEQ ID NO: 685855 - DNA, 17 bp, Homo sapiens
ttggattctaaatacat

SEQ ID NO: 685856 - DNA, 22 bp, Homo sapiens
ttggcaaagtttaaatgtattt

SEQ ID NO: 685857 - DNA, 20 bp, Homo sapiens
ttggcataatagtcaatttc

SEQ ID NO: 685858 - DNA, 19 bp, Homo sapiens
ttggccctttccttccaga

SEQ ID NO: 685859 - DNA, 21 bp, Homo sapiens
ttggcctggggtgcatctcct

SEQ ID NO: 685860 - DNA, 17 bp, Homo sapiens
ttggctcaataaagatt

SEQ ID NO: 685861 - DNA, 12 bp, Homo sapiens
ttgggaaaacat

SEQ ID NO: 685862 - DNA, 16 bp, Homo sapiens
ttgggaaaacatttgc

SEQ ID NO: 685863 - DNA, 17 bp, Homo sapiens
ttgggaaaacatttgct

SEQ ID NO: 685864 - DNA, 22 bp, Homo sapiens
ttgggaaattaaatccaataaa

SEQ ID NO: 685865 - DNA, 18 bp, Homo sapiens
ttgggaagaatccagtat

SEQ ID NO: 685866 - DNA, 14 bp, Homo sapiens
ttgggaattttatt

SEQ ID NO: 685867 - DNA, 16 bp, Homo sapiens
ttgggaggccgaggcg

SEQ ID NO: 685868 - DNA, 11 bp, Homo sapiens
ttgggcagagc

SEQ ID NO: 685869 - DNA, 19 bp, Homo sapiens
ttgggcagtctttcttgaa

SEQ ID NO: 685870 - DNA, 18 bp, Homo sapiens
ttggggagtacctgtcca

SEQ ID NO: 685871 - DNA, 20 bp, Homo sapiens
ttggtaatcccctaaaataa

SEQ ID NO: 685872 - DNA, 21 bp, Homo sapiens
ttggtagagaaggagcagaaa

SEQ ID NO: 685873 - DNA, 15 bp, Homo sapiens
ttggtcagcttttgt

SEQ ID NO: 685874 - DNA, 15 bp, Homo sapiens
ttggtctgccttctg

SEQ ID NO: 685875 - DNA, 14 bp, Homo sapiens
ttggtgaagtaaat

SEQ ID NO: 685876 - DNA, 20 bp, Homo sapiens
ttggtgcatgtctgttcttc

SEQ ID NO: 685877 - DNA, 19 bp, Homo sapiens
ttggtgccctcgcctcctc

SEQ ID NO: 685878 - DNA, 16 bp, Homo sapiens
ttggtggtgaaattga

SEQ ID NO: 685879 - DNA, 15 bp, Homo sapiens
ttggttaaaactgta

SEQ ID NO: 685880 - DNA, 15 bp, Homo sapiens
ttggttaaataaact

SEQ ID NO: 685881 - DNA, 22 bp, Homo sapiens
ttggtttgtggcgtctccctcg

SEQ ID NO: 685882 - DNA, 16 bp, Homo sapiens
ttgtaaaacttctgct

SEQ ID NO: 685883 - DNA, 17 bp, Homo sapiens
ttgtaaaacttctgctc

SEQ ID NO: 685884 - DNA, 19 bp, Homo sapiens
ttgtaaaacttctgctcgt

SEQ ID NO: 685885 - DNA, 17 bp, Homo sapiens
ttgtaactaaaataatt

SEQ ID NO: 685886 - DNA, 18 bp, Homo sapiens
ttgtaactaaaataattt

SEQ ID NO: 685887 - DNA, 18 bp, Homo sapiens
ttgtaagtgtaaaaaatg

SEQ ID NO: 685888 - DNA, 22 bp, Homo sapiens
ttgtaatactttctatgtgaca

SEQ ID NO: 685889 - DNA, 13 bp, Homo sapiens
ttgtaatatctaa

SEQ ID NO: 685890 - DNA, 18 bp, Homo sapiens
ttgtacaaaattaagcaa

SEQ ID NO: 685891 - DNA, 22 bp, Homo sapiens
ttgtacatacgatttaaggtat

SEQ ID NO: 685892 - DNA, 18 bp, Homo sapiens
ttgtagagtgtagactgt

SEQ ID NO: 685893 - DNA, 16 bp, Homo sapiens
ttgtagcataactgta

SEQ ID NO: 685894 - DNA, 22 bp, Homo sapiens
ttgtagcataactgtagctcaa

SEQ ID NO: 685895 - DNA, 22 bp, Homo sapiens
ttgtatatcactaaaagcatga

SEQ ID NO: 685896 - DNA, 20 bp, Homo sapiens
ttgtatggggaggcaagtgt

SEQ ID NO: 685897 - DNA, 19 bp, Homo sapiens
ttgtattgatttttaagaa

SEQ ID NO: 685898 - DNA, 16 bp, Homo sapiens
ttgtattttcatgaaa

SEQ ID NO: 685899 - DNA, 18 bp, Homo sapiens
ttgtcctttttcaggaga

SEQ ID NO: 685900 - DNA, 12 bp, Homo sapiens
ttgtctatttta

SEQ ID NO: 685901 - DNA, 13 bp, Homo sapiens
ttgtctattttaa

SEQ ID NO: 685902 - DNA, 23 bp, Homo sapiens
ttgtctcaacgcctccccctccc

SEQ ID NO: 685903 - DNA, 15 bp, Homo sapiens
ttgtctccatgtgta

SEQ ID NO: 685904 - DNA, 18 bp, Homo sapiens
ttgtcttatgtgaaaaat

SEQ ID NO: 685905 - DNA, 20 bp, Homo sapiens
ttgtcttatgtgaaaaatta

SEQ ID NO: 685906 - DNA, 16 bp, Homo sapiens
ttgtcttgatgttttt

SEQ ID NO: 685907 - DNA, 22 bp, Homo sapiens
ttgtgcaaaagcttcaaattaa

SEQ ID NO: 685908 - DNA, 14 bp, Homo sapiens
ttgtgcattctgga

SEQ ID NO: 685909 - DNA, 22 bp, Homo sapiens
ttgtgccaactgccaggctgcc

SEQ ID NO: 685910 - DNA, 13 bp, Homo sapiens
ttgtgcctggggt

SEQ ID NO: 685911 - DNA, 17 bp, Homo sapiens
ttgtggcgtctccctcg

SEQ ID NO: 685912 - DNA, 15 bp, Homo sapiens
ttgtggtaatctaca

SEQ ID NO: 685913 - DNA, 21 bp, Homo sapiens
ttgtgtctcccgtgcatgctc

SEQ ID NO: 685914 - DNA, 12 bp, Homo sapiens
ttgtgtgaaatt

SEQ ID NO: 685915 - DNA, 14 bp, Homo sapiens
ttgtgtgaaattgc

SEQ ID NO: 685916 - DNA, 15 bp, Homo sapiens
ttgtgtgaaattgca

SEQ ID NO: 685917 - DNA, 16 bp, Homo sapiens
ttgtgtgaaattgcat

SEQ ID NO: 685918 - DNA, 13 bp, Homo sapiens
ttgtgtgtgttct

SEQ ID NO: 685919 - DNA, 20 bp, Homo sapiens
ttgtgtgtgttctgtcccca

SEQ ID NO: 685920 - DNA, 22 bp, Homo sapiens
ttgtgtttaactgtgaacaaat

SEQ ID NO: 685921 - DNA, 21 bp, Homo sapiens
ttgttacaggcaccgagaatg

SEQ ID NO: 685922 - DNA, 14 bp, Homo sapiens
ttgttatatataat

SEQ ID NO: 685923 - DNA, 19 bp, Homo sapiens
ttgttgaagtttgaaccac

SEQ ID NO: 685924 - DNA, 17 bp, Homo sapiens
ttgttgcatatagttaa

SEQ ID NO: 685925 - DNA, 16 bp, Homo sapiens
ttgttggcacagaaca

SEQ ID NO: 685926 - DNA, 12 bp, Homo sapiens
ttgttgtactta

SEQ ID NO: 685927 - DNA, 15 bp, Homo sapiens
ttgtttatttgcaat

SEQ ID NO: 685928 - DNA, 21 bp, Homo sapiens
ttgtttgaggcaaattaactg

SEQ ID NO: 685929 - DNA, 12 bp, Homo sapiens
ttgtttggagac

SEQ ID NO: 685930 - DNA, 21 bp, Homo sapiens
ttgtttggagacgtttataaa

SEQ ID NO: 685931 - DNA, 17 bp, Homo sapiens
ttgtttggcaaggaaag

SEQ ID NO: 685932 - DNA, 17 bp, Homo sapiens
ttgtttggtaaatgttt

SEQ ID NO: 685933 - DNA, 22 bp, Homo sapiens
ttgttttaaccagtacttctaa

SEQ ID NO: 685934 - DNA, 19 bp, Homo sapiens
ttgttttgctgagagcata

SEQ ID NO: 685935 - DNA, 21 bp, Homo sapiens
ttgtttttgagtactgtacta

SEQ ID NO: 685936 - DNA, 15 bp, Homo sapiens
tttaaaaaaaagaaa

SEQ ID NO: 685937 - DNA, 17 bp, Homo sapiens
tttaaaaaaaagaaact

SEQ ID NO: 685938 - DNA, 13 bp, Homo sapiens
tttaaaaactctt

SEQ ID NO: 685939 - DNA, 16 bp, Homo sapiens
tttaaaaactcttcag

SEQ ID NO: 685940 - DNA, 13 bp, Homo sapiens
tttaaaaaggtgc

SEQ ID NO: 685941 - DNA, 22 bp, Homo sapiens
tttaaaacgcgtctgcctgggc

SEQ ID NO: 685942 - DNA, 16 bp, Homo sapiens
tttaaaactggacctg

SEQ ID NO: 685943 - DNA, 12 bp, Homo sapiens
tttaaaatatat

SEQ ID NO: 685944 - DNA, 23 bp, Homo sapiens
tttaaaatgtaatttaaatgaaa

SEQ ID NO: 685945 - DNA, 10 bp, Homo sapiens
tttaaaattt

SEQ ID NO: 685946 - DNA, 21 bp, Homo sapiens
tttaaaattttgtatgttaaa

SEQ ID NO: 685947 - DNA, 16 bp, Homo sapiens
tttaaagaagctttat

SEQ ID NO: 685948 - DNA, 17 bp, Homo sapiens
tttaaagaagctttatc

SEQ ID NO: 685949 - DNA, 23 bp, Homo sapiens
tttaaagaccaataaacttcctt

SEQ ID NO: 685950 - DNA, 11 bp, Homo sapiens
tttaaatcatc

SEQ ID NO: 685951 - DNA, 16 bp, Homo sapiens
tttaaatgtattttac

SEQ ID NO: 685952 - DNA, 18 bp, Homo sapiens
tttaacatacaagaaaat

SEQ ID NO: 685953 - DNA, 19 bp, Homo sapiens
tttaacatacaagaaaatg

SEQ ID NO: 685954 - DNA, 21 bp, Homo sapiens
tttaacattttggaaattgtt

SEQ ID NO: 685955 - DNA, 18 bp, Homo sapiens
tttaaccaggggtcctaa

SEQ ID NO: 685956 - DNA, 20 bp, Homo sapiens
tttaaccattattatgcaaa

SEQ ID NO: 685957 - DNA, 14 bp, Homo sapiens
tttccttgtcccgt

SEQ ID NO: 685958 - DNA, 16 bp, Homo sapiens
tttcgtatttctcata

SEQ ID NO: 685959 - DNA, 21 bp, Homo sapiens
tttctaaataaaaatatgtaa

SEQ ID NO: 685960 - DNA, 20 bp, Homo sapiens
tttctaaatttatattcata

SEQ ID NO: 685961 - DNA, 16 bp, Homo sapiens
tttctaagaaaatgta

SEQ ID NO: 685962 - DNA, 17 bp, Homo sapiens
tttctaatccttttcct

SEQ ID NO: 685963 - DNA, 20 bp, Homo sapiens
tttctaatccttttccttat

SEQ ID NO: 685964 - DNA, 14 bp, Homo sapiens
tttctaatgtttct

SEQ ID NO: 685965 - DNA, 12 bp, Homo sapiens
tttctaattgta

SEQ ID NO: 685966 - DNA, 15 bp, Homo sapiens
tttctagtccaaaat

SEQ ID NO: 685967 - DNA, 13 bp, Homo sapiens
tttctatgacaaa

SEQ ID NO: 685968 - DNA, 14 bp, Homo sapiens
tttctatgcaggca

SEQ ID NO: 685969 - DNA, 21 bp, Homo sapiens
tttctcactatatatatttct

SEQ ID NO: 685970 - DNA, 17 bp, Homo sapiens
tttctcagtgttggtat

SEQ ID NO: 685971 - DNA, 23 bp, Homo sapiens
tttctccacttcatttttaagaa

SEQ ID NO: 685972 - DNA, 16 bp, Homo sapiens
tttctcccaagaaacc

SEQ ID NO: 685973 - DNA, 15 bp, Homo sapiens
tttctcccaagctga

SEQ ID NO: 685974 - DNA, 11 bp, Homo sapiens
tttctcctggc

SEQ ID NO: 685975 - DNA, 16 bp, Homo sapiens
tttctccttttcctat

SEQ ID NO: 685976 - DNA, 19 bp, Homo sapiens
tttctccttttcctatcct

SEQ ID NO: 685977 - DNA, 13 bp, Homo sapiens
tttctctccctcc

SEQ ID NO: 685978 - DNA, 18 bp, Homo sapiens
tttctctctacagtgcca

SEQ ID NO: 685979 - DNA, 23 bp, Homo sapiens
tttctctgccgctacctccctcc

SEQ ID NO: 685980 - DNA, 18 bp, Homo sapiens
tttctcttctaccctttt

SEQ ID NO: 685981 - DNA, 23 bp, Homo sapiens
tttctcttctacccttttccttt

SEQ ID NO: 685982 - DNA, 19 bp, Homo sapiens
tttctgaatgcctacctgg

SEQ ID NO: 685983 - DNA, 17 bp, Homo sapiens
tttctgagatgctcact

SEQ ID NO: 685984 - DNA, 12 bp, Homo sapiens
aaaaaaaagaaa

SEQ ID NO: 685985 - DNA, 17 bp, Homo sapiens
aaaaaccaatttaccca

SEQ ID NO: 685986 - DNA, 14 bp, Homo sapiens
aaaaacctgtatct

SEQ ID NO: 685987 - DNA, 12 bp, Homo sapiens
aaaaacttttga

SEQ ID NO: 685988 - DNA, 15 bp, Homo sapiens
aaaaacttttgagga

SEQ ID NO: 685989 - DNA, 12 bp, Homo sapiens
aaaaagaaactt

SEQ ID NO: 685990 - DNA, 13 bp, Homo sapiens
aaaaagaatagaa

SEQ ID NO: 685991 - DNA, 17 bp, Homo sapiens
aaaaagagtaatttcat

SEQ ID NO: 685992 - DNA, 13 bp, Homo sapiens
aaaaagcagctac

SEQ ID NO: 685993 - DNA, 18 bp, Homo sapiens
aaaaagtttgtcttagtt

SEQ ID NO: 685994 - DNA, 15 bp, Homo sapiens
aaaaataaaatgttt

SEQ ID NO: 685995 - DNA, 18 bp, Homo sapiens
aaaaatagtcttccacaa

SEQ ID NO: 685996 - DNA, 14 bp, Homo sapiens
aaaaatataatgtt

SEQ ID NO: 685997 - DNA, 19 bp, Homo sapiens
aaaaatctcaattgaaagc

SEQ ID NO: 685998 - DNA, 18 bp, Homo sapiens
aaaaatgacaattgtgaa

SEQ ID NO: 685999 - DNA, 15 bp, Homo sapiens
aaaaatgattttgct

SEQ ID NO: 686000 - DNA, 22 bp, Homo sapiens
aaaaatgggagacagcctctta

SEQ ID NO: 686001 - DNA, 14 bp, Homo sapiens
aaaaattaactttt

SEQ ID NO: 686002 - DNA, 15 bp, Homo sapiens
aaaaattaacttttt

SEQ ID NO: 686003 - DNA, 23 bp, Homo sapiens
aaaaattacctttaattttaatg

SEQ ID NO: 686004 - DNA, 13 bp, Homo sapiens
aaaaatttttgtt

SEQ ID NO: 686005 - DNA, 18 bp, Homo sapiens
aaaacagatgaccataat

SEQ ID NO: 686006 - DNA, 12 bp, Homo sapiens
aaaacatttgct

SEQ ID NO: 686007 - DNA, 15 bp, Homo sapiens
aaaacattttgaagt

SEQ ID NO: 686008 - DNA, 18 bp, Homo sapiens
aaaacctaagcaaactta

SEQ ID NO: 686009 - DNA, 14 bp, Homo sapiens
aaaactcttcagtg

SEQ ID NO: 686010 - DNA, 16 bp, Homo sapiens
aaaactggacctgtat

SEQ ID NO: 686011 - DNA, 19 bp, Homo sapiens
aaaactggacctgtatatt

SEQ ID NO: 686012 - DNA, 22 bp, Homo sapiens
aaaactgggattaagaaacctt

SEQ ID NO: 686013 - DNA, 17 bp, Homo sapiens
aaaacttaaaaattaat

SEQ ID NO: 686014 - DNA, 19 bp, Homo sapiens
aaaacttaaaaattaatat

SEQ ID NO: 686015 - DNA, 12 bp, Homo sapiens
aaaacttctgct

SEQ ID NO: 686016 - DNA, 15 bp, Homo sapiens
aaaacttctgctcgt

SEQ ID NO: 686017 - DNA, 14 bp, Homo sapiens
aaaagaaaattgat

SEQ ID NO: 686018 - DNA, 12 bp, Homo sapiens
aaaagaaacttt

SEQ ID NO: 686019 - DNA, 17 bp, Homo sapiens
aaaagaaacttttctga

SEQ ID NO: 686020 - DNA, 23 bp, Homo sapiens
aaaagaaatatattttttgttat

SEQ ID NO: 686021 - DNA, 13 bp, Homo sapiens
aaaagagtaattt

SEQ ID NO: 686022 - DNA, 15 bp, Homo sapiens
aaaagcactcctgct

SEQ ID NO: 686023 - DNA, 19 bp, Homo sapiens
aaaagcatgaattggaact

SEQ ID NO: 686024 - DNA, 14 bp, Homo sapiens
aaaagcattttgta

SEQ ID NO: 686025 - DNA, 14 bp, Homo sapiens
aaaagcttcaaatt

SEQ ID NO: 686026 - DNA, 18 bp, Homo sapiens
aaaaggaaggaagggaca

SEQ ID NO: 686027 - DNA, 19 bp, Homo sapiens
aaaagggctctttagccag

SEQ ID NO: 686028 - DNA, 14 bp, Homo sapiens
aaaaggtattatac

SEQ ID NO: 686029 - DNA, 20 bp, Homo sapiens
aaaaggttgcctgaaaaatg

SEQ ID NO: 686030 - DNA, 13 bp, Homo sapiens
aaaagtatatgtt

SEQ ID NO: 686031 - DNA, 14 bp, Homo sapiens
aaaagtatatgtta

SEQ ID NO: 686032 - DNA, 19 bp, Homo sapiens
aaaagtattttttcaagtt

SEQ ID NO: 686033 - DNA, 13 bp, Homo sapiens
aaaagtgtccttc

SEQ ID NO: 686034 - DNA, 20 bp, Homo sapiens
aaaagtgtgtatatattttg

SEQ ID NO: 686035 - DNA, 19 bp, Homo sapiens
aaaagtttttaatttgatg

SEQ ID NO: 686036 - DNA, 17 bp, Homo sapiens
aaaatacatttgtaagt

SEQ ID NO: 686037 - DNA, 22 bp, Homo sapiens
aaaatactatttaagatgtgaa

SEQ ID NO: 686038 - DNA, 18 bp, Homo sapiens
aaaatagaataattcttt

SEQ ID NO: 686039 - DNA, 13 bp, Homo sapiens
aaaatagccctgc

SEQ ID NO: 686040 - DNA, 18 bp, Homo sapiens
aaaataggggatatttaa

SEQ ID NO: 686041 - DNA, 13 bp, Homo sapiens
aaaatatagctaa

SEQ ID NO: 686042 - DNA, 12 bp, Homo sapiens
aaaatatatgaa

SEQ ID NO: 686043 - DNA, 16 bp, Homo sapiens
aaaatatcataaagca

SEQ ID NO: 686044 - DNA, 20 bp, Homo sapiens
aaaatatgtaagaacacatt

SEQ ID NO: 686045 - DNA, 17 bp, Homo sapiens
aaaatatgtaatttcaa

SEQ ID NO: 686046 - DNA, 20 bp, Homo sapiens
aaaatattttgttgccttca

SEQ ID NO: 686047 - DNA, 13 bp, Homo sapiens
aaaatcagaacaa

SEQ ID NO: 686048 - DNA, 14 bp, Homo sapiens
aaaatcagaacaaa

SEQ ID NO: 686049 - DNA, 18 bp, Homo sapiens
aaaatcccaccttcccac

SEQ ID NO: 686050 - DNA, 21 bp, Homo sapiens
aaaatccccttcgctgaaatt

SEQ ID NO: 686051 - DNA, 16 bp, Homo sapiens
aaaatctgttcacttt

SEQ ID NO: 686052 - DNA, 20 bp, Homo sapiens
aaaatcttggagaccctgca

SEQ ID NO: 686053 - DNA, 16 bp, Homo sapiens
aaaatgacaattgtga

SEQ ID NO: 686054 - DNA, 17 bp, Homo sapiens
aaaatggacacaaattt

SEQ ID NO: 686055 - DNA, 18 bp, Homo sapiens
aaaatgtaggctttcatg

SEQ ID NO: 686056 - DNA, 14 bp, Homo sapiens
aaaatgtcttggtc

SEQ ID NO: 686057 - DNA, 14 bp, Homo sapiens
aaaatgtgtgccat

SEQ ID NO: 686058 - DNA, 15 bp, Homo sapiens
aaaatgtttcattat

SEQ ID NO: 686059 - DNA, 20 bp, Homo sapiens
aaaattaatatggtgtattt

SEQ ID NO: 686060 - DNA, 19 bp, Homo sapiens
aaaattacctttaatttta

SEQ ID NO: 686061 - DNA, 12 bp, Homo sapiens
aaaattactaat

SEQ ID NO: 686062 - DNA, 15 bp, Homo sapiens
aaaattatttgctat

SEQ ID NO: 686063 - DNA, 20 bp, Homo sapiens
aaaattgagttgcacttatt

SEQ ID NO: 686064 - DNA, 19 bp, Homo sapiens
aaaattgatattatattaa

SEQ ID NO: 686065 - DNA, 23 bp, Homo sapiens
aaaattgatattatattaaacat

SEQ ID NO: 686066 - DNA, 16 bp, Homo sapiens
aacattgtagcctcaa

SEQ ID NO: 686067 - DNA, 21 bp, Homo sapiens
aacattgtgactttgctttga

SEQ ID NO: 686068 - DNA, 22 bp, Homo sapiens
aacatttatgtgaggtaattat

SEQ ID NO: 686069 - DNA, 19 bp, Homo sapiens
aacattttatcattaaaaa

SEQ ID NO: 686070 - DNA, 18 bp, Homo sapiens
aacattttggaaattgtt

SEQ ID NO: 686071 - DNA, 13 bp, Homo sapiens
aaccaaatacctc

SEQ ID NO: 686072 - DNA, 23 bp, Homo sapiens
aaccaaatacctcaatttttgtt

SEQ ID NO: 686073 - DNA, 19 bp, Homo sapiens
aaccacacttgaaaccttt

SEQ ID NO: 686074 - DNA, 12 bp, Homo sapiens
aaccactagaaa

SEQ ID NO: 686075 - DNA, 13 bp, Homo sapiens
aaccatatgatac

SEQ ID NO: 686076 - DNA, 11 bp, Homo sapiens
aaccatttata

SEQ ID NO: 686077 - DNA, 19 bp, Homo sapiens
aacccaagcaacatttgta

SEQ ID NO: 686078 - DNA, 16 bp, Homo sapiens
aacccacctctcctgc

SEQ ID NO: 686079 - DNA, 23 bp, Homo sapiens
aacccagttaacttactctttaa

SEQ ID NO: 686080 - DNA, 17 bp, Homo sapiens
aacccctgtaggcctca

SEQ ID NO: 686081 - DNA, 23 bp, Homo sapiens
aacctacagactccatctcttct

SEQ ID NO: 686082 - DNA, 17 bp, Homo sapiens
aacctagctacactgag

SEQ ID NO: 686083 - DNA, 17 bp, Homo sapiens
aacctcagggctcccag

SEQ ID NO: 686084 - DNA, 13 bp, Homo sapiens
aacctctgcctcc

SEQ ID NO: 686085 - DNA, 15 bp, Homo sapiens
aacctgaagtttttt

SEQ ID NO: 686086 - DNA, 22 bp, Homo sapiens
aacctgtattactgaataatat

SEQ ID NO: 686087 - DNA, 19 bp, Homo sapiens
aaccttagagcttggacag

SEQ ID NO: 686088 - DNA, 15 bp, Homo sapiens
aaccttcgtcctttt

SEQ ID NO: 686089 - DNA, 13 bp, Homo sapiens
aacgagttaatga

SEQ ID NO: 686090 - DNA, 22 bp, Homo sapiens
aacgagttaatgatggcagagg

SEQ ID NO: 686091 - DNA, 13 bp, Homo sapiens
aacgcctccccct

SEQ ID NO: 686092 - DNA, 14 bp, Homo sapiens
aacgcgtctgcctg

SEQ ID NO: 686093 - DNA, 17 bp, Homo sapiens
aacgcgtctgcctgggc

SEQ ID NO: 686094 - DNA, 15 bp, Homo sapiens
aacgctacctctctg

SEQ ID NO: 686095 - DNA, 15 bp, Homo sapiens
aacgctgatttaaag

SEQ ID NO: 686096 - DNA, 22 bp, Homo sapiens
aacgcttcgggaaaatattcat

SEQ ID NO: 686097 - DNA, 22 bp, Homo sapiens
aacggaggcctgcgaccctggg

SEQ ID NO: 686098 - DNA, 15 bp, Homo sapiens
aactaaaataatttt

SEQ ID NO: 686099 - DNA, 22 bp, Homo sapiens
aactaaaggacttgatgtacat

SEQ ID NO: 686100 - DNA, 13 bp, Homo sapiens
aactaaatttcac

SEQ ID NO: 686101 - DNA, 20 bp, Homo sapiens
aactaatgtttgaacaaagc

SEQ ID NO: 686102 - DNA, 16 bp, Homo sapiens
aactagggctcatttt

SEQ ID NO: 686103 - DNA, 18 bp, Homo sapiens
aactatatgtgaaacatt

SEQ ID NO: 686104 - DNA, 13 bp, Homo sapiens
aactatcttgtgt

SEQ ID NO: 686105 - DNA, 21 bp, Homo sapiens
aactatttatatcacacaata

SEQ ID NO: 686106 - DNA, 21 bp, Homo sapiens
aactcacctaatgtttatgag

SEQ ID NO: 686107 - DNA, 17 bp, Homo sapiens
aactcacctctcaaggt

SEQ ID NO: 686108 - DNA, 15 bp, Homo sapiens
aactcactctttaga

SEQ ID NO: 686109 - DNA, 17 bp, Homo sapiens
aactcatcctcttttaa

SEQ ID NO: 686110 - DNA, 18 bp, Homo sapiens
aactcccaacttcttcct

SEQ ID NO: 686111 - DNA, 17 bp, Homo sapiens
aactcccccattttaca

SEQ ID NO: 686112 - DNA, 21 bp, Homo sapiens
aactcctcacacaccctgagg

SEQ ID NO: 686113 - DNA, 22 bp, Homo sapiens
aactcctgtcccttttccctta

SEQ ID NO: 686114 - DNA, 20 bp, Homo sapiens
aactctccttttccttacca

SEQ ID NO: 686115 - DNA, 11 bp, Homo sapiens
aactgaagcat

SEQ ID NO: 686116 - DNA, 19 bp, Homo sapiens
aactgaagcataaagaatt

SEQ ID NO: 686117 - DNA, 16 bp, Homo sapiens
aactgagagtaattca

SEQ ID NO: 686118 - DNA, 19 bp, Homo sapiens
aactgaggcttagagatag

SEQ ID NO: 686119 - DNA, 19 bp, Homo sapiens
aactgattcttatgattac

SEQ ID NO: 686120 - DNA, 16 bp, Homo sapiens
aactgccaggctgcct

SEQ ID NO: 686121 - DNA, 24 bp, Homo sapiens
aactgccaggctgcctcctgccct

SEQ ID NO: 686122 - DNA, 23 bp, Homo sapiens
aactgctgaaaactagctcgtga

SEQ ID NO: 686123 - DNA, 16 bp, Homo sapiens
aactggaggcagtcca

SEQ ID NO: 686124 - DNA, 23 bp, Homo sapiens
aactggagttccttatccctctc

SEQ ID NO: 686125 - DNA, 19 bp, Homo sapiens
aactggcaattgtctattt

SEQ ID NO: 686126 - DNA, 14 bp, Homo sapiens
aactggtattgttt

SEQ ID NO: 686127 - DNA, 16 bp, Homo sapiens
aactggtattgtttac

SEQ ID NO: 686128 - DNA, 20 bp, Homo sapiens
aactgtcccaaggagggggc

SEQ ID NO: 686129 - DNA, 21 bp, Homo sapiens
aactgtgctgaatgctttaga

SEQ ID NO: 686130 - DNA, 18 bp, Homo sapiens
aacttaaaaattaatatg

SEQ ID NO: 686131 - DNA, 11 bp, Homo sapiens
aacttaaaata

SEQ ID NO: 686132 - DNA, 11 bp, Homo sapiens
aacttaagaat

SEQ ID NO: 686133 - DNA, 13 bp, Homo sapiens
aacttatttagag

SEQ ID NO: 686134 - DNA, 15 bp, Homo sapiens
aacttatttcataat

SEQ ID NO: 686135 - DNA, 16 bp, Homo sapiens
aacttatttcataatt

SEQ ID NO: 686136 - DNA, 19 bp, Homo sapiens
aacttatttcataattgcc

SEQ ID NO: 686137 - DNA, 21 bp, Homo sapiens
aacttatttcataattgccta

SEQ ID NO: 686138 - DNA, 23 bp, Homo sapiens
aacttatttcataattgcctaca

SEQ ID NO: 686139 - DNA, 23 bp, Homo sapiens
aacttgcatattgttggcacaga

SEQ ID NO: 686140 - DNA, 12 bp, Homo sapiens
aacttggctttc

SEQ ID NO: 686141 - DNA, 15 bp, Homo sapiens
aacttgtacatggaa

SEQ ID NO: 686142 - DNA, 11 bp, Homo sapiens
aactttaatac

SEQ ID NO: 686143 - DNA, 15 bp, Homo sapiens
aactttcaattgtca

SEQ ID NO: 686144 - DNA, 23 bp, Homo sapiens
aactttcccaggttctgtttatg

SEQ ID NO: 686145 - DNA, 18 bp, Homo sapiens
aactttgtcgtggttctt

SEQ ID NO: 686146 - DNA, 20 bp, Homo sapiens
aactttgtcgtggttcttaa

SEQ ID NO: 686147 - DNA, 14 bp, Homo sapiens
aacttttaatttaa

SEQ ID NO: 686148 - DNA, 15 bp, Homo sapiens
aagaaaagtgcatat

SEQ ID NO: 686149 - DNA, 20 bp, Homo sapiens
aagaaaagtgcatatttatc

SEQ ID NO: 686150 - DNA, 13 bp, Homo sapiens
aagaaaatctttg

SEQ ID NO: 686151 - DNA, 16 bp, Homo sapiens
aagaaaatgaagggat

SEQ ID NO: 686152 - DNA, 14 bp, Homo sapiens
aagaaacaaaaatc

SEQ ID NO: 686153 - DNA, 15 bp, Homo sapiens
aagaaaggagataca

SEQ ID NO: 686154 - DNA, 14 bp, Homo sapiens
aagaacaagtttag

SEQ ID NO: 686155 - DNA, 13 bp, Homo sapiens
aagaacacatttt

SEQ ID NO: 686156 - DNA, 16 bp, Homo sapiens
aagaacacattttaaa

SEQ ID NO: 686157 - DNA, 18 bp, Homo sapiens
aagaacacattttaaata

SEQ ID NO: 686158 - DNA, 12 bp, Homo sapiens
aagaacatagaa

SEQ ID NO: 686159 - DNA, 16 bp, Homo sapiens
aagaacatagaactct

SEQ ID NO: 686160 - DNA, 13 bp, Homo sapiens
aagaagaagttca

SEQ ID NO: 686161 - DNA, 12 bp, Homo sapiens
aagaagacattt

SEQ ID NO: 686162 - DNA, 20 bp, Homo sapiens
aagaagcaaagttcaactta

SEQ ID NO: 686163 - DNA, 12 bp, Homo sapiens
aagaagctttat

SEQ ID NO: 686164 - DNA, 14 bp, Homo sapiens
aagaataaaaactt

SEQ ID NO: 686165 - DNA, 15 bp, Homo sapiens
aagaataaaaacttt

SEQ ID NO: 686166 - DNA, 19 bp, Homo sapiens
aagaatatcctttaaaatt

SEQ ID NO: 686167 - DNA, 21 bp, Homo sapiens
aagaatatcctttaaaattta

SEQ ID NO: 686168 - DNA, 14 bp, Homo sapiens
aagaatatttttag

SEQ ID NO: 686169 - DNA, 13 bp, Homo sapiens
aagaatgaaaaat

SEQ ID NO: 686170 - DNA, 13 bp, Homo sapiens
aagaatgaaagct

SEQ ID NO: 686171 - DNA, 17 bp, Homo sapiens
aagaatgaaagctgttc

SEQ ID NO: 686172 - DNA, 13 bp, Homo sapiens
aagaatgcttaaa

SEQ ID NO: 686173 - DNA, 17 bp, Homo sapiens
aagaattctagcatgct

SEQ ID NO: 686174 - DNA, 16 bp, Homo sapiens
aagaatttagtattat

SEQ ID NO: 686175 - DNA, 22 bp, Homo sapiens
aagacagggctcatttttgcac

SEQ ID NO: 686176 - DNA, 23 bp, Homo sapiens
aagacatactgcttgattttaat

SEQ ID NO: 686177 - DNA, 13 bp, Homo sapiens
aagacatttgctg

SEQ ID NO: 686178 - DNA, 13 bp, Homo sapiens
aagacattttgtt

SEQ ID NO: 686179 - DNA, 20 bp, Homo sapiens
aagacattttgttacataag

SEQ ID NO: 686180 - DNA, 18 bp, Homo sapiens
aagacgggaggggaggca

SEQ ID NO: 686181 - DNA, 15 bp, Homo sapiens
aagacttgagacaat

SEQ ID NO: 686182 - DNA, 20 bp, Homo sapiens
aagacttgagacaatgtttt

SEQ ID NO: 686183 - DNA, 14 bp, Homo sapiens
aagagaaaggactc

SEQ ID NO: 686184 - DNA, 17 bp, Homo sapiens
aagagaagtgagtggtg

SEQ ID NO: 686185 - DNA, 23 bp, Homo sapiens
aagagaatatttacaatatatga

SEQ ID NO: 686186 - DNA, 19 bp, Homo sapiens
aagagacaaagatttcttc

SEQ ID NO: 686187 - DNA, 20 bp, Homo sapiens
aatattgtttggtaaatgtt

SEQ ID NO: 686188 - DNA, 19 bp, Homo sapiens
aatatttactaactaaata

SEQ ID NO: 686189 - DNA, 20 bp, Homo sapiens
aatatttactaactaaatac

SEQ ID NO: 686190 - DNA, 12 bp, Homo sapiens
aatatttatgtt

SEQ ID NO: 686191 - DNA, 13 bp, Homo sapiens
aatattttttgct

SEQ ID NO: 686192 - DNA, 14 bp, Homo sapiens
aatcaaactttaca

SEQ ID NO: 686193 - DNA, 16 bp, Homo sapiens
aatcaacttttatgca

SEQ ID NO: 686194 - DNA, 13 bp, Homo sapiens
aatcaagcctctg

SEQ ID NO: 686195 - DNA, 23 bp, Homo sapiens
aatcacttgaccgggagacagag

SEQ ID NO: 686196 - DNA, 16 bp, Homo sapiens
aatcactttgtctaac

SEQ ID NO: 686197 - DNA, 13 bp, Homo sapiens
aatcagaaagtaa

SEQ ID NO: 686198 - DNA, 19 bp, Homo sapiens
aatcagaacaaaacttcta

SEQ ID NO: 686199 - DNA, 14 bp, Homo sapiens
aatcagttctcaat

SEQ ID NO: 686200 - DNA, 24 bp, Homo sapiens
aatcatcggagtcagccaggagct

SEQ ID NO: 686201 - DNA, 19 bp, Homo sapiens
aatccagttataagaagaa

SEQ ID NO: 686202 - DNA, 16 bp, Homo sapiens
aatccatttatttcat

SEQ ID NO: 686203 - DNA, 16 bp, Homo sapiens
aatcccaccttcccac

SEQ ID NO: 686204 - DNA, 18 bp, Homo sapiens
aatccccaacatgcactg

SEQ ID NO: 686205 - DNA, 11 bp, Homo sapiens
aatcctcctcc

SEQ ID NO: 686206 - DNA, 21 bp, Homo sapiens
aatcctggagagggtattttt

SEQ ID NO: 686207 - DNA, 13 bp, Homo sapiens
aatccttttcctt

SEQ ID NO: 686208 - DNA, 14 bp, Homo sapiens
aatccttttcctta

SEQ ID NO: 686209 - DNA, 19 bp, Homo sapiens
aatctaaaagctctgttcc

SEQ ID NO: 686210 - DNA, 10 bp, Homo sapiens
aatctacacc

SEQ ID NO: 686211 - DNA, 20 bp, Homo sapiens
aatctataagtagtaaatca

SEQ ID NO: 686212 - DNA, 20 bp, Homo sapiens
aatctatggcttatttctat

SEQ ID NO: 686213 - DNA, 16 bp, Homo sapiens
aatctccatgtgtact

SEQ ID NO: 686214 - DNA, 12 bp, Homo sapiens
aatctcctgctg

SEQ ID NO: 686215 - DNA, 13 bp, Homo sapiens
aatctcctgctga

SEQ ID NO: 686216 - DNA, 17 bp, Homo sapiens
aatctctttttgtttgc

SEQ ID NO: 686217 - DNA, 18 bp, Homo sapiens
aatctctttttgtttgcc

SEQ ID NO: 686218 - DNA, 15 bp, Homo sapiens
aatctgcctgtatct

SEQ ID NO: 686219 - DNA, 15 bp, Homo sapiens
aatctgctttaatta

SEQ ID NO: 686220 - DNA, 14 bp, Homo sapiens
aatcttcaggtgaa

SEQ ID NO: 686221 - DNA, 19 bp, Homo sapiens
aatcttcagtattttctcc

SEQ ID NO: 686222 - DNA, 14 bp, Homo sapiens
aatctttatactgg

SEQ ID NO: 686223 - DNA, 23 bp, Homo sapiens
aatctttgttgaagtttgaacca

SEQ ID NO: 686224 - DNA, 13 bp, Homo sapiens
aatcttttgaagc

SEQ ID NO: 686225 - DNA, 13 bp, Homo sapiens
aatgaaaaatata

SEQ ID NO: 686226 - DNA, 16 bp, Homo sapiens
aatgaaaaatataatg

SEQ ID NO: 686227 - DNA, 21 bp, Homo sapiens
aatgaaaaatctcaattgaaa

SEQ ID NO: 686228 - DNA, 17 bp, Homo sapiens
aatgaaaagctgaatcc

SEQ ID NO: 686229 - DNA, 16 bp, Homo sapiens
aatgaaagaaaattga

SEQ ID NO: 686230 - DNA, 19 bp, Homo sapiens
aatgaaagaaaattgagtt

SEQ ID NO: 686231 - DNA, 20 bp, Homo sapiens
aatgaaagtcaaatttactt

SEQ ID NO: 686232 - DNA, 22 bp, Homo sapiens
aatgaagaaagtcaaaaaatta

SEQ ID NO: 686233 - DNA, 14 bp, Homo sapiens
aatgaagaacactg

SEQ ID NO: 686234 - DNA, 14 bp, Homo sapiens
aatgaagaagtttc

SEQ ID NO: 686235 - DNA, 18 bp, Homo sapiens
aatgaattgaaaaacaat

SEQ ID NO: 686236 - DNA, 13 bp, Homo sapiens
aatgacagatttc

SEQ ID NO: 686237 - DNA, 18 bp, Homo sapiens
aatgacagatttctgtaa

SEQ ID NO: 686238 - DNA, 15 bp, Homo sapiens
aatgacaggcctgtc

SEQ ID NO: 686239 - DNA, 23 bp, Homo sapiens
aatgaccaagctcagttcaatga

SEQ ID NO: 686240 - DNA, 13 bp, Homo sapiens
aatgacttctaat

SEQ ID NO: 686241 - DNA, 19 bp, Homo sapiens
aatgacttctaatttatat

SEQ ID NO: 686242 - DNA, 19 bp, Homo sapiens
aatgagcccagagaacagc

SEQ ID NO: 686243 - DNA, 15 bp, Homo sapiens
aatgaggattattga

SEQ ID NO: 686244 - DNA, 17 bp, Homo sapiens
aatgaggattattgata

SEQ ID NO: 686245 - DNA, 22 bp, Homo sapiens
aatgataaaataaataatttta

SEQ ID NO: 686246 - DNA, 15 bp, Homo sapiens
aatgatatgcttgta

SEQ ID NO: 686247 - DNA, 17 bp, Homo sapiens
aatgatatgcttgtaac

SEQ ID NO: 686248 - DNA, 13 bp, Homo sapiens
aatgcaataactc

SEQ ID NO: 686249 - DNA, 14 bp, Homo sapiens
aatgcaataactct

SEQ ID NO: 686250 - DNA, 18 bp, Homo sapiens
aatgcaataactctggga

SEQ ID NO: 686251 - DNA, 18 bp, Homo sapiens
aatgcagattacactgat

SEQ ID NO: 686252 - DNA, 22 bp, Homo sapiens
aatgcataaatgcataatttat

SEQ ID NO: 686253 - DNA, 17 bp, Homo sapiens
aatgcataatttatggt

SEQ ID NO: 686254 - DNA, 18 bp, Homo sapiens
aatgcatatcctgagcca

SEQ ID NO: 686255 - DNA, 15 bp, Homo sapiens
aatgcctcctgtggg

SEQ ID NO: 686256 - DNA, 16 bp, Homo sapiens
aatgctacaattttaa

SEQ ID NO: 686257 - DNA, 22 bp, Homo sapiens
aatgctggcaaaggctggctgt

SEQ ID NO: 686258 - DNA, 22 bp, Homo sapiens
aatgctgttagtaaatttctgt

SEQ ID NO: 686259 - DNA, 15 bp, Homo sapiens
aatgcttcattgaaa

SEQ ID NO: 686260 - DNA, 15 bp, Homo sapiens
aatgctttctgtatg

SEQ ID NO: 686261 - DNA, 21 bp, Homo sapiens
aatggaacagatttcaaaaaa

SEQ ID NO: 686262 - DNA, 17 bp, Homo sapiens
aatggacacaaattttc

SEQ ID NO: 686263 - DNA, 20 bp, Homo sapiens
aatggacacaaattttcaag

SEQ ID NO: 686264 - DNA, 17 bp, Homo sapiens
aatggatattattagaa

SEQ ID NO: 686265 - DNA, 18 bp, Homo sapiens
aatggcatttctctttaa

SEQ ID NO: 686266 - DNA, 21 bp, Homo sapiens
aatgggaaaaaacttaaaaat

SEQ ID NO: 686267 - DNA, 18 bp, Homo sapiens
aatgggagacagcctctt

SEQ ID NO: 686268 - DNA, 22 bp, Homo sapiens
aatggtgtgaacccgggagcgg

SEQ ID NO: 686269 - DNA, 14 bp, Homo sapiens
aatgtaaataaact

SEQ ID NO: 686270 - DNA, 15 bp, Homo sapiens
aatgtaaataaacta

SEQ ID NO: 686271 - DNA, 13 bp, Homo sapiens
aatgtaacactgg

SEQ ID NO: 686272 - DNA, 18 bp, Homo sapiens
aatgtacgtccagcctgc

SEQ ID NO: 686273 - DNA, 18 bp, Homo sapiens
aatgtagcgtgtaagctt

SEQ ID NO: 686274 - DNA, 20 bp, Homo sapiens
aatgtagcgtgtaagcttgt

SEQ ID NO: 686275 - DNA, 22 bp, Homo sapiens
aatgtagttagctccataaagt

SEQ ID NO: 686276 - DNA, 13 bp, Homo sapiens
aatgtataaatat

SEQ ID NO: 686277 - DNA, 14 bp, Homo sapiens
aatgtataaatata

SEQ ID NO: 686278 - DNA, 16 bp, Homo sapiens
aatgtataaatataca

SEQ ID NO: 686279 - DNA, 16 bp, Homo sapiens
aatgtataatgtgcag

SEQ ID NO: 686280 - DNA, 23 bp, Homo sapiens
aatgtatccaaggaaacatttta

SEQ ID NO: 686281 - DNA, 17 bp, Homo sapiens
aatgtattttcttttta

SEQ ID NO: 686282 - DNA, 20 bp, Homo sapiens
aatgtcagtagtgctaatgc

SEQ ID NO: 686283 - DNA, 12 bp, Homo sapiens
aatgtcagtgtt

SEQ ID NO: 686284 - DNA, 20 bp, Homo sapiens
aatgtgcagaaaatatttaa

SEQ ID NO: 686285 - DNA, 14 bp, Homo sapiens
aatgtgtcctatct

SEQ ID NO: 686286 - DNA, 14 bp, Homo sapiens
aatgtttatactgt

SEQ ID NO: 686287 - DNA, 16 bp, Homo sapiens
aatgtttatgagccag

SEQ ID NO: 686288 - DNA, 22 bp, Homo sapiens
aatgtttttaaaaagagtaatt

SEQ ID NO: 686289 - DNA, 13 bp, Homo sapiens
aattaaaacaaat

SEQ ID NO: 686290 - DNA, 12 bp, Homo sapiens
aattaactgtat

SEQ ID NO: 686291 - DNA, 23 bp, Homo sapiens
aattaagcaaatgttaaaagttt

SEQ ID NO: 686292 - DNA, 21 bp, Homo sapiens
aattaatatggtgtatttttc

SEQ ID NO: 686293 - DNA, 23 bp, Homo sapiens
aattaatatggtgtatttttcca

SEQ ID NO: 686294 - DNA, 19 bp, Homo sapiens
aattacctggtgagtaact

SEQ ID NO: 686295 - DNA, 24 bp, Homo sapiens
aattacctggtgagtaacttagaa

SEQ ID NO: 686296 - DNA, 12 bp, Homo sapiens
aattactggaat

SEQ ID NO: 686297 - DNA, 15 bp, Homo sapiens
aattactttaacatt

SEQ ID NO: 686298 - DNA, 18 bp, Homo sapiens
aattactttaacattttg

SEQ ID NO: 686299 - DNA, 17 bp, Homo sapiens
aattagataaattgtag

SEQ ID NO: 686300 - DNA, 22 bp, Homo sapiens
aattagatctaaacagttattt

SEQ ID NO: 686301 - DNA, 23 bp, Homo sapiens
aattatgagattggttttcctgt

SEQ ID NO: 686302 - DNA, 18 bp, Homo sapiens
aattatggcatttctatt

SEQ ID NO: 686303 - DNA, 23 bp, Homo sapiens
aattattaggagtaattcttttc

SEQ ID NO: 686304 - DNA, 13 bp, Homo sapiens
aattattatttta

SEQ ID NO: 686305 - DNA, 20 bp, Homo sapiens
aattattattttaaaatata

SEQ ID NO: 686306 - DNA, 14 bp, Homo sapiens
aattatttgcatat

SEQ ID NO: 686307 - DNA, 21 bp, Homo sapiens
aattatttgcatattttgaga

SEQ ID NO: 686308 - DNA, 22 bp, Homo sapiens
aattcaactttgtaaaaatctt

SEQ ID NO: 686309 - DNA, 18 bp, Homo sapiens
aattcatctgtgaatctg

SEQ ID NO: 686310 - DNA, 14 bp, Homo sapiens
aattcccccatcct

SEQ ID NO: 686311 - DNA, 13 bp, Homo sapiens
aattcctaacttt

SEQ ID NO: 686312 - DNA, 15 bp, Homo sapiens
aattcgaaccaggaa

SEQ ID NO: 686313 - DNA, 21 bp, Homo sapiens
aattctcccctccctccagta

SEQ ID NO: 686314 - DNA, 19 bp, Homo sapiens
aattctcctgcctcagcct

SEQ ID NO: 686315 - DNA, 11 bp, Homo sapiens
aattcttaaaa

SEQ ID NO: 686316 - DNA, 17 bp, Homo sapiens
aattcttcacatgttta

SEQ ID NO: 686317 - DNA, 22 bp, Homo sapiens
aattcttctgcaacatttgaca

SEQ ID NO: 686318 - DNA, 13 bp, Homo sapiens
aattcttgagaag

SEQ ID NO: 686319 - DNA, 14 bp, Homo sapiens
aattcttgagaagt

SEQ ID NO: 686320 - DNA, 18 bp, Homo sapiens
aattcttgagaagtaact

SEQ ID NO: 686321 - DNA, 14 bp, Homo sapiens
aattgaaataaata

SEQ ID NO: 686322 - DNA, 22 bp, Homo sapiens
aattgaaataaataaaaatgca

SEQ ID NO: 686323 - DNA, 17 bp, Homo sapiens
aattgaagtgtataata

SEQ ID NO: 686324 - DNA, 23 bp, Homo sapiens
aattgaattggaaagacttctca

SEQ ID NO: 686325 - DNA, 13 bp, Homo sapiens
aattgactgaaat

SEQ ID NO: 686326 - DNA, 15 bp, Homo sapiens
aattgactgaaatta

SEQ ID NO: 686327 - DNA, 14 bp, Homo sapiens
aattgatattatat

SEQ ID NO: 686328 - DNA, 15 bp, Homo sapiens
aattgatattatatt

SEQ ID NO: 686329 - DNA, 21 bp, Homo sapiens
aattgatattatattaaacat

SEQ ID NO: 686330 - DNA, 14 bp, Homo sapiens
aattgatattttta

SEQ ID NO: 686331 - DNA, 13 bp, Homo sapiens
aattgcagtcatt

SEQ ID NO: 686332 - DNA, 22 bp, Homo sapiens
aattgcatactttgtattttga

SEQ ID NO: 686333 - DNA, 14 bp, Homo sapiens
aattgctatgttac

SEQ ID NO: 686334 - DNA, 21 bp, Homo sapiens
aattgctatgttactattttc

SEQ ID NO: 686335 - DNA, 23 bp, Homo sapiens
aattgcttggttgtaattaaatt

SEQ ID NO: 686336 - DNA, 13 bp, Homo sapiens
aattggaactgca

SEQ ID NO: 686337 - DNA, 14 bp, Homo sapiens
aattggaactgcaa

SEQ ID NO: 686338 - DNA, 15 bp, Homo sapiens
aattggaactgcaat

SEQ ID NO: 686339 - DNA, 16 bp, Homo sapiens
aattggggaggagggg

SEQ ID NO: 686340 - DNA, 18 bp, Homo sapiens
aattgtaggggtgtgtgt

SEQ ID NO: 686341 - DNA, 18 bp, Homo sapiens
aattgtatcaatttgttt

SEQ ID NO: 686342 - DNA, 12 bp, Homo sapiens
aattgtctattt

SEQ ID NO: 686343 - DNA, 16 bp, Homo sapiens
aattgtgaacatgata

SEQ ID NO: 686344 - DNA, 13 bp, Homo sapiens
aattgttttacct

SEQ ID NO: 686345 - DNA, 22 bp, Homo sapiens
aattgttttacctgttctgaaa

SEQ ID NO: 686346 - DNA, 18 bp, Homo sapiens
aatttaaaaaataaataa

SEQ ID NO: 686347 - DNA, 18 bp, Homo sapiens
aatttaaaaacacaaaaa

SEQ ID NO: 686348 - DNA, 16 bp, Homo sapiens
aatttaaaatgtgtgc

SEQ ID NO: 686349 - DNA, 19 bp, Homo sapiens
aatttaatttgtaaaactt

SEQ ID NO: 686350 - DNA, 22 bp, Homo sapiens
aatttaatttgtaaaacttctg

SEQ ID NO: 686351 - DNA, 24 bp, Homo sapiens
aatttaatttgtaaaacttctgct

SEQ ID NO: 686352 - DNA, 19 bp, Homo sapiens
aatttaccctcttgaatat

SEQ ID NO: 686353 - DNA, 22 bp, Homo sapiens
aatttaccctcttgaatataat

SEQ ID NO: 686354 - DNA, 16 bp, Homo sapiens
aatttacttgttttgg

SEQ ID NO: 686355 - DNA, 13 bp, Homo sapiens
aatttagaaactg

SEQ ID NO: 686356 - DNA, 20 bp, Homo sapiens
aatttataagcattgccatt

SEQ ID NO: 686357 - DNA, 16 bp, Homo sapiens
aatttatatgtatatt

SEQ ID NO: 686358 - DNA, 16 bp, Homo sapiens
aatttatattatccat

SEQ ID NO: 686359 - DNA, 15 bp, Homo sapiens
aatttatgtgaaatg

SEQ ID NO: 686360 - DNA, 19 bp, Homo sapiens
aatttatttcaataaatct

SEQ ID NO: 686361 - DNA, 23 bp, Homo sapiens
aatttatttcaataaatctttca

SEQ ID NO: 686362 - DNA, 20 bp, Homo sapiens
aatttatttcttaacctttg

SEQ ID NO: 686363 - DNA, 21 bp, Homo sapiens
aatttcaaaatacatttgtaa

SEQ ID NO: 686364 - DNA, 23 bp, Homo sapiens
aatttcaaaatacatttgtaagt

SEQ ID NO: 686365 - DNA, 22 bp, Homo sapiens
aatttgaacaggtcaaagatgt

SEQ ID NO: 686366 - DNA, 21 bp, Homo sapiens
aatttgaagtaacttatttga

SEQ ID NO: 686367 - DNA, 17 bp, Homo sapiens
aatttgagccatttaaa

SEQ ID NO: 686368 - DNA, 13 bp, Homo sapiens
aatttgctttaat

SEQ ID NO: 686369 - DNA, 14 bp, Homo sapiens
aatttggggaaaat

SEQ ID NO: 686370 - DNA, 17 bp, Homo sapiens
aatttgtaaaacttctg

SEQ ID NO: 686371 - DNA, 19 bp, Homo sapiens
aatttgtttgtgttcaata

SEQ ID NO: 686372 - DNA, 22 bp, Homo sapiens
aatttgttttgctgagagcata

SEQ ID NO: 686373 - DNA, 20 bp, Homo sapiens
aattttaatgctgtttctaa

SEQ ID NO: 686374 - DNA, 21 bp, Homo sapiens
aattttaatgctgtttctaag

SEQ ID NO: 686375 - DNA, 13 bp, Homo sapiens
aattttacacatt

SEQ ID NO: 686376 - DNA, 12 bp, Homo sapiens
aattttaggaac

SEQ ID NO: 686377 - DNA, 23 bp, Homo sapiens
aattttattttgtgctcatttaa

SEQ ID NO: 686378 - DNA, 19 bp, Homo sapiens
aattttcacacacgtgaga

SEQ ID NO: 686379 - DNA, 17 bp, Homo sapiens
aattttcagctgcaagg

SEQ ID NO: 686380 - DNA, 16 bp, Homo sapiens
aattttctgtaatctt

SEQ ID NO: 686381 - DNA, 20 bp, Homo sapiens
aattttgtatgttaaagaga

SEQ ID NO: 686382 - DNA, 14 bp, Homo sapiens
aattttgtgtaaga

SEQ ID NO: 686383 - DNA, 16 bp, Homo sapiens
aatttttaggcaaaga

SEQ ID NO: 686384 - DNA, 19 bp, Homo sapiens
aatttttatttatttttct

SEQ ID NO: 686385 - DNA, 12 bp, Homo sapiens
aatttttgtatt

SEQ ID NO: 686386 - DNA, 13 bp, Homo sapiens
aatttttgtattt

SEQ ID NO: 686387 - DNA, 15 bp, Homo sapiens
aattttttttaaaga

SEQ ID NO: 686388 - DNA, 15 bp, Homo sapiens
acaaaaaaaatttta

SEQ ID NO: 686389 - DNA, 21 bp, Homo sapiens
acaaaaaagacttgagacaat

SEQ ID NO: 686390 - DNA, 12 bp, Homo sapiens
acaaaaataata

SEQ ID NO: 686391 - DNA, 11 bp, Homo sapiens
acaaaaggaat

SEQ ID NO: 686392 - DNA, 20 bp, Homo sapiens
acaaaagttctgcgtaatga

SEQ ID NO: 686393 - DNA, 15 bp, Homo sapiens
acaaaattttatttt

SEQ ID NO: 686394 - DNA, 14 bp, Homo sapiens
acaaacagtatttc

SEQ ID NO: 686395 - DNA, 22 bp, Homo sapiens
acaaactcatcctcttttaatg

SEQ ID NO: 686396 - DNA, 14 bp, Homo sapiens
acaaatacatgtgt

SEQ ID NO: 686397 - DNA, 19 bp, Homo sapiens
acaaatacatgtgtatatt

SEQ ID NO: 686398 - DNA, 17 bp, Homo sapiens
acaaatcagttagtttt

SEQ ID NO: 686399 - DNA, 12 bp, Homo sapiens
acaaattttcaa

SEQ ID NO: 686400 - DNA, 17 bp, Homo sapiens
acaaattttcaagttta

SEQ ID NO: 686401 - DNA, 19 bp, Homo sapiens
acaacaaaaaatacattat

SEQ ID NO: 686402 - DNA, 15 bp, Homo sapiens
acaacatccactgtt

SEQ ID NO: 686403 - DNA, 12 bp, Homo sapiens
acaacatttatg

SEQ ID NO: 686404 - DNA, 13 bp, Homo sapiens
acaacatttatgt

SEQ ID NO: 686405 - DNA, 19 bp, Homo sapiens
acaacccttctctgttggt

SEQ ID NO: 686406 - DNA, 18 bp, Homo sapiens
acaactatttactttttt

SEQ ID NO: 686407 - DNA, 12 bp, Homo sapiens
acaagaaaatgt

SEQ ID NO: 686408 - DNA, 16 bp, Homo sapiens
acaagacagaggggag

SEQ ID NO: 686409 - DNA, 19 bp, Homo sapiens
acaagacagaggggagcag

SEQ ID NO: 686410 - DNA, 15 bp, Homo sapiens
acaagagatctacac

SEQ ID NO: 686411 - DNA, 18 bp, Homo sapiens
acaagagatctacacatg

SEQ ID NO: 686412 - DNA, 19 bp, Homo sapiens
acaagagatctacacatgt

SEQ ID NO: 686413 - DNA, 16 bp, Homo sapiens
acaagtaaatatatat

SEQ ID NO: 686414 - DNA, 22 bp, Homo sapiens
acaagttcgagtcaaagttgaa

SEQ ID NO: 686415 - DNA, 22 bp, Homo sapiens
acaataattctacatgttgtct

SEQ ID NO: 686416 - DNA, 22 bp, Homo sapiens
acaatacagtattatagacaaa

SEQ ID NO: 686417 - DNA, 23 bp, Homo sapiens
acaataggagtggtgatttgaaa

SEQ ID NO: 686418 - DNA, 13 bp, Homo sapiens
acaatcaaatctc

SEQ ID NO: 686419 - DNA, 17 bp, Homo sapiens
acaatcaaatctcctgc

SEQ ID NO: 686420 - DNA, 20 bp, Homo sapiens
acaatctatggcttatttct

SEQ ID NO: 686421 - DNA, 13 bp, Homo sapiens
acaatggaataaa

SEQ ID NO: 686422 - DNA, 18 bp, Homo sapiens
acaattattggcaaagtt

SEQ ID NO: 686423 - DNA, 15 bp, Homo sapiens
acaattcttgaattc

SEQ ID NO: 686424 - DNA, 20 bp, Homo sapiens
acaattttctgtaatctttt

SEQ ID NO: 686425 - DNA, 13 bp, Homo sapiens
acacaaattttca

SEQ ID NO: 686426 - DNA, 14 bp, Homo sapiens
acacaatacagtat

SEQ ID NO: 686427 - DNA, 16 bp, Homo sapiens
accttgctctcctcat

SEQ ID NO: 686428 - DNA, 22 bp, Homo sapiens
accttgcttcttactgataatt

SEQ ID NO: 686429 - DNA, 14 bp, Homo sapiens
accttgtgcctggg

SEQ ID NO: 686430 - DNA, 19 bp, Homo sapiens
acctttaacttttttttct

SEQ ID NO: 686431 - DNA, 22 bp, Homo sapiens
acctttattcagaactttagta

SEQ ID NO: 686432 - DNA, 13 bp, Homo sapiens
acctttctctctc

SEQ ID NO: 686433 - DNA, 20 bp, Homo sapiens
acctttgagtagatccattt

SEQ ID NO: 686434 - DNA, 15 bp, Homo sapiens
acctttgctatgtaa

SEQ ID NO: 686435 - DNA, 14 bp, Homo sapiens
accttttaactcac

SEQ ID NO: 686436 - DNA, 21 bp, Homo sapiens
acgaaatacgttaggaggaca

SEQ ID NO: 686437 - DNA, 21 bp, Homo sapiens
acgaaggtaaaaagtattttt

SEQ ID NO: 686438 - DNA, 17 bp, Homo sapiens
acgagggtctcccctcc

SEQ ID NO: 686439 - DNA, 19 bp, Homo sapiens
acgagggtctcccctcctg

SEQ ID NO: 686440 - DNA, 20 bp, Homo sapiens
acgagggtctcccctcctgc

SEQ ID NO: 686441 - DNA, 21 bp, Homo sapiens
acgagttaatgatggcagagg

SEQ ID NO: 686442 - DNA, 18 bp, Homo sapiens
acgatcaggaggaagtga

SEQ ID NO: 686443 - DNA, 15 bp, Homo sapiens
acgatgatgtacaga

SEQ ID NO: 686444 - DNA, 14 bp, Homo sapiens
acgattttgcacaa

SEQ ID NO: 686445 - DNA, 22 bp, Homo sapiens
acgcccgagagcctcgcttttt

SEQ ID NO: 686446 - DNA, 16 bp, Homo sapiens
acgcgtctgcctgggc

SEQ ID NO: 686447 - DNA, 19 bp, Homo sapiens
acggaaaatgcttaaaaaa

SEQ ID NO: 686448 - DNA, 23 bp, Homo sapiens
acggccaagaatgtacgtccagc

SEQ ID NO: 686449 - DNA, 16 bp, Homo sapiens
acggcgcctttttggc

SEQ ID NO: 686450 - DNA, 19 bp, Homo sapiens
acgggacatcacagggtgg

SEQ ID NO: 686451 - DNA, 12 bp, Homo sapiens
acgggaggggag

SEQ ID NO: 686452 - DNA, 19 bp, Homo sapiens
acgggaggggaggcattga

SEQ ID NO: 686453 - DNA, 14 bp, Homo sapiens
acggtttccaggga

SEQ ID NO: 686454 - DNA, 18 bp, Homo sapiens
acgtctggactgctattc

SEQ ID NO: 686455 - DNA, 14 bp, Homo sapiens
acgtgacaggctcg

SEQ ID NO: 686456 - DNA, 16 bp, Homo sapiens
acgtggagctcttggc

SEQ ID NO: 686457 - DNA, 20 bp, Homo sapiens
acgtggcacacactgaccac

SEQ ID NO: 686458 - DNA, 11 bp, Homo sapiens
acgtttataaa

SEQ ID NO: 686459 - DNA, 15 bp, Homo sapiens
actaacattgtgact

SEQ ID NO: 686460 - DNA, 14 bp, Homo sapiens
actaaggcaggtgg

SEQ ID NO: 686461 - DNA, 22 bp, Homo sapiens
actaagtccctataataaaggc

SEQ ID NO: 686462 - DNA, 23 bp, Homo sapiens
actaagtccctataataaaggct

SEQ ID NO: 686463 - DNA, 13 bp, Homo sapiens
actaagttcacat

SEQ ID NO: 686464 - DNA, 16 bp, Homo sapiens
actaataaatataatt

SEQ ID NO: 686465 - DNA, 13 bp, Homo sapiens
actaatgatgttt

SEQ ID NO: 686466 - DNA, 19 bp, Homo sapiens
actaatgtttgaacaaagc

SEQ ID NO: 686467 - DNA, 15 bp, Homo sapiens
actaattttacttct

SEQ ID NO: 686468 - DNA, 11 bp, Homo sapiens
actacacaata

SEQ ID NO: 686469 - DNA, 13 bp, Homo sapiens
actacatctggga

SEQ ID NO: 686470 - DNA, 15 bp, Homo sapiens
actacatctgggact

SEQ ID NO: 686471 - DNA, 14 bp, Homo sapiens
actacggttgggag

SEQ ID NO: 686472 - DNA, 16 bp, Homo sapiens
actacgtcttaagtca

SEQ ID NO: 686473 - DNA, 17 bp, Homo sapiens
actactgaaacagattt

SEQ ID NO: 686474 - DNA, 21 bp, Homo sapiens
actactttgccttcttttgta

SEQ ID NO: 686475 - DNA, 19 bp, Homo sapiens
actagaagattagaaacta

SEQ ID NO: 686476 - DNA, 20 bp, Homo sapiens
actatagcttgcagaactgt

SEQ ID NO: 686477 - DNA, 19 bp, Homo sapiens
actatattgattgtccttt

SEQ ID NO: 686478 - DNA, 15 bp, Homo sapiens
actatcctgtaaata

SEQ ID NO: 686479 - DNA, 19 bp, Homo sapiens
actatcctgtaaatatatc

SEQ ID NO: 686480 - DNA, 14 bp, Homo sapiens
actatgggtgagca

SEQ ID NO: 686481 - DNA, 21 bp, Homo sapiens
actattggaatctgatatact

SEQ ID NO: 686482 - DNA, 17 bp, Homo sapiens
actatttaagatgtgaa

SEQ ID NO: 686483 - DNA, 15 bp, Homo sapiens
actatttatatcaca

SEQ ID NO: 686484 - DNA, 20 bp, Homo sapiens
actatttatatcacacaata

SEQ ID NO: 686485 - DNA, 22 bp, Homo sapiens
actatttctgggtcttttgcta

SEQ ID NO: 686486 - DNA, 17 bp, Homo sapiens
actatttgctaatgtat

SEQ ID NO: 686487 - DNA, 21 bp, Homo sapiens
actcaagagaatttatgtgaa

SEQ ID NO: 686488 - DNA, 20 bp, Homo sapiens
actcaaggtttaaccttaaa

SEQ ID NO: 686489 - DNA, 18 bp, Homo sapiens
actcagaattatttttaa

SEQ ID NO: 686490 - DNA, 17 bp, Homo sapiens
actcagcctagcacagg

SEQ ID NO: 686491 - DNA, 19 bp, Homo sapiens
actcaggccacagtggggc

SEQ ID NO: 686492 - DNA, 24 bp, Homo sapiens
actcaggccacagtggggctgcag

SEQ ID NO: 686493 - DNA, 22 bp, Homo sapiens
actcagtgtgtgatccggtttc

SEQ ID NO: 686494 - DNA, 23 bp, Homo sapiens
actcagtgtgtgatccggtttct

SEQ ID NO: 686495 - DNA, 16 bp, Homo sapiens
actcatcctcttttaa

SEQ ID NO: 686496 - DNA, 23 bp, Homo sapiens
actcatcctcttttaatggcatt

SEQ ID NO: 686497 - DNA, 18 bp, Homo sapiens
actcatttatctcctctt

SEQ ID NO: 686498 - DNA, 15 bp, Homo sapiens
actccaggccctcct

SEQ ID NO: 686499 - DNA, 13 bp, Homo sapiens
actccatgctcct

SEQ ID NO: 686500 - DNA, 19 bp, Homo sapiens
actccatgctccttgagag

SEQ ID NO: 686501 - DNA, 16 bp, Homo sapiens
actccccaacccccaa

SEQ ID NO: 686502 - DNA, 18 bp, Homo sapiens
actcccccaccactcagg

SEQ ID NO: 686503 - DNA, 14 bp, Homo sapiens
actcctcagtccct

SEQ ID NO: 686504 - DNA, 14 bp, Homo sapiens
actcctgcctcatg

SEQ ID NO: 686505 - DNA, 22 bp, Homo sapiens
actcctggcagggccacctgca

SEQ ID NO: 686506 - DNA, 23 bp, Homo sapiens
actcctggcagggccacctgcag

SEQ ID NO: 686507 - DNA, 13 bp, Homo sapiens
actcctggccttt

SEQ ID NO: 686508 - DNA, 14 bp, Homo sapiens
actcctttcttatc

SEQ ID NO: 686509 - DNA, 14 bp, Homo sapiens
actctaaagtctgt

SEQ ID NO: 686510 - DNA, 14 bp, Homo sapiens
actctgcatgtaga

SEQ ID NO: 686511 - DNA, 17 bp, Homo sapiens
actctggggtgctgcct

SEQ ID NO: 686512 - DNA, 12 bp, Homo sapiens
actctgtaattg

SEQ ID NO: 686513 - DNA, 16 bp, Homo sapiens
actcttgatctctctt

SEQ ID NO: 686514 - DNA, 21 bp, Homo sapiens
actcttgatctctcttgtcct

SEQ ID NO: 686515 - DNA, 20 bp, Homo sapiens
actcttggtcagcttttgtt

SEQ ID NO: 686516 - DNA, 19 bp, Homo sapiens
actctttagatatttacat

SEQ ID NO: 686517 - DNA, 15 bp, Homo sapiens
actgaaaaatatctg

SEQ ID NO: 686518 - DNA, 14 bp, Homo sapiens
actgaaattacttt

SEQ ID NO: 686519 - DNA, 18 bp, Homo sapiens
actgaaattactttaaca

SEQ ID NO: 686520 - DNA, 14 bp, Homo sapiens
actgaattgtatca

SEQ ID NO: 686521 - DNA, 22 bp, Homo sapiens
actgaattgtcagatgtggagt

SEQ ID NO: 686522 - DNA, 13 bp, Homo sapiens
actgacatttctt

SEQ ID NO: 686523 - DNA, 21 bp, Homo sapiens
actgaccacacattaggctgt

SEQ ID NO: 686524 - DNA, 17 bp, Homo sapiens
actgaccggtgctttta

SEQ ID NO: 686525 - DNA, 21 bp, Homo sapiens
actgactcctcagtccctctt

SEQ ID NO: 686526 - DNA, 20 bp, Homo sapiens
actgactggaggaggcctgt

SEQ ID NO: 686527 - DNA, 17 bp, Homo sapiens
actgaggtttttttgct

SEQ ID NO: 686528 - DNA, 15 bp, Homo sapiens
actgatgattttcct

SEQ ID NO: 686529 - DNA, 16 bp, Homo sapiens
actgatggaaaatacc

SEQ ID NO: 686530 - DNA, 13 bp, Homo sapiens
actgatgttgtgt

SEQ ID NO: 686531 - DNA, 17 bp, Homo sapiens
actgatgttgtgttttt

SEQ ID NO: 686532 - DNA, 18 bp, Homo sapiens
actgattattttcttcat

SEQ ID NO: 686533 - DNA, 16 bp, Homo sapiens
actgcaaataaagcct

SEQ ID NO: 686534 - DNA, 19 bp, Homo sapiens
actgcaacctcacctcccg

SEQ ID NO: 686535 - DNA, 12 bp, Homo sapiens
actgcaatgaaa

SEQ ID NO: 686536 - DNA, 15 bp, Homo sapiens
actgcaatgaaagtc

SEQ ID NO: 686537 - DNA, 17 bp, Homo sapiens
actgcactccagcctgg

SEQ ID NO: 686538 - DNA, 19 bp, Homo sapiens
actgcactccagcctgggg

SEQ ID NO: 686539 - DNA, 16 bp, Homo sapiens
actgcaggaaaaccct

SEQ ID NO: 686540 - DNA, 16 bp, Homo sapiens
actgccaggctgcctc

SEQ ID NO: 686541 - DNA, 14 bp, Homo sapiens
actgcctgaataaa

SEQ ID NO: 686542 - DNA, 15 bp, Homo sapiens
actgccttcctcctt

SEQ ID NO: 686543 - DNA, 15 bp, Homo sapiens
actgccttgaaaaat

SEQ ID NO: 686544 - DNA, 19 bp, Homo sapiens
actgctacctttcaaagct

SEQ ID NO: 686545 - DNA, 17 bp, Homo sapiens
actgctactatctgttt

SEQ ID NO: 686546 - DNA, 17 bp, Homo sapiens
actgctattctagagct

SEQ ID NO: 686547 - DNA, 20 bp, Homo sapiens
agaacactgtagctacattt

SEQ ID NO: 686548 - DNA, 22 bp, Homo sapiens
agaacactgtagctacattttc

SEQ ID NO: 686549 - DNA, 22 bp, Homo sapiens
agaacaggaggtgtgaatgcac

SEQ ID NO: 686550 - DNA, 11 bp, Homo sapiens
agaacagggtc

SEQ ID NO: 686551 - DNA, 16 bp, Homo sapiens
agaaccacacttgaaa

SEQ ID NO: 686552 - DNA, 22 bp, Homo sapiens
agaacctacagactccatctct

SEQ ID NO: 686553 - DNA, 21 bp, Homo sapiens
agaacttactgattattttct

SEQ ID NO: 686554 - DNA, 19 bp, Homo sapiens
agaagacatactgcttgat

SEQ ID NO: 686555 - DNA, 12 bp, Homo sapiens
agaagacatgaa

SEQ ID NO: 686556 - DNA, 15 bp, Homo sapiens
agaagacatgaacca

SEQ ID NO: 686557 - DNA, 12 bp, Homo sapiens
agaagacatttt

SEQ ID NO: 686558 - DNA, 15 bp, Homo sapiens
agaagacattttgtt

SEQ ID NO: 686559 - DNA, 16 bp, Homo sapiens
agaagacgggagggga

SEQ ID NO: 686560 - DNA, 17 bp, Homo sapiens
agaagacgggaggggag

SEQ ID NO: 686561 - DNA, 20 bp, Homo sapiens
agaagacgggaggggaggca

SEQ ID NO: 686562 - DNA, 22 bp, Homo sapiens
agaagacgggaggggaggcatt

SEQ ID NO: 686563 - DNA, 13 bp, Homo sapiens
agaagagaagtga

SEQ ID NO: 686564 - DNA, 23 bp, Homo sapiens
agaagcagttgtaccaagtgaaa

SEQ ID NO: 686565 - DNA, 15 bp, Homo sapiens
agaagccccgacaca

SEQ ID NO: 686566 - DNA, 23 bp, Homo sapiens
agaagctgctccaggcctgcagc

SEQ ID NO: 686567 - DNA, 16 bp, Homo sapiens
agaagggaatcctcct

SEQ ID NO: 686568 - DNA, 18 bp, Homo sapiens
agaagggaatcctcctcc

SEQ ID NO: 686569 - DNA, 17 bp, Homo sapiens
agaaggtttattgttaa

SEQ ID NO: 686570 - DNA, 13 bp, Homo sapiens
agaagttaacatc

SEQ ID NO: 686571 - DNA, 17 bp, Homo sapiens
agaagttcatgtccaaa

SEQ ID NO: 686572 - DNA, 20 bp, Homo sapiens
agaagttgtttgaggcaaat

SEQ ID NO: 686573 - DNA, 19 bp, Homo sapiens
agaataattcttttctgag

SEQ ID NO: 686574 - DNA, 18 bp, Homo sapiens
agaataccacatcaaata

SEQ ID NO: 686575 - DNA, 13 bp, Homo sapiens
agaatatttacta

SEQ ID NO: 686576 - DNA, 15 bp, Homo sapiens
agaatccagtattat

SEQ ID NO: 686577 - DNA, 16 bp, Homo sapiens
agaatgaaagctgttc

SEQ ID NO: 686578 - DNA, 21 bp, Homo sapiens
agaatgaaagctgttccttgg

SEQ ID NO: 686579 - DNA, 17 bp, Homo sapiens
agaatgactgacaaaga

SEQ ID NO: 686580 - DNA, 21 bp, Homo sapiens
agaatgagtccttgatttcaa

SEQ ID NO: 686581 - DNA, 16 bp, Homo sapiens
agaatgatgcacactg

SEQ ID NO: 686582 - DNA, 14 bp, Homo sapiens
agaatgcttaaaaa

SEQ ID NO: 686583 - DNA, 22 bp, Homo sapiens
agaatgttactgactcctcagt

SEQ ID NO: 686584 - DNA, 23 bp, Homo sapiens
agaattctgattgatttgattgg

SEQ ID NO: 686585 - DNA, 16 bp, Homo sapiens
agaattgaaaagtttt

SEQ ID NO: 686586 - DNA, 19 bp, Homo sapiens
agaattgaaaagtttttgt

SEQ ID NO: 686587 - DNA, 16 bp, Homo sapiens
agaattgaattggaaa

SEQ ID NO: 686588 - DNA, 17 bp, Homo sapiens
agaattgaattggaaag

SEQ ID NO: 686589 - DNA, 16 bp, Homo sapiens
agaatttagtattatc

SEQ ID NO: 686590 - DNA, 13 bp, Homo sapiens
agaattttaggaa

SEQ ID NO: 686591 - DNA, 16 bp, Homo sapiens
agacaaagatttcttc

SEQ ID NO: 686592 - DNA, 18 bp, Homo sapiens
agacaaatggaggaatat

SEQ ID NO: 686593 - DNA, 14 bp, Homo sapiens
agacaagagatcta

SEQ ID NO: 686594 - DNA, 19 bp, Homo sapiens
agacaagagatctacacat

SEQ ID NO: 686595 - DNA, 17 bp, Homo sapiens
agacaatgttttcttca

SEQ ID NO: 686596 - DNA, 13 bp, Homo sapiens
agacacagctctt

SEQ ID NO: 686597 - DNA, 13 bp, Homo sapiens
agacatttgctga

SEQ ID NO: 686598 - DNA, 18 bp, Homo sapiens
agacatttgctgaactca

SEQ ID NO: 686599 - DNA, 22 bp, Homo sapiens
agacatttgctgaactcagcac

SEQ ID NO: 686600 - DNA, 15 bp, Homo sapiens
agacatttgtttgct

SEQ ID NO: 686601 - DNA, 13 bp, Homo sapiens
agacattttgtta

SEQ ID NO: 686602 - DNA, 14 bp, Homo sapiens
agaccatcctggct

SEQ ID NO: 686603 - DNA, 20 bp, Homo sapiens
agaccccctcagccttggga

SEQ ID NO: 686604 - DNA, 15 bp, Homo sapiens
agaccctcttgccca

SEQ ID NO: 686605 - DNA, 19 bp, Homo sapiens
agaccctcttgcccatcct

SEQ ID NO: 686606 - DNA, 22 bp, Homo sapiens
agaccctgcaaacagaacaggg

SEQ ID NO: 686607 - DNA, 13 bp, Homo sapiens
agacgcagagcaa

SEQ ID NO: 686608 - DNA, 15 bp, Homo sapiens
agacgggaggggagg

SEQ ID NO: 686609 - DNA, 18 bp, Homo sapiens
agacgggaggggaggcat

SEQ ID NO: 686610 - DNA, 13 bp, Homo sapiens
agacgtttataaa

SEQ ID NO: 686611 - DNA, 16 bp, Homo sapiens
agacgtttataaacag

SEQ ID NO: 686612 - DNA, 13 bp, Homo sapiens
agactaaattcaa

SEQ ID NO: 686613 - DNA, 21 bp, Homo sapiens
agactatatatataaatgtat

SEQ ID NO: 686614 - DNA, 13 bp, Homo sapiens
agactatttcttt

SEQ ID NO: 686615 - DNA, 16 bp, Homo sapiens
agactatttcttttta

SEQ ID NO: 686616 - DNA, 14 bp, Homo sapiens
agactcaaaaaaac

SEQ ID NO: 686617 - DNA, 21 bp, Homo sapiens
agactcaagagaatttatgtg

SEQ ID NO: 686618 - DNA, 18 bp, Homo sapiens
agactcagtgcagatgga

SEQ ID NO: 686619 - DNA, 16 bp, Homo sapiens
agactccatctcttct

SEQ ID NO: 686620 - DNA, 18 bp, Homo sapiens
agactccatctcttctgc

SEQ ID NO: 686621 - DNA, 13 bp, Homo sapiens
agactcgagaacc

SEQ ID NO: 686622 - DNA, 13 bp, Homo sapiens
agactctgtctca

SEQ ID NO: 686623 - DNA, 16 bp, Homo sapiens
agactgtgccagaggc

SEQ ID NO: 686624 - DNA, 20 bp, Homo sapiens
agactgtgccagaggccaga

SEQ ID NO: 686625 - DNA, 19 bp, Homo sapiens
agactgtggctagtgacaa

SEQ ID NO: 686626 - DNA, 15 bp, Homo sapiens
agacttgagacaatg

SEQ ID NO: 686627 - DNA, 13 bp, Homo sapiens
agactttctcctg

SEQ ID NO: 686628 - DNA, 20 bp, Homo sapiens
agactttgtgactgtcactt

SEQ ID NO: 686629 - DNA, 17 bp, Homo sapiens
agacttttggtagagaa

SEQ ID NO: 686630 - DNA, 18 bp, Homo sapiens
agagaaaagaaaaatcaa

SEQ ID NO: 686631 - DNA, 18 bp, Homo sapiens
agagaaatcagctgctat

SEQ ID NO: 686632 - DNA, 20 bp, Homo sapiens
agagaacctcagattcttca

SEQ ID NO: 686633 - DNA, 23 bp, Homo sapiens
agagaaggaaaagactgaatcta

SEQ ID NO: 686634 - DNA, 21 bp, Homo sapiens
agagagttaataggagtattt

SEQ ID NO: 686635 - DNA, 21 bp, Homo sapiens
agagataggaaactgaagcat

SEQ ID NO: 686636 - DNA, 13 bp, Homo sapiens
agagatctacaca

SEQ ID NO: 686637 - DNA, 14 bp, Homo sapiens
agagatctacacat

SEQ ID NO: 686638 - DNA, 18 bp, Homo sapiens
agagatctacacatgttg

SEQ ID NO: 686639 - DNA, 23 bp, Homo sapiens
agagatgctgtaacttaaaatag

SEQ ID NO: 686640 - DNA, 13 bp, Homo sapiens
agagatttctcat

SEQ ID NO: 686641 - DNA, 17 bp, Homo sapiens
agagatttgtctaattg

SEQ ID NO: 686642 - DNA, 20 bp, Homo sapiens
agagcagaacagatctttta

SEQ ID NO: 686643 - DNA, 22 bp, Homo sapiens
agagcctcctgggaacacatct

SEQ ID NO: 686644 - DNA, 17 bp, Homo sapiens
agagcctcgctttttca

SEQ ID NO: 686645 - DNA, 12 bp, Homo sapiens
agagcctggggg

SEQ ID NO: 686646 - DNA, 19 bp, Homo sapiens
agagcgagaccctgtctca

SEQ ID NO: 686647 - DNA, 21 bp, Homo sapiens
agagctaataaatctcttctt

SEQ ID NO: 686648 - DNA, 22 bp, Homo sapiens
agagcttggacagtctgagctg

SEQ ID NO: 686649 - DNA, 19 bp, Homo sapiens
agagcttggactacacaat

SEQ ID NO: 686650 - DNA, 20 bp, Homo sapiens
agagcttggactacacaata

SEQ ID NO: 686651 - DNA, 17 bp, Homo sapiens
agaggagcgcaggcagc

SEQ ID NO: 686652 - DNA, 21 bp, Homo sapiens
agaggagtaaataattggaaa

SEQ ID NO: 686653 - DNA, 22 bp, Homo sapiens
agaggcaggggcttgctttgca

SEQ ID NO: 686654 - DNA, 10 bp, Homo sapiens
agaggctcag

SEQ ID NO: 686655 - DNA, 18 bp, Homo sapiens
agaggctcagattgtaat

SEQ ID NO: 686656 - DNA, 19 bp, Homo sapiens
agaggctgaaagaggccaa

SEQ ID NO: 686657 - DNA, 16 bp, Homo sapiens
agaggctgcccctctc

SEQ ID NO: 686658 - DNA, 19 bp, Homo sapiens
agaggctgcccctctcacc

SEQ ID NO: 686659 - DNA, 22 bp, Homo sapiens
agagggacggccaagaatgtac

SEQ ID NO: 686660 - DNA, 15 bp, Homo sapiens
agaggtaccctgggt

SEQ ID NO: 686661 - DNA, 18 bp, Homo sapiens
agagtaattcatctgtga

SEQ ID NO: 686662 - DNA, 16 bp, Homo sapiens
agagtacctgtgtgtt

SEQ ID NO: 686663 - DNA, 22 bp, Homo sapiens
agagtgacttattttgtcttat

SEQ ID NO: 686664 - DNA, 14 bp, Homo sapiens
agagtggcgtggcc

SEQ ID NO: 686665 - DNA, 23 bp, Homo sapiens
agagttaataggagtatttttgg

SEQ ID NO: 686666 - DNA, 21 bp, Homo sapiens
agagtttcagtttgttggaaa

SEQ ID NO: 686667 - DNA, 14 bp, Homo sapiens
aggaagcagaagac

SEQ ID NO: 686668 - DNA, 22 bp, Homo sapiens
aggaatatgacggaagaacata

SEQ ID NO: 686669 - DNA, 17 bp, Homo sapiens
aggaatcattcagaaat

SEQ ID NO: 686670 - DNA, 23 bp, Homo sapiens
aggaatcattcagaaatgttgag

SEQ ID NO: 686671 - DNA, 21 bp, Homo sapiens
aggaattaccaagaatatcct

SEQ ID NO: 686672 - DNA, 18 bp, Homo sapiens
aggaatttgatgattttc

SEQ ID NO: 686673 - DNA, 16 bp, Homo sapiens
aggacagttgattcaa

SEQ ID NO: 686674 - DNA, 13 bp, Homo sapiens
aggacatgcaata

SEQ ID NO: 686675 - DNA, 20 bp, Homo sapiens
aggacatgcaataaaattta

SEQ ID NO: 686676 - DNA, 21 bp, Homo sapiens
aggacatgcaataaaatttaa

SEQ ID NO: 686677 - DNA, 15 bp, Homo sapiens
aggaccagggccttt

SEQ ID NO: 686678 - DNA, 13 bp, Homo sapiens
aggaccctgtcct

SEQ ID NO: 686679 - DNA, 16 bp, Homo sapiens
aggaccctgtcctgca

SEQ ID NO: 686680 - DNA, 17 bp, Homo sapiens
aggaccctgtcctgcag

SEQ ID NO: 686681 - DNA, 17 bp, Homo sapiens
aggacttgatgtacata

SEQ ID NO: 686682 - DNA, 21 bp, Homo sapiens
aggacttgtctccatgtgtat

SEQ ID NO: 686683 - DNA, 14 bp, Homo sapiens
aggagaaatctcag

SEQ ID NO: 686684 - DNA, 18 bp, Homo sapiens
aggagaaatgcaataact

SEQ ID NO: 686685 - DNA, 19 bp, Homo sapiens
aggagaaatgcaataactc

SEQ ID NO: 686686 - DNA, 20 bp, Homo sapiens
aggagaaatgcaataactct

SEQ ID NO: 686687 - DNA, 12 bp, Homo sapiens
aggagagcctgg

SEQ ID NO: 686688 - DNA, 15 bp, Homo sapiens
aggagagcctggggg

SEQ ID NO: 686689 - DNA, 20 bp, Homo sapiens
aggagaggcaaagaaaggag

SEQ ID NO: 686690 - DNA, 19 bp, Homo sapiens
aggagagtctgaatatttt

SEQ ID NO: 686691 - DNA, 23 bp, Homo sapiens
aggagcccgaagtctgctgctgt

SEQ ID NO: 686692 - DNA, 19 bp, Homo sapiens
aggagcttcttcgttcctg

SEQ ID NO: 686693 - DNA, 16 bp, Homo sapiens
aggaggacaaaaggaa

SEQ ID NO: 686694 - DNA, 20 bp, Homo sapiens
aggaggatgtccctgggcca

SEQ ID NO: 686695 - DNA, 14 bp, Homo sapiens
aggaggcctgtccc

SEQ ID NO: 686696 - DNA, 17 bp, Homo sapiens
aggagggggccgggcgc

SEQ ID NO: 686697 - DNA, 18 bp, Homo sapiens
aggagggggcctcattgt

SEQ ID NO: 686698 - DNA, 16 bp, Homo sapiens
aggagggtttgggcag

SEQ ID NO: 686699 - DNA, 17 bp, Homo sapiens
aggagggtttgggcaga

SEQ ID NO: 686700 - DNA, 19 bp, Homo sapiens
aggagggtttgggcagagc

SEQ ID NO: 686701 - DNA, 20 bp, Homo sapiens
aggagtctgggtccatcctg

SEQ ID NO: 686702 - DNA, 19 bp, Homo sapiens
aggatatccttatcagagc

SEQ ID NO: 686703 - DNA, 20 bp, Homo sapiens
aggatatccttatcagagct

SEQ ID NO: 686704 - DNA, 21 bp, Homo sapiens
aggatatcggcatttgtttct

SEQ ID NO: 686705 - DNA, 23 bp, Homo sapiens
aggatggtgctgagtaaacataa

SEQ ID NO: 686706 - DNA, 21 bp, Homo sapiens
aggatgtccctgggccagggt

SEQ ID NO: 686707 - DNA, 23 bp, Homo sapiens
aggatgtccctgggccagggtct

SEQ ID NO: 686708 - DNA, 18 bp, Homo sapiens
aggattattgatagtact

SEQ ID NO: 686709 - DNA, 22 bp, Homo sapiens
aggcaaagataatttatttcaa

SEQ ID NO: 686710 - DNA, 18 bp, Homo sapiens
aggcaccgagaatgttgt

SEQ ID NO: 686711 - DNA, 21 bp, Homo sapiens
aggcacttaaagccttttcct

SEQ ID NO: 686712 - DNA, 14 bp, Homo sapiens
aggcagagaacaga

SEQ ID NO: 686713 - DNA, 22 bp, Homo sapiens
aggcagagaacagaactggagg

SEQ ID NO: 686714 - DNA, 13 bp, Homo sapiens
aggcagcgcaggg

SEQ ID NO: 686715 - DNA, 14 bp, Homo sapiens
aggcagctgcctct

SEQ ID NO: 686716 - DNA, 16 bp, Homo sapiens
aggcagctgcctctgc

SEQ ID NO: 686717 - DNA, 21 bp, Homo sapiens
aggcagcttctactcctgcct

SEQ ID NO: 686718 - DNA, 16 bp, Homo sapiens
aggcaggaggatcact

SEQ ID NO: 686719 - DNA, 14 bp, Homo sapiens
aggcaggcatggcc

SEQ ID NO: 686720 - DNA, 17 bp, Homo sapiens
aggcaggcatggccctg

SEQ ID NO: 686721 - DNA, 18 bp, Homo sapiens
aggcaggcatggccctgg

SEQ ID NO: 686722 - DNA, 20 bp, Homo sapiens
aggcaggcggctcctcctca

SEQ ID NO: 686723 - DNA, 23 bp, Homo sapiens
aggcagggagacggtttccaggg

SEQ ID NO: 686724 - DNA, 14 bp, Homo sapiens
aggcatggccctgg

SEQ ID NO: 686725 - DNA, 15 bp, Homo sapiens
aggcatggccctggg

SEQ ID NO: 686726 - DNA, 19 bp, Homo sapiens
aggcattaatgtttctatc

SEQ ID NO: 686727 - DNA, 21 bp, Homo sapiens
aggcattaatgtttctatctg

SEQ ID NO: 686728 - DNA, 19 bp, Homo sapiens
aggcattgacataggtcat

SEQ ID NO: 686729 - DNA, 21 bp, Homo sapiens
aggccacagtggggctgcagg

SEQ ID NO: 686730 - DNA, 23 bp, Homo sapiens
aggccacagtggggctgcaggca

SEQ ID NO: 686731 - DNA, 23 bp, Homo sapiens
aggcccatgtatataagtactga

SEQ ID NO: 686732 - DNA, 23 bp, Homo sapiens
aggcccgcttgctgggtacctgg

SEQ ID NO: 686733 - DNA, 15 bp, Homo sapiens
aggccctcctgtgct

SEQ ID NO: 686734 - DNA, 19 bp, Homo sapiens
aggcctaattctatgcctg

SEQ ID NO: 686735 - DNA, 16 bp, Homo sapiens
aggcctcgagcagaga

SEQ ID NO: 686736 - DNA, 17 bp, Homo sapiens
aggcctcgagcagagag

SEQ ID NO: 686737 - DNA, 17 bp, Homo sapiens
aggcctgacttctgctg

SEQ ID NO: 686738 - DNA, 13 bp, Homo sapiens
aggcctgcacagg

SEQ ID NO: 686739 - DNA, 18 bp, Homo sapiens
aggcctgcctcccacttc

SEQ ID NO: 686740 - DNA, 17 bp, Homo sapiens
aggcctgcgaccctggg

SEQ ID NO: 686741 - DNA, 18 bp, Homo sapiens
aggcctgcgaccctgggg

SEQ ID NO: 686742 - DNA, 20 bp, Homo sapiens
aggcctgggctggttggaga

SEQ ID NO: 686743 - DNA, 12 bp, Homo sapiens
aggcctgtccca

SEQ ID NO: 686744 - DNA, 20 bp, Homo sapiens
aggcctgtcccttgcctctg

SEQ ID NO: 686745 - DNA, 19 bp, Homo sapiens
aggcctgtgctagaagctc

SEQ ID NO: 686746 - DNA, 14 bp, Homo sapiens
aggctacagaacta

SEQ ID NO: 686747 - DNA, 15 bp, Homo sapiens
aggctacagaactaa

SEQ ID NO: 686748 - DNA, 15 bp, Homo sapiens
aggctaccagaagag

SEQ ID NO: 686749 - DNA, 15 bp, Homo sapiens
aggctagacagaaac

SEQ ID NO: 686750 - DNA, 15 bp, Homo sapiens
aggctatgccatgtg

SEQ ID NO: 686751 - DNA, 16 bp, Homo sapiens
aggctatgccatgtgc

SEQ ID NO: 686752 - DNA, 19 bp, Homo sapiens
aggctatgtataaaataca

SEQ ID NO: 686753 - DNA, 20 bp, Homo sapiens
aggctgaaatatccacccag

SEQ ID NO: 686754 - DNA, 22 bp, Homo sapiens
aggctgaaatatccacccagca

SEQ ID NO: 686755 - DNA, 23 bp, Homo sapiens
aggctgaaatatccacccagcag

SEQ ID NO: 686756 - DNA, 14 bp, Homo sapiens
aggctgatgccact

SEQ ID NO: 686757 - DNA, 14 bp, Homo sapiens
aggctgatgggcaa

SEQ ID NO: 686758 - DNA, 18 bp, Homo sapiens
aggctgatgggcaaaaaa

SEQ ID NO: 686759 - DNA, 12 bp, Homo sapiens
aggctgcccctc

SEQ ID NO: 686760 - DNA, 16 bp, Homo sapiens
aggctgcctcctgccc

SEQ ID NO: 686761 - DNA, 16 bp, Homo sapiens
aggctggctgtgtata

SEQ ID NO: 686762 - DNA, 19 bp, Homo sapiens
aggctggtacaacggaggc

SEQ ID NO: 686763 - DNA, 19 bp, Homo sapiens
aggcttaattgactgaaat

SEQ ID NO: 686764 - DNA, 21 bp, Homo sapiens
aggcttaattgactgaaatta

SEQ ID NO: 686765 - DNA, 14 bp, Homo sapiens
aggcttctgcagtt

SEQ ID NO: 686766 - DNA, 21 bp, Homo sapiens
aggcttgtttacctttctctc

SEQ ID NO: 686767 - DNA, 22 bp, Homo sapiens
aggctttctgttgccatggtga

SEQ ID NO: 686768 - DNA, 15 bp, Homo sapiens
agggaagagtagctg

SEQ ID NO: 686769 - DNA, 16 bp, Homo sapiens
agggaagctggcctga

SEQ ID NO: 686770 - DNA, 15 bp, Homo sapiens
agggaatcctcctcc

SEQ ID NO: 686771 - DNA, 12 bp, Homo sapiens
agggaattgctc

SEQ ID NO: 686772 - DNA, 13 bp, Homo sapiens
agggaattgctca

SEQ ID NO: 686773 - DNA, 16 bp, Homo sapiens
agggacacatatcaaa

SEQ ID NO: 686774 - DNA, 19 bp, Homo sapiens
agggacggccaagaatgta

SEQ ID NO: 686775 - DNA, 20 bp, Homo sapiens
agggacggccaagaatgtac

SEQ ID NO: 686776 - DNA, 13 bp, Homo sapiens
agggacttagcaa

SEQ ID NO: 686777 - DNA, 19 bp, Homo sapiens
agggagcagggaaggcctg

SEQ ID NO: 686778 - DNA, 15 bp, Homo sapiens
agggaggccccaggg

SEQ ID NO: 686779 - DNA, 16 bp, Homo sapiens
agggaggccccagggg

SEQ ID NO: 686780 - DNA, 15 bp, Homo sapiens
agggagtgctggctc

SEQ ID NO: 686781 - DNA, 17 bp, Homo sapiens
agggagtgctggctcac

SEQ ID NO: 686782 - DNA, 23 bp, Homo sapiens
agggagtgctggctcacagtaca

SEQ ID NO: 686783 - DNA, 24 bp, Homo sapiens
agggagtgctggctcacagtacag

SEQ ID NO: 686784 - DNA, 20 bp, Homo sapiens
agggataaagaaaaaaatac

SEQ ID NO: 686785 - DNA, 21 bp, Homo sapiens
agggataaagaaaaaaatact

SEQ ID NO: 686786 - DNA, 19 bp, Homo sapiens
agtttttagaatgttgaaa

SEQ ID NO: 686787 - DNA, 17 bp, Homo sapiens
agtttttggttgggaat

SEQ ID NO: 686788 - DNA, 16 bp, Homo sapiens
agtttttgtttggaga

SEQ ID NO: 686789 - DNA, 12 bp, Homo sapiens
agtttttttgct

SEQ ID NO: 686790 - DNA, 19 bp, Homo sapiens
ataaaaacattttgaagtg

SEQ ID NO: 686791 - DNA, 17 bp, Homo sapiens
ataaaatacatagtgaa

SEQ ID NO: 686792 - DNA, 15 bp, Homo sapiens
ataaaatagaataat

SEQ ID NO: 686793 - DNA, 12 bp, Homo sapiens
ataaaatatcat

SEQ ID NO: 686794 - DNA, 16 bp, Homo sapiens
ataaaatatcataaag

SEQ ID NO: 686795 - DNA, 17 bp, Homo sapiens
ataaaatatcataaagc

SEQ ID NO: 686796 - DNA, 17 bp, Homo sapiens
ataaaatggacacaaat

SEQ ID NO: 686797 - DNA, 12 bp, Homo sapiens
ataaaatttaaa

SEQ ID NO: 686798 - DNA, 14 bp, Homo sapiens
ataaaattttgctt

SEQ ID NO: 686799 - DNA, 16 bp, Homo sapiens
ataaaattttgctttt

SEQ ID NO: 686800 - DNA, 19 bp, Homo sapiens
ataaacagacaatatgtga

SEQ ID NO: 686801 - DNA, 15 bp, Homo sapiens
ataaaccaataaatc

SEQ ID NO: 686802 - DNA, 19 bp, Homo sapiens
ataaactatttatatcaca

SEQ ID NO: 686803 - DNA, 16 bp, Homo sapiens
ataaacttcctttttt

SEQ ID NO: 686804 - DNA, 16 bp, Homo sapiens
ataaagacccaggggg

SEQ ID NO: 686805 - DNA, 13 bp, Homo sapiens
ataaagcttaaat

SEQ ID NO: 686806 - DNA, 18 bp, Homo sapiens
ataaagcttaaattttat

SEQ ID NO: 686807 - DNA, 17 bp, Homo sapiens
ataaagcttaggtcaaa

SEQ ID NO: 686808 - DNA, 10 bp, Homo sapiens
ataaagcttt

SEQ ID NO: 686809 - DNA, 16 bp, Homo sapiens
ataaaggcagctgcct

SEQ ID NO: 686810 - DNA, 12 bp, Homo sapiens
ataaagtacaaa

SEQ ID NO: 686811 - DNA, 15 bp, Homo sapiens
ataaagtacaaatga

SEQ ID NO: 686812 - DNA, 19 bp, Homo sapiens
ataaataaaattcatttct

SEQ ID NO: 686813 - DNA, 15 bp, Homo sapiens
ataaatataatttat

SEQ ID NO: 686814 - DNA, 15 bp, Homo sapiens
ataaatgcataattt

SEQ ID NO: 686815 - DNA, 18 bp, Homo sapiens
ataaatgcataatttatg

SEQ ID NO: 686816 - DNA, 23 bp, Homo sapiens
ataaatgggtgtatataatttta

SEQ ID NO: 686817 - DNA, 19 bp, Homo sapiens
ataaatgtataaatataca

SEQ ID NO: 686818 - DNA, 14 bp, Homo sapiens
ataaattagttgtt

SEQ ID NO: 686819 - DNA, 19 bp, Homo sapiens
ataaattatggcatttcta

SEQ ID NO: 686820 - DNA, 15 bp, Homo sapiens
ataaattcaactttg

SEQ ID NO: 686821 - DNA, 20 bp, Homo sapiens
ataaattcaactttgtaaaa

SEQ ID NO: 686822 - DNA, 18 bp, Homo sapiens
ataaattgtagggcttta

SEQ ID NO: 686823 - DNA, 12 bp, Homo sapiens
ataaatttaatc

SEQ ID NO: 686824 - DNA, 23 bp, Homo sapiens
ataacacatttttttgcatgcat

SEQ ID NO: 686825 - DNA, 14 bp, Homo sapiens
ataacactgtattt

SEQ ID NO: 686826 - DNA, 21 bp, Homo sapiens
ataacactgtattttaatgta

SEQ ID NO: 686827 - DNA, 11 bp, Homo sapiens
ataacatatat

SEQ ID NO: 686828 - DNA, 14 bp, Homo sapiens
ataacatatatgga

SEQ ID NO: 686829 - DNA, 13 bp, Homo sapiens
ataactcaacatt

SEQ ID NO: 686830 - DNA, 17 bp, Homo sapiens
ataactcctgtcccttt

SEQ ID NO: 686831 - DNA, 22 bp, Homo sapiens
ataactcctgtcccttttccct

SEQ ID NO: 686832 - DNA, 12 bp, Homo sapiens
ataacttcctgt

SEQ ID NO: 686833 - DNA, 18 bp, Homo sapiens
ataagaaagcctaaaatt

SEQ ID NO: 686834 - DNA, 15 bp, Homo sapiens
ataagacaaaaataa

SEQ ID NO: 686835 - DNA, 14 bp, Homo sapiens
ataagcaagagaga

SEQ ID NO: 686836 - DNA, 16 bp, Homo sapiens
ataagcaagagagatg

SEQ ID NO: 686837 - DNA, 17 bp, Homo sapiens
ataagcactgtaaactt

SEQ ID NO: 686838 - DNA, 17 bp, Homo sapiens
ataagctaaagaggctg

SEQ ID NO: 686839 - DNA, 13 bp, Homo sapiens
ataaggatgactt

SEQ ID NO: 686840 - DNA, 13 bp, Homo sapiens
ataagtagtaaat

SEQ ID NO: 686841 - DNA, 14 bp, Homo sapiens
ataataaagaatag

SEQ ID NO: 686842 - DNA, 12 bp, Homo sapiens
ataataaatact

SEQ ID NO: 686843 - DNA, 14 bp, Homo sapiens
ataataaatactca

SEQ ID NO: 686844 - DNA, 13 bp, Homo sapiens
ataataagctaaa

SEQ ID NO: 686845 - DNA, 16 bp, Homo sapiens
ataatagtcaatttct

SEQ ID NO: 686846 - DNA, 23 bp, Homo sapiens
ataatagtcaatttctacttctg

SEQ ID NO: 686847 - DNA, 12 bp, Homo sapiens
ataatataaaaa

SEQ ID NO: 686848 - DNA, 14 bp, Homo sapiens
ataatatatattaa

SEQ ID NO: 686849 - DNA, 21 bp, Homo sapiens
ataatattgtttggtaaatgt

SEQ ID NO: 686850 - DNA, 20 bp, Homo sapiens
ataatatttttgtatttctc

SEQ ID NO: 686851 - DNA, 14 bp, Homo sapiens
ataatcagtaaata

SEQ ID NO: 686852 - DNA, 15 bp, Homo sapiens
ataatcagtaaatag

SEQ ID NO: 686853 - DNA, 17 bp, Homo sapiens
ataatgaagaacactgt

SEQ ID NO: 686854 - DNA, 17 bp, Homo sapiens
ataatgctacaatttta

SEQ ID NO: 686855 - DNA, 14 bp, Homo sapiens
ataatgtattttct

SEQ ID NO: 686856 - DNA, 13 bp, Homo sapiens
ataattgtacaaa

SEQ ID NO: 686857 - DNA, 15 bp, Homo sapiens
ataattgtacaaaat

SEQ ID NO: 686858 - DNA, 21 bp, Homo sapiens
ataattgtacaaaattaagca

SEQ ID NO: 686859 - DNA, 15 bp, Homo sapiens
ataatttatttcaat

SEQ ID NO: 686860 - DNA, 18 bp, Homo sapiens
ataattttaatattcttt

SEQ ID NO: 686861 - DNA, 12 bp, Homo sapiens
ataattttgcaa

SEQ ID NO: 686862 - DNA, 13 bp, Homo sapiens
ataattttgctgg

SEQ ID NO: 686863 - DNA, 22 bp, Homo sapiens
ataattttgctggaattcctaa

SEQ ID NO: 686864 - DNA, 16 bp, Homo sapiens
ataattttttttaaag

SEQ ID NO: 686865 - DNA, 17 bp, Homo sapiens
atacaagaaaatgtatc

SEQ ID NO: 686866 - DNA, 15 bp, Homo sapiens
atacaagattgaaaa

SEQ ID NO: 686867 - DNA, 13 bp, Homo sapiens
atacaagtaattt

SEQ ID NO: 686868 - DNA, 22 bp, Homo sapiens
atacacatttgctactgttgta

SEQ ID NO: 686869 - DNA, 17 bp, Homo sapiens
atacagctgaagtcaaa

SEQ ID NO: 686870 - DNA, 16 bp, Homo sapiens
atacatagtgaaaatt

SEQ ID NO: 686871 - DNA, 18 bp, Homo sapiens
atacatagtgaaaattgt

SEQ ID NO: 686872 - DNA, 22 bp, Homo sapiens
atacatattgtatatatattca

SEQ ID NO: 686873 - DNA, 17 bp, Homo sapiens
atacatgccacatcaaa

SEQ ID NO: 686874 - DNA, 19 bp, Homo sapiens
atacatgtgatacattttt

SEQ ID NO: 686875 - DNA, 17 bp, Homo sapiens
atacattataacaacta

SEQ ID NO: 686876 - DNA, 18 bp, Homo sapiens
atacattccctctaattt

SEQ ID NO: 686877 - DNA, 22 bp, Homo sapiens
atacattgtcttgatgtttttt

SEQ ID NO: 686878 - DNA, 23 bp, Homo sapiens
atacatttgtaagtgtaaaaaat

SEQ ID NO: 686879 - DNA, 16 bp, Homo sapiens
atacattttctaaata

SEQ ID NO: 686880 - DNA, 18 bp, Homo sapiens
atacattttctaaataaa

SEQ ID NO: 686881 - DNA, 16 bp, Homo sapiens
atacattttttaagct

SEQ ID NO: 686882 - DNA, 13 bp, Homo sapiens
ataccacatcaaa

SEQ ID NO: 686883 - DNA, 20 bp, Homo sapiens
ataccactttgacacgcttc

SEQ ID NO: 686884 - DNA, 14 bp, Homo sapiens
ataccaggcagtgt

SEQ ID NO: 686885 - DNA, 18 bp, Homo sapiens
ataccatttagtaagaat

SEQ ID NO: 686886 - DNA, 11 bp, Homo sapiens
atacctggagc

SEQ ID NO: 686887 - DNA, 17 bp, Homo sapiens
atacctgtctcagctgt

SEQ ID NO: 686888 - DNA, 15 bp, Homo sapiens
atacgcttttctttg

SEQ ID NO: 686889 - DNA, 14 bp, Homo sapiens
atactaataaatat

SEQ ID NO: 686890 - DNA, 18 bp, Homo sapiens
atactaataaatataatt

SEQ ID NO: 686891 - DNA, 21 bp, Homo sapiens
atactaataaatataatttat

SEQ ID NO: 686892 - DNA, 23 bp, Homo sapiens
atactaataaatataatttataa

SEQ ID NO: 686893 - DNA, 14 bp, Homo sapiens
atactactgaaaca

SEQ ID NO: 686894 - DNA, 19 bp, Homo sapiens
atactactgaaacagattt

SEQ ID NO: 686895 - DNA, 18 bp, Homo sapiens
atactatttaagatgtga

SEQ ID NO: 686896 - DNA, 13 bp, Homo sapiens
atactgtatttct

SEQ ID NO: 686897 - DNA, 22 bp, Homo sapiens
atactgtgtgcttgttttataa

SEQ ID NO: 686898 - DNA, 22 bp, Homo sapiens
atacttgcaagataattttcag

SEQ ID NO: 686899 - DNA, 13 bp, Homo sapiens
atacttgtgaaac

SEQ ID NO: 686900 - DNA, 13 bp, Homo sapiens
atactttatttct

SEQ ID NO: 686901 - DNA, 20 bp, Homo sapiens
atagaaaattcttgagaagt

SEQ ID NO: 686902 - DNA, 22 bp, Homo sapiens
atagagatttgtctaattgcat

SEQ ID NO: 686903 - DNA, 23 bp, Homo sapiens
atagaggatagggagaatattta

SEQ ID NO: 686904 - DNA, 23 bp, Homo sapiens
atagatcctggttaccactcttt

SEQ ID NO: 686905 - DNA, 18 bp, Homo sapiens
atagatgctgtgtatatg

SEQ ID NO: 686906 - DNA, 15 bp, Homo sapiens
atagatgttgctctt

SEQ ID NO: 686907 - DNA, 12 bp, Homo sapiens
atgaaagaaaat

SEQ ID NO: 686908 - DNA, 22 bp, Homo sapiens
atgaaagagccagactctgtct

SEQ ID NO: 686909 - DNA, 16 bp, Homo sapiens
atgaaagctgttcctt

SEQ ID NO: 686910 - DNA, 12 bp, Homo sapiens
atgaaagtcaaa

SEQ ID NO: 686911 - DNA, 14 bp, Homo sapiens
atgaaatgacttct

SEQ ID NO: 686912 - DNA, 23 bp, Homo sapiens
atgaagcaattagtctgaaactg

SEQ ID NO: 686913 - DNA, 13 bp, Homo sapiens
atgaagctgttgt

SEQ ID NO: 686914 - DNA, 14 bp, Homo sapiens
atgaagggccagca

SEQ ID NO: 686915 - DNA, 22 bp, Homo sapiens
atgaagggccagcatatatact

SEQ ID NO: 686916 - DNA, 23 bp, Homo sapiens
atgaagggccagcatatatactt

SEQ ID NO: 686917 - DNA, 20 bp, Homo sapiens
atgaagtcataggttacaga

SEQ ID NO: 686918 - DNA, 16 bp, Homo sapiens
atgaagtgcgtgaatg

SEQ ID NO: 686919 - DNA, 18 bp, Homo sapiens
atgaatgcagattacact

SEQ ID NO: 686920 - DNA, 16 bp, Homo sapiens
atgacaattgtgaaca

SEQ ID NO: 686921 - DNA, 17 bp, Homo sapiens
atgacattaaatgcaat

SEQ ID NO: 686922 - DNA, 21 bp, Homo sapiens
atgacctgaaataatatattt

SEQ ID NO: 686923 - DNA, 14 bp, Homo sapiens
atgactaaagagag

SEQ ID NO: 686924 - DNA, 22 bp, Homo sapiens
atgacttagcgtcaagacattt

SEQ ID NO: 686925 - DNA, 17 bp, Homo sapiens
atgagaatataccttat

SEQ ID NO: 686926 - DNA, 21 bp, Homo sapiens
atgagactttccgactgcttt

SEQ ID NO: 686927 - DNA, 20 bp, Homo sapiens
atgagattggttttcctgtg

SEQ ID NO: 686928 - DNA, 11 bp, Homo sapiens
atgagccagac

SEQ ID NO: 686929 - DNA, 17 bp, Homo sapiens
atgagctctgaaatctt

SEQ ID NO: 686930 - DNA, 24 bp, Homo sapiens
atgaggaggatgtccctgggccag

SEQ ID NO: 686931 - DNA, 21 bp, Homo sapiens
atgagtctttgagactaaatt

SEQ ID NO: 686932 - DNA, 18 bp, Homo sapiens
atgatatttcttgctttc

SEQ ID NO: 686933 - DNA, 18 bp, Homo sapiens
atgatgaaaaggttgcct

SEQ ID NO: 686934 - DNA, 21 bp, Homo sapiens
atgatgtacagattctttcag

SEQ ID NO: 686935 - DNA, 21 bp, Homo sapiens
atgatttcagtcatagcaagc

SEQ ID NO: 686936 - DNA, 20 bp, Homo sapiens
atgattttcctttttcttcg

SEQ ID NO: 686937 - DNA, 23 bp, Homo sapiens
atgattttcctttttcttcgctg

SEQ ID NO: 686938 - DNA, 13 bp, Homo sapiens
atgcaaaatttag

SEQ ID NO: 686939 - DNA, 14 bp, Homo sapiens
atgcaaaatttaga

SEQ ID NO: 686940 - DNA, 14 bp, Homo sapiens
atgcaaatgagctc

SEQ ID NO: 686941 - DNA, 20 bp, Homo sapiens
atgcaaatgagctctgaaat

SEQ ID NO: 686942 - DNA, 21 bp, Homo sapiens
atgcaactctaactctgagag

SEQ ID NO: 686943 - DNA, 17 bp, Homo sapiens
atgcaataactctggga

SEQ ID NO: 686944 - DNA, 15 bp, Homo sapiens
atgcaattagaattt

SEQ ID NO: 686945 - DNA, 19 bp, Homo sapiens
atgcaatttgaagtaactt

SEQ ID NO: 686946 - DNA, 20 bp, Homo sapiens
atgcacttttagaaatgcat

SEQ ID NO: 686947 - DNA, 21 bp, Homo sapiens
atgcacttttagaaatgcata

SEQ ID NO: 686948 - DNA, 22 bp, Homo sapiens
atgcacttttagaaatgcatat

SEQ ID NO: 686949 - DNA, 15 bp, Homo sapiens
atgcagcaaatatat

SEQ ID NO: 686950 - DNA, 16 bp, Homo sapiens
atgcagccgtgatcaa

SEQ ID NO: 686951 - DNA, 16 bp, Homo sapiens
atgcagcggcgtgagg

SEQ ID NO: 686952 - DNA, 15 bp, Homo sapiens
atgcataatttatgg

SEQ ID NO: 686953 - DNA, 18 bp, Homo sapiens
atgcatatcctgagccat

SEQ ID NO: 686954 - DNA, 14 bp, Homo sapiens
atgcatatttgcca

SEQ ID NO: 686955 - DNA, 13 bp, Homo sapiens
atgcatgcaaatg

SEQ ID NO: 686956 - DNA, 22 bp, Homo sapiens
atgcattgttgttctgctcaat

SEQ ID NO: 686957 - DNA, 13 bp, Homo sapiens
atgcatttgaggt

SEQ ID NO: 686958 - DNA, 17 bp, Homo sapiens
atgcatttgaggtcaag

SEQ ID NO: 686959 - DNA, 23 bp, Homo sapiens
atgcatttgaggtcaagtaagaa

SEQ ID NO: 686960 - DNA, 14 bp, Homo sapiens
atgccacctggcaa

SEQ ID NO: 686961 - DNA, 19 bp, Homo sapiens
atgccgtcctgcagtcctt

SEQ ID NO: 686962 - DNA, 19 bp, Homo sapiens
atgcctagcacaagtacca

SEQ ID NO: 686963 - DNA, 16 bp, Homo sapiens
atgcctggcacagctt

SEQ ID NO: 686964 - DNA, 12 bp, Homo sapiens
atgcctgtcctt

SEQ ID NO: 686965 - DNA, 19 bp, Homo sapiens
atgcctgtcttaattttct

SEQ ID NO: 686966 - DNA, 16 bp, Homo sapiens
atgccttaatttagaa

SEQ ID NO: 686967 - DNA, 14 bp, Homo sapiens
atgcgtttcatgta

SEQ ID NO: 686968 - DNA, 17 bp, Homo sapiens
atgctaaacctttgagt

SEQ ID NO: 686969 - DNA, 15 bp, Homo sapiens
atgctcactttatta

SEQ ID NO: 686970 - DNA, 13 bp, Homo sapiens
atgctccccacag

SEQ ID NO: 686971 - DNA, 21 bp, Homo sapiens
atgctccccacagcgtccctg

SEQ ID NO: 686972 - DNA, 22 bp, Homo sapiens
atgctccccacagcgtccctgg

SEQ ID NO: 686973 - DNA, 22 bp, Homo sapiens
atgctctgcagcattgaagtat

SEQ ID NO: 686974 - DNA, 19 bp, Homo sapiens
atgctgatcatcgccagag

SEQ ID NO: 686975 - DNA, 22 bp, Homo sapiens
atgctgatcatcgccagaggtg

SEQ ID NO: 686976 - DNA, 15 bp, Homo sapiens
atgctgatcttttaa

SEQ ID NO: 686977 - DNA, 20 bp, Homo sapiens
atgctgtaacttaaaatagg

SEQ ID NO: 686978 - DNA, 20 bp, Homo sapiens
atgctgttagtaaatttctg

SEQ ID NO: 686979 - DNA, 14 bp, Homo sapiens
atgctgtttctaag

SEQ ID NO: 686980 - DNA, 20 bp, Homo sapiens
atgctgtttctaagaaaatg

SEQ ID NO: 686981 - DNA, 20 bp, Homo sapiens
atgcttcatcattccctctc

SEQ ID NO: 686982 - DNA, 22 bp, Homo sapiens
atgcttcatcattccctctcat

SEQ ID NO: 686983 - DNA, 20 bp, Homo sapiens
atgcttcattattcaagaat

SEQ ID NO: 686984 - DNA, 16 bp, Homo sapiens
atgcttcctgacaatc

SEQ ID NO: 686985 - DNA, 21 bp, Homo sapiens
atgcttgccatctgttcattt

SEQ ID NO: 686986 - DNA, 13 bp, Homo sapiens
atggaaacggtga

SEQ ID NO: 686987 - DNA, 18 bp, Homo sapiens
atggaaatacagttattt

SEQ ID NO: 686988 - DNA, 17 bp, Homo sapiens
atggaacagatttcaaa

SEQ ID NO: 686989 - DNA, 20 bp, Homo sapiens
atggaacataaagttgtatt

SEQ ID NO: 686990 - DNA, 21 bp, Homo sapiens
atggaacataaagttgtattg

SEQ ID NO: 686991 - DNA, 13 bp, Homo sapiens
atggaggaatatg

SEQ ID NO: 686992 - DNA, 23 bp, Homo sapiens
atggatatatttgaaatagtata

SEQ ID NO: 686993 - DNA, 22 bp, Homo sapiens
atggatttggcactagccaaag

SEQ ID NO: 686994 - DNA, 16 bp, Homo sapiens
atggcagaagggaatt

SEQ ID NO: 686995 - DNA, 19 bp, Homo sapiens
atggcagcctactctcctt

SEQ ID NO: 686996 - DNA, 14 bp, Homo sapiens
atggcaggactcct

SEQ ID NO: 686997 - DNA, 16 bp, Homo sapiens
atggcaggactcctgg

SEQ ID NO: 686998 - DNA, 16 bp, Homo sapiens
atggcatttctcttta

SEQ ID NO: 686999 - DNA, 21 bp, Homo sapiens
atggcatttctctttaaacta

SEQ ID NO: 687000 - DNA, 23 bp, Homo sapiens
atggcatttctctttaaactatg

SEQ ID NO: 687001 - DNA, 14 bp, Homo sapiens
atggccacatttaa

SEQ ID NO: 687002 - DNA, 15 bp, Homo sapiens
atggccacatttaat

SEQ ID NO: 687003 - DNA, 13 bp, Homo sapiens
atggctcagggtg

SEQ ID NO: 687004 - DNA, 22 bp, Homo sapiens
atggctctgcacccctctgccc

SEQ ID NO: 687005 - DNA, 20 bp, Homo sapiens
atggctgtctcaaaccaagc

SEQ ID NO: 687006 - DNA, 14 bp, Homo sapiens
atggcttatttcta

SEQ ID NO: 687007 - DNA, 22 bp, Homo sapiens
atggcttatttctatgacaaat

SEQ ID NO: 687008 - DNA, 14 bp, Homo sapiens
atggcttcaccaag

SEQ ID NO: 687009 - DNA, 22 bp, Homo sapiens
atggcttcttctagaatgtaaa

SEQ ID NO: 687010 - DNA, 13 bp, Homo sapiens
atggcttgtctat

SEQ ID NO: 687011 - DNA, 17 bp, Homo sapiens
atgggaattggaatcaa

SEQ ID NO: 687012 - DNA, 12 bp, Homo sapiens
atgggcccctgg

SEQ ID NO: 687013 - DNA, 14 bp, Homo sapiens
atgggcccctggca

SEQ ID NO: 687014 - DNA, 22 bp, Homo sapiens
atgggcttttggggagccagaa

SEQ ID NO: 687015 - DNA, 14 bp, Homo sapiens
atgggttgcatttg

SEQ ID NO: 687016 - DNA, 13 bp, Homo sapiens
atggtaataagca

SEQ ID NO: 687017 - DNA, 14 bp, Homo sapiens
atggtatatataca

SEQ ID NO: 687018 - DNA, 13 bp, Homo sapiens
atggtcatataca

SEQ ID NO: 687019 - DNA, 17 bp, Homo sapiens
atggtcattgcagttta

SEQ ID NO: 687020 - DNA, 14 bp, Homo sapiens
atggtgatgactta

SEQ ID NO: 687021 - DNA, 12 bp, Homo sapiens
atggtgtgttca

SEQ ID NO: 687022 - DNA, 19 bp, Homo sapiens
atgtaaaagaacttactga

SEQ ID NO: 687023 - DNA, 14 bp, Homo sapiens
atgtaaaatgaatt

SEQ ID NO: 687024 - DNA, 13 bp, Homo sapiens
atgtaaagttaaa

SEQ ID NO: 687025 - DNA, 15 bp, Homo sapiens
atgtaaagttatgta

SEQ ID NO: 687026 - DNA, 17 bp, Homo sapiens
atgtaaataaactattt

SEQ ID NO: 687027 - DNA, 14 bp, Homo sapiens
attggggaggaggg

SEQ ID NO: 687028 - DNA, 19 bp, Homo sapiens
attggtatagccatgattt

SEQ ID NO: 687029 - DNA, 13 bp, Homo sapiens
attgtaaaagcat

SEQ ID NO: 687030 - DNA, 18 bp, Homo sapiens
attgtaagtgaaattaag

SEQ ID NO: 687031 - DNA, 20 bp, Homo sapiens
attgtaagtgaaattaagca

SEQ ID NO: 687032 - DNA, 18 bp, Homo sapiens
attgtacaaaattaagca

SEQ ID NO: 687033 - DNA, 21 bp, Homo sapiens
attgtacaaaattaagcaaat

SEQ ID NO: 687034 - DNA, 13 bp, Homo sapiens
attgtcacctctg

SEQ ID NO: 687035 - DNA, 20 bp, Homo sapiens
attgtctactcctagaagaa

SEQ ID NO: 687036 - DNA, 21 bp, Homo sapiens
attgtctactcctagaagaac

SEQ ID NO: 687037 - DNA, 14 bp, Homo sapiens
attgtctcaacgcc

SEQ ID NO: 687038 - DNA, 23 bp, Homo sapiens
attgtctcaacgcctccccctcc

SEQ ID NO: 687039 - DNA, 16 bp, Homo sapiens
attgtcttgatgtttt

SEQ ID NO: 687040 - DNA, 14 bp, Homo sapiens
attgtgaagtacat

SEQ ID NO: 687041 - DNA, 20 bp, Homo sapiens
attgtgcagtactttgtgca

SEQ ID NO: 687042 - DNA, 20 bp, Homo sapiens
attgtggtcacaacttgatg

SEQ ID NO: 687043 - DNA, 12 bp, Homo sapiens
attgtgtattta

SEQ ID NO: 687044 - DNA, 13 bp, Homo sapiens
attgtgtctcccg

SEQ ID NO: 687045 - DNA, 14 bp, Homo sapiens
attgttaatacaag

SEQ ID NO: 687046 - DNA, 19 bp, Homo sapiens
attgttaatacaaggtata

SEQ ID NO: 687047 - DNA, 17 bp, Homo sapiens
attgttggcacagaaca

SEQ ID NO: 687048 - DNA, 19 bp, Homo sapiens
attgttgtatatcactaaa

SEQ ID NO: 687049 - DNA, 15 bp, Homo sapiens
attgtttaaaatgta

SEQ ID NO: 687050 - DNA, 16 bp, Homo sapiens
attgtttaaaatgtaa

SEQ ID NO: 687051 - DNA, 20 bp, Homo sapiens
attgtttacgtttgatacaa

SEQ ID NO: 687052 - DNA, 17 bp, Homo sapiens
attgtttcctcttccaa

SEQ ID NO: 687053 - DNA, 20 bp, Homo sapiens
attgtttcctcttccaaagt

SEQ ID NO: 687054 - DNA, 13 bp, Homo sapiens
attgttttactcc

SEQ ID NO: 687055 - DNA, 21 bp, Homo sapiens
atttaaaaagctcactgctga

SEQ ID NO: 687056 - DNA, 21 bp, Homo sapiens
atttaaaacattaaaatataa

SEQ ID NO: 687057 - DNA, 17 bp, Homo sapiens
atttaaaattgctatgt

SEQ ID NO: 687058 - DNA, 17 bp, Homo sapiens
atttaaactatcttgtg

SEQ ID NO: 687059 - DNA, 16 bp, Homo sapiens
atttaaagttgtatct

SEQ ID NO: 687060 - DNA, 17 bp, Homo sapiens
atttaaagttgtatctt

SEQ ID NO: 687061 - DNA, 23 bp, Homo sapiens
atttaaagttgtatcttgacaca

SEQ ID NO: 687062 - DNA, 13 bp, Homo sapiens
atttaaatatctg

SEQ ID NO: 687063 - DNA, 15 bp, Homo sapiens
atttaaatatctgtt

SEQ ID NO: 687064 - DNA, 12 bp, Homo sapiens
atttaaggtatt

SEQ ID NO: 687065 - DNA, 12 bp, Homo sapiens
atttaatacagc

SEQ ID NO: 687066 - DNA, 22 bp, Homo sapiens
atttaatacagctgaagtcaaa

SEQ ID NO: 687067 - DNA, 19 bp, Homo sapiens
atttaataccagatacctt

SEQ ID NO: 687068 - DNA, 12 bp, Homo sapiens
atttaatatcaa

SEQ ID NO: 687069 - DNA, 16 bp, Homo sapiens
atttacaaaagattta

SEQ ID NO: 687070 - DNA, 19 bp, Homo sapiens
atttacaaaagatttattg

SEQ ID NO: 687071 - DNA, 15 bp, Homo sapiens
atttacaatatatga

SEQ ID NO: 687072 - DNA, 16 bp, Homo sapiens
atttactaactaaata

SEQ ID NO: 687073 - DNA, 16 bp, Homo sapiens
atttacttgttttgga

SEQ ID NO: 687074 - DNA, 17 bp, Homo sapiens
atttactttaaaaagaa

SEQ ID NO: 687075 - DNA, 19 bp, Homo sapiens
atttactttaaaaagaaat

SEQ ID NO: 687076 - DNA, 13 bp, Homo sapiens
atttagaagaaaa

SEQ ID NO: 687077 - DNA, 22 bp, Homo sapiens
atttagagatgctgtaacttaa

SEQ ID NO: 687078 - DNA, 21 bp, Homo sapiens
atttagtgatcaaattgtgca

SEQ ID NO: 687079 - DNA, 13 bp, Homo sapiens
atttataagcatt

SEQ ID NO: 687080 - DNA, 21 bp, Homo sapiens
atttataagcattgccattga

SEQ ID NO: 687081 - DNA, 23 bp, Homo sapiens
atttataagcattgccattgaag

SEQ ID NO: 687082 - DNA, 22 bp, Homo sapiens
atttatacaagattgaaaatct

SEQ ID NO: 687083 - DNA, 22 bp, Homo sapiens
atttatatcacacaatatagtt

SEQ ID NO: 687084 - DNA, 20 bp, Homo sapiens
atttatattcataaagttac

SEQ ID NO: 687085 - DNA, 18 bp, Homo sapiens
atttatccaaaatgtgta

SEQ ID NO: 687086 - DNA, 16 bp, Homo sapiens
atttatccagaaaact

SEQ ID NO: 687087 - DNA, 21 bp, Homo sapiens
atttatgtagatgtgcatttt

SEQ ID NO: 687088 - DNA, 22 bp, Homo sapiens
atttatgtgaggtaattattgc

SEQ ID NO: 687089 - DNA, 15 bp, Homo sapiens
atttatgttgggtca

SEQ ID NO: 687090 - DNA, 15 bp, Homo sapiens
atttatttatccaga

SEQ ID NO: 687091 - DNA, 13 bp, Homo sapiens
atttatttcttaa

SEQ ID NO: 687092 - DNA, 13 bp, Homo sapiens
atttatttgaggt

SEQ ID NO: 687093 - DNA, 22 bp, Homo sapiens
atttcaaaatacatttgtaagt

SEQ ID NO: 687094 - DNA, 21 bp, Homo sapiens
atttcataattgcctacattt

SEQ ID NO: 687095 - DNA, 17 bp, Homo sapiens
atttcatcattgtttct

SEQ ID NO: 687096 - DNA, 14 bp, Homo sapiens
atttcatttaaata

SEQ ID NO: 687097 - DNA, 18 bp, Homo sapiens
atttcccaacacaaagat

SEQ ID NO: 687098 - DNA, 19 bp, Homo sapiens
atttccctcccaagtaaat

SEQ ID NO: 687099 - DNA, 22 bp, Homo sapiens
atttcctgagctaaatgcttca

SEQ ID NO: 687100 - DNA, 15 bp, Homo sapiens
atttctaaatttata

SEQ ID NO: 687101 - DNA, 16 bp, Homo sapiens
atttctaaatttatat

SEQ ID NO: 687102 - DNA, 14 bp, Homo sapiens
atttctaagaagtt

SEQ ID NO: 687103 - DNA, 13 bp, Homo sapiens
atttctaattgta

SEQ ID NO: 687104 - DNA, 16 bp, Homo sapiens
atttctaattgtaagt

SEQ ID NO: 687105 - DNA, 16 bp, Homo sapiens
atttctatgacaaatt

SEQ ID NO: 687106 - DNA, 17 bp, Homo sapiens
atttctatgacaaattc

SEQ ID NO: 687107 - DNA, 20 bp, Homo sapiens
atttctcaaagatctgaatt

SEQ ID NO: 687108 - DNA, 20 bp, Homo sapiens
atttctcataattttgcaaa

SEQ ID NO: 687109 - DNA, 21 bp, Homo sapiens
atttctcataggctatgccat

SEQ ID NO: 687110 - DNA, 22 bp, Homo sapiens
atttctcataggctatgccatg

SEQ ID NO: 687111 - DNA, 15 bp, Homo sapiens
atttctcattgactt

SEQ ID NO: 687112 - DNA, 20 bp, Homo sapiens
atttctccatcctgcagata

SEQ ID NO: 687113 - DNA, 21 bp, Homo sapiens
atttctcttctacccttttcc

SEQ ID NO: 687114 - DNA, 19 bp, Homo sapiens
atttctctttaaactatgt

SEQ ID NO: 687115 - DNA, 16 bp, Homo sapiens
atttctggtgtatatt

SEQ ID NO: 687116 - DNA, 23 bp, Homo sapiens
atttctgtttcctatttaataca

SEQ ID NO: 687117 - DNA, 17 bp, Homo sapiens
atttcttaacctttgct

SEQ ID NO: 687118 - DNA, 22 bp, Homo sapiens
atttcttatacgcttttctttg

SEQ ID NO: 687119 - DNA, 15 bp, Homo sapiens
atttcttccctgctt

SEQ ID NO: 687120 - DNA, 19 bp, Homo sapiens
atttcttccctgctttgca

SEQ ID NO: 687121 - DNA, 22 bp, Homo sapiens
atttcttccctgctttgcatct

SEQ ID NO: 687122 - DNA, 18 bp, Homo sapiens
atttcttcttctaagaag

SEQ ID NO: 687123 - DNA, 13 bp, Homo sapiens
atttcttgctttc

SEQ ID NO: 687124 - DNA, 15 bp, Homo sapiens
atttctttttatagg

SEQ ID NO: 687125 - DNA, 14 bp, Homo sapiens
atttgaaaaatata

SEQ ID NO: 687126 - DNA, 15 bp, Homo sapiens
atttgaaaaatataa

SEQ ID NO: 687127 - DNA, 21 bp, Homo sapiens
atttgaaatagtatacattgt

SEQ ID NO: 687128 - DNA, 17 bp, Homo sapiens
atttgaggtcagtgttt

SEQ ID NO: 687129 - DNA, 16 bp, Homo sapiens
atttgatgattttcat

SEQ ID NO: 687130 - DNA, 22 bp, Homo sapiens
atttgcaatttgagccatttaa

SEQ ID NO: 687131 - DNA, 16 bp, Homo sapiens
atttgcatattttgag

SEQ ID NO: 687132 - DNA, 19 bp, Homo sapiens
atttgccttctactcccct

SEQ ID NO: 687133 - DNA, 23 bp, Homo sapiens
atttgctaaatgctgttcttaca

SEQ ID NO: 687134 - DNA, 23 bp, Homo sapiens
atttgctaatcaaagccagggtc

SEQ ID NO: 687135 - DNA, 14 bp, Homo sapiens
atttgctaatgtat

SEQ ID NO: 687136 - DNA, 17 bp, Homo sapiens
atttgctactgttgtaa

SEQ ID NO: 687137 - DNA, 21 bp, Homo sapiens
atttgctgaactcagcacatt

SEQ ID NO: 687138 - DNA, 13 bp, Homo sapiens
atttgctgccatt

SEQ ID NO: 687139 - DNA, 15 bp, Homo sapiens
atttgctttaattaa

SEQ ID NO: 687140 - DNA, 15 bp, Homo sapiens
atttgctttggaagt

SEQ ID NO: 687141 - DNA, 20 bp, Homo sapiens
atttggtatatactttgcca

SEQ ID NO: 687142 - DNA, 23 bp, Homo sapiens
atttggtatatactttgccactg

SEQ ID NO: 687143 - DNA, 15 bp, Homo sapiens
atttgtaaaacttct

SEQ ID NO: 687144 - DNA, 18 bp, Homo sapiens
atttgtggtaatctacac

SEQ ID NO: 687145 - DNA, 19 bp, Homo sapiens
atttgtttatttgcaattt

SEQ ID NO: 687146 - DNA, 18 bp, Homo sapiens
atttgtttgctgtacaga

SEQ ID NO: 687147 - DNA, 19 bp, Homo sapiens
cacagctcttccagggcag

SEQ ID NO: 687148 - DNA, 20 bp, Homo sapiens
cacagctcttccagggcagc

SEQ ID NO: 687149 - DNA, 15 bp, Homo sapiens
cacagctgggagcct

SEQ ID NO: 687150 - DNA, 15 bp, Homo sapiens
cacaggaggcaggca

SEQ ID NO: 687151 - DNA, 21 bp, Homo sapiens
cacaggaggcaggcatggccc

SEQ ID NO: 687152 - DNA, 22 bp, Homo sapiens
cacaggaggcaggcatggccct

SEQ ID NO: 687153 - DNA, 21 bp, Homo sapiens
cacaggctgaaatatccaccc

SEQ ID NO: 687154 - DNA, 20 bp, Homo sapiens
cacagggaaaattgccccat

SEQ ID NO: 687155 - DNA, 14 bp, Homo sapiens
cacagggtgggcct

SEQ ID NO: 687156 - DNA, 19 bp, Homo sapiens
cacagtacagcatgtgcct

SEQ ID NO: 687157 - DNA, 16 bp, Homo sapiens
cacagtgcttagaagt

SEQ ID NO: 687158 - DNA, 19 bp, Homo sapiens
cacagtggctcacacctgt

SEQ ID NO: 687159 - DNA, 18 bp, Homo sapiens
cacagtggggctgcaggc

SEQ ID NO: 687160 - DNA, 21 bp, Homo sapiens
cacagtggggctgcaggcagg

SEQ ID NO: 687161 - DNA, 16 bp, Homo sapiens
cacatatttgaagggt

SEQ ID NO: 687162 - DNA, 14 bp, Homo sapiens
cacatcaaaccttt

SEQ ID NO: 687163 - DNA, 14 bp, Homo sapiens
cacatcaaataaga

SEQ ID NO: 687164 - DNA, 19 bp, Homo sapiens
cacatccgcgtgtgcctgt

SEQ ID NO: 687165 - DNA, 22 bp, Homo sapiens
cacatccgcgtgtgcctgtgtg

SEQ ID NO: 687166 - DNA, 19 bp, Homo sapiens
cacatctggctgcacaggc

SEQ ID NO: 687167 - DNA, 20 bp, Homo sapiens
cacatctggctgcacaggct

SEQ ID NO: 687168 - DNA, 22 bp, Homo sapiens
cacatctggctgcacaggctga

SEQ ID NO: 687169 - DNA, 21 bp, Homo sapiens
cacatgctgcctggcacagac

SEQ ID NO: 687170 - DNA, 16 bp, Homo sapiens
cacatgtccagcacct

SEQ ID NO: 687171 - DNA, 21 bp, Homo sapiens
cacattagattttattttact

SEQ ID NO: 687172 - DNA, 22 bp, Homo sapiens
cacattaggctgtgtcaccatt

SEQ ID NO: 687173 - DNA, 20 bp, Homo sapiens
cacattcgggaccaatatat

SEQ ID NO: 687174 - DNA, 22 bp, Homo sapiens
cacattgataaaagcattgttt

SEQ ID NO: 687175 - DNA, 22 bp, Homo sapiens
caccacgggacatcacagggtg

SEQ ID NO: 687176 - DNA, 23 bp, Homo sapiens
caccactatctccgttccatctg

SEQ ID NO: 687177 - DNA, 12 bp, Homo sapiens
caccactcaggc

SEQ ID NO: 687178 - DNA, 16 bp, Homo sapiens
caccactcaggccaca

SEQ ID NO: 687179 - DNA, 16 bp, Homo sapiens
caccagttatgtttga

SEQ ID NO: 687180 - DNA, 15 bp, Homo sapiens
caccatccagctccc

SEQ ID NO: 687181 - DNA, 18 bp, Homo sapiens
caccatccagctccccag

SEQ ID NO: 687182 - DNA, 20 bp, Homo sapiens
caccatgcccagctaatttt

SEQ ID NO: 687183 - DNA, 20 bp, Homo sapiens
cacccaaaccggcaggtgcg

SEQ ID NO: 687184 - DNA, 15 bp, Homo sapiens
caccccccactcagt

SEQ ID NO: 687185 - DNA, 19 bp, Homo sapiens
cacccgagttcctctgggt

SEQ ID NO: 687186 - DNA, 21 bp, Homo sapiens
cacccggtgggacccccgtgg

SEQ ID NO: 687187 - DNA, 20 bp, Homo sapiens
caccctgaggtcagggagtg

SEQ ID NO: 687188 - DNA, 22 bp, Homo sapiens
cacccttgcaccgtcctcagca

SEQ ID NO: 687189 - DNA, 13 bp, Homo sapiens
caccgagaatgtt

SEQ ID NO: 687190 - DNA, 13 bp, Homo sapiens
caccgagcagagg

SEQ ID NO: 687191 - DNA, 14 bp, Homo sapiens
caccgaggggcctt

SEQ ID NO: 687192 - DNA, 18 bp, Homo sapiens
caccggtcagtgcctttt

SEQ ID NO: 687193 - DNA, 14 bp, Homo sapiens
caccgtcctcagca

SEQ ID NO: 687194 - DNA, 20 bp, Homo sapiens
cacctaaaggtgtatttaaa

SEQ ID NO: 687195 - DNA, 21 bp, Homo sapiens
cacctaatgtttatgagccag

SEQ ID NO: 687196 - DNA, 17 bp, Homo sapiens
cacctcccgaagccacc

SEQ ID NO: 687197 - DNA, 15 bp, Homo sapiens
cacctcggcacacac

SEQ ID NO: 687198 - DNA, 16 bp, Homo sapiens
cacctcggcacacact

SEQ ID NO: 687199 - DNA, 22 bp, Homo sapiens
cacctctgggtccttggctccc

SEQ ID NO: 687200 - DNA, 11 bp, Homo sapiens
cacctgcagga

SEQ ID NO: 687201 - DNA, 13 bp, Homo sapiens
cacctgcaggacc

SEQ ID NO: 687202 - DNA, 11 bp, Homo sapiens
cacctggttgc

SEQ ID NO: 687203 - DNA, 19 bp, Homo sapiens
caccttcactctccagggt

SEQ ID NO: 687204 - DNA, 18 bp, Homo sapiens
caccttgtgcctggggtg

SEQ ID NO: 687205 - DNA, 21 bp, Homo sapiens
cacgaaggtaaaaagtatttt

SEQ ID NO: 687206 - DNA, 21 bp, Homo sapiens
cacgagggtctcccctcctgc

SEQ ID NO: 687207 - DNA, 15 bp, Homo sapiens
cacgaggtcaggaga

SEQ ID NO: 687208 - DNA, 14 bp, Homo sapiens
cacgtgacaggctc

SEQ ID NO: 687209 - DNA, 21 bp, Homo sapiens
cacgttggggtgatttaatcc

SEQ ID NO: 687210 - DNA, 12 bp, Homo sapiens
cactaaaagcat

SEQ ID NO: 687211 - DNA, 14 bp, Homo sapiens
cactaaaagcatga

SEQ ID NO: 687212 - DNA, 15 bp, Homo sapiens
cactacacatttgaa

SEQ ID NO: 687213 - DNA, 16 bp, Homo sapiens
cactacacatttgaaa

SEQ ID NO: 687214 - DNA, 19 bp, Homo sapiens
cactactgtactccagcca

SEQ ID NO: 687215 - DNA, 17 bp, Homo sapiens
cactatgggtgagcata

SEQ ID NO: 687216 - DNA, 14 bp, Homo sapiens
cactcaggccacag

SEQ ID NO: 687217 - DNA, 13 bp, Homo sapiens
cactcagtgcctc

SEQ ID NO: 687218 - DNA, 21 bp, Homo sapiens
cactcagtgcctccacatgct

SEQ ID NO: 687219 - DNA, 19 bp, Homo sapiens
cactccattattcctctca

SEQ ID NO: 687220 - DNA, 14 bp, Homo sapiens
cactcctccctccg

SEQ ID NO: 687221 - DNA, 23 bp, Homo sapiens
cactctgtaattgcactttttaa

SEQ ID NO: 687222 - DNA, 20 bp, Homo sapiens
cactcttgatctctcttgtc

SEQ ID NO: 687223 - DNA, 23 bp, Homo sapiens
cactgagaccccaggctgttagg

SEQ ID NO: 687224 - DNA, 19 bp, Homo sapiens
cactgatgttgtgttttta

SEQ ID NO: 687225 - DNA, 16 bp, Homo sapiens
cactgcaaattttaac

SEQ ID NO: 687226 - DNA, 13 bp, Homo sapiens
cactgcagacttg

SEQ ID NO: 687227 - DNA, 14 bp, Homo sapiens
cactgcagcagaaa

SEQ ID NO: 687228 - DNA, 17 bp, Homo sapiens
cactgcagcagaaaggc

SEQ ID NO: 687229 - DNA, 15 bp, Homo sapiens
cactgctgagctggc

SEQ ID NO: 687230 - DNA, 14 bp, Homo sapiens
cactgtagcaggtt

SEQ ID NO: 687231 - DNA, 19 bp, Homo sapiens
cactgtctctaccaaaaaa

SEQ ID NO: 687232 - DNA, 17 bp, Homo sapiens
cactgtggccaggcctt

SEQ ID NO: 687233 - DNA, 16 bp, Homo sapiens
cactgttaagaataga

SEQ ID NO: 687234 - DNA, 21 bp, Homo sapiens
cacttagtgatcatttaaaaa

SEQ ID NO: 687235 - DNA, 16 bp, Homo sapiens
cacttatctcgaattt

SEQ ID NO: 687236 - DNA, 21 bp, Homo sapiens
cacttatctcgaatttgaaga

SEQ ID NO: 687237 - DNA, 14 bp, Homo sapiens
cacttcatttttaa

SEQ ID NO: 687238 - DNA, 20 bp, Homo sapiens
cacttccaggggaacctgcc

SEQ ID NO: 687239 - DNA, 22 bp, Homo sapiens
cacttcctttgcccttcctcct

SEQ ID NO: 687240 - DNA, 23 bp, Homo sapiens
cacttcctttgcccttcctcctg

SEQ ID NO: 687241 - DNA, 20 bp, Homo sapiens
cacttgaccgggagacagag

SEQ ID NO: 687242 - DNA, 19 bp, Homo sapiens
cacttgagccccggaggtc

SEQ ID NO: 687243 - DNA, 19 bp, Homo sapiens
cacttgagctcaggaggtc

SEQ ID NO: 687244 - DNA, 14 bp, Homo sapiens
cacttgctgctttt

SEQ ID NO: 687245 - DNA, 18 bp, Homo sapiens
cactttctaatgtttctg

SEQ ID NO: 687246 - DNA, 17 bp, Homo sapiens
cactttgcaactccctg

SEQ ID NO: 687247 - DNA, 14 bp, Homo sapiens
cactttttatgcta

SEQ ID NO: 687248 - DNA, 15 bp, Homo sapiens
cagaaacatgtcttg

SEQ ID NO: 687249 - DNA, 14 bp, Homo sapiens
cagaaaggctctga

SEQ ID NO: 687250 - DNA, 20 bp, Homo sapiens
cagaaatataacacattttt

SEQ ID NO: 687251 - DNA, 17 bp, Homo sapiens
cagaaatggaaagcaga

SEQ ID NO: 687252 - DNA, 14 bp, Homo sapiens
cagaacaaaacttc

SEQ ID NO: 687253 - DNA, 13 bp, Homo sapiens
cagaacagggtca

SEQ ID NO: 687254 - DNA, 21 bp, Homo sapiens
cagaaccacacttgaaacctt

SEQ ID NO: 687255 - DNA, 10 bp, Homo sapiens
cagaaccagg

SEQ ID NO: 687256 - DNA, 21 bp, Homo sapiens
cagaactgaaccggctttacc

SEQ ID NO: 687257 - DNA, 23 bp, Homo sapiens
cagaactggaggcagtccatcta

SEQ ID NO: 687258 - DNA, 17 bp, Homo sapiens
cagaacttgaagggtta

SEQ ID NO: 687259 - DNA, 12 bp, Homo sapiens
cagaagacggga

SEQ ID NO: 687260 - DNA, 18 bp, Homo sapiens
cagaagacgggaggggag

SEQ ID NO: 687261 - DNA, 20 bp, Homo sapiens
cagaagacgggaggggaggc

SEQ ID NO: 687262 - DNA, 22 bp, Homo sapiens
cagaagacgggaggggaggcat

SEQ ID NO: 687263 - DNA, 23 bp, Homo sapiens
cagaagacttctatggaccacaa

SEQ ID NO: 687264 - DNA, 17 bp, Homo sapiens
cagaagaggggcagctt

SEQ ID NO: 687265 - DNA, 18 bp, Homo sapiens
cagaagaggggcagcttt

SEQ ID NO: 687266 - DNA, 20 bp, Homo sapiens
cataaatgcataatttatgg

SEQ ID NO: 687267 - DNA, 19 bp, Homo sapiens
cataacaattcccccatcc

SEQ ID NO: 687268 - DNA, 16 bp, Homo sapiens
cataactcctgtccct

SEQ ID NO: 687269 - DNA, 17 bp, Homo sapiens
cataactcctgtccctt

SEQ ID NO: 687270 - DNA, 14 bp, Homo sapiens
cataacttcctgta

SEQ ID NO: 687271 - DNA, 18 bp, Homo sapiens
cataatgataaaataaat

SEQ ID NO: 687272 - DNA, 23 bp, Homo sapiens
cataatgataaaataaataattt

SEQ ID NO: 687273 - DNA, 16 bp, Homo sapiens
cataattgcctacatt

SEQ ID NO: 687274 - DNA, 19 bp, Homo sapiens
cataattgcctacatttat

SEQ ID NO: 687275 - DNA, 19 bp, Homo sapiens
cataatttcagtgggaaat

SEQ ID NO: 687276 - DNA, 13 bp, Homo sapiens
cataattttgcaa

SEQ ID NO: 687277 - DNA, 21 bp, Homo sapiens
catacattccctctaatttga

SEQ ID NO: 687278 - DNA, 16 bp, Homo sapiens
catacctaccagtatt

SEQ ID NO: 687279 - DNA, 22 bp, Homo sapiens
catacctcagaatgtaaaagaa

SEQ ID NO: 687280 - DNA, 18 bp, Homo sapiens
catactactgaaacagat

SEQ ID NO: 687281 - DNA, 13 bp, Homo sapiens
catacttgtgaaa

SEQ ID NO: 687282 - DNA, 18 bp, Homo sapiens
catagaaaccactagaaa

SEQ ID NO: 687283 - DNA, 17 bp, Homo sapiens
catagataatattgttt

SEQ ID NO: 687284 - DNA, 24 bp, Homo sapiens
catagataatattgtttggtaaat

SEQ ID NO: 687285 - DNA, 22 bp, Homo sapiens
catagcacctaacaacattgta

SEQ ID NO: 687286 - DNA, 13 bp, Homo sapiens
catagccataaat

SEQ ID NO: 687287 - DNA, 17 bp, Homo sapiens
catagccataaatgatg

SEQ ID NO: 687288 - DNA, 18 bp, Homo sapiens
cataggaagaaaatgtca

SEQ ID NO: 687289 - DNA, 19 bp, Homo sapiens
cataggctatgccatgtgc

SEQ ID NO: 687290 - DNA, 18 bp, Homo sapiens
cataggtttctctccctc

SEQ ID NO: 687291 - DNA, 19 bp, Homo sapiens
cataggtttctctccctcc

SEQ ID NO: 687292 - DNA, 14 bp, Homo sapiens
catagtaagattga

SEQ ID NO: 687293 - DNA, 14 bp, Homo sapiens
catataaccaaaat

SEQ ID NO: 687294 - DNA, 20 bp, Homo sapiens
catatagcattgataatctt

SEQ ID NO: 687295 - DNA, 15 bp, Homo sapiens
catatagttaaactg

SEQ ID NO: 687296 - DNA, 19 bp, Homo sapiens
catatattaattagcaggt

SEQ ID NO: 687297 - DNA, 12 bp, Homo sapiens
catatcccacca

SEQ ID NO: 687298 - DNA, 15 bp, Homo sapiens
catatcctgagccat

SEQ ID NO: 687299 - DNA, 22 bp, Homo sapiens
catatgagaatataccttattt

SEQ ID NO: 687300 - DNA, 21 bp, Homo sapiens
catatgggtgggattttgcaa

SEQ ID NO: 687301 - DNA, 21 bp, Homo sapiens
catattctggttcttgaaaat

SEQ ID NO: 687302 - DNA, 16 bp, Homo sapiens
catatttgatttctaa

SEQ ID NO: 687303 - DNA, 17 bp, Homo sapiens
catattttagctgcacg

SEQ ID NO: 687304 - DNA, 22 bp, Homo sapiens
catattttttgtatatttgttt

SEQ ID NO: 687305 - DNA, 13 bp, Homo sapiens
catcaaataagaa

SEQ ID NO: 687306 - DNA, 13 bp, Homo sapiens
catcacagggtgg

SEQ ID NO: 687307 - DNA, 22 bp, Homo sapiens
catcagaaagctttattttgag

SEQ ID NO: 687308 - DNA, 16 bp, Homo sapiens
catcaggaaagagagc

SEQ ID NO: 687309 - DNA, 13 bp, Homo sapiens
catcagggcctgg

SEQ ID NO: 687310 - DNA, 16 bp, Homo sapiens
catcagggcctggggc

SEQ ID NO: 687311 - DNA, 18 bp, Homo sapiens
catcagggcctggggcct

SEQ ID NO: 687312 - DNA, 23 bp, Homo sapiens
catcagggcctggggcctgagag

SEQ ID NO: 687313 - DNA, 15 bp, Homo sapiens
catcagttccagcct

SEQ ID NO: 687314 - DNA, 14 bp, Homo sapiens
catcatcagggcct

SEQ ID NO: 687315 - DNA, 14 bp, Homo sapiens
catcattccctctc

SEQ ID NO: 687316 - DNA, 20 bp, Homo sapiens
catcattccctctcatctca

SEQ ID NO: 687317 - DNA, 14 bp, Homo sapiens
catccatctctctc

SEQ ID NO: 687318 - DNA, 13 bp, Homo sapiens
catccctttggtt

SEQ ID NO: 687319 - DNA, 19 bp, Homo sapiens
catccctttggttaataaa

SEQ ID NO: 687320 - DNA, 16 bp, Homo sapiens
catccgcgtgtgcctg

SEQ ID NO: 687321 - DNA, 20 bp, Homo sapiens
catccgcgtgtgcctgtgtg

SEQ ID NO: 687322 - DNA, 18 bp, Homo sapiens
catcctcccgccaggagc

SEQ ID NO: 687323 - DNA, 15 bp, Homo sapiens
catcctggtcagctg

SEQ ID NO: 687324 - DNA, 17 bp, Homo sapiens
catccttctttccttgt

SEQ ID NO: 687325 - DNA, 16 bp, Homo sapiens
catctaaagcagcagg

SEQ ID NO: 687326 - DNA, 15 bp, Homo sapiens
catctaattctgatt

SEQ ID NO: 687327 - DNA, 15 bp, Homo sapiens
catctccctgcctgg

SEQ ID NO: 687328 - DNA, 19 bp, Homo sapiens
catctcctcccgcccttcc

SEQ ID NO: 687329 - DNA, 22 bp, Homo sapiens
catctggaaagttttctccact

SEQ ID NO: 687330 - DNA, 15 bp, Homo sapiens
catctggctgcacag

SEQ ID NO: 687331 - DNA, 19 bp, Homo sapiens
catctggctgcacaggctg

SEQ ID NO: 687332 - DNA, 15 bp, Homo sapiens
catctggctggaaag

SEQ ID NO: 687333 - DNA, 13 bp, Homo sapiens
catcttcaatatg

SEQ ID NO: 687334 - DNA, 20 bp, Homo sapiens
catctttgttacttccttat

SEQ ID NO: 687335 - DNA, 15 bp, Homo sapiens
catgaaaaagcagct

SEQ ID NO: 687336 - DNA, 18 bp, Homo sapiens
catgaaaaagcagctacc

SEQ ID NO: 687337 - DNA, 20 bp, Homo sapiens
catgaaatgtgaatttttat

SEQ ID NO: 687338 - DNA, 23 bp, Homo sapiens
catgaaatgtgaatttttattgt

SEQ ID NO: 687339 - DNA, 15 bp, Homo sapiens
catgaagctgttgtg

SEQ ID NO: 687340 - DNA, 17 bp, Homo sapiens
catgagactcagtgcag

SEQ ID NO: 687341 - DNA, 22 bp, Homo sapiens
catgagactttccgactgcttt

SEQ ID NO: 687342 - DNA, 21 bp, Homo sapiens
catgattatagcaactaatgt

SEQ ID NO: 687343 - DNA, 22 bp, Homo sapiens
catgatttagcaagcaactaat

SEQ ID NO: 687344 - DNA, 16 bp, Homo sapiens
catgcaaatgagctct

SEQ ID NO: 687345 - DNA, 20 bp, Homo sapiens
catgcaaatgagctctgaaa

SEQ ID NO: 687346 - DNA, 15 bp, Homo sapiens
catgcaagcagagga

SEQ ID NO: 687347 - DNA, 17 bp, Homo sapiens
catgcaagcagaggacc

SEQ ID NO: 687348 - DNA, 14 bp, Homo sapiens
catgcactgatgtt

SEQ ID NO: 687349 - DNA, 15 bp, Homo sapiens
catgcactgatgttg

SEQ ID NO: 687350 - DNA, 18 bp, Homo sapiens
catgcagagttgaagttt

SEQ ID NO: 687351 - DNA, 21 bp, Homo sapiens
catgcagccgtgatcaaggga

SEQ ID NO: 687352 - DNA, 14 bp, Homo sapiens
catgcatgcaaatg

SEQ ID NO: 687353 - DNA, 19 bp, Homo sapiens
catgcatgcaaatgagctc

SEQ ID NO: 687354 - DNA, 16 bp, Homo sapiens
catgccaaccctgggc

SEQ ID NO: 687355 - DNA, 12 bp, Homo sapiens
catgctccaaat

SEQ ID NO: 687356 - DNA, 15 bp, Homo sapiens
catgctgcctggcac

SEQ ID NO: 687357 - DNA, 21 bp, Homo sapiens
catgctgcctggcacagacca

SEQ ID NO: 687358 - DNA, 20 bp, Homo sapiens
catggaattttttgaatatg

SEQ ID NO: 687359 - DNA, 13 bp, Homo sapiens
catggaggccctc

SEQ ID NO: 687360 - DNA, 12 bp, Homo sapiens
catggcccccaa

SEQ ID NO: 687361 - DNA, 15 bp, Homo sapiens
catggcccccaataa

SEQ ID NO: 687362 - DNA, 18 bp, Homo sapiens
catggcccccaataaagg

SEQ ID NO: 687363 - DNA, 14 bp, Homo sapiens
catggccctgggcg

SEQ ID NO: 687364 - DNA, 13 bp, Homo sapiens
catggtgttgcgt

SEQ ID NO: 687365 - DNA, 13 bp, Homo sapiens
catggttgttgca

SEQ ID NO: 687366 - DNA, 12 bp, Homo sapiens
catgtaataaaa

SEQ ID NO: 687367 - DNA, 23 bp, Homo sapiens
catgtaatgttaatgttatatca

SEQ ID NO: 687368 - DNA, 22 bp, Homo sapiens
catgtatgtcagaagtgcagaa

SEQ ID NO: 687369 - DNA, 14 bp, Homo sapiens
catgtatttgttat

SEQ ID NO: 687370 - DNA, 15 bp, Homo sapiens
catgtatttgttata

SEQ ID NO: 687371 - DNA, 19 bp, Homo sapiens
catgtccaaacgtcctctt

SEQ ID NO: 687372 - DNA, 14 bp, Homo sapiens
catgtccaaagagg

SEQ ID NO: 687373 - DNA, 17 bp, Homo sapiens
catgtccaaagaggctg

SEQ ID NO: 687374 - DNA, 20 bp, Homo sapiens
catgtccaaagaggctgccc

SEQ ID NO: 687375 - DNA, 22 bp, Homo sapiens
catgtccagcaccttgtgcctg

SEQ ID NO: 687376 - DNA, 18 bp, Homo sapiens
catgtgagctcttcctat

SEQ ID NO: 687377 - DNA, 15 bp, Homo sapiens
catgtgatacatttt

SEQ ID NO: 687378 - DNA, 16 bp, Homo sapiens
catgtgatacattttt

SEQ ID NO: 687379 - DNA, 14 bp, Homo sapiens
catgtgcctttctt

SEQ ID NO: 687380 - DNA, 19 bp, Homo sapiens
catgtgcctttctttgcct

SEQ ID NO: 687381 - DNA, 22 bp, Homo sapiens
catgtgcctttctttgcctctg

SEQ ID NO: 687382 - DNA, 21 bp, Homo sapiens
catgtgtcctggtgagaaaat

SEQ ID NO: 687383 - DNA, 13 bp, Homo sapiens
catgttaaatatt

SEQ ID NO: 687384 - DNA, 20 bp, Homo sapiens
catgttagtaatggcagagc

SEQ ID NO: 687385 - DNA, 14 bp, Homo sapiens
catgtttttaactt

SEQ ID NO: 687386 - DNA, 18 bp, Homo sapiens
ccatgtgcctttctttgc

SEQ ID NO: 687387 - DNA, 22 bp, Homo sapiens
ccatgtgcctttctttgcctct

SEQ ID NO: 687388 - DNA, 19 bp, Homo sapiens
ccatgtgcggaattcaagt

SEQ ID NO: 687389 - DNA, 21 bp, Homo sapiens
ccatgttagtaatggcagagc

SEQ ID NO: 687390 - DNA, 15 bp, Homo sapiens
ccattattcctctca

SEQ ID NO: 687391 - DNA, 18 bp, Homo sapiens
ccattgcttattatgtag

SEQ ID NO: 687392 - DNA, 14 bp, Homo sapiens
ccatttaaaaagtt

SEQ ID NO: 687393 - DNA, 22 bp, Homo sapiens
ccatttaaagaccaataaactt

SEQ ID NO: 687394 - DNA, 19 bp, Homo sapiens
ccatttcctcagcttatct

SEQ ID NO: 687395 - DNA, 20 bp, Homo sapiens
ccattttgtaaatgaaactt

SEQ ID NO: 687396 - DNA, 22 bp, Homo sapiens
ccattttgtaaatgaaacttaa

SEQ ID NO: 687397 - DNA, 22 bp, Homo sapiens
ccatttttctcccaagaaacct

SEQ ID NO: 687398 - DNA, 18 bp, Homo sapiens
ccattttttaatttactt

SEQ ID NO: 687399 - DNA, 16 bp, Homo sapiens
cccaaacaggacagca

SEQ ID NO: 687400 - DNA, 18 bp, Homo sapiens
cccaaagctgagcctgca

SEQ ID NO: 687401 - DNA, 17 bp, Homo sapiens
cccaaaggtaggaaggt

SEQ ID NO: 687402 - DNA, 13 bp, Homo sapiens
cccaacacaaaga

SEQ ID NO: 687403 - DNA, 19 bp, Homo sapiens
cccaacctcagggctccca

SEQ ID NO: 687404 - DNA, 20 bp, Homo sapiens
cccaacctcagggctcccag

SEQ ID NO: 687405 - DNA, 13 bp, Homo sapiens
cccaacttcttcc

SEQ ID NO: 687406 - DNA, 13 bp, Homo sapiens
cccaaggaggggg

SEQ ID NO: 687407 - DNA, 19 bp, Homo sapiens
cccaagtgcactttctaat

SEQ ID NO: 687408 - DNA, 18 bp, Homo sapiens
cccaagtggtgaatgaca

SEQ ID NO: 687409 - DNA, 12 bp, Homo sapiens
cccaataaaggc

SEQ ID NO: 687410 - DNA, 14 bp, Homo sapiens
cccaataaaggcag

SEQ ID NO: 687411 - DNA, 16 bp, Homo sapiens
cccaataaaggcagct

SEQ ID NO: 687412 - DNA, 22 bp, Homo sapiens
cccaatgagactctagggtcca

SEQ ID NO: 687413 - DNA, 14 bp, Homo sapiens
cccacacccagcta

SEQ ID NO: 687414 - DNA, 19 bp, Homo sapiens
cccacactgtgcagaccca

SEQ ID NO: 687415 - DNA, 14 bp, Homo sapiens
cccacatgtccagc

SEQ ID NO: 687416 - DNA, 15 bp, Homo sapiens
cccaccaacctccag

SEQ ID NO: 687417 - DNA, 16 bp, Homo sapiens
cccaccaacctccagt

SEQ ID NO: 687418 - DNA, 13 bp, Homo sapiens
cccacccggtggg

SEQ ID NO: 687419 - DNA, 15 bp, Homo sapiens
cccaccctgctgctg

SEQ ID NO: 687420 - DNA, 14 bp, Homo sapiens
cccacctctcctgc

SEQ ID NO: 687421 - DNA, 16 bp, Homo sapiens
cccacctctcctgccc

SEQ ID NO: 687422 - DNA, 17 bp, Homo sapiens
cccacctgctcccaggc

SEQ ID NO: 687423 - DNA, 17 bp, Homo sapiens
cccactcagtgcctcca

SEQ ID NO: 687424 - DNA, 21 bp, Homo sapiens
cccactcccccgtttctcctt

SEQ ID NO: 687425 - DNA, 22 bp, Homo sapiens
cccactcccccgtttctccttt

SEQ ID NO: 687426 - DNA, 11 bp, Homo sapiens
cccactcctgt

SEQ ID NO: 687427 - DNA, 18 bp, Homo sapiens
cccactttcatctacctt

SEQ ID NO: 687428 - DNA, 21 bp, Homo sapiens
cccactttgctgttccttact

SEQ ID NO: 687429 - DNA, 21 bp, Homo sapiens
cccagaatttaccatcatctc

SEQ ID NO: 687430 - DNA, 17 bp, Homo sapiens
cccagagaacagcgaag

SEQ ID NO: 687431 - DNA, 15 bp, Homo sapiens
cccagcactttggga

SEQ ID NO: 687432 - DNA, 16 bp, Homo sapiens
cccagcccacctgctc

SEQ ID NO: 687433 - DNA, 23 bp, Homo sapiens
cccagctacttgggaggctgagg

SEQ ID NO: 687434 - DNA, 22 bp, Homo sapiens
cccagggggtctcacccatgca

SEQ ID NO: 687435 - DNA, 20 bp, Homo sapiens
cccaggggtctccctggctc

SEQ ID NO: 687436 - DNA, 19 bp, Homo sapiens
cccaggttggagtgcagtg

SEQ ID NO: 687437 - DNA, 15 bp, Homo sapiens
cccagtcccacactg

SEQ ID NO: 687438 - DNA, 11 bp, Homo sapiens
cccagtgcaga

SEQ ID NO: 687439 - DNA, 15 bp, Homo sapiens
cccagtgcagaatgt

SEQ ID NO: 687440 - DNA, 17 bp, Homo sapiens
cccagtgcagaatgtaa

SEQ ID NO: 687441 - DNA, 12 bp, Homo sapiens
cccagtgcatgg

SEQ ID NO: 687442 - DNA, 20 bp, Homo sapiens
cccagtgcctcaccttccaa

SEQ ID NO: 687443 - DNA, 18 bp, Homo sapiens
cccagtggctgttctgga

SEQ ID NO: 687444 - DNA, 12 bp, Homo sapiens
cccatctccctg

SEQ ID NO: 687445 - DNA, 16 bp, Homo sapiens
cccatgcaagcagagg

SEQ ID NO: 687446 - DNA, 17 bp, Homo sapiens
cccatggcccccaataa

SEQ ID NO: 687447 - DNA, 21 bp, Homo sapiens
cccatggcccccaataaaggc

SEQ ID NO: 687448 - DNA, 16 bp, Homo sapiens
cccatgggagccaggc

SEQ ID NO: 687449 - DNA, 21 bp, Homo sapiens
cccattaaggggaagaatgaa

SEQ ID NO: 687450 - DNA, 18 bp, Homo sapiens
cccattcagagactgtcc

SEQ ID NO: 687451 - DNA, 16 bp, Homo sapiens
ccccaacatgcactga

SEQ ID NO: 687452 - DNA, 21 bp, Homo sapiens
ccccaacctcagggctcccag

SEQ ID NO: 687453 - DNA, 12 bp, Homo sapiens
ccccaataaagg

SEQ ID NO: 687454 - DNA, 13 bp, Homo sapiens
ccccaataaaggc

SEQ ID NO: 687455 - DNA, 21 bp, Homo sapiens
ccccaataaaggcagctgcct

SEQ ID NO: 687456 - DNA, 15 bp, Homo sapiens
ccccaattctcccct

SEQ ID NO: 687457 - DNA, 18 bp, Homo sapiens
ccccacagcgtccctggc

SEQ ID NO: 687458 - DNA, 15 bp, Homo sapiens
ccccactgctgagct

SEQ ID NO: 687459 - DNA, 21 bp, Homo sapiens
ccccagtgcctcaccttccaa

SEQ ID NO: 687460 - DNA, 18 bp, Homo sapiens
ccccatccagacctggct

SEQ ID NO: 687461 - DNA, 20 bp, Homo sapiens
ccccatctaggtcctggctg

SEQ ID NO: 687462 - DNA, 18 bp, Homo sapiens
ccccatctccctgcctgg

SEQ ID NO: 687463 - DNA, 13 bp, Homo sapiens
ccccatctgagct

SEQ ID NO: 687464 - DNA, 15 bp, Homo sapiens
cccccaacctcaggg

SEQ ID NO: 687465 - DNA, 12 bp, Homo sapiens
cccccaataaag

SEQ ID NO: 687466 - DNA, 13 bp, Homo sapiens
cccccaataaagg

SEQ ID NO: 687467 - DNA, 22 bp, Homo sapiens
cccccaataaaggcagctgcct

SEQ ID NO: 687468 - DNA, 12 bp, Homo sapiens
cccccactcagt

SEQ ID NO: 687469 - DNA, 18 bp, Homo sapiens
cccccactcagtgcctcc

SEQ ID NO: 687470 - DNA, 12 bp, Homo sapiens
cccccagtgcct

SEQ ID NO: 687471 - DNA, 22 bp, Homo sapiens
cccccagtgcctcaccttccaa

SEQ ID NO: 687472 - DNA, 18 bp, Homo sapiens
ccccctgggctggggcct

SEQ ID NO: 687473 - DNA, 22 bp, Homo sapiens
ccccctgggctggggcctcaga

SEQ ID NO: 687474 - DNA, 12 bp, Homo sapiens
ccccgacacacg

SEQ ID NO: 687475 - DNA, 16 bp, Homo sapiens
ccccgagtgactctgg

SEQ ID NO: 687476 - DNA, 21 bp, Homo sapiens
ccccggcatgagactcagtgc

SEQ ID NO: 687477 - DNA, 20 bp, Homo sapiens
ccccgtttctccttttccta

SEQ ID NO: 687478 - DNA, 21 bp, Homo sapiens
cccctaaaagcactcctgctt

SEQ ID NO: 687479 - DNA, 19 bp, Homo sapiens
cccctaaagcctcaaaaca

SEQ ID NO: 687480 - DNA, 20 bp, Homo sapiens
cccctagagccctctcctcc

SEQ ID NO: 687481 - DNA, 13 bp, Homo sapiens
cccctcctgcaca

SEQ ID NO: 687482 - DNA, 10 bp, Homo sapiens
cccctggctt

SEQ ID NO: 687483 - DNA, 11 bp, Homo sapiens
cccctgggctg

SEQ ID NO: 687484 - DNA, 21 bp, Homo sapiens
cccctgggctggggcctcaga

SEQ ID NO: 687485 - DNA, 10 bp, Homo sapiens
ccccttccca

SEQ ID NO: 687486 - DNA, 10 bp, Homo sapiens
ccccttccct

SEQ ID NO: 687487 - DNA, 12 bp, Homo sapiens
cccgaagttcag

SEQ ID NO: 687488 - DNA, 12 bp, Homo sapiens
cccgacatggct

SEQ ID NO: 687489 - DNA, 13 bp, Homo sapiens
cccgagagcctcg

SEQ ID NO: 687490 - DNA, 15 bp, Homo sapiens
cccgagtgactctgg

SEQ ID NO: 687491 - DNA, 14 bp, Homo sapiens
cccgcccagcctca

SEQ ID NO: 687492 - DNA, 16 bp, Homo sapiens
cccgccgatagaggga

SEQ ID NO: 687493 - DNA, 16 bp, Homo sapiens
cccgctgctgtgcaac

SEQ ID NO: 687494 - DNA, 20 bp, Homo sapiens
cccggagcagcagcttctcc

SEQ ID NO: 687495 - DNA, 21 bp, Homo sapiens
cccggagcagcagcttctcca

SEQ ID NO: 687496 - DNA, 19 bp, Homo sapiens
cccggtgtatcctggccct

SEQ ID NO: 687497 - DNA, 16 bp, Homo sapiens
cccgtgcatgctctgc

SEQ ID NO: 687498 - DNA, 19 bp, Homo sapiens
ccctagcagcccaccctgc

SEQ ID NO: 687499 - DNA, 15 bp, Homo sapiens
ccctataataaaggc

SEQ ID NO: 687500 - DNA, 17 bp, Homo sapiens
ccctcattactgggcct

SEQ ID NO: 687501 - DNA, 18 bp, Homo sapiens
ccctcattactgggcctt

SEQ ID NO: 687502 - DNA, 22 bp, Homo sapiens
ccctccaccccccactcagtgc

SEQ ID NO: 687503 - DNA, 10 bp, Homo sapiens
ccctcccact

SEQ ID NO: 687504 - DNA, 15 bp, Homo sapiens
ccctcccactttgct

SEQ ID NO: 687505 - DNA, 20 bp, Homo sapiens
ccctcctgcacacagggcag

SEQ ID NO: 687506 - DNA, 22 bp, Homo sapiens
ccctcgcagagcccttctcgtt

SEQ ID NO: 687507 - DNA, 15 bp, Homo sapiens
cctgtccaagacagg

SEQ ID NO: 687508 - DNA, 23 bp, Homo sapiens
cctgtccaagacagggctcattt

SEQ ID NO: 687509 - DNA, 10 bp, Homo sapiens
cctgtcccaa

SEQ ID NO: 687510 - DNA, 20 bp, Homo sapiens
cctgtccccaaacaggacag

SEQ ID NO: 687511 - DNA, 14 bp, Homo sapiens
cctgtcccttgcct

SEQ ID NO: 687512 - DNA, 17 bp, Homo sapiens
cctgtcccttgcctctg

SEQ ID NO: 687513 - DNA, 15 bp, Homo sapiens
cctgtcccttttccc

SEQ ID NO: 687514 - DNA, 18 bp, Homo sapiens
cctgtcctaaggaacctt

SEQ ID NO: 687515 - DNA, 13 bp, Homo sapiens
cctgtcctgcagt

SEQ ID NO: 687516 - DNA, 23 bp, Homo sapiens
cctgtcctgcagtcccacactgt

SEQ ID NO: 687517 - DNA, 15 bp, Homo sapiens
cctgtctcagctgtt

SEQ ID NO: 687518 - DNA, 15 bp, Homo sapiens
cctgtgatgttttat

SEQ ID NO: 687519 - DNA, 17 bp, Homo sapiens
cctgtgccagcaccaca

SEQ ID NO: 687520 - DNA, 14 bp, Homo sapiens
cctgtgctggggga

SEQ ID NO: 687521 - DNA, 23 bp, Homo sapiens
cctgtggaatgagtgtgcatgga

SEQ ID NO: 687522 - DNA, 15 bp, Homo sapiens
cctgtggcataaatt

SEQ ID NO: 687523 - DNA, 13 bp, Homo sapiens
cctgtggctccct

SEQ ID NO: 687524 - DNA, 16 bp, Homo sapiens
cctgtgtgcaggttcc

SEQ ID NO: 687525 - DNA, 22 bp, Homo sapiens
cctgtgtgtgttgccctggcat

SEQ ID NO: 687526 - DNA, 13 bp, Homo sapiens
cctgttagctttc

SEQ ID NO: 687527 - DNA, 22 bp, Homo sapiens
cctgttagctttccaaggaagc

SEQ ID NO: 687528 - DNA, 13 bp, Homo sapiens
cctgttctgaaat

SEQ ID NO: 687529 - DNA, 15 bp, Homo sapiens
ccttaacccacctct

SEQ ID NO: 687530 - DNA, 23 bp, Homo sapiens
ccttaatctaatctaaaagctct

SEQ ID NO: 687531 - DNA, 22 bp, Homo sapiens
ccttaatgcttcatatgaggag

SEQ ID NO: 687532 - DNA, 21 bp, Homo sapiens
ccttacaatgtgaataatggc

SEQ ID NO: 687533 - DNA, 21 bp, Homo sapiens
ccttactttactgcctgaata

SEQ ID NO: 687534 - DNA, 23 bp, Homo sapiens
ccttactttactgcctgaataaa

SEQ ID NO: 687535 - DNA, 18 bp, Homo sapiens
ccttagaaacactgcaaa

SEQ ID NO: 687536 - DNA, 18 bp, Homo sapiens
ccttagggaagctggcct

SEQ ID NO: 687537 - DNA, 20 bp, Homo sapiens
ccttagggaagctggcctga

SEQ ID NO: 687538 - DNA, 21 bp, Homo sapiens
ccttagggaagctggcctgag

SEQ ID NO: 687539 - DNA, 15 bp, Homo sapiens
ccttagtgggccagg

SEQ ID NO: 687540 - DNA, 14 bp, Homo sapiens
ccttatcagagcta

SEQ ID NO: 687541 - DNA, 16 bp, Homo sapiens
ccttatccctctcttc

SEQ ID NO: 687542 - DNA, 16 bp, Homo sapiens
ccttatttatttttgt

SEQ ID NO: 687543 - DNA, 22 bp, Homo sapiens
ccttatttgctaatcaaagcca

SEQ ID NO: 687544 - DNA, 18 bp, Homo sapiens
ccttcactctccagggta

SEQ ID NO: 687545 - DNA, 15 bp, Homo sapiens
ccttccatgtgcctt

SEQ ID NO: 687546 - DNA, 16 bp, Homo sapiens
ccttccatgtgccttt

SEQ ID NO: 687547 - DNA, 19 bp, Homo sapiens
ccttccatgtgcctttctt

SEQ ID NO: 687548 - DNA, 23 bp, Homo sapiens
ccttccatgtgcctttctttgcc

SEQ ID NO: 687549 - DNA, 16 bp, Homo sapiens
ccttcctcagctgcct

SEQ ID NO: 687550 - DNA, 20 bp, Homo sapiens
ccttcctcctgcctttctca

SEQ ID NO: 687551 - DNA, 17 bp, Homo sapiens
ccttctccctagctcct

SEQ ID NO: 687552 - DNA, 22 bp, Homo sapiens
ccttctccctagctcctcccct

SEQ ID NO: 687553 - DNA, 12 bp, Homo sapiens
ccttctgctgaa

SEQ ID NO: 687554 - DNA, 20 bp, Homo sapiens
ccttgaaaaatgacaattgt

SEQ ID NO: 687555 - DNA, 19 bp, Homo sapiens
ccttgaaactttgggaaaa

SEQ ID NO: 687556 - DNA, 16 bp, Homo sapiens
ccttgagccctggctg

SEQ ID NO: 687557 - DNA, 17 bp, Homo sapiens
ccttgccccaggccctg

SEQ ID NO: 687558 - DNA, 15 bp, Homo sapiens
ccttgcccccagtgc

SEQ ID NO: 687559 - DNA, 12 bp, Homo sapiens
ccttgcctctgc

SEQ ID NO: 687560 - DNA, 16 bp, Homo sapiens
ccttgcttgcctgcag

SEQ ID NO: 687561 - DNA, 18 bp, Homo sapiens
ccttgcttgcctgcaggg

SEQ ID NO: 687562 - DNA, 21 bp, Homo sapiens
ccttggctcccgggggcccca

SEQ ID NO: 687563 - DNA, 22 bp, Homo sapiens
ccttggctcccgggggccccac

SEQ ID NO: 687564 - DNA, 14 bp, Homo sapiens
ccttggtgccctcg

SEQ ID NO: 687565 - DNA, 17 bp, Homo sapiens
ccttgtcctcagccagt

SEQ ID NO: 687566 - DNA, 12 bp, Homo sapiens
ccttgtgcctgg

SEQ ID NO: 687567 - DNA, 14 bp, Homo sapiens
ccttgtgcctgggg

SEQ ID NO: 687568 - DNA, 15 bp, Homo sapiens
ccttgtgcctggggt

SEQ ID NO: 687569 - DNA, 22 bp, Homo sapiens
cctttaacttttttttctctct

SEQ ID NO: 687570 - DNA, 15 bp, Homo sapiens
cctttcaaagcactt

SEQ ID NO: 687571 - DNA, 13 bp, Homo sapiens
cctttcaaagctt

SEQ ID NO: 687572 - DNA, 23 bp, Homo sapiens
cctttctgtcccactacatctgg

SEQ ID NO: 687573 - DNA, 14 bp, Homo sapiens
cctttctttgcctc

SEQ ID NO: 687574 - DNA, 16 bp, Homo sapiens
cctttctttgcctctg

SEQ ID NO: 687575 - DNA, 17 bp, Homo sapiens
cctttctttgcctctgc

SEQ ID NO: 687576 - DNA, 17 bp, Homo sapiens
cctttgcccttcctcct

SEQ ID NO: 687577 - DNA, 12 bp, Homo sapiens
cctttggcctgg

SEQ ID NO: 687578 - DNA, 13 bp, Homo sapiens
cctttgttctggg

SEQ ID NO: 687579 - DNA, 15 bp, Homo sapiens
cctttgttctggggg

SEQ ID NO: 687580 - DNA, 12 bp, Homo sapiens
ccttttcctttt

SEQ ID NO: 687581 - DNA, 14 bp, Homo sapiens
ccttttctcttttc

SEQ ID NO: 687582 - DNA, 15 bp, Homo sapiens
ccttttctggcaccg

SEQ ID NO: 687583 - DNA, 15 bp, Homo sapiens
ccttttgcatttctt

SEQ ID NO: 687584 - DNA, 13 bp, Homo sapiens
cctttttattcat

SEQ ID NO: 687585 - DNA, 23 bp, Homo sapiens
cctttttggcctgtgatgtttta

SEQ ID NO: 687586 - DNA, 16 bp, Homo sapiens
ccttttttttttcttg

SEQ ID NO: 687587 - DNA, 23 bp, Homo sapiens
cgaagaccctcttgcccatcctg

SEQ ID NO: 687588 - DNA, 21 bp, Homo sapiens
cgaagatggtggccacagact

SEQ ID NO: 687589 - DNA, 15 bp, Homo sapiens
cgaagtagcttgctc

SEQ ID NO: 687590 - DNA, 21 bp, Homo sapiens
cgaagtagcttgctccctgtg

SEQ ID NO: 687591 - DNA, 16 bp, Homo sapiens
cgacacatatacatat

SEQ ID NO: 687592 - DNA, 23 bp, Homo sapiens
cgacatggctccggcctctgcct

SEQ ID NO: 687593 - DNA, 23 bp, Homo sapiens
cgaccctgggggcacaggaggca

SEQ ID NO: 687594 - DNA, 19 bp, Homo sapiens
cgactgactggaggaggcc

SEQ ID NO: 687595 - DNA, 15 bp, Homo sapiens
cgagaccctgtctca

SEQ ID NO: 687596 - DNA, 21 bp, Homo sapiens
cgagagcctcgctttttcatc

SEQ ID NO: 687597 - DNA, 19 bp, Homo sapiens
cgagggtctcccctcctgc

SEQ ID NO: 687598 - DNA, 20 bp, Homo sapiens
cgagggtctcccctcctgca

SEQ ID NO: 687599 - DNA, 21 bp, Homo sapiens
cgagggtctcccctcctgcac

SEQ ID NO: 687600 - DNA, 14 bp, Homo sapiens
cgaggtcaggagat

SEQ ID NO: 687601 - DNA, 13 bp, Homo sapiens
cgaggttgagagg

SEQ ID NO: 687602 - DNA, 17 bp, Homo sapiens
cgatatcttcagaaaac

SEQ ID NO: 687603 - DNA, 15 bp, Homo sapiens
cgatctctcctggcc

SEQ ID NO: 687604 - DNA, 15 bp, Homo sapiens
cgatgttgtattgat

SEQ ID NO: 687605 - DNA, 20 bp, Homo sapiens
cgattttttttttttcctct

SEQ ID NO: 687606 - DNA, 21 bp, Homo sapiens
cgattttttttttttcctctt

SEQ ID NO: 687607 - DNA, 18 bp, Homo sapiens
cgcaacgtctaactggac

SEQ ID NO: 687608 - DNA, 13 bp, Homo sapiens
cgcagaagccctg

SEQ ID NO: 687609 - DNA, 19 bp, Homo sapiens
cgcaggcagcgcagggctg

SEQ ID NO: 687610 - DNA, 15 bp, Homo sapiens
cgcagggctggcacg

SEQ ID NO: 687611 - DNA, 22 bp, Homo sapiens
cgcagggctggcacgtgacagg

SEQ ID NO: 687612 - DNA, 18 bp, Homo sapiens
cgcaggtgggctggactt

SEQ ID NO: 687613 - DNA, 22 bp, Homo sapiens
cgcatgaccacccctctcgcct

SEQ ID NO: 687614 - DNA, 16 bp, Homo sapiens
cgccaagtgcgtgccg

SEQ ID NO: 687615 - DNA, 17 bp, Homo sapiens
cgccagaggtgcttcac

SEQ ID NO: 687616 - DNA, 15 bp, Homo sapiens
cgccagcgaacttga

SEQ ID NO: 687617 - DNA, 13 bp, Homo sapiens
cgcccagcctcac

SEQ ID NO: 687618 - DNA, 15 bp, Homo sapiens
cgcccctgttttttg

SEQ ID NO: 687619 - DNA, 14 bp, Homo sapiens
cgcccttccatgtg

SEQ ID NO: 687620 - DNA, 15 bp, Homo sapiens
cgcccttccatgtgc

SEQ ID NO: 687621 - DNA, 16 bp, Homo sapiens
cgcctcattactgtga

SEQ ID NO: 687622 - DNA, 19 bp, Homo sapiens
cgcctccccacctccaggc

SEQ ID NO: 687623 - DNA, 22 bp, Homo sapiens
cgcctccccctcccccattccc

SEQ ID NO: 687624 - DNA, 11 bp, Homo sapiens
cgcctgccatc

SEQ ID NO: 687625 - DNA, 14 bp, Homo sapiens
cgcctttttggcct

SEQ ID NO: 687626 - DNA, 18 bp, Homo sapiens
cgctacagtttttattta

SEQ ID NO: 687627 - DNA, 15 bp, Homo sapiens
ctcagtgcctccaca

SEQ ID NO: 687628 - DNA, 19 bp, Homo sapiens
ctcagtgcctccacatgct

SEQ ID NO: 687629 - DNA, 22 bp, Homo sapiens
ctcagtgttggtatattttata

SEQ ID NO: 687630 - DNA, 21 bp, Homo sapiens
ctcatccgaagatggtggcca

SEQ ID NO: 687631 - DNA, 22 bp, Homo sapiens
ctcatccgaagatggtggccac

SEQ ID NO: 687632 - DNA, 23 bp, Homo sapiens
ctcatcctccagtaccttgcttc

SEQ ID NO: 687633 - DNA, 20 bp, Homo sapiens
ctcatctatgaggaaaggtt

SEQ ID NO: 687634 - DNA, 16 bp, Homo sapiens
ctcatgagtgtgcccc

SEQ ID NO: 687635 - DNA, 17 bp, Homo sapiens
ctcatgcacccctgagc

SEQ ID NO: 687636 - DNA, 18 bp, Homo sapiens
ctcatgcacccctgagcc

SEQ ID NO: 687637 - DNA, 15 bp, Homo sapiens
ctcatgcagccgtga

SEQ ID NO: 687638 - DNA, 15 bp, Homo sapiens
ctcatgttaaatatt

SEQ ID NO: 687639 - DNA, 15 bp, Homo sapiens
ctcattaaacttttt

SEQ ID NO: 687640 - DNA, 21 bp, Homo sapiens
ctcattctggttccctgctgc

SEQ ID NO: 687641 - DNA, 22 bp, Homo sapiens
ctcattctggttccctgctgcg

SEQ ID NO: 687642 - DNA, 22 bp, Homo sapiens
ctcattgacttttataaagcat

SEQ ID NO: 687643 - DNA, 22 bp, Homo sapiens
ctcattgtcacctctgtgaccc

SEQ ID NO: 687644 - DNA, 13 bp, Homo sapiens
ctcattgtgtctc

SEQ ID NO: 687645 - DNA, 17 bp, Homo sapiens
ctccacatgctgcctgg

SEQ ID NO: 687646 - DNA, 20 bp, Homo sapiens
ctccacatgctgcctggcac

SEQ ID NO: 687647 - DNA, 22 bp, Homo sapiens
ctccaccccccactcagtgcct

SEQ ID NO: 687648 - DNA, 20 bp, Homo sapiens
ctccactcttgatctctctt

SEQ ID NO: 687649 - DNA, 22 bp, Homo sapiens
ctccactcttgatctctcttgt

SEQ ID NO: 687650 - DNA, 18 bp, Homo sapiens
ctccacttcatttttaag

SEQ ID NO: 687651 - DNA, 23 bp, Homo sapiens
ctccacttcatttttaagaaagg

SEQ ID NO: 687652 - DNA, 12 bp, Homo sapiens
ctccagcctggg

SEQ ID NO: 687653 - DNA, 19 bp, Homo sapiens
ctccagcgtcagctgctcc

SEQ ID NO: 687654 - DNA, 23 bp, Homo sapiens
ctccagcgtcagctgctccctgg

SEQ ID NO: 687655 - DNA, 13 bp, Homo sapiens
ctccaggccctcc

SEQ ID NO: 687656 - DNA, 17 bp, Homo sapiens
ctccaggcctgcagcag

SEQ ID NO: 687657 - DNA, 13 bp, Homo sapiens
ctccaggcctgcc

SEQ ID NO: 687658 - DNA, 14 bp, Homo sapiens
ctccaggcctgcct

SEQ ID NO: 687659 - DNA, 16 bp, Homo sapiens
ctccaggcctgcctcc

SEQ ID NO: 687660 - DNA, 17 bp, Homo sapiens
ctccaggcctgcctccc

SEQ ID NO: 687661 - DNA, 18 bp, Homo sapiens
ctccaggcctgcctccca

SEQ ID NO: 687662 - DNA, 22 bp, Homo sapiens
ctccaggcctgcctcccacttc

SEQ ID NO: 687663 - DNA, 14 bp, Homo sapiens
ctccaggtgcagag

SEQ ID NO: 687664 - DNA, 15 bp, Homo sapiens
ctccaggtgcagagg

SEQ ID NO: 687665 - DNA, 18 bp, Homo sapiens
ctccaggtgcagaggtac

SEQ ID NO: 687666 - DNA, 19 bp, Homo sapiens
ctccagtattgccccctct

SEQ ID NO: 687667 - DNA, 16 bp, Homo sapiens
ctccagtgtcagggtc

SEQ ID NO: 687668 - DNA, 15 bp, Homo sapiens
ctccataaacagact

SEQ ID NO: 687669 - DNA, 19 bp, Homo sapiens
ctccataaagtacaaatga

SEQ ID NO: 687670 - DNA, 16 bp, Homo sapiens
ctccataccttttctc

SEQ ID NO: 687671 - DNA, 21 bp, Homo sapiens
ctccataccttttctcttttc

SEQ ID NO: 687672 - DNA, 19 bp, Homo sapiens
ctccatatttgatttctaa

SEQ ID NO: 687673 - DNA, 14 bp, Homo sapiens
ctccatctcttctg

SEQ ID NO: 687674 - DNA, 15 bp, Homo sapiens
ctccatctcttctgc

SEQ ID NO: 687675 - DNA, 23 bp, Homo sapiens
ctccatctcttctgcaagcctca

SEQ ID NO: 687676 - DNA, 23 bp, Homo sapiens
ctccatgttagtaatggcagagc

SEQ ID NO: 687677 - DNA, 19 bp, Homo sapiens
ctccattattcctctcacc

SEQ ID NO: 687678 - DNA, 20 bp, Homo sapiens
ctcccaacttcttcctgtga

SEQ ID NO: 687679 - DNA, 17 bp, Homo sapiens
ctcccaagctgatttta

SEQ ID NO: 687680 - DNA, 12 bp, Homo sapiens
ctcccactttgc

SEQ ID NO: 687681 - DNA, 17 bp, Homo sapiens
ctcccaggatgacgtgc

SEQ ID NO: 687682 - DNA, 20 bp, Homo sapiens
ctcccaggggtctccctggc

SEQ ID NO: 687683 - DNA, 18 bp, Homo sapiens
ctccccacagcgtccctg

SEQ ID NO: 687684 - DNA, 18 bp, Homo sapiens
ctccccacaggagccctg

SEQ ID NO: 687685 - DNA, 14 bp, Homo sapiens
ctccccagcccacc

SEQ ID NO: 687686 - DNA, 23 bp, Homo sapiens
ctcccctaaagcctcaaaacaaa

SEQ ID NO: 687687 - DNA, 21 bp, Homo sapiens
ctcccctagagccctctcctc

SEQ ID NO: 687688 - DNA, 22 bp, Homo sapiens
ctcccctagagccctctcctcc

SEQ ID NO: 687689 - DNA, 14 bp, Homo sapiens
ctcccgaagccacc

SEQ ID NO: 687690 - DNA, 14 bp, Homo sapiens
ctcccgggggcccc

SEQ ID NO: 687691 - DNA, 14 bp, Homo sapiens
ctccctcctccagg

SEQ ID NO: 687692 - DNA, 22 bp, Homo sapiens
ctccctctgtccctctccttgc

SEQ ID NO: 687693 - DNA, 12 bp, Homo sapiens
ctccctgcctgg

SEQ ID NO: 687694 - DNA, 14 bp, Homo sapiens
ctccctggctccct

SEQ ID NO: 687695 - DNA, 21 bp, Homo sapiens
ctccctgtaggaagtcatcct

SEQ ID NO: 687696 - DNA, 16 bp, Homo sapiens
ctcccttggtgccctc

SEQ ID NO: 687697 - DNA, 15 bp, Homo sapiens
ctccgtagctctgct

SEQ ID NO: 687698 - DNA, 21 bp, Homo sapiens
ctccgtagctctgctgctgat

SEQ ID NO: 687699 - DNA, 13 bp, Homo sapiens
ctcctaaaactgg

SEQ ID NO: 687700 - DNA, 15 bp, Homo sapiens
ctcctattctataaa

SEQ ID NO: 687701 - DNA, 17 bp, Homo sapiens
ctcctcacccacctctg

SEQ ID NO: 687702 - DNA, 13 bp, Homo sapiens
ctcctccaggcct

SEQ ID NO: 687703 - DNA, 14 bp, Homo sapiens
ctcctccaggcctg

SEQ ID NO: 687704 - DNA, 21 bp, Homo sapiens
ctcctccaggcctgcctccca

SEQ ID NO: 687705 - DNA, 21 bp, Homo sapiens
ctcctcccgcccttccatgtg

SEQ ID NO: 687706 - DNA, 13 bp, Homo sapiens
ctcctcctcctgc

SEQ ID NO: 687707 - DNA, 12 bp, Homo sapiens
ctcctcctgccc

SEQ ID NO: 687708 - DNA, 18 bp, Homo sapiens
ctcctcctgccctcctct

SEQ ID NO: 687709 - DNA, 14 bp, Homo sapiens
ctcctctcagtgtt

SEQ ID NO: 687710 - DNA, 14 bp, Homo sapiens
ctcctgaatatttt

SEQ ID NO: 687711 - DNA, 13 bp, Homo sapiens
ctcctgccctcct

SEQ ID NO: 687712 - DNA, 14 bp, Homo sapiens
ctcctgccctgtga

SEQ ID NO: 687713 - DNA, 15 bp, Homo sapiens
ctcctgccctgtgat

SEQ ID NO: 687714 - DNA, 16 bp, Homo sapiens
ctcctgcctcagcctc

SEQ ID NO: 687715 - DNA, 18 bp, Homo sapiens
ctcctgcgccctgtgccc

SEQ ID NO: 687716 - DNA, 19 bp, Homo sapiens
ctcctgcttaatcttcaaa

SEQ ID NO: 687717 - DNA, 14 bp, Homo sapiens
ctcctggcagggcc

SEQ ID NO: 687718 - DNA, 23 bp, Homo sapiens
ctcctggcctatccgctgccagc

SEQ ID NO: 687719 - DNA, 12 bp, Homo sapiens
ctcctggccttt

SEQ ID NO: 687720 - DNA, 23 bp, Homo sapiens
ctcctggcctttcctggttttca

SEQ ID NO: 687721 - DNA, 13 bp, Homo sapiens
ctcctggcctttt

SEQ ID NO: 687722 - DNA, 15 bp, Homo sapiens
ctcctgtcccttttc

SEQ ID NO: 687723 - DNA, 17 bp, Homo sapiens
ctcctgtcccttttccc

SEQ ID NO: 687724 - DNA, 20 bp, Homo sapiens
ctcctgtcccttttccctta

SEQ ID NO: 687725 - DNA, 23 bp, Homo sapiens
ctccttgagaggagaaatgcaat

SEQ ID NO: 687726 - DNA, 12 bp, Homo sapiens
ctccttttccta

SEQ ID NO: 687727 - DNA, 16 bp, Homo sapiens
ctccttttccttacca

SEQ ID NO: 687728 - DNA, 14 bp, Homo sapiens
ctcgaatttgaaga

SEQ ID NO: 687729 - DNA, 15 bp, Homo sapiens
ctcgaatttgaagag

SEQ ID NO: 687730 - DNA, 14 bp, Homo sapiens
ctcgcctcctcctc

SEQ ID NO: 687731 - DNA, 17 bp, Homo sapiens
ctcgcctcctcctcctg

SEQ ID NO: 687732 - DNA, 22 bp, Homo sapiens
ctcgctgagggcagactggggc

SEQ ID NO: 687733 - DNA, 13 bp, Homo sapiens
ctcggactctgct

SEQ ID NO: 687734 - DNA, 13 bp, Homo sapiens
ctcggcacacact

SEQ ID NO: 687735 - DNA, 16 bp, Homo sapiens
ctcgtcagccacctgg

SEQ ID NO: 687736 - DNA, 21 bp, Homo sapiens
ctcgtgcattaaaatttctta

SEQ ID NO: 687737 - DNA, 22 bp, Homo sapiens
ctctaaaaggtaatgtgtggat

SEQ ID NO: 687738 - DNA, 18 bp, Homo sapiens
ctctaccaaaaaaaggaa

SEQ ID NO: 687739 - DNA, 20 bp, Homo sapiens
ctctaccaaaaaaaggaagg

SEQ ID NO: 687740 - DNA, 21 bp, Homo sapiens
ctctaggaagacatttttccg

SEQ ID NO: 687741 - DNA, 12 bp, Homo sapiens
ctctagggtcca

SEQ ID NO: 687742 - DNA, 17 bp, Homo sapiens
ctctagtagtgtggcct

SEQ ID NO: 687743 - DNA, 19 bp, Homo sapiens
ctctcaccccactcctgtc

SEQ ID NO: 687744 - DNA, 19 bp, Homo sapiens
ctctcatcctccagtacct

SEQ ID NO: 687745 - DNA, 13 bp, Homo sapiens
ctctcatctcagg

SEQ ID NO: 687746 - DNA, 17 bp, Homo sapiens
ctctccaatgttctatt

SEQ ID NO: 687747 - DNA, 21 bp, Homo sapiens
ctggctttgcctcttctttgt

SEQ ID NO: 687748 - DNA, 22 bp, Homo sapiens
ctggctttgcctcttctttgtg

SEQ ID NO: 687749 - DNA, 17 bp, Homo sapiens
ctgggaacacagttctg

SEQ ID NO: 687750 - DNA, 15 bp, Homo sapiens
ctgggaacacatctg

SEQ ID NO: 687751 - DNA, 12 bp, Homo sapiens
ctgggagaggtt

SEQ ID NO: 687752 - DNA, 15 bp, Homo sapiens
ctgggagcagggcat

SEQ ID NO: 687753 - DNA, 18 bp, Homo sapiens
ctgggagccgcctgcttc

SEQ ID NO: 687754 - DNA, 16 bp, Homo sapiens
ctgggcagctgtccct

SEQ ID NO: 687755 - DNA, 13 bp, Homo sapiens
ctgggccagggtc

SEQ ID NO: 687756 - DNA, 18 bp, Homo sapiens
ctgggccatgtccaaaga

SEQ ID NO: 687757 - DNA, 22 bp, Homo sapiens
ctgggccctgagtctgggcagc

SEQ ID NO: 687758 - DNA, 21 bp, Homo sapiens
ctgggccgtggcacagctggg

SEQ ID NO: 687759 - DNA, 23 bp, Homo sapiens
ctgggcgtccagctcagccctgg

SEQ ID NO: 687760 - DNA, 16 bp, Homo sapiens
ctgggctattgctgct

SEQ ID NO: 687761 - DNA, 19 bp, Homo sapiens
ctgggctcaagctttcccg

SEQ ID NO: 687762 - DNA, 12 bp, Homo sapiens
ctgggctcagcc

SEQ ID NO: 687763 - DNA, 19 bp, Homo sapiens
ctgggcttatatgtacttt

SEQ ID NO: 687764 - DNA, 17 bp, Homo sapiens
ctggggacaggcccgct

SEQ ID NO: 687765 - DNA, 14 bp, Homo sapiens
ctggggcaggctgg

SEQ ID NO: 687766 - DNA, 16 bp, Homo sapiens
ctggggcaggctgggc

SEQ ID NO: 687767 - DNA, 21 bp, Homo sapiens
ctggggcaggctgggccatgt

SEQ ID NO: 687768 - DNA, 18 bp, Homo sapiens
ctggggcatcctgtgcca

SEQ ID NO: 687769 - DNA, 24 bp, Homo sapiens
ctggggcctagcgatctctcctgg

SEQ ID NO: 687770 - DNA, 13 bp, Homo sapiens
ctggggcctcaga

SEQ ID NO: 687771 - DNA, 12 bp, Homo sapiens
ctggggcctgag

SEQ ID NO: 687772 - DNA, 15 bp, Homo sapiens
ctggggcctgagaga

SEQ ID NO: 687773 - DNA, 16 bp, Homo sapiens
ctggggcctgagagaa

SEQ ID NO: 687774 - DNA, 19 bp, Homo sapiens
ctgggggcacaggaggcag

SEQ ID NO: 687775 - DNA, 14 bp, Homo sapiens
ctggggggacccag

SEQ ID NO: 687776 - DNA, 17 bp, Homo sapiens
ctggggggacccagtgc

SEQ ID NO: 687777 - DNA, 18 bp, Homo sapiens
ctggggggacccagtgca

SEQ ID NO: 687778 - DNA, 20 bp, Homo sapiens
ctggggtgctgcctgaatcc

SEQ ID NO: 687779 - DNA, 19 bp, Homo sapiens
ctggggttgcgtctgaggc

SEQ ID NO: 687780 - DNA, 23 bp, Homo sapiens
ctgggtaaaagcagggcagcagg

SEQ ID NO: 687781 - DNA, 18 bp, Homo sapiens
ctgggtatagtgcagaaa

SEQ ID NO: 687782 - DNA, 17 bp, Homo sapiens
ctgggtccttggctccc

SEQ ID NO: 687783 - DNA, 19 bp, Homo sapiens
ctgggtccttggctcccgg

SEQ ID NO: 687784 - DNA, 18 bp, Homo sapiens
ctgggtctgcgatgcagc

SEQ ID NO: 687785 - DNA, 18 bp, Homo sapiens
ctgggtctggggacaggc

SEQ ID NO: 687786 - DNA, 21 bp, Homo sapiens
ctgggtgtccccgctgctgtg

SEQ ID NO: 687787 - DNA, 12 bp, Homo sapiens
ctgggtgtctgg

SEQ ID NO: 687788 - DNA, 22 bp, Homo sapiens
ctgggtgtgttcttactgacac

SEQ ID NO: 687789 - DNA, 21 bp, Homo sapiens
ctggtactattgtgaccacag

SEQ ID NO: 687790 - DNA, 16 bp, Homo sapiens
ctggtcagctgcccca

SEQ ID NO: 687791 - DNA, 19 bp, Homo sapiens
ctggtcttgttagaaaaca

SEQ ID NO: 687792 - DNA, 14 bp, Homo sapiens
ctggtgaatatttt

SEQ ID NO: 687793 - DNA, 16 bp, Homo sapiens
ctggtgagaaaatata

SEQ ID NO: 687794 - DNA, 22 bp, Homo sapiens
ctggtgagaaaatatatgcctg

SEQ ID NO: 687795 - DNA, 19 bp, Homo sapiens
ctggtgagtaacttagaaa

SEQ ID NO: 687796 - DNA, 17 bp, Homo sapiens
ctggtggtttttgctct

SEQ ID NO: 687797 - DNA, 19 bp, Homo sapiens
ctggtgtatattttaatgt

SEQ ID NO: 687798 - DNA, 21 bp, Homo sapiens
ctggtgtttattataaagctt

SEQ ID NO: 687799 - DNA, 17 bp, Homo sapiens
ctggttaccactctttt

SEQ ID NO: 687800 - DNA, 16 bp, Homo sapiens
ctggttcagacacagc

SEQ ID NO: 687801 - DNA, 15 bp, Homo sapiens
ctggttccctgctgc

SEQ ID NO: 687802 - DNA, 18 bp, Homo sapiens
ctggttccctgctgcgct

SEQ ID NO: 687803 - DNA, 19 bp, Homo sapiens
ctggttggagaaggtcaca

SEQ ID NO: 687804 - DNA, 14 bp, Homo sapiens
ctggtttcccttta

SEQ ID NO: 687805 - DNA, 17 bp, Homo sapiens
ctggtttccctttattt

SEQ ID NO: 687806 - DNA, 19 bp, Homo sapiens
ctgtaatcccagcactttg

SEQ ID NO: 687807 - DNA, 14 bp, Homo sapiens
ctgtacatttaaaa

SEQ ID NO: 687808 - DNA, 19 bp, Homo sapiens
ctgtacatttaaaattgct

SEQ ID NO: 687809 - DNA, 17 bp, Homo sapiens
ctgtactgtgtctcatg

SEQ ID NO: 687810 - DNA, 22 bp, Homo sapiens
ctgtagaaaggggagaatgtca

SEQ ID NO: 687811 - DNA, 14 bp, Homo sapiens
ctgtagatatgtat

SEQ ID NO: 687812 - DNA, 18 bp, Homo sapiens
ctgtagatatgtattctt

SEQ ID NO: 687813 - DNA, 19 bp, Homo sapiens
ctgtagctacaagggaagc

SEQ ID NO: 687814 - DNA, 14 bp, Homo sapiens
ctgtagctacattt

SEQ ID NO: 687815 - DNA, 16 bp, Homo sapiens
ctgtagcttttaggaa

SEQ ID NO: 687816 - DNA, 12 bp, Homo sapiens
ctgtaggcctca

SEQ ID NO: 687817 - DNA, 14 bp, Homo sapiens
ctgtagtcccagct

SEQ ID NO: 687818 - DNA, 13 bp, Homo sapiens
ctgtagtttatgg

SEQ ID NO: 687819 - DNA, 19 bp, Homo sapiens
ctgtatatttgtaaagcta

SEQ ID NO: 687820 - DNA, 20 bp, Homo sapiens
ctgtatatttgtaaagctat

SEQ ID NO: 687821 - DNA, 20 bp, Homo sapiens
ctgtatgaaaaattggggag

SEQ ID NO: 687822 - DNA, 16 bp, Homo sapiens
ctgtattcgtgcattt

SEQ ID NO: 687823 - DNA, 20 bp, Homo sapiens
ctgtatttttatttttgcac

SEQ ID NO: 687824 - DNA, 14 bp, Homo sapiens
ctgtcaaggctcag

SEQ ID NO: 687825 - DNA, 15 bp, Homo sapiens
ctgtcacttgctgct

SEQ ID NO: 687826 - DNA, 15 bp, Homo sapiens
ctgtcattgcacata

SEQ ID NO: 687827 - DNA, 13 bp, Homo sapiens
ctgtccaaattta

SEQ ID NO: 687828 - DNA, 23 bp, Homo sapiens
ctgtccaaatttaaaatgtgtgc

SEQ ID NO: 687829 - DNA, 15 bp, Homo sapiens
ctgtccctgaaacct

SEQ ID NO: 687830 - DNA, 14 bp, Homo sapiens
ctgtcccttgcctc

SEQ ID NO: 687831 - DNA, 18 bp, Homo sapiens
ctgtcccttgctgtatgc

SEQ ID NO: 687832 - DNA, 17 bp, Homo sapiens
ctgtcccttgcttgcct

SEQ ID NO: 687833 - DNA, 17 bp, Homo sapiens
ctgtcctaaggaacctt

SEQ ID NO: 687834 - DNA, 13 bp, Homo sapiens
ctgtcctggaggt

SEQ ID NO: 687835 - DNA, 11 bp, Homo sapiens
ctgtccttaac

SEQ ID NO: 687836 - DNA, 17 bp, Homo sapiens
ctgtcctttcagtctga

SEQ ID NO: 687837 - DNA, 15 bp, Homo sapiens
ctgtcgttaaaaaca

SEQ ID NO: 687838 - DNA, 22 bp, Homo sapiens
ctgtctctaccaaaaaaaggaa

SEQ ID NO: 687839 - DNA, 19 bp, Homo sapiens
ctgtctgtatagtgtctgt

SEQ ID NO: 687840 - DNA, 17 bp, Homo sapiens
ctgtctgttatgatttc

SEQ ID NO: 687841 - DNA, 19 bp, Homo sapiens
ctgtcttgttaatgctttt

SEQ ID NO: 687842 - DNA, 16 bp, Homo sapiens
ctgtctttcagataca

SEQ ID NO: 687843 - DNA, 20 bp, Homo sapiens
ctgtctttcagatacatggt

SEQ ID NO: 687844 - DNA, 20 bp, Homo sapiens
ctgtgaatctgctttaatta

SEQ ID NO: 687845 - DNA, 21 bp, Homo sapiens
ctgtgagattttgcttttcca

SEQ ID NO: 687846 - DNA, 22 bp, Homo sapiens
ctgtgcaacggtctcctgactg

SEQ ID NO: 687847 - DNA, 13 bp, Homo sapiens
ctgtgcagaccca

SEQ ID NO: 687848 - DNA, 15 bp, Homo sapiens
ctgtgccagcaccac

SEQ ID NO: 687849 - DNA, 23 bp, Homo sapiens
ctgtgctgggggaatgagcccag

SEQ ID NO: 687850 - DNA, 16 bp, Homo sapiens
ctgtggttcctctgct

SEQ ID NO: 687851 - DNA, 21 bp, Homo sapiens
ctgtgtatatggtatatatac

SEQ ID NO: 687852 - DNA, 13 bp, Homo sapiens
ctgtgtgaatgtg

SEQ ID NO: 687853 - DNA, 14 bp, Homo sapiens
ctgtgtgaatgtgg

SEQ ID NO: 687854 - DNA, 17 bp, Homo sapiens
ctgtgtgaatgtgggca

SEQ ID NO: 687855 - DNA, 19 bp, Homo sapiens
ctgtgtgtcccaggcaggg

SEQ ID NO: 687856 - DNA, 22 bp, Homo sapiens
ctgtgtgtcccaggcagggaga

SEQ ID NO: 687857 - DNA, 18 bp, Homo sapiens
ctgttacactttttggaa

SEQ ID NO: 687858 - DNA, 15 bp, Homo sapiens
ctgttactgggccct

SEQ ID NO: 687859 - DNA, 20 bp, Homo sapiens
ctgttactgggccctgagtc

SEQ ID NO: 687860 - DNA, 23 bp, Homo sapiens
ctgttatatatttactcagtctt

SEQ ID NO: 687861 - DNA, 18 bp, Homo sapiens
ctgttattcaaatttgat

SEQ ID NO: 687862 - DNA, 13 bp, Homo sapiens
ctgttatttcttc

SEQ ID NO: 687863 - DNA, 18 bp, Homo sapiens
ctgttcatttctaaattt

SEQ ID NO: 687864 - DNA, 19 bp, Homo sapiens
ctgttcatttctaaattta

SEQ ID NO: 687865 - DNA, 20 bp, Homo sapiens
ctgttctgtggttcctctgc

SEQ ID NO: 687866 - DNA, 13 bp, Homo sapiens
ctgttggtctgcc

SEQ ID NO: 687867 - DNA, 14 bp, Homo sapiens
ctgttggtctgcct

SEQ ID NO: 687868 - DNA, 20 bp, Homo sapiens
ctgttggtctgccttctgct

SEQ ID NO: 687869 - DNA, 22 bp, Homo sapiens
ctgttggtctgccttctgctga

SEQ ID NO: 687870 - DNA, 19 bp, Homo sapiens
ctgttgtaagaattctgat

SEQ ID NO: 687871 - DNA, 16 bp, Homo sapiens
ctgtttcagaggctca

SEQ ID NO: 687872 - DNA, 14 bp, Homo sapiens
ctgtttctaagaaa

SEQ ID NO: 687873 - DNA, 16 bp, Homo sapiens
ctgtttctaagaaaat

SEQ ID NO: 687874 - DNA, 14 bp, Homo sapiens
ctgtttctgtttat

SEQ ID NO: 687875 - DNA, 12 bp, Homo sapiens
ctgtttggactg

SEQ ID NO: 687876 - DNA, 21 bp, Homo sapiens
cttaaaattgatattatatta

SEQ ID NO: 687877 - DNA, 18 bp, Homo sapiens
cttaaacacaggctgtcc

SEQ ID NO: 687878 - DNA, 20 bp, Homo sapiens
cttaaataatgcttcagata

SEQ ID NO: 687879 - DNA, 18 bp, Homo sapiens
cttaaatgtttatactgt

SEQ ID NO: 687880 - DNA, 22 bp, Homo sapiens
cttaaatgtttatactgtattt

SEQ ID NO: 687881 - DNA, 23 bp, Homo sapiens
cttaaattttatatcattttaaa

SEQ ID NO: 687882 - DNA, 14 bp, Homo sapiens
cttaacccacctct

SEQ ID NO: 687883 - DNA, 17 bp, Homo sapiens
cttaacccacctctcct

SEQ ID NO: 687884 - DNA, 22 bp, Homo sapiens
cttaacccacctctcctgccct

SEQ ID NO: 687885 - DNA, 18 bp, Homo sapiens
cttaacctttgctatgta

SEQ ID NO: 687886 - DNA, 12 bp, Homo sapiens
cttaacttgttt

SEQ ID NO: 687887 - DNA, 11 bp, Homo sapiens
cttaactttat

SEQ ID NO: 687888 - DNA, 13 bp, Homo sapiens
cttaactttataa

SEQ ID NO: 687889 - DNA, 20 bp, Homo sapiens
cttaaggggtatcatgtatg

SEQ ID NO: 687890 - DNA, 14 bp, Homo sapiens
cttaattgactgaa

SEQ ID NO: 687891 - DNA, 15 bp, Homo sapiens
cttaattgactgaaa

SEQ ID NO: 687892 - DNA, 16 bp, Homo sapiens
cttaattgactgaaat

SEQ ID NO: 687893 - DNA, 19 bp, Homo sapiens
cttaatttagaaactgaaa

SEQ ID NO: 687894 - DNA, 21 bp, Homo sapiens
cttacaatattgattgggaaa

SEQ ID NO: 687895 - DNA, 14 bp, Homo sapiens
cttacaatcaaatc

SEQ ID NO: 687896 - DNA, 14 bp, Homo sapiens
cttacaatgtgaat

SEQ ID NO: 687897 - DNA, 23 bp, Homo sapiens
cttacaatgtgaataatggcact

SEQ ID NO: 687898 - DNA, 13 bp, Homo sapiens
cttacacactgtc

SEQ ID NO: 687899 - DNA, 15 bp, Homo sapiens
cttacacactgtctg

SEQ ID NO: 687900 - DNA, 23 bp, Homo sapiens
cttacagccctaagtggctgcct

SEQ ID NO: 687901 - DNA, 15 bp, Homo sapiens
cttacaggtcctgct

SEQ ID NO: 687902 - DNA, 14 bp, Homo sapiens
cttacatgcatttg

SEQ ID NO: 687903 - DNA, 22 bp, Homo sapiens
cttactattttgacagttattt

SEQ ID NO: 687904 - DNA, 24 bp, Homo sapiens
cttactcccccaccactcaggcca

SEQ ID NO: 687905 - DNA, 17 bp, Homo sapiens
cttactgattattttct

SEQ ID NO: 687906 - DNA, 22 bp, Homo sapiens
cttacttgccaagaaaatgaag

SEQ ID NO: 687907 - DNA, 24 bp, Homo sapiens
cttagaaaagtggtgtaaacttgt

SEQ ID NO: 687908 - DNA, 13 bp, Homo sapiens
cttagaaaatgtg

SEQ ID NO: 687909 - DNA, 20 bp, Homo sapiens
cttagaaacactgcaaattt

SEQ ID NO: 687910 - DNA, 14 bp, Homo sapiens
cttagaaagggaag

SEQ ID NO: 687911 - DNA, 16 bp, Homo sapiens
cttagcgtcaagacat

SEQ ID NO: 687912 - DNA, 17 bp, Homo sapiens
cttagggaagctggcct

SEQ ID NO: 687913 - DNA, 20 bp, Homo sapiens
cttagtgatcatttaaaaag

SEQ ID NO: 687914 - DNA, 13 bp, Homo sapiens
cttagtgggccag

SEQ ID NO: 687915 - DNA, 18 bp, Homo sapiens
cttagtgggccagggctg

SEQ ID NO: 687916 - DNA, 19 bp, Homo sapiens
cttatacgcttttctttgt

SEQ ID NO: 687917 - DNA, 16 bp, Homo sapiens
cttataggcctgtccc

SEQ ID NO: 687918 - DNA, 18 bp, Homo sapiens
cttataggcctgtccctt

SEQ ID NO: 687919 - DNA, 16 bp, Homo sapiens
cttatagtctaagact

SEQ ID NO: 687920 - DNA, 12 bp, Homo sapiens
cttatcagagct

SEQ ID NO: 687921 - DNA, 15 bp, Homo sapiens
cttatccctctcttc

SEQ ID NO: 687922 - DNA, 18 bp, Homo sapiens
cttatcctacagtacaat

SEQ ID NO: 687923 - DNA, 15 bp, Homo sapiens
cttatcttgaccata

SEQ ID NO: 687924 - DNA, 22 bp, Homo sapiens
cttatcttgaccatactaataa

SEQ ID NO: 687925 - DNA, 14 bp, Homo sapiens
cttatgtcctgtca

SEQ ID NO: 687926 - DNA, 18 bp, Homo sapiens
cttatgtgaaaaattaac

SEQ ID NO: 687927 - DNA, 21 bp, Homo sapiens
cttatgtgaaaaattaacttt

SEQ ID NO: 687928 - DNA, 20 bp, Homo sapiens
cttattagaaaaatattata

SEQ ID NO: 687929 - DNA, 12 bp, Homo sapiens
cttattcttaag

SEQ ID NO: 687930 - DNA, 16 bp, Homo sapiens
cttattgaccattttt

SEQ ID NO: 687931 - DNA, 18 bp, Homo sapiens
cttattgtttctctgaaa

SEQ ID NO: 687932 - DNA, 12 bp, Homo sapiens
cttatttaacca

SEQ ID NO: 687933 - DNA, 16 bp, Homo sapiens
cttatttacccttttc

SEQ ID NO: 687934 - DNA, 14 bp, Homo sapiens
cttatttgccttct

SEQ ID NO: 687935 - DNA, 23 bp, Homo sapiens
cttatttgccttctactcccctt

SEQ ID NO: 687936 - DNA, 14 bp, Homo sapiens
cttattttgtctta

SEQ ID NO: 687937 - DNA, 19 bp, Homo sapiens
cttattttgtcttattctt

SEQ ID NO: 687938 - DNA, 21 bp, Homo sapiens
cttattttgtcttattcttaa

SEQ ID NO: 687939 - DNA, 15 bp, Homo sapiens
cttcaaagccttctc

SEQ ID NO: 687940 - DNA, 17 bp, Homo sapiens
cttcaaagtttatatgc

SEQ ID NO: 687941 - DNA, 16 bp, Homo sapiens
cttcaatgacttctaa

SEQ ID NO: 687942 - DNA, 16 bp, Homo sapiens
cttcacatgtttaact

SEQ ID NO: 687943 - DNA, 22 bp, Homo sapiens
cttcacccgagttcctctgggt

SEQ ID NO: 687944 - DNA, 14 bp, Homo sapiens
cttcacttcaagct

SEQ ID NO: 687945 - DNA, 18 bp, Homo sapiens
cttcagatattattgctt

SEQ ID NO: 687946 - DNA, 17 bp, Homo sapiens
cttcagtattttctcca

SEQ ID NO: 687947 - DNA, 18 bp, Homo sapiens
cttcagtattttctccac

SEQ ID NO: 687948 - DNA, 15 bp, Homo sapiens
cttcagttgcttgtc

SEQ ID NO: 687949 - DNA, 23 bp, Homo sapiens
cttcagttgcttgtcttctggta

SEQ ID NO: 687950 - DNA, 23 bp, Homo sapiens
cttcatatagcattgataatctt

SEQ ID NO: 687951 - DNA, 17 bp, Homo sapiens
cttcatgcttgacatac

SEQ ID NO: 687952 - DNA, 19 bp, Homo sapiens
cttcatgcttgacatacct

SEQ ID NO: 687953 - DNA, 21 bp, Homo sapiens
cttcattattcaagaatgaaa

SEQ ID NO: 687954 - DNA, 23 bp, Homo sapiens
cttcatttttaagaaaggaagca

SEQ ID NO: 687955 - DNA, 19 bp, Homo sapiens
cttccaaatgcaatttgat

SEQ ID NO: 687956 - DNA, 12 bp, Homo sapiens
cttccagatcct

SEQ ID NO: 687957 - DNA, 19 bp, Homo sapiens
cttccaggggaacctgcca

SEQ ID NO: 687958 - DNA, 16 bp, Homo sapiens
cttccagtataaccag

SEQ ID NO: 687959 - DNA, 14 bp, Homo sapiens
cttccatgatttta

SEQ ID NO: 687960 - DNA, 15 bp, Homo sapiens
cttccatgtgccttt

SEQ ID NO: 687961 - DNA, 16 bp, Homo sapiens
cttccatgtgcctttc

SEQ ID NO: 687962 - DNA, 23 bp, Homo sapiens
cttccatgtgcctttctttgcct

SEQ ID NO: 687963 - DNA, 12 bp, Homo sapiens
cttcccatttct

SEQ ID NO: 687964 - DNA, 16 bp, Homo sapiens
cttcccatttcttccc

SEQ ID NO: 687965 - DNA, 15 bp, Homo sapiens
cttccccttccctta

SEQ ID NO: 687966 - DNA, 21 bp, Homo sapiens
cttccctgctttgcatctttg

SEQ ID NO: 687967 - DNA, 15 bp, Homo sapiens
cttcctcagctgcct

SEQ ID NO: 687968 - DNA, 16 bp, Homo sapiens
cttcctcttgtctgat

SEQ ID NO: 687969 - DNA, 18 bp, Homo sapiens
cttcctcttgtctgattt

SEQ ID NO: 687970 - DNA, 22 bp, Homo sapiens
cttcctgtgaagtttaattgtc

SEQ ID NO: 687971 - DNA, 23 bp, Homo sapiens
cttccttatgtatcagtgtcctt

SEQ ID NO: 687972 - DNA, 14 bp, Homo sapiens
cttccttcctgctt

SEQ ID NO: 687973 - DNA, 19 bp, Homo sapiens
cttcctttgcccttcctcc

SEQ ID NO: 687974 - DNA, 13 bp, Homo sapiens
cttctaaatgcat

SEQ ID NO: 687975 - DNA, 17 bp, Homo sapiens
cttctaagaagacattt

SEQ ID NO: 687976 - DNA, 20 bp, Homo sapiens
cttctaagaagacattttgt

SEQ ID NO: 687977 - DNA, 15 bp, Homo sapiens
cttctaattgctgtg

SEQ ID NO: 687978 - DNA, 14 bp, Homo sapiens
cttctacctgccct

SEQ ID NO: 687979 - DNA, 13 bp, Homo sapiens
cttctactcccct

SEQ ID NO: 687980 - DNA, 16 bp, Homo sapiens
cttctactcctgcctc

SEQ ID NO: 687981 - DNA, 17 bp, Homo sapiens
cttctactcctgcctca

SEQ ID NO: 687982 - DNA, 15 bp, Homo sapiens
cttctactgccttga

SEQ ID NO: 687983 - DNA, 15 bp, Homo sapiens
cttctagagttttat

SEQ ID NO: 687984 - DNA, 19 bp, Homo sapiens
cttctccctagctcctccc

SEQ ID NO: 687985 - DNA, 15 bp, Homo sapiens
cttctctgtgagaag

SEQ ID NO: 687986 - DNA, 18 bp, Homo sapiens
cttctctgttggtctgcc

SEQ ID NO: 687987 - DNA, 13 bp, Homo sapiens
gacataatttcag

SEQ ID NO: 687988 - DNA, 15 bp, Homo sapiens
gacatcacagggtgg

SEQ ID NO: 687989 - DNA, 19 bp, Homo sapiens
gacatcacagggtgggcct

SEQ ID NO: 687990 - DNA, 16 bp, Homo sapiens
gacatgaagctgttgt

SEQ ID NO: 687991 - DNA, 15 bp, Homo sapiens
gacatgcaataaaat

SEQ ID NO: 687992 - DNA, 20 bp, Homo sapiens
gacatgcaataaaatttaaa

SEQ ID NO: 687993 - DNA, 19 bp, Homo sapiens
gacatggctccggcctctg

SEQ ID NO: 687994 - DNA, 20 bp, Homo sapiens
gacatgggtgaacttacttg

SEQ ID NO: 687995 - DNA, 13 bp, Homo sapiens
gaccacccctctc

SEQ ID NO: 687996 - DNA, 23 bp, Homo sapiens
gaccacttccaggggaacctgcc

SEQ ID NO: 687997 - DNA, 18 bp, Homo sapiens
gaccatcaagaacctaca

SEQ ID NO: 687998 - DNA, 23 bp, Homo sapiens
gaccattttttaatttacttgtt

SEQ ID NO: 687999 - DNA, 18 bp, Homo sapiens
gacccacgggctcatgca

SEQ ID NO: 688000 - DNA, 21 bp, Homo sapiens
gacccactttgtaatttttgc

SEQ ID NO: 688001 - DNA, 22 bp, Homo sapiens
gacccagtcccacactgtggcc

SEQ ID NO: 688002 - DNA, 23 bp, Homo sapiens
gacccagtcccacactgtggcca

SEQ ID NO: 688003 - DNA, 17 bp, Homo sapiens
gacccccatctgagctg

SEQ ID NO: 688004 - DNA, 13 bp, Homo sapiens
gaccccctcagcc

SEQ ID NO: 688005 - DNA, 20 bp, Homo sapiens
gaccccgtccacgtcctcca

SEQ ID NO: 688006 - DNA, 22 bp, Homo sapiens
gaccctcttgcccatcctgact

SEQ ID NO: 688007 - DNA, 20 bp, Homo sapiens
gaccctgcaaacagaacagg

SEQ ID NO: 688008 - DNA, 17 bp, Homo sapiens
gaccctgggggcacagg

SEQ ID NO: 688009 - DNA, 21 bp, Homo sapiens
gaccctgggggcacaggaggc

SEQ ID NO: 688010 - DNA, 24 bp, Homo sapiens
gaccctgtcctgcagtcccacact

SEQ ID NO: 688011 - DNA, 15 bp, Homo sapiens
gacccttataaaatc

SEQ ID NO: 688012 - DNA, 17 bp, Homo sapiens
gacccttataaaatcct

SEQ ID NO: 688013 - DNA, 20 bp, Homo sapiens
gacctggcatctaattctga

SEQ ID NO: 688014 - DNA, 23 bp, Homo sapiens
gacctgtatatttgtaaagctat

SEQ ID NO: 688015 - DNA, 23 bp, Homo sapiens
gacggctgggtgtttcagtttga

SEQ ID NO: 688016 - DNA, 17 bp, Homo sapiens
gacgggaggggaggcat

SEQ ID NO: 688017 - DNA, 18 bp, Homo sapiens
gacgggaggggaggcatt

SEQ ID NO: 688018 - DNA, 22 bp, Homo sapiens
gacggtttccagggaggggccg

SEQ ID NO: 688019 - DNA, 21 bp, Homo sapiens
gacgttgacctggactgaagt

SEQ ID NO: 688020 - DNA, 13 bp, Homo sapiens
gactaaagagaga

SEQ ID NO: 688021 - DNA, 22 bp, Homo sapiens
gactacacaatacagtattata

SEQ ID NO: 688022 - DNA, 15 bp, Homo sapiens
gactacacctacgga

SEQ ID NO: 688023 - DNA, 13 bp, Homo sapiens
gactatctttgct

SEQ ID NO: 688024 - DNA, 20 bp, Homo sapiens
gactattgtgccaactgcca

SEQ ID NO: 688025 - DNA, 21 bp, Homo sapiens
gactcaaggtggacgtgcgtt

SEQ ID NO: 688026 - DNA, 18 bp, Homo sapiens
gactcaattatttgcata

SEQ ID NO: 688027 - DNA, 14 bp, Homo sapiens
gactcatcatttgt

SEQ ID NO: 688028 - DNA, 12 bp, Homo sapiens
gactccctggga

SEQ ID NO: 688029 - DNA, 15 bp, Homo sapiens
gactgaaagtagggg

SEQ ID NO: 688030 - DNA, 21 bp, Homo sapiens
gactgaaattactttaacatt

SEQ ID NO: 688031 - DNA, 12 bp, Homo sapiens
gactgaatgcag

SEQ ID NO: 688032 - DNA, 20 bp, Homo sapiens
gactgacccccatctgagct

SEQ ID NO: 688033 - DNA, 21 bp, Homo sapiens
gactgctacctttcaaagctt

SEQ ID NO: 688034 - DNA, 21 bp, Homo sapiens
gactggcccctaggctgctgc

SEQ ID NO: 688035 - DNA, 19 bp, Homo sapiens
gactgtacattatgaagaa

SEQ ID NO: 688036 - DNA, 20 bp, Homo sapiens
gactgtacattatgaagaat

SEQ ID NO: 688037 - DNA, 23 bp, Homo sapiens
gactgtaccatggtttgatatgt

SEQ ID NO: 688038 - DNA, 13 bp, Homo sapiens
gactgtctttcag

SEQ ID NO: 688039 - DNA, 21 bp, Homo sapiens
gactgtgtctgcctgtcccca

SEQ ID NO: 688040 - DNA, 18 bp, Homo sapiens
gactgttagttgtccaca

SEQ ID NO: 688041 - DNA, 17 bp, Homo sapiens
gacttagcgtcaagaca

SEQ ID NO: 688042 - DNA, 17 bp, Homo sapiens
gacttattttgtcttat

SEQ ID NO: 688043 - DNA, 12 bp, Homo sapiens
gacttcaaagca

SEQ ID NO: 688044 - DNA, 17 bp, Homo sapiens
gacttctaatttatatt

SEQ ID NO: 688045 - DNA, 18 bp, Homo sapiens
gacttgagacaatgtttt

SEQ ID NO: 688046 - DNA, 17 bp, Homo sapiens
gacttgtacaaacagta

SEQ ID NO: 688047 - DNA, 19 bp, Homo sapiens
gacttgtacaaacagtatt

SEQ ID NO: 688048 - DNA, 14 bp, Homo sapiens
gactttctcctggc

SEQ ID NO: 688049 - DNA, 18 bp, Homo sapiens
gacttttcaataaatcag

SEQ ID NO: 688050 - DNA, 15 bp, Homo sapiens
gacttttgaaaaaaa

SEQ ID NO: 688051 - DNA, 16 bp, Homo sapiens
gacttttgttaaattc

SEQ ID NO: 688052 - DNA, 22 bp, Homo sapiens
gacttttgttaaattcagtaat

SEQ ID NO: 688053 - DNA, 14 bp, Homo sapiens
gagaaaagaaaaat

SEQ ID NO: 688054 - DNA, 12 bp, Homo sapiens
gagaaaatatat

SEQ ID NO: 688055 - DNA, 14 bp, Homo sapiens
gagaaccaaccagg

SEQ ID NO: 688056 - DNA, 16 bp, Homo sapiens
gagaacccagtttccc

SEQ ID NO: 688057 - DNA, 19 bp, Homo sapiens
gagaaggtaaggtgtgaac

SEQ ID NO: 688058 - DNA, 16 bp, Homo sapiens
gagaaggtttattgtt

SEQ ID NO: 688059 - DNA, 17 bp, Homo sapiens
gagaaggtttattgtta

SEQ ID NO: 688060 - DNA, 23 bp, Homo sapiens
gagaatcacttgaccgggagaca

SEQ ID NO: 688061 - DNA, 23 bp, Homo sapiens
gagaatgagtccttgatttcaaa

SEQ ID NO: 688062 - DNA, 23 bp, Homo sapiens
gagaatggtgtgaacccgggagc

SEQ ID NO: 688063 - DNA, 21 bp, Homo sapiens
gagaatgtagatattgtgaag

SEQ ID NO: 688064 - DNA, 14 bp, Homo sapiens
gagacactgtctct

SEQ ID NO: 688065 - DNA, 21 bp, Homo sapiens
gagaccacacaccctttggga

SEQ ID NO: 688066 - DNA, 16 bp, Homo sapiens
gagaccatcctggcta

SEQ ID NO: 688067 - DNA, 22 bp, Homo sapiens
gagaccctgcaaacagaacagg

SEQ ID NO: 688068 - DNA, 23 bp, Homo sapiens
gagacgtttataaacagaaatgg

SEQ ID NO: 688069 - DNA, 13 bp, Homo sapiens
gagactcagtgca

SEQ ID NO: 688070 - DNA, 15 bp, Homo sapiens
gagactcagtgcaga

SEQ ID NO: 688071 - DNA, 16 bp, Homo sapiens
gagactcagtgcagat

SEQ ID NO: 688072 - DNA, 23 bp, Homo sapiens
gagactcagtgcagatggagaga

SEQ ID NO: 688073 - DNA, 19 bp, Homo sapiens
gagactctagggtccagtg

SEQ ID NO: 688074 - DNA, 22 bp, Homo sapiens
gagactgtccctgaaacctagt

SEQ ID NO: 688075 - DNA, 13 bp, Homo sapiens
gagagcctggggg

SEQ ID NO: 688076 - DNA, 19 bp, Homo sapiens
gagagcttggactacacaa

SEQ ID NO: 688077 - DNA, 19 bp, Homo sapiens
gagagggcccaggtcccaa

SEQ ID NO: 688078 - DNA, 15 bp, Homo sapiens
gagagggctggtcct

SEQ ID NO: 688079 - DNA, 15 bp, Homo sapiens
gagaggggaaagtgt

SEQ ID NO: 688080 - DNA, 21 bp, Homo sapiens
gagaggtgattctcagggctg

SEQ ID NO: 688081 - DNA, 22 bp, Homo sapiens
gagaggtgattctcagggctgg

SEQ ID NO: 688082 - DNA, 14 bp, Homo sapiens
gagagtacctgtgt

SEQ ID NO: 688083 - DNA, 21 bp, Homo sapiens
gagagttaataggagtatttt

SEQ ID NO: 688084 - DNA, 19 bp, Homo sapiens
gagataaaccaataaatcc

SEQ ID NO: 688085 - DNA, 17 bp, Homo sapiens
gagatcagcatgcctgt

SEQ ID NO: 688086 - DNA, 14 bp, Homo sapiens
gagatgagaaatga

SEQ ID NO: 688087 - DNA, 18 bp, Homo sapiens
gagatgagaaatgatgaa

SEQ ID NO: 688088 - DNA, 13 bp, Homo sapiens
gagattataataa

SEQ ID NO: 688089 - DNA, 21 bp, Homo sapiens
gagattctggtccctggaaat

SEQ ID NO: 688090 - DNA, 12 bp, Homo sapiens
gagatttgtcta

SEQ ID NO: 688091 - DNA, 13 bp, Homo sapiens
gagcacctcacct

SEQ ID NO: 688092 - DNA, 22 bp, Homo sapiens
gagcacctcacctcccgaagcc

SEQ ID NO: 688093 - DNA, 19 bp, Homo sapiens
gagcactgcgcgctatccc

SEQ ID NO: 688094 - DNA, 15 bp, Homo sapiens
gagcagggcatagga

SEQ ID NO: 688095 - DNA, 16 bp, Homo sapiens
gagcagtcgcctgcct

SEQ ID NO: 688096 - DNA, 15 bp, Homo sapiens
gagcatgtaagtgtt

SEQ ID NO: 688097 - DNA, 12 bp, Homo sapiens
gagccagcaggg

SEQ ID NO: 688098 - DNA, 16 bp, Homo sapiens
gagcccagagaacagc

SEQ ID NO: 688099 - DNA, 12 bp, Homo sapiens
gagcctcctggg

SEQ ID NO: 688100 - DNA, 11 bp, Homo sapiens
gagcctggggg

SEQ ID NO: 688101 - DNA, 11 bp, Homo sapiens
gagcctggggt

SEQ ID NO: 688102 - DNA, 21 bp, Homo sapiens
gagcctggttcagacacagct

SEQ ID NO: 688103 - DNA, 22 bp, Homo sapiens
gagcctggttcagacacagctc

SEQ ID NO: 688104 - DNA, 14 bp, Homo sapiens
gagccttttgctct

SEQ ID NO: 688105 - DNA, 15 bp, Homo sapiens
gagctaagggtgggt

SEQ ID NO: 688106 - DNA, 13 bp, Homo sapiens
gcagctgcctctg

SEQ ID NO: 688107 - DNA, 15 bp, Homo sapiens
gcagctgcctctgct

SEQ ID NO: 688108 - DNA, 18 bp, Homo sapiens
gcagcttctactcctgcc

SEQ ID NO: 688109 - DNA, 13 bp, Homo sapiens
gcagcttctccag

SEQ ID NO: 688110 - DNA, 19 bp, Homo sapiens
gcaggaccctgtcctgcag

SEQ ID NO: 688111 - DNA, 20 bp, Homo sapiens
gcaggactcctggcagggcc

SEQ ID NO: 688112 - DNA, 18 bp, Homo sapiens
gcaggagtggtgcagaca

SEQ ID NO: 688113 - DNA, 17 bp, Homo sapiens
gcaggcaggcggctcct

SEQ ID NO: 688114 - DNA, 18 bp, Homo sapiens
gcaggcaggcggctcctc

SEQ ID NO: 688115 - DNA, 15 bp, Homo sapiens
gcaggcatggccctg

SEQ ID NO: 688116 - DNA, 19 bp, Homo sapiens
gcaggcatggccctgggcg

SEQ ID NO: 688117 - DNA, 15 bp, Homo sapiens
gcaggcattgaggaa

SEQ ID NO: 688118 - DNA, 14 bp, Homo sapiens
gcaggctagacaga

SEQ ID NO: 688119 - DNA, 10 bp, Homo sapiens
gcaggctggg

SEQ ID NO: 688120 - DNA, 14 bp, Homo sapiens
gcagggaaggcctg

SEQ ID NO: 688121 - DNA, 22 bp, Homo sapiens
gcagggagctgggcccgacatg

SEQ ID NO: 688122 - DNA, 21 bp, Homo sapiens
gcagggccacctgcaggaccc

SEQ ID NO: 688123 - DNA, 18 bp, Homo sapiens
gcagggccatggctcagg

SEQ ID NO: 688124 - DNA, 22 bp, Homo sapiens
gcagggccatggctcagggtgg

SEQ ID NO: 688125 - DNA, 22 bp, Homo sapiens
gcagggctggcacgtgacaggc

SEQ ID NO: 688126 - DNA, 20 bp, Homo sapiens
gcaggggcttgttgcaggct

SEQ ID NO: 688127 - DNA, 20 bp, Homo sapiens
gcaggggtgacggccctcat

SEQ ID NO: 688128 - DNA, 14 bp, Homo sapiens
gcaggtgggcagac

SEQ ID NO: 688129 - DNA, 15 bp, Homo sapiens
gcagtattcttgcac

SEQ ID NO: 688130 - DNA, 16 bp, Homo sapiens
gcagtcactgggagag

SEQ ID NO: 688131 - DNA, 20 bp, Homo sapiens
gcagtcactgggagaggtta

SEQ ID NO: 688132 - DNA, 23 bp, Homo sapiens
gcagtcgcctgcctgcagcaggc

SEQ ID NO: 688133 - DNA, 16 bp, Homo sapiens
gcagtctttcttgaaa

SEQ ID NO: 688134 - DNA, 18 bp, Homo sapiens
gcagtggccatcatcctc

SEQ ID NO: 688135 - DNA, 20 bp, Homo sapiens
gcataaagaattaatgactt

SEQ ID NO: 688136 - DNA, 22 bp, Homo sapiens
gcataatgataaaataaataat

SEQ ID NO: 688137 - DNA, 15 bp, Homo sapiens
gcatacgcctcttgt

SEQ ID NO: 688138 - DNA, 14 bp, Homo sapiens
gcatactttgtatt

SEQ ID NO: 688139 - DNA, 23 bp, Homo sapiens
gcatagataatattgtttggtaa

SEQ ID NO: 688140 - DNA, 19 bp, Homo sapiens
gcataggaagaaaatgtca

SEQ ID NO: 688141 - DNA, 19 bp, Homo sapiens
gcatatagttaaactgaga

SEQ ID NO: 688142 - DNA, 16 bp, Homo sapiens
gcatattcaatgtatt

SEQ ID NO: 688143 - DNA, 18 bp, Homo sapiens
gcatattttgagaaactg

SEQ ID NO: 688144 - DNA, 20 bp, Homo sapiens
gcatctcctcccgcccttcc

SEQ ID NO: 688145 - DNA, 23 bp, Homo sapiens
gcatctcctcccgcccttccatg

SEQ ID NO: 688146 - DNA, 14 bp, Homo sapiens
gcatgaaatgtgaa

SEQ ID NO: 688147 - DNA, 18 bp, Homo sapiens
gcatgagactcagtgcag

SEQ ID NO: 688148 - DNA, 21 bp, Homo sapiens
gcatgagactcagtgcagatg

SEQ ID NO: 688149 - DNA, 14 bp, Homo sapiens
gcatgcaatttgaa

SEQ ID NO: 688150 - DNA, 14 bp, Homo sapiens
gcatgcatgcaaat

SEQ ID NO: 688151 - DNA, 16 bp, Homo sapiens
gcatggaggccctcct

SEQ ID NO: 688152 - DNA, 14 bp, Homo sapiens
gcatggtggccaga

SEQ ID NO: 688153 - DNA, 15 bp, Homo sapiens
gcatggttgttgcat

SEQ ID NO: 688154 - DNA, 22 bp, Homo sapiens
gcatgtagactgtgccagaggc

SEQ ID NO: 688155 - DNA, 20 bp, Homo sapiens
gcatgtagaggcttgtttac

SEQ ID NO: 688156 - DNA, 21 bp, Homo sapiens
gcatgttcacccttatagtct

SEQ ID NO: 688157 - DNA, 15 bp, Homo sapiens
gcatgttttgttgct

SEQ ID NO: 688158 - DNA, 13 bp, Homo sapiens
gcattaatgtttc

SEQ ID NO: 688159 - DNA, 14 bp, Homo sapiens
gcattcaaaatctt

SEQ ID NO: 688160 - DNA, 17 bp, Homo sapiens
gcattgaactctacaac

SEQ ID NO: 688161 - DNA, 21 bp, Homo sapiens
gcattgaagtatggtgtgttc

SEQ ID NO: 688162 - DNA, 16 bp, Homo sapiens
gcattgataatcttca

SEQ ID NO: 688163 - DNA, 18 bp, Homo sapiens
gcattgataatcttcagg

SEQ ID NO: 688164 - DNA, 16 bp, Homo sapiens
gcatttccttgtcccg

SEQ ID NO: 688165 - DNA, 12 bp, Homo sapiens
gcatttctattg

SEQ ID NO: 688166 - DNA, 22 bp, Homo sapiens
gcatttgtggtaatctacacca

SEQ ID NO: 688167 - DNA, 12 bp, Homo sapiens
gcattttgtaat

SEQ ID NO: 688168 - DNA, 23 bp, Homo sapiens
gccaacagttgtatgtttgctga

SEQ ID NO: 688169 - DNA, 19 bp, Homo sapiens
gccaaccctgggctattgc

SEQ ID NO: 688170 - DNA, 13 bp, Homo sapiens
gccaactgacaaa

SEQ ID NO: 688171 - DNA, 21 bp, Homo sapiens
gccaactttccccacgttaaa

SEQ ID NO: 688172 - DNA, 18 bp, Homo sapiens
gccaagaaaatgaaggga

SEQ ID NO: 688173 - DNA, 12 bp, Homo sapiens
gccacctgcagg

SEQ ID NO: 688174 - DNA, 17 bp, Homo sapiens
gccacctgggaacacag

SEQ ID NO: 688175 - DNA, 22 bp, Homo sapiens
gccacctgggaacacagttctg

SEQ ID NO: 688176 - DNA, 14 bp, Homo sapiens
gccactgctgtatt

SEQ ID NO: 688177 - DNA, 18 bp, Homo sapiens
gccagaatctagagcaaa

SEQ ID NO: 688178 - DNA, 19 bp, Homo sapiens
gccagaatctagagcaaag

SEQ ID NO: 688179 - DNA, 21 bp, Homo sapiens
gccagacccacgggctcatgc

SEQ ID NO: 688180 - DNA, 13 bp, Homo sapiens
gccagaggccaga

SEQ ID NO: 688181 - DNA, 19 bp, Homo sapiens
gccagcagaactgaagtgt

SEQ ID NO: 688182 - DNA, 17 bp, Homo sapiens
gccagcccatggccccc

SEQ ID NO: 688183 - DNA, 19 bp, Homo sapiens
gccagcccatggcccccaa

SEQ ID NO: 688184 - DNA, 16 bp, Homo sapiens
gccagcgggcccagca

SEQ ID NO: 688185 - DNA, 19 bp, Homo sapiens
gccaggaccttggtgagat

SEQ ID NO: 688186 - DNA, 23 bp, Homo sapiens
gccaggagctgtcaccaaggaaa

SEQ ID NO: 688187 - DNA, 22 bp, Homo sapiens
gccaggccttacatctggctgg

SEQ ID NO: 688188 - DNA, 18 bp, Homo sapiens
gccaggctgcctggcctt

SEQ ID NO: 688189 - DNA, 10 bp, Homo sapiens
gccagggctg

SEQ ID NO: 688190 - DNA, 18 bp, Homo sapiens
gccagggtctctccctca

SEQ ID NO: 688191 - DNA, 19 bp, Homo sapiens
gccagggtctctccctcag

SEQ ID NO: 688192 - DNA, 23 bp, Homo sapiens
gccagggtctctccctcaggtgt

SEQ ID NO: 688193 - DNA, 18 bp, Homo sapiens
gccagggtctgtgtgaat

SEQ ID NO: 688194 - DNA, 20 bp, Homo sapiens
gccagggtctgtgtgaatgt

SEQ ID NO: 688195 - DNA, 22 bp, Homo sapiens
gccagggtctgtgtgaatgtgg

SEQ ID NO: 688196 - DNA, 16 bp, Homo sapiens
gccagtaggagaaatc

SEQ ID NO: 688197 - DNA, 14 bp, Homo sapiens
gccagtctcattgt

SEQ ID NO: 688198 - DNA, 14 bp, Homo sapiens
gccagtggggcctg

SEQ ID NO: 688199 - DNA, 16 bp, Homo sapiens
gccagtggggcctgtg

SEQ ID NO: 688200 - DNA, 17 bp, Homo sapiens
gccagtggggcctgtgg

SEQ ID NO: 688201 - DNA, 19 bp, Homo sapiens
gccagtggggcctgtggaa

SEQ ID NO: 688202 - DNA, 17 bp, Homo sapiens
gccagttagactagtcc

SEQ ID NO: 688203 - DNA, 15 bp, Homo sapiens
gccagttttccctgg

SEQ ID NO: 688204 - DNA, 19 bp, Homo sapiens
gccagttttccctggaact

SEQ ID NO: 688205 - DNA, 16 bp, Homo sapiens
gccatctagccagccc

SEQ ID NO: 688206 - DNA, 23 bp, Homo sapiens
gccatctagccagcccctcttcc

SEQ ID NO: 688207 - DNA, 17 bp, Homo sapiens
gccatctgttcatttct

SEQ ID NO: 688208 - DNA, 16 bp, Homo sapiens
gccatgccaggaacct

SEQ ID NO: 688209 - DNA, 20 bp, Homo sapiens
gccatggctgtctcaaacca

SEQ ID NO: 688210 - DNA, 19 bp, Homo sapiens
gccatgtccaaagaggctg

SEQ ID NO: 688211 - DNA, 20 bp, Homo sapiens
gccatttccaagaggctgta

SEQ ID NO: 688212 - DNA, 14 bp, Homo sapiens
gcccaaaatttgat

SEQ ID NO: 688213 - DNA, 15 bp, Homo sapiens
gcccaaactcctttc

SEQ ID NO: 688214 - DNA, 12 bp, Homo sapiens
gcccaatatatt

SEQ ID NO: 688215 - DNA, 16 bp, Homo sapiens
gcccaccctgctgctg

SEQ ID NO: 688216 - DNA, 14 bp, Homo sapiens
gcccacctgctccc

SEQ ID NO: 688217 - DNA, 16 bp, Homo sapiens
gcccacctgctcccag

SEQ ID NO: 688218 - DNA, 13 bp, Homo sapiens
gcccagagaacag

SEQ ID NO: 688219 - DNA, 21 bp, Homo sapiens
gcccagcaatctccatgtgta

SEQ ID NO: 688220 - DNA, 13 bp, Homo sapiens
gcccagcctcact

SEQ ID NO: 688221 - DNA, 17 bp, Homo sapiens
gcccagcctcacttcct

SEQ ID NO: 688222 - DNA, 18 bp, Homo sapiens
gcccagggcaccatccag

SEQ ID NO: 688223 - DNA, 11 bp, Homo sapiens
gcccagtgcat

SEQ ID NO: 688224 - DNA, 14 bp, Homo sapiens
gcccagtgcatggt

SEQ ID NO: 688225 - DNA, 12 bp, Homo sapiens
gcccatccttcc

SEQ ID NO: 688226 - DNA, 19 bp, Homo sapiens
gcgaccctgggggcacagg

SEQ ID NO: 688227 - DNA, 19 bp, Homo sapiens
gcgattctggataaagcca

SEQ ID NO: 688228 - DNA, 18 bp, Homo sapiens
gcgcaggcagcgcagggc

SEQ ID NO: 688229 - DNA, 21 bp, Homo sapiens
gcgcaggcagcgcagggctgg

SEQ ID NO: 688230 - DNA, 14 bp, Homo sapiens
gcgcagggctggca

SEQ ID NO: 688231 - DNA, 18 bp, Homo sapiens
gcgcaggtgggctggact

SEQ ID NO: 688232 - DNA, 19 bp, Homo sapiens
gcgcaggtgggctggactt

SEQ ID NO: 688233 - DNA, 16 bp, Homo sapiens
gcgcatatagactgta

SEQ ID NO: 688234 - DNA, 18 bp, Homo sapiens
gcgcatcttgcctccagg

SEQ ID NO: 688235 - DNA, 22 bp, Homo sapiens
gcgcatcttgcctccaggtgca

SEQ ID NO: 688236 - DNA, 15 bp, Homo sapiens
gcgcggtggctcacg

SEQ ID NO: 688237 - DNA, 20 bp, Homo sapiens
gcgcggtggctcacgcctgt

SEQ ID NO: 688238 - DNA, 19 bp, Homo sapiens
gcggaggttgcagtgagct

SEQ ID NO: 688239 - DNA, 19 bp, Homo sapiens
gcgggtggatcacgaggtc

SEQ ID NO: 688240 - DNA, 17 bp, Homo sapiens
gcgggtgtcacattcct

SEQ ID NO: 688241 - DNA, 17 bp, Homo sapiens
gcgtcagctgctccctg

SEQ ID NO: 688242 - DNA, 22 bp, Homo sapiens
gcgtcagctgctccctggcatt

SEQ ID NO: 688243 - DNA, 24 bp, Homo sapiens
gcgtccagctcagccctggcctgg

SEQ ID NO: 688244 - DNA, 14 bp, Homo sapiens
gcgtctgaggcctg

SEQ ID NO: 688245 - DNA, 12 bp, Homo sapiens
gcgtctgcctgg

SEQ ID NO: 688246 - DNA, 24 bp, Homo sapiens
gcgtgccgtgtgagtgtgacaggg

SEQ ID NO: 688247 - DNA, 23 bp, Homo sapiens
gcgtgcgcatcttgcctccaggt

SEQ ID NO: 688248 - DNA, 22 bp, Homo sapiens
gcgtggagggaggccccagggg

SEQ ID NO: 688249 - DNA, 15 bp, Homo sapiens
gctaaccatttatat

SEQ ID NO: 688250 - DNA, 21 bp, Homo sapiens
gctaatcaaagccagggtctc

SEQ ID NO: 688251 - DNA, 13 bp, Homo sapiens
gctacaattttaa

SEQ ID NO: 688252 - DNA, 12 bp, Homo sapiens
gctacactgagc

SEQ ID NO: 688253 - DNA, 14 bp, Homo sapiens
gctacattttcaga

SEQ ID NO: 688254 - DNA, 12 bp, Homo sapiens
gctacctccctc

SEQ ID NO: 688255 - DNA, 21 bp, Homo sapiens
gctacctctctgtcccttgct

SEQ ID NO: 688256 - DNA, 14 bp, Homo sapiens
gctactaatgatgt

SEQ ID NO: 688257 - DNA, 18 bp, Homo sapiens
gctactaatgatgttttc

SEQ ID NO: 688258 - DNA, 19 bp, Homo sapiens
gctactgttgtaagaattc

SEQ ID NO: 688259 - DNA, 13 bp, Homo sapiens
gctagaaaaataa

SEQ ID NO: 688260 - DNA, 18 bp, Homo sapiens
gctagaaaaatgttcttt

SEQ ID NO: 688261 - DNA, 11 bp, Homo sapiens
gctagacagaa

SEQ ID NO: 688262 - DNA, 13 bp, Homo sapiens
gctaggaagagtc

SEQ ID NO: 688263 - DNA, 21 bp, Homo sapiens
gctaggaagagtctacccgac

SEQ ID NO: 688264 - DNA, 18 bp, Homo sapiens
gctatccccatctccctg

SEQ ID NO: 688265 - DNA, 19 bp, Homo sapiens
gctatgaagccaactgaca

SEQ ID NO: 688266 - DNA, 16 bp, Homo sapiens
gctatgttactatttt

SEQ ID NO: 688267 - DNA, 19 bp, Homo sapiens
gctattctagagcttttat

SEQ ID NO: 688268 - DNA, 13 bp, Homo sapiens
gctattgcataag

SEQ ID NO: 688269 - DNA, 16 bp, Homo sapiens
gctcaagtttaaaagc

SEQ ID NO: 688270 - DNA, 14 bp, Homo sapiens
gctcaataaagatt

SEQ ID NO: 688271 - DNA, 15 bp, Homo sapiens
gctcacagtacagca

SEQ ID NO: 688272 - DNA, 22 bp, Homo sapiens
gctcacagtacagcatgtgcct

SEQ ID NO: 688273 - DNA, 15 bp, Homo sapiens
gctcaccgcccatca

SEQ ID NO: 688274 - DNA, 20 bp, Homo sapiens
gctcactttattatccctat

SEQ ID NO: 688275 - DNA, 17 bp, Homo sapiens
gctcagagaaggaaaag

SEQ ID NO: 688276 - DNA, 19 bp, Homo sapiens
gctcagccctggcctggct

SEQ ID NO: 688277 - DNA, 22 bp, Homo sapiens
gctcagccctggcctggctggg

SEQ ID NO: 688278 - DNA, 19 bp, Homo sapiens
gctcagctgtcaaggctca

SEQ ID NO: 688279 - DNA, 20 bp, Homo sapiens
gctcatacaggaatgaagcc

SEQ ID NO: 688280 - DNA, 17 bp, Homo sapiens
gctcatgtttttaactt

SEQ ID NO: 688281 - DNA, 11 bp, Homo sapiens
gctcatttaag

SEQ ID NO: 688282 - DNA, 18 bp, Homo sapiens
gctcatttttgcacttat

SEQ ID NO: 688283 - DNA, 20 bp, Homo sapiens
gctccactcttgatctctct

SEQ ID NO: 688284 - DNA, 17 bp, Homo sapiens
gctccactttctcatcc

SEQ ID NO: 688285 - DNA, 15 bp, Homo sapiens
gctccaggcctgcag

SEQ ID NO: 688286 - DNA, 19 bp, Homo sapiens
gctccaggcctgcagcagg

SEQ ID NO: 688287 - DNA, 16 bp, Homo sapiens
gctccataccttttct

SEQ ID NO: 688288 - DNA, 20 bp, Homo sapiens
gctccatatttgatttctaa

SEQ ID NO: 688289 - DNA, 19 bp, Homo sapiens
gctcccaggccccaggcct

SEQ ID NO: 688290 - DNA, 20 bp, Homo sapiens
gctcccaggggtctccctgg

SEQ ID NO: 688291 - DNA, 22 bp, Homo sapiens
gctcccaggggtctccctggct

SEQ ID NO: 688292 - DNA, 22 bp, Homo sapiens
gctccccacagcgtccctggcg

SEQ ID NO: 688293 - DNA, 17 bp, Homo sapiens
gctccccagcccacctg

SEQ ID NO: 688294 - DNA, 14 bp, Homo sapiens
gctccctcctccag

SEQ ID NO: 688295 - DNA, 16 bp, Homo sapiens
gctccctcctccaggc

SEQ ID NO: 688296 - DNA, 19 bp, Homo sapiens
gctccctcctccaggcctg

SEQ ID NO: 688297 - DNA, 21 bp, Homo sapiens
gctccggcctctgcctttgca

SEQ ID NO: 688298 - DNA, 16 bp, Homo sapiens
gctccgtagctctgct

SEQ ID NO: 688299 - DNA, 23 bp, Homo sapiens
gctcctccccttcctcttgtctg

SEQ ID NO: 688300 - DNA, 22 bp, Homo sapiens
gctcctcctcacccacctctgg

SEQ ID NO: 688301 - DNA, 23 bp, Homo sapiens
gctcctcctcacccacctctggg

SEQ ID NO: 688302 - DNA, 16 bp, Homo sapiens
gctcgcccctgttttt

SEQ ID NO: 688303 - DNA, 18 bp, Homo sapiens
gctcgcccctgttttttg

SEQ ID NO: 688304 - DNA, 19 bp, Homo sapiens
gctcgtcagccacctggga

SEQ ID NO: 688305 - DNA, 22 bp, Homo sapiens
gctctgctcccctaaagcctca

SEQ ID NO: 688306 - DNA, 19 bp, Homo sapiens
gctcttcctatccctctcc

SEQ ID NO: 688307 - DNA, 21 bp, Homo sapiens
gctctttcacctgggtgtctg

SEQ ID NO: 688308 - DNA, 12 bp, Homo sapiens
gctctttccaaa

SEQ ID NO: 688309 - DNA, 21 bp, Homo sapiens
gctcttttcctggtgctcttt

SEQ ID NO: 688310 - DNA, 16 bp, Homo sapiens
gctctttttttaaaag

SEQ ID NO: 688311 - DNA, 17 bp, Homo sapiens
gctctttttttaaaagg

SEQ ID NO: 688312 - DNA, 10 bp, Homo sapiens
gctgaaagca

SEQ ID NO: 688313 - DNA, 19 bp, Homo sapiens
gctgaaatatccacccagc

SEQ ID NO: 688314 - DNA, 21 bp, Homo sapiens
gctgaaattgcttatttttgg

SEQ ID NO: 688315 - DNA, 19 bp, Homo sapiens
gctgaagttgcagatgtta

SEQ ID NO: 688316 - DNA, 13 bp, Homo sapiens
gctgaatgcctcc

SEQ ID NO: 688317 - DNA, 12 bp, Homo sapiens
gctgagcctgca

SEQ ID NO: 688318 - DNA, 15 bp, Homo sapiens
gctgagcctgcaggg

SEQ ID NO: 688319 - DNA, 16 bp, Homo sapiens
gctgagcctgcaggga

SEQ ID NO: 688320 - DNA, 20 bp, Homo sapiens
gctgagcctgcagggaagcc

SEQ ID NO: 688321 - DNA, 17 bp, Homo sapiens
gctgagtaggaggcctc

SEQ ID NO: 688322 - DNA, 15 bp, Homo sapiens
gctgagttggcctgg

SEQ ID NO: 688323 - DNA, 16 bp, Homo sapiens
gctgatcgtagaaaat

SEQ ID NO: 688324 - DNA, 23 bp, Homo sapiens
gctgatgccactacccgatttgt

SEQ ID NO: 688325 - DNA, 18 bp, Homo sapiens
gctgcaatccatttattt

SEQ ID NO: 688326 - DNA, 16 bp, Homo sapiens
gctgcacaacagccct

SEQ ID NO: 688327 - DNA, 22 bp, Homo sapiens
gctgcacaacagccctgcctga

SEQ ID NO: 688328 - DNA, 18 bp, Homo sapiens
gctgcagagatttctcat

SEQ ID NO: 688329 - DNA, 20 bp, Homo sapiens
gctgcaggcaggcggctcct

SEQ ID NO: 688330 - DNA, 23 bp, Homo sapiens
gctgcaggcaggcggctcctcct

SEQ ID NO: 688331 - DNA, 14 bp, Homo sapiens
gctgcagtcatcta

SEQ ID NO: 688332 - DNA, 16 bp, Homo sapiens
gctgccagccttgagc

SEQ ID NO: 688333 - DNA, 15 bp, Homo sapiens
gctgcccctctcacc

SEQ ID NO: 688334 - DNA, 12 bp, Homo sapiens
gctgccctgaga

SEQ ID NO: 688335 - DNA, 14 bp, Homo sapiens
gctgccctttctca

SEQ ID NO: 688336 - DNA, 15 bp, Homo sapiens
gctgcctcctgccct

SEQ ID NO: 688337 - DNA, 11 bp, Homo sapiens
gctgcctctgc

SEQ ID NO: 688338 - DNA, 12 bp, Homo sapiens
gctgcctctgct

SEQ ID NO: 688339 - DNA, 22 bp, Homo sapiens
gctgcctggcacagaccaggcc

SEQ ID NO: 688340 - DNA, 22 bp, Homo sapiens
gctgctatccccatctccctgc

SEQ ID NO: 688341 - DNA, 15 bp, Homo sapiens
gctgctccaggcctg

SEQ ID NO: 688342 - DNA, 13 bp, Homo sapiens
gctgctgcctctt

SEQ ID NO: 688343 - DNA, 17 bp, Homo sapiens
gctgctggtgcacagcc

SEQ ID NO: 688344 - DNA, 18 bp, Homo sapiens
gctggaaagcagagcctc

SEQ ID NO: 688345 - DNA, 17 bp, Homo sapiens
gctggactattgtgcca

SEQ ID NO: 688346 - DNA, 18 bp, Homo sapiens
ggctcaagctttcccgcc

SEQ ID NO: 688347 - DNA, 13 bp, Homo sapiens
ggctcagatctca

SEQ ID NO: 688348 - DNA, 16 bp, Homo sapiens
ggctcatttttgcact

SEQ ID NO: 688349 - DNA, 22 bp, Homo sapiens
ggctccactcttgatctctctt

SEQ ID NO: 688350 - DNA, 12 bp, Homo sapiens
ggctcccagggg

SEQ ID NO: 688351 - DNA, 16 bp, Homo sapiens
ggctcccgggggcccc

SEQ ID NO: 688352 - DNA, 23 bp, Homo sapiens
ggctcctcctcacccacctctgg

SEQ ID NO: 688353 - DNA, 16 bp, Homo sapiens
ggctgaggcaggagaa

SEQ ID NO: 688354 - DNA, 17 bp, Homo sapiens
ggctgcacaacagccct

SEQ ID NO: 688355 - DNA, 18 bp, Homo sapiens
ggctgcacaacagccctg

SEQ ID NO: 688356 - DNA, 17 bp, Homo sapiens
ggctgcaggcaggcggc

SEQ ID NO: 688357 - DNA, 14 bp, Homo sapiens
ggctgccctgagaa

SEQ ID NO: 688358 - DNA, 21 bp, Homo sapiens
ggctgccctgagaagctgctc

SEQ ID NO: 688359 - DNA, 18 bp, Homo sapiens
ggctgcctcctgccctta

SEQ ID NO: 688360 - DNA, 15 bp, Homo sapiens
ggctggagcctgggg

SEQ ID NO: 688361 - DNA, 16 bp, Homo sapiens
ggctggttggagaagg

SEQ ID NO: 688362 - DNA, 22 bp, Homo sapiens
ggctggtttaaccattggaatg

SEQ ID NO: 688363 - DNA, 23 bp, Homo sapiens
ggcttccccactcccccgtttct

SEQ ID NO: 688364 - DNA, 20 bp, Homo sapiens
ggcttccctgacttgcttta

SEQ ID NO: 688365 - DNA, 22 bp, Homo sapiens
ggcttgtctatactccttccct

SEQ ID NO: 688366 - DNA, 23 bp, Homo sapiens
ggctttcccacttcccaccctgc

SEQ ID NO: 688367 - DNA, 15 bp, Homo sapiens
ggctttgcctcttct

SEQ ID NO: 688368 - DNA, 23 bp, Homo sapiens
gggaaaaagaggatctggagaac

SEQ ID NO: 688369 - DNA, 20 bp, Homo sapiens
gggaaaggggttggggtgac

SEQ ID NO: 688370 - DNA, 16 bp, Homo sapiens
gggaacacagttctgg

SEQ ID NO: 688371 - DNA, 19 bp, Homo sapiens
gggaacctagctacactga

SEQ ID NO: 688372 - DNA, 14 bp, Homo sapiens
gggaagtcctccct

SEQ ID NO: 688373 - DNA, 21 bp, Homo sapiens
gggaatgtaactgctgaaaac

SEQ ID NO: 688374 - DNA, 15 bp, Homo sapiens
gggaattgaaaaaaa

SEQ ID NO: 688375 - DNA, 21 bp, Homo sapiens
gggacagacaaggtgcctgtt

SEQ ID NO: 688376 - DNA, 21 bp, Homo sapiens
gggacaggcccgcttgctggg

SEQ ID NO: 688377 - DNA, 17 bp, Homo sapiens
gggacatcacagggtgg

SEQ ID NO: 688378 - DNA, 21 bp, Homo sapiens
gggactgtctttcagatacat

SEQ ID NO: 688379 - DNA, 18 bp, Homo sapiens
gggagacggtttccaggg

SEQ ID NO: 688380 - DNA, 21 bp, Homo sapiens
gggagacggtttccagggagg

SEQ ID NO: 688381 - DNA, 22 bp, Homo sapiens
gggagacggtttccagggaggg

SEQ ID NO: 688382 - DNA, 18 bp, Homo sapiens
gggagagtacctgtgtgt

SEQ ID NO: 688383 - DNA, 19 bp, Homo sapiens
gggaggctgaggcaggaga

SEQ ID NO: 688384 - DNA, 13 bp, Homo sapiens
gggaggggaggca

SEQ ID NO: 688385 - DNA, 19 bp, Homo sapiens
gggagtgctggctcacagt

SEQ ID NO: 688386 - DNA, 23 bp, Homo sapiens
gggagtgctggctcacagtacag

SEQ ID NO: 688387 - DNA, 15 bp, Homo sapiens
gggatatttttttct

SEQ ID NO: 688388 - DNA, 14 bp, Homo sapiens
gggattaagaaacc

SEQ ID NO: 688389 - DNA, 20 bp, Homo sapiens
gggattggaccgagctggaa

SEQ ID NO: 688390 - DNA, 22 bp, Homo sapiens
gggattttttactgccctttca

SEQ ID NO: 688391 - DNA, 18 bp, Homo sapiens
gggcacaggaggcaggca

SEQ ID NO: 688392 - DNA, 17 bp, Homo sapiens
gggcacagtggtgaccc

SEQ ID NO: 688393 - DNA, 15 bp, Homo sapiens
gggcactggcccagg

SEQ ID NO: 688394 - DNA, 12 bp, Homo sapiens
gggcaggctggg

SEQ ID NO: 688395 - DNA, 14 bp, Homo sapiens
gggcaggctgggcc

SEQ ID NO: 688396 - DNA, 20 bp, Homo sapiens
gggcagtccttactccccca

SEQ ID NO: 688397 - DNA, 18 bp, Homo sapiens
gggcagtctttcttgaaa

SEQ ID NO: 688398 - DNA, 22 bp, Homo sapiens
gggccactggtccccaacaatg

SEQ ID NO: 688399 - DNA, 14 bp, Homo sapiens
gggccagcatatat

SEQ ID NO: 688400 - DNA, 20 bp, Homo sapiens
gggccagggctgccctgaga

SEQ ID NO: 688401 - DNA, 19 bp, Homo sapiens
gggccagtggggcctgtgg

SEQ ID NO: 688402 - DNA, 13 bp, Homo sapiens
gggcccaaaggcc

SEQ ID NO: 688403 - DNA, 18 bp, Homo sapiens
gggcccacccatgtcacc

SEQ ID NO: 688404 - DNA, 18 bp, Homo sapiens
gggcccgacatggctccg

SEQ ID NO: 688405 - DNA, 17 bp, Homo sapiens
gggccgtggcacagctg

SEQ ID NO: 688406 - DNA, 22 bp, Homo sapiens
gggcctcagaccccctcagcct

SEQ ID NO: 688407 - DNA, 14 bp, Homo sapiens
gggcctgagagaat

SEQ ID NO: 688408 - DNA, 13 bp, Homo sapiens
gggcctggggcct

SEQ ID NO: 688409 - DNA, 16 bp, Homo sapiens
gggcctgtggaatgag

SEQ ID NO: 688410 - DNA, 21 bp, Homo sapiens
gggccttttctggcaccgcag

SEQ ID NO: 688411 - DNA, 13 bp, Homo sapiens
gggcgtggaggga

SEQ ID NO: 688412 - DNA, 15 bp, Homo sapiens
gggcgtggagggagg

SEQ ID NO: 688413 - DNA, 23 bp, Homo sapiens
gggctcccaggggtctccctggc

SEQ ID NO: 688414 - DNA, 22 bp, Homo sapiens
gggctgactctccagggagctg

SEQ ID NO: 688415 - DNA, 13 bp, Homo sapiens
gggctgcaggcag

SEQ ID NO: 688416 - DNA, 14 bp, Homo sapiens
gggctgcaggcagg

SEQ ID NO: 688417 - DNA, 13 bp, Homo sapiens
gggctgccctgag

SEQ ID NO: 688418 - DNA, 14 bp, Homo sapiens
gggctgccctgaga

SEQ ID NO: 688419 - DNA, 21 bp, Homo sapiens
gggctggcacgtgacaggctc

SEQ ID NO: 688420 - DNA, 17 bp, Homo sapiens
gggctggttggagaagg

SEQ ID NO: 688421 - DNA, 15 bp, Homo sapiens
gggctttctggggcc

SEQ ID NO: 688422 - DNA, 21 bp, Homo sapiens
ggggaacctgccatgccagga

SEQ ID NO: 688423 - DNA, 22 bp, Homo sapiens
ggggaacctgccatgccaggaa

SEQ ID NO: 688424 - DNA, 13 bp, Homo sapiens
ggggacccagtgc

SEQ ID NO: 688425 - DNA, 21 bp, Homo sapiens
ggggacccagtgcagaatgta

SEQ ID NO: 688426 - DNA, 15 bp, Homo sapiens
ggggactagacagtt

SEQ ID NO: 688427 - DNA, 13 bp, Homo sapiens
ggggactgccttg

SEQ ID NO: 688428 - DNA, 14 bp, Homo sapiens
ggggaggagggggc

SEQ ID NO: 688429 - DNA, 15 bp, Homo sapiens
ggggaggcgcacagt

SEQ ID NO: 688430 - DNA, 22 bp, Homo sapiens
ggggagtggttaggcagcaagc

SEQ ID NO: 688431 - DNA, 15 bp, Homo sapiens
ggggattgcccctgg

SEQ ID NO: 688432 - DNA, 20 bp, Homo sapiens
ggggccggccctgtgtgcag

SEQ ID NO: 688433 - DNA, 21 bp, Homo sapiens
ggggcctagcgatctctcctg

SEQ ID NO: 688434 - DNA, 12 bp, Homo sapiens
ggggcctgagag

SEQ ID NO: 688435 - DNA, 16 bp, Homo sapiens
ggggctgcaggcaggc

SEQ ID NO: 688436 - DNA, 15 bp, Homo sapiens
gggggcacaggaggc

SEQ ID NO: 688437 - DNA, 16 bp, Homo sapiens
ggggtccctagcagcc

SEQ ID NO: 688438 - DNA, 21 bp, Homo sapiens
ggggtctccctggctccctcc

SEQ ID NO: 688439 - DNA, 18 bp, Homo sapiens
ggggtgacggccctcatc

SEQ ID NO: 688440 - DNA, 11 bp, Homo sapiens
ggggtgctgcc

SEQ ID NO: 688441 - DNA, 18 bp, Homo sapiens
ggggtgttagtggcaccg

SEQ ID NO: 688442 - DNA, 21 bp, Homo sapiens
ggggttgcgtctgaggcctgc

SEQ ID NO: 688443 - DNA, 18 bp, Homo sapiens
gggtctcccctcctgcac

SEQ ID NO: 688444 - DNA, 17 bp, Homo sapiens
gggtctgcgatgcagcg

SEQ ID NO: 688445 - DNA, 14 bp, Homo sapiens
gggtctgggcgtcc

SEQ ID NO: 688446 - DNA, 16 bp, Homo sapiens
gggtctggggacaggc

SEQ ID NO: 688447 - DNA, 19 bp, Homo sapiens
gggtctggggacaggcccg

SEQ ID NO: 688448 - DNA, 15 bp, Homo sapiens
gggtctgtgtgaatg

SEQ ID NO: 688449 - DNA, 18 bp, Homo sapiens
gggtgacagtcatcatca

SEQ ID NO: 688450 - DNA, 16 bp, Homo sapiens
gggtgggtgctcagaa

SEQ ID NO: 688451 - DNA, 16 bp, Homo sapiens
gggttcaaaatgtctg

SEQ ID NO: 688452 - DNA, 18 bp, Homo sapiens
ggtaaaaagtattttttc

SEQ ID NO: 688453 - DNA, 20 bp, Homo sapiens
ggtaaatttttaggcaaaga

SEQ ID NO: 688454 - DNA, 17 bp, Homo sapiens
ggtaactaattggaagg

SEQ ID NO: 688455 - DNA, 20 bp, Homo sapiens
ggtaatctacaccaatgaaa

SEQ ID NO: 688456 - DNA, 16 bp, Homo sapiens
ggtacaacggaggcct

SEQ ID NO: 688457 - DNA, 11 bp, Homo sapiens
ggtaccctggg

SEQ ID NO: 688458 - DNA, 19 bp, Homo sapiens
ggtattaaaactaaatttc

SEQ ID NO: 688459 - DNA, 19 bp, Homo sapiens
ggtatttaaagtattttct

SEQ ID NO: 688460 - DNA, 20 bp, Homo sapiens
ggtcaagattttgaatgctt

SEQ ID NO: 688461 - DNA, 20 bp, Homo sapiens
ggtcaagtaagaagacatga

SEQ ID NO: 688462 - DNA, 19 bp, Homo sapiens
ggtcaataacactgtattt

SEQ ID NO: 688463 - DNA, 16 bp, Homo sapiens
ggtcagggagtgctgg

SEQ ID NO: 688464 - DNA, 22 bp, Homo sapiens
ggtcagtgccttttggaactgt

SEQ ID NO: 688465 - DNA, 15 bp, Homo sapiens
ggtcataaagcattg

SEQ ID NO: 688466 - DNA, 12 bp, Homo sapiens
gtagtgtggcct

SEQ ID NO: 688467 - DNA, 14 bp, Homo sapiens
gtagtgtggcctgt

SEQ ID NO: 688468 - DNA, 14 bp, Homo sapiens
gtataaaatacata

SEQ ID NO: 688469 - DNA, 18 bp, Homo sapiens
gtataaaatacatagtga

SEQ ID NO: 688470 - DNA, 22 bp, Homo sapiens
gtataaaatacatagtgaaaat

SEQ ID NO: 688471 - DNA, 15 bp, Homo sapiens
gtataaccaagtgtg

SEQ ID NO: 688472 - DNA, 15 bp, Homo sapiens
gtatagccatgattt

SEQ ID NO: 688473 - DNA, 13 bp, Homo sapiens
gtatataatttta

SEQ ID NO: 688474 - DNA, 17 bp, Homo sapiens
gtatatactttgccact

SEQ ID NO: 688475 - DNA, 18 bp, Homo sapiens
gtatatatacatatatat

SEQ ID NO: 688476 - DNA, 13 bp, Homo sapiens
gtatatattttgt

SEQ ID NO: 688477 - DNA, 19 bp, Homo sapiens
gtatatggtatatatacat

SEQ ID NO: 688478 - DNA, 19 bp, Homo sapiens
gtatattccttttaaagaa

SEQ ID NO: 688479 - DNA, 17 bp, Homo sapiens
gtatatttgtaaagcta

SEQ ID NO: 688480 - DNA, 18 bp, Homo sapiens
gtatatttgttttatgct

SEQ ID NO: 688481 - DNA, 23 bp, Homo sapiens
gtatatttgttttatgctactga

SEQ ID NO: 688482 - DNA, 11 bp, Homo sapiens
gtatcaaatca

SEQ ID NO: 688483 - DNA, 17 bp, Homo sapiens
gtatcagtgtcctttcc

SEQ ID NO: 688484 - DNA, 16 bp, Homo sapiens
gtatcctggccctggg

SEQ ID NO: 688485 - DNA, 17 bp, Homo sapiens
gtatctgggattattct

SEQ ID NO: 688486 - DNA, 17 bp, Homo sapiens
gtatcttttatcctggg

SEQ ID NO: 688487 - DNA, 23 bp, Homo sapiens
gtatgatttataaacagacaata

SEQ ID NO: 688488 - DNA, 17 bp, Homo sapiens
gtatggaagttttccta

SEQ ID NO: 688489 - DNA, 21 bp, Homo sapiens
gtatggatatatttgaaatag

SEQ ID NO: 688490 - DNA, 14 bp, Homo sapiens
gtatggctctgcac

SEQ ID NO: 688491 - DNA, 20 bp, Homo sapiens
gtatggctctgcacccctct

SEQ ID NO: 688492 - DNA, 21 bp, Homo sapiens
gtatggctctgcacccctctg

SEQ ID NO: 688493 - DNA, 13 bp, Homo sapiens
gtatggtctaaca

SEQ ID NO: 688494 - DNA, 16 bp, Homo sapiens
gtatgtgtgtaggtta

SEQ ID NO: 688495 - DNA, 18 bp, Homo sapiens
gtatgttaaagagaatga

SEQ ID NO: 688496 - DNA, 15 bp, Homo sapiens
gtatgttttttatgt

SEQ ID NO: 688497 - DNA, 20 bp, Homo sapiens
gtattaaatcagttctcaat

SEQ ID NO: 688498 - DNA, 16 bp, Homo sapiens
gtattatcaaagggat

SEQ ID NO: 688499 - DNA, 18 bp, Homo sapiens
gtattgtttaaaatgtaa

SEQ ID NO: 688500 - DNA, 20 bp, Homo sapiens
gtatttaaaaaaaagaaact

SEQ ID NO: 688501 - DNA, 22 bp, Homo sapiens
gtatttaaaaaaaagaaacttt

SEQ ID NO: 688502 - DNA, 19 bp, Homo sapiens
gtatttctggtgtatattt

SEQ ID NO: 688503 - DNA, 15 bp, Homo sapiens
gtatttgttatatat

SEQ ID NO: 688504 - DNA, 22 bp, Homo sapiens
gtatttgttatatataataaat

SEQ ID NO: 688505 - DNA, 15 bp, Homo sapiens
gtattttcttctctg

SEQ ID NO: 688506 - DNA, 13 bp, Homo sapiens
gtattttgacact

SEQ ID NO: 688507 - DNA, 17 bp, Homo sapiens
gtatttttatttttgca

SEQ ID NO: 688508 - DNA, 21 bp, Homo sapiens
gtatttttgggctattgcata

SEQ ID NO: 688509 - DNA, 20 bp, Homo sapiens
gtcaaaaaattatttgctat

SEQ ID NO: 688510 - DNA, 14 bp, Homo sapiens
gtcaaaatatgtaa

SEQ ID NO: 688511 - DNA, 16 bp, Homo sapiens
gtcaaatttactttaa

SEQ ID NO: 688512 - DNA, 17 bp, Homo sapiens
gtcaaatttactttaaa

SEQ ID NO: 688513 - DNA, 21 bp, Homo sapiens
gtcaagaatagcattgtaaaa

SEQ ID NO: 688514 - DNA, 19 bp, Homo sapiens
gtcaataacactgtatttt

SEQ ID NO: 688515 - DNA, 18 bp, Homo sapiens
gtcaattcataaaaacaa

SEQ ID NO: 688516 - DNA, 19 bp, Homo sapiens
gtcacccctttctgtccca

SEQ ID NO: 688517 - DNA, 15 bp, Homo sapiens
gtcacttgctgcttt

SEQ ID NO: 688518 - DNA, 21 bp, Homo sapiens
gtcacttgctgctttttctgc

SEQ ID NO: 688519 - DNA, 23 bp, Homo sapiens
gtcagaaaattggcagtggcaga

SEQ ID NO: 688520 - DNA, 23 bp, Homo sapiens
gtcagagttgactttcctcccat

SEQ ID NO: 688521 - DNA, 13 bp, Homo sapiens
gtcagatttttat

SEQ ID NO: 688522 - DNA, 15 bp, Homo sapiens
gtcagccacctggga

SEQ ID NO: 688523 - DNA, 20 bp, Homo sapiens
gtcagccaggagctgtcacc

SEQ ID NO: 688524 - DNA, 14 bp, Homo sapiens
gtcagctactaatg

SEQ ID NO: 688525 - DNA, 12 bp, Homo sapiens
gtcagctccagc

SEQ ID NO: 688526 - DNA, 15 bp, Homo sapiens
gtcagtagtgctaat

SEQ ID NO: 688527 - DNA, 18 bp, Homo sapiens
gtcatcatcagggcctgg

SEQ ID NO: 688528 - DNA, 13 bp, Homo sapiens
gtccacctgtggg

SEQ ID NO: 688529 - DNA, 14 bp, Homo sapiens
gtccacctgtgggt

SEQ ID NO: 688530 - DNA, 23 bp, Homo sapiens
gtccagcaccttgtgcctggggt

SEQ ID NO: 688531 - DNA, 13 bp, Homo sapiens
gtccagctcagcc

SEQ ID NO: 688532 - DNA, 17 bp, Homo sapiens
gtccaggagagcctggg

SEQ ID NO: 688533 - DNA, 19 bp, Homo sapiens
gtccaggagagcctggggg

SEQ ID NO: 688534 - DNA, 15 bp, Homo sapiens
gtccatctgacaaaa

SEQ ID NO: 688535 - DNA, 23 bp, Homo sapiens
gtcccaaggagggggcctcattg

SEQ ID NO: 688536 - DNA, 12 bp, Homo sapiens
gtcccacactgt

SEQ ID NO: 688537 - DNA, 20 bp, Homo sapiens
gtcccacactgtggccaggc

SEQ ID NO: 688538 - DNA, 17 bp, Homo sapiens
gtccccaaacaggacag

SEQ ID NO: 688539 - DNA, 22 bp, Homo sapiens
gtccccaaccgtgtctgtctgg

SEQ ID NO: 688540 - DNA, 19 bp, Homo sapiens
gtccccactgctgagctgg

SEQ ID NO: 688541 - DNA, 19 bp, Homo sapiens
gtccccatctaggtcctgg

SEQ ID NO: 688542 - DNA, 22 bp, Homo sapiens
gtccctcttctggtttcccttt

SEQ ID NO: 688543 - DNA, 16 bp, Homo sapiens
gtcccttgcctctgcc

SEQ ID NO: 688544 - DNA, 20 bp, Homo sapiens
gtcccttgcctctgccctgg

SEQ ID NO: 688545 - DNA, 23 bp, Homo sapiens
gtcccttgcctctgccctggatt

SEQ ID NO: 688546 - DNA, 15 bp, Homo sapiens
gtcccttttccctta

SEQ ID NO: 688547 - DNA, 16 bp, Homo sapiens
gtcctaaccactaaca

SEQ ID NO: 688548 - DNA, 14 bp, Homo sapiens
gtcctagtaagaag

SEQ ID NO: 688549 - DNA, 17 bp, Homo sapiens
gtcctagtaagaagaca

SEQ ID NO: 688550 - DNA, 13 bp, Homo sapiens
gtcctcagggagc

SEQ ID NO: 688551 - DNA, 12 bp, Homo sapiens
gtcctcttctgc

SEQ ID NO: 688552 - DNA, 17 bp, Homo sapiens
gtcctctttagtttttg

SEQ ID NO: 688553 - DNA, 21 bp, Homo sapiens
gtcctgaatgtagcgtgtaag

SEQ ID NO: 688554 - DNA, 20 bp, Homo sapiens
gtcctgagatggaaaagtgt

SEQ ID NO: 688555 - DNA, 23 bp, Homo sapiens
gtcctggctggccgcatgaccac

SEQ ID NO: 688556 - DNA, 19 bp, Homo sapiens
gtccttaacccacctctcc

SEQ ID NO: 688557 - DNA, 14 bp, Homo sapiens
gtccttactccccc

SEQ ID NO: 688558 - DNA, 17 bp, Homo sapiens
gtccttactcccccacc

SEQ ID NO: 688559 - DNA, 20 bp, Homo sapiens
gtccttactcccccaccact

SEQ ID NO: 688560 - DNA, 15 bp, Homo sapiens
gtccttatgtcctgt

SEQ ID NO: 688561 - DNA, 14 bp, Homo sapiens
gtccttatttattt

SEQ ID NO: 688562 - DNA, 14 bp, Homo sapiens
gtccttgatttcaa

SEQ ID NO: 688563 - DNA, 19 bp, Homo sapiens
gtccttgatttcaaagttt

SEQ ID NO: 688564 - DNA, 14 bp, Homo sapiens
gtccttggctcccg

SEQ ID NO: 688565 - DNA, 16 bp, Homo sapiens
gtcgttgttgtggaag

SEQ ID NO: 688566 - DNA, 21 bp, Homo sapiens
gtcgttgttgtggaagcatgt

SEQ ID NO: 688567 - DNA, 23 bp, Homo sapiens
gtctaacacaccactttctgctt

SEQ ID NO: 688568 - DNA, 18 bp, Homo sapiens
gtctactcctagaagaac

SEQ ID NO: 688569 - DNA, 18 bp, Homo sapiens
gtctcaacgcctccccct

SEQ ID NO: 688570 - DNA, 13 bp, Homo sapiens
gtctcacccatgc

SEQ ID NO: 688571 - DNA, 16 bp, Homo sapiens
gtctcagagagttaat

SEQ ID NO: 688572 - DNA, 19 bp, Homo sapiens
gtctcattccgttgtctgt

SEQ ID NO: 688573 - DNA, 15 bp, Homo sapiens
gtctcattgtcacct

SEQ ID NO: 688574 - DNA, 19 bp, Homo sapiens
gtctccccaattctcccct

SEQ ID NO: 688575 - DNA, 16 bp, Homo sapiens
gtctcccctcctgcac

SEQ ID NO: 688576 - DNA, 10 bp, Homo sapiens
gtctccctcg

SEQ ID NO: 688577 - DNA, 11 bp, Homo sapiens
gtctccctggc

SEQ ID NO: 688578 - DNA, 15 bp, Homo sapiens
gtctccctggctccc

SEQ ID NO: 688579 - DNA, 20 bp, Homo sapiens
gtctcctgactggtgctgca

SEQ ID NO: 688580 - DNA, 16 bp, Homo sapiens
gtctccttccttccca

SEQ ID NO: 688581 - DNA, 14 bp, Homo sapiens
gtctctccctcagg

SEQ ID NO: 688582 - DNA, 15 bp, Homo sapiens
gtctctccctcaggt

SEQ ID NO: 688583 - DNA, 21 bp, Homo sapiens
gtctcttcttggggcccagtg

SEQ ID NO: 688584 - DNA, 21 bp, Homo sapiens
gtctgaaactggcttccccac

SEQ ID NO: 688585 - DNA, 14 bp, Homo sapiens
gtctgaggcctgcc

SEQ ID NO: 688586 - DNA, 14 bp, Homo sapiens
gtttataaacagaa

SEQ ID NO: 688587 - DNA, 15 bp, Homo sapiens
gtttataatgaagaa

SEQ ID NO: 688588 - DNA, 22 bp, Homo sapiens
gtttatatacagtacacagata

SEQ ID NO: 688589 - DNA, 13 bp, Homo sapiens
gtttatgagccag

SEQ ID NO: 688590 - DNA, 17 bp, Homo sapiens
gtttatgatatttcttg

SEQ ID NO: 688591 - DNA, 21 bp, Homo sapiens
gtttatgatatttcttgcttt

SEQ ID NO: 688592 - DNA, 14 bp, Homo sapiens
gtttatggcagaag

SEQ ID NO: 688593 - DNA, 23 bp, Homo sapiens
gtttatggccacatttaatatct

SEQ ID NO: 688594 - DNA, 15 bp, Homo sapiens
gtttattataaagct

SEQ ID NO: 688595 - DNA, 16 bp, Homo sapiens
gtttattataaagctt

SEQ ID NO: 688596 - DNA, 17 bp, Homo sapiens
gtttattataaagctta

SEQ ID NO: 688597 - DNA, 13 bp, Homo sapiens
gtttcaagaaaat

SEQ ID NO: 688598 - DNA, 20 bp, Homo sapiens
gtttcaagaaaatctttgtt

SEQ ID NO: 688599 - DNA, 19 bp, Homo sapiens
gtttcctatttaatacagc

SEQ ID NO: 688600 - DNA, 13 bp, Homo sapiens
gtttctaaaaaca

SEQ ID NO: 688601 - DNA, 22 bp, Homo sapiens
gtttctggacccttataaaatc

SEQ ID NO: 688602 - DNA, 17 bp, Homo sapiens
gtttctgtcgttaaaaa

SEQ ID NO: 688603 - DNA, 22 bp, Homo sapiens
gtttctgtcgttaaaaacagat

SEQ ID NO: 688604 - DNA, 11 bp, Homo sapiens
gtttcttcttc

SEQ ID NO: 688605 - DNA, 14 bp, Homo sapiens
gtttcttttaaaga

SEQ ID NO: 688606 - DNA, 22 bp, Homo sapiens
gtttcttttttttttttttaca

SEQ ID NO: 688607 - DNA, 21 bp, Homo sapiens
gtttgaatgaaccctcctttt

SEQ ID NO: 688608 - DNA, 15 bp, Homo sapiens
gtttgcaggggtgac

SEQ ID NO: 688609 - DNA, 16 bp, Homo sapiens
gtttgcaggggtgacg

SEQ ID NO: 688610 - DNA, 14 bp, Homo sapiens
gtttggcaaggaaa

SEQ ID NO: 688611 - DNA, 12 bp, Homo sapiens
gtttgggcagag

SEQ ID NO: 688612 - DNA, 13 bp, Homo sapiens
gtttgggcagagc

SEQ ID NO: 688613 - DNA, 16 bp, Homo sapiens
gtttggtaaatgtttc

SEQ ID NO: 688614 - DNA, 16 bp, Homo sapiens
gtttgtctattttaaa

SEQ ID NO: 688615 - DNA, 15 bp, Homo sapiens
gttttactgtctatt

SEQ ID NO: 688616 - DNA, 18 bp, Homo sapiens
gttttatccttacaatgt

SEQ ID NO: 688617 - DNA, 18 bp, Homo sapiens
gttttatgccccattgga

SEQ ID NO: 688618 - DNA, 18 bp, Homo sapiens
gttttgctttggaaacac

SEQ ID NO: 688619 - DNA, 18 bp, Homo sapiens
gttttggatcttgaatgt

SEQ ID NO: 688620 - DNA, 19 bp, Homo sapiens
gtttttaaaaagagtaatt

SEQ ID NO: 688621 - DNA, 17 bp, Homo sapiens
gtttttacaagatgtat

SEQ ID NO: 688622 - DNA, 18 bp, Homo sapiens
gtttttattgtaaaacaa

SEQ ID NO: 688623 - DNA, 12 bp, Homo sapiens
gtttttgcaact

SEQ ID NO: 688624 - DNA, 18 bp, Homo sapiens
gttttttctgtaatgtaa

SEQ ID NO: 688625 - DNA, 19 bp, Homo sapiens
gttttttctttcccatgta

SEQ ID NO: 688626 - DNA, 19 bp, Homo sapiens
taaaaaacactaaacattc

SEQ ID NO: 688627 - DNA, 20 bp, Homo sapiens
taaaaacagatttggaaaga

SEQ ID NO: 688628 - DNA, 17 bp, Homo sapiens
taaaaacataacataaa

SEQ ID NO: 688629 - DNA, 19 bp, Homo sapiens
taaaaacattttgaagtgt

SEQ ID NO: 688630 - DNA, 13 bp, Homo sapiens
taaaaactcttca

SEQ ID NO: 688631 - DNA, 12 bp, Homo sapiens
taaaaagaaatt

SEQ ID NO: 688632 - DNA, 19 bp, Homo sapiens
taaaaagagtaatttcatt

SEQ ID NO: 688633 - DNA, 19 bp, Homo sapiens
taaaaagatgaaaaagaat

SEQ ID NO: 688634 - DNA, 20 bp, Homo sapiens
taaaaagatgaaaaagaata

SEQ ID NO: 688635 - DNA, 18 bp, Homo sapiens
taaaaagctcactgctga

SEQ ID NO: 688636 - DNA, 14 bp, Homo sapiens
taaaaagtattttt

SEQ ID NO: 688637 - DNA, 22 bp, Homo sapiens
taaaaataggctttttaggaac

SEQ ID NO: 688638 - DNA, 17 bp, Homo sapiens
taaaaatcattgattgt

SEQ ID NO: 688639 - DNA, 15 bp, Homo sapiens
taaaaattaaaacct

SEQ ID NO: 688640 - DNA, 22 bp, Homo sapiens
taaaaattgaatgtggctgaag

SEQ ID NO: 688641 - DNA, 21 bp, Homo sapiens
taaaacaaatatacattttct

SEQ ID NO: 688642 - DNA, 16 bp, Homo sapiens
taaaacattaaaatat

SEQ ID NO: 688643 - DNA, 19 bp, Homo sapiens
taaaacgcgtctgcctggg

SEQ ID NO: 688644 - DNA, 23 bp, Homo sapiens
taaaactctccttttccttacca

SEQ ID NO: 688645 - DNA, 18 bp, Homo sapiens
taaaagaacttactgatt

SEQ ID NO: 688646 - DNA, 19 bp, Homo sapiens
taaaagaacttactgatta

SEQ ID NO: 688647 - DNA, 16 bp, Homo sapiens
taaaagcagggcagca

SEQ ID NO: 688648 - DNA, 20 bp, Homo sapiens
taaaagcatgaattggaact

SEQ ID NO: 688649 - DNA, 17 bp, Homo sapiens
taaaagcattttgtaat

SEQ ID NO: 688650 - DNA, 18 bp, Homo sapiens
taaaaggtagagtcttac

SEQ ID NO: 688651 - DNA, 19 bp, Homo sapiens
taaaaggtagagtcttaca

SEQ ID NO: 688652 - DNA, 20 bp, Homo sapiens
taaaaggtagagtcttacaa

SEQ ID NO: 688653 - DNA, 17 bp, Homo sapiens
taaaagttttatatgct

SEQ ID NO: 688654 - DNA, 19 bp, Homo sapiens
taaaagttttatatgcttt

SEQ ID NO: 688655 - DNA, 22 bp, Homo sapiens
taaaagttttttattatgcatt

SEQ ID NO: 688656 - DNA, 15 bp, Homo sapiens
taaaataaataattt

SEQ ID NO: 688657 - DNA, 14 bp, Homo sapiens
taaaataaattagt

SEQ ID NO: 688658 - DNA, 14 bp, Homo sapiens
taaaatagaataat

SEQ ID NO: 688659 - DNA, 15 bp, Homo sapiens
taaaatagatataaa

SEQ ID NO: 688660 - DNA, 22 bp, Homo sapiens
taaaatccccttcgctgaaatt

SEQ ID NO: 688661 - DNA, 18 bp, Homo sapiens
taaaatggacacaaattt

SEQ ID NO: 688662 - DNA, 22 bp, Homo sapiens
taaaatggacacaaattttcaa

SEQ ID NO: 688663 - DNA, 21 bp, Homo sapiens
taaaatgtcagtgtttgggaa

SEQ ID NO: 688664 - DNA, 17 bp, Homo sapiens
taaaatgtttcattatg

SEQ ID NO: 688665 - DNA, 22 bp, Homo sapiens
taaaattgatattatattaaac

SEQ ID NO: 688666 - DNA, 22 bp, Homo sapiens
taaacaagttcgagtcaaagtt

SEQ ID NO: 688667 - DNA, 16 bp, Homo sapiens
taaacactacacattt

SEQ ID NO: 688668 - DNA, 17 bp, Homo sapiens
taaacagacaaaaacaa

SEQ ID NO: 688669 - DNA, 16 bp, Homo sapiens
taaacagactgttaat

SEQ ID NO: 688670 - DNA, 21 bp, Homo sapiens
taaacattcaattccagagaa

SEQ ID NO: 688671 - DNA, 21 bp, Homo sapiens
taaacctaggacttccgagct

SEQ ID NO: 688672 - DNA, 13 bp, Homo sapiens
taaactatttata

SEQ ID NO: 688673 - DNA, 18 bp, Homo sapiens
taaactatttatatcaca

SEQ ID NO: 688674 - DNA, 16 bp, Homo sapiens
taaactgagagtaatt

SEQ ID NO: 688675 - DNA, 18 bp, Homo sapiens
taaactgagagtaattca

SEQ ID NO: 688676 - DNA, 23 bp, Homo sapiens
taaacttctgcaacaagcatgca

SEQ ID NO: 688677 - DNA, 14 bp, Homo sapiens
taaagaaaaaaata

SEQ ID NO: 688678 - DNA, 21 bp, Homo sapiens
taaagaaaagtttaccatctg

SEQ ID NO: 688679 - DNA, 14 bp, Homo sapiens
taaagaagctttat

SEQ ID NO: 688680 - DNA, 15 bp, Homo sapiens
taaagacacctggtt

SEQ ID NO: 688681 - DNA, 19 bp, Homo sapiens
taaagacccagggggagaa

SEQ ID NO: 688682 - DNA, 21 bp, Homo sapiens
taaagacccagggggagaatg

SEQ ID NO: 688683 - DNA, 12 bp, Homo sapiens
taaagagagaat

SEQ ID NO: 688684 - DNA, 20 bp, Homo sapiens
taaagaggctgaaagaggcc

SEQ ID NO: 688685 - DNA, 19 bp, Homo sapiens
taaagatgagctttgtcta

SEQ ID NO: 688686 - DNA, 23 bp, Homo sapiens
taaagatttatacagttgaaaac

SEQ ID NO: 688687 - DNA, 18 bp, Homo sapiens
taaagcatgaaatgtgaa

SEQ ID NO: 688688 - DNA, 23 bp, Homo sapiens
taaagcctgtgggtttggtcctt

SEQ ID NO: 688689 - DNA, 19 bp, Homo sapiens
taaagccttttaaatcatc

SEQ ID NO: 688690 - DNA, 11 bp, Homo sapiens
taaaggcagct

SEQ ID NO: 688691 - DNA, 16 bp, Homo sapiens
taaaggcagctgcctc

SEQ ID NO: 688692 - DNA, 17 bp, Homo sapiens
taaaggcagctgcctct

SEQ ID NO: 688693 - DNA, 22 bp, Homo sapiens
taaaggctgaggctgcatctgc

SEQ ID NO: 688694 - DNA, 18 bp, Homo sapiens
taaaggggactagacagt

SEQ ID NO: 688695 - DNA, 18 bp, Homo sapiens
taaagtacaaatgaagaa

SEQ ID NO: 688696 - DNA, 22 bp, Homo sapiens
taaagtacaaatgaagaaagtc

SEQ ID NO: 688697 - DNA, 20 bp, Homo sapiens
taaagtcattattaggaagt

SEQ ID NO: 688698 - DNA, 18 bp, Homo sapiens
taaagtgcacacctttat

SEQ ID NO: 688699 - DNA, 12 bp, Homo sapiens
taaagttacagt

SEQ ID NO: 688700 - DNA, 15 bp, Homo sapiens
taaagttagtaaaga

SEQ ID NO: 688701 - DNA, 17 bp, Homo sapiens
taaagttttgcaacaat

SEQ ID NO: 688702 - DNA, 19 bp, Homo sapiens
taaagtttttaaagtgtgt

SEQ ID NO: 688703 - DNA, 21 bp, Homo sapiens
taaataaaaatatgtaatttc

SEQ ID NO: 688704 - DNA, 21 bp, Homo sapiens
taaataaaaatgcattgaaca

SEQ ID NO: 688705 - DNA, 19 bp, Homo sapiens
taatgacttgtacaaacag

SEQ ID NO: 688706 - DNA, 24 bp, Homo sapiens
taatgacttgtacaaacagtattt

SEQ ID NO: 688707 - DNA, 18 bp, Homo sapiens
taatgataaaataaataa

SEQ ID NO: 688708 - DNA, 20 bp, Homo sapiens
taatgataaaataaataatt

SEQ ID NO: 688709 - DNA, 15 bp, Homo sapiens
taatgatatgcttgt

SEQ ID NO: 688710 - DNA, 13 bp, Homo sapiens
taatgatggcaga

SEQ ID NO: 688711 - DNA, 15 bp, Homo sapiens
taatgatggcagagg

SEQ ID NO: 688712 - DNA, 11 bp, Homo sapiens
taatgatgttt

SEQ ID NO: 688713 - DNA, 18 bp, Homo sapiens
taatgcagtttttaaaaa

SEQ ID NO: 688714 - DNA, 20 bp, Homo sapiens
taatgcagtttttaaaaacc

SEQ ID NO: 688715 - DNA, 15 bp, Homo sapiens
taatgctacaatttt

SEQ ID NO: 688716 - DNA, 17 bp, Homo sapiens
taatgctgtttctaaga

SEQ ID NO: 688717 - DNA, 23 bp, Homo sapiens
taatggaagtgtatttattttac

SEQ ID NO: 688718 - DNA, 18 bp, Homo sapiens
taatggatcatagaattg

SEQ ID NO: 688719 - DNA, 19 bp, Homo sapiens
taatggcagagcagtctaa

SEQ ID NO: 688720 - DNA, 15 bp, Homo sapiens
taatggcatttctct

SEQ ID NO: 688721 - DNA, 18 bp, Homo sapiens
taatgtgcagaaaatatt

SEQ ID NO: 688722 - DNA, 23 bp, Homo sapiens
taatgtgtggattgcctctgaaa

SEQ ID NO: 688723 - DNA, 18 bp, Homo sapiens
taatgtgtggtggcctca

SEQ ID NO: 688724 - DNA, 19 bp, Homo sapiens
taatgtgtggtggcctcag

SEQ ID NO: 688725 - DNA, 13 bp, Homo sapiens
taattaagtatct

SEQ ID NO: 688726 - DNA, 18 bp, Homo sapiens
taattaagtatctgggat

SEQ ID NO: 688727 - DNA, 14 bp, Homo sapiens
taattacctggtga

SEQ ID NO: 688728 - DNA, 23 bp, Homo sapiens
taattacctggtgagtaacttag

SEQ ID NO: 688729 - DNA, 20 bp, Homo sapiens
taattatgttctaagtgcct

SEQ ID NO: 688730 - DNA, 16 bp, Homo sapiens
taattgactgaaatta

SEQ ID NO: 688731 - DNA, 15 bp, Homo sapiens
taattgcctacattt

SEQ ID NO: 688732 - DNA, 23 bp, Homo sapiens
taattggtacttttaaaaacata

SEQ ID NO: 688733 - DNA, 18 bp, Homo sapiens
taattgtaagtgaaatta

SEQ ID NO: 688734 - DNA, 17 bp, Homo sapiens
taattgtacaaaattaa

SEQ ID NO: 688735 - DNA, 17 bp, Homo sapiens
taatttaaaaacacaaa

SEQ ID NO: 688736 - DNA, 12 bp, Homo sapiens
taatttaaatga

SEQ ID NO: 688737 - DNA, 13 bp, Homo sapiens
taatttaaatgaa

SEQ ID NO: 688738 - DNA, 16 bp, Homo sapiens
taatttacaagatatt

SEQ ID NO: 688739 - DNA, 17 bp, Homo sapiens
taatttagaaactgaaa

SEQ ID NO: 688740 - DNA, 22 bp, Homo sapiens
taatttagagataggaaactga

SEQ ID NO: 688741 - DNA, 13 bp, Homo sapiens
taatttcatttaa

SEQ ID NO: 688742 - DNA, 14 bp, Homo sapiens
taatttgaacaggt

SEQ ID NO: 688743 - DNA, 17 bp, Homo sapiens
taatttggggaaaatga

SEQ ID NO: 688744 - DNA, 21 bp, Homo sapiens
taatttgtaaaacttctgctc

SEQ ID NO: 688745 - DNA, 22 bp, Homo sapiens
taatttgtaaaacttctgctcg

SEQ ID NO: 688746 - DNA, 15 bp, Homo sapiens
taattttaatgctgt

SEQ ID NO: 688747 - DNA, 14 bp, Homo sapiens
taattttacacatt

SEQ ID NO: 688748 - DNA, 15 bp, Homo sapiens
taattttcaccgagc

SEQ ID NO: 688749 - DNA, 13 bp, Homo sapiens
taattttgtgtaa

SEQ ID NO: 688750 - DNA, 13 bp, Homo sapiens
taatttttattta

SEQ ID NO: 688751 - DNA, 18 bp, Homo sapiens
taatttttttttcataga

SEQ ID NO: 688752 - DNA, 23 bp, Homo sapiens
tacaaaattaagcaaatgttaaa

SEQ ID NO: 688753 - DNA, 16 bp, Homo sapiens
tacaaacagtatttct

SEQ ID NO: 688754 - DNA, 14 bp, Homo sapiens
tacaaatgaagaaa

SEQ ID NO: 688755 - DNA, 17 bp, Homo sapiens
tacaaatgaagaaagtc

SEQ ID NO: 688756 - DNA, 18 bp, Homo sapiens
tacaagaaaatgtatcca

SEQ ID NO: 688757 - DNA, 14 bp, Homo sapiens
tacaagatattatt

SEQ ID NO: 688758 - DNA, 16 bp, Homo sapiens
tacaaggtataataaa

SEQ ID NO: 688759 - DNA, 19 bp, Homo sapiens
tacaagtaatgtaaagatg

SEQ ID NO: 688760 - DNA, 17 bp, Homo sapiens
tacaagtttatatatat

SEQ ID NO: 688761 - DNA, 15 bp, Homo sapiens
tacaatcaaatctcc

SEQ ID NO: 688762 - DNA, 21 bp, Homo sapiens
tacaatcaaatctcctgctga

SEQ ID NO: 688763 - DNA, 21 bp, Homo sapiens
tacaattaatagtttgtctat

SEQ ID NO: 688764 - DNA, 22 bp, Homo sapiens
tacaattaatagtttgtctatt

SEQ ID NO: 688765 - DNA, 16 bp, Homo sapiens
tacacaatacagtatt

SEQ ID NO: 688766 - DNA, 19 bp, Homo sapiens
tacaccaatgaaaacatgt

SEQ ID NO: 688767 - DNA, 15 bp, Homo sapiens
tacacctaaaggtgt

SEQ ID NO: 688768 - DNA, 17 bp, Homo sapiens
tacagacctcagtttta

SEQ ID NO: 688769 - DNA, 15 bp, Homo sapiens
tacagactccatctc

SEQ ID NO: 688770 - DNA, 16 bp, Homo sapiens
tacagaggtattaaaa

SEQ ID NO: 688771 - DNA, 16 bp, Homo sapiens
tacagctcattaaact

SEQ ID NO: 688772 - DNA, 20 bp, Homo sapiens
tacagctcctttgaaaactc

SEQ ID NO: 688773 - DNA, 20 bp, Homo sapiens
tacaggcaccgagaatgttg

SEQ ID NO: 688774 - DNA, 24 bp, Homo sapiens
tacagggtaactgtgctgaatgct

SEQ ID NO: 688775 - DNA, 20 bp, Homo sapiens
tacagtacaatcagcagtct

SEQ ID NO: 688776 - DNA, 19 bp, Homo sapiens
tacagtgactccctgggag

SEQ ID NO: 688777 - DNA, 13 bp, Homo sapiens
tacagttatttca

SEQ ID NO: 688778 - DNA, 19 bp, Homo sapiens
tacagttgaaaacttgtaa

SEQ ID NO: 688779 - DNA, 20 bp, Homo sapiens
tacagtttgatacaggaatt

SEQ ID NO: 688780 - DNA, 13 bp, Homo sapiens
tacataactcctg

SEQ ID NO: 688781 - DNA, 15 bp, Homo sapiens
tacataactcctgtc

SEQ ID NO: 688782 - DNA, 18 bp, Homo sapiens
tacataactcctgtccct

SEQ ID NO: 688783 - DNA, 19 bp, Homo sapiens
tacataactcctgtccctt

SEQ ID NO: 688784 - DNA, 22 bp, Homo sapiens
tacataactcctgtcccttttc

SEQ ID NO: 688785 - DNA, 23 bp, Homo sapiens
tacataactcctgtcccttttcc

SEQ ID NO: 688786 - DNA, 17 bp, Homo sapiens
tacataaggatgacttt

SEQ ID NO: 688787 - DNA, 18 bp, Homo sapiens
tacataaggatgactttt

SEQ ID NO: 688788 - DNA, 15 bp, Homo sapiens
tacatacgatttaag

SEQ ID NO: 688789 - DNA, 19 bp, Homo sapiens
tacatacgatttaaggtat

SEQ ID NO: 688790 - DNA, 14 bp, Homo sapiens
tacatatagcagct

SEQ ID NO: 688791 - DNA, 17 bp, Homo sapiens
tacatatgagaatatac

SEQ ID NO: 688792 - DNA, 21 bp, Homo sapiens
tacatatgagaatatacctta

SEQ ID NO: 688793 - DNA, 19 bp, Homo sapiens
tacatatgctgatctttta

SEQ ID NO: 688794 - DNA, 20 bp, Homo sapiens
tacatcaagtccatctgaca

SEQ ID NO: 688795 - DNA, 15 bp, Homo sapiens
tacatccagagttct

SEQ ID NO: 688796 - DNA, 15 bp, Homo sapiens
tacatcctcatgcag

SEQ ID NO: 688797 - DNA, 19 bp, Homo sapiens
tacatctgcaatatgaatt

SEQ ID NO: 688798 - DNA, 19 bp, Homo sapiens
tacatggaattttttgaat

SEQ ID NO: 688799 - DNA, 15 bp, Homo sapiens
tacatggtgtttgtg

SEQ ID NO: 688800 - DNA, 16 bp, Homo sapiens
tacatggttgtgacct

SEQ ID NO: 688801 - DNA, 19 bp, Homo sapiens
tacatgtgtatattccttt

SEQ ID NO: 688802 - DNA, 15 bp, Homo sapiens
tacattatgaagaat

SEQ ID NO: 688803 - DNA, 13 bp, Homo sapiens
tacatttaaaatt

SEQ ID NO: 688804 - DNA, 18 bp, Homo sapiens
tacatttaaaattgctat

SEQ ID NO: 688805 - DNA, 18 bp, Homo sapiens
tacatttatcatggtcct

SEQ ID NO: 688806 - DNA, 13 bp, Homo sapiens
tacattttctaaa

SEQ ID NO: 688807 - DNA, 17 bp, Homo sapiens
taccaatgtaacactgg

SEQ ID NO: 688808 - DNA, 19 bp, Homo sapiens
taccaatgtaacactggcc

SEQ ID NO: 688809 - DNA, 19 bp, Homo sapiens
taccactcttttgctgtgc

SEQ ID NO: 688810 - DNA, 22 bp, Homo sapiens
taccactttttttaaccattat

SEQ ID NO: 688811 - DNA, 12 bp, Homo sapiens
taccatcatctc

SEQ ID NO: 688812 - DNA, 13 bp, Homo sapiens
taccatcatctct

SEQ ID NO: 688813 - DNA, 17 bp, Homo sapiens
taccatcatctctgaag

SEQ ID NO: 688814 - DNA, 23 bp, Homo sapiens
taccattatggataaagatgaga

SEQ ID NO: 688815 - DNA, 18 bp, Homo sapiens
taccattatttttaggat

SEQ ID NO: 688816 - DNA, 17 bp, Homo sapiens
tacccatagacatgaaa

SEQ ID NO: 688817 - DNA, 18 bp, Homo sapiens
tacccatagacatgaaag

SEQ ID NO: 688818 - DNA, 20 bp, Homo sapiens
tacccatcagttccagcctt

SEQ ID NO: 688819 - DNA, 21 bp, Homo sapiens
tacccatctagtacttgaaaa

SEQ ID NO: 688820 - DNA, 17 bp, Homo sapiens
tacccgatttgtttatt

SEQ ID NO: 688821 - DNA, 13 bp, Homo sapiens
tacccttttcccc

SEQ ID NO: 688822 - DNA, 17 bp, Homo sapiens
tacccttttcccccttc

SEQ ID NO: 688823 - DNA, 13 bp, Homo sapiens
tacccttttcctt

SEQ ID NO: 688824 - DNA, 23 bp, Homo sapiens
taccgagagcttggactacacaa

SEQ ID NO: 688825 - DNA, 15 bp, Homo sapiens
tagctctgctgctga

SEQ ID NO: 688826 - DNA, 17 bp, Homo sapiens
tagctcttcccactttt

SEQ ID NO: 688827 - DNA, 19 bp, Homo sapiens
tagctttccaaggaagcag

SEQ ID NO: 688828 - DNA, 20 bp, Homo sapiens
tagcttttaggaaaatcact

SEQ ID NO: 688829 - DNA, 21 bp, Homo sapiens
taggaaaatcactttgtctaa

SEQ ID NO: 688830 - DNA, 14 bp, Homo sapiens
taggaaactgaagc

SEQ ID NO: 688831 - DNA, 16 bp, Homo sapiens
taggaactcactcttt

SEQ ID NO: 688832 - DNA, 14 bp, Homo sapiens
taggaacttcagag

SEQ ID NO: 688833 - DNA, 17 bp, Homo sapiens
taggaatcattcagaaa

SEQ ID NO: 688834 - DNA, 18 bp, Homo sapiens
taggaggctgtgggtttt

SEQ ID NO: 688835 - DNA, 19 bp, Homo sapiens
taggagtggtgatttgaaa

SEQ ID NO: 688836 - DNA, 19 bp, Homo sapiens
taggcaaagataatttatt

SEQ ID NO: 688837 - DNA, 15 bp, Homo sapiens
taggcctgtcccttg

SEQ ID NO: 688838 - DNA, 20 bp, Homo sapiens
taggcctgtcccttgcctct

SEQ ID NO: 688839 - DNA, 19 bp, Homo sapiens
tagggaagctggcctgaga

SEQ ID NO: 688840 - DNA, 20 bp, Homo sapiens
tagggactacccatagacat

SEQ ID NO: 688841 - DNA, 18 bp, Homo sapiens
tagggatatggcaggact

SEQ ID NO: 688842 - DNA, 22 bp, Homo sapiens
tagggatatggcaggactcctg

SEQ ID NO: 688843 - DNA, 18 bp, Homo sapiens
taggggaaggagaagtaa

SEQ ID NO: 688844 - DNA, 23 bp, Homo sapiens
taggtaaatttttaggcaaagat

SEQ ID NO: 688845 - DNA, 21 bp, Homo sapiens
taggtatttctaacgccagca

SEQ ID NO: 688846 - DNA, 22 bp, Homo sapiens
taggtcaataacactgtatttt

SEQ ID NO: 688847 - DNA, 14 bp, Homo sapiens
taggtcataaagca

SEQ ID NO: 688848 - DNA, 16 bp, Homo sapiens
taggtcataaagcatt

SEQ ID NO: 688849 - DNA, 17 bp, Homo sapiens
taggtgaaagaacaagt

SEQ ID NO: 688850 - DNA, 22 bp, Homo sapiens
taggtgatgtttgctcttgttt

SEQ ID NO: 688851 - DNA, 18 bp, Homo sapiens
taggttatctttttaaaa

SEQ ID NO: 688852 - DNA, 22 bp, Homo sapiens
taggttattttgatgtaaagat

SEQ ID NO: 688853 - DNA, 11 bp, Homo sapiens
tagtaagaata

SEQ ID NO: 688854 - DNA, 12 bp, Homo sapiens
tagtaagcatag

SEQ ID NO: 688855 - DNA, 15 bp, Homo sapiens
tagtaatggcagagc

SEQ ID NO: 688856 - DNA, 15 bp, Homo sapiens
tagtaggaatgtaca

SEQ ID NO: 688857 - DNA, 16 bp, Homo sapiens
tagtagttaaataact

SEQ ID NO: 688858 - DNA, 17 bp, Homo sapiens
tagtctaagactatata

SEQ ID NO: 688859 - DNA, 13 bp, Homo sapiens
tagtgagacactg

SEQ ID NO: 688860 - DNA, 19 bp, Homo sapiens
tagtgatcaaattgtgcag

SEQ ID NO: 688861 - DNA, 21 bp, Homo sapiens
tagtgccagaattttaggaac

SEQ ID NO: 688862 - DNA, 21 bp, Homo sapiens
tagtgcttaaaaatcattgat

SEQ ID NO: 688863 - DNA, 15 bp, Homo sapiens
tagtgggccagggct

SEQ ID NO: 688864 - DNA, 21 bp, Homo sapiens
tagtgtacctcctctcagtgt

SEQ ID NO: 688865 - DNA, 23 bp, Homo sapiens
tagtgtacctcctctcagtgttt

SEQ ID NO: 688866 - DNA, 15 bp, Homo sapiens
tagttaaactgagag

SEQ ID NO: 688867 - DNA, 16 bp, Homo sapiens
tagttaaataactgtg

SEQ ID NO: 688868 - DNA, 19 bp, Homo sapiens
tagttaaattgaagaaagt

SEQ ID NO: 688869 - DNA, 15 bp, Homo sapiens
tagttcccaggtgat

SEQ ID NO: 688870 - DNA, 16 bp, Homo sapiens
tagttctagcagtccc

SEQ ID NO: 688871 - DNA, 12 bp, Homo sapiens
tagttgaaatga

SEQ ID NO: 688872 - DNA, 21 bp, Homo sapiens
tagttgccaacagttgtatgt

SEQ ID NO: 688873 - DNA, 18 bp, Homo sapiens
tagtttgtctattttaaa

SEQ ID NO: 688874 - DNA, 22 bp, Homo sapiens
tagtttgtctattttaaaataa

SEQ ID NO: 688875 - DNA, 15 bp, Homo sapiens
tataaaatggacaca

SEQ ID NO: 688876 - DNA, 21 bp, Homo sapiens
tataaacagaaatggaaagca

SEQ ID NO: 688877 - DNA, 15 bp, Homo sapiens
tataaatatacagta

SEQ ID NO: 688878 - DNA, 14 bp, Homo sapiens
tataacaactattt

SEQ ID NO: 688879 - DNA, 22 bp, Homo sapiens
tataacacttaggactagaaga

SEQ ID NO: 688880 - DNA, 19 bp, Homo sapiens
tataacatatatggaagag

SEQ ID NO: 688881 - DNA, 15 bp, Homo sapiens
tataagacatttgtt

SEQ ID NO: 688882 - DNA, 11 bp, Homo sapiens
tataagcattg

SEQ ID NO: 688883 - DNA, 16 bp, Homo sapiens
tataagtagtaaatca

SEQ ID NO: 688884 - DNA, 20 bp, Homo sapiens
tataagtagtaaatcagaaa

SEQ ID NO: 688885 - DNA, 21 bp, Homo sapiens
tataagtagtaaatcagaaag

SEQ ID NO: 688886 - DNA, 22 bp, Homo sapiens
tataataaatactcagtgatga

SEQ ID NO: 688887 - DNA, 22 bp, Homo sapiens
tataatataaaaaattttaaaa

SEQ ID NO: 688888 - DNA, 14 bp, Homo sapiens
tataattgtacaaa

SEQ ID NO: 688889 - DNA, 13 bp, Homo sapiens
tataattttatgg

SEQ ID NO: 688890 - DNA, 23 bp, Homo sapiens
tatacaaattttcagaaggttat

SEQ ID NO: 688891 - DNA, 19 bp, Homo sapiens
tatacaagtaatttcctga

SEQ ID NO: 688892 - DNA, 21 bp, Homo sapiens
tatacaatggaataaattatg

SEQ ID NO: 688893 - DNA, 19 bp, Homo sapiens
tatacatatatatatataa

SEQ ID NO: 688894 - DNA, 14 bp, Homo sapiens
tatacatatgagaa

SEQ ID NO: 688895 - DNA, 18 bp, Homo sapiens
tatacatgtgatacattt

SEQ ID NO: 688896 - DNA, 17 bp, Homo sapiens
tatacattttctaaata

SEQ ID NO: 688897 - DNA, 22 bp, Homo sapiens
tatacattttctaaataaaaat

SEQ ID NO: 688898 - DNA, 14 bp, Homo sapiens
tataccatttcctc

SEQ ID NO: 688899 - DNA, 18 bp, Homo sapiens
tataccatttcctcagct

SEQ ID NO: 688900 - DNA, 20 bp, Homo sapiens
tataccctggtgcaatcaca

SEQ ID NO: 688901 - DNA, 14 bp, Homo sapiens
tatactgcagcttt

SEQ ID NO: 688902 - DNA, 14 bp, Homo sapiens
tatactgggtttca

SEQ ID NO: 688903 - DNA, 15 bp, Homo sapiens
tatactgggtttcaa

SEQ ID NO: 688904 - DNA, 18 bp, Homo sapiens
tatactgtgtgcttgttt

SEQ ID NO: 688905 - DNA, 20 bp, Homo sapiens
tatacttgcaagataatttt

SEQ ID NO: 688906 - DNA, 18 bp, Homo sapiens
tatactttgccactgctg

SEQ ID NO: 688907 - DNA, 13 bp, Homo sapiens
tatagaaaattct

SEQ ID NO: 688908 - DNA, 21 bp, Homo sapiens
tatagacaaaagaataagaca

SEQ ID NO: 688909 - DNA, 21 bp, Homo sapiens
tatagaggaccctaacacagt

SEQ ID NO: 688910 - DNA, 20 bp, Homo sapiens
tatagcattgataatcttca

SEQ ID NO: 688911 - DNA, 22 bp, Homo sapiens
tatagcattgataatcttcagg

SEQ ID NO: 688912 - DNA, 19 bp, Homo sapiens
tatagtctaagactatata

SEQ ID NO: 688913 - DNA, 14 bp, Homo sapiens
tatagttaaactga

SEQ ID NO: 688914 - DNA, 17 bp, Homo sapiens
tatagttaaactgagag

SEQ ID NO: 688915 - DNA, 21 bp, Homo sapiens
tatagttaaactgagagtaat

SEQ ID NO: 688916 - DNA, 23 bp, Homo sapiens
tatagttaaactgagagtaattc

SEQ ID NO: 688917 - DNA, 19 bp, Homo sapiens
tatataaaacttaaaaaca

SEQ ID NO: 688918 - DNA, 18 bp, Homo sapiens
tatataacatatatggaa

SEQ ID NO: 688919 - DNA, 15 bp, Homo sapiens
tatataataaatact

SEQ ID NO: 688920 - DNA, 13 bp, Homo sapiens
tatataattttat

SEQ ID NO: 688921 - DNA, 16 bp, Homo sapiens
tatatataataaatac

SEQ ID NO: 688922 - DNA, 14 bp, Homo sapiens
tatatatacatata

SEQ ID NO: 688923 - DNA, 15 bp, Homo sapiens
tatatatacatatat

SEQ ID NO: 688924 - DNA, 11 bp, Homo sapiens
tatatatataa

SEQ ID NO: 688925 - DNA, 14 bp, Homo sapiens
tatatatataaatg

SEQ ID NO: 688926 - DNA, 16 bp, Homo sapiens
tatatatataaatgta

SEQ ID NO: 688927 - DNA, 18 bp, Homo sapiens
tatatatggtcatataca

SEQ ID NO: 688928 - DNA, 17 bp, Homo sapiens
tatatatttacaaggag

SEQ ID NO: 688929 - DNA, 23 bp, Homo sapiens
tatatattttgtgtgaaattgca

SEQ ID NO: 688930 - DNA, 14 bp, Homo sapiens
tatatcatatgtat

SEQ ID NO: 688931 - DNA, 15 bp, Homo sapiens
tatatgcaatgtcca

SEQ ID NO: 688932 - DNA, 18 bp, Homo sapiens
tatatgctttattaatgt

SEQ ID NO: 688933 - DNA, 22 bp, Homo sapiens
tatatggtatatatacatatat

SEQ ID NO: 688934 - DNA, 13 bp, Homo sapiens
tatatgtgaaaca

SEQ ID NO: 688935 - DNA, 18 bp, Homo sapiens
tatatgtgaaacattttt

SEQ ID NO: 688936 - DNA, 22 bp, Homo sapiens
tatattaaaacaataatgcaat

SEQ ID NO: 688937 - DNA, 20 bp, Homo sapiens
tatattacggaggaacagat

SEQ ID NO: 688938 - DNA, 13 bp, Homo sapiens
tatattcctttta

SEQ ID NO: 688939 - DNA, 19 bp, Homo sapiens
tatattccttttaaagaag

SEQ ID NO: 688940 - DNA, 15 bp, Homo sapiens
tatatttgtaaagct

SEQ ID NO: 688941 - DNA, 18 bp, Homo sapiens
tatattttgtgtgaaatt

SEQ ID NO: 688942 - DNA, 22 bp, Homo sapiens
tatattttgtgtgaaattgcat

SEQ ID NO: 688943 - DNA, 18 bp, Homo sapiens
tatatttttttaatttaa

SEQ ID NO: 688944 - DNA, 15 bp, Homo sapiens
tcactaaagcatgaa

SEQ ID NO: 688945 - DNA, 23 bp, Homo sapiens
tcactaattggtacttttaaaaa

SEQ ID NO: 688946 - DNA, 21 bp, Homo sapiens
tcactatatatatttctagaa

SEQ ID NO: 688947 - DNA, 17 bp, Homo sapiens
tcactatgggtgagcat

SEQ ID NO: 688948 - DNA, 20 bp, Homo sapiens
tcactccccaacccccaact

SEQ ID NO: 688949 - DNA, 15 bp, Homo sapiens
tcactctccagggta

SEQ ID NO: 688950 - DNA, 17 bp, Homo sapiens
tcactgcaacctctgcc

SEQ ID NO: 688951 - DNA, 18 bp, Homo sapiens
tcactgtatcattttctt

SEQ ID NO: 688952 - DNA, 16 bp, Homo sapiens
tcacttcctttgccct

SEQ ID NO: 688953 - DNA, 16 bp, Homo sapiens
tcacttctaaatgcat

SEQ ID NO: 688954 - DNA, 12 bp, Homo sapiens
tcacttgctgct

SEQ ID NO: 688955 - DNA, 18 bp, Homo sapiens
tcacttgctgctttttct

SEQ ID NO: 688956 - DNA, 15 bp, Homo sapiens
tcactttaagatctt

SEQ ID NO: 688957 - DNA, 13 bp, Homo sapiens
tcactttgtctaa

SEQ ID NO: 688958 - DNA, 19 bp, Homo sapiens
tcactttgtctaactcaga

SEQ ID NO: 688959 - DNA, 21 bp, Homo sapiens
tcactttttatgctatttctg

SEQ ID NO: 688960 - DNA, 19 bp, Homo sapiens
tcagaaagctttattttga

SEQ ID NO: 688961 - DNA, 21 bp, Homo sapiens
tcagaactttagtattaaatc

SEQ ID NO: 688962 - DNA, 13 bp, Homo sapiens
tcagaagggctat

SEQ ID NO: 688963 - DNA, 14 bp, Homo sapiens
tcagaagttaacat

SEQ ID NO: 688964 - DNA, 21 bp, Homo sapiens
tcagaataaggcaggcattga

SEQ ID NO: 688965 - DNA, 14 bp, Homo sapiens
tcagaatgtaaaag

SEQ ID NO: 688966 - DNA, 23 bp, Homo sapiens
tcagacaagacagaggggagcag

SEQ ID NO: 688967 - DNA, 14 bp, Homo sapiens
tcagaggagtaaat

SEQ ID NO: 688968 - DNA, 23 bp, Homo sapiens
tcagagtccttgcaaaattgtct

SEQ ID NO: 688969 - DNA, 18 bp, Homo sapiens
tcagatttttatttatga

SEQ ID NO: 688970 - DNA, 22 bp, Homo sapiens
tcagcacattcgggaccaatat

SEQ ID NO: 688971 - DNA, 23 bp, Homo sapiens
tcagcatctaaagcagcaggtct

SEQ ID NO: 688972 - DNA, 16 bp, Homo sapiens
tcagccacctgggaac

SEQ ID NO: 688973 - DNA, 19 bp, Homo sapiens
tcagccaggagctgtcacc

SEQ ID NO: 688974 - DNA, 20 bp, Homo sapiens
tcagctactaatgatgtttt

SEQ ID NO: 688975 - DNA, 22 bp, Homo sapiens
tcagctgaatgcctcctgtggg

SEQ ID NO: 688976 - DNA, 12 bp, Homo sapiens
tcagctgcaagg

SEQ ID NO: 688977 - DNA, 19 bp, Homo sapiens
tcagcttatctcttttata

SEQ ID NO: 688978 - DNA, 13 bp, Homo sapiens
tcagcttgctggg

SEQ ID NO: 688979 - DNA, 15 bp, Homo sapiens
tcagctttgataatt

SEQ ID NO: 688980 - DNA, 15 bp, Homo sapiens
tcaggagttcaagac

SEQ ID NO: 688981 - DNA, 17 bp, Homo sapiens
tcagggaaggtgaaaca

SEQ ID NO: 688982 - DNA, 17 bp, Homo sapiens
tcagggagtgctggctc

SEQ ID NO: 688983 - DNA, 19 bp, Homo sapiens
tcagggagtgctggctcac

SEQ ID NO: 688984 - DNA, 17 bp, Homo sapiens
tcagggctggagcctgg

SEQ ID NO: 688985 - DNA, 21 bp, Homo sapiens
tcaggtgaaactccagatgcc

SEQ ID NO: 688986 - DNA, 14 bp, Homo sapiens
tcaggtgaacactt

SEQ ID NO: 688987 - DNA, 14 bp, Homo sapiens
tcagtaaatagtgt

SEQ ID NO: 688988 - DNA, 13 bp, Homo sapiens
tcagtatccaggc

SEQ ID NO: 688989 - DNA, 18 bp, Homo sapiens
tcagtccctcttctggtt

SEQ ID NO: 688990 - DNA, 23 bp, Homo sapiens
tcagtgataattggtttgactgt

SEQ ID NO: 688991 - DNA, 19 bp, Homo sapiens
tcagtgcaaattgtatctt

SEQ ID NO: 688992 - DNA, 20 bp, Homo sapiens
tcagtggaaaccctgagagt

SEQ ID NO: 688993 - DNA, 21 bp, Homo sapiens
tcagtgggaaatatgccactg

SEQ ID NO: 688994 - DNA, 13 bp, Homo sapiens
tcagttgcttgtc

SEQ ID NO: 688995 - DNA, 23 bp, Homo sapiens
tcataaagcattggagtttcaaa

SEQ ID NO: 688996 - DNA, 16 bp, Homo sapiens
tcataatcagtaaata

SEQ ID NO: 688997 - DNA, 18 bp, Homo sapiens
tcataatcagtaaatagt

SEQ ID NO: 688998 - DNA, 20 bp, Homo sapiens
tcataatcagtaaatagtgt

SEQ ID NO: 688999 - DNA, 19 bp, Homo sapiens
tcataattgcctacattta

SEQ ID NO: 689000 - DNA, 14 bp, Homo sapiens
tcataattttgcaa

SEQ ID NO: 689001 - DNA, 18 bp, Homo sapiens
tcatacctcagaatgtaa

SEQ ID NO: 689002 - DNA, 20 bp, Homo sapiens
tcatagagatttgtctaatt

SEQ ID NO: 689003 - DNA, 20 bp, Homo sapiens
tcatagcaagcttttgctca

SEQ ID NO: 689004 - DNA, 17 bp, Homo sapiens
tcatagccataaatgat

SEQ ID NO: 689005 - DNA, 20 bp, Homo sapiens
tcatatacaaacatgtatgt

SEQ ID NO: 689006 - DNA, 21 bp, Homo sapiens
tcatatagcattgataatctt

SEQ ID NO: 689007 - DNA, 17 bp, Homo sapiens
tcatatattaaaacaat

SEQ ID NO: 689008 - DNA, 20 bp, Homo sapiens
tcatattttaaacagaggat

SEQ ID NO: 689009 - DNA, 11 bp, Homo sapiens
tcatcatcagg

SEQ ID NO: 689010 - DNA, 17 bp, Homo sapiens
tcatccaacttatgttt

SEQ ID NO: 689011 - DNA, 14 bp, Homo sapiens
tcatccctttggtt

SEQ ID NO: 689012 - DNA, 21 bp, Homo sapiens
tcatcctcccgccaggagctt

SEQ ID NO: 689013 - DNA, 16 bp, Homo sapiens
tcatccttctttcctt

SEQ ID NO: 689014 - DNA, 19 bp, Homo sapiens
tcatccttctttccttgtt

SEQ ID NO: 689015 - DNA, 17 bp, Homo sapiens
tcatctgatgagaacaa

SEQ ID NO: 689016 - DNA, 14 bp, Homo sapiens
tcatgaaaatacca

SEQ ID NO: 689017 - DNA, 18 bp, Homo sapiens
tcatgattatagcaacta

SEQ ID NO: 689018 - DNA, 22 bp, Homo sapiens
tcatgattatagcaactaatgt

SEQ ID NO: 689019 - DNA, 17 bp, Homo sapiens
tcatgcacccctgagcc

SEQ ID NO: 689020 - DNA, 16 bp, Homo sapiens
tcatgcgtacgtccca

SEQ ID NO: 689021 - DNA, 15 bp, Homo sapiens
tcatgcttgacatac

SEQ ID NO: 689022 - DNA, 18 bp, Homo sapiens
tcatgtatttgagcatat

SEQ ID NO: 689023 - DNA, 18 bp, Homo sapiens
tcattatgcacttttaga

SEQ ID NO: 689024 - DNA, 18 bp, Homo sapiens
tcattattcaagaatgaa

SEQ ID NO: 689025 - DNA, 22 bp, Homo sapiens
tcattattcaagaatgaaaaat

SEQ ID NO: 689026 - DNA, 20 bp, Homo sapiens
tcattctggttccctgctgc

SEQ ID NO: 689027 - DNA, 21 bp, Homo sapiens
tcattctggttccctgctgcg

SEQ ID NO: 689028 - DNA, 24 bp, Homo sapiens
tcattgacttttataaagcatgtt

SEQ ID NO: 689029 - DNA, 16 bp, Homo sapiens
tcattgctaaactgat

SEQ ID NO: 689030 - DNA, 22 bp, Homo sapiens
tcattgtctactcctagaagaa

SEQ ID NO: 689031 - DNA, 15 bp, Homo sapiens
tcattgttatttata

SEQ ID NO: 689032 - DNA, 16 bp, Homo sapiens
tcatttacaaaagatt

SEQ ID NO: 689033 - DNA, 14 bp, Homo sapiens
tcatttcttcactt

SEQ ID NO: 689034 - DNA, 16 bp, Homo sapiens
tcatttgctttggaag

SEQ ID NO: 689035 - DNA, 16 bp, Homo sapiens
tcattttcttttttaa

SEQ ID NO: 689036 - DNA, 20 bp, Homo sapiens
tcattttttatgtattgttt

SEQ ID NO: 689037 - DNA, 20 bp, Homo sapiens
tccaaactgttctgagaagg

SEQ ID NO: 689038 - DNA, 15 bp, Homo sapiens
tccaaagtaaaattg

SEQ ID NO: 689039 - DNA, 17 bp, Homo sapiens
tccaaatataagacatt

SEQ ID NO: 689040 - DNA, 17 bp, Homo sapiens
tccaaattaaaacaaat

SEQ ID NO: 689041 - DNA, 15 bp, Homo sapiens
tccaaatttaaaatg

SEQ ID NO: 689042 - DNA, 19 bp, Homo sapiens
tccaagacagggctcattt

SEQ ID NO: 689043 - DNA, 13 bp, Homo sapiens
tccaagaggctgt

SEQ ID NO: 689044 - DNA, 22 bp, Homo sapiens
tccaaggaaacattttatcatt

SEQ ID NO: 689045 - DNA, 19 bp, Homo sapiens
tccacaattattggcaaag

SEQ ID NO: 689046 - DNA, 20 bp, Homo sapiens
tccacaattattggcaaagt

SEQ ID NO: 689047 - DNA, 17 bp, Homo sapiens
tccacagaggacacaga

SEQ ID NO: 689048 - DNA, 19 bp, Homo sapiens
tccacagaggacacagaga

SEQ ID NO: 689049 - DNA, 18 bp, Homo sapiens
tccacatgctgcctggca

SEQ ID NO: 689050 - DNA, 14 bp, Homo sapiens
tccaccccccactc

SEQ ID NO: 689051 - DNA, 17 bp, Homo sapiens
tccaccccccactcagt

SEQ ID NO: 689052 - DNA, 13 bp, Homo sapiens
tccacctgtgggt

SEQ ID NO: 689053 - DNA, 14 bp, Homo sapiens
tccacgtttgtgcc

SEQ ID NO: 689054 - DNA, 20 bp, Homo sapiens
tccactcttgatctctcttg

SEQ ID NO: 689055 - DNA, 22 bp, Homo sapiens
tccactgcaaataaagcctttt

SEQ ID NO: 689056 - DNA, 18 bp, Homo sapiens
tccactgttagcacattg

SEQ ID NO: 689057 - DNA, 23 bp, Homo sapiens
tccactgttctcctgaatatttt

SEQ ID NO: 689058 - DNA, 16 bp, Homo sapiens
tccacttcatttttaa

SEQ ID NO: 689059 - DNA, 19 bp, Homo sapiens
tccacttcatttttaagaa

SEQ ID NO: 689060 - DNA, 19 bp, Homo sapiens
tccagaaccacacttgaaa

SEQ ID NO: 689061 - DNA, 18 bp, Homo sapiens
tccagcaccttgtgcctg

SEQ ID NO: 689062 - DNA, 21 bp, Homo sapiens
tccagcaccttgtgcctgggg

SEQ ID NO: 689063 - DNA, 18 bp, Homo sapiens
tcctcccgccaggagctt

SEQ ID NO: 689064 - DNA, 19 bp, Homo sapiens
tcctccctctgtccctctc

SEQ ID NO: 689065 - DNA, 15 bp, Homo sapiens
tcctccctggcagac

SEQ ID NO: 689066 - DNA, 14 bp, Homo sapiens
tcctcctgccctcc

SEQ ID NO: 689067 - DNA, 16 bp, Homo sapiens
tcctctcaccccactc

SEQ ID NO: 689068 - DNA, 22 bp, Homo sapiens
tcctctcaccccactcctgtca

SEQ ID NO: 689069 - DNA, 21 bp, Homo sapiens
tcctctggtgtttattataaa

SEQ ID NO: 689070 - DNA, 19 bp, Homo sapiens
tcctctttagtttttggtt

SEQ ID NO: 689071 - DNA, 13 bp, Homo sapiens
tcctgaatatttt

SEQ ID NO: 689072 - DNA, 20 bp, Homo sapiens
tcctgactgaaagtaggggg

SEQ ID NO: 689073 - DNA, 17 bp, Homo sapiens
tcctgagctaaatgctt

SEQ ID NO: 689074 - DNA, 18 bp, Homo sapiens
tcctgcacacagggcagt

SEQ ID NO: 689075 - DNA, 17 bp, Homo sapiens
tcctgcagtcccacact

SEQ ID NO: 689076 - DNA, 24 bp, Homo sapiens
tcctgcagtcccacactgtgcaga

SEQ ID NO: 689077 - DNA, 13 bp, Homo sapiens
tcctgccctcctc

SEQ ID NO: 689078 - DNA, 15 bp, Homo sapiens
tcctgccctcctctc

SEQ ID NO: 689079 - DNA, 19 bp, Homo sapiens
tcctgcctttctcaactgt

SEQ ID NO: 689080 - DNA, 15 bp, Homo sapiens
tcctggcccctgcct

SEQ ID NO: 689081 - DNA, 19 bp, Homo sapiens
tcctggccctgggggtctg

SEQ ID NO: 689082 - DNA, 23 bp, Homo sapiens
tcctggtgagaaaatatatgcct

SEQ ID NO: 689083 - DNA, 15 bp, Homo sapiens
tcctgtaaatatatc

SEQ ID NO: 689084 - DNA, 14 bp, Homo sapiens
tcctgtcccttttc

SEQ ID NO: 689085 - DNA, 22 bp, Homo sapiens
tcctgtgaagtttaattgtctc

SEQ ID NO: 689086 - DNA, 15 bp, Homo sapiens
tcctgtttccagggt

SEQ ID NO: 689087 - DNA, 22 bp, Homo sapiens
tccttaacccacctctcctgcc

SEQ ID NO: 689088 - DNA, 14 bp, Homo sapiens
tccttacaatgtga

SEQ ID NO: 689089 - DNA, 16 bp, Homo sapiens
tccttacaatgtgaat

SEQ ID NO: 689090 - DNA, 14 bp, Homo sapiens
tccttatcagagct

SEQ ID NO: 689091 - DNA, 22 bp, Homo sapiens
tccttatcagagctaagggtgg

SEQ ID NO: 689092 - DNA, 13 bp, Homo sapiens
tccttatccctct

SEQ ID NO: 689093 - DNA, 15 bp, Homo sapiens
tccttatccctctct

SEQ ID NO: 689094 - DNA, 19 bp, Homo sapiens
tccttatccctctcttccc

SEQ ID NO: 689095 - DNA, 22 bp, Homo sapiens
tccttatgtatcagtgtccttt

SEQ ID NO: 689096 - DNA, 16 bp, Homo sapiens
tccttatgtcctgtca

SEQ ID NO: 689097 - DNA, 14 bp, Homo sapiens
tccttatttgcctt

SEQ ID NO: 689098 - DNA, 18 bp, Homo sapiens
tccttcatcgaatgctaa

SEQ ID NO: 689099 - DNA, 15 bp, Homo sapiens
tccttccagtataac

SEQ ID NO: 689100 - DNA, 19 bp, Homo sapiens
tccttctccttctcacaca

SEQ ID NO: 689101 - DNA, 22 bp, Homo sapiens
tccttgaacaagatgtgggcct

SEQ ID NO: 689102 - DNA, 12 bp, Homo sapiens
tccttgccccca

SEQ ID NO: 689103 - DNA, 16 bp, Homo sapiens
tccttgcccccagtgc

SEQ ID NO: 689104 - DNA, 22 bp, Homo sapiens
tccttggctcccgggggcccca

SEQ ID NO: 689105 - DNA, 20 bp, Homo sapiens
tccttgtcccgtctggacct

SEQ ID NO: 689106 - DNA, 13 bp, Homo sapiens
tcctttcttatct

SEQ ID NO: 689107 - DNA, 12 bp, Homo sapiens
tcctttgccctt

SEQ ID NO: 689108 - DNA, 15 bp, Homo sapiens
tcctttgcccttcct

SEQ ID NO: 689109 - DNA, 19 bp, Homo sapiens
tcctttgcccttcctcctg

SEQ ID NO: 689110 - DNA, 13 bp, Homo sapiens
tccttttaaagaa

SEQ ID NO: 689111 - DNA, 17 bp, Homo sapiens
tccttttaaagaagctt

SEQ ID NO: 689112 - DNA, 14 bp, Homo sapiens
tccttttcctatcc

SEQ ID NO: 689113 - DNA, 11 bp, Homo sapiens
tccttttcctt

SEQ ID NO: 689114 - DNA, 21 bp, Homo sapiens
tcctttttcttcgctggacta

SEQ ID NO: 689115 - DNA, 16 bp, Homo sapiens
tcgaatttgaagagat

SEQ ID NO: 689116 - DNA, 23 bp, Homo sapiens
tcgagtgagacagactagaagtt

SEQ ID NO: 689117 - DNA, 22 bp, Homo sapiens
tcgcctgagggaagagtagctg

SEQ ID NO: 689118 - DNA, 13 bp, Homo sapiens
tcgcctgcctgca

SEQ ID NO: 689119 - DNA, 11 bp, Homo sapiens
tcgctgaaagc

SEQ ID NO: 689120 - DNA, 17 bp, Homo sapiens
tcgctggactattgtgc

SEQ ID NO: 689121 - DNA, 16 bp, Homo sapiens
tcgctttttcatcctt

SEQ ID NO: 689122 - DNA, 18 bp, Homo sapiens
tcggcacacactgtgccc

SEQ ID NO: 689123 - DNA, 16 bp, Homo sapiens
tcgtgctactgcactc

SEQ ID NO: 689124 - DNA, 22 bp, Homo sapiens
tcgttgcacagctgtttgaaat

SEQ ID NO: 689125 - DNA, 22 bp, Homo sapiens
tcgtttacactgcacattgaat

SEQ ID NO: 689126 - DNA, 16 bp, Homo sapiens
tctaaaagcagaaaat

SEQ ID NO: 689127 - DNA, 17 bp, Homo sapiens
tctaaaagcagaaaata

SEQ ID NO: 689128 - DNA, 14 bp, Homo sapiens
tctaaaagctctgt

SEQ ID NO: 689129 - DNA, 12 bp, Homo sapiens
tctaaaatgtca

SEQ ID NO: 689130 - DNA, 17 bp, Homo sapiens
tctaaagcagcaggtct

SEQ ID NO: 689131 - DNA, 15 bp, Homo sapiens
tctaaataaaaatat

SEQ ID NO: 689132 - DNA, 22 bp, Homo sapiens
tctaaataaaaatatgtaattt

SEQ ID NO: 689133 - DNA, 14 bp, Homo sapiens
tctaaatgcatatc

SEQ ID NO: 689134 - DNA, 23 bp, Homo sapiens
tctaaatgcatatcctgagccat

SEQ ID NO: 689135 - DNA, 14 bp, Homo sapiens
tctaactcagaatt

SEQ ID NO: 689136 - DNA, 14 bp, Homo sapiens
tctaagaaaatgta

SEQ ID NO: 689137 - DNA, 14 bp, Homo sapiens
tctaagaagacatt

SEQ ID NO: 689138 - DNA, 21 bp, Homo sapiens
tctaagactatatatataaat

SEQ ID NO: 689139 - DNA, 14 bp, Homo sapiens
tctaagcagttatg

SEQ ID NO: 689140 - DNA, 18 bp, Homo sapiens
tctaatccttttccttat

SEQ ID NO: 689141 - DNA, 22 bp, Homo sapiens
tctaatccttttccttatttgc

SEQ ID NO: 689142 - DNA, 14 bp, Homo sapiens
tctaattctgattc

SEQ ID NO: 689143 - DNA, 14 bp, Homo sapiens
tctaatttgaactg

SEQ ID NO: 689144 - DNA, 15 bp, Homo sapiens
tctaatttgaactgg

SEQ ID NO: 689145 - DNA, 14 bp, Homo sapiens
tctacaatctcttt

SEQ ID NO: 689146 - DNA, 19 bp, Homo sapiens
tctacaatctctttttgtt

SEQ ID NO: 689147 - DNA, 15 bp, Homo sapiens
tctacaccaatgaaa

SEQ ID NO: 689148 - DNA, 15 bp, Homo sapiens
tctacactcatctta

SEQ ID NO: 689149 - DNA, 17 bp, Homo sapiens
tctaccaaaaaaaggaa

SEQ ID NO: 689150 - DNA, 13 bp, Homo sapiens
tctacccttttcc

SEQ ID NO: 689151 - DNA, 17 bp, Homo sapiens
tctactcctagaagaac

SEQ ID NO: 689152 - DNA, 15 bp, Homo sapiens
tctactgccttgaaa

SEQ ID NO: 689153 - DNA, 21 bp, Homo sapiens
tctactgccttgaaaaatgac

SEQ ID NO: 689154 - DNA, 22 bp, Homo sapiens
tctactgccttgaaaaatgaca

SEQ ID NO: 689155 - DNA, 12 bp, Homo sapiens
tctagaagctcc

SEQ ID NO: 689156 - DNA, 13 bp, Homo sapiens
tctagagctttta

SEQ ID NO: 689157 - DNA, 17 bp, Homo sapiens
tctagctaaataaatgg

SEQ ID NO: 689158 - DNA, 12 bp, Homo sapiens
tctagtgatgat

SEQ ID NO: 689159 - DNA, 17 bp, Homo sapiens
tctataaaatagatata

SEQ ID NO: 689160 - DNA, 19 bp, Homo sapiens
tctataaaatagatataaa

SEQ ID NO: 689161 - DNA, 13 bp, Homo sapiens
tctatgcctgtct

SEQ ID NO: 689162 - DNA, 23 bp, Homo sapiens
tctatgggaagatacttattttt

SEQ ID NO: 689163 - DNA, 15 bp, Homo sapiens
tctattttaaaataa

SEQ ID NO: 689164 - DNA, 20 bp, Homo sapiens
tctcaaaccaagcaaaggaa

SEQ ID NO: 689165 - DNA, 19 bp, Homo sapiens
tctcaatgaaccataaatt

SEQ ID NO: 689166 - DNA, 20 bp, Homo sapiens
tctcaattgaaagcttttaa

SEQ ID NO: 689167 - DNA, 23 bp, Homo sapiens
tctcaattgaaagcttttaaaat

SEQ ID NO: 689168 - DNA, 14 bp, Homo sapiens
tctcaccccactcc

SEQ ID NO: 689169 - DNA, 17 bp, Homo sapiens
tctcactatatatattt

SEQ ID NO: 689170 - DNA, 19 bp, Homo sapiens
tctcagggctggagcctgg

SEQ ID NO: 689171 - DNA, 22 bp, Homo sapiens
tctcagggctggagcctggggt

SEQ ID NO: 689172 - DNA, 15 bp, Homo sapiens
tctcataattttgca

SEQ ID NO: 689173 - DNA, 21 bp, Homo sapiens
tctcatgactcctacttttca

SEQ ID NO: 689174 - DNA, 21 bp, Homo sapiens
tctccacttcatttttaagaa

SEQ ID NO: 689175 - DNA, 22 bp, Homo sapiens
tctcccaaagtaccttgaactc

SEQ ID NO: 689176 - DNA, 15 bp, Homo sapiens
tctccccccgcctgc

SEQ ID NO: 689177 - DNA, 13 bp, Homo sapiens
tctcccctcctgc

SEQ ID NO: 689178 - DNA, 14 bp, Homo sapiens
tctcccctcctgca

SEQ ID NO: 689179 - DNA, 15 bp, Homo sapiens
tctcccctcctgcac

SEQ ID NO: 689180 - DNA, 20 bp, Homo sapiens
tctcccctcctgcacacagg

SEQ ID NO: 689181 - DNA, 20 bp, Homo sapiens
tctccctagctcctcccctt

SEQ ID NO: 689182 - DNA, 13 bp, Homo sapiens
tctccctgcctgg

SEQ ID NO: 689183 - DNA, 15 bp, Homo sapiens
tctccctgcctggcc

SEQ ID NO: 689184 - DNA, 21 bp, Homo sapiens
tcttctactgccttgaaaaat

SEQ ID NO: 689185 - DNA, 14 bp, Homo sapiens
tcttctctgtgaga

SEQ ID NO: 689186 - DNA, 17 bp, Homo sapiens
tcttctgctcttttcct

SEQ ID NO: 689187 - DNA, 22 bp, Homo sapiens
tcttctggggcaggctgggcca

SEQ ID NO: 689188 - DNA, 22 bp, Homo sapiens
tcttctggtactttctgttatg

SEQ ID NO: 689189 - DNA, 19 bp, Homo sapiens
tcttctggtgttgactgga

SEQ ID NO: 689190 - DNA, 14 bp, Homo sapiens
tcttcttctaagaa

SEQ ID NO: 689191 - DNA, 12 bp, Homo sapiens
tcttctttgtgc

SEQ ID NO: 689192 - DNA, 23 bp, Homo sapiens
tcttctttgtgcctttggcctgg

SEQ ID NO: 689193 - DNA, 14 bp, Homo sapiens
tcttgaaattgaag

SEQ ID NO: 689194 - DNA, 15 bp, Homo sapiens
tcttgaaattgaaga

SEQ ID NO: 689195 - DNA, 11 bp, Homo sapiens
tcttgaatgtg

SEQ ID NO: 689196 - DNA, 19 bp, Homo sapiens
tcttgaatgtggtctcagg

SEQ ID NO: 689197 - DNA, 16 bp, Homo sapiens
tcttgaccatactaat

SEQ ID NO: 689198 - DNA, 18 bp, Homo sapiens
tcttgagccagtaatctt

SEQ ID NO: 689199 - DNA, 19 bp, Homo sapiens
tcttgatctctcttgtcct

SEQ ID NO: 689200 - DNA, 21 bp, Homo sapiens
tcttgatgttttttctgtaat

SEQ ID NO: 689201 - DNA, 14 bp, Homo sapiens
tcttgcactgaggt

SEQ ID NO: 689202 - DNA, 19 bp, Homo sapiens
tcttgcattcaaaatcttc

SEQ ID NO: 689203 - DNA, 15 bp, Homo sapiens
tcttgcctccaggtg

SEQ ID NO: 689204 - DNA, 15 bp, Homo sapiens
tcttgggcagtcttt

SEQ ID NO: 689205 - DNA, 13 bp, Homo sapiens
tcttggggcccag

SEQ ID NO: 689206 - DNA, 19 bp, Homo sapiens
tcttggttcgatacctgga

SEQ ID NO: 689207 - DNA, 21 bp, Homo sapiens
tcttggttcgatacctggagc

SEQ ID NO: 689208 - DNA, 21 bp, Homo sapiens
tcttgtcctcttctgctcttt

SEQ ID NO: 689209 - DNA, 16 bp, Homo sapiens
tcttgtctgatttctt

SEQ ID NO: 689210 - DNA, 17 bp, Homo sapiens
tcttgtggttgtgtgtg

SEQ ID NO: 689211 - DNA, 21 bp, Homo sapiens
tcttgtggttgtgtgtgttct

SEQ ID NO: 689212 - DNA, 23 bp, Homo sapiens
tcttgtggttgtgtgtgttctgt

SEQ ID NO: 689213 - DNA, 17 bp, Homo sapiens
tcttgttagaaaacaaa

SEQ ID NO: 689214 - DNA, 17 bp, Homo sapiens
tcttgtttttattaatt

SEQ ID NO: 689215 - DNA, 21 bp, Homo sapiens
tcttgtttttattaatttata

SEQ ID NO: 689216 - DNA, 23 bp, Homo sapiens
tctttatcaagcaacattcttgt

SEQ ID NO: 689217 - DNA, 21 bp, Homo sapiens
tctttcatttgctttggaagt

SEQ ID NO: 689218 - DNA, 11 bp, Homo sapiens
tctttccaaat

SEQ ID NO: 689219 - DNA, 12 bp, Homo sapiens
tctttccaaatt

SEQ ID NO: 689220 - DNA, 15 bp, Homo sapiens
tctttccaaattaaa

SEQ ID NO: 689221 - DNA, 23 bp, Homo sapiens
tctttccaggctatgtataaaat

SEQ ID NO: 689222 - DNA, 17 bp, Homo sapiens
tctttcccatgtatttg

SEQ ID NO: 689223 - DNA, 16 bp, Homo sapiens
tctttccttgttcagc

SEQ ID NO: 689224 - DNA, 15 bp, Homo sapiens
tctttctctgaggac

SEQ ID NO: 689225 - DNA, 20 bp, Homo sapiens
tctttctgtcttgttaatgc

SEQ ID NO: 689226 - DNA, 12 bp, Homo sapiens
tctttcttgaaa

SEQ ID NO: 689227 - DNA, 15 bp, Homo sapiens
tctttcttgaaattg

SEQ ID NO: 689228 - DNA, 18 bp, Homo sapiens
tctttgaaaacagatgac

SEQ ID NO: 689229 - DNA, 21 bp, Homo sapiens
tctttgaaaacagatgaccat

SEQ ID NO: 689230 - DNA, 16 bp, Homo sapiens
tctttggattctaaat

SEQ ID NO: 689231 - DNA, 14 bp, Homo sapiens
tctttgtgcctttg

SEQ ID NO: 689232 - DNA, 15 bp, Homo sapiens
tctttgtgcctttgg

SEQ ID NO: 689233 - DNA, 16 bp, Homo sapiens
tctttgtgcctttggc

SEQ ID NO: 689234 - DNA, 18 bp, Homo sapiens
tcttttaatggcatttct

SEQ ID NO: 689235 - DNA, 21 bp, Homo sapiens
tcttttctgtttctgtttata

SEQ ID NO: 689236 - DNA, 16 bp, Homo sapiens
tcttttctttctgtct

SEQ ID NO: 689237 - DNA, 13 bp, Homo sapiens
tcttttgtttcca

SEQ ID NO: 689238 - DNA, 12 bp, Homo sapiens
tcttttgtttgg

SEQ ID NO: 689239 - DNA, 16 bp, Homo sapiens
tctttttaaaaactct

SEQ ID NO: 689240 - DNA, 18 bp, Homo sapiens
tctttttaaaaactcttc

SEQ ID NO: 689241 - DNA, 22 bp, Homo sapiens
tctttttgccagttttccctgg

SEQ ID NO: 689242 - DNA, 12 bp, Homo sapiens
tcttttttaacc

SEQ ID NO: 689243 - DNA, 20 bp, Homo sapiens
tgaaaaacaattttctgtaa

SEQ ID NO: 689244 - DNA, 11 bp, Homo sapiens
tgaaaaagaat

SEQ ID NO: 689245 - DNA, 20 bp, Homo sapiens
tgaaaaagaataaaaacttt

SEQ ID NO: 689246 - DNA, 16 bp, Homo sapiens
tgaaaaagtaaagtgt

SEQ ID NO: 689247 - DNA, 22 bp, Homo sapiens
tgaaaaatataaaattatgaga

SEQ ID NO: 689248 - DNA, 17 bp, Homo sapiens
tgaaaaatgacaattgt

SEQ ID NO: 689249 - DNA, 14 bp, Homo sapiens
tgaaaagtaattga

SEQ ID NO: 689250 - DNA, 17 bp, Homo sapiens
tgaaaataagattccag

SEQ ID NO: 689251 - DNA, 22 bp, Homo sapiens
tgaaaattcatagtaagattga

SEQ ID NO: 689252 - DNA, 22 bp, Homo sapiens
tgaaaattgtttagtgatatta

SEQ ID NO: 689253 - DNA, 17 bp, Homo sapiens
tgaaacaaagtactctt

SEQ ID NO: 689254 - DNA, 18 bp, Homo sapiens
tgaaacaaagtactcttt

SEQ ID NO: 689255 - DNA, 22 bp, Homo sapiens
tgaaacaaagtactctttaaca

SEQ ID NO: 689256 - DNA, 19 bp, Homo sapiens
tgaaacattttttcttctg

SEQ ID NO: 689257 - DNA, 20 bp, Homo sapiens
tgaaaccaattaagcagctt

SEQ ID NO: 689258 - DNA, 18 bp, Homo sapiens
tgaaacctagtactgccc

SEQ ID NO: 689259 - DNA, 17 bp, Homo sapiens
tgaaacctttttttatc

SEQ ID NO: 689260 - DNA, 17 bp, Homo sapiens
tgaaactccagatgcca

SEQ ID NO: 689261 - DNA, 17 bp, Homo sapiens
tgaaacttaagaattga

SEQ ID NO: 689262 - DNA, 16 bp, Homo sapiens
tgaaactttgggaaaa

SEQ ID NO: 689263 - DNA, 13 bp, Homo sapiens
tgaaagaaaattg

SEQ ID NO: 689264 - DNA, 14 bp, Homo sapiens
tgaaagaaaattga

SEQ ID NO: 689265 - DNA, 15 bp, Homo sapiens
tgaaagaaaattgag

SEQ ID NO: 689266 - DNA, 17 bp, Homo sapiens
tgaaagaaaattgagtt

SEQ ID NO: 689267 - DNA, 22 bp, Homo sapiens
tgaaagccttagggaagctggc

SEQ ID NO: 689268 - DNA, 19 bp, Homo sapiens
tgaaagcttcaaagtttat

SEQ ID NO: 689269 - DNA, 13 bp, Homo sapiens
tgaaagtcaaatt

SEQ ID NO: 689270 - DNA, 21 bp, Homo sapiens
tgaaagtcaaatttactttaa

SEQ ID NO: 689271 - DNA, 18 bp, Homo sapiens
tgaaataatatatttctt

SEQ ID NO: 689272 - DNA, 19 bp, Homo sapiens
tgaaataatatatttcttc

SEQ ID NO: 689273 - DNA, 16 bp, Homo sapiens
tgaaatagtatacatt

SEQ ID NO: 689274 - DNA, 22 bp, Homo sapiens
tgaaatagtatacattgtcttg

SEQ ID NO: 689275 - DNA, 15 bp, Homo sapiens
tgaaatcttcccagt

SEQ ID NO: 689276 - DNA, 14 bp, Homo sapiens
tgaaatgaaaacat

SEQ ID NO: 689277 - DNA, 17 bp, Homo sapiens
tgaaatgacctctgtcc

SEQ ID NO: 689278 - DNA, 12 bp, Homo sapiens
tgaaatggaaca

SEQ ID NO: 689279 - DNA, 12 bp, Homo sapiens
tgaaatgtgaat

SEQ ID NO: 689280 - DNA, 21 bp, Homo sapiens
tgaaatgttagtcattgttat

SEQ ID NO: 689281 - DNA, 13 bp, Homo sapiens
tgaaattaagcat

SEQ ID NO: 689282 - DNA, 20 bp, Homo sapiens
tgaaattacgggtacctgaa

SEQ ID NO: 689283 - DNA, 14 bp, Homo sapiens
tgaaattactttaa

SEQ ID NO: 689284 - DNA, 22 bp, Homo sapiens
tgaaattgaagaggtgaaatgg

SEQ ID NO: 689285 - DNA, 20 bp, Homo sapiens
tgaacaaagctcaaagtatg

SEQ ID NO: 689286 - DNA, 13 bp, Homo sapiens
tgaacaggtcaaa

SEQ ID NO: 689287 - DNA, 18 bp, Homo sapiens
tgaacaggtcaaagatgt

SEQ ID NO: 689288 - DNA, 18 bp, Homo sapiens
tgaacatgatagttaaac

SEQ ID NO: 689289 - DNA, 19 bp, Homo sapiens
tgaacatgatagttaaact

SEQ ID NO: 689290 - DNA, 15 bp, Homo sapiens
tgaaccacaactttg

SEQ ID NO: 689291 - DNA, 21 bp, Homo sapiens
tgaaccataaattcaactttg

SEQ ID NO: 689292 - DNA, 17 bp, Homo sapiens
tgaacctcattctggtt

SEQ ID NO: 689293 - DNA, 20 bp, Homo sapiens
tgaactcagcacattcggga

SEQ ID NO: 689294 - DNA, 22 bp, Homo sapiens
tgaactcttagtgattgagact

SEQ ID NO: 689295 - DNA, 23 bp, Homo sapiens
tgaactgcaggataaaatggtac

SEQ ID NO: 689296 - DNA, 14 bp, Homo sapiens
tgaacttggctttc

SEQ ID NO: 689297 - DNA, 22 bp, Homo sapiens
tgaagaaagtcaaaaaattatt

SEQ ID NO: 689298 - DNA, 22 bp, Homo sapiens
tgaagaaagtcagctcttgtca

SEQ ID NO: 689299 - DNA, 14 bp, Homo sapiens
tgaagaattaagat

SEQ ID NO: 689300 - DNA, 13 bp, Homo sapiens
tgaagaattgaaa

SEQ ID NO: 689301 - DNA, 15 bp, Homo sapiens
tgaagagattgctga

SEQ ID NO: 689302 - DNA, 13 bp, Homo sapiens
tgaagcaaagaag

SEQ ID NO: 689303 - DNA, 23 bp, Homo sapiens
tgaagcaattagtctgaaactgg

SEQ ID NO: 689304 - DNA, 19 bp, Homo sapiens
tgcatattttgagaaactg

SEQ ID NO: 689305 - DNA, 16 bp, Homo sapiens
tgcatcacgtgtctta

SEQ ID NO: 689306 - DNA, 19 bp, Homo sapiens
tgcatcagaaagctttatt

SEQ ID NO: 689307 - DNA, 14 bp, Homo sapiens
tgcatccctgagac

SEQ ID NO: 689308 - DNA, 14 bp, Homo sapiens
tgcatctcaaaatt

SEQ ID NO: 689309 - DNA, 15 bp, Homo sapiens
tgcatgctctgcagc

SEQ ID NO: 689310 - DNA, 16 bp, Homo sapiens
tgcatggaggccctcc

SEQ ID NO: 689311 - DNA, 18 bp, Homo sapiens
tgcatgtagaggcttgtt

SEQ ID NO: 689312 - DNA, 16 bp, Homo sapiens
tgcatgtctgttcttc

SEQ ID NO: 689313 - DNA, 22 bp, Homo sapiens
tgcattatatcaaatctaccac

SEQ ID NO: 689314 - DNA, 16 bp, Homo sapiens
tgcattctggatttta

SEQ ID NO: 689315 - DNA, 13 bp, Homo sapiens
tgcatttgaggtc

SEQ ID NO: 689316 - DNA, 16 bp, Homo sapiens
tgcatttggtcaagat

SEQ ID NO: 689317 - DNA, 22 bp, Homo sapiens
tgcatttgtggtaatctacacc

SEQ ID NO: 689318 - DNA, 17 bp, Homo sapiens
tgcattttggaaggctg

SEQ ID NO: 689319 - DNA, 16 bp, Homo sapiens
tgcatttttgtgaaat

SEQ ID NO: 689320 - DNA, 14 bp, Homo sapiens
tgccaaatcagttt

SEQ ID NO: 689321 - DNA, 20 bp, Homo sapiens
tgccaacagttgtatgtttg

SEQ ID NO: 689322 - DNA, 15 bp, Homo sapiens
tgccaaccctgggct

SEQ ID NO: 689323 - DNA, 16 bp, Homo sapiens
tgccaaccctgggcta

SEQ ID NO: 689324 - DNA, 18 bp, Homo sapiens
tgccaactgccaggctgc

SEQ ID NO: 689325 - DNA, 14 bp, Homo sapiens
tgccaagaaaatga

SEQ ID NO: 689326 - DNA, 20 bp, Homo sapiens
tgccaagagtcaacaggtca

SEQ ID NO: 689327 - DNA, 22 bp, Homo sapiens
tgccacatcaaacctttgagta

SEQ ID NO: 689328 - DNA, 16 bp, Homo sapiens
tgccaccatacctcct

SEQ ID NO: 689329 - DNA, 15 bp, Homo sapiens
tgccacctcccccca

SEQ ID NO: 689330 - DNA, 17 bp, Homo sapiens
tgccacctccccccaca

SEQ ID NO: 689331 - DNA, 13 bp, Homo sapiens
tgccacctggcaa

SEQ ID NO: 689332 - DNA, 14 bp, Homo sapiens
tgccactcctccct

SEQ ID NO: 689333 - DNA, 17 bp, Homo sapiens
tgccactgctgtatttt

SEQ ID NO: 689334 - DNA, 21 bp, Homo sapiens
tgccactgctgtatttttatt

SEQ ID NO: 689335 - DNA, 22 bp, Homo sapiens
tgccactgctgtatttttattt

SEQ ID NO: 689336 - DNA, 17 bp, Homo sapiens
tgccagaattttaggaa

SEQ ID NO: 689337 - DNA, 21 bp, Homo sapiens
tgccagccccctaaaagcact

SEQ ID NO: 689338 - DNA, 17 bp, Homo sapiens
tgccagccttgagccct

SEQ ID NO: 689339 - DNA, 14 bp, Homo sapiens
tgccaggctgcctc

SEQ ID NO: 689340 - DNA, 19 bp, Homo sapiens
tgccaggctgcctcctgcc

SEQ ID NO: 689341 - DNA, 15 bp, Homo sapiens
tgccagtctcattgt

SEQ ID NO: 689342 - DNA, 15 bp, Homo sapiens
tgccatcatgcctga

SEQ ID NO: 689343 - DNA, 16 bp, Homo sapiens
tgccatcatgcctgac

SEQ ID NO: 689344 - DNA, 18 bp, Homo sapiens
tgccatctagccagcccc

SEQ ID NO: 689345 - DNA, 16 bp, Homo sapiens
tgccatctatctagtt

SEQ ID NO: 689346 - DNA, 18 bp, Homo sapiens
tgccatctgttcatttct

SEQ ID NO: 689347 - DNA, 15 bp, Homo sapiens
tgccatgtgaagagg

SEQ ID NO: 689348 - DNA, 20 bp, Homo sapiens
tgccattgaaggcttaattg

SEQ ID NO: 689349 - DNA, 17 bp, Homo sapiens
tgccatttaaaaagttg

SEQ ID NO: 689350 - DNA, 15 bp, Homo sapiens
tgcccatcctgactg

SEQ ID NO: 689351 - DNA, 23 bp, Homo sapiens
tgcccatggcttctggtcatgaa

SEQ ID NO: 689352 - DNA, 14 bp, Homo sapiens
tgcccctctcacca

SEQ ID NO: 689353 - DNA, 13 bp, Homo sapiens
tgcccctggcttt

SEQ ID NO: 689354 - DNA, 18 bp, Homo sapiens
tgcccctggctttgcctc

SEQ ID NO: 689355 - DNA, 20 bp, Homo sapiens
tgcccctggctttgcctctt

SEQ ID NO: 689356 - DNA, 22 bp, Homo sapiens
tgccccttaaacacaggctgtc

SEQ ID NO: 689357 - DNA, 19 bp, Homo sapiens
tgcccgtgtagtccccaac

SEQ ID NO: 689358 - DNA, 17 bp, Homo sapiens
tgccctcgcctcctcct

SEQ ID NO: 689359 - DNA, 21 bp, Homo sapiens
tgccctcgcctcctcctcctg

SEQ ID NO: 689360 - DNA, 22 bp, Homo sapiens
tgccctcgcctcctcctcctgc

SEQ ID NO: 689361 - DNA, 20 bp, Homo sapiens
tgccctcttctcgtgcctcc

SEQ ID NO: 689362 - DNA, 20 bp, Homo sapiens
tgccctgagaagctgctcca

SEQ ID NO: 689363 - DNA, 14 bp, Homo sapiens
tgccctgtgtgtgt

SEQ ID NO: 689364 - DNA, 18 bp, Homo sapiens
tgccctgttagctttcca

SEQ ID NO: 689365 - DNA, 13 bp, Homo sapiens
tgcccttcctcct

SEQ ID NO: 689366 - DNA, 14 bp, Homo sapiens
tgcccttcctcctg

SEQ ID NO: 689367 - DNA, 13 bp, Homo sapiens
tgccctttcaaag

SEQ ID NO: 689368 - DNA, 15 bp, Homo sapiens
tgccgctacctccct

SEQ ID NO: 689369 - DNA, 17 bp, Homo sapiens
tgccgctacctccctcc

SEQ ID NO: 689370 - DNA, 18 bp, Homo sapiens
tgccgctacctccctccc

SEQ ID NO: 689371 - DNA, 16 bp, Homo sapiens
tgccgtgtgagtgtga

SEQ ID NO: 689372 - DNA, 22 bp, Homo sapiens
tgccgtgtgagtgtgacagggc

SEQ ID NO: 689373 - DNA, 23 bp, Homo sapiens
tgcctagtttcttacacactgtc

SEQ ID NO: 689374 - DNA, 15 bp, Homo sapiens
tgcctccacatgctg

SEQ ID NO: 689375 - DNA, 16 bp, Homo sapiens
tgcctccacatgctgc

SEQ ID NO: 689376 - DNA, 17 bp, Homo sapiens
tgcctccaggtgcagag

SEQ ID NO: 689377 - DNA, 21 bp, Homo sapiens
tgcctccaggtgcagaggtac

SEQ ID NO: 689378 - DNA, 14 bp, Homo sapiens
tgcctcctgcgccc

SEQ ID NO: 689379 - DNA, 14 bp, Homo sapiens
tgcctcctgtgggg

SEQ ID NO: 689380 - DNA, 14 bp, Homo sapiens
tgcctctccctggg

SEQ ID NO: 689381 - DNA, 15 bp, Homo sapiens
tgcctctccctgggt

SEQ ID NO: 689382 - DNA, 14 bp, Homo sapiens
tgcctctgccctgg

SEQ ID NO: 689383 - DNA, 16 bp, Homo sapiens
tgcctctgctccctct

SEQ ID NO: 689384 - DNA, 12 bp, Homo sapiens
tgcctgcagggc

SEQ ID NO: 689385 - DNA, 22 bp, Homo sapiens
tgcctggcacagcttttgtata

SEQ ID NO: 689386 - DNA, 12 bp, Homo sapiens
tgcctggccccc

SEQ ID NO: 689387 - DNA, 23 bp, Homo sapiens
tgcctggggtgttagtggcaccg

SEQ ID NO: 689388 - DNA, 18 bp, Homo sapiens
tgcctggttaatattaat

SEQ ID NO: 689389 - DNA, 23 bp, Homo sapiens
tgcctgtccccaaacaggacagc

SEQ ID NO: 689390 - DNA, 15 bp, Homo sapiens
tgcctgtcctttcag

SEQ ID NO: 689391 - DNA, 21 bp, Homo sapiens
tgccttaatttagaaactgaa

SEQ ID NO: 689392 - DNA, 22 bp, Homo sapiens
tgccttaatttagaaactgaaa

SEQ ID NO: 689393 - DNA, 13 bp, Homo sapiens
tgccttctgctga

SEQ ID NO: 689394 - DNA, 14 bp, Homo sapiens
tgccttctgctgaa

SEQ ID NO: 689395 - DNA, 18 bp, Homo sapiens
tgccttgaaaaatgacaa

SEQ ID NO: 689396 - DNA, 20 bp, Homo sapiens
tgccttgctgtttgtcctga

SEQ ID NO: 689397 - DNA, 22 bp, Homo sapiens
tgccttgctgtttgtcctgaga

SEQ ID NO: 689398 - DNA, 20 bp, Homo sapiens
tgcctttctcaactgtccca

SEQ ID NO: 689399 - DNA, 16 bp, Homo sapiens
tgcctttctttgcctc

SEQ ID NO: 689400 - DNA, 18 bp, Homo sapiens
tgcctttctttgcctctg

SEQ ID NO: 689401 - DNA, 16 bp, Homo sapiens
tgccttttgcagaaga

SEQ ID NO: 689402 - DNA, 22 bp, Homo sapiens
tgccttttgcagaagagggtgt

SEQ ID NO: 689403 - DNA, 14 bp, Homo sapiens
tgcgaccctggggg

SEQ ID NO: 689404 - DNA, 22 bp, Homo sapiens
tgcgatggcgtgggctgcgtga

SEQ ID NO: 689405 - DNA, 13 bp, Homo sapiens
tgcgattctggat

SEQ ID NO: 689406 - DNA, 20 bp, Homo sapiens
tgcgcatcttgcctccaggt

SEQ ID NO: 689407 - DNA, 20 bp, Homo sapiens
tgcgcttcagtaacaagtgt

SEQ ID NO: 689408 - DNA, 20 bp, Homo sapiens
tgcggatactcttggagagt

SEQ ID NO: 689409 - DNA, 15 bp, Homo sapiens
tgcgtgccgtgtgag

SEQ ID NO: 689410 - DNA, 19 bp, Homo sapiens
tgcgtgccgtgtgagtgtg

SEQ ID NO: 689411 - DNA, 23 bp, Homo sapiens
tgcgtgccgtgtgagtgtgacag

SEQ ID NO: 689412 - DNA, 19 bp, Homo sapiens
tgctaaagcctgtgggttt

SEQ ID NO: 689413 - DNA, 20 bp, Homo sapiens
tgctaatcaaagccagggtc

SEQ ID NO: 689414 - DNA, 18 bp, Homo sapiens
tgctactgcactccagcc

SEQ ID NO: 689415 - DNA, 20 bp, Homo sapiens
tgctactgttgtaagaattc

SEQ ID NO: 689416 - DNA, 21 bp, Homo sapiens
tgctactgttgtaagaattct

SEQ ID NO: 689417 - DNA, 22 bp, Homo sapiens
tgctacttggggacataatttc

SEQ ID NO: 689418 - DNA, 18 bp, Homo sapiens
tgctagtggtgagcatgt

SEQ ID NO: 689419 - DNA, 14 bp, Homo sapiens
tgctatgaagccaa

SEQ ID NO: 689420 - DNA, 20 bp, Homo sapiens
tgctatggcaggataagaaa

SEQ ID NO: 689421 - DNA, 13 bp, Homo sapiens
tgctatgtaaggg

SEQ ID NO: 689422 - DNA, 15 bp, Homo sapiens
tgctattctagagct

SEQ ID NO: 689423 - DNA, 14 bp, Homo sapiens
tgctcagaagggct

SEQ ID NO: 689424 - DNA, 11 bp, Homo sapiens
tggtgaacagt

SEQ ID NO: 689425 - DNA, 20 bp, Homo sapiens
tggtgaagtaaattaggcag

SEQ ID NO: 689426 - DNA, 23 bp, Homo sapiens
tggtgaagtaaattaggcagtgc

SEQ ID NO: 689427 - DNA, 15 bp, Homo sapiens
tggtgagaaaatata

SEQ ID NO: 689428 - DNA, 20 bp, Homo sapiens
tggtgatttgaaaaatataa

SEQ ID NO: 689429 - DNA, 13 bp, Homo sapiens
tggtgcagacaga

SEQ ID NO: 689430 - DNA, 18 bp, Homo sapiens
tggtgccctcgcctcctc

SEQ ID NO: 689431 - DNA, 16 bp, Homo sapiens
tggtgctcttttttct

SEQ ID NO: 689432 - DNA, 12 bp, Homo sapiens
tggtggcctcag

SEQ ID NO: 689433 - DNA, 17 bp, Homo sapiens
tggtggtttacgcctat

SEQ ID NO: 689434 - DNA, 18 bp, Homo sapiens
tggtgtaaggtactttca

SEQ ID NO: 689435 - DNA, 14 bp, Homo sapiens
tggtgttgactgga

SEQ ID NO: 689436 - DNA, 21 bp, Homo sapiens
tggtgtttattataaagctta

SEQ ID NO: 689437 - DNA, 17 bp, Homo sapiens
tggtgtttttcccccgc

SEQ ID NO: 689438 - DNA, 23 bp, Homo sapiens
tggttaccactcttttgctgtgc

SEQ ID NO: 689439 - DNA, 20 bp, Homo sapiens
tggttacctgacctaaatta

SEQ ID NO: 689440 - DNA, 21 bp, Homo sapiens
tggttacctgacctaaattag

SEQ ID NO: 689441 - DNA, 20 bp, Homo sapiens
tggttacgttggttaaataa

SEQ ID NO: 689442 - DNA, 17 bp, Homo sapiens
tggttcagacacagctc

SEQ ID NO: 689443 - DNA, 14 bp, Homo sapiens
tggttccctgctgc

SEQ ID NO: 689444 - DNA, 19 bp, Homo sapiens
tggttccctgctgcgctgc

SEQ ID NO: 689445 - DNA, 13 bp, Homo sapiens
tggttcctctgct

SEQ ID NO: 689446 - DNA, 13 bp, Homo sapiens
tggttcttgaaaa

SEQ ID NO: 689447 - DNA, 16 bp, Homo sapiens
tggttgtgtgtgttct

SEQ ID NO: 689448 - DNA, 12 bp, Homo sapiens
tggttttaagaa

SEQ ID NO: 689449 - DNA, 12 bp, Homo sapiens
tgtaaaaatctt

SEQ ID NO: 689450 - DNA, 15 bp, Homo sapiens
tgtaaaacttctgct

SEQ ID NO: 689451 - DNA, 17 bp, Homo sapiens
tgtaaaagcattttgta

SEQ ID NO: 689452 - DNA, 18 bp, Homo sapiens
tgtaaaagcattttgtaa

SEQ ID NO: 689453 - DNA, 15 bp, Homo sapiens
tgtaaacttgtacat

SEQ ID NO: 689454 - DNA, 20 bp, Homo sapiens
tgtaaagttatgtatttaaa

SEQ ID NO: 689455 - DNA, 18 bp, Homo sapiens
tgtaaataaactatttat

SEQ ID NO: 689456 - DNA, 22 bp, Homo sapiens
tgtaaataaactatttatatca

SEQ ID NO: 689457 - DNA, 16 bp, Homo sapiens
tgtaaatcctgccatt

SEQ ID NO: 689458 - DNA, 14 bp, Homo sapiens
tgtaaatgaaactt

SEQ ID NO: 689459 - DNA, 23 bp, Homo sapiens
tgtaaatgcatattaaataataa

SEQ ID NO: 689460 - DNA, 15 bp, Homo sapiens
tgtaaatgctggtat

SEQ ID NO: 689461 - DNA, 11 bp, Homo sapiens
tgtaacactgg

SEQ ID NO: 689462 - DNA, 14 bp, Homo sapiens
tgtaactaaaataa

SEQ ID NO: 689463 - DNA, 16 bp, Homo sapiens
tgtaagaattcagaag

SEQ ID NO: 689464 - DNA, 15 bp, Homo sapiens
tgtaagtgtaaaaaa

SEQ ID NO: 689465 - DNA, 20 bp, Homo sapiens
tgtaataaaaagtatatgtt

SEQ ID NO: 689466 - DNA, 16 bp, Homo sapiens
tgtaatataatgtatt

SEQ ID NO: 689467 - DNA, 12 bp, Homo sapiens
tgtaatgtaaat

SEQ ID NO: 689468 - DNA, 13 bp, Homo sapiens
tgtaatgtaaata

SEQ ID NO: 689469 - DNA, 14 bp, Homo sapiens
tgtaatgtaaataa

SEQ ID NO: 689470 - DNA, 18 bp, Homo sapiens
tgtaatgtaaataaacta

SEQ ID NO: 689471 - DNA, 15 bp, Homo sapiens
tgtaatttaaatgaa

SEQ ID NO: 689472 - DNA, 18 bp, Homo sapiens
tgtaatttcaaaatacat

SEQ ID NO: 689473 - DNA, 16 bp, Homo sapiens
tgtaattttgtgtaag

SEQ ID NO: 689474 - DNA, 20 bp, Homo sapiens
tgtaattttgtgtaagaaat

SEQ ID NO: 689475 - DNA, 13 bp, Homo sapiens
tgtaatttttgct

SEQ ID NO: 689476 - DNA, 16 bp, Homo sapiens
tgtacaaaattaagca

SEQ ID NO: 689477 - DNA, 19 bp, Homo sapiens
tgtacatacgatttaaggt

SEQ ID NO: 689478 - DNA, 15 bp, Homo sapiens
tgtacatggaatttt

SEQ ID NO: 689479 - DNA, 22 bp, Homo sapiens
tgtacatggaattttttgaata

SEQ ID NO: 689480 - DNA, 15 bp, Homo sapiens
tgtacatttaaaatt

SEQ ID NO: 689481 - DNA, 16 bp, Homo sapiens
tgtacatttctataaa

SEQ ID NO: 689482 - DNA, 21 bp, Homo sapiens
tgtacatttctataaatagat

SEQ ID NO: 689483 - DNA, 17 bp, Homo sapiens
tgtaccatggtttgata

SEQ ID NO: 689484 - DNA, 20 bp, Homo sapiens
tgtaccatggtttgatatgt

SEQ ID NO: 689485 - DNA, 16 bp, Homo sapiens
tgtaccttaagatatt

SEQ ID NO: 689486 - DNA, 20 bp, Homo sapiens
tgtaccttaagatattgaag

SEQ ID NO: 689487 - DNA, 19 bp, Homo sapiens
tgtactctggggtgctgcc

SEQ ID NO: 689488 - DNA, 16 bp, Homo sapiens
tgtactgtctgttatg

SEQ ID NO: 689489 - DNA, 13 bp, Homo sapiens
tgtacttattaca

SEQ ID NO: 689490 - DNA, 21 bp, Homo sapiens
tgtacttgaaaaatgttttta

SEQ ID NO: 689491 - DNA, 17 bp, Homo sapiens
tgtagcaggttctaggc

SEQ ID NO: 689492 - DNA, 12 bp, Homo sapiens
tgtagcataact

SEQ ID NO: 689493 - DNA, 20 bp, Homo sapiens
tgtagcataactgtagctca

SEQ ID NO: 689494 - DNA, 24 bp, Homo sapiens
tgtagctacattttcagaagttaa

SEQ ID NO: 689495 - DNA, 13 bp, Homo sapiens
tgtaggagaaact

SEQ ID NO: 689496 - DNA, 18 bp, Homo sapiens
tgtaggttatctttttaa

SEQ ID NO: 689497 - DNA, 14 bp, Homo sapiens
tgtataaaatacat

SEQ ID NO: 689498 - DNA, 14 bp, Homo sapiens
tgtataaatataca

SEQ ID NO: 689499 - DNA, 19 bp, Homo sapiens
tgtataaatatacagtata

SEQ ID NO: 689500 - DNA, 18 bp, Homo sapiens
tgtataaccaagtgtgct

SEQ ID NO: 689501 - DNA, 22 bp, Homo sapiens
tgtataatgtgcagaaaatatt

SEQ ID NO: 689502 - DNA, 21 bp, Homo sapiens
tgtatataagtactgaccact

SEQ ID NO: 689503 - DNA, 15 bp, Homo sapiens
tgtatatacatatat

SEQ ID NO: 689504 - DNA, 20 bp, Homo sapiens
tgtatatattttgtgtgaaa

SEQ ID NO: 689505 - DNA, 14 bp, Homo sapiens
tgtatatcactaaa

SEQ ID NO: 689506 - DNA, 21 bp, Homo sapiens
tgtatatggtatatatacata

SEQ ID NO: 689507 - DNA, 15 bp, Homo sapiens
tgtatattcctttta

SEQ ID NO: 689508 - DNA, 18 bp, Homo sapiens
tgtatcagtgtcctttcc

SEQ ID NO: 689509 - DNA, 19 bp, Homo sapiens
tgtatcagtgtcctttcca

SEQ ID NO: 689510 - DNA, 20 bp, Homo sapiens
tgtatcagtgtcctttccag

SEQ ID NO: 689511 - DNA, 18 bp, Homo sapiens
tgtatccaaggaaacatt

SEQ ID NO: 689512 - DNA, 19 bp, Homo sapiens
tgtatcctccctggcagac

SEQ ID NO: 689513 - DNA, 22 bp, Homo sapiens
tgtatcctccctggcagacaca

SEQ ID NO: 689514 - DNA, 19 bp, Homo sapiens
tgtatcctggccctggggg

SEQ ID NO: 689515 - DNA, 15 bp, Homo sapiens
tgtatgatttataaa

SEQ ID NO: 689516 - DNA, 22 bp, Homo sapiens
tgtatgcagtattcttgcactg

SEQ ID NO: 689517 - DNA, 23 bp, Homo sapiens
tgtatgctgatcatcgccagagg

SEQ ID NO: 689518 - DNA, 23 bp, Homo sapiens
tgtatggatatatttgaaatagt

SEQ ID NO: 689519 - DNA, 13 bp, Homo sapiens
tgtatggggaggc

SEQ ID NO: 689520 - DNA, 14 bp, Homo sapiens
tgtatgtaaagtta

SEQ ID NO: 689521 - DNA, 16 bp, Homo sapiens
tgtatgtaaagttaaa

SEQ ID NO: 689522 - DNA, 22 bp, Homo sapiens
tgtatgtaatacatatagcagc

SEQ ID NO: 689523 - DNA, 15 bp, Homo sapiens
tgtatgttaaagaga

SEQ ID NO: 689524 - DNA, 12 bp, Homo sapiens
tgtatgtttgct

SEQ ID NO: 689525 - DNA, 16 bp, Homo sapiens
tgtattgttttactcc

SEQ ID NO: 689526 - DNA, 19 bp, Homo sapiens
tgtattgttttctgacagt

SEQ ID NO: 689527 - DNA, 19 bp, Homo sapiens
tgtatttaaaaaaaagaaa

SEQ ID NO: 689528 - DNA, 21 bp, Homo sapiens
tgtatttaaaaaaaagaaact

SEQ ID NO: 689529 - DNA, 23 bp, Homo sapiens
tgtatttaaaaaaaagaaacttt

SEQ ID NO: 689530 - DNA, 14 bp, Homo sapiens
tgtatttaaagttg

SEQ ID NO: 689531 - DNA, 13 bp, Homo sapiens
tgtatttctccat

SEQ ID NO: 689532 - DNA, 18 bp, Homo sapiens
tgtatttcttatacgctt

SEQ ID NO: 689533 - DNA, 15 bp, Homo sapiens
tgtatttgagcatat

SEQ ID NO: 689534 - DNA, 17 bp, Homo sapiens
tgtatttgttatatata

SEQ ID NO: 689535 - DNA, 16 bp, Homo sapiens
tgtattttcatgaaaa

SEQ ID NO: 689536 - DNA, 18 bp, Homo sapiens
tgtatttttatttttgca

SEQ ID NO: 689537 - DNA, 20 bp, Homo sapiens
tgtatttttatttttgcaca

SEQ ID NO: 689538 - DNA, 21 bp, Homo sapiens
tgtcaagaatagcattgtaaa

SEQ ID NO: 689539 - DNA, 19 bp, Homo sapiens
tgtcaaggaagacttttgg

SEQ ID NO: 689540 - DNA, 15 bp, Homo sapiens
tgtcaatctgtccgt

SEQ ID NO: 689541 - DNA, 11 bp, Homo sapiens
tgtcacattcc

SEQ ID NO: 689542 - DNA, 15 bp, Homo sapiens
tgtcaccaaggaaac

SEQ ID NO: 689543 - DNA, 23 bp, Homo sapiens
tgtcacccaaaccggcaggtgcg

SEQ ID NO: 689544 - DNA, 16 bp, Homo sapiens
ttatccctctcttccc

SEQ ID NO: 689545 - DNA, 18 bp, Homo sapiens
ttatctttttaaaaactc

SEQ ID NO: 689546 - DNA, 20 bp, Homo sapiens
ttatgagattggttttcctg

SEQ ID NO: 689547 - DNA, 22 bp, Homo sapiens
ttatgatagcaaatggcctcat

SEQ ID NO: 689548 - DNA, 17 bp, Homo sapiens
ttatgcaaaatttagaa

SEQ ID NO: 689549 - DNA, 20 bp, Homo sapiens
ttatgcacttttagaaatgc

SEQ ID NO: 689550 - DNA, 20 bp, Homo sapiens
ttatgcagcaaatatatgat

SEQ ID NO: 689551 - DNA, 19 bp, Homo sapiens
ttatgctactgaactgaaa

SEQ ID NO: 689552 - DNA, 16 bp, Homo sapiens
ttatgtagatgtgcat

SEQ ID NO: 689553 - DNA, 22 bp, Homo sapiens
ttatgtatcagtgtcctttcca

SEQ ID NO: 689554 - DNA, 20 bp, Homo sapiens
ttatgtatggatatatttga

SEQ ID NO: 689555 - DNA, 11 bp, Homo sapiens
ttatgtattta

SEQ ID NO: 689556 - DNA, 22 bp, Homo sapiens
ttatgtcagcacacacttacag

SEQ ID NO: 689557 - DNA, 13 bp, Homo sapiens
ttatgtgaaaaat

SEQ ID NO: 689558 - DNA, 16 bp, Homo sapiens
ttatgtgaaaaattaa

SEQ ID NO: 689559 - DNA, 11 bp, Homo sapiens
ttatgttcctt

SEQ ID NO: 689560 - DNA, 16 bp, Homo sapiens
ttatgttctaagtgcc

SEQ ID NO: 689561 - DNA, 14 bp, Homo sapiens
ttatgtttgaatga

SEQ ID NO: 689562 - DNA, 15 bp, Homo sapiens
ttatgtttgaatgaa

SEQ ID NO: 689563 - DNA, 12 bp, Homo sapiens
ttattaatgttt

SEQ ID NO: 689564 - DNA, 15 bp, Homo sapiens
ttattataaagctta

SEQ ID NO: 689565 - DNA, 14 bp, Homo sapiens
ttattatgcattat

SEQ ID NO: 689566 - DNA, 14 bp, Homo sapiens
ttattcaaatttga

SEQ ID NO: 689567 - DNA, 17 bp, Homo sapiens
ttattcaagaatgaaaa

SEQ ID NO: 689568 - DNA, 19 bp, Homo sapiens
ttattcaagaatgaaaaat

SEQ ID NO: 689569 - DNA, 15 bp, Homo sapiens
ttattcagaacttta

SEQ ID NO: 689570 - DNA, 15 bp, Homo sapiens
ttattctttgaaaac

SEQ ID NO: 689571 - DNA, 13 bp, Homo sapiens
ttattgaccattt

SEQ ID NO: 689572 - DNA, 22 bp, Homo sapiens
ttattgaccattttttaattta

SEQ ID NO: 689573 - DNA, 17 bp, Homo sapiens
ttattgtaaagtcctat

SEQ ID NO: 689574 - DNA, 22 bp, Homo sapiens
ttattgtaagcatctcaatctt

SEQ ID NO: 689575 - DNA, 18 bp, Homo sapiens
ttatttagcatggggatt

SEQ ID NO: 689576 - DNA, 22 bp, Homo sapiens
ttatttatccagaaaactgtga

SEQ ID NO: 689577 - DNA, 23 bp, Homo sapiens
ttatttatccagaaaactgtgat

SEQ ID NO: 689578 - DNA, 19 bp, Homo sapiens
ttatttatgacctgaaata

SEQ ID NO: 689579 - DNA, 14 bp, Homo sapiens
ttatttcaataaat

SEQ ID NO: 689580 - DNA, 21 bp, Homo sapiens
ttatttcatcttttattcaag

SEQ ID NO: 689581 - DNA, 21 bp, Homo sapiens
ttatttcttccctgctttgca

SEQ ID NO: 689582 - DNA, 19 bp, Homo sapiens
ttatttgaggtcagtgttt

SEQ ID NO: 689583 - DNA, 20 bp, Homo sapiens
ttattttaaaatatatgaag

SEQ ID NO: 689584 - DNA, 14 bp, Homo sapiens
ttatttttataatt

SEQ ID NO: 689585 - DNA, 16 bp, Homo sapiens
ttatttttgacagact

SEQ ID NO: 689586 - DNA, 23 bp, Homo sapiens
ttattttttggtggtgaaattga

SEQ ID NO: 689587 - DNA, 17 bp, Homo sapiens
ttatttttttaaaattt

SEQ ID NO: 689588 - DNA, 20 bp, Homo sapiens
ttcaaaaggtattatacatg

SEQ ID NO: 689589 - DNA, 14 bp, Homo sapiens
ttcaaaatgtctgt

SEQ ID NO: 689590 - DNA, 19 bp, Homo sapiens
ttcaaacttactattttga

SEQ ID NO: 689591 - DNA, 16 bp, Homo sapiens
ttcaaagttttgttgt

SEQ ID NO: 689592 - DNA, 17 bp, Homo sapiens
ttcaacttatttcataa

SEQ ID NO: 689593 - DNA, 20 bp, Homo sapiens
ttcaagaaaatctttgttga

SEQ ID NO: 689594 - DNA, 21 bp, Homo sapiens
ttcaagaatgaaaaatataat

SEQ ID NO: 689595 - DNA, 23 bp, Homo sapiens
ttcaagctgttatttcttccctg

SEQ ID NO: 689596 - DNA, 18 bp, Homo sapiens
ttcaaggagaatatgata

SEQ ID NO: 689597 - DNA, 15 bp, Homo sapiens
ttcaagtttacactt

SEQ ID NO: 689598 - DNA, 20 bp, Homo sapiens
ttcaatatcagctttgataa

SEQ ID NO: 689599 - DNA, 22 bp, Homo sapiens
ttcacccttatagtctaagact

SEQ ID NO: 689600 - DNA, 18 bp, Homo sapiens
ttcactactcatgcgtga

SEQ ID NO: 689601 - DNA, 15 bp, Homo sapiens
ttcactctccagggt

SEQ ID NO: 689602 - DNA, 13 bp, Homo sapiens
ttcactgcaattt

SEQ ID NO: 689603 - DNA, 15 bp, Homo sapiens
ttcactgcaattttg

SEQ ID NO: 689604 - DNA, 22 bp, Homo sapiens
ttcactggcccctactttgtgg

SEQ ID NO: 689605 - DNA, 21 bp, Homo sapiens
ttcagaaatataacacatttt

SEQ ID NO: 689606 - DNA, 18 bp, Homo sapiens
ttcagaagttaacatcaa

SEQ ID NO: 689607 - DNA, 22 bp, Homo sapiens
ttcagaagttaacatcaagcca

SEQ ID NO: 689608 - DNA, 19 bp, Homo sapiens
ttcagacacagctcttcca

SEQ ID NO: 689609 - DNA, 18 bp, Homo sapiens
ttcagatattattgcttt

SEQ ID NO: 689610 - DNA, 15 bp, Homo sapiens
ttcagatcactgaat

SEQ ID NO: 689611 - DNA, 18 bp, Homo sapiens
ttcagatcactgaattta

SEQ ID NO: 689612 - DNA, 19 bp, Homo sapiens
ttcagcaggctagacagaa

SEQ ID NO: 689613 - DNA, 20 bp, Homo sapiens
ttcagcatctaaagcagcag

SEQ ID NO: 689614 - DNA, 18 bp, Homo sapiens
ttcagccaccagcccctg

SEQ ID NO: 689615 - DNA, 19 bp, Homo sapiens
ttcagctagcttttaggaa

SEQ ID NO: 689616 - DNA, 20 bp, Homo sapiens
ttcagctagcttttaggaaa

SEQ ID NO: 689617 - DNA, 17 bp, Homo sapiens
ttcagctctttccaaat

SEQ ID NO: 689618 - DNA, 13 bp, Homo sapiens
ttcagctcttttt

SEQ ID NO: 689619 - DNA, 16 bp, Homo sapiens
ttcagtaacaagtgtt

SEQ ID NO: 689620 - DNA, 19 bp, Homo sapiens
ttcagtcctgggcaaaggt

SEQ ID NO: 689621 - DNA, 14 bp, Homo sapiens
ttcagttctttgga

SEQ ID NO: 689622 - DNA, 17 bp, Homo sapiens
ttcagttgcttgtcttc

SEQ ID NO: 689623 - DNA, 18 bp, Homo sapiens
ttcagttgcttgtcttct

SEQ ID NO: 689624 - DNA, 22 bp, Homo sapiens
ttcagttggttcgttctgtact

SEQ ID NO: 689625 - DNA, 11 bp, Homo sapiens
ttcataaacaa

SEQ ID NO: 689626 - DNA, 14 bp, Homo sapiens
ttcataatcagtaa

SEQ ID NO: 689627 - DNA, 18 bp, Homo sapiens
ttcataatcagtaaatag

SEQ ID NO: 689628 - DNA, 15 bp, Homo sapiens
ttcatacctcagaat

SEQ ID NO: 689629 - DNA, 20 bp, Homo sapiens
ttcatagagatttgtctaat

SEQ ID NO: 689630 - DNA, 20 bp, Homo sapiens
ttcatagagttcccatgaac

SEQ ID NO: 689631 - DNA, 22 bp, Homo sapiens
ttcatatagcattgataatctt

SEQ ID NO: 689632 - DNA, 22 bp, Homo sapiens
ttcatattttaaacagaggata

SEQ ID NO: 689633 - DNA, 19 bp, Homo sapiens
ttcatcattccctctcatc

SEQ ID NO: 689634 - DNA, 17 bp, Homo sapiens
ttcatccttctttcctt

SEQ ID NO: 689635 - DNA, 17 bp, Homo sapiens
ttcatctaccttttctg

SEQ ID NO: 689636 - DNA, 19 bp, Homo sapiens
ttcatctaccttttctggc

SEQ ID NO: 689637 - DNA, 17 bp, Homo sapiens
ttcatgaaaataccatt

SEQ ID NO: 689638 - DNA, 16 bp, Homo sapiens
ttcatgattatagcaa

SEQ ID NO: 689639 - DNA, 15 bp, Homo sapiens
ttcatgcttgacata

SEQ ID NO: 689640 - DNA, 21 bp, Homo sapiens
ttcatggcatcttcaatatga

SEQ ID NO: 689641 - DNA, 21 bp, Homo sapiens
ttcatggctgctgttgcttaa

SEQ ID NO: 689642 - DNA, 19 bp, Homo sapiens
ttcatgtgtggaaatggga

SEQ ID NO: 689643 - DNA, 23 bp, Homo sapiens
ttcattatgcacttttagaaatg

SEQ ID NO: 689644 - DNA, 15 bp, Homo sapiens
ttcattcattggtga

SEQ ID NO: 689645 - DNA, 18 bp, Homo sapiens
ttcattcctaacacagca

SEQ ID NO: 689646 - DNA, 12 bp, Homo sapiens
ttcatttgcttt

SEQ ID NO: 689647 - DNA, 15 bp, Homo sapiens
ttccaagaggctgta

SEQ ID NO: 689648 - DNA, 16 bp, Homo sapiens
ttccaagcttcatatt

SEQ ID NO: 689649 - DNA, 14 bp, Homo sapiens
ttccacagaggaca

SEQ ID NO: 689650 - DNA, 22 bp, Homo sapiens
ttccacagaggacacagagaag

SEQ ID NO: 689651 - DNA, 13 bp, Homo sapiens
ttccactgagacc

SEQ ID NO: 689652 - DNA, 23 bp, Homo sapiens
ttccactgcaaataaagcctttt

SEQ ID NO: 689653 - DNA, 23 bp, Homo sapiens
ttccactgcctgggatgatgcag

SEQ ID NO: 689654 - DNA, 20 bp, Homo sapiens
ttccagatctttcagaaata

SEQ ID NO: 689655 - DNA, 17 bp, Homo sapiens
ttccaggagttctgaag

SEQ ID NO: 689656 - DNA, 19 bp, Homo sapiens
ttccaggcttccctgactt

SEQ ID NO: 689657 - DNA, 23 bp, Homo sapiens
ttccaggcttccctgacttgctt

SEQ ID NO: 689658 - DNA, 17 bp, Homo sapiens
ttccaggggaacctgcc

SEQ ID NO: 689659 - DNA, 17 bp, Homo sapiens
ttccagtataaccagct

SEQ ID NO: 689660 - DNA, 14 bp, Homo sapiens
ttccagtgtctgtc

SEQ ID NO: 689661 - DNA, 18 bp, Homo sapiens
ttccatcatcactttgga

SEQ ID NO: 689662 - DNA, 19 bp, Homo sapiens
ttccatgatttagcaagca

SEQ ID NO: 689663 - DNA, 20 bp, Homo sapiens
ttgtatatcactaaaagcat

SEQ ID NO: 689664 - DNA, 20 bp, Homo sapiens
ttgtatatttgttttatgct

SEQ ID NO: 689665 - DNA, 14 bp, Homo sapiens
ttgtatcttttatc

SEQ ID NO: 689666 - DNA, 22 bp, Homo sapiens
ttgtatcttttatcctgggagc

SEQ ID NO: 689667 - DNA, 12 bp, Homo sapiens
ttgtatgtttgc

SEQ ID NO: 689668 - DNA, 23 bp, Homo sapiens
ttgtattgatttttaagaaagta

SEQ ID NO: 689669 - DNA, 14 bp, Homo sapiens
ttgtattgttttct

SEQ ID NO: 689670 - DNA, 17 bp, Homo sapiens
ttgtattttcatgaaaa

SEQ ID NO: 689671 - DNA, 22 bp, Homo sapiens
ttgtcaagaatagcattgtaaa

SEQ ID NO: 689672 - DNA, 12 bp, Homo sapiens
ttgtcagctact

SEQ ID NO: 689673 - DNA, 17 bp, Homo sapiens
ttgtcagtttatcttaa

SEQ ID NO: 689674 - DNA, 15 bp, Homo sapiens
ttgtcccttccagga

SEQ ID NO: 689675 - DNA, 15 bp, Homo sapiens
ttgtcctcttctgct

SEQ ID NO: 689676 - DNA, 18 bp, Homo sapiens
ttgtcctcttctgctctt

SEQ ID NO: 689677 - DNA, 20 bp, Homo sapiens
ttgtcctttaaaaaagaaaa

SEQ ID NO: 689678 - DNA, 15 bp, Homo sapiens
ttgtcgtggttctta

SEQ ID NO: 689679 - DNA, 15 bp, Homo sapiens
ttgtctaaaatgtca

SEQ ID NO: 689680 - DNA, 19 bp, Homo sapiens
ttgtctactcctagaagaa

SEQ ID NO: 689681 - DNA, 16 bp, Homo sapiens
ttgtctattttaaaat

SEQ ID NO: 689682 - DNA, 18 bp, Homo sapiens
ttgtctcaacgcctcccc

SEQ ID NO: 689683 - DNA, 20 bp, Homo sapiens
ttgtctcaacgcctccccct

SEQ ID NO: 689684 - DNA, 21 bp, Homo sapiens
ttgtctgtaggtgaaagaaca

SEQ ID NO: 689685 - DNA, 23 bp, Homo sapiens
ttgtcttaagatggaaatacagt

SEQ ID NO: 689686 - DNA, 16 bp, Homo sapiens
ttgtcttattcttaag

SEQ ID NO: 689687 - DNA, 17 bp, Homo sapiens
ttgtgaaatgaaaacat

SEQ ID NO: 689688 - DNA, 23 bp, Homo sapiens
ttgtgaaatgaaaacatgtaata

SEQ ID NO: 689689 - DNA, 20 bp, Homo sapiens
ttgtgaacatgatagttaaa

SEQ ID NO: 689690 - DNA, 22 bp, Homo sapiens
ttgtgaacatgatagttaaact

SEQ ID NO: 689691 - DNA, 14 bp, Homo sapiens
ttgtgaagtacata

SEQ ID NO: 689692 - DNA, 10 bp, Homo sapiens
ttgtgccttt

SEQ ID NO: 689693 - DNA, 14 bp, Homo sapiens
ttgtgcctttggcc

SEQ ID NO: 689694 - DNA, 18 bp, Homo sapiens
ttgtggatataaaatgtg

SEQ ID NO: 689695 - DNA, 17 bp, Homo sapiens
ttgtggtaatctacacc

SEQ ID NO: 689696 - DNA, 18 bp, Homo sapiens
ttgtgtaagaaatacaga

SEQ ID NO: 689697 - DNA, 18 bp, Homo sapiens
ttgtgtcccttggtcctg

SEQ ID NO: 689698 - DNA, 13 bp, Homo sapiens
ttgttaatacaag

SEQ ID NO: 689699 - DNA, 18 bp, Homo sapiens
ttgttaatacaaggtata

SEQ ID NO: 689700 - DNA, 22 bp, Homo sapiens
ttgttagaaaacaaaattttat

SEQ ID NO: 689701 - DNA, 16 bp, Homo sapiens
ttgttagcaaatgaca

SEQ ID NO: 689702 - DNA, 15 bp, Homo sapiens
ttgttatatataata

SEQ ID NO: 689703 - DNA, 20 bp, Homo sapiens
ttgttatatataataaatac

SEQ ID NO: 689704 - DNA, 22 bp, Homo sapiens
ttgttatatataataaatactc

SEQ ID NO: 689705 - DNA, 21 bp, Homo sapiens
ttgttattattagataatatt

SEQ ID NO: 689706 - DNA, 18 bp, Homo sapiens
ttgttcttattctggcat

SEQ ID NO: 689707 - DNA, 14 bp, Homo sapiens
ttgttgaagtttga

SEQ ID NO: 689708 - DNA, 14 bp, Homo sapiens
ttgttgtacttaaa

SEQ ID NO: 689709 - DNA, 12 bp, Homo sapiens
ttgttgtctcca

SEQ ID NO: 689710 - DNA, 21 bp, Homo sapiens
ttgtttaaaatgtaatttaaa

SEQ ID NO: 689711 - DNA, 14 bp, Homo sapiens
ttgtttatttgcaa

SEQ ID NO: 689712 - DNA, 16 bp, Homo sapiens
ttgtttcctcttccaa

SEQ ID NO: 689713 - DNA, 19 bp, Homo sapiens
ttgtttcctcttccaaagt

SEQ ID NO: 689714 - DNA, 21 bp, Homo sapiens
ttgtttcctcttccaaagtaa

SEQ ID NO: 689715 - DNA, 16 bp, Homo sapiens
ttgtttctttctctga

SEQ ID NO: 689716 - DNA, 23 bp, Homo sapiens
ttgtttgaggcaaattaactgta

SEQ ID NO: 689717 - DNA, 16 bp, Homo sapiens
ttgtttggcaaggaaa

SEQ ID NO: 689718 - DNA, 19 bp, Homo sapiens
ttgtttggtaaatgtttct

SEQ ID NO: 689719 - DNA, 13 bp, Homo sapiens
ttgtttggttata

SEQ ID NO: 689720 - DNA, 13 bp, Homo sapiens
ttgttttgtattg

SEQ ID NO: 689721 - DNA, 22 bp, Homo sapiens
ttgtttttgagtactgtactat

SEQ ID NO: 689722 - DNA, 22 bp, Homo sapiens
tttaaaaaataaataaaaacta

SEQ ID NO: 689723 - DNA, 21 bp, Homo sapiens
tttaaaacgcgtctgcctggg

SEQ ID NO: 689724 - DNA, 12 bp, Homo sapiens
tttaaaagaaat

SEQ ID NO: 689725 - DNA, 17 bp, Homo sapiens
tttaaaagccatgtata

SEQ ID NO: 689726 - DNA, 17 bp, Homo sapiens
tttaaaattttgtatgt

SEQ ID NO: 689727 - DNA, 11 bp, Homo sapiens
tttaaactttc

SEQ ID NO: 689728 - DNA, 14 bp, Homo sapiens
tttaaagtgcaaaa

SEQ ID NO: 689729 - DNA, 21 bp, Homo sapiens
tttaacatacaagaaaatgta

SEQ ID NO: 689730 - DNA, 23 bp, Homo sapiens
tttaacatgaacacccttagaaa

SEQ ID NO: 689731 - DNA, 17 bp, Homo sapiens
tttaacattttggaaat

SEQ ID NO: 689732 - DNA, 20 bp, Homo sapiens
tttaacattttggaaattgt

SEQ ID NO: 689733 - DNA, 23 bp, Homo sapiens
tttaaccaggggtcctaaccact

SEQ ID NO: 689734 - DNA, 23 bp, Homo sapiens
tttaaccggtaagagtttcagtt

SEQ ID NO: 689735 - DNA, 21 bp, Homo sapiens
tttaactgattcttatgatta

SEQ ID NO: 689736 - DNA, 14 bp, Homo sapiens
tttaactttaatac

SEQ ID NO: 689737 - DNA, 17 bp, Homo sapiens
tttaagaaagtaattta

SEQ ID NO: 689738 - DNA, 16 bp, Homo sapiens
tttaagaatattttta

SEQ ID NO: 689739 - DNA, 23 bp, Homo sapiens
tttaagtagtgggcatttcatag

SEQ ID NO: 689740 - DNA, 20 bp, Homo sapiens
tttaagtcagtatggtctaa

SEQ ID NO: 689741 - DNA, 12 bp, Homo sapiens
tttaataaactg

SEQ ID NO: 689742 - DNA, 17 bp, Homo sapiens
tttaataaagctttata

SEQ ID NO: 689743 - DNA, 21 bp, Homo sapiens
tttaatattcttttgtttcca

SEQ ID NO: 689744 - DNA, 13 bp, Homo sapiens
tttaattaaataa

SEQ ID NO: 689745 - DNA, 14 bp, Homo sapiens
tttaattcagcaga

SEQ ID NO: 689746 - DNA, 16 bp, Homo sapiens
tttaatttgaaatatg

SEQ ID NO: 689747 - DNA, 11 bp, Homo sapiens
tttaatttgat

SEQ ID NO: 689748 - DNA, 13 bp, Homo sapiens
tttaattttaatg

SEQ ID NO: 689749 - DNA, 17 bp, Homo sapiens
tttaattttaatgctgt

SEQ ID NO: 689750 - DNA, 19 bp, Homo sapiens
tttacataacggaaagttt

SEQ ID NO: 689751 - DNA, 16 bp, Homo sapiens
tttaccatcatctctg

SEQ ID NO: 689752 - DNA, 18 bp, Homo sapiens
tttacccttttccccctt

SEQ ID NO: 689753 - DNA, 19 bp, Homo sapiens
tttactgccttcctcctta

SEQ ID NO: 689754 - DNA, 21 bp, Homo sapiens
tttactgtcaaaatatttctc

SEQ ID NO: 689755 - DNA, 20 bp, Homo sapiens
tttacttctaagtcattcat

SEQ ID NO: 689756 - DNA, 15 bp, Homo sapiens
tttacttgttttgga

SEQ ID NO: 689757 - DNA, 17 bp, Homo sapiens
tttagaaactgaaaaat

SEQ ID NO: 689758 - DNA, 14 bp, Homo sapiens
tttagaaatgcata

SEQ ID NO: 689759 - DNA, 16 bp, Homo sapiens
tttagaagaaaagtta

SEQ ID NO: 689760 - DNA, 21 bp, Homo sapiens
tttagaatgttgaaaagtaat

SEQ ID NO: 689761 - DNA, 18 bp, Homo sapiens
tttagagataggaaactg

SEQ ID NO: 689762 - DNA, 19 bp, Homo sapiens
tttagagataggaaactga

SEQ ID NO: 689763 - DNA, 13 bp, Homo sapiens
tttaggaaaatca

SEQ ID NO: 689764 - DNA, 15 bp, Homo sapiens
tttaggaacttcaga

SEQ ID NO: 689765 - DNA, 17 bp, Homo sapiens
tttaggaacttcagaga

SEQ ID NO: 689766 - DNA, 17 bp, Homo sapiens
tttagttgccaacagtt

SEQ ID NO: 689767 - DNA, 15 bp, Homo sapiens
tttataaacagaaat

SEQ ID NO: 689768 - DNA, 16 bp, Homo sapiens
tttataaacagaaatg

SEQ ID NO: 689769 - DNA, 12 bp, Homo sapiens
tttataaagcat

SEQ ID NO: 689770 - DNA, 24 bp, Homo sapiens
tttataaagtacccatctagtact

SEQ ID NO: 689771 - DNA, 20 bp, Homo sapiens
tttataattgtacaaaatta

SEQ ID NO: 689772 - DNA, 20 bp, Homo sapiens
tttatacaatggaataaatt

SEQ ID NO: 689773 - DNA, 20 bp, Homo sapiens
tttatactgtatttctaaga

SEQ ID NO: 689774 - DNA, 18 bp, Homo sapiens
tttatatcattttaaaat

SEQ ID NO: 689775 - DNA, 19 bp, Homo sapiens
tttatatcattttaaaatg

SEQ ID NO: 689776 - DNA, 15 bp, Homo sapiens
tttatcattaaaaat

SEQ ID NO: 689777 - DNA, 21 bp, Homo sapiens
tttatccttacaatgtgaata

SEQ ID NO: 689778 - DNA, 23 bp, Homo sapiens
tttatgacctgaaataatatatt

SEQ ID NO: 689779 - DNA, 15 bp, Homo sapiens
tttatgatcagtgtt

SEQ ID NO: 689780 - DNA, 21 bp, Homo sapiens
tttatgatcagtgttgttgct

SEQ ID NO: 689781 - DNA, 17 bp, Homo sapiens
tttatgcagcaaatata

SEQ ID NO: 689782 - DNA, 12 bp, Homo sapiens
tttattaatgtt

SEQ ID NO: 689783 - DNA, 14 bp, Homo sapiens
agctggtgactttg

SEQ ID NO: 689784 - DNA, 18 bp, Homo sapiens
agctggtgactttgggga

SEQ ID NO: 689785 - DNA, 12 bp, Homo sapiens
agctggtgccaa

SEQ ID NO: 689786 - DNA, 22 bp, Homo sapiens
agctggtgccaaatagccccag

SEQ ID NO: 689787 - DNA, 18 bp, Homo sapiens
agctggtggccctgtgcc

SEQ ID NO: 689788 - DNA, 22 bp, Homo sapiens
agctggtggccctgtgcctggg

SEQ ID NO: 689789 - DNA, 15 bp, Homo sapiens
agctggtgggaagcg

SEQ ID NO: 689790 - DNA, 16 bp, Homo sapiens
agctggttgaggtttc

SEQ ID NO: 689791 - DNA, 22 bp, Homo sapiens
agctggtttcctcattcctgaa

SEQ ID NO: 689792 - DNA, 22 bp, Homo sapiens
agctgtaagaagagactgggaa

SEQ ID NO: 689793 - DNA, 13 bp, Homo sapiens
agctgtaaggcat

SEQ ID NO: 689794 - DNA, 20 bp, Homo sapiens
agctgtaatttcgccttaaa

SEQ ID NO: 689795 - DNA, 21 bp, Homo sapiens
agctgtaatttcgccttaaac

SEQ ID NO: 689796 - DNA, 22 bp, Homo sapiens
agctgtaatttcgccttaaact

SEQ ID NO: 689797 - DNA, 23 bp, Homo sapiens
agctgtactataagtagttggtt

SEQ ID NO: 689798 - DNA, 15 bp, Homo sapiens
agctgtactcagagc

SEQ ID NO: 689799 - DNA, 16 bp, Homo sapiens
agctgtactcagagca

SEQ ID NO: 689800 - DNA, 17 bp, Homo sapiens
agctgtactcagagcag

SEQ ID NO: 689801 - DNA, 19 bp, Homo sapiens
agctgtactcagagcagag

SEQ ID NO: 689802 - DNA, 20 bp, Homo sapiens
agctgtactcagagcagagc

SEQ ID NO: 689803 - DNA, 21 bp, Homo sapiens
agctgtacttcgtcttctaat

SEQ ID NO: 689804 - DNA, 19 bp, Homo sapiens
agctgtacttcttgaatat

SEQ ID NO: 689805 - DNA, 16 bp, Homo sapiens
agctgtagctcccgag

SEQ ID NO: 689806 - DNA, 23 bp, Homo sapiens
agctgtataattaattgtcatta

SEQ ID NO: 689807 - DNA, 16 bp, Homo sapiens
agctgtatgatttgtt

SEQ ID NO: 689808 - DNA, 15 bp, Homo sapiens
agctgtcacaacttg

SEQ ID NO: 689809 - DNA, 18 bp, Homo sapiens
agctgtcaccaaggaaac

SEQ ID NO: 689810 - DNA, 13 bp, Homo sapiens
agctgtcacctgc

SEQ ID NO: 689811 - DNA, 16 bp, Homo sapiens
agctgtcacctgctca

SEQ ID NO: 689812 - DNA, 17 bp, Homo sapiens
agctgtcacctgctcac

SEQ ID NO: 689813 - DNA, 15 bp, Homo sapiens
agctgtcccatgggg

SEQ ID NO: 689814 - DNA, 12 bp, Homo sapiens
agctgtcgtctg

SEQ ID NO: 689815 - DNA, 16 bp, Homo sapiens
agctgtcgtctgactc

SEQ ID NO: 689816 - DNA, 15 bp, Homo sapiens
agctgtctactggac

SEQ ID NO: 689817 - DNA, 13 bp, Homo sapiens
agctgtctgactg

SEQ ID NO: 689818 - DNA, 17 bp, Homo sapiens
agctgtctgccaggcac

SEQ ID NO: 689819 - DNA, 11 bp, Homo sapiens
agctgtctgct

SEQ ID NO: 689820 - DNA, 17 bp, Homo sapiens
agctgtctgctcagaca

SEQ ID NO: 689821 - DNA, 15 bp, Homo sapiens
agctgtctgtgaata

SEQ ID NO: 689822 - DNA, 16 bp, Homo sapiens
agctgtcttcccctga

SEQ ID NO: 689823 - DNA, 17 bp, Homo sapiens
agctgtcttcccctgag

SEQ ID NO: 689824 - DNA, 22 bp, Homo sapiens
agctgtgaaggcttcactctta

SEQ ID NO: 689825 - DNA, 21 bp, Homo sapiens
agctgtgagtgcgtgtgtgtg

SEQ ID NO: 689826 - DNA, 19 bp, Homo sapiens
agctgtgagttctccctgt

SEQ ID NO: 689827 - DNA, 10 bp, Homo sapiens
agctgtgcag

SEQ ID NO: 689828 - DNA, 14 bp, Homo sapiens
agctgtgcaggcat

SEQ ID NO: 689829 - DNA, 20 bp, Homo sapiens
agctgtgcatccaatttatt

SEQ ID NO: 689830 - DNA, 15 bp, Homo sapiens
agctgtgccagcagg

SEQ ID NO: 689831 - DNA, 13 bp, Homo sapiens
agctgtgcccctc

SEQ ID NO: 689832 - DNA, 20 bp, Homo sapiens
agctgtgcccctcccccagg

SEQ ID NO: 689833 - DNA, 14 bp, Homo sapiens
agctgtgcctgctc

SEQ ID NO: 689834 - DNA, 16 bp, Homo sapiens
agctgtgcctgctcag

SEQ ID NO: 689835 - DNA, 21 bp, Homo sapiens
agctgtgcctgctcagcagcc

SEQ ID NO: 689836 - DNA, 22 bp, Homo sapiens
agctgtgcctgctcagcagcca

SEQ ID NO: 689837 - DNA, 23 bp, Homo sapiens
agctgtgcctgctcagcagccag

SEQ ID NO: 689838 - DNA, 22 bp, Homo sapiens
agctgtggcagagttacagttc

SEQ ID NO: 689839 - DNA, 21 bp, Homo sapiens
agctgtggctcgtttgaggga

SEQ ID NO: 689840 - DNA, 21 bp, Homo sapiens
agctgtggtacaaatgtgata

SEQ ID NO: 689841 - DNA, 13 bp, Homo sapiens
agctgtgtctgcc

SEQ ID NO: 689842 - DNA, 15 bp, Homo sapiens
agctgtgtctgccaa

SEQ ID NO: 689843 - DNA, 14 bp, Homo sapiens
agctgtgtgaaata

SEQ ID NO: 689844 - DNA, 22 bp, Homo sapiens
agctgtgtgtttggaagactat

SEQ ID NO: 689845 - DNA, 14 bp, Homo sapiens
agctgttaaactgt

SEQ ID NO: 689846 - DNA, 16 bp, Homo sapiens
agctgttaaactgtta

SEQ ID NO: 689847 - DNA, 23 bp, Homo sapiens
agctgttaaactgttagcactgt

SEQ ID NO: 689848 - DNA, 18 bp, Homo sapiens
agctgttactgtcttcag

SEQ ID NO: 689849 - DNA, 13 bp, Homo sapiens
agctgttcctgtg

SEQ ID NO: 689850 - DNA, 14 bp, Homo sapiens
agctgttcctgtgt

SEQ ID NO: 689851 - DNA, 19 bp, Homo sapiens
agctgttcctgttcagtaa

SEQ ID NO: 689852 - DNA, 19 bp, Homo sapiens
agctgttcgctcctcccag

SEQ ID NO: 689853 - DNA, 22 bp, Homo sapiens
agctgttgaagtctcaggagtc

SEQ ID NO: 689854 - DNA, 16 bp, Homo sapiens
agctgttgtgagcttt

SEQ ID NO: 689855 - DNA, 16 bp, Homo sapiens
agctgtttactaggga

SEQ ID NO: 689856 - DNA, 22 bp, Homo sapiens
agctgtttactagggatccctc

SEQ ID NO: 689857 - DNA, 13 bp, Homo sapiens
agctgtttatgca

SEQ ID NO: 689858 - DNA, 19 bp, Homo sapiens
agctgtttatttattcact

SEQ ID NO: 689859 - DNA, 20 bp, Homo sapiens
agctgtttatttattcactg

SEQ ID NO: 689860 - DNA, 14 bp, Homo sapiens
agctgtttctcatg

SEQ ID NO: 689861 - DNA, 18 bp, Homo sapiens
agctgtttctcatgaagc

SEQ ID NO: 689862 - DNA, 19 bp, Homo sapiens
agctgtttgccaagctgaa

SEQ ID NO: 689863 - DNA, 13 bp, Homo sapiens
agctgtttgtcat

SEQ ID NO: 689864 - DNA, 15 bp, Homo sapiens
agctgttttccctga

SEQ ID NO: 689865 - DNA, 23 bp, Homo sapiens
agctgttttgttgacattctgaa

SEQ ID NO: 689866 - DNA, 12 bp, Homo sapiens
agcttaaaaaaa

SEQ ID NO: 689867 - DNA, 13 bp, Homo sapiens
agcttaaaacttt

SEQ ID NO: 689868 - DNA, 14 bp, Homo sapiens
agcttaaaatacaa

SEQ ID NO: 689869 - DNA, 15 bp, Homo sapiens
agcttaaaatacaag

SEQ ID NO: 689870 - DNA, 17 bp, Homo sapiens
agcttaaaatacaagac

SEQ ID NO: 689871 - DNA, 21 bp, Homo sapiens
agcttaaacccatacaatgta

SEQ ID NO: 689872 - DNA, 22 bp, Homo sapiens
agcttaaacccatacaatgtat

SEQ ID NO: 689873 - DNA, 13 bp, Homo sapiens
agcttaaactgaa

SEQ ID NO: 689874 - DNA, 14 bp, Homo sapiens
agcttaaactgaat

SEQ ID NO: 689875 - DNA, 23 bp, Homo sapiens
agcttaaattgcttttgttgtga

SEQ ID NO: 689876 - DNA, 13 bp, Homo sapiens
agcttaacagtgt

SEQ ID NO: 689877 - DNA, 16 bp, Homo sapiens
agcttaacattgactt

SEQ ID NO: 689878 - DNA, 17 bp, Homo sapiens
aaaaacagcattgcttt

SEQ ID NO: 689879 - DNA, 21 bp, Homo sapiens
aaaaacaggtatatactttga

SEQ ID NO: 689880 - DNA, 16 bp, Homo sapiens
aaaaacataaaaagca

SEQ ID NO: 689881 - DNA, 14 bp, Homo sapiens
aaaaacatattctt

SEQ ID NO: 689882 - DNA, 15 bp, Homo sapiens
aaaaacatattcttg

SEQ ID NO: 689883 - DNA, 16 bp, Homo sapiens
aaaaacatgtatgtgc

SEQ ID NO: 689884 - DNA, 19 bp, Homo sapiens
aaaaacattctatctactg

SEQ ID NO: 689885 - DNA, 15 bp, Homo sapiens
aaaaacattgccttt

SEQ ID NO: 689886 - DNA, 22 bp, Homo sapiens
aaaaacattttatttttaaaat

SEQ ID NO: 689887 - DNA, 23 bp, Homo sapiens
aaaaacattttttaaggagggag

SEQ ID NO: 689888 - DNA, 16 bp, Homo sapiens
aaaaaccaatcatttt

SEQ ID NO: 689889 - DNA, 23 bp, Homo sapiens
aaaaaccatgttgcgttcaaaga

SEQ ID NO: 689890 - DNA, 16 bp, Homo sapiens
aaaaaccctaattttg

SEQ ID NO: 689891 - DNA, 17 bp, Homo sapiens
aaaaaccgaataaatgt

SEQ ID NO: 689892 - DNA, 13 bp, Homo sapiens
aaaaacggggaga

SEQ ID NO: 689893 - DNA, 14 bp, Homo sapiens
aaaaactaaaaact

SEQ ID NO: 689894 - DNA, 17 bp, Homo sapiens
aaaaactaaaaactaga

SEQ ID NO: 689895 - DNA, 17 bp, Homo sapiens
aaaaactacattttgca

SEQ ID NO: 689896 - DNA, 21 bp, Homo sapiens
aaaaactacccatgtctttct

SEQ ID NO: 689897 - DNA, 22 bp, Homo sapiens
aaaaactagaaggcttctctcc

SEQ ID NO: 689898 - DNA, 13 bp, Homo sapiens
aaaaactcttcag

SEQ ID NO: 689899 - DNA, 15 bp, Homo sapiens
aaaaactgaaggttt

SEQ ID NO: 689900 - DNA, 17 bp, Homo sapiens
aaaaactgaaggttttt

SEQ ID NO: 689901 - DNA, 15 bp, Homo sapiens
aaaaactgagtgact

SEQ ID NO: 689902 - DNA, 12 bp, Homo sapiens
aaaaactgctta

SEQ ID NO: 689903 - DNA, 11 bp, Homo sapiens
aaaaactgtgt

SEQ ID NO: 689904 - DNA, 15 bp, Homo sapiens
aaaaactgtgtatca

SEQ ID NO: 689905 - DNA, 17 bp, Homo sapiens
aaaaactgtgtatcatt

SEQ ID NO: 689906 - DNA, 18 bp, Homo sapiens
aaaaactgttcttttgca

SEQ ID NO: 689907 - DNA, 16 bp, Homo sapiens
aaaaacttattttatc

SEQ ID NO: 689908 - DNA, 22 bp, Homo sapiens
aaaaacttcatgtaattttatt

SEQ ID NO: 689909 - DNA, 15 bp, Homo sapiens
aaaaacttgtactat

SEQ ID NO: 689910 - DNA, 18 bp, Homo sapiens
aaaaacttgtactatgtt

SEQ ID NO: 689911 - DNA, 21 bp, Homo sapiens
aaaaacttttaggttgttacc

SEQ ID NO: 689912 - DNA, 9 bp, Homo sapiens
aaaaagaaa

SEQ ID NO: 689913 - DNA, 11 bp, Homo sapiens
aaaaagaaaaa

SEQ ID NO: 689914 - DNA, 19 bp, Homo sapiens
aaaaagaaaggctgttaaa

SEQ ID NO: 689915 - DNA, 12 bp, Homo sapiens
aaaaagaaatga

SEQ ID NO: 689916 - DNA, 14 bp, Homo sapiens
aaaaagaaatgtca

SEQ ID NO: 689917 - DNA, 13 bp, Homo sapiens
aaaaagacaaaca

SEQ ID NO: 689918 - DNA, 14 bp, Homo sapiens
aaaaagacagggct

SEQ ID NO: 689919 - DNA, 12 bp, Homo sapiens
aaaaagactatt

SEQ ID NO: 689920 - DNA, 22 bp, Homo sapiens
aggaaagggctggctccccctc

SEQ ID NO: 689921 - DNA, 19 bp, Homo sapiens
aggaaaggggcgagcaccc

SEQ ID NO: 689922 - DNA, 20 bp, Homo sapiens
aggaaaggtctcagcttgta

SEQ ID NO: 689923 - DNA, 21 bp, Homo sapiens
aggaaagtcacccaaacactt

SEQ ID NO: 689924 - DNA, 18 bp, Homo sapiens
aggaaagtgatatgcatt

SEQ ID NO: 689925 - DNA, 22 bp, Homo sapiens
aggaaataaaacctttcaaatt

SEQ ID NO: 689926 - DNA, 20 bp, Homo sapiens
aggaaataaaggtaaaatca

SEQ ID NO: 689927 - DNA, 23 bp, Homo sapiens
aggaaataaaggtaaaatcactt

SEQ ID NO: 689928 - DNA, 19 bp, Homo sapiens
aggaaataacagagagaat

SEQ ID NO: 689929 - DNA, 16 bp, Homo sapiens
aggaaataagaaaaat

SEQ ID NO: 689930 - DNA, 21 bp, Homo sapiens
aggaaataagagcagtcacaa

SEQ ID NO: 689931 - DNA, 22 bp, Homo sapiens
aggaaatactttgcataaatta

SEQ ID NO: 689932 - DNA, 23 bp, Homo sapiens
aggaaatactttgcataaattaa

SEQ ID NO: 689933 - DNA, 15 bp, Homo sapiens
aggaaatagaattga

SEQ ID NO: 689934 - DNA, 12 bp, Homo sapiens
aggaaatatatt

SEQ ID NO: 689935 - DNA, 11 bp, Homo sapiens
aggaaatccat

SEQ ID NO: 689936 - DNA, 16 bp, Homo sapiens
aggaaatccattgttt

SEQ ID NO: 689937 - DNA, 18 bp, Homo sapiens
aggaaatccattgtttaa

SEQ ID NO: 689938 - DNA, 14 bp, Homo sapiens
aggaaatctcaccc

SEQ ID NO: 689939 - DNA, 18 bp, Homo sapiens
aggaaatgagtggccagc

SEQ ID NO: 689940 - DNA, 17 bp, Homo sapiens
aggaaatgatggaattt

SEQ ID NO: 689941 - DNA, 23 bp, Homo sapiens
aggaaattgagattagagggagg

SEQ ID NO: 689942 - DNA, 16 bp, Homo sapiens
aggaaatttgtttgta

SEQ ID NO: 689943 - DNA, 20 bp, Homo sapiens
aggaaatttgtttgtatttt

SEQ ID NO: 689944 - DNA, 14 bp, Homo sapiens
aggaacaaacaggg

SEQ ID NO: 689945 - DNA, 15 bp, Homo sapiens
aggaacaaagacagg

SEQ ID NO: 689946 - DNA, 14 bp, Homo sapiens
aggaacaagactga

SEQ ID NO: 689947 - DNA, 17 bp, Homo sapiens
aggaacacgattttcaa

SEQ ID NO: 689948 - DNA, 13 bp, Homo sapiens
aggaacagaagga

SEQ ID NO: 689949 - DNA, 14 bp, Homo sapiens
aggaacagaaggat

SEQ ID NO: 689950 - DNA, 21 bp, Homo sapiens
aggaacagaaggatgaatgag

SEQ ID NO: 689951 - DNA, 17 bp, Homo sapiens
aggaacagtcctgttca

SEQ ID NO: 689952 - DNA, 14 bp, Homo sapiens
aggaacagtggctg

SEQ ID NO: 689953 - DNA, 23 bp, Homo sapiens
aggaaccacaatgtttcttcatt

SEQ ID NO: 689954 - DNA, 24 bp, Homo sapiens
aggaaccacatataacacttaact

SEQ ID NO: 689955 - DNA, 18 bp, Homo sapiens
aggaaccagggcctccct

SEQ ID NO: 689956 - DNA, 23 bp, Homo sapiens
aggaaccctcaggccaccctcca

SEQ ID NO: 689957 - DNA, 19 bp, Homo sapiens
aggaacccttacagtagga

SEQ ID NO: 689958 - DNA, 23 bp, Homo sapiens
aggaaccgtggtatgtctgccat

SEQ ID NO: 689959 - DNA, 19 bp, Homo sapiens
aggaacctcctccacacca

SEQ ID NO: 689960 - DNA, 13 bp, Homo sapiens
aggaacctgtcct

SEQ ID NO: 689961 - DNA, 22 bp, Homo sapiens
aggaaccttccttcctgcttga

SEQ ID NO: 689962 - DNA, 15 bp, Homo sapiens
aggaacgctctcctc

SEQ ID NO: 689963 - DNA, 17 bp, Homo sapiens
aggaacgggcagccaca

SEQ ID NO: 689964 - DNA, 18 bp, Homo sapiens
aggaacgggcagccacag

SEQ ID NO: 689965 - DNA, 21 bp, Homo sapiens
aggaactaacttactgtccac

SEQ ID NO: 689966 - DNA, 16 bp, Homo sapiens
aggaactagtaaacat

SEQ ID NO: 689967 - DNA, 22 bp, Homo sapiens
aggaactccaggacgaggagga

SEQ ID NO: 689968 - DNA, 13 bp, Homo sapiens
aggaactcccagc

SEQ ID NO: 689969 - DNA, 15 bp, Homo sapiens
aggaactgcaataat

SEQ ID NO: 689970 - DNA, 16 bp, Homo sapiens
aggaactgcctgggcc

SEQ ID NO: 689971 - DNA, 23 bp, Homo sapiens
aggaacttaaataatgtgaaact

SEQ ID NO: 689972 - DNA, 15 bp, Homo sapiens
aggaacttttgttag

SEQ ID NO: 689973 - DNA, 15 bp, Homo sapiens
aggaagaaattcagg

SEQ ID NO: 689974 - DNA, 19 bp, Homo sapiens
aggaagaaattcaggtaca

SEQ ID NO: 689975 - DNA, 20 bp, Homo sapiens
aggaagaagaaatctttctc

SEQ ID NO: 689976 - DNA, 15 bp, Homo sapiens
aggaagaaggcagtg

SEQ ID NO: 689977 - DNA, 16 bp, Homo sapiens
aggaagacataaaact

SEQ ID NO: 689978 - DNA, 18 bp, Homo sapiens
aggaagacataaaacttt

SEQ ID NO: 689979 - DNA, 20 bp, Homo sapiens
aggaagacataaaactttaa

SEQ ID NO: 689980 - DNA, 21 bp, Homo sapiens
aggaagacatctgtagggaat

SEQ ID NO: 689981 - DNA, 20 bp, Homo sapiens
aggaagaccaaggcctcggc

SEQ ID NO: 689982 - DNA, 16 bp, Homo sapiens
aggaagaccctgccat

SEQ ID NO: 689983 - DNA, 14 bp, Homo sapiens
aggaagagaagaca

SEQ ID NO: 689984 - DNA, 15 bp, Homo sapiens
aggaagagaagacat

SEQ ID NO: 689985 - DNA, 12 bp, Homo sapiens
aggaagagcagg

SEQ ID NO: 689986 - DNA, 20 bp, Homo sapiens
aggaagagcaggcacatgga

SEQ ID NO: 689987 - DNA, 14 bp, Homo sapiens
aggaagagccacct

SEQ ID NO: 689988 - DNA, 19 bp, Homo sapiens
aggaagagccacctgcaag

SEQ ID NO: 689989 - DNA, 21 bp, Homo sapiens
aggaagagccacctgcaagat

SEQ ID NO: 689990 - DNA, 19 bp, Homo sapiens
aggaagagcccgcagggcc

SEQ ID NO: 689991 - DNA, 17 bp, Homo sapiens
aggaagaggcccactag

SEQ ID NO: 689992 - DNA, 23 bp, Homo sapiens
aggaagaggcccactagagggcc

SEQ ID NO: 689993 - DNA, 14 bp, Homo sapiens
aggaagagggacag

SEQ ID NO: 689994 - DNA, 18 bp, Homo sapiens
aggaagatcccccagaaa

SEQ ID NO: 689995 - DNA, 15 bp, Homo sapiens
aggaagatgaaagag

SEQ ID NO: 689996 - DNA, 15 bp, Homo sapiens
aggaagatgtttaca

SEQ ID NO: 689997 - DNA, 12 bp, Homo sapiens
aggaagcaacag

SEQ ID NO: 689998 - DNA, 20 bp, Homo sapiens
aggaagcagcctcagagtgg

SEQ ID NO: 689999 - DNA, 13 bp, Homo sapiens
aggaagcagggag

SEQ ID NO: 690000 - DNA, 15 bp, Homo sapiens
aaaaccacatgggct

SEQ ID NO: 690001 - DNA, 18 bp, Homo sapiens
aaaaccagagaatcttaa

SEQ ID NO: 690002 - DNA, 22 bp, Homo sapiens
aaaaccatcagatatttcttat

SEQ ID NO: 690003 - DNA, 13 bp, Homo sapiens
aaaaccattgctt

SEQ ID NO: 690004 - DNA, 12 bp, Homo sapiens
aaaacccaagtg

SEQ ID NO: 690005 - DNA, 19 bp, Homo sapiens
aaaacccaagtttatttct

SEQ ID NO: 690006 - DNA, 22 bp, Homo sapiens
aaaacccaccttgttggagcct

SEQ ID NO: 690007 - DNA, 21 bp, Homo sapiens
aaaacccagcaacagaaaaat

SEQ ID NO: 690008 - DNA, 14 bp, Homo sapiens
aaaacccagggcaa

SEQ ID NO: 690009 - DNA, 19 bp, Homo sapiens
aaaacccgagggacagcag

SEQ ID NO: 690010 - DNA, 21 bp, Homo sapiens
aaaaccctcagcactgttaca

SEQ ID NO: 690011 - DNA, 23 bp, Homo sapiens
aaaaccgagataggggagggggg

SEQ ID NO: 690012 - DNA, 22 bp, Homo sapiens
aaaacctgggtatgttcctaag

SEQ ID NO: 690013 - DNA, 17 bp, Homo sapiens
aaaacctgtcaatgata

SEQ ID NO: 690014 - DNA, 23 bp, Homo sapiens
aaaaccttgtaaaaaaagcaaaa

SEQ ID NO: 690015 - DNA, 17 bp, Homo sapiens
aaaacctttacagttag

SEQ ID NO: 690016 - DNA, 20 bp, Homo sapiens
aaaacctttcaaatttcaca

SEQ ID NO: 690017 - DNA, 15 bp, Homo sapiens
aaaaccttttactgg

SEQ ID NO: 690018 - DNA, 23 bp, Homo sapiens
aaaaccttttactggttgcatgg

SEQ ID NO: 690019 - DNA, 20 bp, Homo sapiens
aaaacgaaaataaagtagct

SEQ ID NO: 690020 - DNA, 17 bp, Homo sapiens
aaaacgcatggagtgtg

SEQ ID NO: 690021 - DNA, 23 bp, Homo sapiens
aaaacgggcagtctgctctgctg

SEQ ID NO: 690022 - DNA, 22 bp, Homo sapiens
aaaacgtgatgttttgaatgtg

SEQ ID NO: 690023 - DNA, 16 bp, Homo sapiens
aaaacgttttattgtg

SEQ ID NO: 690024 - DNA, 16 bp, Homo sapiens
aaaactaaaaactaga

SEQ ID NO: 690025 - DNA, 17 bp, Homo sapiens
aaaactaaatatatgtc

SEQ ID NO: 690026 - DNA, 15 bp, Homo sapiens
aaaactaagcacaaa

SEQ ID NO: 690027 - DNA, 12 bp, Homo sapiens
aaaactacattt

SEQ ID NO: 690028 - DNA, 12 bp, Homo sapiens
aaaactactttt

SEQ ID NO: 690029 - DNA, 13 bp, Homo sapiens
aaaactagcatta

SEQ ID NO: 690030 - DNA, 14 bp, Homo sapiens
aaaactatcctgat

SEQ ID NO: 690031 - DNA, 18 bp, Homo sapiens
aaaactattgagccttgc

SEQ ID NO: 690032 - DNA, 20 bp, Homo sapiens
aaaactatttaaaattggca

SEQ ID NO: 690033 - DNA, 23 bp, Homo sapiens
aaaactcaagcaagatgagctgt

SEQ ID NO: 690034 - DNA, 14 bp, Homo sapiens
aaaactcactgtga

SEQ ID NO: 690035 - DNA, 18 bp, Homo sapiens
aaaactcagttaaaatgt

SEQ ID NO: 690036 - DNA, 17 bp, Homo sapiens
aaaactcccaatggata

SEQ ID NO: 690037 - DNA, 19 bp, Homo sapiens
aaaactctacttaatccaa

SEQ ID NO: 690038 - DNA, 22 bp, Homo sapiens
aaaactctccttttccttacca

SEQ ID NO: 690039 - DNA, 14 bp, Homo sapiens
aaaactctgggtct

SEQ ID NO: 690040 - DNA, 17 bp, Homo sapiens
aaaactctggtgataaa

SEQ ID NO: 690041 - DNA, 14 bp, Homo sapiens
aaaactcttcagtg

SEQ ID NO: 690042 - DNA, 12 bp, Homo sapiens
aaaactctttga

SEQ ID NO: 690043 - DNA, 10 bp, Homo sapiens
aaaactgaag

SEQ ID NO: 690044 - DNA, 15 bp, Homo sapiens
aaaactgacagagga

SEQ ID NO: 690045 - DNA, 14 bp, Homo sapiens
aaaactgagtccat

SEQ ID NO: 690046 - DNA, 19 bp, Homo sapiens
aaaactgagtccatgaaaa

SEQ ID NO: 690047 - DNA, 21 bp, Homo sapiens
aaaactgagtccatgaaaata

SEQ ID NO: 690048 - DNA, 18 bp, Homo sapiens
aaaactgattgaatgata

SEQ ID NO: 690049 - DNA, 16 bp, Homo sapiens
aaaactgcacagtgct

SEQ ID NO: 690050 - DNA, 11 bp, Homo sapiens
aaaactgctcc

SEQ ID NO: 690051 - DNA, 23 bp, Homo sapiens
aaaactggtgcaattacagcaaa

SEQ ID NO: 690052 - DNA, 15 bp, Homo sapiens
aaaactgtactgtgt

SEQ ID NO: 690053 - DNA, 17 bp, Homo sapiens
aggaccaggactccctc

SEQ ID NO: 690054 - DNA, 15 bp, Homo sapiens
aggaccagggccctg

SEQ ID NO: 690055 - DNA, 19 bp, Homo sapiens
aggaccagtcaacctgggc

SEQ ID NO: 690056 - DNA, 20 bp, Homo sapiens
aggaccagtcaacctgggca

SEQ ID NO: 690057 - DNA, 14 bp, Homo sapiens
aggacccaggccct

SEQ ID NO: 690058 - DNA, 19 bp, Homo sapiens
aggacccaggccctccatg

SEQ ID NO: 690059 - DNA, 22 bp, Homo sapiens
aggacccagggtcccctcccca

SEQ ID NO: 690060 - DNA, 11 bp, Homo sapiens
aggaccccagg

SEQ ID NO: 690061 - DNA, 13 bp, Homo sapiens
aggaccccagggt

SEQ ID NO: 690062 - DNA, 16 bp, Homo sapiens
aggaccccaggtcagg

SEQ ID NO: 690063 - DNA, 18 bp, Homo sapiens
aggaccccaggtcagggg

SEQ ID NO: 690064 - DNA, 22 bp, Homo sapiens
aggacccccgaggggagggcag

SEQ ID NO: 690065 - DNA, 23 bp, Homo sapiens
aggacccccgaggggagggcagg

SEQ ID NO: 690066 - DNA, 13 bp, Homo sapiens
aggacccccttcc

SEQ ID NO: 690067 - DNA, 13 bp, Homo sapiens
aggacccctcacc

SEQ ID NO: 690068 - DNA, 14 bp, Homo sapiens
aggacccctcacca

SEQ ID NO: 690069 - DNA, 16 bp, Homo sapiens
aggacccctcaccacc

SEQ ID NO: 690070 - DNA, 18 bp, Homo sapiens
aggacccctcaccacccc

SEQ ID NO: 690071 - DNA, 19 bp, Homo sapiens
aggacccctcaccaccccc

SEQ ID NO: 690072 - DNA, 23 bp, Homo sapiens
aggacccctcaccttgcaacaca

SEQ ID NO: 690073 - DNA, 17 bp, Homo sapiens
aggacccctgccttcct

SEQ ID NO: 690074 - DNA, 22 bp, Homo sapiens
aggacccctgccttcctctgag

SEQ ID NO: 690075 - DNA, 23 bp, Homo sapiens
aggaccccttaatcttgctttct

SEQ ID NO: 690076 - DNA, 19 bp, Homo sapiens
aggacccgccagccccgct

SEQ ID NO: 690077 - DNA, 20 bp, Homo sapiens
aggacccgccagccccgctc

SEQ ID NO: 690078 - DNA, 21 bp, Homo sapiens
aggacccgcctgctcccatcc

SEQ ID NO: 690079 - DNA, 17 bp, Homo sapiens
aggacccggaggggcct

SEQ ID NO: 690080 - DNA, 15 bp, Homo sapiens
aggaccctcagccct

SEQ ID NO: 690081 - DNA, 14 bp, Homo sapiens
aggaccctgctgac

SEQ ID NO: 690082 - DNA, 18 bp, Homo sapiens
aggaccctgtttctgtag

SEQ ID NO: 690083 - DNA, 16 bp, Homo sapiens
aggaccggcggctcgg

SEQ ID NO: 690084 - DNA, 18 bp, Homo sapiens
aggaccgttctctgtccc

SEQ ID NO: 690085 - DNA, 14 bp, Homo sapiens
aggacctaaaacat

SEQ ID NO: 690086 - DNA, 18 bp, Homo sapiens
aggacctagagccgggca

SEQ ID NO: 690087 - DNA, 13 bp, Homo sapiens
aggacctcaggtg

SEQ ID NO: 690088 - DNA, 14 bp, Homo sapiens
aggacctcaggtga

SEQ ID NO: 690089 - DNA, 20 bp, Homo sapiens
aggacctcaggtgagaagca

SEQ ID NO: 690090 - DNA, 15 bp, Homo sapiens
aggacctcccttccg

SEQ ID NO: 690091 - DNA, 22 bp, Homo sapiens
aggacctctcagcatagcctgc

SEQ ID NO: 690092 - DNA, 20 bp, Homo sapiens
aggacctctgtaggcagcag

SEQ ID NO: 690093 - DNA, 16 bp, Homo sapiens
aggacctgagactcac

SEQ ID NO: 690094 - DNA, 21 bp, Homo sapiens
aggacctgagtttgggagagt

SEQ ID NO: 690095 - DNA, 16 bp, Homo sapiens
aggacctggctgccat

SEQ ID NO: 690096 - DNA, 16 bp, Homo sapiens
aggacctggggcacag

SEQ ID NO: 690097 - DNA, 22 bp, Homo sapiens
aggacctggggcacagtccagg

SEQ ID NO: 690098 - DNA, 16 bp, Homo sapiens
aggacctgtggccaag

SEQ ID NO: 690099 - DNA, 20 bp, Homo sapiens
aggaccttcgggctgtgccc

SEQ ID NO: 690100 - DNA, 14 bp, Homo sapiens
aggaccttgggcca

SEQ ID NO: 690101 - DNA, 23 bp, Homo sapiens
aggacctttaggtcaaactccct

SEQ ID NO: 690102 - DNA, 22 bp, Homo sapiens
aggacctttccaccacagccag

SEQ ID NO: 690103 - DNA, 21 bp, Homo sapiens
aggacgcacgctcgctgccat

SEQ ID NO: 690104 - DNA, 22 bp, Homo sapiens
aggacgcacgctcgctgccatc

SEQ ID NO: 690105 - DNA, 19 bp, Homo sapiens
aggacgccactcatttcat

SEQ ID NO: 690106 - DNA, 20 bp, Homo sapiens
aggacgccactcatttcatc

SEQ ID NO: 690107 - DNA, 23 bp, Homo sapiens
aggacgccactcatttcatctca

SEQ ID NO: 690108 - DNA, 17 bp, Homo sapiens
aggacgcctgcaggaga

SEQ ID NO: 690109 - DNA, 15 bp, Homo sapiens
aggacggccctgcct

SEQ ID NO: 690110 - DNA, 20 bp, Homo sapiens
aggacggccctgcctgcctc

SEQ ID NO: 690111 - DNA, 15 bp, Homo sapiens
aggacggctcctcag

SEQ ID NO: 690112 - DNA, 18 bp, Homo sapiens
aggacggtgccaagggcc

SEQ ID NO: 690113 - DNA, 22 bp, Homo sapiens
aggacggtgccaagggccccag

SEQ ID NO: 690114 - DNA, 14 bp, Homo sapiens
aggacgtaaaattt

SEQ ID NO: 690115 - DNA, 22 bp, Homo sapiens
aggactaacataaaatctgtga

SEQ ID NO: 690116 - DNA, 21 bp, Homo sapiens
aggactacaataccctaccct

SEQ ID NO: 690117 - DNA, 19 bp, Homo sapiens
aggactacgttaagggaag

SEQ ID NO: 690118 - DNA, 21 bp, Homo sapiens
aggactagaaaaacttgggtc

SEQ ID NO: 690119 - DNA, 16 bp, Homo sapiens
aggactatagcccagg

SEQ ID NO: 690120 - DNA, 18 bp, Homo sapiens
aggactatagcccaggtc

SEQ ID NO: 690121 - DNA, 16 bp, Homo sapiens
aggagcagccaggacc

SEQ ID NO: 690122 - DNA, 12 bp, Homo sapiens
aggagcagcctc

SEQ ID NO: 690123 - DNA, 15 bp, Homo sapiens
aggagcagcgggaac

SEQ ID NO: 690124 - DNA, 18 bp, Homo sapiens
aggagcagctggggtagg

SEQ ID NO: 690125 - DNA, 11 bp, Homo sapiens
aggagcagggt

SEQ ID NO: 690126 - DNA, 17 bp, Homo sapiens
aggagcatagaagccac

SEQ ID NO: 690127 - DNA, 16 bp, Homo sapiens
aggagcattaagccca

SEQ ID NO: 690128 - DNA, 14 bp, Homo sapiens
aggagccaccagtt

SEQ ID NO: 690129 - DNA, 16 bp, Homo sapiens
aggagcccagccagaa

SEQ ID NO: 690130 - DNA, 18 bp, Homo sapiens
aggagcccagccagaaag

SEQ ID NO: 690131 - DNA, 15 bp, Homo sapiens
aggagcccagtgggc

SEQ ID NO: 690132 - DNA, 20 bp, Homo sapiens
aggagcccagtgggctgcac

SEQ ID NO: 690133 - DNA, 19 bp, Homo sapiens
aggagcccccaacacaggc

SEQ ID NO: 690134 - DNA, 20 bp, Homo sapiens
aggagcccccaacacaggca

SEQ ID NO: 690135 - DNA, 16 bp, Homo sapiens
aggagcccctgagtcc

SEQ ID NO: 690136 - DNA, 18 bp, Homo sapiens
aggagccctgaggacctc

SEQ ID NO: 690137 - DNA, 21 bp, Homo sapiens
aggagccctgaggacctctca

SEQ ID NO: 690138 - DNA, 18 bp, Homo sapiens
aggagccgaagcccaggg

SEQ ID NO: 690139 - DNA, 12 bp, Homo sapiens
aggagcctccct

SEQ ID NO: 690140 - DNA, 13 bp, Homo sapiens
aggagcctccctg

SEQ ID NO: 690141 - DNA, 14 bp, Homo sapiens
aggagcctccctgc

SEQ ID NO: 690142 - DNA, 19 bp, Homo sapiens
aggagcctggtccttccct

SEQ ID NO: 690143 - DNA, 21 bp, Homo sapiens
aggagccttgataatacttga

SEQ ID NO: 690144 - DNA, 22 bp, Homo sapiens
aggagccttgataatacttgac

SEQ ID NO: 690145 - DNA, 21 bp, Homo sapiens
aggagccttgctgggccaggg

SEQ ID NO: 690146 - DNA, 22 bp, Homo sapiens
aggagccttgctgggccaggga

SEQ ID NO: 690147 - DNA, 14 bp, Homo sapiens
aggagcgagcatgt

SEQ ID NO: 690148 - DNA, 13 bp, Homo sapiens
aggagcgcaggca

SEQ ID NO: 690149 - DNA, 15 bp, Homo sapiens
aggagcgcaggcagc

SEQ ID NO: 690150 - DNA, 17 bp, Homo sapiens
aggagcgggcagggccg

SEQ ID NO: 690151 - DNA, 18 bp, Homo sapiens
aggagctactgacattcc

SEQ ID NO: 690152 - DNA, 19 bp, Homo sapiens
aggagctcaggaagaagag

SEQ ID NO: 690153 - DNA, 22 bp, Homo sapiens
aggagctcccctgtttgcatga

SEQ ID NO: 690154 - DNA, 21 bp, Homo sapiens
aggagctctgcgccaggcaga

SEQ ID NO: 690155 - DNA, 21 bp, Homo sapiens
aggagctcttcaggcctccct

SEQ ID NO: 690156 - DNA, 20 bp, Homo sapiens
aggagctgagggagggagcc

SEQ ID NO: 690157 - DNA, 15 bp, Homo sapiens
aggagctgaggtttc

SEQ ID NO: 690158 - DNA, 16 bp, Homo sapiens
aggagctgagtcacct

SEQ ID NO: 690159 - DNA, 18 bp, Homo sapiens
aggagctgagtcacctcc

SEQ ID NO: 690160 - DNA, 18 bp, Homo sapiens
aggagctgagttggcaga

SEQ ID NO: 690161 - DNA, 20 bp, Homo sapiens
aggagctgagttggcagacc

SEQ ID NO: 690162 - DNA, 15 bp, Homo sapiens
aggagctgatggcag

SEQ ID NO: 690163 - DNA, 18 bp, Homo sapiens
aggagctgatttccaggc

SEQ ID NO: 690164 - DNA, 23 bp, Homo sapiens
aggagctgatttccaggcccctg

SEQ ID NO: 690165 - DNA, 15 bp, Homo sapiens
aggagctgcactgat

SEQ ID NO: 690166 - DNA, 21 bp, Homo sapiens
aggagctgccttggctcagac

SEQ ID NO: 690167 - DNA, 23 bp, Homo sapiens
aggagctgccttggctcagacat

SEQ ID NO: 690168 - DNA, 11 bp, Homo sapiens
aggagctgcta

SEQ ID NO: 690169 - DNA, 13 bp, Homo sapiens
aggagctgctggc

SEQ ID NO: 690170 - DNA, 21 bp, Homo sapiens
aggagctgtcaccaaggaaac

SEQ ID NO: 690171 - DNA, 16 bp, Homo sapiens
aggagcttacccaagc

SEQ ID NO: 690172 - DNA, 20 bp, Homo sapiens
aggagcttcttgtttccttg

SEQ ID NO: 690173 - DNA, 22 bp, Homo sapiens
aggagcttcttgtttccttgtt

SEQ ID NO: 690174 - DNA, 19 bp, Homo sapiens
aggagctttctcaatgtct

SEQ ID NO: 690175 - DNA, 13 bp, Homo sapiens
aggaggaaacagt

SEQ ID NO: 690176 - DNA, 15 bp, Homo sapiens
aggaggaaagagagt

SEQ ID NO: 690177 - DNA, 17 bp, Homo sapiens
aggaggaacgggcagcc

SEQ ID NO: 690178 - DNA, 19 bp, Homo sapiens
aggaggaacgggcagccac

SEQ ID NO: 690179 - DNA, 20 bp, Homo sapiens
aggaggaacgggcagccaca

SEQ ID NO: 690180 - DNA, 14 bp, Homo sapiens
aggaggaaggcaag

SEQ ID NO: 690181 - DNA, 23 bp, Homo sapiens
aggaggaatcatgtcaggcctgt

SEQ ID NO: 690182 - DNA, 22 bp, Homo sapiens
aaaaggaagtggggacagattc

SEQ ID NO: 690183 - DNA, 17 bp, Homo sapiens
aaaaggacatcagcaaa

SEQ ID NO: 690184 - DNA, 19 bp, Homo sapiens
aaaaggacatcagcaaaca

SEQ ID NO: 690185 - DNA, 18 bp, Homo sapiens
aaaaggacgtaaaattta

SEQ ID NO: 690186 - DNA, 18 bp, Homo sapiens
aaaaggacttcaggaaca

SEQ ID NO: 690187 - DNA, 11 bp, Homo sapiens
aaaaggagaga

SEQ ID NO: 690188 - DNA, 21 bp, Homo sapiens
aaaaggatgtataaattttta

SEQ ID NO: 690189 - DNA, 18 bp, Homo sapiens
aaaaggattcctctttgt

SEQ ID NO: 690190 - DNA, 16 bp, Homo sapiens
aaaaggcaaatattga

SEQ ID NO: 690191 - DNA, 16 bp, Homo sapiens
aaaaggcaaatgtgta

SEQ ID NO: 690192 - DNA, 15 bp, Homo sapiens
aaaaggccaaagata

SEQ ID NO: 690193 - DNA, 17 bp, Homo sapiens
aaaaggccaaagataaa

SEQ ID NO: 690194 - DNA, 23 bp, Homo sapiens
aaaaggcctcttgtaaagactgg

SEQ ID NO: 690195 - DNA, 20 bp, Homo sapiens
aaaaggcggtactagttcag

SEQ ID NO: 690196 - DNA, 18 bp, Homo sapiens
aaaaggctaagaatagtg

SEQ ID NO: 690197 - DNA, 21 bp, Homo sapiens
aaaaggctgctcacaagttct

SEQ ID NO: 690198 - DNA, 19 bp, Homo sapiens
aaaaggctgtgctgccctg

SEQ ID NO: 690199 - DNA, 20 bp, Homo sapiens
aaaaggctgtgctgccctga

SEQ ID NO: 690200 - DNA, 15 bp, Homo sapiens
aaaagggaaaaaaga

SEQ ID NO: 690201 - DNA, 15 bp, Homo sapiens
aaaagggaagaaact

SEQ ID NO: 690202 - DNA, 18 bp, Homo sapiens
aaaagggaagtagtcctt

SEQ ID NO: 690203 - DNA, 20 bp, Homo sapiens
aaaagggaagttgtgccttt

SEQ ID NO: 690204 - DNA, 13 bp, Homo sapiens
aaaagggagaata

SEQ ID NO: 690205 - DNA, 23 bp, Homo sapiens
aaaagggcagggcatctcctgtg

SEQ ID NO: 690206 - DNA, 13 bp, Homo sapiens
aaaagggccaggt

SEQ ID NO: 690207 - DNA, 22 bp, Homo sapiens
aaaagggcttcggccacaggca

SEQ ID NO: 690208 - DNA, 13 bp, Homo sapiens
aaaaggggaggag

SEQ ID NO: 690209 - DNA, 21 bp, Homo sapiens
aaaagggtcttgggaaatatg

SEQ ID NO: 690210 - DNA, 22 bp, Homo sapiens
aaaagggtgtatagtgttcaca

SEQ ID NO: 690211 - DNA, 15 bp, Homo sapiens
aaaaggtattaaatt

SEQ ID NO: 690212 - DNA, 13 bp, Homo sapiens
aaaaggttgaata

SEQ ID NO: 690213 - DNA, 15 bp, Homo sapiens
aaaaggttgaataat

SEQ ID NO: 690214 - DNA, 20 bp, Homo sapiens
aaaaggttgcctgaaaaatg

SEQ ID NO: 690215 - DNA, 19 bp, Homo sapiens
aaaaggtttatgaaaaaga

SEQ ID NO: 690216 - DNA, 22 bp, Homo sapiens
aaaaggtttctttttttttcct

SEQ ID NO: 690217 - DNA, 11 bp, Homo sapiens
aaaagtaaaca

SEQ ID NO: 690218 - DNA, 12 bp, Homo sapiens
aaaagtaacttg

SEQ ID NO: 690219 - DNA, 13 bp, Homo sapiens
aaaagtaataaaa

SEQ ID NO: 690220 - DNA, 17 bp, Homo sapiens
aaaagtaatctttaaac

SEQ ID NO: 690221 - DNA, 12 bp, Homo sapiens
aaaagtagactt

SEQ ID NO: 690222 - DNA, 20 bp, Homo sapiens
aaaagtaggtttacattcat

SEQ ID NO: 690223 - DNA, 15 bp, Homo sapiens
aaaagtatatgttag

SEQ ID NO: 690224 - DNA, 15 bp, Homo sapiens
aaaagtatctttaac

SEQ ID NO: 690225 - DNA, 18 bp, Homo sapiens
aaaagtatctttaacaat

SEQ ID NO: 690226 - DNA, 13 bp, Homo sapiens
aaaagtattatca

SEQ ID NO: 690227 - DNA, 14 bp, Homo sapiens
aaaagtatttaatt

SEQ ID NO: 690228 - DNA, 16 bp, Homo sapiens
aaaagtatttaatttg

SEQ ID NO: 690229 - DNA, 16 bp, Homo sapiens
aaaagtcagagacaga

SEQ ID NO: 690230 - DNA, 21 bp, Homo sapiens
aaaagtcagtatcatattatt

SEQ ID NO: 690231 - DNA, 23 bp, Homo sapiens
aaaagtccaatgttgtgtgcatg

SEQ ID NO: 690232 - DNA, 16 bp, Homo sapiens
aaaagtctacctgtgt

SEQ ID NO: 690233 - DNA, 23 bp, Homo sapiens
aaaagtcttcactctctgaagat

SEQ ID NO: 690234 - DNA, 16 bp, Homo sapiens
aaaagtgaaaaaaaga

SEQ ID NO: 690235 - DNA, 21 bp, Homo sapiens
aaaagtgaaaaaaagaaacga

SEQ ID NO: 690236 - DNA, 14 bp, Homo sapiens
aaaagtgaactttt

SEQ ID NO: 690237 - DNA, 16 bp, Homo sapiens
aaaagtgaacttttgt

SEQ ID NO: 690238 - DNA, 18 bp, Homo sapiens
aaaagtgaacttttgtaa

SEQ ID NO: 690239 - DNA, 15 bp, Homo sapiens
aaaagtgacacagca

SEQ ID NO: 690240 - DNA, 14 bp, Homo sapiens
aaaagtgactctca

SEQ ID NO: 690241 - DNA, 17 bp, Homo sapiens
aaaagtgactctcagcg

SEQ ID NO: 690242 - DNA, 16 bp, Homo sapiens
aaaagtgagagacctc

SEQ ID NO: 690243 - DNA, 16 bp, Homo sapiens
aggatgccttttctgt

SEQ ID NO: 690244 - DNA, 17 bp, Homo sapiens
aggatgccttttctgtg

SEQ ID NO: 690245 - DNA, 23 bp, Homo sapiens
aggatgcggctttctctgcctct

SEQ ID NO: 690246 - DNA, 17 bp, Homo sapiens
aggatgctaacatctaa

SEQ ID NO: 690247 - DNA, 23 bp, Homo sapiens
aggatgctaacatctaaaaatag

SEQ ID NO: 690248 - DNA, 16 bp, Homo sapiens
aggatgctgcagcaga

SEQ ID NO: 690249 - DNA, 22 bp, Homo sapiens
aggatgctgggctctgttcttg

SEQ ID NO: 690250 - DNA, 15 bp, Homo sapiens
aggatgcttgtacat

SEQ ID NO: 690251 - DNA, 15 bp, Homo sapiens
aggatggaaaaataa

SEQ ID NO: 690252 - DNA, 22 bp, Homo sapiens
aggatggaaaaataaaacgcaa

SEQ ID NO: 690253 - DNA, 13 bp, Homo sapiens
aggatggagagag

SEQ ID NO: 690254 - DNA, 19 bp, Homo sapiens
aggatggagagaggggaat

SEQ ID NO: 690255 - DNA, 12 bp, Homo sapiens
aggatggagggg

SEQ ID NO: 690256 - DNA, 17 bp, Homo sapiens
aggatggcagcaatggc

SEQ ID NO: 690257 - DNA, 21 bp, Homo sapiens
aggatggcagcaatggcgctg

SEQ ID NO: 690258 - DNA, 20 bp, Homo sapiens
aggatggcctttccttccct

SEQ ID NO: 690259 - DNA, 22 bp, Homo sapiens
aggatggcctttccttccctct

SEQ ID NO: 690260 - DNA, 15 bp, Homo sapiens
aggatgggaatcagg

SEQ ID NO: 690261 - DNA, 22 bp, Homo sapiens
aggatgggatctttctgggagc

SEQ ID NO: 690262 - DNA, 19 bp, Homo sapiens
aggatgggccaaacccaga

SEQ ID NO: 690263 - DNA, 15 bp, Homo sapiens
aggatgggctgagct

SEQ ID NO: 690264 - DNA, 16 bp, Homo sapiens
aggatggggctcccag

SEQ ID NO: 690265 - DNA, 16 bp, Homo sapiens
aggatgggtcagagct

SEQ ID NO: 690266 - DNA, 17 bp, Homo sapiens
aggatgggtcagagcta

SEQ ID NO: 690267 - DNA, 16 bp, Homo sapiens
aggatgggtcccctcc

SEQ ID NO: 690268 - DNA, 14 bp, Homo sapiens
aggatggtgggcag

SEQ ID NO: 690269 - DNA, 21 bp, Homo sapiens
aggatggtggttattttaaat

SEQ ID NO: 690270 - DNA, 19 bp, Homo sapiens
aggatgtaaacagtgcctg

SEQ ID NO: 690271 - DNA, 15 bp, Homo sapiens
aggatgtcacagggc

SEQ ID NO: 690272 - DNA, 17 bp, Homo sapiens
aggatgtcacagggcca

SEQ ID NO: 690273 - DNA, 21 bp, Homo sapiens
aggatgtccctgggccagggt

SEQ ID NO: 690274 - DNA, 22 bp, Homo sapiens
aggatgtccctgggccagggtc

SEQ ID NO: 690275 - DNA, 14 bp, Homo sapiens
aggatgtgatatat

SEQ ID NO: 690276 - DNA, 18 bp, Homo sapiens
aggatgtgatatataagt

SEQ ID NO: 690277 - DNA, 20 bp, Homo sapiens
aggatgtgattgtggaatgg

SEQ ID NO: 690278 - DNA, 18 bp, Homo sapiens
aggatgtggaagagcatt

SEQ ID NO: 690279 - DNA, 15 bp, Homo sapiens
aggatgttacaagtt

SEQ ID NO: 690280 - DNA, 14 bp, Homo sapiens
aggatgttgcttct

SEQ ID NO: 690281 - DNA, 17 bp, Homo sapiens
aggatgtttagcagtgg

SEQ ID NO: 690282 - DNA, 21 bp, Homo sapiens
aggatgtttagcagtggctgg

SEQ ID NO: 690283 - DNA, 16 bp, Homo sapiens
aggattaaacacacac

SEQ ID NO: 690284 - DNA, 23 bp, Homo sapiens
aggattaagggacgggggtggga

SEQ ID NO: 690285 - DNA, 12 bp, Homo sapiens
aggattatggaa

SEQ ID NO: 690286 - DNA, 18 bp, Homo sapiens
aggattattgatagtact

SEQ ID NO: 690287 - DNA, 14 bp, Homo sapiens
aggattattggaaa

SEQ ID NO: 690288 - DNA, 21 bp, Homo sapiens
aggattccaaaaacattttat

SEQ ID NO: 690289 - DNA, 22 bp, Homo sapiens
aggattccccctgccctgtgcc

SEQ ID NO: 690290 - DNA, 12 bp, Homo sapiens
aggattcccttc

SEQ ID NO: 690291 - DNA, 20 bp, Homo sapiens
aggattctgtgcctccagga

SEQ ID NO: 690292 - DNA, 22 bp, Homo sapiens
aggattgaagagcattgcatgg

SEQ ID NO: 690293 - DNA, 18 bp, Homo sapiens
aggattgcatcctgctgg

SEQ ID NO: 690294 - DNA, 18 bp, Homo sapiens
aggattgcctttaatatt

SEQ ID NO: 690295 - DNA, 13 bp, Homo sapiens
aggattgtggaaa

SEQ ID NO: 690296 - DNA, 15 bp, Homo sapiens
aggatttaaaaactg

SEQ ID NO: 690297 - DNA, 16 bp, Homo sapiens
aggatttaacagtcat

SEQ ID NO: 690298 - DNA, 16 bp, Homo sapiens
aggatttataaagcaa

SEQ ID NO: 690299 - DNA, 20 bp, Homo sapiens
aggatttatgtattttgaaa

SEQ ID NO: 690300 - DNA, 19 bp, Homo sapiens
aggatttcatgatttcatt

SEQ ID NO: 690301 - DNA, 13 bp, Homo sapiens
aggatttcctgga

SEQ ID NO: 690302 - DNA, 20 bp, Homo sapiens
aggattttaatttcaggaaa

SEQ ID NO: 690303 - DNA, 14 bp, Homo sapiens
aggattttaccaaa

SEQ ID NO: 690304 - DNA, 17 bp, Homo sapiens
aggatttttccatgtgt

SEQ ID NO: 690305 - DNA, 17 bp, Homo sapiens
aggcaaaaactgtactg

SEQ ID NO: 690306 - DNA, 12 bp, Homo sapiens
aggcaaaaatgt

SEQ ID NO: 690307 - DNA, 13 bp, Homo sapiens
aggcaaacaatcc

SEQ ID NO: 690308 - DNA, 18 bp, Homo sapiens
aggcaaaccaatacagaa

SEQ ID NO: 690309 - DNA, 22 bp, Homo sapiens
aggcaaacccatcaacaaaaat

SEQ ID NO: 690310 - DNA, 16 bp, Homo sapiens
aggcaaaggcagagga

SEQ ID NO: 690311 - DNA, 22 bp, Homo sapiens
aggcaaagtttacagatgtttt

SEQ ID NO: 690312 - DNA, 13 bp, Homo sapiens
aggcaaagtttta

SEQ ID NO: 690313 - DNA, 14 bp, Homo sapiens
aggcaaatgtgtac

SEQ ID NO: 690314 - DNA, 23 bp, Homo sapiens
aaaatgaaagtgactttaaaaga

SEQ ID NO: 690315 - DNA, 16 bp, Homo sapiens
aaaatgaaatgcatat

SEQ ID NO: 690316 - DNA, 21 bp, Homo sapiens
aaaatgaataatttattatta

SEQ ID NO: 690317 - DNA, 14 bp, Homo sapiens
aaaatgaatagctt

SEQ ID NO: 690318 - DNA, 14 bp, Homo sapiens
aaaatgaatatcta

SEQ ID NO: 690319 - DNA, 22 bp, Homo sapiens
aaaatgaatatctattaatata

SEQ ID NO: 690320 - DNA, 12 bp, Homo sapiens
aaaatgaatttg

SEQ ID NO: 690321 - DNA, 22 bp, Homo sapiens
aaaatgaattttgtatgctgaa

SEQ ID NO: 690322 - DNA, 15 bp, Homo sapiens
aaaatgacaaagcca

SEQ ID NO: 690323 - DNA, 14 bp, Homo sapiens
aaaatgacaacaga

SEQ ID NO: 690324 - DNA, 14 bp, Homo sapiens
aaaatgactttgaa

SEQ ID NO: 690325 - DNA, 15 bp, Homo sapiens
aaaatgagagctgta

SEQ ID NO: 690326 - DNA, 19 bp, Homo sapiens
aaaatgagagctgtaactg

SEQ ID NO: 690327 - DNA, 16 bp, Homo sapiens
aaaatgaggaatagca

SEQ ID NO: 690328 - DNA, 18 bp, Homo sapiens
aaaatgaggaatagcaaa

SEQ ID NO: 690329 - DNA, 17 bp, Homo sapiens
aaaatgaggaatccaaa

SEQ ID NO: 690330 - DNA, 20 bp, Homo sapiens
aaaatgaggaatccaaaaga

SEQ ID NO: 690331 - DNA, 19 bp, Homo sapiens
aaaatgaggaatgtatatg

SEQ ID NO: 690332 - DNA, 16 bp, Homo sapiens
aaaatgaggacatgtt

SEQ ID NO: 690333 - DNA, 23 bp, Homo sapiens
aaaatgagtcatttgtttaaaca

SEQ ID NO: 690334 - DNA, 14 bp, Homo sapiens
aaaatgagtttgta

SEQ ID NO: 690335 - DNA, 15 bp, Homo sapiens
aaaatgagtttgtat

SEQ ID NO: 690336 - DNA, 14 bp, Homo sapiens
aaaatgcacgtagc

SEQ ID NO: 690337 - DNA, 18 bp, Homo sapiens
aaaatgcagcagggatgc

SEQ ID NO: 690338 - DNA, 20 bp, Homo sapiens
aaaatgcaggtgaacttttt

SEQ ID NO: 690339 - DNA, 19 bp, Homo sapiens
aaaatgcattgaaagaatt

SEQ ID NO: 690340 - DNA, 20 bp, Homo sapiens
aaaatgccactccctaccca

SEQ ID NO: 690341 - DNA, 17 bp, Homo sapiens
aaaatgccatcaaatga

SEQ ID NO: 690342 - DNA, 20 bp, Homo sapiens
aaaatgcccatttttgctaa

SEQ ID NO: 690343 - DNA, 19 bp, Homo sapiens
aaaatgcctcagtgtattt

SEQ ID NO: 690344 - DNA, 15 bp, Homo sapiens
aaaatgctgaacatt

SEQ ID NO: 690345 - DNA, 18 bp, Homo sapiens
aaaatgctgaacattgca

SEQ ID NO: 690346 - DNA, 17 bp, Homo sapiens
aaaatgctgctttgtcc

SEQ ID NO: 690347 - DNA, 19 bp, Homo sapiens
aaaatgctggctatagatg

SEQ ID NO: 690348 - DNA, 21 bp, Homo sapiens
aaaatgctggctgagctgaac

SEQ ID NO: 690349 - DNA, 16 bp, Homo sapiens
aaaatgcttctgttgt

SEQ ID NO: 690350 - DNA, 11 bp, Homo sapiens
aaaatggaaaa

SEQ ID NO: 690351 - DNA, 12 bp, Homo sapiens
aaaatggaaaat

SEQ ID NO: 690352 - DNA, 13 bp, Homo sapiens
aaaatggaagcaa

SEQ ID NO: 690353 - DNA, 16 bp, Homo sapiens
aaaatggaagcaaaga

SEQ ID NO: 690354 - DNA, 18 bp, Homo sapiens
aaaatggaagcaaagaca

SEQ ID NO: 690355 - DNA, 23 bp, Homo sapiens
aaaatggaagcaaagacaaaaga

SEQ ID NO: 690356 - DNA, 14 bp, Homo sapiens
aaaatggatacata

SEQ ID NO: 690357 - DNA, 20 bp, Homo sapiens
aaaatggatattattagaaa

SEQ ID NO: 690358 - DNA, 23 bp, Homo sapiens
aaaatggatgccttgaataataa

SEQ ID NO: 690359 - DNA, 23 bp, Homo sapiens
aaaatggcttcagaattaaaact

SEQ ID NO: 690360 - DNA, 15 bp, Homo sapiens
aaaatgggaggagga

SEQ ID NO: 690361 - DNA, 22 bp, Homo sapiens
aaaatggtagcattttaaacaa

SEQ ID NO: 690362 - DNA, 18 bp, Homo sapiens
aaaatggtatcaaaatta

SEQ ID NO: 690363 - DNA, 24 bp, Homo sapiens
aaaatggtatcaaaattacatata

SEQ ID NO: 690364 - DNA, 22 bp, Homo sapiens
aaaatggtccaattagtttcct

SEQ ID NO: 690365 - DNA, 17 bp, Homo sapiens
aggcaggggctgctgcc

SEQ ID NO: 690366 - DNA, 15 bp, Homo sapiens
aggcagggggccctg

SEQ ID NO: 690367 - DNA, 17 bp, Homo sapiens
aggcaggggtgggagag

SEQ ID NO: 690368 - DNA, 15 bp, Homo sapiens
aggcaggggtggggg

SEQ ID NO: 690369 - DNA, 16 bp, Homo sapiens
aggcaggggtgggggt

SEQ ID NO: 690370 - DNA, 19 bp, Homo sapiens
aggcaggggtgggggtgga

SEQ ID NO: 690371 - DNA, 20 bp, Homo sapiens
aggcaggggtgggggtggag

SEQ ID NO: 690372 - DNA, 19 bp, Homo sapiens
aggcagggtcaggagaggg

SEQ ID NO: 690373 - DNA, 15 bp, Homo sapiens
aggcaggtcacagaa

SEQ ID NO: 690374 - DNA, 16 bp, Homo sapiens
aggcaggtcacagaaa

SEQ ID NO: 690375 - DNA, 13 bp, Homo sapiens
aggcaggtctgca

SEQ ID NO: 690376 - DNA, 19 bp, Homo sapiens
aggcaggtctgcaagggcc

SEQ ID NO: 690377 - DNA, 17 bp, Homo sapiens
aggcaggtgggatggat

SEQ ID NO: 690378 - DNA, 17 bp, Homo sapiens
aggcaggtttgccagtg

SEQ ID NO: 690379 - DNA, 21 bp, Homo sapiens
aggcaggtttgccagtgaaga

SEQ ID NO: 690380 - DNA, 17 bp, Homo sapiens
aggcagtagatgtgctt

SEQ ID NO: 690381 - DNA, 12 bp, Homo sapiens
aggcagtccaga

SEQ ID NO: 690382 - DNA, 15 bp, Homo sapiens
aggcagtccagagct

SEQ ID NO: 690383 - DNA, 21 bp, Homo sapiens
aggcagtcccgggagaaaaga

SEQ ID NO: 690384 - DNA, 13 bp, Homo sapiens
aggcagtctctat

SEQ ID NO: 690385 - DNA, 20 bp, Homo sapiens
aggcagtctctatattatgt

SEQ ID NO: 690386 - DNA, 14 bp, Homo sapiens
aggcagtctgaacc

SEQ ID NO: 690387 - DNA, 16 bp, Homo sapiens
aggcagtctgaaccct

SEQ ID NO: 690388 - DNA, 14 bp, Homo sapiens
aggcagtgcatgca

SEQ ID NO: 690389 - DNA, 15 bp, Homo sapiens
aggcagtgcatgcat

SEQ ID NO: 690390 - DNA, 18 bp, Homo sapiens
aggcagtgcatgcatgtt

SEQ ID NO: 690391 - DNA, 19 bp, Homo sapiens
aggcagtgcatgtgaagca

SEQ ID NO: 690392 - DNA, 16 bp, Homo sapiens
aggcagtggctagtgg

SEQ ID NO: 690393 - DNA, 16 bp, Homo sapiens
aggcagttaggtgctg

SEQ ID NO: 690394 - DNA, 14 bp, Homo sapiens
aggcagtttgcaaa

SEQ ID NO: 690395 - DNA, 13 bp, Homo sapiens
aggcagttttcta

SEQ ID NO: 690396 - DNA, 15 bp, Homo sapiens
aggcataggcctggg

SEQ ID NO: 690397 - DNA, 22 bp, Homo sapiens
aggcatatcttctatatctgaa

SEQ ID NO: 690398 - DNA, 19 bp, Homo sapiens
aggcatatgtttccccatc

SEQ ID NO: 690399 - DNA, 12 bp, Homo sapiens
aggcatatttta

SEQ ID NO: 690400 - DNA, 21 bp, Homo sapiens
aggcatccatagtgcactagc

SEQ ID NO: 690401 - DNA, 22 bp, Homo sapiens
aggcatccttgtcttttgagct

SEQ ID NO: 690402 - DNA, 21 bp, Homo sapiens
aggcatctccttgggctggga

SEQ ID NO: 690403 - DNA, 17 bp, Homo sapiens
aggcatctgaactttta

SEQ ID NO: 690404 - DNA, 19 bp, Homo sapiens
aggcatctgtgggcatggt

SEQ ID NO: 690405 - DNA, 23 bp, Homo sapiens
aggcatcttttctagagacacat

SEQ ID NO: 690406 - DNA, 20 bp, Homo sapiens
aggcatgagccaccgcgcct

SEQ ID NO: 690407 - DNA, 15 bp, Homo sapiens
aggcatgagccactg

SEQ ID NO: 690408 - DNA, 12 bp, Homo sapiens
aggcatgcagct

SEQ ID NO: 690409 - DNA, 14 bp, Homo sapiens
aggcatgcagctgc

SEQ ID NO: 690410 - DNA, 15 bp, Homo sapiens
aggcatgcagctgcc

SEQ ID NO: 690411 - DNA, 18 bp, Homo sapiens
aggcatgcagctgcctgg

SEQ ID NO: 690412 - DNA, 20 bp, Homo sapiens
aggcatgcagctgcctgggg

SEQ ID NO: 690413 - DNA, 21 bp, Homo sapiens
aggcatgcagctgcctggggc

SEQ ID NO: 690414 - DNA, 17 bp, Homo sapiens
aggcatggcaattctgg

SEQ ID NO: 690415 - DNA, 18 bp, Homo sapiens
aggcatggcaattctgga

SEQ ID NO: 690416 - DNA, 18 bp, Homo sapiens
aggcatggctcagagctt

SEQ ID NO: 690417 - DNA, 22 bp, Homo sapiens
aggcatggggcatgtcctttcc

SEQ ID NO: 690418 - DNA, 20 bp, Homo sapiens
aggcatgggtgcaaggaaaa

SEQ ID NO: 690419 - DNA, 15 bp, Homo sapiens
aggcatggtggccca

SEQ ID NO: 690420 - DNA, 15 bp, Homo sapiens
aggcatgtcttacgt

SEQ ID NO: 690421 - DNA, 14 bp, Homo sapiens
aggcatgtggcctt

SEQ ID NO: 690422 - DNA, 13 bp, Homo sapiens
aggcattaacaca

SEQ ID NO: 690423 - DNA, 19 bp, Homo sapiens
aggcattaacacaaaggag

SEQ ID NO: 690424 - DNA, 16 bp, Homo sapiens
aggcattaatgtttct

SEQ ID NO: 690425 - DNA, 19 bp, Homo sapiens
aggcattaatgtttctatc

SEQ ID NO: 690426 - DNA, 21 bp, Homo sapiens
aggcattaatgtttctatctg

SEQ ID NO: 690427 - DNA, 13 bp, Homo sapiens
aggcattctctga

SEQ ID NO: 690428 - DNA, 19 bp, Homo sapiens
aggcattgcaggaccttgg

SEQ ID NO: 690429 - DNA, 21 bp, Homo sapiens
aggcattgttagtttagtgtg

SEQ ID NO: 690430 - DNA, 12 bp, Homo sapiens
aggcatttccta

SEQ ID NO: 690431 - DNA, 18 bp, Homo sapiens
aggcatttgcagggtcct

SEQ ID NO: 690432 - DNA, 21 bp, Homo sapiens
aggcatttgcagggtcctctt

SEQ ID NO: 690433 - DNA, 21 bp, Homo sapiens
aggcatttgcctaattcctgg

SEQ ID NO: 690434 - DNA, 23 bp, Homo sapiens
aggcatttgcctaattcctggca

SEQ ID NO: 690435 - DNA, 11 bp, Homo sapiens
aggcatttgtt

SEQ ID NO: 690436 - DNA, 18 bp, Homo sapiens
aggcatttgtttgaactg

SEQ ID NO: 690437 - DNA, 23 bp, Homo sapiens
aggcattttatatgaattataaa

SEQ ID NO: 690438 - DNA, 12 bp, Homo sapiens
aggcattttgtt

SEQ ID NO: 690439 - DNA, 13 bp, Homo sapiens
aggccaaaaaaat

SEQ ID NO: 690440 - DNA, 15 bp, Homo sapiens
aggccaaaatcaaga

SEQ ID NO: 690441 - DNA, 21 bp, Homo sapiens
aggccaaagagtctccagttt

SEQ ID NO: 690442 - DNA, 14 bp, Homo sapiens
aggccaaagataaa

SEQ ID NO: 690443 - DNA, 15 bp, Homo sapiens
aggccaaagccccat

SEQ ID NO: 690444 - DNA, 17 bp, Homo sapiens
aggccaaagccccatgt

SEQ ID NO: 690445 - DNA, 21 bp, Homo sapiens
aggccaaagccccatgtgcct

SEQ ID NO: 690446 - DNA, 22 bp, Homo sapiens
aggccaaagccccatgtgcctt

SEQ ID NO: 690447 - DNA, 14 bp, Homo sapiens
aaacactctttgag

SEQ ID NO: 690448 - DNA, 13 bp, Homo sapiens
aaacactgaaaaa

SEQ ID NO: 690449 - DNA, 22 bp, Homo sapiens
aaacactgcagtttcctggaaa

SEQ ID NO: 690450 - DNA, 12 bp, Homo sapiens
aaacactgcttc

SEQ ID NO: 690451 - DNA, 13 bp, Homo sapiens
aaacactggacct

SEQ ID NO: 690452 - DNA, 14 bp, Homo sapiens
aaacactggacctg

SEQ ID NO: 690453 - DNA, 12 bp, Homo sapiens
aaacactgtaat

SEQ ID NO: 690454 - DNA, 14 bp, Homo sapiens
aaacactgtaatct

SEQ ID NO: 690455 - DNA, 18 bp, Homo sapiens
aaacacttcgttcgcaga

SEQ ID NO: 690456 - DNA, 15 bp, Homo sapiens
aaacacttctgcttt

SEQ ID NO: 690457 - DNA, 13 bp, Homo sapiens
aaacactttcaaa

SEQ ID NO: 690458 - DNA, 21 bp, Homo sapiens
aaacactttctcttcttgttt

SEQ ID NO: 690459 - DNA, 12 bp, Homo sapiens
aaacagaacact

SEQ ID NO: 690460 - DNA, 13 bp, Homo sapiens
aaacagaataaaa

SEQ ID NO: 690461 - DNA, 22 bp, Homo sapiens
aaacagaataaaagttcctctc

SEQ ID NO: 690462 - DNA, 15 bp, Homo sapiens
aaacagaatcttctg

SEQ ID NO: 690463 - DNA, 16 bp, Homo sapiens
aaacagaatcttctgg

SEQ ID NO: 690464 - DNA, 22 bp, Homo sapiens
aaacagacaaaaacagcctcac

SEQ ID NO: 690465 - DNA, 20 bp, Homo sapiens
aaacagacaggaatttagaa

SEQ ID NO: 690466 - DNA, 20 bp, Homo sapiens
aaacagactcgctagcactc

SEQ ID NO: 690467 - DNA, 16 bp, Homo sapiens
aaacagagaaagaaaa

SEQ ID NO: 690468 - DNA, 19 bp, Homo sapiens
aaacagagaaagaaaaggc

SEQ ID NO: 690469 - DNA, 15 bp, Homo sapiens
aaacagagacaggcc

SEQ ID NO: 690470 - DNA, 15 bp, Homo sapiens
aaacagatataaatg

SEQ ID NO: 690471 - DNA, 17 bp, Homo sapiens
aaacagatgaccataat

SEQ ID NO: 690472 - DNA, 20 bp, Homo sapiens
aaacagattcaggccagccc

SEQ ID NO: 690473 - DNA, 16 bp, Homo sapiens
aaacagattgtttgca

SEQ ID NO: 690474 - DNA, 19 bp, Homo sapiens
aaacagatttttacaaatg

SEQ ID NO: 690475 - DNA, 14 bp, Homo sapiens
aaacagcagtgttc

SEQ ID NO: 690476 - DNA, 14 bp, Homo sapiens
aaacagcatgaata

SEQ ID NO: 690477 - DNA, 23 bp, Homo sapiens
aaacagcatgaataaaacactca

SEQ ID NO: 690478 - DNA, 14 bp, Homo sapiens
aaacagccatgtcc

SEQ ID NO: 690479 - DNA, 15 bp, Homo sapiens
aaacagcctcacaga

SEQ ID NO: 690480 - DNA, 20 bp, Homo sapiens
aaacagctgcattagaaaaa

SEQ ID NO: 690481 - DNA, 14 bp, Homo sapiens
aaacagctgcttct

SEQ ID NO: 690482 - DNA, 18 bp, Homo sapiens
aaacagcttcatgccttt

SEQ ID NO: 690483 - DNA, 12 bp, Homo sapiens
aaacagctttca

SEQ ID NO: 690484 - DNA, 18 bp, Homo sapiens
aaacaggaaaaaaacttt

SEQ ID NO: 690485 - DNA, 20 bp, Homo sapiens
aaacaggaaaaaaactttta

SEQ ID NO: 690486 - DNA, 17 bp, Homo sapiens
aaacaggaattttattt

SEQ ID NO: 690487 - DNA, 18 bp, Homo sapiens
aaacaggagacaggaagg

SEQ ID NO: 690488 - DNA, 20 bp, Homo sapiens
aggcccccggctttcctccg

SEQ ID NO: 690489 - DNA, 16 bp, Homo sapiens
aggccccctgcatcta

SEQ ID NO: 690490 - DNA, 18 bp, Homo sapiens
aggccccgcttgtccagc

SEQ ID NO: 690491 - DNA, 12 bp, Homo sapiens
aggcccctgagg

SEQ ID NO: 690492 - DNA, 17 bp, Homo sapiens
aggcccctgaggactgg

SEQ ID NO: 690493 - DNA, 12 bp, Homo sapiens
aggcccctgcaa

SEQ ID NO: 690494 - DNA, 17 bp, Homo sapiens
aggcccctggacaagca

SEQ ID NO: 690495 - DNA, 14 bp, Homo sapiens
aggcccctggagcc

SEQ ID NO: 690496 - DNA, 16 bp, Homo sapiens
aggcccctggagccag

SEQ ID NO: 690497 - DNA, 15 bp, Homo sapiens
aggcccctggcccag

SEQ ID NO: 690498 - DNA, 22 bp, Homo sapiens
aggcccgccctctgcctcctca

SEQ ID NO: 690499 - DNA, 20 bp, Homo sapiens
aggcccgcgggcacagccag

SEQ ID NO: 690500 - DNA, 21 bp, Homo sapiens
aggcccgcgggcacagccagc

SEQ ID NO: 690501 - DNA, 20 bp, Homo sapiens
aggcccggaagcgccaggct

SEQ ID NO: 690502 - DNA, 20 bp, Homo sapiens
aggcccgtcggagctgcctg

SEQ ID NO: 690503 - DNA, 22 bp, Homo sapiens
aggcccgtcggagctgcctgca

SEQ ID NO: 690504 - DNA, 18 bp, Homo sapiens
aggccctccatgggctag

SEQ ID NO: 690505 - DNA, 10 bp, Homo sapiens
aggccctccc

SEQ ID NO: 690506 - DNA, 19 bp, Homo sapiens
aggccctcccaccacccca

SEQ ID NO: 690507 - DNA, 13 bp, Homo sapiens
aggccctccctct

SEQ ID NO: 690508 - DNA, 14 bp, Homo sapiens
aggccctccctcta

SEQ ID NO: 690509 - DNA, 17 bp, Homo sapiens
aggccctccctgactcc

SEQ ID NO: 690510 - DNA, 13 bp, Homo sapiens
aggccctccctgt

SEQ ID NO: 690511 - DNA, 17 bp, Homo sapiens
aggccctcgctgccagc

SEQ ID NO: 690512 - DNA, 13 bp, Homo sapiens
aggccctctgcct

SEQ ID NO: 690513 - DNA, 23 bp, Homo sapiens
aggccctctgcctgcactccctg

SEQ ID NO: 690514 - DNA, 15 bp, Homo sapiens
aggccctctggaggg

SEQ ID NO: 690515 - DNA, 22 bp, Homo sapiens
aggccctctggagtggccacta

SEQ ID NO: 690516 - DNA, 19 bp, Homo sapiens
aggccctgaagcctccgtg

SEQ ID NO: 690517 - DNA, 21 bp, Homo sapiens
aggccctgaagcctccgtgga

SEQ ID NO: 690518 - DNA, 19 bp, Homo sapiens
aggccctgactcctctggc

SEQ ID NO: 690519 - DNA, 22 bp, Homo sapiens
aggccctgactcctctggcttt

SEQ ID NO: 690520 - DNA, 18 bp, Homo sapiens
aggccctgagatggggga

SEQ ID NO: 690521 - DNA, 16 bp, Homo sapiens
aggccctgccacgtcc

SEQ ID NO: 690522 - DNA, 20 bp, Homo sapiens
aggccctgccattggcctct

SEQ ID NO: 690523 - DNA, 12 bp, Homo sapiens
aggccctgcctc

SEQ ID NO: 690524 - DNA, 13 bp, Homo sapiens
aggccctgcctga

SEQ ID NO: 690525 - DNA, 15 bp, Homo sapiens
aggccctgcctgacc

SEQ ID NO: 690526 - DNA, 16 bp, Homo sapiens
aggccctgctcctgca

SEQ ID NO: 690527 - DNA, 14 bp, Homo sapiens
aggccctggcctcc

SEQ ID NO: 690528 - DNA, 22 bp, Homo sapiens
aggccctggcctcccctgccac

SEQ ID NO: 690529 - DNA, 13 bp, Homo sapiens
aggccctgggctg

SEQ ID NO: 690530 - DNA, 20 bp, Homo sapiens
aggccctggtcctggcctcc

SEQ ID NO: 690531 - DNA, 14 bp, Homo sapiens
aggccctgtccagc

SEQ ID NO: 690532 - DNA, 19 bp, Homo sapiens
aggccctgtccagccccca

SEQ ID NO: 690533 - DNA, 12 bp, Homo sapiens
aggccctgtgat

SEQ ID NO: 690534 - DNA, 12 bp, Homo sapiens
aggccctgtggt

SEQ ID NO: 690535 - DNA, 14 bp, Homo sapiens
aggccctgttccct

SEQ ID NO: 690536 - DNA, 17 bp, Homo sapiens
aggcccttagggaagtt

SEQ ID NO: 690537 - DNA, 16 bp, Homo sapiens
aggcccttattttcaa

SEQ ID NO: 690538 - DNA, 13 bp, Homo sapiens
aggcccttcctct

SEQ ID NO: 690539 - DNA, 17 bp, Homo sapiens
aggcccttgtcattgcc

SEQ ID NO: 690540 - DNA, 14 bp, Homo sapiens
aggcccttgtcctg

SEQ ID NO: 690541 - DNA, 15 bp, Homo sapiens
aggcccttgtcctgc

SEQ ID NO: 690542 - DNA, 22 bp, Homo sapiens
aggcccttgtcctgccagctgc

SEQ ID NO: 690543 - DNA, 14 bp, Homo sapiens
aggccgaagctctg

SEQ ID NO: 690544 - DNA, 14 bp, Homo sapiens
aggccgagggccag

SEQ ID NO: 690545 - DNA, 15 bp, Homo sapiens
aggccgagggccagg

SEQ ID NO: 690546 - DNA, 17 bp, Homo sapiens
aggccgaggtgggcaga

SEQ ID NO: 690547 - DNA, 19 bp, Homo sapiens
aggccgatttgggaaccaa

SEQ ID NO: 690548 - DNA, 17 bp, Homo sapiens
aggccgcagctcttgcc

SEQ ID NO: 690549 - DNA, 18 bp, Homo sapiens
aggccgcagctcttgccc

SEQ ID NO: 690550 - DNA, 16 bp, Homo sapiens
aggccgccagcgtgtg

SEQ ID NO: 690551 - DNA, 20 bp, Homo sapiens
aggccgcgcgtccagctgcc

SEQ ID NO: 690552 - DNA, 13 bp, Homo sapiens
aggccgcggccca

SEQ ID NO: 690553 - DNA, 20 bp, Homo sapiens
aggccgctagaggcctgagg

SEQ ID NO: 690554 - DNA, 13 bp, Homo sapiens
aggccggagccca

SEQ ID NO: 690555 - DNA, 13 bp, Homo sapiens
aggccggcccaga

SEQ ID NO: 690556 - DNA, 19 bp, Homo sapiens
aggccggcttgccacaccc

SEQ ID NO: 690557 - DNA, 21 bp, Homo sapiens
aggccggcttgccacaccccc

SEQ ID NO: 690558 - DNA, 21 bp, Homo sapiens
aggccgggccgaatcccctcc

SEQ ID NO: 690559 - DNA, 18 bp, Homo sapiens
aggccgggcggtcacagc

SEQ ID NO: 690560 - DNA, 19 bp, Homo sapiens
aggccggggtccaggcccg

SEQ ID NO: 690561 - DNA, 13 bp, Homo sapiens
aggccgtcctccc

SEQ ID NO: 690562 - DNA, 17 bp, Homo sapiens
aggccgtcctcccgggc

SEQ ID NO: 690563 - DNA, 18 bp, Homo sapiens
aggccgtgtctctgagga

SEQ ID NO: 690564 - DNA, 16 bp, Homo sapiens
aggcctaaaagtaaac

SEQ ID NO: 690565 - DNA, 17 bp, Homo sapiens
aggcctaaaagtaaaca

SEQ ID NO: 690566 - DNA, 22 bp, Homo sapiens
aggcctaattctatgcctgtct

SEQ ID NO: 690567 - DNA, 19 bp, Homo sapiens
aggcctacagaggaggcct

SEQ ID NO: 690568 - DNA, 22 bp, Homo sapiens
aggcctacatgctttgtgaaca

SEQ ID NO: 690569 - DNA, 23 bp, Homo sapiens
aggcctacatgctttgtgaacaa

SEQ ID NO: 690570 - DNA, 16 bp, Homo sapiens
aggcctaccccgcaga

SEQ ID NO: 690571 - DNA, 22 bp, Homo sapiens
aggcctaccccgcagacacctt

SEQ ID NO: 690572 - DNA, 21 bp, Homo sapiens
aggcctacctcaagttcttgg

SEQ ID NO: 690573 - DNA, 22 bp, Homo sapiens
aggcctacctcaagttcttgga

SEQ ID NO: 690574 - DNA, 16 bp, Homo sapiens
aggcctagactctgtc

SEQ ID NO: 690575 - DNA, 15 bp, Homo sapiens
aggcctatctggaag

SEQ ID NO: 690576 - DNA, 17 bp, Homo sapiens
aggcctcacctctaccc

SEQ ID NO: 690577 - DNA, 18 bp, Homo sapiens
aggcctcacctctaccca

SEQ ID NO: 690578 - DNA, 15 bp, Homo sapiens
aggcctcactggctc

SEQ ID NO: 690579 - DNA, 13 bp, Homo sapiens
aggcctcagccag

SEQ ID NO: 690580 - DNA, 14 bp, Homo sapiens
aggcctcagccaga

SEQ ID NO: 690581 - DNA, 16 bp, Homo sapiens
aaacgctcctttgtgt

SEQ ID NO: 690582 - DNA, 21 bp, Homo sapiens
aaacggaataataaaaagcat

SEQ ID NO: 690583 - DNA, 12 bp, Homo sapiens
aaacggcagcct

SEQ ID NO: 690584 - DNA, 21 bp, Homo sapiens
aaacgggttaaaaattgtttt

SEQ ID NO: 690585 - DNA, 17 bp, Homo sapiens
aaacggtatcctccctg

SEQ ID NO: 690586 - DNA, 21 bp, Homo sapiens
aaacggtatcctccctgccca

SEQ ID NO: 690587 - DNA, 16 bp, Homo sapiens
aaacggtgctatttct

SEQ ID NO: 690588 - DNA, 19 bp, Homo sapiens
aaacggttcagtttcttct

SEQ ID NO: 690589 - DNA, 18 bp, Homo sapiens
aaacgtcttattgtggta

SEQ ID NO: 690590 - DNA, 17 bp, Homo sapiens
aaacgtggattttaaaa

SEQ ID NO: 690591 - DNA, 16 bp, Homo sapiens
aaacgtggtcaccttc

SEQ ID NO: 690592 - DNA, 18 bp, Homo sapiens
aaacgtgttttttaaaaa

SEQ ID NO: 690593 - DNA, 14 bp, Homo sapiens
aaactaaacagaaa

SEQ ID NO: 690594 - DNA, 20 bp, Homo sapiens
aaactaaagagctgcacagc

SEQ ID NO: 690595 - DNA, 15 bp, Homo sapiens
aaactaaatatatgt

SEQ ID NO: 690596 - DNA, 13 bp, Homo sapiens
aaactaaatctct

SEQ ID NO: 690597 - DNA, 17 bp, Homo sapiens
aaactaaatctctaata

SEQ ID NO: 690598 - DNA, 22 bp, Homo sapiens
aaactaaattactgttttatgt

SEQ ID NO: 690599 - DNA, 15 bp, Homo sapiens
aaactaacagataag

SEQ ID NO: 690600 - DNA, 20 bp, Homo sapiens
aaactaacagataagcaaga

SEQ ID NO: 690601 - DNA, 13 bp, Homo sapiens
aaactaagccagg

SEQ ID NO: 690602 - DNA, 14 bp, Homo sapiens
aaactaagctcttt

SEQ ID NO: 690603 - DNA, 19 bp, Homo sapiens
aaactaaggcttttatttc

SEQ ID NO: 690604 - DNA, 22 bp, Homo sapiens
aaactaatgagtatgaacttga

SEQ ID NO: 690605 - DNA, 22 bp, Homo sapiens
aaactaatgtactgtacataaa

SEQ ID NO: 690606 - DNA, 16 bp, Homo sapiens
aaactacaaagtaaaa

SEQ ID NO: 690607 - DNA, 20 bp, Homo sapiens
aaactacaaagtaaaatgaa

SEQ ID NO: 690608 - DNA, 22 bp, Homo sapiens
aaactacacatccctaatgtgt

SEQ ID NO: 690609 - DNA, 17 bp, Homo sapiens
aaactactctttgattt

SEQ ID NO: 690610 - DNA, 24 bp, Homo sapiens
aggctaagttgggatctaggagag

SEQ ID NO: 690611 - DNA, 22 bp, Homo sapiens
aggctacaggggttagcctgga

SEQ ID NO: 690612 - DNA, 17 bp, Homo sapiens
aggctacctcacctggg

SEQ ID NO: 690613 - DNA, 13 bp, Homo sapiens
aggctacctttgt

SEQ ID NO: 690614 - DNA, 15 bp, Homo sapiens
aggctacctttgtat

SEQ ID NO: 690615 - DNA, 17 bp, Homo sapiens
aggctagagtgcaatgg

SEQ ID NO: 690616 - DNA, 17 bp, Homo sapiens
aggctagcttctgcttt

SEQ ID NO: 690617 - DNA, 23 bp, Homo sapiens
aggctaggtgggttgaaagccaa

SEQ ID NO: 690618 - DNA, 14 bp, Homo sapiens
aggctagttccttt

SEQ ID NO: 690619 - DNA, 13 bp, Homo sapiens
aggctatcctgct

SEQ ID NO: 690620 - DNA, 19 bp, Homo sapiens
aggctatcctgctgaaagt

SEQ ID NO: 690621 - DNA, 21 bp, Homo sapiens
aggctatggagggtcctcctc

SEQ ID NO: 690622 - DNA, 20 bp, Homo sapiens
aggctatggttgccacccca

SEQ ID NO: 690623 - DNA, 22 bp, Homo sapiens
aggctattcctgagagctgcat

SEQ ID NO: 690624 - DNA, 16 bp, Homo sapiens
aggctatttgtaaatc

SEQ ID NO: 690625 - DNA, 22 bp, Homo sapiens
aggctatttgtaaatctgccac

SEQ ID NO: 690626 - DNA, 19 bp, Homo sapiens
aggctatttgttcagagag

SEQ ID NO: 690627 - DNA, 14 bp, Homo sapiens
aggctattttctaa

SEQ ID NO: 690628 - DNA, 18 bp, Homo sapiens
aggctattttctaaagac

SEQ ID NO: 690629 - DNA, 19 bp, Homo sapiens
aggctattttctaaagact

SEQ ID NO: 690630 - DNA, 13 bp, Homo sapiens
aggctcaagctat

SEQ ID NO: 690631 - DNA, 20 bp, Homo sapiens
aggctcaagctatccttgca

SEQ ID NO: 690632 - DNA, 16 bp, Homo sapiens
aggctcacccccttct

SEQ ID NO: 690633 - DNA, 21 bp, Homo sapiens
aggctcacccccttctccatc

SEQ ID NO: 690634 - DNA, 20 bp, Homo sapiens
aggctcacctttagaacagg

SEQ ID NO: 690635 - DNA, 22 bp, Homo sapiens
aggctcactgcaacttctgcct

SEQ ID NO: 690636 - DNA, 14 bp, Homo sapiens
aggctcactgcagc

SEQ ID NO: 690637 - DNA, 13 bp, Homo sapiens
aggctcactgcca

SEQ ID NO: 690638 - DNA, 14 bp, Homo sapiens
aggctcactgccag

SEQ ID NO: 690639 - DNA, 15 bp, Homo sapiens
aggctcactgccagg

SEQ ID NO: 690640 - DNA, 19 bp, Homo sapiens
aggctcaggcacatacacc

SEQ ID NO: 690641 - DNA, 23 bp, Homo sapiens
aggctcagtctcaggagcatggg

SEQ ID NO: 690642 - DNA, 15 bp, Homo sapiens
aggctcatttaaaac

SEQ ID NO: 690643 - DNA, 18 bp, Homo sapiens
aggctcatttaaaacagg

SEQ ID NO: 690644 - DNA, 16 bp, Homo sapiens
aggctccaagaggctg

SEQ ID NO: 690645 - DNA, 19 bp, Homo sapiens
aggctccaagaggctgagg

SEQ ID NO: 690646 - DNA, 16 bp, Homo sapiens
aggctccagagggcac

SEQ ID NO: 690647 - DNA, 18 bp, Homo sapiens
aggctcccaatcagcttt

SEQ ID NO: 690648 - DNA, 14 bp, Homo sapiens
aggctccccacccc

SEQ ID NO: 690649 - DNA, 15 bp, Homo sapiens
aggctccccaccccg

SEQ ID NO: 690650 - DNA, 16 bp, Homo sapiens
aggctccccagaactg

SEQ ID NO: 690651 - DNA, 15 bp, Homo sapiens
aggctccccgcctcc

SEQ ID NO: 690652 - DNA, 17 bp, Homo sapiens
aggctccccgcctccac

SEQ ID NO: 690653 - DNA, 20 bp, Homo sapiens
aggctcccgaggggaagggg

SEQ ID NO: 690654 - DNA, 13 bp, Homo sapiens
aggctccgccctt

SEQ ID NO: 690655 - DNA, 14 bp, Homo sapiens
aggctcctcagcct

SEQ ID NO: 690656 - DNA, 14 bp, Homo sapiens
aggctcctccttgc

SEQ ID NO: 690657 - DNA, 19 bp, Homo sapiens
aggctcctccttgcccaga

SEQ ID NO: 690658 - DNA, 21 bp, Homo sapiens
aggctcctgccagtgtggaac

SEQ ID NO: 690659 - DNA, 17 bp, Homo sapiens
aggctcctggctgtgcc

SEQ ID NO: 690660 - DNA, 22 bp, Homo sapiens
aggctcctggctgtgcccagca

SEQ ID NO: 690661 - DNA, 15 bp, Homo sapiens
aggctcgattttgta

SEQ ID NO: 690662 - DNA, 16 bp, Homo sapiens
aggctcgattttgtat

SEQ ID NO: 690663 - DNA, 22 bp, Homo sapiens
aggctcgattttgtatctgcag

SEQ ID NO: 690664 - DNA, 19 bp, Homo sapiens
aggctcgccttccctcctg

SEQ ID NO: 690665 - DNA, 20 bp, Homo sapiens
aggctcggaggaccctggaa

SEQ ID NO: 690666 - DNA, 15 bp, Homo sapiens
aggctcggccgtggg

SEQ ID NO: 690667 - DNA, 15 bp, Homo sapiens
aggctctagagagag

SEQ ID NO: 690668 - DNA, 16 bp, Homo sapiens
aggctctagagagagg

SEQ ID NO: 690669 - DNA, 11 bp, Homo sapiens
aggctctcccc

SEQ ID NO: 690670 - DNA, 14 bp, Homo sapiens
aggctctcccctct

SEQ ID NO: 690671 - DNA, 22 bp, Homo sapiens
aggctctctctttctagaggtg

SEQ ID NO: 690672 - DNA, 16 bp, Homo sapiens
aggctctgaggggcac

SEQ ID NO: 690673 - DNA, 17 bp, Homo sapiens
aggctctgaggggcacg

SEQ ID NO: 690674 - DNA, 17 bp, Homo sapiens
aggctctgcacagatgg

SEQ ID NO: 690675 - DNA, 15 bp, Homo sapiens
aggctctgggctcag

SEQ ID NO: 690676 - DNA, 17 bp, Homo sapiens
aggctctgtcactccag

SEQ ID NO: 690677 - DNA, 15 bp, Homo sapiens
aggctctgtcactga

SEQ ID NO: 690678 - DNA, 16 bp, Homo sapiens
aggctctgttcctcaa

SEQ ID NO: 690679 - DNA, 19 bp, Homo sapiens
aggctcttagcagcttcca

SEQ ID NO: 690680 - DNA, 22 bp, Homo sapiens
aggctcttagcagcttccagat

SEQ ID NO: 690681 - DNA, 19 bp, Homo sapiens
aggctcttatgtgtgcctt

SEQ ID NO: 690682 - DNA, 16 bp, Homo sapiens
aggctcttcctggacc

SEQ ID NO: 690683 - DNA, 20 bp, Homo sapiens
aggctcttcctggacctgag

SEQ ID NO: 690684 - DNA, 13 bp, Homo sapiens
aggctcttctcct

SEQ ID NO: 690685 - DNA, 14 bp, Homo sapiens
aggctcttctcctt

SEQ ID NO: 690686 - DNA, 21 bp, Homo sapiens
aggctctttggggtcagccag

SEQ ID NO: 690687 - DNA, 16 bp, Homo sapiens
aggctgaaagaggcca

SEQ ID NO: 690688 - DNA, 17 bp, Homo sapiens
aggctgaactcttcaga

SEQ ID NO: 690689 - DNA, 14 bp, Homo sapiens
aggctgaagagagg

SEQ ID NO: 690690 - DNA, 23 bp, Homo sapiens
aggctgacacagaggctggcact

SEQ ID NO: 690691 - DNA, 17 bp, Homo sapiens
aggctgaccaagagaga

SEQ ID NO: 690692 - DNA, 20 bp, Homo sapiens
aggctgaccaagagagaaag

SEQ ID NO: 690693 - DNA, 17 bp, Homo sapiens
aggctgacgttccgggc

SEQ ID NO: 690694 - DNA, 15 bp, Homo sapiens
aggctgagacaggag

SEQ ID NO: 690695 - DNA, 18 bp, Homo sapiens
aggctgagacaggagaat

SEQ ID NO: 690696 - DNA, 16 bp, Homo sapiens
aggctgagactgcggg

SEQ ID NO: 690697 - DNA, 13 bp, Homo sapiens
aggctgagccctg

SEQ ID NO: 690698 - DNA, 22 bp, Homo sapiens
aggctgagccctgtacccaccc

SEQ ID NO: 690699 - DNA, 11 bp, Homo sapiens
aggctgagcct

SEQ ID NO: 690700 - DNA, 14 bp, Homo sapiens
aggctgaggcagaa

SEQ ID NO: 690701 - DNA, 19 bp, Homo sapiens
aggctgaggcaggagaatg

SEQ ID NO: 690702 - DNA, 18 bp, Homo sapiens
aggctgaggcaggagact

SEQ ID NO: 690703 - DNA, 16 bp, Homo sapiens
aggctgaggcaggtgg

SEQ ID NO: 690704 - DNA, 16 bp, Homo sapiens
aggctgaggcgggtgg

SEQ ID NO: 690705 - DNA, 14 bp, Homo sapiens
aggctgaggctggc

SEQ ID NO: 690706 - DNA, 22 bp, Homo sapiens
aggctgaggggaggatcactgg

SEQ ID NO: 690707 - DNA, 17 bp, Homo sapiens
aggctgaggtggggaag

SEQ ID NO: 690708 - DNA, 19 bp, Homo sapiens
aggctgaggtggggaagga

SEQ ID NO: 690709 - DNA, 24 bp, Homo sapiens
aggctgagtccagagcttgtgctc

SEQ ID NO: 690710 - DNA, 21 bp, Homo sapiens
aggctgcaaaattaaatctag

SEQ ID NO: 690711 - DNA, 18 bp, Homo sapiens
aggctgcacccctgggcc

SEQ ID NO: 690712 - DNA, 13 bp, Homo sapiens
aggctgcactgca

SEQ ID NO: 690713 - DNA, 15 bp, Homo sapiens
aggctgcactggagc

SEQ ID NO: 690714 - DNA, 17 bp, Homo sapiens
aaagaaggaaagatggt

SEQ ID NO: 690715 - DNA, 12 bp, Homo sapiens
aaagaaggaagt

SEQ ID NO: 690716 - DNA, 15 bp, Homo sapiens
aaagaaggagctgag

SEQ ID NO: 690717 - DNA, 13 bp, Homo sapiens
aaagaaggtgctg

SEQ ID NO: 690718 - DNA, 16 bp, Homo sapiens
aaagaaggtgctgatc

SEQ ID NO: 690719 - DNA, 23 bp, Homo sapiens
aaagaagtaggggaagacatgca

SEQ ID NO: 690720 - DNA, 21 bp, Homo sapiens
aaagaagtgtccgagaactaa

SEQ ID NO: 690721 - DNA, 15 bp, Homo sapiens
aaagaagttgtagtg

SEQ ID NO: 690722 - DNA, 18 bp, Homo sapiens
aaagaatatttaaataaa

SEQ ID NO: 690723 - DNA, 21 bp, Homo sapiens
aaagaatccctgttcattgta

SEQ ID NO: 690724 - DNA, 22 bp, Homo sapiens
aaagaatccctgttcattgtaa

SEQ ID NO: 690725 - DNA, 13 bp, Homo sapiens
aaagaatgactat

SEQ ID NO: 690726 - DNA, 13 bp, Homo sapiens
aaagaatgatgct

SEQ ID NO: 690727 - DNA, 20 bp, Homo sapiens
aaagaatgccatttctcacg

SEQ ID NO: 690728 - DNA, 17 bp, Homo sapiens
aaagaatggcagaaaag

SEQ ID NO: 690729 - DNA, 16 bp, Homo sapiens
aaagaattaaaaactt

SEQ ID NO: 690730 - DNA, 20 bp, Homo sapiens
aaagaattatttttgtgttt

SEQ ID NO: 690731 - DNA, 21 bp, Homo sapiens
aaagaattcctgaagccagat

SEQ ID NO: 690732 - DNA, 19 bp, Homo sapiens
aaagctaaattttgttact

SEQ ID NO: 690733 - DNA, 16 bp, Homo sapiens
aaagctaacatcttta

SEQ ID NO: 690734 - DNA, 15 bp, Homo sapiens
aaagctaatgtgcag

SEQ ID NO: 690735 - DNA, 15 bp, Homo sapiens
aaagctacaggactg

SEQ ID NO: 690736 - DNA, 13 bp, Homo sapiens
aaagctagaaatg

SEQ ID NO: 690737 - DNA, 13 bp, Homo sapiens
aaagctagaattg

SEQ ID NO: 690738 - DNA, 12 bp, Homo sapiens
aaagctataaag

SEQ ID NO: 690739 - DNA, 14 bp, Homo sapiens
aaagctcaaatgaa

SEQ ID NO: 690740 - DNA, 18 bp, Homo sapiens
aaagctcaaatgaaatgt

SEQ ID NO: 690741 - DNA, 15 bp, Homo sapiens
aaagctcagatgaca

SEQ ID NO: 690742 - DNA, 12 bp, Homo sapiens
aaagctcaggag

SEQ ID NO: 690743 - DNA, 15 bp, Homo sapiens
aaagctcccttgaag

SEQ ID NO: 690744 - DNA, 16 bp, Homo sapiens
aaagctcttcatttct

SEQ ID NO: 690745 - DNA, 12 bp, Homo sapiens
aaagctctttaa

SEQ ID NO: 690746 - DNA, 14 bp, Homo sapiens
aaagctgaatattt

SEQ ID NO: 690747 - DNA, 19 bp, Homo sapiens
aaagctgacattgccaaaa

SEQ ID NO: 690748 - DNA, 14 bp, Homo sapiens
aaagctgactgttt

SEQ ID NO: 690749 - DNA, 17 bp, Homo sapiens
aaagctgagagaccctg

SEQ ID NO: 690750 - DNA, 23 bp, Homo sapiens
aaagctgagagaccctggcctca

SEQ ID NO: 690751 - DNA, 16 bp, Homo sapiens
aaagctgaggaacagg

SEQ ID NO: 690752 - DNA, 22 bp, Homo sapiens
aaagctgcccactgtttctctt

SEQ ID NO: 690753 - DNA, 16 bp, Homo sapiens
aaagctgcctgtagtt

SEQ ID NO: 690754 - DNA, 20 bp, Homo sapiens
aaagctgcctgtgccatgcc

SEQ ID NO: 690755 - DNA, 21 bp, Homo sapiens
aaagctgctcagggaaaagca

SEQ ID NO: 690756 - DNA, 15 bp, Homo sapiens
aaagctggaacattt

SEQ ID NO: 690757 - DNA, 18 bp, Homo sapiens
aaagctggtttaatgttt

SEQ ID NO: 690758 - DNA, 18 bp, Homo sapiens
aaagctgtgtgtttggaa

SEQ ID NO: 690759 - DNA, 16 bp, Homo sapiens
aaagctgttaaactgt

SEQ ID NO: 690760 - DNA, 23 bp, Homo sapiens
aaagctgttaaactgttagcact

SEQ ID NO: 690761 - DNA, 16 bp, Homo sapiens
aaagcttaatgattct

SEQ ID NO: 690762 - DNA, 12 bp, Homo sapiens
aaagcttatttt

SEQ ID NO: 690763 - DNA, 16 bp, Homo sapiens
aaagcttcacagtacc

SEQ ID NO: 690764 - DNA, 21 bp, Homo sapiens
aaagcttcagactcaagtacc

SEQ ID NO: 690765 - DNA, 17 bp, Homo sapiens
aaagcttccatgattct

SEQ ID NO: 690766 - DNA, 20 bp, Homo sapiens
aaagcttccatgattctatt

SEQ ID NO: 690767 - DNA, 22 bp, Homo sapiens
aaagcttcgtcttgtgtttgct

SEQ ID NO: 690768 - DNA, 14 bp, Homo sapiens
aaagcttcttcaga

SEQ ID NO: 690769 - DNA, 20 bp, Homo sapiens
aaagcttgatttgatctttg

SEQ ID NO: 690770 - DNA, 22 bp, Homo sapiens
aaagcttgatttgatctttgtt

SEQ ID NO: 690771 - DNA, 20 bp, Homo sapiens
aaagcttggattaaatacat

SEQ ID NO: 690772 - DNA, 16 bp, Homo sapiens
aaagctttactactgt

SEQ ID NO: 690773 - DNA, 20 bp, Homo sapiens
aaagctttactactgtggaa

SEQ ID NO: 690774 - DNA, 13 bp, Homo sapiens
aaagctttatctt

SEQ ID NO: 690775 - DNA, 12 bp, Homo sapiens
aaagctttcctg

SEQ ID NO: 690776 - DNA, 22 bp, Homo sapiens
aaagctttcctgccccaggcct

SEQ ID NO: 690777 - DNA, 23 bp, Homo sapiens
aaagctttcctgccccaggcctg

SEQ ID NO: 690778 - DNA, 19 bp, Homo sapiens
aaagctttgaatactgtga

SEQ ID NO: 690779 - DNA, 12 bp, Homo sapiens
aaagctttgcta

SEQ ID NO: 690780 - DNA, 16 bp, Homo sapiens
aaagctttgctacaaa

SEQ ID NO: 690781 - DNA, 21 bp, Homo sapiens
aaagctttgcttatggtaata

SEQ ID NO: 690782 - DNA, 16 bp, Homo sapiens
aaagctttggacaagt

SEQ ID NO: 690783 - DNA, 15 bp, Homo sapiens
aaagcttttagaaat

SEQ ID NO: 690784 - DNA, 17 bp, Homo sapiens
aaagcttttattccttt

SEQ ID NO: 690785 - DNA, 12 bp, Homo sapiens
aaaggaaaaaaa

SEQ ID NO: 690786 - DNA, 16 bp, Homo sapiens
aaaggaaaaaaaacac

SEQ ID NO: 690787 - DNA, 11 bp, Homo sapiens
aaaggaaaaat

SEQ ID NO: 690788 - DNA, 15 bp, Homo sapiens
aaaggaaaacctgaa

SEQ ID NO: 690789 - DNA, 18 bp, Homo sapiens
aaaggaaaacctgaagac

SEQ ID NO: 690790 - DNA, 13 bp, Homo sapiens
aaaggaaaagaaa

SEQ ID NO: 690791 - DNA, 11 bp, Homo sapiens
aaaggaaaagt

SEQ ID NO: 690792 - DNA, 22 bp, Homo sapiens
aaaggaaacactaaggctgctt

SEQ ID NO: 690793 - DNA, 16 bp, Homo sapiens
aaaggaaatattcttt

SEQ ID NO: 690794 - DNA, 17 bp, Homo sapiens
aaaggaaatcaaatgaa

SEQ ID NO: 690795 - DNA, 18 bp, Homo sapiens
aaaggaaatttgtttgta

SEQ ID NO: 690796 - DNA, 17 bp, Homo sapiens
aaaggaactaacttact

SEQ ID NO: 690797 - DNA, 17 bp, Homo sapiens
aaaggaagcattgtaaa

SEQ ID NO: 690798 - DNA, 18 bp, Homo sapiens
aaaggaaggggttttccc

SEQ ID NO: 690799 - DNA, 19 bp, Homo sapiens
aaaggaagtggggacagat

SEQ ID NO: 690800 - DNA, 14 bp, Homo sapiens
aaaggaatgtgaaa

SEQ ID NO: 690801 - DNA, 22 bp, Homo sapiens
aaaggacaacagttctgagctg

SEQ ID NO: 690802 - DNA, 22 bp, Homo sapiens
aaaggacaccttttaactcacc

SEQ ID NO: 690803 - DNA, 21 bp, Homo sapiens
aaaggacacgccgtctgtcct

SEQ ID NO: 690804 - DNA, 15 bp, Homo sapiens
aaaggacatcagcaa

SEQ ID NO: 690805 - DNA, 21 bp, Homo sapiens
aaaggaccaactggcttctgt

SEQ ID NO: 690806 - DNA, 15 bp, Homo sapiens
aaaggacgcctgcag

SEQ ID NO: 690807 - DNA, 21 bp, Homo sapiens
aaaggacgcctgcaggagaga

SEQ ID NO: 690808 - DNA, 22 bp, Homo sapiens
aaaggactaacataaaatctgt

SEQ ID NO: 690809 - DNA, 20 bp, Homo sapiens
aaaggactgttttttcctga

SEQ ID NO: 690810 - DNA, 18 bp, Homo sapiens
aaaggagaaaaaaaacct

SEQ ID NO: 690811 - DNA, 21 bp, Homo sapiens
aaaggagagctagcagcaggg

SEQ ID NO: 690812 - DNA, 14 bp, Homo sapiens
aaaggagagtactt

SEQ ID NO: 690813 - DNA, 15 bp, Homo sapiens
aaaggagctttctca

SEQ ID NO: 690814 - DNA, 22 bp, Homo sapiens
aaaggagctttctcaatgtctt

SEQ ID NO: 690815 - DNA, 22 bp, Homo sapiens
aaaggaggccctgttccctgga

SEQ ID NO: 690816 - DNA, 13 bp, Homo sapiens
aaaggaggctggc

SEQ ID NO: 690817 - DNA, 14 bp, Homo sapiens
aaaggaggggagaa

SEQ ID NO: 690818 - DNA, 22 bp, Homo sapiens
aaaggataaagaaggatgatgt

SEQ ID NO: 690819 - DNA, 18 bp, Homo sapiens
aaaggataactctgtatt

SEQ ID NO: 690820 - DNA, 16 bp, Homo sapiens
aaaggatactgtaaca

SEQ ID NO: 690821 - DNA, 18 bp, Homo sapiens
aaaggatactgtaacact

SEQ ID NO: 690822 - DNA, 16 bp, Homo sapiens
aaaggatataaaagga

SEQ ID NO: 690823 - DNA, 17 bp, Homo sapiens
aaaggatataaaaggat

SEQ ID NO: 690824 - DNA, 22 bp, Homo sapiens
aaaggatcttattttgtgaact

SEQ ID NO: 690825 - DNA, 19 bp, Homo sapiens
aaaggatctttgtggccaa

SEQ ID NO: 690826 - DNA, 17 bp, Homo sapiens
aaaggatgagaatgtga

SEQ ID NO: 690827 - DNA, 18 bp, Homo sapiens
aaaggatgagaatgtgac

SEQ ID NO: 690828 - DNA, 14 bp, Homo sapiens
aaaggatggtggtt

SEQ ID NO: 690829 - DNA, 17 bp, Homo sapiens
aaaggatgtataaattt

SEQ ID NO: 690830 - DNA, 14 bp, Homo sapiens
aaaggatgtgatat

SEQ ID NO: 690831 - DNA, 19 bp, Homo sapiens
aaaggatgtgatatataag

SEQ ID NO: 690832 - DNA, 23 bp, Homo sapiens
aaaggatgtgatatataagtgta

SEQ ID NO: 690833 - DNA, 14 bp, Homo sapiens
aaaggattttacca

SEQ ID NO: 690834 - DNA, 19 bp, Homo sapiens
aaaggattttaccaaagca

SEQ ID NO: 690835 - DNA, 16 bp, Homo sapiens
aaaggcaaaagactgg

SEQ ID NO: 690836 - DNA, 20 bp, Homo sapiens
aaaggcaaataatggaaaaa

SEQ ID NO: 690837 - DNA, 13 bp, Homo sapiens
aaaggcaaatatt

SEQ ID NO: 690838 - DNA, 16 bp, Homo sapiens
aaaggcaaatattgaa

SEQ ID NO: 690839 - DNA, 14 bp, Homo sapiens
aaaggcaagcactt

SEQ ID NO: 690840 - DNA, 13 bp, Homo sapiens
aaaggcaaggtcc

SEQ ID NO: 690841 - DNA, 15 bp, Homo sapiens
aaaggcagatttcca

SEQ ID NO: 690842 - DNA, 22 bp, Homo sapiens
aaaggcagccctcacctctgag

SEQ ID NO: 690843 - DNA, 23 bp, Homo sapiens
aaaggcagctcacccctgggcag

SEQ ID NO: 690844 - DNA, 12 bp, Homo sapiens
aaaggcagctgc

SEQ ID NO: 690845 - DNA, 14 bp, Homo sapiens
aaaggcagctgcct

SEQ ID NO: 690846 - DNA, 16 bp, Homo sapiens
aaaggcagctgcctct

SEQ ID NO: 690847 - DNA, 17 bp, Homo sapiens
aaaggcagctgcctctg

SEQ ID NO: 690848 - DNA, 19 bp, Homo sapiens
aaaggcagctgcctctgct

SEQ ID NO: 690849 - DNA, 18 bp, Homo sapiens
agggactggaaccaggga

SEQ ID NO: 690850 - DNA, 21 bp, Homo sapiens
agggactgtcacactggtgct

SEQ ID NO: 690851 - DNA, 22 bp, Homo sapiens
agggactgtcacactggtgctg

SEQ ID NO: 690852 - DNA, 12 bp, Homo sapiens
agggacttaaaa

SEQ ID NO: 690853 - DNA, 17 bp, Homo sapiens
agggacttaaaaaactt

SEQ ID NO: 690854 - DNA, 16 bp, Homo sapiens
agggcccaaagaattg

SEQ ID NO: 690855 - DNA, 22 bp, Homo sapiens
agggcccaagtccctgttttct

SEQ ID NO: 690856 - DNA, 13 bp, Homo sapiens
aaagtattgtaaa

SEQ ID NO: 690857 - DNA, 21 bp, Homo sapiens
aaagtattgtaaattatattt

SEQ ID NO: 690858 - DNA, 23 bp, Homo sapiens
aaagtattgtaaattatatttgt

SEQ ID NO: 690859 - DNA, 20 bp, Homo sapiens
aaagtatttataaaaatata

SEQ ID NO: 690860 - DNA, 22 bp, Homo sapiens
aaagtatttataaaaatataaa

SEQ ID NO: 690861 - DNA, 22 bp, Homo sapiens
aaagtcaaacgactaacctatc

SEQ ID NO: 690862 - DNA, 19 bp, Homo sapiens
aaagtcaataaaagagctg

SEQ ID NO: 690863 - DNA, 15 bp, Homo sapiens
aaagtcagagacaga

SEQ ID NO: 690864 - DNA, 18 bp, Homo sapiens
aaagtcagagacagatac

SEQ ID NO: 690865 - DNA, 11 bp, Homo sapiens
aaagtcatccc

SEQ ID NO: 690866 - DNA, 20 bp, Homo sapiens
aaagtcatcccctctcagga

SEQ ID NO: 690867 - DNA, 17 bp, Homo sapiens
aaagtcattaaagacag

SEQ ID NO: 690868 - DNA, 12 bp, Homo sapiens
aaagtcattatt

SEQ ID NO: 690869 - DNA, 17 bp, Homo sapiens
aaagtcattattcctgg

SEQ ID NO: 690870 - DNA, 19 bp, Homo sapiens
aaagtccaattttaattta

SEQ ID NO: 690871 - DNA, 20 bp, Homo sapiens
aaagtccaattttaatttag

SEQ ID NO: 690872 - DNA, 19 bp, Homo sapiens
aaagtccctccctgcctga

SEQ ID NO: 690873 - DNA, 12 bp, Homo sapiens
aaagtcccttcc

SEQ ID NO: 690874 - DNA, 22 bp, Homo sapiens
aaagtcctttttttccatcttt

SEQ ID NO: 690875 - DNA, 21 bp, Homo sapiens
aaagtcgccagtcactgctgc

SEQ ID NO: 690876 - DNA, 18 bp, Homo sapiens
aaagtctcaatgaaatag

SEQ ID NO: 690877 - DNA, 12 bp, Homo sapiens
aaagtctcttgt

SEQ ID NO: 690878 - DNA, 21 bp, Homo sapiens
aaagtctgtcaggtttggttt

SEQ ID NO: 690879 - DNA, 22 bp, Homo sapiens
aaagtctgtccttgaaggacta

SEQ ID NO: 690880 - DNA, 16 bp, Homo sapiens
aaagtctgtctttcct

SEQ ID NO: 690881 - DNA, 19 bp, Homo sapiens
aaagtctgttgattaaaga

SEQ ID NO: 690882 - DNA, 20 bp, Homo sapiens
aaagtcttcactctctgaag

SEQ ID NO: 690883 - DNA, 18 bp, Homo sapiens
aaagtcttttttttcctg

SEQ ID NO: 690884 - DNA, 13 bp, Homo sapiens
aaagtgaaaaaaa

SEQ ID NO: 690885 - DNA, 20 bp, Homo sapiens
aaagtgaaagtccagaaact

SEQ ID NO: 690886 - DNA, 12 bp, Homo sapiens
aaagtgaacttt

SEQ ID NO: 690887 - DNA, 20 bp, Homo sapiens
aaagtgaaggggaaacacac

SEQ ID NO: 690888 - DNA, 12 bp, Homo sapiens
aaagtgacattt

SEQ ID NO: 690889 - DNA, 13 bp, Homo sapiens
aaagtgataaatt

SEQ ID NO: 690890 - DNA, 15 bp, Homo sapiens
aaagtgataatttct

SEQ ID NO: 690891 - DNA, 15 bp, Homo sapiens
aaagtgattaaacgt

SEQ ID NO: 690892 - DNA, 12 bp, Homo sapiens
aaagtgatttct

SEQ ID NO: 690893 - DNA, 19 bp, Homo sapiens
aaagtgattttatttttgc

SEQ ID NO: 690894 - DNA, 13 bp, Homo sapiens
aaagtgcacacct

SEQ ID NO: 690895 - DNA, 14 bp, Homo sapiens
aaagtgcagccctt

SEQ ID NO: 690896 - DNA, 19 bp, Homo sapiens
aaagtgcagcccttcctcc

SEQ ID NO: 690897 - DNA, 21 bp, Homo sapiens
aaagtgcagcccttcctcctg

SEQ ID NO: 690898 - DNA, 23 bp, Homo sapiens
aaagtgcagctccgtttggcagt

SEQ ID NO: 690899 - DNA, 12 bp, Homo sapiens
aaagtgcattta

SEQ ID NO: 690900 - DNA, 15 bp, Homo sapiens
aaagtgcatttaagg

SEQ ID NO: 690901 - DNA, 16 bp, Homo sapiens
aaagtgcatttaagga

SEQ ID NO: 690902 - DNA, 16 bp, Homo sapiens
aaagtgccagaaagtg

SEQ ID NO: 690903 - DNA, 12 bp, Homo sapiens
aaagtgcctggg

SEQ ID NO: 690904 - DNA, 16 bp, Homo sapiens
aaagtgcgttctccca

SEQ ID NO: 690905 - DNA, 13 bp, Homo sapiens
aaagtgctgggat

SEQ ID NO: 690906 - DNA, 22 bp, Homo sapiens
aaagtgctgggattacaggcat

SEQ ID NO: 690907 - DNA, 20 bp, Homo sapiens
aaagtggaaaacaaggaagt

SEQ ID NO: 690908 - DNA, 15 bp, Homo sapiens
aaagtggagctggga

SEQ ID NO: 690909 - DNA, 19 bp, Homo sapiens
aaagtggccaagaagcagt

SEQ ID NO: 690910 - DNA, 21 bp, Homo sapiens
aaagtggcgtgggagccagcc

SEQ ID NO: 690911 - DNA, 18 bp, Homo sapiens
aaagtggtctctgctggg

SEQ ID NO: 690912 - DNA, 13 bp, Homo sapiens
aaagtggttgtcc

SEQ ID NO: 690913 - DNA, 10 bp, Homo sapiens
aaagtgtatt

SEQ ID NO: 690914 - DNA, 14 bp, Homo sapiens
aaagtgtatttgga

SEQ ID NO: 690915 - DNA, 15 bp, Homo sapiens
aaagtgtatttggaa

SEQ ID NO: 690916 - DNA, 22 bp, Homo sapiens
aaagtgtatttggaaataaagt

SEQ ID NO: 690917 - DNA, 23 bp, Homo sapiens
aaagtgtatttggaaataaagtc

SEQ ID NO: 690918 - DNA, 20 bp, Homo sapiens
aaagtgtattttattcagta

SEQ ID NO: 690919 - DNA, 14 bp, Homo sapiens
aaagtgtctcaaag

SEQ ID NO: 690920 - DNA, 17 bp, Homo sapiens
aaagtgtcttttgacat

SEQ ID NO: 690921 - DNA, 22 bp, Homo sapiens
aaagtgtcttttgacattttat

SEQ ID NO: 690922 - DNA, 18 bp, Homo sapiens
aaagtgtgtgtgttctgt

SEQ ID NO: 690923 - DNA, 11 bp, Homo sapiens
aaagtgttact

SEQ ID NO: 690924 - DNA, 19 bp, Homo sapiens
aaagtgttggctaatgaag

SEQ ID NO: 690925 - DNA, 18 bp, Homo sapiens
aaagtgttggtctttcta

SEQ ID NO: 690926 - DNA, 17 bp, Homo sapiens
aaagtgttgtgttcctg

SEQ ID NO: 690927 - DNA, 22 bp, Homo sapiens
aaagtgttgtgttcctggctga

SEQ ID NO: 690928 - DNA, 15 bp, Homo sapiens
aaagtgtttctgtta

SEQ ID NO: 690929 - DNA, 21 bp, Homo sapiens
aaagtgttttctctgaacaca

SEQ ID NO: 690930 - DNA, 17 bp, Homo sapiens
aaagttaaaattgttat

SEQ ID NO: 690931 - DNA, 15 bp, Homo sapiens
aaagttaaactaaaa

SEQ ID NO: 690932 - DNA, 13 bp, Homo sapiens
aaagttaagttga

SEQ ID NO: 690933 - DNA, 22 bp, Homo sapiens
aaagttaccagtgccttaaact

SEQ ID NO: 690934 - DNA, 14 bp, Homo sapiens
aaagttagctgagc

SEQ ID NO: 690935 - DNA, 18 bp, Homo sapiens
aaagttagggggttctta

SEQ ID NO: 690936 - DNA, 14 bp, Homo sapiens
aaagttataataac

SEQ ID NO: 690937 - DNA, 21 bp, Homo sapiens
aaagttataataactgaactg

SEQ ID NO: 690938 - DNA, 13 bp, Homo sapiens
aaagttatatttc

SEQ ID NO: 690939 - DNA, 19 bp, Homo sapiens
aaagttattgtgatatcct

SEQ ID NO: 690940 - DNA, 20 bp, Homo sapiens
aaagttccaaatgtttataa

SEQ ID NO: 690941 - DNA, 22 bp, Homo sapiens
aaagttccaaatgtttataaag

SEQ ID NO: 690942 - DNA, 21 bp, Homo sapiens
aaagttcccactccttcagga

SEQ ID NO: 690943 - DNA, 23 bp, Homo sapiens
aaagttccctacttcctgtgact

SEQ ID NO: 690944 - DNA, 16 bp, Homo sapiens
aaagttcttattttag

SEQ ID NO: 690945 - DNA, 17 bp, Homo sapiens
aaagttgataaagattt

SEQ ID NO: 690946 - DNA, 14 bp, Homo sapiens
aaagttgcaaggca

SEQ ID NO: 690947 - DNA, 21 bp, Homo sapiens
aaagttgcaaggcaaatgttt

SEQ ID NO: 690948 - DNA, 22 bp, Homo sapiens
aaagttgcagatgtattgactg

SEQ ID NO: 690949 - DNA, 18 bp, Homo sapiens
aaagttgcagctgttttg

SEQ ID NO: 690950 - DNA, 20 bp, Homo sapiens
aaagttgcagctgttttgtt

SEQ ID NO: 690951 - DNA, 23 bp, Homo sapiens
aaagttgcagctgttttgttgac

SEQ ID NO: 690952 - DNA, 18 bp, Homo sapiens
aaagttggaaggatctgc

SEQ ID NO: 690953 - DNA, 23 bp, Homo sapiens
aaagttggccatgtattatgaaa

SEQ ID NO: 690954 - DNA, 18 bp, Homo sapiens
aaagttgtaaataatttt

SEQ ID NO: 690955 - DNA, 19 bp, Homo sapiens
aaagttgtaacaaatacag

SEQ ID NO: 690956 - DNA, 22 bp, Homo sapiens
aaagttgtatccattaacctgg

SEQ ID NO: 690957 - DNA, 23 bp, Homo sapiens
aaagttgtgcatgtatgtataca

SEQ ID NO: 690958 - DNA, 16 bp, Homo sapiens
aaagttgttttatctt

SEQ ID NO: 690959 - DNA, 18 bp, Homo sapiens
aaagttgttttatctttt

SEQ ID NO: 690960 - DNA, 20 bp, Homo sapiens
aaagttgttttatcttttaa

SEQ ID NO: 690961 - DNA, 20 bp, Homo sapiens
aaagtttaaaacagaagcct

SEQ ID NO: 690962 - DNA, 16 bp, Homo sapiens
aaagtttacattgtcc

SEQ ID NO: 690963 - DNA, 19 bp, Homo sapiens
aaagtttagcccctgaaag

SEQ ID NO: 690964 - DNA, 13 bp, Homo sapiens
aaagtttcaatgt

SEQ ID NO: 690965 - DNA, 14 bp, Homo sapiens
aaagtttccatatg

SEQ ID NO: 690966 - DNA, 15 bp, Homo sapiens
aaagtttctgttgaa

SEQ ID NO: 690967 - DNA, 13 bp, Homo sapiens
aaagtttgccaga

SEQ ID NO: 690968 - DNA, 18 bp, Homo sapiens
aaagtttggtattgtaaa

SEQ ID NO: 690969 - DNA, 15 bp, Homo sapiens
aaagttttcctgaga

SEQ ID NO: 690970 - DNA, 17 bp, Homo sapiens
aaagttttgaaggaaac

SEQ ID NO: 690971 - DNA, 13 bp, Homo sapiens
aaagttttgcaaa

SEQ ID NO: 690972 - DNA, 11 bp, Homo sapiens
aaagtttttta

SEQ ID NO: 690973 - DNA, 22 bp, Homo sapiens
aaagttttttattatgcattat

SEQ ID NO: 690974 - DNA, 16 bp, Homo sapiens
aaagtttttttcctta

SEQ ID NO: 690975 - DNA, 17 bp, Homo sapiens
aaataaaaaaaagaaaa

SEQ ID NO: 690976 - DNA, 14 bp, Homo sapiens
aggggcaggcaggg

SEQ ID NO: 690977 - DNA, 16 bp, Homo sapiens
aggggcaggcagggct

SEQ ID NO: 690978 - DNA, 17 bp, Homo sapiens
aggggcaggcctgggac

SEQ ID NO: 690979 - DNA, 22 bp, Homo sapiens
aggggcaggcctgggacccagc

SEQ ID NO: 690980 - DNA, 23 bp, Homo sapiens
aggggcaggcctgggacccagct

SEQ ID NO: 690981 - DNA, 15 bp, Homo sapiens
aggggcaggcgcaga

SEQ ID NO: 690982 - DNA, 12 bp, Homo sapiens
aggggcaggctg

SEQ ID NO: 690983 - DNA, 13 bp, Homo sapiens
aggggcaggctga

SEQ ID NO: 690984 - DNA, 16 bp, Homo sapiens
aggggcaggtggtgga

SEQ ID NO: 690985 - DNA, 20 bp, Homo sapiens
aggggcagttttagcagcac

SEQ ID NO: 690986 - DNA, 19 bp, Homo sapiens
aggggcatctgcccctccc

SEQ ID NO: 690987 - DNA, 19 bp, Homo sapiens
aggggcatgtattggcctg

SEQ ID NO: 690988 - DNA, 22 bp, Homo sapiens
aggggcatgtattggcctggag

SEQ ID NO: 690989 - DNA, 18 bp, Homo sapiens
aaatacatgctaagagaa

SEQ ID NO: 690990 - DNA, 14 bp, Homo sapiens
aaatacatgtttgt

SEQ ID NO: 690991 - DNA, 18 bp, Homo sapiens
aaatacattgtatatatg

SEQ ID NO: 690992 - DNA, 16 bp, Homo sapiens
aaataccaagagcaat

SEQ ID NO: 690993 - DNA, 21 bp, Homo sapiens
aaataccagccagtaaatggg

SEQ ID NO: 690994 - DNA, 18 bp, Homo sapiens
aaataccagtgaaccaaa

SEQ ID NO: 690995 - DNA, 17 bp, Homo sapiens
aaataccagtgtggttt

SEQ ID NO: 690996 - DNA, 19 bp, Homo sapiens
aaataccatgtctctaagc

SEQ ID NO: 690997 - DNA, 18 bp, Homo sapiens
aaataccattgaaatcag

SEQ ID NO: 690998 - DNA, 18 bp, Homo sapiens
aaatacctcaatttttgt

SEQ ID NO: 690999 - DNA, 14 bp, Homo sapiens
aaatactactcctg

SEQ ID NO: 691000 - DNA, 20 bp, Homo sapiens
aaatactatttaaagcctcc

SEQ ID NO: 691001 - DNA, 16 bp, Homo sapiens
aaatactcatgaatga

SEQ ID NO: 691002 - DNA, 20 bp, Homo sapiens
aaatactcatgaatgaaaat

SEQ ID NO: 691003 - DNA, 12 bp, Homo sapiens
aaatactccagc

SEQ ID NO: 691004 - DNA, 17 bp, Homo sapiens
aaatactccagcacctg

SEQ ID NO: 691005 - DNA, 12 bp, Homo sapiens
aaatactctttc

SEQ ID NO: 691006 - DNA, 16 bp, Homo sapiens
aaatactctttcaata

SEQ ID NO: 691007 - DNA, 18 bp, Homo sapiens
aaatactctttcaataaa

SEQ ID NO: 691008 - DNA, 15 bp, Homo sapiens
aaatactgagatgct

SEQ ID NO: 691009 - DNA, 18 bp, Homo sapiens
aaatactgcctagaaaat

SEQ ID NO: 691010 - DNA, 17 bp, Homo sapiens
aaatactggactcagga

SEQ ID NO: 691011 - DNA, 14 bp, Homo sapiens
aaatactgtgaaat

SEQ ID NO: 691012 - DNA, 16 bp, Homo sapiens
aaatactgtgaaatac

SEQ ID NO: 691013 - DNA, 14 bp, Homo sapiens
aaatacttgcagtt

SEQ ID NO: 691014 - DNA, 17 bp, Homo sapiens
aaatacttgcagttgtg

SEQ ID NO: 691015 - DNA, 18 bp, Homo sapiens
aaatacttgcagttgtga

SEQ ID NO: 691016 - DNA, 22 bp, Homo sapiens
aaatacttgtcaatatttaaac

SEQ ID NO: 691017 - DNA, 15 bp, Homo sapiens
aaatactttgatttt

SEQ ID NO: 691018 - DNA, 17 bp, Homo sapiens
aaatactttgattttta

SEQ ID NO: 691019 - DNA, 18 bp, Homo sapiens
aaatactttgcataaatt

SEQ ID NO: 691020 - DNA, 19 bp, Homo sapiens
aaatactttgcataaatta

SEQ ID NO: 691021 - DNA, 17 bp, Homo sapiens
aaatacttttactctgc

SEQ ID NO: 691022 - DNA, 19 bp, Homo sapiens
aaatacttttactctgcct

SEQ ID NO: 691023 - DNA, 21 bp, Homo sapiens
aaatacttttgctttcaggga

SEQ ID NO: 691024 - DNA, 18 bp, Homo sapiens
aaatactttttctaatga

SEQ ID NO: 691025 - DNA, 15 bp, Homo sapiens
aaatagaaagagttc

SEQ ID NO: 691026 - DNA, 16 bp, Homo sapiens
aaatagaaccactatg

SEQ ID NO: 691027 - DNA, 12 bp, Homo sapiens
aaatagaactat

SEQ ID NO: 691028 - DNA, 14 bp, Homo sapiens
aaatagacaaaaag

SEQ ID NO: 691029 - DNA, 19 bp, Homo sapiens
aaatagacagtatatttat

SEQ ID NO: 691030 - DNA, 18 bp, Homo sapiens
aaatagacttgcacctta

SEQ ID NO: 691031 - DNA, 13 bp, Homo sapiens
aaatagagagaga

SEQ ID NO: 691032 - DNA, 22 bp, Homo sapiens
aaatagagccaactgattttgt

SEQ ID NO: 691033 - DNA, 21 bp, Homo sapiens
aaatagataagagtagaaact

SEQ ID NO: 691034 - DNA, 14 bp, Homo sapiens
aaatagatacaaat

SEQ ID NO: 691035 - DNA, 18 bp, Homo sapiens
aaatagatgatggtatga

SEQ ID NO: 691036 - DNA, 16 bp, Homo sapiens
aaatagattaatgacg

SEQ ID NO: 691037 - DNA, 13 bp, Homo sapiens
aaatagatttttg

SEQ ID NO: 691038 - DNA, 17 bp, Homo sapiens
aaatagatttttgattc

SEQ ID NO: 691039 - DNA, 12 bp, Homo sapiens
aaatagcaaaga

SEQ ID NO: 691040 - DNA, 16 bp, Homo sapiens
aaatagcatactgtgt

SEQ ID NO: 691041 - DNA, 19 bp, Homo sapiens
aaatagcggtacaagttct

SEQ ID NO: 691042 - DNA, 15 bp, Homo sapiens
aaatagcgttcttgt

SEQ ID NO: 691043 - DNA, 18 bp, Homo sapiens
aaatagcgttcttgtaat

SEQ ID NO: 691044 - DNA, 19 bp, Homo sapiens
aaatagcgttcttgtaatt

SEQ ID NO: 691045 - DNA, 16 bp, Homo sapiens
aaatagctactggaaa

SEQ ID NO: 691046 - DNA, 16 bp, Homo sapiens
aaatagctatatccat

SEQ ID NO: 691047 - DNA, 13 bp, Homo sapiens
aaatagctctttc

SEQ ID NO: 691048 - DNA, 20 bp, Homo sapiens
aaatagctgaaaactaatgt

SEQ ID NO: 691049 - DNA, 22 bp, Homo sapiens
aaatagctgaaaactaatgtac

SEQ ID NO: 691050 - DNA, 22 bp, Homo sapiens
aaatagctttactgtttctcaa

SEQ ID NO: 691051 - DNA, 19 bp, Homo sapiens
aaataggagggaaaccttt

SEQ ID NO: 691052 - DNA, 20 bp, Homo sapiens
aaataggagtgagtgtatgt

SEQ ID NO: 691053 - DNA, 16 bp, Homo sapiens
aaataggatcctggag

SEQ ID NO: 691054 - DNA, 17 bp, Homo sapiens
aaataggattgcttcaa

SEQ ID NO: 691055 - DNA, 20 bp, Homo sapiens
aaataggattgcttcaatta

SEQ ID NO: 691056 - DNA, 23 bp, Homo sapiens
aaataggattgcttcaattaaaa

SEQ ID NO: 691057 - DNA, 20 bp, Homo sapiens
aaataggggatggtccagga

SEQ ID NO: 691058 - DNA, 17 bp, Homo sapiens
aaataggtaaatgtatt

SEQ ID NO: 691059 - DNA, 21 bp, Homo sapiens
aaataggtagagtcattcata

SEQ ID NO: 691060 - DNA, 19 bp, Homo sapiens
aaatagtatgaaaatggaa

SEQ ID NO: 691061 - DNA, 23 bp, Homo sapiens
aaatagtatgggaaaaaaactga

SEQ ID NO: 691062 - DNA, 22 bp, Homo sapiens
aaatagtcatttttagcactgg

SEQ ID NO: 691063 - DNA, 19 bp, Homo sapiens
aaatagtgacataatatat

SEQ ID NO: 691064 - DNA, 22 bp, Homo sapiens
aaatagtgacataatatattct

SEQ ID NO: 691065 - DNA, 20 bp, Homo sapiens
aaatagtgcagaatctcata

SEQ ID NO: 691066 - DNA, 18 bp, Homo sapiens
aaatagtgtaagaactgt

SEQ ID NO: 691067 - DNA, 21 bp, Homo sapiens
aaatagtgtaagaactgtaca

SEQ ID NO: 691068 - DNA, 23 bp, Homo sapiens
aaatagtgtcatataaactcatt

SEQ ID NO: 691069 - DNA, 21 bp, Homo sapiens
aaatagtgtggaaattaagaa

SEQ ID NO: 691070 - DNA, 22 bp, Homo sapiens
aaatagttaagacatgatttcc

SEQ ID NO: 691071 - DNA, 17 bp, Homo sapiens
aaatagttaatatagtc

SEQ ID NO: 691072 - DNA, 23 bp, Homo sapiens
aaatagttgcatagcagtatatg

SEQ ID NO: 691073 - DNA, 15 bp, Homo sapiens
aaatataaaactgaa

SEQ ID NO: 691074 - DNA, 17 bp, Homo sapiens
aaatataaaactgaaat

SEQ ID NO: 691075 - DNA, 22 bp, Homo sapiens
aaatataaccattacatgttta

SEQ ID NO: 691076 - DNA, 17 bp, Homo sapiens
aaatataagacatttgt

SEQ ID NO: 691077 - DNA, 18 bp, Homo sapiens
aaatataattctgtaaat

SEQ ID NO: 691078 - DNA, 12 bp, Homo sapiens
aaatatacagtt

SEQ ID NO: 691079 - DNA, 16 bp, Homo sapiens
aaatatacattttcta

SEQ ID NO: 691080 - DNA, 18 bp, Homo sapiens
aaatatagatcagttata

SEQ ID NO: 691081 - DNA, 13 bp, Homo sapiens
aaatatagcaaat

SEQ ID NO: 691082 - DNA, 19 bp, Homo sapiens
aaatatagcaaatgcagaa

SEQ ID NO: 691083 - DNA, 20 bp, Homo sapiens
aaatataggatagacactgg

SEQ ID NO: 691084 - DNA, 12 bp, Homo sapiens
aaatatataaat

SEQ ID NO: 691085 - DNA, 18 bp, Homo sapiens
aaatatataaatatatat

SEQ ID NO: 691086 - DNA, 24 bp, Homo sapiens
aaatatatagcttgaaagcagtta

SEQ ID NO: 691087 - DNA, 14 bp, Homo sapiens
aaatatatataaac

SEQ ID NO: 691088 - DNA, 16 bp, Homo sapiens
aaatatatatagatat

SEQ ID NO: 691089 - DNA, 12 bp, Homo sapiens
aaatatatatat

SEQ ID NO: 691090 - DNA, 17 bp, Homo sapiens
aaatatatatatatatt

SEQ ID NO: 691091 - DNA, 22 bp, Homo sapiens
aaatatatatctatctatttga

SEQ ID NO: 691092 - DNA, 17 bp, Homo sapiens
aaatatatatgtcaata

SEQ ID NO: 691093 - DNA, 23 bp, Homo sapiens
aaatatatatgtgtgtgtatgtt

SEQ ID NO: 691094 - DNA, 15 bp, Homo sapiens
aaatatatattttgt

SEQ ID NO: 691095 - DNA, 19 bp, Homo sapiens
aaatatatatttttcaaat

SEQ ID NO: 691096 - DNA, 23 bp, Homo sapiens
aaatatatatttttcaaatagat

SEQ ID NO: 691097 - DNA, 20 bp, Homo sapiens
agggtcgtctttgtgtatgg

SEQ ID NO: 691098 - DNA, 18 bp, Homo sapiens
agggtctcccctcctgca

SEQ ID NO: 691099 - DNA, 16 bp, Homo sapiens
agggtctctagtgctg

SEQ ID NO: 691100 - DNA, 18 bp, Homo sapiens
agggtctctagtgctgtg

SEQ ID NO: 691101 - DNA, 21 bp, Homo sapiens
agggtctctagtgctgtgaaa

SEQ ID NO: 691102 - DNA, 16 bp, Homo sapiens
agggtctctccctcag

SEQ ID NO: 691103 - DNA, 22 bp, Homo sapiens
agggtctgcagcctgctggggc

SEQ ID NO: 691104 - DNA, 22 bp, Homo sapiens
agggtctgctctttctctgcca

SEQ ID NO: 691105 - DNA, 13 bp, Homo sapiens
agggtctggagaa

SEQ ID NO: 691106 - DNA, 14 bp, Homo sapiens
agggtctggagaag

SEQ ID NO: 691107 - DNA, 19 bp, Homo sapiens
agggtctggagaagcagtg

SEQ ID NO: 691108 - DNA, 16 bp, Homo sapiens
agggtctggcagagcc

SEQ ID NO: 691109 - DNA, 22 bp, Homo sapiens
agggtctggcagagcctctgag

SEQ ID NO: 691110 - DNA, 23 bp, Homo sapiens
agggtctggcagagcctctgaga

SEQ ID NO: 691111 - DNA, 12 bp, Homo sapiens
agggtctgggct

SEQ ID NO: 691112 - DNA, 13 bp, Homo sapiens
agggtctgggggc

SEQ ID NO: 691113 - DNA, 14 bp, Homo sapiens
agggtctgggggca

SEQ ID NO: 691114 - DNA, 13 bp, Homo sapiens
agggtctgtgtga

SEQ ID NO: 691115 - DNA, 17 bp, Homo sapiens
agggtctgtttggactg

SEQ ID NO: 691116 - DNA, 15 bp, Homo sapiens
agggtcttccctacc

SEQ ID NO: 691117 - DNA, 17 bp, Homo sapiens
agggtcttccctacctc

SEQ ID NO: 691118 - DNA, 18 bp, Homo sapiens
agggtcttgactctaaat

SEQ ID NO: 691119 - DNA, 15 bp, Homo sapiens
agggtcttgagggga

SEQ ID NO: 691120 - DNA, 18 bp, Homo sapiens
agggtcttgctctgtccc

SEQ ID NO: 691121 - DNA, 19 bp, Homo sapiens
aaatcaggttttcttttaa

SEQ ID NO: 691122 - DNA, 15 bp, Homo sapiens
aaatcagtaagaggt

SEQ ID NO: 691123 - DNA, 16 bp, Homo sapiens
aaatcagtaagaggtg

SEQ ID NO: 691124 - DNA, 19 bp, Homo sapiens
aaatcagtaagaggtgtta

SEQ ID NO: 691125 - DNA, 14 bp, Homo sapiens
aaatcagtcaagct

SEQ ID NO: 691126 - DNA, 17 bp, Homo sapiens
aaatcagttactaagaa

SEQ ID NO: 691127 - DNA, 17 bp, Homo sapiens
aaatcagtttttcatac

SEQ ID NO: 691128 - DNA, 16 bp, Homo sapiens
aaatcataaagtcagt

SEQ ID NO: 691129 - DNA, 18 bp, Homo sapiens
aaatcatcaagaagggct

SEQ ID NO: 691130 - DNA, 23 bp, Homo sapiens
aaatcatcaagaagggctgcatg

SEQ ID NO: 691131 - DNA, 15 bp, Homo sapiens
aaatcatcctcatgt

SEQ ID NO: 691132 - DNA, 22 bp, Homo sapiens
aaatcatcctgttttctctgtg

SEQ ID NO: 691133 - DNA, 11 bp, Homo sapiens
aaatcatctca

SEQ ID NO: 691134 - DNA, 23 bp, Homo sapiens
aaatcatgccattgcactccagc

SEQ ID NO: 691135 - DNA, 15 bp, Homo sapiens
aaatcatgggccaga

SEQ ID NO: 691136 - DNA, 19 bp, Homo sapiens
aaatcattaatactcttct

SEQ ID NO: 691137 - DNA, 15 bp, Homo sapiens
aaatcattgtagaaa

SEQ ID NO: 691138 - DNA, 14 bp, Homo sapiens
aaatcatttcagta

SEQ ID NO: 691139 - DNA, 20 bp, Homo sapiens
aaatcatttcagtatcatct

SEQ ID NO: 691140 - DNA, 19 bp, Homo sapiens
aaatcatttggttaaatca

SEQ ID NO: 691141 - DNA, 12 bp, Homo sapiens
aaatcatttgtt

SEQ ID NO: 691142 - DNA, 13 bp, Homo sapiens
aaatccaataaaa

SEQ ID NO: 691143 - DNA, 14 bp, Homo sapiens
aaatccaatattgt

SEQ ID NO: 691144 - DNA, 20 bp, Homo sapiens
aaatccatatcttaaagaaa

SEQ ID NO: 691145 - DNA, 19 bp, Homo sapiens
aaatccatgtgaccattct

SEQ ID NO: 691146 - DNA, 22 bp, Homo sapiens
aaatccatgtgaccattctgcc

SEQ ID NO: 691147 - DNA, 15 bp, Homo sapiens
aaatccattccaggt

SEQ ID NO: 691148 - DNA, 18 bp, Homo sapiens
aaatccattccaggtagc

SEQ ID NO: 691149 - DNA, 18 bp, Homo sapiens
aaatccattgtttaaaga

SEQ ID NO: 691150 - DNA, 15 bp, Homo sapiens
aaatcccaagaaatg

SEQ ID NO: 691151 - DNA, 11 bp, Homo sapiens
aaatcccctca

SEQ ID NO: 691152 - DNA, 13 bp, Homo sapiens
aaatcccctcagc

SEQ ID NO: 691153 - DNA, 14 bp, Homo sapiens
aaatccgacttgaa

SEQ ID NO: 691154 - DNA, 15 bp, Homo sapiens
aaatccgacttgaat

SEQ ID NO: 691155 - DNA, 19 bp, Homo sapiens
aaatccgctctcttcctgc

SEQ ID NO: 691156 - DNA, 22 bp, Homo sapiens
aaatcctaagacacaaatgcat

SEQ ID NO: 691157 - DNA, 20 bp, Homo sapiens
aaatcctcaacactattgta

SEQ ID NO: 691158 - DNA, 12 bp, Homo sapiens
aaatcctcacca

SEQ ID NO: 691159 - DNA, 11 bp, Homo sapiens
aaatcctcagc

SEQ ID NO: 691160 - DNA, 14 bp, Homo sapiens
aaatcctcaggaaa

SEQ ID NO: 691161 - DNA, 15 bp, Homo sapiens
aaatcctcaggaaat

SEQ ID NO: 691162 - DNA, 18 bp, Homo sapiens
aaatcctgaactttctcc

SEQ ID NO: 691163 - DNA, 15 bp, Homo sapiens
aaatcctgaagagca

SEQ ID NO: 691164 - DNA, 12 bp, Homo sapiens
aaatcctggaag

SEQ ID NO: 691165 - DNA, 17 bp, Homo sapiens
aaatcctggaaggacac

SEQ ID NO: 691166 - DNA, 19 bp, Homo sapiens
aaatcctggaaggacacag

SEQ ID NO: 691167 - DNA, 21 bp, Homo sapiens
aaatccttcgtcctaacataa

SEQ ID NO: 691168 - DNA, 16 bp, Homo sapiens
aaatcctttactgtta

SEQ ID NO: 691169 - DNA, 18 bp, Homo sapiens
aaatcctttttctttata

SEQ ID NO: 691170 - DNA, 15 bp, Homo sapiens
aaatcgattggcttt

SEQ ID NO: 691171 - DNA, 15 bp, Homo sapiens
aaatcgccataggcc

SEQ ID NO: 691172 - DNA, 22 bp, Homo sapiens
aaatctaaaacaaaatctgaac

SEQ ID NO: 691173 - DNA, 23 bp, Homo sapiens
aaatctaaaacaaaatctgaact

SEQ ID NO: 691174 - DNA, 19 bp, Homo sapiens
aaatctaaaatttcataat

SEQ ID NO: 691175 - DNA, 17 bp, Homo sapiens
aaatctaaatctattta

SEQ ID NO: 691176 - DNA, 20 bp, Homo sapiens
aaatctaaatctatttatta

SEQ ID NO: 691177 - DNA, 15 bp, Homo sapiens
aaatctaagctgtgt

SEQ ID NO: 691178 - DNA, 19 bp, Homo sapiens
aaatctaatatttctagta

SEQ ID NO: 691179 - DNA, 14 bp, Homo sapiens
aaatctaatctctt

SEQ ID NO: 691180 - DNA, 13 bp, Homo sapiens
aaatctaccactg

SEQ ID NO: 691181 - DNA, 17 bp, Homo sapiens
aaatctaccactgtatg

SEQ ID NO: 691182 - DNA, 17 bp, Homo sapiens
aaatctagccagagccc

SEQ ID NO: 691183 - DNA, 22 bp, Homo sapiens
aaatctagtatttcatgctggg

SEQ ID NO: 691184 - DNA, 13 bp, Homo sapiens
aaatctattcaga

SEQ ID NO: 691185 - DNA, 19 bp, Homo sapiens
aaatctattcagacaagca

SEQ ID NO: 691186 - DNA, 12 bp, Homo sapiens
aaatctatttat

SEQ ID NO: 691187 - DNA, 13 bp, Homo sapiens
aaatctcaaattt

SEQ ID NO: 691188 - DNA, 16 bp, Homo sapiens
aaatctcaaatttatt

SEQ ID NO: 691189 - DNA, 17 bp, Homo sapiens
aaatctcaaatttctaa

SEQ ID NO: 691190 - DNA, 20 bp, Homo sapiens
aaatctcagatacttatgaa

SEQ ID NO: 691191 - DNA, 11 bp, Homo sapiens
aaatctcagca

SEQ ID NO: 691192 - DNA, 22 bp, Homo sapiens
aaatctcagttgtttgcttctt

SEQ ID NO: 691193 - DNA, 12 bp, Homo sapiens
aaatctctaata

SEQ ID NO: 691194 - DNA, 15 bp, Homo sapiens
aaatctgaagattgc

SEQ ID NO: 691195 - DNA, 14 bp, Homo sapiens
aaatctgattagaa

SEQ ID NO: 691196 - DNA, 18 bp, Homo sapiens
aaatctgatttaatgttt

SEQ ID NO: 691197 - DNA, 19 bp, Homo sapiens
aaatctgatttaatgtttt

SEQ ID NO: 691198 - DNA, 22 bp, Homo sapiens
aaatctgatttaatgttttctg

SEQ ID NO: 691199 - DNA, 16 bp, Homo sapiens
aaatctgctagaaagt

SEQ ID NO: 691200 - DNA, 19 bp, Homo sapiens
aaatctgctagaaagttag

SEQ ID NO: 691201 - DNA, 15 bp, Homo sapiens
aaatctgctgttaac

SEQ ID NO: 691202 - DNA, 15 bp, Homo sapiens
aaatctggaaatctg

SEQ ID NO: 691203 - DNA, 22 bp, Homo sapiens
aaatctggtcttgttagaaaac

SEQ ID NO: 691204 - DNA, 17 bp, Homo sapiens
aaatctgtaattgataa

SEQ ID NO: 691205 - DNA, 20 bp, Homo sapiens
aaatctgtcaagagtagtta

SEQ ID NO: 691206 - DNA, 22 bp, Homo sapiens
aaatctgtcagcatctggctgt

SEQ ID NO: 691207 - DNA, 15 bp, Homo sapiens
aaatctgtgaattaa

SEQ ID NO: 691208 - DNA, 19 bp, Homo sapiens
aaatctgtgatgatcctca

SEQ ID NO: 691209 - DNA, 23 bp, Homo sapiens
aaatctgtgatgatcctcatatg

SEQ ID NO: 691210 - DNA, 15 bp, Homo sapiens
aaatctgttggtttt

SEQ ID NO: 691211 - DNA, 15 bp, Homo sapiens
aaatcttaaacaatg

SEQ ID NO: 691212 - DNA, 15 bp, Homo sapiens
aaatcttaacatcat

SEQ ID NO: 691213 - DNA, 17 bp, Homo sapiens
aaatcttaatcattatc

SEQ ID NO: 691214 - DNA, 14 bp, Homo sapiens
aaatcttacaaaat

SEQ ID NO: 691215 - DNA, 18 bp, Homo sapiens
aaatcttacaaaatcctg

SEQ ID NO: 691216 - DNA, 14 bp, Homo sapiens
aaatcttagtgttc

SEQ ID NO: 691217 - DNA, 17 bp, Homo sapiens
aaatcttgaatttctgc

SEQ ID NO: 691218 - DNA, 14 bp, Homo sapiens
aaatcttgatcagt

SEQ ID NO: 691219 - DNA, 20 bp, Homo sapiens
aaatcttggttgatgccaaa

SEQ ID NO: 691220 - DNA, 14 bp, Homo sapiens
aaatgtgaaatctc

SEQ ID NO: 691221 - DNA, 14 bp, Homo sapiens
aaatgtgaaatgct

SEQ ID NO: 691222 - DNA, 16 bp, Homo sapiens
aaatgtgaaatgcttt

SEQ ID NO: 691223 - DNA, 11 bp, Homo sapiens
aaatgtgaatt

SEQ ID NO: 691224 - DNA, 20 bp, Homo sapiens
aaatgtgaatttcaactttt

SEQ ID NO: 691225 - DNA, 13 bp, Homo sapiens
aaatgtgaatttt

SEQ ID NO: 691226 - DNA, 12 bp, Homo sapiens
aaatgtgagaaa

SEQ ID NO: 691227 - DNA, 16 bp, Homo sapiens
aaatgtgagaaatgtc

SEQ ID NO: 691228 - DNA, 14 bp, Homo sapiens
aaatgtgaggaaga

SEQ ID NO: 691229 - DNA, 17 bp, Homo sapiens
aaatgtgataatatatt

SEQ ID NO: 691230 - DNA, 15 bp, Homo sapiens
aaatgtgatcaactg

SEQ ID NO: 691231 - DNA, 23 bp, Homo sapiens
aaatgtgcattcttttaaaagac

SEQ ID NO: 691232 - DNA, 16 bp, Homo sapiens
aaatgtgctttgagaa

SEQ ID NO: 691233 - DNA, 20 bp, Homo sapiens
aaatgtgtcagaataggaaa

SEQ ID NO: 691234 - DNA, 20 bp, Homo sapiens
aaatgtgtcctatctatctt

SEQ ID NO: 691235 - DNA, 15 bp, Homo sapiens
aaatgtgtctctgct

SEQ ID NO: 691236 - DNA, 13 bp, Homo sapiens
aaatgtgtttttc

SEQ ID NO: 691237 - DNA, 16 bp, Homo sapiens
aaatgtgtttttctat

SEQ ID NO: 691238 - DNA, 13 bp, Homo sapiens
aaatgttaacaat

SEQ ID NO: 691239 - DNA, 23 bp, Homo sapiens
aaatgttaacaatgcctattgta

SEQ ID NO: 691240 - DNA, 13 bp, Homo sapiens
aaatgttacgtga

SEQ ID NO: 691241 - DNA, 16 bp, Homo sapiens
aaatgttattatctgg

SEQ ID NO: 691242 - DNA, 21 bp, Homo sapiens
aaatgttattttttaattatt

SEQ ID NO: 691243 - DNA, 17 bp, Homo sapiens
aaatgttcccttgacca

SEQ ID NO: 691244 - DNA, 19 bp, Homo sapiens
aaatgttctatttaacaac

SEQ ID NO: 691245 - DNA, 15 bp, Homo sapiens
aaatgttgaataaaa

SEQ ID NO: 691246 - DNA, 23 bp, Homo sapiens
aaatgttggatttataaatgcta

SEQ ID NO: 691247 - DNA, 17 bp, Homo sapiens
aaatgttggtcatttta

SEQ ID NO: 691248 - DNA, 13 bp, Homo sapiens
aaatgttgtattg

SEQ ID NO: 691249 - DNA, 13 bp, Homo sapiens
aaatgtttaaaga

SEQ ID NO: 691250 - DNA, 23 bp, Homo sapiens
aaatgtttaagtattaacttaca

SEQ ID NO: 691251 - DNA, 18 bp, Homo sapiens
aaatgtttatactgtatt

SEQ ID NO: 691252 - DNA, 17 bp, Homo sapiens
aaatgtttatttaaaag

SEQ ID NO: 691253 - DNA, 13 bp, Homo sapiens
aaatgtttcctta

SEQ ID NO: 691254 - DNA, 15 bp, Homo sapiens
aaatgtttccttaaa

SEQ ID NO: 691255 - DNA, 13 bp, Homo sapiens
aaatgtttctgca

SEQ ID NO: 691256 - DNA, 12 bp, Homo sapiens
aaatgtttggaa

SEQ ID NO: 691257 - DNA, 13 bp, Homo sapiens
aaatgtttggaaa

SEQ ID NO: 691258 - DNA, 17 bp, Homo sapiens
atggtatgatcaataaa

SEQ ID NO: 691259 - DNA, 15 bp, Homo sapiens
atggtatgctggcca

SEQ ID NO: 691260 - DNA, 17 bp, Homo sapiens
atggtatgctggccagc

SEQ ID NO: 691261 - DNA, 17 bp, Homo sapiens
atggtattaatcttgtg

SEQ ID NO: 691262 - DNA, 17 bp, Homo sapiens
atggtatttgctgtatt

SEQ ID NO: 691263 - DNA, 20 bp, Homo sapiens
atggtcaacacttaagggtt

SEQ ID NO: 691264 - DNA, 15 bp, Homo sapiens
atggtcacacactga

SEQ ID NO: 691265 - DNA, 19 bp, Homo sapiens
atggtcaccaaatcagctg

SEQ ID NO: 691266 - DNA, 23 bp, Homo sapiens
atggtcacgaggtccagacccac

SEQ ID NO: 691267 - DNA, 21 bp, Homo sapiens
atggtcacgtttggtgcttct

SEQ ID NO: 691268 - DNA, 20 bp, Homo sapiens
atggtcagtgtggagagggg

SEQ ID NO: 691269 - DNA, 17 bp, Homo sapiens
atggtcattgcagttta

SEQ ID NO: 691270 - DNA, 13 bp, Homo sapiens
atggtccaggaga

SEQ ID NO: 691271 - DNA, 16 bp, Homo sapiens
atggtccaggagaagg

SEQ ID NO: 691272 - DNA, 19 bp, Homo sapiens
atggtccaggagaaggcca

SEQ ID NO: 691273 - DNA, 19 bp, Homo sapiens
atggtccatttgttcctgc

SEQ ID NO: 691274 - DNA, 18 bp, Homo sapiens
atggtcccaggaagcagg

SEQ ID NO: 691275 - DNA, 20 bp, Homo sapiens
atggtcccatccaggcagtc

SEQ ID NO: 691276 - DNA, 16 bp, Homo sapiens
atggtccgtgcccagg

SEQ ID NO: 691277 - DNA, 20 bp, Homo sapiens
atggtccgtgcccaggccct

SEQ ID NO: 691278 - DNA, 23 bp, Homo sapiens
atggtcctcacaagcctcttctg

SEQ ID NO: 691279 - DNA, 12 bp, Homo sapiens
atggtcctgggg

SEQ ID NO: 691280 - DNA, 22 bp, Homo sapiens
atggtcctgtctgtccttctga

SEQ ID NO: 691281 - DNA, 23 bp, Homo sapiens
atggtcgagaaagaggcaccagg

SEQ ID NO: 691282 - DNA, 17 bp, Homo sapiens
atggtctctctccctct

SEQ ID NO: 691283 - DNA, 15 bp, Homo sapiens
atggtcttacattgg

SEQ ID NO: 691284 - DNA, 16 bp, Homo sapiens
atggtcttgatcctcc

SEQ ID NO: 691285 - DNA, 12 bp, Homo sapiens
atggtctttgct

SEQ ID NO: 691286 - DNA, 14 bp, Homo sapiens
atggtctttgctag

SEQ ID NO: 691287 - DNA, 13 bp, Homo sapiens
atggtctttgctc

SEQ ID NO: 691288 - DNA, 16 bp, Homo sapiens
atggtgaaaatgtact

SEQ ID NO: 691289 - DNA, 22 bp, Homo sapiens
atggtgaccaccccctgttccc

SEQ ID NO: 691290 - DNA, 13 bp, Homo sapiens
atggtgagctggg

SEQ ID NO: 691291 - DNA, 23 bp, Homo sapiens
atggtgatcctctattttgtgat

SEQ ID NO: 691292 - DNA, 14 bp, Homo sapiens
atggtgatgactta

SEQ ID NO: 691293 - DNA, 13 bp, Homo sapiens
atggtgcaaaaaa

SEQ ID NO: 691294 - DNA, 18 bp, Homo sapiens
atggtgcaaaaaaaaact

SEQ ID NO: 691295 - DNA, 21 bp, Homo sapiens
atggtgcaaaaaaaaacttaa

SEQ ID NO: 691296 - DNA, 18 bp, Homo sapiens
atggtgcagttgacagca

SEQ ID NO: 691297 - DNA, 18 bp, Homo sapiens
atggtgcattgtatagat

SEQ ID NO: 691298 - DNA, 13 bp, Homo sapiens
atggtgcccctag

SEQ ID NO: 691299 - DNA, 17 bp, Homo sapiens
atggtgcctgagaggca

SEQ ID NO: 691300 - DNA, 18 bp, Homo sapiens
atggtgcctgagaggcag

SEQ ID NO: 691301 - DNA, 21 bp, Homo sapiens
atggtgcctgagaggcaggca

SEQ ID NO: 691302 - DNA, 23 bp, Homo sapiens
atggtgcctgagaggcaggcata

SEQ ID NO: 691303 - DNA, 16 bp, Homo sapiens
atggtggacccagcgg

SEQ ID NO: 691304 - DNA, 14 bp, Homo sapiens
atggtggagggcac

SEQ ID NO: 691305 - DNA, 15 bp, Homo sapiens
atggtggagggcact

SEQ ID NO: 691306 - DNA, 16 bp, Homo sapiens
atggtggagggcactt

SEQ ID NO: 691307 - DNA, 23 bp, Homo sapiens
atggtggagggcacttcaggtcc

SEQ ID NO: 691308 - DNA, 14 bp, Homo sapiens
atggtggagggcca

SEQ ID NO: 691309 - DNA, 23 bp, Homo sapiens
atggtggagtgagagcctttgcc

SEQ ID NO: 691310 - DNA, 18 bp, Homo sapiens
atggtggcacacgcctgt

SEQ ID NO: 691311 - DNA, 21 bp, Homo sapiens
atggtggcacacgcctgtagt

SEQ ID NO: 691312 - DNA, 23 bp, Homo sapiens
atggtggcgctttctcctgtgcc

SEQ ID NO: 691313 - DNA, 19 bp, Homo sapiens
atggtggggatatttttaa

SEQ ID NO: 691314 - DNA, 16 bp, Homo sapiens
atggtggtcttctcca

SEQ ID NO: 691315 - DNA, 16 bp, Homo sapiens
atggtgtagaacacta

SEQ ID NO: 691316 - DNA, 15 bp, Homo sapiens
atggtgtccttccct

SEQ ID NO: 691317 - DNA, 14 bp, Homo sapiens
atggtgtctttcaa

SEQ ID NO: 691318 - DNA, 22 bp, Homo sapiens
atggtgtgaaagtcagatgccc

SEQ ID NO: 691319 - DNA, 14 bp, Homo sapiens
atggtgtgttacac

SEQ ID NO: 691320 - DNA, 18 bp, Homo sapiens
atggtgttaaagctgtac

SEQ ID NO: 691321 - DNA, 20 bp, Homo sapiens
atggtgttgccctgagtgga

SEQ ID NO: 691322 - DNA, 21 bp, Homo sapiens
atggtgttttcatgtaaataa

SEQ ID NO: 691323 - DNA, 20 bp, Homo sapiens
atggttaatttttcctgcat

SEQ ID NO: 691324 - DNA, 14 bp, Homo sapiens
acagtattaagggt

SEQ ID NO: 691325 - DNA, 13 bp, Homo sapiens
acagtattgccac

SEQ ID NO: 691326 - DNA, 15 bp, Homo sapiens
acagtattgccacct

SEQ ID NO: 691327 - DNA, 24 bp, Homo sapiens
acagtattttgctagtgcatttca

SEQ ID NO: 691328 - DNA, 16 bp, Homo sapiens
acagtcaaaacagaga

SEQ ID NO: 691329 - DNA, 18 bp, Homo sapiens
acagtcaaaacagagatg

SEQ ID NO: 691330 - DNA, 14 bp, Homo sapiens
acagtcaaaataat

SEQ ID NO: 691331 - DNA, 16 bp, Homo sapiens
acagtcacccctccct

SEQ ID NO: 691332 - DNA, 14 bp, Homo sapiens
acagtcatcatcag

SEQ ID NO: 691333 - DNA, 16 bp, Homo sapiens
acagtcatgtatgcaa

SEQ ID NO: 691334 - DNA, 21 bp, Homo sapiens
acagtcattggaataaggcat

SEQ ID NO: 691335 - DNA, 17 bp, Homo sapiens
acagtccaaccagaaac

SEQ ID NO: 691336 - DNA, 21 bp, Homo sapiens
acagtccacagctgaagagca

SEQ ID NO: 691337 - DNA, 12 bp, Homo sapiens
acagtccacagg

SEQ ID NO: 691338 - DNA, 13 bp, Homo sapiens
acagtccacaggg

SEQ ID NO: 691339 - DNA, 14 bp, Homo sapiens
acagtccagaccca

SEQ ID NO: 691340 - DNA, 22 bp, Homo sapiens
acagtcccccacccacctcctg

SEQ ID NO: 691341 - DNA, 17 bp, Homo sapiens
acagtccctaaagaaaa

SEQ ID NO: 691342 - DNA, 15 bp, Homo sapiens
acagtcccttatgag

SEQ ID NO: 691343 - DNA, 18 bp, Homo sapiens
acagtcctaactggtata

SEQ ID NO: 691344 - DNA, 17 bp, Homo sapiens
acagtcctatgtacaga

SEQ ID NO: 691345 - DNA, 20 bp, Homo sapiens
acagtcctatgtacagagct

SEQ ID NO: 691346 - DNA, 15 bp, Homo sapiens
acagtcctccatcca

SEQ ID NO: 691347 - DNA, 22 bp, Homo sapiens
acagtcctgggagaacctcagg

SEQ ID NO: 691348 - DNA, 17 bp, Homo sapiens
acagtcgctcagtctgt

SEQ ID NO: 691349 - DNA, 16 bp, Homo sapiens
acagtcggtgacccca

SEQ ID NO: 691350 - DNA, 16 bp, Homo sapiens
acagtcgtaaaagaga

SEQ ID NO: 691351 - DNA, 15 bp, Homo sapiens
acagtctaaagctgg

SEQ ID NO: 691352 - DNA, 20 bp, Homo sapiens
acagtctacattgagcattt

SEQ ID NO: 691353 - DNA, 17 bp, Homo sapiens
acagtctccctgatgga

SEQ ID NO: 691354 - DNA, 22 bp, Homo sapiens
acagtctccctgatggaccctc

SEQ ID NO: 691355 - DNA, 14 bp, Homo sapiens
acagtctctttctt

SEQ ID NO: 691356 - DNA, 19 bp, Homo sapiens
acagtctctttcttccttt

SEQ ID NO: 691357 - DNA, 14 bp, Homo sapiens
acagtcttcatttt

SEQ ID NO: 691358 - DNA, 13 bp, Homo sapiens
acagtcttccaca

SEQ ID NO: 691359 - DNA, 19 bp, Homo sapiens
acagtcttccatttgcaag

SEQ ID NO: 691360 - DNA, 21 bp, Homo sapiens
acagtgaatggtgccattttc

SEQ ID NO: 691361 - DNA, 19 bp, Homo sapiens
acagtgaatgtgtctggac

SEQ ID NO: 691362 - DNA, 14 bp, Homo sapiens
acagtgaattgtct

SEQ ID NO: 691363 - DNA, 15 bp, Homo sapiens
acagtgactccctgg

SEQ ID NO: 691364 - DNA, 17 bp, Homo sapiens
acagtgactccctggga

SEQ ID NO: 691365 - DNA, 19 bp, Homo sapiens
acagtgactccctgggagc

SEQ ID NO: 691366 - DNA, 19 bp, Homo sapiens
acagtgacttggccccaga

SEQ ID NO: 691367 - DNA, 21 bp, Homo sapiens
acagtgagacagtctggaaag

SEQ ID NO: 691368 - DNA, 15 bp, Homo sapiens
acagtgagaggggag

SEQ ID NO: 691369 - DNA, 22 bp, Homo sapiens
acagtgagaggggagggctcct

SEQ ID NO: 691370 - DNA, 20 bp, Homo sapiens
acagtgagagtactcacttt

SEQ ID NO: 691371 - DNA, 14 bp, Homo sapiens
acagtgagcatatc

SEQ ID NO: 691372 - DNA, 14 bp, Homo sapiens
acagtgagcctgaa

SEQ ID NO: 691373 - DNA, 17 bp, Homo sapiens
acagtgagcctgaattt

SEQ ID NO: 691374 - DNA, 18 bp, Homo sapiens
acagtgagcctgaatttt

SEQ ID NO: 691375 - DNA, 21 bp, Homo sapiens
acagtgagcctgaattttgtt

SEQ ID NO: 691376 - DNA, 14 bp, Homo sapiens
acagtgaggagggt

SEQ ID NO: 691377 - DNA, 15 bp, Homo sapiens
acagtgataggccca

SEQ ID NO: 691378 - DNA, 18 bp, Homo sapiens
acagtgatattggaactt

SEQ ID NO: 691379 - DNA, 19 bp, Homo sapiens
acagtgatctccatatgtt

SEQ ID NO: 691380 - DNA, 15 bp, Homo sapiens
atgtagcttccacct

SEQ ID NO: 691381 - DNA, 16 bp, Homo sapiens
atgtagcttccacctc

SEQ ID NO: 691382 - DNA, 21 bp, Homo sapiens
atgtagcttccacctcatgga

SEQ ID NO: 691383 - DNA, 16 bp, Homo sapiens
atgtaggactgtatag

SEQ ID NO: 691384 - DNA, 22 bp, Homo sapiens
atgtaggggaagagatgtttac

SEQ ID NO: 691385 - DNA, 16 bp, Homo sapiens
atgtaggtatgaataa

SEQ ID NO: 691386 - DNA, 17 bp, Homo sapiens
atgtaggtatgaataag

SEQ ID NO: 691387 - DNA, 15 bp, Homo sapiens
atgtaggtgagcctg

SEQ ID NO: 691388 - DNA, 15 bp, Homo sapiens
atgtagtaacactaa

SEQ ID NO: 691389 - DNA, 22 bp, Homo sapiens
atgtagtaacactaatatattt

SEQ ID NO: 691390 - DNA, 17 bp, Homo sapiens
atgtagtaattgacatg

SEQ ID NO: 691391 - DNA, 14 bp, Homo sapiens
atgtagtagtactt

SEQ ID NO: 691392 - DNA, 18 bp, Homo sapiens
atgtagtattaaaagttg

SEQ ID NO: 691393 - DNA, 19 bp, Homo sapiens
atgtagtattgttctattt

SEQ ID NO: 691394 - DNA, 12 bp, Homo sapiens
atgtagtatttt

SEQ ID NO: 691395 - DNA, 15 bp, Homo sapiens
atgtagtcagttgca

SEQ ID NO: 691396 - DNA, 17 bp, Homo sapiens
atgtagtgattaaatat

SEQ ID NO: 691397 - DNA, 18 bp, Homo sapiens
atgtagttctgccaggca

SEQ ID NO: 691398 - DNA, 19 bp, Homo sapiens
atgtataaaaattatcaaa

SEQ ID NO: 691399 - DNA, 17 bp, Homo sapiens
atgtataaagattgtac

SEQ ID NO: 691400 - DNA, 19 bp, Homo sapiens
atgtataaagattgtactt

SEQ ID NO: 691401 - DNA, 17 bp, Homo sapiens
atgtataaattaataca

SEQ ID NO: 691402 - DNA, 16 bp, Homo sapiens
atgtataaattattca

SEQ ID NO: 691403 - DNA, 14 bp, Homo sapiens
atgtataaccaagt

SEQ ID NO: 691404 - DNA, 23 bp, Homo sapiens
atgtataaccaagtgtgctcttt

SEQ ID NO: 691405 - DNA, 15 bp, Homo sapiens
atgtataattaactt

SEQ ID NO: 691406 - DNA, 17 bp, Homo sapiens
atgtataatttgaggtg

SEQ ID NO: 691407 - DNA, 12 bp, Homo sapiens
atgtatacacac

SEQ ID NO: 691408 - DNA, 13 bp, Homo sapiens
atgtatacacaca

SEQ ID NO: 691409 - DNA, 15 bp, Homo sapiens
atgtatacacacata

SEQ ID NO: 691410 - DNA, 19 bp, Homo sapiens
atgtatacttatcttgctc

SEQ ID NO: 691411 - DNA, 16 bp, Homo sapiens
atgtatagtaaatcac

SEQ ID NO: 691412 - DNA, 15 bp, Homo sapiens
atgtatataaaaatg

SEQ ID NO: 691413 - DNA, 19 bp, Homo sapiens
atgtatatatatatatgca

SEQ ID NO: 691414 - DNA, 21 bp, Homo sapiens
atgtatatcattctacagaat

SEQ ID NO: 691415 - DNA, 17 bp, Homo sapiens
atgtatatgtatatata

SEQ ID NO: 691416 - DNA, 16 bp, Homo sapiens
atgtatatgtgttcat

SEQ ID NO: 691417 - DNA, 22 bp, Homo sapiens
atgtatattaaaaaagagacat

SEQ ID NO: 691418 - DNA, 20 bp, Homo sapiens
atgtatatttgctgcaaaga

SEQ ID NO: 691419 - DNA, 18 bp, Homo sapiens
atgtatattttatataaa

SEQ ID NO: 691420 - DNA, 20 bp, Homo sapiens
atgtatatttttttaattta

SEQ ID NO: 691421 - DNA, 17 bp, Homo sapiens
atgtatcaaatacattt

SEQ ID NO: 691422 - DNA, 18 bp, Homo sapiens
atgtatcagccagccttc

SEQ ID NO: 691423 - DNA, 14 bp, Homo sapiens
atgtatcagctctc

SEQ ID NO: 691424 - DNA, 21 bp, Homo sapiens
atgtatcaggaaatatatatg

SEQ ID NO: 691425 - DNA, 17 bp, Homo sapiens
atgtatcatagaaatgt

SEQ ID NO: 691426 - DNA, 21 bp, Homo sapiens
atgtatcatttttgtgcacag

SEQ ID NO: 691427 - DNA, 15 bp, Homo sapiens
atgtatcctgataaa

SEQ ID NO: 691428 - DNA, 22 bp, Homo sapiens
atgtatcctgataaacattaaa

SEQ ID NO: 691429 - DNA, 16 bp, Homo sapiens
atgtatcgctcctatt

SEQ ID NO: 691430 - DNA, 20 bp, Homo sapiens
atgtatctacaatacatata

SEQ ID NO: 691431 - DNA, 21 bp, Homo sapiens
atgtatctatttgtacaattt

SEQ ID NO: 691432 - DNA, 16 bp, Homo sapiens
atgtatctttattaaa

SEQ ID NO: 691433 - DNA, 17 bp, Homo sapiens
atgtatctttattaaaa

SEQ ID NO: 691434 - DNA, 21 bp, Homo sapiens
atgtatgaaggaatcattcca

SEQ ID NO: 691435 - DNA, 14 bp, Homo sapiens
atgtatgcagctat

SEQ ID NO: 691436 - DNA, 23 bp, Homo sapiens
atgtatgcctgcaatatgggaac

SEQ ID NO: 691437 - DNA, 18 bp, Homo sapiens
atgtatgctttgaatgca

SEQ ID NO: 691438 - DNA, 21 bp, Homo sapiens
atgtatggaatacagtgttat

SEQ ID NO: 691439 - DNA, 15 bp, Homo sapiens
atgtatgtacaatac

SEQ ID NO: 691440 - DNA, 18 bp, Homo sapiens
atgtatgtctgcaggtgt

SEQ ID NO: 691441 - DNA, 16 bp, Homo sapiens
atgtatgtgcactgtc

SEQ ID NO: 691442 - DNA, 14 bp, Homo sapiens
atgtatgtgcattt

SEQ ID NO: 691443 - DNA, 12 bp, Homo sapiens
atgtatgtgtaa

SEQ ID NO: 691444 - DNA, 17 bp, Homo sapiens
atgtatgtttacatatc

SEQ ID NO: 691445 - DNA, 12 bp, Homo sapiens
atgtatgtttct

SEQ ID NO: 691446 - DNA, 20 bp, Homo sapiens
atgtattaagccaaacatga

SEQ ID NO: 691447 - DNA, 22 bp, Homo sapiens
atgtattaagccaaacatgagt

SEQ ID NO: 691448 - DNA, 12 bp, Homo sapiens
atgtattaatct

SEQ ID NO: 691449 - DNA, 16 bp, Homo sapiens
atgtattaatctgttt

SEQ ID NO: 691450 - DNA, 18 bp, Homo sapiens
atgtattagctcactgaa

SEQ ID NO: 691451 - DNA, 22 bp, Homo sapiens
atgtattagtatggttcaagat

SEQ ID NO: 691452 - DNA, 13 bp, Homo sapiens
atgtattatcaca

SEQ ID NO: 691453 - DNA, 21 bp, Homo sapiens
atgtattatcacatcaagcat

SEQ ID NO: 691454 - DNA, 18 bp, Homo sapiens
atgtattatgaaaaagat

SEQ ID NO: 691455 - DNA, 15 bp, Homo sapiens
atgtattatttataa

SEQ ID NO: 691456 - DNA, 16 bp, Homo sapiens
atgtattatttataat

SEQ ID NO: 691457 - DNA, 21 bp, Homo sapiens
atgtattcaagcaaacatcaa

SEQ ID NO: 691458 - DNA, 15 bp, Homo sapiens
acatacttacatttc

SEQ ID NO: 691459 - DNA, 17 bp, Homo sapiens
acatacttacatttcag

SEQ ID NO: 691460 - DNA, 19 bp, Homo sapiens
acatacttcaaaaataatg

SEQ ID NO: 691461 - DNA, 15 bp, Homo sapiens
acatactttatcaat

SEQ ID NO: 691462 - DNA, 12 bp, Homo sapiens
acatagaaatgg

SEQ ID NO: 691463 - DNA, 16 bp, Homo sapiens
acatagacagaagaaa

SEQ ID NO: 691464 - DNA, 17 bp, Homo sapiens
acatagacagaagaaac

SEQ ID NO: 691465 - DNA, 17 bp, Homo sapiens
acatagagctttttaat

SEQ ID NO: 691466 - DNA, 18 bp, Homo sapiens
acatagagctttttaata

SEQ ID NO: 691467 - DNA, 13 bp, Homo sapiens
acatagatgtccc

SEQ ID NO: 691468 - DNA, 20 bp, Homo sapiens
acatagattcacctgtaaaa

SEQ ID NO: 691469 - DNA, 22 bp, Homo sapiens
acatagattcacctgtaaaact

SEQ ID NO: 691470 - DNA, 22 bp, Homo sapiens
acatagatttatttttcagttc

SEQ ID NO: 691471 - DNA, 21 bp, Homo sapiens
acatagcatgcttcctttctc

SEQ ID NO: 691472 - DNA, 21 bp, Homo sapiens
acatagcccacttacatttac

SEQ ID NO: 691473 - DNA, 12 bp, Homo sapiens
acatagcccctg

SEQ ID NO: 691474 - DNA, 19 bp, Homo sapiens
acatagccgattctctgcc

SEQ ID NO: 691475 - DNA, 20 bp, Homo sapiens
acatagccgattctctgccc

SEQ ID NO: 691476 - DNA, 19 bp, Homo sapiens
acatagcgaatacaaaatt

SEQ ID NO: 691477 - DNA, 19 bp, Homo sapiens
acataggaagggatctgag

SEQ ID NO: 691478 - DNA, 20 bp, Homo sapiens
acataggctggtggccttgg

SEQ ID NO: 691479 - DNA, 21 bp, Homo sapiens
acataggcttctattacctat

SEQ ID NO: 691480 - DNA, 20 bp, Homo sapiens
acataggtctgtatggctgt

SEQ ID NO: 691481 - DNA, 15 bp, Homo sapiens
acatagtcctcaggg

SEQ ID NO: 691482 - DNA, 19 bp, Homo sapiens
acatagtcctcagggctca

SEQ ID NO: 691483 - DNA, 18 bp, Homo sapiens
acatagtgtcctgcccac

SEQ ID NO: 691484 - DNA, 15 bp, Homo sapiens
acatagtttttcagt

SEQ ID NO: 691485 - DNA, 16 bp, Homo sapiens
acatataacacttaac

SEQ ID NO: 691486 - DNA, 14 bp, Homo sapiens
acatatacacattt

SEQ ID NO: 691487 - DNA, 13 bp, Homo sapiens
acatatacatata

SEQ ID NO: 691488 - DNA, 17 bp, Homo sapiens
acatatacatatatata

SEQ ID NO: 691489 - DNA, 14 bp, Homo sapiens
acatatacatatga

SEQ ID NO: 691490 - DNA, 15 bp, Homo sapiens
acatatacatatgag

SEQ ID NO: 691491 - DNA, 10 bp, Homo sapiens
acatatatat

SEQ ID NO: 691492 - DNA, 20 bp, Homo sapiens
acatatatatatacacatac

SEQ ID NO: 691493 - DNA, 23 bp, Homo sapiens
acatatatatatacacatacata

SEQ ID NO: 691494 - DNA, 14 bp, Homo sapiens
acatatatattaca

SEQ ID NO: 691495 - DNA, 12 bp, Homo sapiens
acatatatattt

SEQ ID NO: 691496 - DNA, 15 bp, Homo sapiens
acatatatatttatt

SEQ ID NO: 691497 - DNA, 18 bp, Homo sapiens
acatatattttttaaaat

SEQ ID NO: 691498 - DNA, 19 bp, Homo sapiens
acatatcatggtaatgaca

SEQ ID NO: 691499 - DNA, 12 bp, Homo sapiens
acatatcatttg

SEQ ID NO: 691500 - DNA, 15 bp, Homo sapiens
acatatcatttgtga

SEQ ID NO: 691501 - DNA, 18 bp, Homo sapiens
acatatcatttgtgaaga

SEQ ID NO: 691502 - DNA, 18 bp, Homo sapiens
acatgctaagagaagtag

SEQ ID NO: 691503 - DNA, 19 bp, Homo sapiens
acatgctaagagaagtaga

SEQ ID NO: 691504 - DNA, 18 bp, Homo sapiens
acatgctaggatgcggaa

SEQ ID NO: 691505 - DNA, 23 bp, Homo sapiens
acatgctatgttctgtcttccca

SEQ ID NO: 691506 - DNA, 16 bp, Homo sapiens
acatgctcacctctag

SEQ ID NO: 691507 - DNA, 22 bp, Homo sapiens
acatgctgaggttttgaataaa

SEQ ID NO: 691508 - DNA, 19 bp, Homo sapiens
acatgctgtctggccctgg

SEQ ID NO: 691509 - DNA, 16 bp, Homo sapiens
acatgctgtgctcttt

SEQ ID NO: 691510 - DNA, 18 bp, Homo sapiens
acatgctgtgctctttga

SEQ ID NO: 691511 - DNA, 13 bp, Homo sapiens
acatgcttagctt

SEQ ID NO: 691512 - DNA, 18 bp, Homo sapiens
acatgcttagcttatctt

SEQ ID NO: 691513 - DNA, 19 bp, Homo sapiens
acatgcttagcttatcttt

SEQ ID NO: 691514 - DNA, 23 bp, Homo sapiens
acatgcttagcttatctttcttt

SEQ ID NO: 691515 - DNA, 16 bp, Homo sapiens
acatggaccagcatct

SEQ ID NO: 691516 - DNA, 19 bp, Homo sapiens
acatggacccggagctaac

SEQ ID NO: 691517 - DNA, 18 bp, Homo sapiens
acatggacttgtatattt

SEQ ID NO: 691518 - DNA, 15 bp, Homo sapiens
acatggagactcctg

SEQ ID NO: 691519 - DNA, 16 bp, Homo sapiens
acatggagactcctgc

SEQ ID NO: 691520 - DNA, 19 bp, Homo sapiens
acatggagctcttgttgca

SEQ ID NO: 691521 - DNA, 15 bp, Homo sapiens
acatggagtatatgt

SEQ ID NO: 691522 - DNA, 19 bp, Homo sapiens
acatggagtatatgtcaag

SEQ ID NO: 691523 - DNA, 15 bp, Homo sapiens
acatggatacttcct

SEQ ID NO: 691524 - DNA, 13 bp, Homo sapiens
acatggcacaggc

SEQ ID NO: 691525 - DNA, 17 bp, Homo sapiens
acatggccatagaggcc

SEQ ID NO: 691526 - DNA, 20 bp, Homo sapiens
acatggccatagaggcccag

SEQ ID NO: 691527 - DNA, 21 bp, Homo sapiens
acatggccatagaggcccagg

SEQ ID NO: 691528 - DNA, 15 bp, Homo sapiens
acatggctagccttt

SEQ ID NO: 691529 - DNA, 19 bp, Homo sapiens
acatggcttaatcttattt

SEQ ID NO: 691530 - DNA, 13 bp, Homo sapiens
acatgggacctgg

SEQ ID NO: 691531 - DNA, 12 bp, Homo sapiens
acatgggacttg

SEQ ID NO: 691532 - DNA, 13 bp, Homo sapiens
acatgggagttta

SEQ ID NO: 691533 - DNA, 12 bp, Homo sapiens
acatgggctggg

SEQ ID NO: 691534 - DNA, 13 bp, Homo sapiens
acatggggaaggc

SEQ ID NO: 691535 - DNA, 14 bp, Homo sapiens
acatggggcaagcc

SEQ ID NO: 691536 - DNA, 22 bp, Homo sapiens
acatggggcaagccagggccca

SEQ ID NO: 691537 - DNA, 13 bp, Homo sapiens
acatgggggagag

SEQ ID NO: 691538 - DNA, 14 bp, Homo sapiens
acatggtacctaag

SEQ ID NO: 691539 - DNA, 20 bp, Homo sapiens
acatggtgagcctagccctg

SEQ ID NO: 691540 - DNA, 19 bp, Homo sapiens
acatggtgcccctagcttt

SEQ ID NO: 691541 - DNA, 16 bp, Homo sapiens
acatggtgcctgagag

SEQ ID NO: 691542 - DNA, 20 bp, Homo sapiens
acatggtgcctgagaggcag

SEQ ID NO: 691543 - DNA, 13 bp, Homo sapiens
acatggtgcctta

SEQ ID NO: 691544 - DNA, 19 bp, Homo sapiens
acatggtgggtccatgggc

SEQ ID NO: 691545 - DNA, 15 bp, Homo sapiens
acatggtgtctccca

SEQ ID NO: 691546 - DNA, 19 bp, Homo sapiens
acatggttgggggaatgca

SEQ ID NO: 691547 - DNA, 20 bp, Homo sapiens
acatggttgggggaatgcac

SEQ ID NO: 691548 - DNA, 21 bp, Homo sapiens
acatggtttaaaagaaaaaat

SEQ ID NO: 691549 - DNA, 15 bp, Homo sapiens
acatgtaaaatatgt

SEQ ID NO: 691550 - DNA, 21 bp, Homo sapiens
acatgtaaaatatgtaaaact

SEQ ID NO: 691551 - DNA, 16 bp, Homo sapiens
acatgtaagaaaatgt

SEQ ID NO: 691552 - DNA, 20 bp, Homo sapiens
acatgtaataaaaagtatat

SEQ ID NO: 691553 - DNA, 18 bp, Homo sapiens
acatgtaataaattcaaa

SEQ ID NO: 691554 - DNA, 22 bp, Homo sapiens
acatgtaattaagtactatgta

SEQ ID NO: 691555 - DNA, 12 bp, Homo sapiens
acatgtacataa

SEQ ID NO: 691556 - DNA, 19 bp, Homo sapiens
acatgtaccccctttccct

SEQ ID NO: 691557 - DNA, 17 bp, Homo sapiens
acatgtacctatagaaa

SEQ ID NO: 691558 - DNA, 16 bp, Homo sapiens
acatgtactccagagg

SEQ ID NO: 691559 - DNA, 23 bp, Homo sapiens
acatgtaggtgtttgttcatctg

SEQ ID NO: 691560 - DNA, 19 bp, Homo sapiens
acatgtattgcacattgta

SEQ ID NO: 691561 - DNA, 21 bp, Homo sapiens
acatgtattgcacattgtaaa

SEQ ID NO: 691562 - DNA, 15 bp, Homo sapiens
acatgtcaatctgtc

SEQ ID NO: 691563 - DNA, 21 bp, Homo sapiens
acatgtcatttgactgtctca

SEQ ID NO: 691564 - DNA, 12 bp, Homo sapiens
acatgtcccaga

SEQ ID NO: 691565 - DNA, 19 bp, Homo sapiens
acatgtccttctgagcccg

SEQ ID NO: 691566 - DNA, 20 bp, Homo sapiens
acatgtctactttttaattt

SEQ ID NO: 691567 - DNA, 19 bp, Homo sapiens
acatgtctgtcctcagagc

SEQ ID NO: 691568 - DNA, 17 bp, Homo sapiens
acatgtctgttctacat

SEQ ID NO: 691569 - DNA, 18 bp, Homo sapiens
acatgtctgttctacata

SEQ ID NO: 691570 - DNA, 13 bp, Homo sapiens
acatgtcttccat

SEQ ID NO: 691571 - DNA, 20 bp, Homo sapiens
acatgtcttccatgtatctt

SEQ ID NO: 691572 - DNA, 14 bp, Homo sapiens
acatgtgaaaagaa

SEQ ID NO: 691573 - DNA, 18 bp, Homo sapiens
acatgtgaaaagaataga

SEQ ID NO: 691574 - DNA, 14 bp, Homo sapiens
acatgtgacattta

SEQ ID NO: 691575 - DNA, 20 bp, Homo sapiens
acatgtgaggaggaaaagga

SEQ ID NO: 691576 - DNA, 22 bp, Homo sapiens
acatgtgccagggcaatgatga

SEQ ID NO: 691577 - DNA, 16 bp, Homo sapiens
acatgtgctgatgttt

SEQ ID NO: 691578 - DNA, 18 bp, Homo sapiens
acatgtgctgccctacag

SEQ ID NO: 691579 - DNA, 16 bp, Homo sapiens
acatgtggggccaggt

SEQ ID NO: 691580 - DNA, 18 bp, Homo sapiens
acatgtggggccaggtca

SEQ ID NO: 691581 - DNA, 18 bp, Homo sapiens
acatgtgtagggaaagtt

SEQ ID NO: 691582 - DNA, 22 bp, Homo sapiens
acatgtgtatttatacccccag

SEQ ID NO: 691583 - DNA, 19 bp, Homo sapiens
acatgtgtcccagccacag

SEQ ID NO: 691584 - DNA, 18 bp, Homo sapiens
acatgtgtgaaaacaata

SEQ ID NO: 691585 - DNA, 15 bp, Homo sapiens
acatgtgtttctgac

SEQ ID NO: 691586 - DNA, 20 bp, Homo sapiens
acatgtgttttcatcatttc

SEQ ID NO: 691587 - DNA, 22 bp, Homo sapiens
acatgttaagataacttactgt

SEQ ID NO: 691588 - DNA, 23 bp, Homo sapiens
acatgttaagataacttactgta

SEQ ID NO: 691589 - DNA, 11 bp, Homo sapiens
acatgttactg

SEQ ID NO: 691590 - DNA, 15 bp, Homo sapiens
acatgttcttgtcat

SEQ ID NO: 691591 - DNA, 20 bp, Homo sapiens
acatgttgggaaacttggct

SEQ ID NO: 691592 - DNA, 14 bp, Homo sapiens
acatgttgtacatt

SEQ ID NO: 691593 - DNA, 23 bp, Homo sapiens
acatgtttaaattgtaaatttta

SEQ ID NO: 691594 - DNA, 22 bp, Homo sapiens
atgtgcagggatattgccttat

SEQ ID NO: 691595 - DNA, 12 bp, Homo sapiens
atgtgcatataa

SEQ ID NO: 691596 - DNA, 14 bp, Homo sapiens
atgtgcatctggtg

SEQ ID NO: 691597 - DNA, 17 bp, Homo sapiens
atgtgcatttcacctgt

SEQ ID NO: 691598 - DNA, 22 bp, Homo sapiens
atgtgcatttcacctgtgacaa

SEQ ID NO: 691599 - DNA, 20 bp, Homo sapiens
atgtgcatttttgtgaaatg

SEQ ID NO: 691600 - DNA, 15 bp, Homo sapiens
atgtgccaaagcttt

SEQ ID NO: 691601 - DNA, 17 bp, Homo sapiens
atgtgccaaagctttac

SEQ ID NO: 691602 - DNA, 22 bp, Homo sapiens
atgtgccaagattctactcttg

SEQ ID NO: 691603 - DNA, 15 bp, Homo sapiens
atgtgccaaggtggg

SEQ ID NO: 691604 - DNA, 17 bp, Homo sapiens
atgtgccaatcaatagc

SEQ ID NO: 691605 - DNA, 22 bp, Homo sapiens
atgtgccaccaacataaaacaa

SEQ ID NO: 691606 - DNA, 20 bp, Homo sapiens
atgtgccacctgtccggccc

SEQ ID NO: 691607 - DNA, 23 bp, Homo sapiens
atgtgccacctgtccggcccagt

SEQ ID NO: 691608 - DNA, 19 bp, Homo sapiens
atgtgccaggcttgcctgg

SEQ ID NO: 691609 - DNA, 19 bp, Homo sapiens
atgtgccatactaatgatg

SEQ ID NO: 691610 - DNA, 19 bp, Homo sapiens
atgtgccatctgtacatat

SEQ ID NO: 691611 - DNA, 18 bp, Homo sapiens
atgtgccccatgtccaag

SEQ ID NO: 691612 - DNA, 15 bp, Homo sapiens
atgtgcccctggccc

SEQ ID NO: 691613 - DNA, 16 bp, Homo sapiens
atgtgcccctggccca

SEQ ID NO: 691614 - DNA, 20 bp, Homo sapiens
atgtgcccctggcccatctc

SEQ ID NO: 691615 - DNA, 13 bp, Homo sapiens
atgtgccctcctg

SEQ ID NO: 691616 - DNA, 18 bp, Homo sapiens
atgtgccctcctgaggga

SEQ ID NO: 691617 - DNA, 22 bp, Homo sapiens
atgtgcccttttataaggaaac

SEQ ID NO: 691618 - DNA, 20 bp, Homo sapiens
atgtgcctccaagcggccct

SEQ ID NO: 691619 - DNA, 20 bp, Homo sapiens
atgtgcctgtaatctttttc

SEQ ID NO: 691620 - DNA, 22 bp, Homo sapiens
atgtgcctgtaatctttttctc

SEQ ID NO: 691621 - DNA, 17 bp, Homo sapiens
atgtgcctgtgggaggg

SEQ ID NO: 691622 - DNA, 17 bp, Homo sapiens
atgtgccttatgttgaa

SEQ ID NO: 691623 - DNA, 20 bp, Homo sapiens
atgtgtttctgtaacaaatt

SEQ ID NO: 691624 - DNA, 19 bp, Homo sapiens
atgtgtttggatacatctg

SEQ ID NO: 691625 - DNA, 21 bp, Homo sapiens
atgtgttttcatcatttcagc

SEQ ID NO: 691626 - DNA, 15 bp, Homo sapiens
atgtgttttctgaat

SEQ ID NO: 691627 - DNA, 18 bp, Homo sapiens
atgtgttttctgtagact

SEQ ID NO: 691628 - DNA, 16 bp, Homo sapiens
atgtgttttgcacgtc

SEQ ID NO: 691629 - DNA, 23 bp, Homo sapiens
atgtgttttgcacgtcttgctat

SEQ ID NO: 691630 - DNA, 18 bp, Homo sapiens
atgtgttttgtttattaa

SEQ ID NO: 691631 - DNA, 13 bp, Homo sapiens
atgtgtttttaaa

SEQ ID NO: 691632 - DNA, 19 bp, Homo sapiens
atgtgtttttctatatagt

SEQ ID NO: 691633 - DNA, 18 bp, Homo sapiens
atgttaaaataaatggtt

SEQ ID NO: 691634 - DNA, 21 bp, Homo sapiens
atgttaaactctgttgtaagt

SEQ ID NO: 691635 - DNA, 13 bp, Homo sapiens
atgttaaatactg

SEQ ID NO: 691636 - DNA, 12 bp, Homo sapiens
atgttaaatgac

SEQ ID NO: 691637 - DNA, 13 bp, Homo sapiens
atgttaaatgtta

SEQ ID NO: 691638 - DNA, 18 bp, Homo sapiens
atgttaacaatgcctatt

SEQ ID NO: 691639 - DNA, 21 bp, Homo sapiens
atgttaacaatgcctattgta

SEQ ID NO: 691640 - DNA, 18 bp, Homo sapiens
atgttaacctcagtgtca

SEQ ID NO: 691641 - DNA, 14 bp, Homo sapiens
atgttaactgccaa

SEQ ID NO: 691642 - DNA, 18 bp, Homo sapiens
atgttaagaaatgggttt

SEQ ID NO: 691643 - DNA, 21 bp, Homo sapiens
atgttaagcagctaaattttc

SEQ ID NO: 691644 - DNA, 19 bp, Homo sapiens
atgttaagtcctccctgac

SEQ ID NO: 691645 - DNA, 22 bp, Homo sapiens
atgttaattcagcactgatttc

SEQ ID NO: 691646 - DNA, 23 bp, Homo sapiens
atgttaattcagcactgatttca

SEQ ID NO: 691647 - DNA, 18 bp, Homo sapiens
atgttaatttactttctg

SEQ ID NO: 691648 - DNA, 19 bp, Homo sapiens
atgttaatttattttgctc

SEQ ID NO: 691649 - DNA, 20 bp, Homo sapiens
atgttaatttgtgtgttttt

SEQ ID NO: 691650 - DNA, 17 bp, Homo sapiens
atgttaattttttggta

SEQ ID NO: 691651 - DNA, 19 bp, Homo sapiens
atgttaattttttggtaca

SEQ ID NO: 691652 - DNA, 22 bp, Homo sapiens
atgttaattttttggtacaaaa

SEQ ID NO: 691653 - DNA, 16 bp, Homo sapiens
atgttacaagtttgct

SEQ ID NO: 691654 - DNA, 18 bp, Homo sapiens
atgttacaagtttgctaa

SEQ ID NO: 691655 - DNA, 17 bp, Homo sapiens
atgttacactaagggtg

SEQ ID NO: 691656 - DNA, 21 bp, Homo sapiens
atgttacctcctataaactta

SEQ ID NO: 691657 - DNA, 14 bp, Homo sapiens
atgttactattttc

SEQ ID NO: 691658 - DNA, 18 bp, Homo sapiens
atgttactcagtgttaga

SEQ ID NO: 691659 - DNA, 23 bp, Homo sapiens
atgttactcagtgttagagaaat

SEQ ID NO: 691660 - DNA, 14 bp, Homo sapiens
atgttactgaccag

SEQ ID NO: 691661 - DNA, 15 bp, Homo sapiens
atgttactgcttcat

SEQ ID NO: 691662 - DNA, 16 bp, Homo sapiens
atgttactgcttcatt

SEQ ID NO: 691663 - DNA, 24 bp, Homo sapiens
atgttagactcatggtgtgttaca

SEQ ID NO: 691664 - DNA, 14 bp, Homo sapiens
atgttagagtaatg

SEQ ID NO: 691665 - DNA, 21 bp, Homo sapiens
atgttagcagacccagcttag

SEQ ID NO: 691666 - DNA, 18 bp, Homo sapiens
atgttaggaaaatttcac

SEQ ID NO: 691667 - DNA, 23 bp, Homo sapiens
atgttagggtataagttgctgta

SEQ ID NO: 691668 - DNA, 16 bp, Homo sapiens
atgttagggtgctctg

SEQ ID NO: 691669 - DNA, 16 bp, Homo sapiens
atgttagggttatgtt

SEQ ID NO: 691670 - DNA, 14 bp, Homo sapiens
atgttagtaaagga

SEQ ID NO: 691671 - DNA, 22 bp, Homo sapiens
atgttagttaccttatagttac

SEQ ID NO: 691672 - DNA, 14 bp, Homo sapiens
atgttatagaactt

SEQ ID NO: 691673 - DNA, 16 bp, Homo sapiens
atgttatatcatatgt

SEQ ID NO: 691674 - DNA, 21 bp, Homo sapiens
atgttatcttatactgtacaa

SEQ ID NO: 691675 - DNA, 14 bp, Homo sapiens
atgttatgaacagc

SEQ ID NO: 691676 - DNA, 22 bp, Homo sapiens
atgttatgaacagctgtgtctg

SEQ ID NO: 691677 - DNA, 17 bp, Homo sapiens
atgttatgatattgttt

SEQ ID NO: 691678 - DNA, 18 bp, Homo sapiens
atgttatgcataaagtca

SEQ ID NO: 691679 - DNA, 23 bp, Homo sapiens
atgttatgggatgtaaacaatgt

SEQ ID NO: 691680 - DNA, 15 bp, Homo sapiens
atgttattactgttt

SEQ ID NO: 691681 - DNA, 17 bp, Homo sapiens
atgttattactgttttg

SEQ ID NO: 691682 - DNA, 15 bp, Homo sapiens
atgttattctctcac

SEQ ID NO: 691683 - DNA, 13 bp, Homo sapiens
atgttatttaaca

SEQ ID NO: 691684 - DNA, 15 bp, Homo sapiens
atgttatttgtaata

SEQ ID NO: 691685 - DNA, 19 bp, Homo sapiens
atgttatttgtaatagatg

SEQ ID NO: 691686 - DNA, 18 bp, Homo sapiens
atgttattttctgttgaa

SEQ ID NO: 691687 - DNA, 21 bp, Homo sapiens
atgttattttctgttgaagtt

SEQ ID NO: 691688 - DNA, 18 bp, Homo sapiens
atgttcaaagccacatta

SEQ ID NO: 691689 - DNA, 14 bp, Homo sapiens
atgttcacattttt

SEQ ID NO: 691690 - DNA, 22 bp, Homo sapiens
atgttcacttttgacaaaggca

SEQ ID NO: 691691 - DNA, 16 bp, Homo sapiens
atgttcagaagaaatt

SEQ ID NO: 691692 - DNA, 23 bp, Homo sapiens
atgttcagaaggttgctctagat

SEQ ID NO: 691693 - DNA, 18 bp, Homo sapiens
atgttcagcttataatga

SEQ ID NO: 691694 - DNA, 14 bp, Homo sapiens
atgttcagttcaaa

SEQ ID NO: 691695 - DNA, 21 bp, Homo sapiens
atgttcatcatcctaagctat

SEQ ID NO: 691696 - DNA, 22 bp, Homo sapiens
atgttcatcctcattgcctcct

SEQ ID NO: 691697 - DNA, 13 bp, Homo sapiens
atgttcattataa

SEQ ID NO: 691698 - DNA, 22 bp, Homo sapiens
atgttcattgtaatgttactga

SEQ ID NO: 691699 - DNA, 17 bp, Homo sapiens
atgttccagtgaggaac

SEQ ID NO: 691700 - DNA, 20 bp, Homo sapiens
atgttccagtgaggaaccct

SEQ ID NO: 691701 - DNA, 20 bp, Homo sapiens
atgttcccaatttgaattta

SEQ ID NO: 691702 - DNA, 16 bp, Homo sapiens
atgttcccagcagtgg

SEQ ID NO: 691703 - DNA, 16 bp, Homo sapiens
atgttcccttgaccat

SEQ ID NO: 691704 - DNA, 18 bp, Homo sapiens
atgttcctaacaaaatga

SEQ ID NO: 691705 - DNA, 11 bp, Homo sapiens
atgttcctaag

SEQ ID NO: 691706 - DNA, 21 bp, Homo sapiens
atgttcctaaggtcatttctt

SEQ ID NO: 691707 - DNA, 18 bp, Homo sapiens
atgttcctaataagtgaa

SEQ ID NO: 691708 - DNA, 16 bp, Homo sapiens
atgttcctcaaagctt

SEQ ID NO: 691709 - DNA, 14 bp, Homo sapiens
atgttccttaccaa

SEQ ID NO: 691710 - DNA, 22 bp, Homo sapiens
atgttccttttttcaatatgca

SEQ ID NO: 691711 - DNA, 20 bp, Homo sapiens
atgttctatttaacaactgg

SEQ ID NO: 691712 - DNA, 17 bp, Homo sapiens
atgttctcatgaactac

SEQ ID NO: 691713 - DNA, 20 bp, Homo sapiens
atgttctcctgatgtagctt

SEQ ID NO: 691714 - DNA, 15 bp, Homo sapiens
atgttctcttcccag

SEQ ID NO: 691715 - DNA, 18 bp, Homo sapiens
atgttctcttcccaggcc

SEQ ID NO: 691716 - DNA, 20 bp, Homo sapiens
atgttctcttcccaggcctt

SEQ ID NO: 691717 - DNA, 18 bp, Homo sapiens
atgttctgaatttccttt

SEQ ID NO: 691718 - DNA, 15 bp, Homo sapiens
atgttctgacattaa

SEQ ID NO: 691719 - DNA, 16 bp, Homo sapiens
atgttctgacattaac

SEQ ID NO: 691720 - DNA, 12 bp, Homo sapiens
atgttctgcctc

SEQ ID NO: 691721 - DNA, 21 bp, Homo sapiens
atgttctgcctctccctgggt

SEQ ID NO: 691722 - DNA, 15 bp, Homo sapiens
atgttctgtcttccc

SEQ ID NO: 691723 - DNA, 16 bp, Homo sapiens
acattgtaaatattta

SEQ ID NO: 691724 - DNA, 23 bp, Homo sapiens
acattgtccccaatgaatatact

SEQ ID NO: 691725 - DNA, 15 bp, Homo sapiens
acattgtcctgtagc

SEQ ID NO: 691726 - DNA, 14 bp, Homo sapiens
acattgtgagctct

SEQ ID NO: 691727 - DNA, 11 bp, Homo sapiens
acattgtgcca

SEQ ID NO: 691728 - DNA, 19 bp, Homo sapiens
acattgtgtgaaaaaagaa

SEQ ID NO: 691729 - DNA, 20 bp, Homo sapiens
acattgttcaattagaatag

SEQ ID NO: 691730 - DNA, 17 bp, Homo sapiens
acattgttgagctattg

SEQ ID NO: 691731 - DNA, 14 bp, Homo sapiens
acattgttgttttt

SEQ ID NO: 691732 - DNA, 10 bp, Homo sapiens
acatttaaaa

SEQ ID NO: 691733 - DNA, 12 bp, Homo sapiens
acatttaaaaca

SEQ ID NO: 691734 - DNA, 22 bp, Homo sapiens
acatttaaaacattaaaatata

SEQ ID NO: 691735 - DNA, 17 bp, Homo sapiens
acatttaaactttttaa

SEQ ID NO: 691736 - DNA, 18 bp, Homo sapiens
acatttaaagagatttcc

SEQ ID NO: 691737 - DNA, 20 bp, Homo sapiens
acatttaaataaaactttcc

SEQ ID NO: 691738 - DNA, 12 bp, Homo sapiens
acatttaacata

SEQ ID NO: 691739 - DNA, 13 bp, Homo sapiens
acatttaacataa

SEQ ID NO: 691740 - DNA, 13 bp, Homo sapiens
acatttaataaaa

SEQ ID NO: 691741 - DNA, 16 bp, Homo sapiens
acatttacaaactgaa

SEQ ID NO: 691742 - DNA, 16 bp, Homo sapiens
acatttacaggagggc

SEQ ID NO: 691743 - DNA, 11 bp, Homo sapiens
acatttaccaa

SEQ ID NO: 691744 - DNA, 14 bp, Homo sapiens
acatttactgacca

SEQ ID NO: 691745 - DNA, 21 bp, Homo sapiens
atgtttttgttttctttgaat

SEQ ID NO: 691746 - DNA, 22 bp, Homo sapiens
atgttttttagatcaaatactt

SEQ ID NO: 691747 - DNA, 20 bp, Homo sapiens
attaaaaaaaaatactcttt

SEQ ID NO: 691748 - DNA, 23 bp, Homo sapiens
attaaaaaaaacaaaaagaacaa

SEQ ID NO: 691749 - DNA, 16 bp, Homo sapiens
attaaaaaaatgtggt

SEQ ID NO: 691750 - DNA, 22 bp, Homo sapiens
attaaaaaacttcatgtaattt

SEQ ID NO: 691751 - DNA, 13 bp, Homo sapiens
attaaaaaagtct

SEQ ID NO: 691752 - DNA, 15 bp, Homo sapiens
attaaaaactgctta

SEQ ID NO: 691753 - DNA, 13 bp, Homo sapiens
attaaaaacttta

SEQ ID NO: 691754 - DNA, 17 bp, Homo sapiens
attaaaaactttaaaga

SEQ ID NO: 691755 - DNA, 14 bp, Homo sapiens
attaaaaagaagat

SEQ ID NO: 691756 - DNA, 12 bp, Homo sapiens
attaaaaagcct

SEQ ID NO: 691757 - DNA, 22 bp, Homo sapiens
attaaaaagggagaaagaaaac

SEQ ID NO: 691758 - DNA, 23 bp, Homo sapiens
attaaaaagggagaaagaaaact

SEQ ID NO: 691759 - DNA, 13 bp, Homo sapiens
attaaaaagtggg

SEQ ID NO: 691760 - DNA, 15 bp, Homo sapiens
attaaaaatagacag

SEQ ID NO: 691761 - DNA, 13 bp, Homo sapiens
attaaaaatataa

SEQ ID NO: 691762 - DNA, 17 bp, Homo sapiens
attaaaaatataaaact

SEQ ID NO: 691763 - DNA, 22 bp, Homo sapiens
attaaaaatctcaaatttctaa

SEQ ID NO: 691764 - DNA, 16 bp, Homo sapiens
attaaaacaaaagggt

SEQ ID NO: 691765 - DNA, 21 bp, Homo sapiens
attaaaacaaaagggtgtata

SEQ ID NO: 691766 - DNA, 14 bp, Homo sapiens
attaaaacaaatat

SEQ ID NO: 691767 - DNA, 20 bp, Homo sapiens
attaaaacaatattgtttct

SEQ ID NO: 691768 - DNA, 17 bp, Homo sapiens
attaaaacatatttcat

SEQ ID NO: 691769 - DNA, 12 bp, Homo sapiens
attaaaactgag

SEQ ID NO: 691770 - DNA, 14 bp, Homo sapiens
attaaaactgcttt

SEQ ID NO: 691771 - DNA, 16 bp, Homo sapiens
attaaaactgcttttt

SEQ ID NO: 691772 - DNA, 20 bp, Homo sapiens
attaaaagaaatatacagtt

SEQ ID NO: 691773 - DNA, 14 bp, Homo sapiens
attaaaagaatttt

SEQ ID NO: 691774 - DNA, 11 bp, Homo sapiens
attaaaagact

SEQ ID NO: 691775 - DNA, 17 bp, Homo sapiens
attaaaagactccacat

SEQ ID NO: 691776 - DNA, 15 bp, Homo sapiens
attaaaagcaaatca

SEQ ID NO: 691777 - DNA, 23 bp, Homo sapiens
attaaaagcccactgtggagatg

SEQ ID NO: 691778 - DNA, 15 bp, Homo sapiens
attaaaataaaacaa

SEQ ID NO: 691779 - DNA, 20 bp, Homo sapiens
attaaaataaaacaagcctt

SEQ ID NO: 691780 - DNA, 16 bp, Homo sapiens
attaaaatatatgttc

SEQ ID NO: 691781 - DNA, 21 bp, Homo sapiens
attaaaatatatttaatatgt

SEQ ID NO: 691782 - DNA, 22 bp, Homo sapiens
attaaaatattatttgatatct

SEQ ID NO: 691783 - DNA, 12 bp, Homo sapiens
attaaaatattt

SEQ ID NO: 691784 - DNA, 14 bp, Homo sapiens
attaaaatcctcaa

SEQ ID NO: 691785 - DNA, 14 bp, Homo sapiens
attaaaatctgatg

SEQ ID NO: 691786 - DNA, 11 bp, Homo sapiens
attaaaatctt

SEQ ID NO: 691787 - DNA, 12 bp, Homo sapiens
attaaaatggat

SEQ ID NO: 691788 - DNA, 11 bp, Homo sapiens
attaaacaatt

SEQ ID NO: 691789 - DNA, 12 bp, Homo sapiens
attaaacctgtc

SEQ ID NO: 691790 - DNA, 22 bp, Homo sapiens
attaaacctgtctccactgtgc

SEQ ID NO: 691791 - DNA, 19 bp, Homo sapiens
attaaacgtatgcatgtga

SEQ ID NO: 691792 - DNA, 16 bp, Homo sapiens
attaaacgtgtaaatt

SEQ ID NO: 691793 - DNA, 23 bp, Homo sapiens
attaaactcttcacaaaatctgt

SEQ ID NO: 691794 - DNA, 17 bp, Homo sapiens
attaaacttaatctaaa

SEQ ID NO: 691795 - DNA, 21 bp, Homo sapiens
attaaacttccaaagaaagtt

SEQ ID NO: 691796 - DNA, 17 bp, Homo sapiens
attaaacttgaagcagt

SEQ ID NO: 691797 - DNA, 12 bp, Homo sapiens
attaaacttttt

SEQ ID NO: 691798 - DNA, 15 bp, Homo sapiens
attaaagaaatgaaa

SEQ ID NO: 691799 - DNA, 16 bp, Homo sapiens
attaaagaagacctga

SEQ ID NO: 691800 - DNA, 18 bp, Homo sapiens
attaaagatgccatagca

SEQ ID NO: 691801 - DNA, 15 bp, Homo sapiens
attaaagattctctt

SEQ ID NO: 691802 - DNA, 17 bp, Homo sapiens
attaaagattctcttta

SEQ ID NO: 691803 - DNA, 13 bp, Homo sapiens
attaaagatttct

SEQ ID NO: 691804 - DNA, 21 bp, Homo sapiens
attaaagatttcttttcatta

SEQ ID NO: 691805 - DNA, 12 bp, Homo sapiens
attaaagcccat

SEQ ID NO: 691806 - DNA, 17 bp, Homo sapiens
attaaagctaaagtatc

SEQ ID NO: 691807 - DNA, 16 bp, Homo sapiens
attaaaggaaggaaaa

SEQ ID NO: 691808 - DNA, 14 bp, Homo sapiens
attaaagtaaatgg

SEQ ID NO: 691809 - DNA, 18 bp, Homo sapiens
attaaagtatgcaaaata

SEQ ID NO: 691810 - DNA, 13 bp, Homo sapiens
attaaagtattct

SEQ ID NO: 691811 - DNA, 16 bp, Homo sapiens
attaaagtcagaagtt

SEQ ID NO: 691812 - DNA, 17 bp, Homo sapiens
attaaagtctattcaaa

SEQ ID NO: 691813 - DNA, 12 bp, Homo sapiens
attaaagtgact

SEQ ID NO: 691814 - DNA, 14 bp, Homo sapiens
attaaataaactgt

SEQ ID NO: 691815 - DNA, 19 bp, Homo sapiens
attaaatacaaaacttcca

SEQ ID NO: 691816 - DNA, 19 bp, Homo sapiens
attaaatacagacactaag

SEQ ID NO: 691817 - DNA, 19 bp, Homo sapiens
attaaatacatatggatgt

SEQ ID NO: 691818 - DNA, 11 bp, Homo sapiens
attaaatagtg

SEQ ID NO: 691819 - DNA, 20 bp, Homo sapiens
attaaatagtgtgatgtttg

SEQ ID NO: 691820 - DNA, 21 bp, Homo sapiens
attaaatagtgtgatgtttgg

SEQ ID NO: 691821 - DNA, 18 bp, Homo sapiens
attaaatatatgtatgta

SEQ ID NO: 691822 - DNA, 15 bp, Homo sapiens
attaaatatttgaag

SEQ ID NO: 691823 - DNA, 16 bp, Homo sapiens
attaaatatttgaaga

SEQ ID NO: 691824 - DNA, 17 bp, Homo sapiens
attaaatctctttaaga

SEQ ID NO: 691825 - DNA, 19 bp, Homo sapiens
attaaatgccttgtataaa

SEQ ID NO: 691826 - DNA, 16 bp, Homo sapiens
attaaatgcttcattt

SEQ ID NO: 691827 - DNA, 14 bp, Homo sapiens
attaaatgtagctt

SEQ ID NO: 691828 - DNA, 13 bp, Homo sapiens
attaaatgttgct

SEQ ID NO: 691829 - DNA, 11 bp, Homo sapiens
attaaattaca

SEQ ID NO: 691830 - DNA, 12 bp, Homo sapiens
attaaattacct

SEQ ID NO: 691831 - DNA, 16 bp, Homo sapiens
attaaattcacaaact

SEQ ID NO: 691832 - DNA, 13 bp, Homo sapiens
attaaattcttgc

SEQ ID NO: 691833 - DNA, 20 bp, Homo sapiens
attaaattcttgcaaagtat

SEQ ID NO: 691834 - DNA, 15 bp, Homo sapiens
attaaattttagtca

SEQ ID NO: 691835 - DNA, 18 bp, Homo sapiens
attaaattttttgttgac

SEQ ID NO: 691836 - DNA, 17 bp, Homo sapiens
attaaattttttttaca

SEQ ID NO: 691837 - DNA, 18 bp, Homo sapiens
attaaattttttttacat

SEQ ID NO: 691838 - DNA, 20 bp, Homo sapiens
attaacaaattatgttacat

SEQ ID NO: 691839 - DNA, 18 bp, Homo sapiens
attaacaacaataacact

SEQ ID NO: 691840 - DNA, 16 bp, Homo sapiens
attaacaattaattgt

SEQ ID NO: 691841 - DNA, 17 bp, Homo sapiens
attaacacagtgtttca

SEQ ID NO: 691842 - DNA, 22 bp, Homo sapiens
attaacagttttccatgaaaac

SEQ ID NO: 691843 - DNA, 23 bp, Homo sapiens
attaacatacctaagaagtacat

SEQ ID NO: 691844 - DNA, 15 bp, Homo sapiens
attaacatatgtcac

SEQ ID NO: 691845 - DNA, 17 bp, Homo sapiens
attaacatcgtgggtca

SEQ ID NO: 691846 - DNA, 22 bp, Homo sapiens
attaacctgaaagaacatacat

SEQ ID NO: 691847 - DNA, 17 bp, Homo sapiens
attaaccttttttgtct

SEQ ID NO: 691848 - DNA, 18 bp, Homo sapiens
attaaccttttttgtctt

SEQ ID NO: 691849 - DNA, 13 bp, Homo sapiens
attaactaaatgc

SEQ ID NO: 691850 - DNA, 21 bp, Homo sapiens
attaactactgaataatgcta

SEQ ID NO: 691851 - DNA, 17 bp, Homo sapiens
attaactcattagactg

SEQ ID NO: 691852 - DNA, 14 bp, Homo sapiens
attaactgaaacat

SEQ ID NO: 691853 - DNA, 19 bp, Homo sapiens
attaactgggtaatgaaac

SEQ ID NO: 691854 - DNA, 18 bp, Homo sapiens
attaacttacggatttat

SEQ ID NO: 691855 - DNA, 15 bp, Homo sapiens
attaacttatttaga

SEQ ID NO: 691856 - DNA, 20 bp, Homo sapiens
attaacttttataaacttta

SEQ ID NO: 691857 - DNA, 13 bp, Homo sapiens
attaagaaaatca

SEQ ID NO: 691858 - DNA, 22 bp, Homo sapiens
accacacctccctgaaccatcc

SEQ ID NO: 691859 - DNA, 19 bp, Homo sapiens
accacacctggctaatttt

SEQ ID NO: 691860 - DNA, 16 bp, Homo sapiens
accacactacacagca

SEQ ID NO: 691861 - DNA, 20 bp, Homo sapiens
accacactcaccccagcctc

SEQ ID NO: 691862 - DNA, 18 bp, Homo sapiens
accacactgaatctcccc

SEQ ID NO: 691863 - DNA, 15 bp, Homo sapiens
accacactgagttct

SEQ ID NO: 691864 - DNA, 16 bp, Homo sapiens
accacactggactccg

SEQ ID NO: 691865 - DNA, 18 bp, Homo sapiens
accacactgggtgcgtct

SEQ ID NO: 691866 - DNA, 22 bp, Homo sapiens
accacacttcctgtccagagag

SEQ ID NO: 691867 - DNA, 23 bp, Homo sapiens
accacagaatacggaagagcagg

SEQ ID NO: 691868 - DNA, 14 bp, Homo sapiens
attacatctaatgc

SEQ ID NO: 691869 - DNA, 18 bp, Homo sapiens
attacatgactgtttctt

SEQ ID NO: 691870 - DNA, 16 bp, Homo sapiens
attacatgtaatttga

SEQ ID NO: 691871 - DNA, 22 bp, Homo sapiens
attacatgtttaaattgtaaat

SEQ ID NO: 691872 - DNA, 20 bp, Homo sapiens
attacatgttttttcatttg

SEQ ID NO: 691873 - DNA, 22 bp, Homo sapiens
attacatgttttttcatttgta

SEQ ID NO: 691874 - DNA, 14 bp, Homo sapiens
attacattcctaac

SEQ ID NO: 691875 - DNA, 19 bp, Homo sapiens
attacattcctaactagaa

SEQ ID NO: 691876 - DNA, 13 bp, Homo sapiens
attacatttttaa

SEQ ID NO: 691877 - DNA, 16 bp, Homo sapiens
attaccaacctgttac

SEQ ID NO: 691878 - DNA, 14 bp, Homo sapiens
attaccaccctttc

SEQ ID NO: 691879 - DNA, 20 bp, Homo sapiens
attaccagatataaaataat

SEQ ID NO: 691880 - DNA, 13 bp, Homo sapiens
attaccagtctga

SEQ ID NO: 691881 - DNA, 16 bp, Homo sapiens
attaccagtctgatta

SEQ ID NO: 691882 - DNA, 23 bp, Homo sapiens
attaccagtctttaaaggcccag

SEQ ID NO: 691883 - DNA, 22 bp, Homo sapiens
attaccatagagtaatgatgta

SEQ ID NO: 691884 - DNA, 15 bp, Homo sapiens
attaccatggagaca

SEQ ID NO: 691885 - DNA, 14 bp, Homo sapiens
attaccatgtaatg

SEQ ID NO: 691886 - DNA, 19 bp, Homo sapiens
attaccatttgttaatatc

SEQ ID NO: 691887 - DNA, 19 bp, Homo sapiens
attacccacgtgacaccac

SEQ ID NO: 691888 - DNA, 18 bp, Homo sapiens
attaccccctccttcaga

SEQ ID NO: 691889 - DNA, 19 bp, Homo sapiens
attaccccctccttcagac

SEQ ID NO: 691890 - DNA, 20 bp, Homo sapiens
attaccccctccttcagaca

SEQ ID NO: 691891 - DNA, 21 bp, Homo sapiens
attaccgcgttgtaaaatata

SEQ ID NO: 691892 - DNA, 21 bp, Homo sapiens
attaccgttatgtctttggaa

SEQ ID NO: 691893 - DNA, 16 bp, Homo sapiens
attacctagaaatcta

SEQ ID NO: 691894 - DNA, 14 bp, Homo sapiens
attacctattaggt

SEQ ID NO: 691895 - DNA, 17 bp, Homo sapiens
attacctcctgagaaaa

SEQ ID NO: 691896 - DNA, 15 bp, Homo sapiens
attacctcttgccct

SEQ ID NO: 691897 - DNA, 21 bp, Homo sapiens
attacctggagaagaatggct

SEQ ID NO: 691898 - DNA, 15 bp, Homo sapiens
attacctttaatttt

SEQ ID NO: 691899 - DNA, 14 bp, Homo sapiens
attacgtgagccag

SEQ ID NO: 691900 - DNA, 20 bp, Homo sapiens
attacgtgagccaggtaatg

SEQ ID NO: 691901 - DNA, 17 bp, Homo sapiens
attacgtgtatgtttct

SEQ ID NO: 691902 - DNA, 18 bp, Homo sapiens
attacgtgtatgtttctt

SEQ ID NO: 691903 - DNA, 20 bp, Homo sapiens
attactaaggagtaatctgt

SEQ ID NO: 691904 - DNA, 15 bp, Homo sapiens
attactacaaaattt

SEQ ID NO: 691905 - DNA, 20 bp, Homo sapiens
attactacaaaatttgaaat

SEQ ID NO: 691906 - DNA, 19 bp, Homo sapiens
attactacactggtgtgtc

SEQ ID NO: 691907 - DNA, 14 bp, Homo sapiens
attactactccttt

SEQ ID NO: 691908 - DNA, 16 bp, Homo sapiens
attactatctgttgaa

SEQ ID NO: 691909 - DNA, 17 bp, Homo sapiens
attactcagtaatttgt

SEQ ID NO: 691910 - DNA, 16 bp, Homo sapiens
attactctacactgaa

SEQ ID NO: 691911 - DNA, 16 bp, Homo sapiens
attactctagtttatt

SEQ ID NO: 691912 - DNA, 14 bp, Homo sapiens
attactctggtgga

SEQ ID NO: 691913 - DNA, 13 bp, Homo sapiens
attactctttctc

SEQ ID NO: 691914 - DNA, 19 bp, Homo sapiens
attactgaaatttaagaaa

SEQ ID NO: 691915 - DNA, 14 bp, Homo sapiens
attactgaggggat

SEQ ID NO: 691916 - DNA, 20 bp, Homo sapiens
attactgatttagaagcaaa

SEQ ID NO: 691917 - DNA, 22 bp, Homo sapiens
attactgatttagaagcaaaga

SEQ ID NO: 691918 - DNA, 16 bp, Homo sapiens
attactgctaagtatt

SEQ ID NO: 691919 - DNA, 17 bp, Homo sapiens
attactgctaagtattt

SEQ ID NO: 691920 - DNA, 19 bp, Homo sapiens
attactggatctcttaaga

SEQ ID NO: 691921 - DNA, 12 bp, Homo sapiens
attactgggcct

SEQ ID NO: 691922 - DNA, 13 bp, Homo sapiens
attactgggcctt

SEQ ID NO: 691923 - DNA, 14 bp, Homo sapiens
attactgggtatat

SEQ ID NO: 691924 - DNA, 14 bp, Homo sapiens
attactgtcccctt

SEQ ID NO: 691925 - DNA, 18 bp, Homo sapiens
attactgtctggttttaa

SEQ ID NO: 691926 - DNA, 19 bp, Homo sapiens
attactgtctttattctta

SEQ ID NO: 691927 - DNA, 20 bp, Homo sapiens
attactgtctttattcttat

SEQ ID NO: 691928 - DNA, 13 bp, Homo sapiens
attactgtgtaaa

SEQ ID NO: 691929 - DNA, 19 bp, Homo sapiens
attactgttgcatttactt

SEQ ID NO: 691930 - DNA, 19 bp, Homo sapiens
attactgttttatgttgat

SEQ ID NO: 691931 - DNA, 16 bp, Homo sapiens
attactgttttgggcc

SEQ ID NO: 691932 - DNA, 13 bp, Homo sapiens
attacttagagga

SEQ ID NO: 691933 - DNA, 21 bp, Homo sapiens
attacttaggttattttgctt

SEQ ID NO: 691934 - DNA, 16 bp, Homo sapiens
attacttatttttgac

SEQ ID NO: 691935 - DNA, 19 bp, Homo sapiens
attacttatttttgacagt

SEQ ID NO: 691936 - DNA, 17 bp, Homo sapiens
attacttccatgaattt

SEQ ID NO: 691937 - DNA, 14 bp, Homo sapiens
attacttctgtttc

SEQ ID NO: 691938 - DNA, 15 bp, Homo sapiens
attacttgccagggg

SEQ ID NO: 691939 - DNA, 23 bp, Homo sapiens
attacttgctttcaattgacaaa

SEQ ID NO: 691940 - DNA, 21 bp, Homo sapiens
attacttgggaaatttttaat

SEQ ID NO: 691941 - DNA, 13 bp, Homo sapiens
attacttttgtaa

SEQ ID NO: 691942 - DNA, 16 bp, Homo sapiens
attacttttgtaaata

SEQ ID NO: 691943 - DNA, 18 bp, Homo sapiens
attactttttttgtagat

SEQ ID NO: 691944 - DNA, 18 bp, Homo sapiens
attagaaaagttaacatt

SEQ ID NO: 691945 - DNA, 15 bp, Homo sapiens
attagaaaatattct

SEQ ID NO: 691946 - DNA, 22 bp, Homo sapiens
attagaaaatgttatttaacag

SEQ ID NO: 691947 - DNA, 14 bp, Homo sapiens
attagaaatatttt

SEQ ID NO: 691948 - DNA, 17 bp, Homo sapiens
attagaaatattttaaa

SEQ ID NO: 691949 - DNA, 21 bp, Homo sapiens
attagaaatattttaaaatca

SEQ ID NO: 691950 - DNA, 15 bp, Homo sapiens
attagaaattagctg

SEQ ID NO: 691951 - DNA, 20 bp, Homo sapiens
attagaaattagctgtgtga

SEQ ID NO: 691952 - DNA, 16 bp, Homo sapiens
attagaacattcactt

SEQ ID NO: 691953 - DNA, 13 bp, Homo sapiens
attagaagacatt

SEQ ID NO: 691954 - DNA, 22 bp, Homo sapiens
attagaatagtgttctgcaaaa

SEQ ID NO: 691955 - DNA, 19 bp, Homo sapiens
attagaatcaaacattttg

SEQ ID NO: 691956 - DNA, 12 bp, Homo sapiens
attagaatgtga

SEQ ID NO: 691957 - DNA, 22 bp, Homo sapiens
attagaattgtgtgttaatgtc

SEQ ID NO: 691958 - DNA, 14 bp, Homo sapiens
attagacagaacac

SEQ ID NO: 691959 - DNA, 20 bp, Homo sapiens
attagactttagaaataaat

SEQ ID NO: 691960 - DNA, 21 bp, Homo sapiens
attagagagcatctgcaacaa

SEQ ID NO: 691961 - DNA, 21 bp, Homo sapiens
attagagcacagcttcttctg

SEQ ID NO: 691962 - DNA, 16 bp, Homo sapiens
attagagcctgtaaac

SEQ ID NO: 691963 - DNA, 22 bp, Homo sapiens
attagagggaggtgtttaaaga

SEQ ID NO: 691964 - DNA, 18 bp, Homo sapiens
attagagtatttcccttc

SEQ ID NO: 691965 - DNA, 19 bp, Homo sapiens
attagagtatttcccttcc

SEQ ID NO: 691966 - DNA, 17 bp, Homo sapiens
attagataaagatttct

SEQ ID NO: 691967 - DNA, 19 bp, Homo sapiens
attagatcaaatagttgca

SEQ ID NO: 691968 - DNA, 23 bp, Homo sapiens
attagatcacatcttaaattcat

SEQ ID NO: 691969 - DNA, 18 bp, Homo sapiens
attagatccattaattta

SEQ ID NO: 691970 - DNA, 16 bp, Homo sapiens
attagatggcttattt

SEQ ID NO: 691971 - DNA, 18 bp, Homo sapiens
attagatgtcatgaggaa

SEQ ID NO: 691972 - DNA, 20 bp, Homo sapiens
attagatgtcatgaggaaac

SEQ ID NO: 691973 - DNA, 18 bp, Homo sapiens
attagattatttctgtat

SEQ ID NO: 691974 - DNA, 19 bp, Homo sapiens
attagattatttctgtatt

SEQ ID NO: 691975 - DNA, 14 bp, Homo sapiens
attagattttagaa

SEQ ID NO: 691976 - DNA, 16 bp, Homo sapiens
attagcaaggctgggt

SEQ ID NO: 691977 - DNA, 13 bp, Homo sapiens
attagcagaatgg

SEQ ID NO: 691978 - DNA, 16 bp, Homo sapiens
attagcagaatggaga

SEQ ID NO: 691979 - DNA, 17 bp, Homo sapiens
attagcagaatggagaa

SEQ ID NO: 691980 - DNA, 15 bp, Homo sapiens
attagcatgcaagct

SEQ ID NO: 691981 - DNA, 17 bp, Homo sapiens
attagccacaaaattgg

SEQ ID NO: 691982 - DNA, 18 bp, Homo sapiens
attagccgggcatggtgg

SEQ ID NO: 691983 - DNA, 21 bp, Homo sapiens
attagcggctcctcgccccca

SEQ ID NO: 691984 - DNA, 16 bp, Homo sapiens
attagctaattagaaa

SEQ ID NO: 691985 - DNA, 12 bp, Homo sapiens
attagctctgga

SEQ ID NO: 691986 - DNA, 15 bp, Homo sapiens
attagctttactgtt

SEQ ID NO: 691987 - DNA, 20 bp, Homo sapiens
attaggaagtgtaacagctg

SEQ ID NO: 691988 - DNA, 15 bp, Homo sapiens
attaggaagtgttta

SEQ ID NO: 691989 - DNA, 16 bp, Homo sapiens
attaggaataaataaa

SEQ ID NO: 691990 - DNA, 21 bp, Homo sapiens
attattttgaatgtcacaaat

SEQ ID NO: 691991 - DNA, 20 bp, Homo sapiens
attattttggtacttttatg

SEQ ID NO: 691992 - DNA, 17 bp, Homo sapiens
attattttgtggttcta

SEQ ID NO: 691993 - DNA, 21 bp, Homo sapiens
attattttgtggttctatttt

SEQ ID NO: 691994 - DNA, 22 bp, Homo sapiens
attattttgtggttctatttta

SEQ ID NO: 691995 - DNA, 19 bp, Homo sapiens
attatttttacctaaagac

SEQ ID NO: 691996 - DNA, 18 bp, Homo sapiens
attattttttaaaaaggt

SEQ ID NO: 691997 - DNA, 16 bp, Homo sapiens
attattttttaataaa

SEQ ID NO: 691998 - DNA, 15 bp, Homo sapiens
attattttttatttc

SEQ ID NO: 691999 - DNA, 21 bp, Homo sapiens
attcaaaaagacagcagacaa

SEQ ID NO: 692000 - DNA, 15 bp, Homo sapiens
acccacaaccctggg

SEQ ID NO: 692001 - DNA, 16 bp, Homo sapiens
acccacaaccctggga

SEQ ID NO: 692002 - DNA, 13 bp, Homo sapiens
acccacacagctg

SEQ ID NO: 692003 - DNA, 15 bp, Homo sapiens
acccacacagctgcc

SEQ ID NO: 692004 - DNA, 18 bp, Homo sapiens
acccacacagctgcccta

SEQ ID NO: 692005 - DNA, 19 bp, Homo sapiens
acccacacagctgccctag

SEQ ID NO: 692006 - DNA, 19 bp, Homo sapiens
acccacacattccagggct

SEQ ID NO: 692007 - DNA, 21 bp, Homo sapiens
acccacacattccagggctgg

SEQ ID NO: 692008 - DNA, 23 bp, Homo sapiens
acccacacattccagggctgggg

SEQ ID NO: 692009 - DNA, 22 bp, Homo sapiens
acccacagatgtctctggggca

SEQ ID NO: 692010 - DNA, 11 bp, Homo sapiens
acccacagctc

SEQ ID NO: 692011 - DNA, 15 bp, Homo sapiens
acccacagctctggg

SEQ ID NO: 692012 - DNA, 17 bp, Homo sapiens
acccacagctctgggcc

SEQ ID NO: 692013 - DNA, 18 bp, Homo sapiens
acccacagctctgggcct

SEQ ID NO: 692014 - DNA, 13 bp, Homo sapiens
acccacagggcta

SEQ ID NO: 692015 - DNA, 20 bp, Homo sapiens
acccacaggtgaggggcagg

SEQ ID NO: 692016 - DNA, 14 bp, Homo sapiens
acccacatgctcca

SEQ ID NO: 692017 - DNA, 17 bp, Homo sapiens
acccaccaaactgcaca

SEQ ID NO: 692018 - DNA, 14 bp, Homo sapiens
acccacccagcccc

SEQ ID NO: 692019 - DNA, 15 bp, Homo sapiens
acccaccccagcaca

SEQ ID NO: 692020 - DNA, 13 bp, Homo sapiens
acccacccctgtg

SEQ ID NO: 692021 - DNA, 15 bp, Homo sapiens
acccacccctgtgct

SEQ ID NO: 692022 - DNA, 20 bp, Homo sapiens
acccacccggctggccggga

SEQ ID NO: 692023 - DNA, 21 bp, Homo sapiens
acccaccgatggagcccccag

SEQ ID NO: 692024 - DNA, 22 bp, Homo sapiens
acccaccgtccgccctgctcct

SEQ ID NO: 692025 - DNA, 18 bp, Homo sapiens
acccaccgtctcggccct

SEQ ID NO: 692026 - DNA, 19 bp, Homo sapiens
acccaccgtctcggccctg

SEQ ID NO: 692027 - DNA, 22 bp, Homo sapiens
acccaccgtggaggaggaaggc

SEQ ID NO: 692028 - DNA, 14 bp, Homo sapiens
acccacctccaccc

SEQ ID NO: 692029 - DNA, 15 bp, Homo sapiens
acccacctccctgcc

SEQ ID NO: 692030 - DNA, 20 bp, Homo sapiens
acccacctcctgcggctcag

SEQ ID NO: 692031 - DNA, 22 bp, Homo sapiens
acccacctgctgagagacccaa

SEQ ID NO: 692032 - DNA, 17 bp, Homo sapiens
acccacctggagcccgc

SEQ ID NO: 692033 - DNA, 18 bp, Homo sapiens
acccacctgttttctgaa

SEQ ID NO: 692034 - DNA, 15 bp, Homo sapiens
acccaccttgacgtt

SEQ ID NO: 692035 - DNA, 23 bp, Homo sapiens
acccaccttgttggagcctgcag

SEQ ID NO: 692036 - DNA, 18 bp, Homo sapiens
acccacgattttctccag

SEQ ID NO: 692037 - DNA, 20 bp, Homo sapiens
acccacgattttctccagct

SEQ ID NO: 692038 - DNA, 21 bp, Homo sapiens
acccacgttctcacacccacc

SEQ ID NO: 692039 - DNA, 18 bp, Homo sapiens
acccactatccttcgtga

SEQ ID NO: 692040 - DNA, 14 bp, Homo sapiens
acccactcaccagg

SEQ ID NO: 692041 - DNA, 15 bp, Homo sapiens
acccactcaggattg

SEQ ID NO: 692042 - DNA, 15 bp, Homo sapiens
acccactcggtccca

SEQ ID NO: 692043 - DNA, 13 bp, Homo sapiens
acccactctggtg

SEQ ID NO: 692044 - DNA, 20 bp, Homo sapiens
acccactctggtggccactt

SEQ ID NO: 692045 - DNA, 23 bp, Homo sapiens
acccactctggtggccacttcat

SEQ ID NO: 692046 - DNA, 19 bp, Homo sapiens
acccactgaaatgaccaag

SEQ ID NO: 692047 - DNA, 22 bp, Homo sapiens
acccactgaaatgaccaagaca

SEQ ID NO: 692048 - DNA, 16 bp, Homo sapiens
acccactgccagatgc

SEQ ID NO: 692049 - DNA, 12 bp, Homo sapiens
acccactgcccc

SEQ ID NO: 692050 - DNA, 17 bp, Homo sapiens
acccacttatttttcaa

SEQ ID NO: 692051 - DNA, 12 bp, Homo sapiens
acccacttctgg

SEQ ID NO: 692052 - DNA, 19 bp, Homo sapiens
acccacttctggcctccag

SEQ ID NO: 692053 - DNA, 14 bp, Homo sapiens
acccagaaaggcta

SEQ ID NO: 692054 - DNA, 19 bp, Homo sapiens
acccagacccaactcgcct

SEQ ID NO: 692055 - DNA, 23 bp, Homo sapiens
acccagagaaggacggtgccaag

SEQ ID NO: 692056 - DNA, 14 bp, Homo sapiens
acccagagcacagg

SEQ ID NO: 692057 - DNA, 18 bp, Homo sapiens
acccagagcacaggagct

SEQ ID NO: 692058 - DNA, 24 bp, Homo sapiens
acccagagcattacgtgagccagg

SEQ ID NO: 692059 - DNA, 22 bp, Homo sapiens
acccagaggaaggggccagagg

SEQ ID NO: 692060 - DNA, 20 bp, Homo sapiens
acccagaggccctgaagcct

SEQ ID NO: 692061 - DNA, 23 bp, Homo sapiens
acccagaggctactcttgactta

SEQ ID NO: 692062 - DNA, 16 bp, Homo sapiens
acccagagtcccaggc

SEQ ID NO: 692063 - DNA, 20 bp, Homo sapiens
acccagagtggagtctgagt

SEQ ID NO: 692064 - DNA, 15 bp, Homo sapiens
acccagatcaggaac

SEQ ID NO: 692065 - DNA, 22 bp, Homo sapiens
acccagatcaggaaccagggcc

SEQ ID NO: 692066 - DNA, 18 bp, Homo sapiens
acccagcaccttgcagat

SEQ ID NO: 692067 - DNA, 16 bp, Homo sapiens
acccagcagcagcagc

SEQ ID NO: 692068 - DNA, 19 bp, Homo sapiens
acccagccacgactgccat

SEQ ID NO: 692069 - DNA, 23 bp, Homo sapiens
acccagccactgccaagcttcct

SEQ ID NO: 692070 - DNA, 19 bp, Homo sapiens
acccagccagctgcagggc

SEQ ID NO: 692071 - DNA, 21 bp, Homo sapiens
acccagccagctgcagggcac

SEQ ID NO: 692072 - DNA, 13 bp, Homo sapiens
acccagccatctg

SEQ ID NO: 692073 - DNA, 21 bp, Homo sapiens
acccagccatctgcccagggg

SEQ ID NO: 692074 - DNA, 22 bp, Homo sapiens
acccagcccattctctctcctg

SEQ ID NO: 692075 - DNA, 13 bp, Homo sapiens
acccagcccctgg

SEQ ID NO: 692076 - DNA, 20 bp, Homo sapiens
acccagccccttgagaaacc

SEQ ID NO: 692077 - DNA, 19 bp, Homo sapiens
acccagcccgcggcctgga

SEQ ID NO: 692078 - DNA, 21 bp, Homo sapiens
acccagcccgcggcctggacc

SEQ ID NO: 692079 - DNA, 11 bp, Homo sapiens
acccagcctgg

SEQ ID NO: 692080 - DNA, 17 bp, Homo sapiens
acccagcggccccccgc

SEQ ID NO: 692081 - DNA, 22 bp, Homo sapiens
acccagcggcttagccaagccc

SEQ ID NO: 692082 - DNA, 23 bp, Homo sapiens
acccagcgggcaggttctgcctg

SEQ ID NO: 692083 - DNA, 18 bp, Homo sapiens
acccagctactctgtcca

SEQ ID NO: 692084 - DNA, 19 bp, Homo sapiens
acccagctactctgtccag

SEQ ID NO: 692085 - DNA, 20 bp, Homo sapiens
acccagctactctgtccagg

SEQ ID NO: 692086 - DNA, 16 bp, Homo sapiens
acccagctccaggccc

SEQ ID NO: 692087 - DNA, 17 bp, Homo sapiens
acccagctccaggccca

SEQ ID NO: 692088 - DNA, 14 bp, Homo sapiens
acccagctccaggg

SEQ ID NO: 692089 - DNA, 17 bp, Homo sapiens
acccagctccaggggcc

SEQ ID NO: 692090 - DNA, 13 bp, Homo sapiens
acccagctcctct

SEQ ID NO: 692091 - DNA, 15 bp, Homo sapiens
acccagctcctctga

SEQ ID NO: 692092 - DNA, 17 bp, Homo sapiens
acccagctcctctgagc

SEQ ID NO: 692093 - DNA, 21 bp, Homo sapiens
acccagctcctctgagccata

SEQ ID NO: 692094 - DNA, 22 bp, Homo sapiens
acccagctccttttgtccccag

SEQ ID NO: 692095 - DNA, 19 bp, Homo sapiens
acccagctggtcctgtgga

SEQ ID NO: 692096 - DNA, 19 bp, Homo sapiens
acccagcttagagttcttc

SEQ ID NO: 692097 - DNA, 23 bp, Homo sapiens
acccaggaagggaaagcgggcag

SEQ ID NO: 692098 - DNA, 14 bp, Homo sapiens
acccaggaatagtg

SEQ ID NO: 692099 - DNA, 11 bp, Homo sapiens
acccaggacag

SEQ ID NO: 692100 - DNA, 14 bp, Homo sapiens
acccaggaggtgga

SEQ ID NO: 692101 - DNA, 23 bp, Homo sapiens
acccaggaggtggaggttgcagt

SEQ ID NO: 692102 - DNA, 17 bp, Homo sapiens
acccaggagtgtggcca

SEQ ID NO: 692103 - DNA, 20 bp, Homo sapiens
acccaggcaatcttgccttc

SEQ ID NO: 692104 - DNA, 16 bp, Homo sapiens
acccaggccctccatg

SEQ ID NO: 692105 - DNA, 17 bp, Homo sapiens
acccaggccctccatgg

SEQ ID NO: 692106 - DNA, 19 bp, Homo sapiens
acccaggccctccatgggc

SEQ ID NO: 692107 - DNA, 15 bp, Homo sapiens
acccaggctccgccc

SEQ ID NO: 692108 - DNA, 21 bp, Homo sapiens
acccaggctccgcccttagtc

SEQ ID NO: 692109 - DNA, 21 bp, Homo sapiens
acccaggctctggagccagag

SEQ ID NO: 692110 - DNA, 11 bp, Homo sapiens
acccaggctgc

SEQ ID NO: 692111 - DNA, 14 bp, Homo sapiens
attccaatctctgt

SEQ ID NO: 692112 - DNA, 14 bp, Homo sapiens
attccacaggacac

SEQ ID NO: 692113 - DNA, 15 bp, Homo sapiens
attccaccattcaca

SEQ ID NO: 692114 - DNA, 14 bp, Homo sapiens
attccacgtgcccc

SEQ ID NO: 692115 - DNA, 18 bp, Homo sapiens
attccactgcgttgtcca

SEQ ID NO: 692116 - DNA, 12 bp, Homo sapiens
attccactggac

SEQ ID NO: 692117 - DNA, 18 bp, Homo sapiens
attccagaacaaattgtt

SEQ ID NO: 692118 - DNA, 12 bp, Homo sapiens
attccagaatat

SEQ ID NO: 692119 - DNA, 18 bp, Homo sapiens
attccagaatatctggga

SEQ ID NO: 692120 - DNA, 15 bp, Homo sapiens
attccagaatgctgt

SEQ ID NO: 692121 - DNA, 19 bp, Homo sapiens
attccagaatgctgtacat

SEQ ID NO: 692122 - DNA, 20 bp, Homo sapiens
attccagaatgctgtacatc

SEQ ID NO: 692123 - DNA, 19 bp, Homo sapiens
attccagagagtggctcct

SEQ ID NO: 692124 - DNA, 17 bp, Homo sapiens
attccagaggactctgc

SEQ ID NO: 692125 - DNA, 14 bp, Homo sapiens
attccagcagctgc

SEQ ID NO: 692126 - DNA, 16 bp, Homo sapiens
attccagcagctgcac

SEQ ID NO: 692127 - DNA, 16 bp, Homo sapiens
attccagccaggccca

SEQ ID NO: 692128 - DNA, 17 bp, Homo sapiens
attccagcccctctggt

SEQ ID NO: 692129 - DNA, 15 bp, Homo sapiens
attccagctctgccc

SEQ ID NO: 692130 - DNA, 16 bp, Homo sapiens
attccagctctgcccc

SEQ ID NO: 692131 - DNA, 19 bp, Homo sapiens
attccaggatggtttggaa

SEQ ID NO: 692132 - DNA, 12 bp, Homo sapiens
attccagggctg

SEQ ID NO: 692133 - DNA, 18 bp, Homo sapiens
acccccagcccacagagc

SEQ ID NO: 692134 - DNA, 20 bp, Homo sapiens
acccccagccccgactccag

SEQ ID NO: 692135 - DNA, 21 bp, Homo sapiens
acccccagccccgactccagc

SEQ ID NO: 692136 - DNA, 14 bp, Homo sapiens
acccccagctgact

SEQ ID NO: 692137 - DNA, 13 bp, Homo sapiens
acccccaggcaga

SEQ ID NO: 692138 - DNA, 17 bp, Homo sapiens
acccccagtgtattttg

SEQ ID NO: 692139 - DNA, 15 bp, Homo sapiens
acccccatgctgcct

SEQ ID NO: 692140 - DNA, 15 bp, Homo sapiens
acccccattctcatc

SEQ ID NO: 692141 - DNA, 12 bp, Homo sapiens
accccccacctg

SEQ ID NO: 692142 - DNA, 16 bp, Homo sapiens
accccccagcctccag

SEQ ID NO: 692143 - DNA, 12 bp, Homo sapiens
accccccaggcc

SEQ ID NO: 692144 - DNA, 23 bp, Homo sapiens
acccccccacaaggaaccctcag

SEQ ID NO: 692145 - DNA, 13 bp, Homo sapiens
acccccctcccag

SEQ ID NO: 692146 - DNA, 18 bp, Homo sapiens
acccccctcccagacagg

SEQ ID NO: 692147 - DNA, 14 bp, Homo sapiens
acccccctcctccc

SEQ ID NO: 692148 - DNA, 21 bp, Homo sapiens
acccccctcctccccctttgg

SEQ ID NO: 692149 - DNA, 13 bp, Homo sapiens
acccccctcctgc

SEQ ID NO: 692150 - DNA, 14 bp, Homo sapiens
acccccctcctgct

SEQ ID NO: 692151 - DNA, 23 bp, Homo sapiens
acccccctcctgctcctccctgc

SEQ ID NO: 692152 - DNA, 21 bp, Homo sapiens
acccccctctctttctctggt

SEQ ID NO: 692153 - DNA, 11 bp, Homo sapiens
acccccctctg

SEQ ID NO: 692154 - DNA, 22 bp, Homo sapiens
acccccctgtacacaactcact

SEQ ID NO: 692155 - DNA, 17 bp, Homo sapiens
acccccgacggcctcca

SEQ ID NO: 692156 - DNA, 20 bp, Homo sapiens
acccccgaggggagggcagg

SEQ ID NO: 692157 - DNA, 23 bp, Homo sapiens
acccccgcaccaagcagacaaag

SEQ ID NO: 692158 - DNA, 19 bp, Homo sapiens
acccccgccacctcagggc

SEQ ID NO: 692159 - DNA, 21 bp, Homo sapiens
acccccgccacctcagggcac

SEQ ID NO: 692160 - DNA, 19 bp, Homo sapiens
acccccgccacggccaccc

SEQ ID NO: 692161 - DNA, 21 bp, Homo sapiens
acccccgccacggccaccctc

SEQ ID NO: 692162 - DNA, 23 bp, Homo sapiens
acccccgccacggccaccctcct

SEQ ID NO: 692163 - DNA, 13 bp, Homo sapiens
acccccgccaggc

SEQ ID NO: 692164 - DNA, 13 bp, Homo sapiens
acccccgccccct

SEQ ID NO: 692165 - DNA, 14 bp, Homo sapiens
acccccgccccctg

SEQ ID NO: 692166 - DNA, 20 bp, Homo sapiens
acccccgccccctgccctcc

SEQ ID NO: 692167 - DNA, 13 bp, Homo sapiens
acccccgctggag

SEQ ID NO: 692168 - DNA, 19 bp, Homo sapiens
acccccgtcctcttcgaga

SEQ ID NO: 692169 - DNA, 20 bp, Homo sapiens
accccctaacctctaaccct

SEQ ID NO: 692170 - DNA, 18 bp, Homo sapiens
accccctcatcccccagt

SEQ ID NO: 692171 - DNA, 13 bp, Homo sapiens
accccctcccacc

SEQ ID NO: 692172 - DNA, 16 bp, Homo sapiens
accccctcccaccccc

SEQ ID NO: 692173 - DNA, 20 bp, Homo sapiens
accccctccccgcccctgtg

SEQ ID NO: 692174 - DNA, 15 bp, Homo sapiens
accccctccctggcc

SEQ ID NO: 692175 - DNA, 20 bp, Homo sapiens
accccctccctggcctgttc

SEQ ID NO: 692176 - DNA, 17 bp, Homo sapiens
accccctccctgtccca

SEQ ID NO: 692177 - DNA, 16 bp, Homo sapiens
accccctcctccccca

SEQ ID NO: 692178 - DNA, 13 bp, Homo sapiens
accccctcctggc

SEQ ID NO: 692179 - DNA, 14 bp, Homo sapiens
accccctcctggca

SEQ ID NO: 692180 - DNA, 15 bp, Homo sapiens
accccctcctggcaa

SEQ ID NO: 692181 - DNA, 12 bp, Homo sapiens
accccctccttc

SEQ ID NO: 692182 - DNA, 17 bp, Homo sapiens
accccctccttcagaca

SEQ ID NO: 692183 - DNA, 11 bp, Homo sapiens
accccctcgcc

SEQ ID NO: 692184 - DNA, 16 bp, Homo sapiens
accccctcgccagctt

SEQ ID NO: 692185 - DNA, 15 bp, Homo sapiens
accccctcggagcct

SEQ ID NO: 692186 - DNA, 20 bp, Homo sapiens
accccctcggagcctgtgtt

SEQ ID NO: 692187 - DNA, 19 bp, Homo sapiens
accccctcttcaaagcaga

SEQ ID NO: 692188 - DNA, 23 bp, Homo sapiens
accccctgagatcccctgagccc

SEQ ID NO: 692189 - DNA, 22 bp, Homo sapiens
accccctgcaaagcccagcttg

SEQ ID NO: 692190 - DNA, 14 bp, Homo sapiens
accccctgcaagaa

SEQ ID NO: 692191 - DNA, 14 bp, Homo sapiens
accccctgcccgcc

SEQ ID NO: 692192 - DNA, 13 bp, Homo sapiens
accccctgccctg

SEQ ID NO: 692193 - DNA, 19 bp, Homo sapiens
accccctgggcagatgtcc

SEQ ID NO: 692194 - DNA, 18 bp, Homo sapiens
accccctgttccctgttc

SEQ ID NO: 692195 - DNA, 20 bp, Homo sapiens
acccccttcagtgcccacca

SEQ ID NO: 692196 - DNA, 19 bp, Homo sapiens
acccccttctccatccaca

SEQ ID NO: 692197 - DNA, 14 bp, Homo sapiens
acccccttctctgc

SEQ ID NO: 692198 - DNA, 16 bp, Homo sapiens
acccccttctctgctc

SEQ ID NO: 692199 - DNA, 17 bp, Homo sapiens
acccccttctctgctcc

SEQ ID NO: 692200 - DNA, 16 bp, Homo sapiens
accccctttcccttct

SEQ ID NO: 692201 - DNA, 18 bp, Homo sapiens
accccgaaatcagccccc

SEQ ID NO: 692202 - DNA, 20 bp, Homo sapiens
accccgaaatcagcccccag

SEQ ID NO: 692203 - DNA, 15 bp, Homo sapiens
accccgagaagtgct

SEQ ID NO: 692204 - DNA, 18 bp, Homo sapiens
accccgagggctgaggag

SEQ ID NO: 692205 - DNA, 16 bp, Homo sapiens
accccgcactgcagac

SEQ ID NO: 692206 - DNA, 15 bp, Homo sapiens
accccgcagcccgtg

SEQ ID NO: 692207 - DNA, 17 bp, Homo sapiens
accccgccgttccctgc

SEQ ID NO: 692208 - DNA, 14 bp, Homo sapiens
accccgcctgccct

SEQ ID NO: 692209 - DNA, 14 bp, Homo sapiens
accccgcggcccag

SEQ ID NO: 692210 - DNA, 15 bp, Homo sapiens
accccgcggcccaga

SEQ ID NO: 692211 - DNA, 15 bp, Homo sapiens
accccgcggtgctct

SEQ ID NO: 692212 - DNA, 19 bp, Homo sapiens
accccgcggtgctctggcg

SEQ ID NO: 692213 - DNA, 21 bp, Homo sapiens
accccgcggtgctctggcggc

SEQ ID NO: 692214 - DNA, 18 bp, Homo sapiens
accccgcttttgcagcag

SEQ ID NO: 692215 - DNA, 20 bp, Homo sapiens
accccgcttttgcagcagag

SEQ ID NO: 692216 - DNA, 22 bp, Homo sapiens
accccggaggcgtggaggagag

SEQ ID NO: 692217 - DNA, 17 bp, Homo sapiens
accccgggcccgggccc

SEQ ID NO: 692218 - DNA, 13 bp, Homo sapiens
accccgggccgga

SEQ ID NO: 692219 - DNA, 15 bp, Homo sapiens
accccgggccggacc

SEQ ID NO: 692220 - DNA, 13 bp, Homo sapiens
accccgggctctc

SEQ ID NO: 692221 - DNA, 18 bp, Homo sapiens
accccgggctctctgctg

SEQ ID NO: 692222 - DNA, 24 bp, Homo sapiens
accccggggcatggacagggccag

SEQ ID NO: 692223 - DNA, 20 bp, Homo sapiens
accccggggtgcccacaggc

SEQ ID NO: 692224 - DNA, 20 bp, Homo sapiens
accccgtcgaggggctctca

SEQ ID NO: 692225 - DNA, 16 bp, Homo sapiens
accccgtctctactaa

SEQ ID NO: 692226 - DNA, 13 bp, Homo sapiens
accccgtgcccct

SEQ ID NO: 692227 - DNA, 14 bp, Homo sapiens
accccgtgttcaaa

SEQ ID NO: 692228 - DNA, 17 bp, Homo sapiens
acccctaaactccaggg

SEQ ID NO: 692229 - DNA, 22 bp, Homo sapiens
acccctaaagagatactttgat

SEQ ID NO: 692230 - DNA, 16 bp, Homo sapiens
acccctaagactgcct

SEQ ID NO: 692231 - DNA, 11 bp, Homo sapiens
acccctacccc

SEQ ID NO: 692232 - DNA, 12 bp, Homo sapiens
acccctaccccc

SEQ ID NO: 692233 - DNA, 15 bp, Homo sapiens
acccctaccccctca

SEQ ID NO: 692234 - DNA, 17 bp, Homo sapiens
attcttgtccacattct

SEQ ID NO: 692235 - DNA, 18 bp, Homo sapiens
attcttgtccacattcta

SEQ ID NO: 692236 - DNA, 20 bp, Homo sapiens
attcttgtccacattctact

SEQ ID NO: 692237 - DNA, 21 bp, Homo sapiens
attcttgttgctgtacaaaag

SEQ ID NO: 692238 - DNA, 14 bp, Homo sapiens
attcttgtttgaat

SEQ ID NO: 692239 - DNA, 19 bp, Homo sapiens
attcttgtttgaattcctc

SEQ ID NO: 692240 - DNA, 19 bp, Homo sapiens
attctttaaacaaatatga

SEQ ID NO: 692241 - DNA, 22 bp, Homo sapiens
attctttagagattataacaaa

SEQ ID NO: 692242 - DNA, 21 bp, Homo sapiens
attctttataatcctctgtaa

SEQ ID NO: 692243 - DNA, 15 bp, Homo sapiens
attctttatatctga

SEQ ID NO: 692244 - DNA, 15 bp, Homo sapiens
attctttcacttgat

SEQ ID NO: 692245 - DNA, 15 bp, Homo sapiens
attctttccatttgc

SEQ ID NO: 692246 - DNA, 22 bp, Homo sapiens
attctttccatttgcatttgtt

SEQ ID NO: 692247 - DNA, 15 bp, Homo sapiens
attctttccccagag

SEQ ID NO: 692248 - DNA, 20 bp, Homo sapiens
attctttcccctcagagctc

SEQ ID NO: 692249 - DNA, 12 bp, Homo sapiens
attctttgaaca

SEQ ID NO: 692250 - DNA, 13 bp, Homo sapiens
attctttgttctg

SEQ ID NO: 692251 - DNA, 15 bp, Homo sapiens
attctttgttctgtt

SEQ ID NO: 692252 - DNA, 16 bp, Homo sapiens
attcttttgaattgtt

SEQ ID NO: 692253 - DNA, 21 bp, Homo sapiens
attcttttgatcacattgttt

SEQ ID NO: 692254 - DNA, 16 bp, Homo sapiens
attctttttaaagtat

SEQ ID NO: 692255 - DNA, 16 bp, Homo sapiens
attctttttctttttt

SEQ ID NO: 692256 - DNA, 18 bp, Homo sapiens
attctttttttctgtcag

SEQ ID NO: 692257 - DNA, 14 bp, Homo sapiens
attgaaaaaaaaaa

SEQ ID NO: 692258 - DNA, 19 bp, Homo sapiens
attgaaaaaaaaaatgttg

SEQ ID NO: 692259 - DNA, 18 bp, Homo sapiens
attgaaaacacttagtat

SEQ ID NO: 692260 - DNA, 14 bp, Homo sapiens
attgaaaacttcaa

SEQ ID NO: 692261 - DNA, 19 bp, Homo sapiens
attgaaaacttcaaagctg

SEQ ID NO: 692262 - DNA, 12 bp, Homo sapiens
attgaaaagtac

SEQ ID NO: 692263 - DNA, 13 bp, Homo sapiens
attgaaaatcata

SEQ ID NO: 692264 - DNA, 16 bp, Homo sapiens
attgaaaattgaaaag

SEQ ID NO: 692265 - DNA, 18 bp, Homo sapiens
attgaaactacactaaat

SEQ ID NO: 692266 - DNA, 14 bp, Homo sapiens
attgaaagaactta

SEQ ID NO: 692267 - DNA, 19 bp, Homo sapiens
aaccattataaccttaatt

SEQ ID NO: 692268 - DNA, 14 bp, Homo sapiens
aaccattatacctt

SEQ ID NO: 692269 - DNA, 22 bp, Homo sapiens
aaccattcaaatgacgcctgat

SEQ ID NO: 692270 - DNA, 18 bp, Homo sapiens
aaccattccctagtcatt

SEQ ID NO: 692271 - DNA, 21 bp, Homo sapiens
aaccattccctagtcatttcc

SEQ ID NO: 692272 - DNA, 12 bp, Homo sapiens
aaccattgcttc

SEQ ID NO: 692273 - DNA, 14 bp, Homo sapiens
aaccattggacaga

SEQ ID NO: 692274 - DNA, 11 bp, Homo sapiens
aaccattgtaa

SEQ ID NO: 692275 - DNA, 17 bp, Homo sapiens
aaccatttaaagaaaga

SEQ ID NO: 692276 - DNA, 20 bp, Homo sapiens
aaccattttattttttgggc

SEQ ID NO: 692277 - DNA, 23 bp, Homo sapiens
aacccaaaaagagacccacaata

SEQ ID NO: 692278 - DNA, 19 bp, Homo sapiens
aacccaagcaacatttgta

SEQ ID NO: 692279 - DNA, 13 bp, Homo sapiens
aacccaagctcct

SEQ ID NO: 692280 - DNA, 16 bp, Homo sapiens
aacccaagctcctcct

SEQ ID NO: 692281 - DNA, 17 bp, Homo sapiens
aacccaagctctgggga

SEQ ID NO: 692282 - DNA, 16 bp, Homo sapiens
aacccaaggagcacag

SEQ ID NO: 692283 - DNA, 15 bp, Homo sapiens
aacccaagtgcctca

SEQ ID NO: 692284 - DNA, 15 bp, Homo sapiens
aacccaatccctctc

SEQ ID NO: 692285 - DNA, 19 bp, Homo sapiens
aacccaatgacttccctgc

SEQ ID NO: 692286 - DNA, 13 bp, Homo sapiens
aacccacacctgg

SEQ ID NO: 692287 - DNA, 22 bp, Homo sapiens
aacccacagacctcacacctgg

SEQ ID NO: 692288 - DNA, 22 bp, Homo sapiens
aacccaccttgttggagcctgc

SEQ ID NO: 692289 - DNA, 16 bp, Homo sapiens
aacccacttctggcct

SEQ ID NO: 692290 - DNA, 12 bp, Homo sapiens
aacccagagagg

SEQ ID NO: 692291 - DNA, 21 bp, Homo sapiens
aacccagcggcttagccaagc

SEQ ID NO: 692292 - DNA, 16 bp, Homo sapiens
aacccaggacgcttct

SEQ ID NO: 692293 - DNA, 18 bp, Homo sapiens
aacccaggacgcttctga

SEQ ID NO: 692294 - DNA, 22 bp, Homo sapiens
aacccagggcaacaagcccgtt

SEQ ID NO: 692295 - DNA, 19 bp, Homo sapiens
aacccagggctctgcccca

SEQ ID NO: 692296 - DNA, 20 bp, Homo sapiens
aacccagggctctgccccag

SEQ ID NO: 692297 - DNA, 15 bp, Homo sapiens
aacccagggtggaga

SEQ ID NO: 692298 - DNA, 21 bp, Homo sapiens
aacccagttacttttttacac

SEQ ID NO: 692299 - DNA, 18 bp, Homo sapiens
aacccatacaatgtatgt

SEQ ID NO: 692300 - DNA, 23 bp, Homo sapiens
aacccatacaatgtatgtacaat

SEQ ID NO: 692301 - DNA, 17 bp, Homo sapiens
aacccatattgtaaaac

SEQ ID NO: 692302 - DNA, 21 bp, Homo sapiens
aacccatattgtaaaacaggt

SEQ ID NO: 692303 - DNA, 17 bp, Homo sapiens
aacccatcagaaggaga

SEQ ID NO: 692304 - DNA, 19 bp, Homo sapiens
aacccatcagaaggagaag

SEQ ID NO: 692305 - DNA, 15 bp, Homo sapiens
aacccatgagattca

SEQ ID NO: 692306 - DNA, 23 bp, Homo sapiens
aacccattccagtacagtattct

SEQ ID NO: 692307 - DNA, 16 bp, Homo sapiens
aaccccacccagctcc

SEQ ID NO: 692308 - DNA, 15 bp, Homo sapiens
aaccccagacactgg

SEQ ID NO: 692309 - DNA, 14 bp, Homo sapiens
aaccccagcatcct

SEQ ID NO: 692310 - DNA, 12 bp, Homo sapiens
aaccccagcctg

SEQ ID NO: 692311 - DNA, 13 bp, Homo sapiens
aaccccagcctga

SEQ ID NO: 692312 - DNA, 15 bp, Homo sapiens
aaccccagcctgacc

SEQ ID NO: 692313 - DNA, 17 bp, Homo sapiens
aaccccatgtcctcagc

SEQ ID NO: 692314 - DNA, 11 bp, Homo sapiens
aacccccaccc

SEQ ID NO: 692315 - DNA, 13 bp, Homo sapiens
aacccccacccca

SEQ ID NO: 692316 - DNA, 17 bp, Homo sapiens
aacccccagaggtggcc

SEQ ID NO: 692317 - DNA, 20 bp, Homo sapiens
aacccccagaggtggccctt

SEQ ID NO: 692318 - DNA, 23 bp, Homo sapiens
aacccccctcccagacaggccct

SEQ ID NO: 692319 - DNA, 12 bp, Homo sapiens
aacccccctcct

SEQ ID NO: 692320 - DNA, 15 bp, Homo sapiens
aacccccctcctgct

SEQ ID NO: 692321 - DNA, 16 bp, Homo sapiens
aacccccctcctgctc

SEQ ID NO: 692322 - DNA, 20 bp, Homo sapiens
aacccccctcctgctcctcc

SEQ ID NO: 692323 - DNA, 22 bp, Homo sapiens
aacccccctcctgctcctccct

SEQ ID NO: 692324 - DNA, 12 bp, Homo sapiens
aaccccctgcaa

SEQ ID NO: 692325 - DNA, 13 bp, Homo sapiens
aaccccctgccca

SEQ ID NO: 692326 - DNA, 16 bp, Homo sapiens
aaccccgcggcccaga

SEQ ID NO: 692327 - DNA, 21 bp, Homo sapiens
aaccccgcggtgctctggcgg

SEQ ID NO: 692328 - DNA, 15 bp, Homo sapiens
aaccccgggatgcaa

SEQ ID NO: 692329 - DNA, 22 bp, Homo sapiens
aaccccgggcccgggcccccgc

SEQ ID NO: 692330 - DNA, 22 bp, Homo sapiens
aaccccgtcgaggggctctcag

SEQ ID NO: 692331 - DNA, 21 bp, Homo sapiens
aacccctacatgaaacagaaa

SEQ ID NO: 692332 - DNA, 19 bp, Homo sapiens
aacccctagaaaggagaga

SEQ ID NO: 692333 - DNA, 15 bp, Homo sapiens
aacccctcctggcct

SEQ ID NO: 692334 - DNA, 13 bp, Homo sapiens
aacccctgtaccc

SEQ ID NO: 692335 - DNA, 11 bp, Homo sapiens
aacccctgtgt

SEQ ID NO: 692336 - DNA, 17 bp, Homo sapiens
aacccgtccattcagaa

SEQ ID NO: 692337 - DNA, 19 bp, Homo sapiens
aacccgtccattcagaaag

SEQ ID NO: 692338 - DNA, 16 bp, Homo sapiens
aacccgtttcccggtt

SEQ ID NO: 692339 - DNA, 18 bp, Homo sapiens
aaccctaattttgtacat

SEQ ID NO: 692340 - DNA, 17 bp, Homo sapiens
aaccctacaaagagcct

SEQ ID NO: 692341 - DNA, 17 bp, Homo sapiens
aaccctaggttccctgt

SEQ ID NO: 692342 - DNA, 16 bp, Homo sapiens
aaccctatctcctgac

SEQ ID NO: 692343 - DNA, 19 bp, Homo sapiens
aaccctatctcctgacaga

SEQ ID NO: 692344 - DNA, 23 bp, Homo sapiens
aaccctatctcctgacagaaggt

SEQ ID NO: 692345 - DNA, 20 bp, Homo sapiens
aaccctattcattagcatta

SEQ ID NO: 692346 - DNA, 20 bp, Homo sapiens
aaccctcaggccaccctcca

SEQ ID NO: 692347 - DNA, 23 bp, Homo sapiens
aaccctcattgctgtcttgcccc

SEQ ID NO: 692348 - DNA, 21 bp, Homo sapiens
aaccctcccagaaacatctct

SEQ ID NO: 692349 - DNA, 16 bp, Homo sapiens
aaccctccctcagccc

SEQ ID NO: 692350 - DNA, 21 bp, Homo sapiens
aaccctccctcagcccctctt

SEQ ID NO: 692351 - DNA, 20 bp, Homo sapiens
aggtctcctcagggtggggg

SEQ ID NO: 692352 - DNA, 15 bp, Homo sapiens
aggtctcgtcccagc

SEQ ID NO: 692353 - DNA, 15 bp, Homo sapiens
aggtctctgccggct

SEQ ID NO: 692354 - DNA, 16 bp, Homo sapiens
aggtctctgccggctc

SEQ ID NO: 692355 - DNA, 19 bp, Homo sapiens
aggtctcttctcccagaat

SEQ ID NO: 692356 - DNA, 15 bp, Homo sapiens
aggtctcttgaggga

SEQ ID NO: 692357 - DNA, 15 bp, Homo sapiens
aggtctgaatctgcg

SEQ ID NO: 692358 - DNA, 19 bp, Homo sapiens
aggtctgcaagggcccaga

SEQ ID NO: 692359 - DNA, 22 bp, Homo sapiens
aggtctgcaagggcccagagtg

SEQ ID NO: 692360 - DNA, 22 bp, Homo sapiens
aggtctggagaagctcccagga

SEQ ID NO: 692361 - DNA, 14 bp, Homo sapiens
aggtctgggcaagt

SEQ ID NO: 692362 - DNA, 18 bp, Homo sapiens
aggtctgtaactgcccag

SEQ ID NO: 692363 - DNA, 14 bp, Homo sapiens
aggtcttaaagtag

SEQ ID NO: 692364 - DNA, 18 bp, Homo sapiens
aggtcttatctgttcagt

SEQ ID NO: 692365 - DNA, 23 bp, Homo sapiens
aggtcttcatatttttgatcatc

SEQ ID NO: 692366 - DNA, 13 bp, Homo sapiens
aggtcttcctgct

SEQ ID NO: 692367 - DNA, 17 bp, Homo sapiens
aggtcttcttgtgtcct

SEQ ID NO: 692368 - DNA, 21 bp, Homo sapiens
aggtcttcttgtgtcctgatg

SEQ ID NO: 692369 - DNA, 19 bp, Homo sapiens
aggtcttgactcatggcag

SEQ ID NO: 692370 - DNA, 23 bp, Homo sapiens
aggtcttgactcatggcagctgt

SEQ ID NO: 692371 - DNA, 18 bp, Homo sapiens
aggtcttgcagtggcttt

SEQ ID NO: 692372 - DNA, 18 bp, Homo sapiens
aggtctttcagtactttt

SEQ ID NO: 692373 - DNA, 11 bp, Homo sapiens
aggtctttcct

SEQ ID NO: 692374 - DNA, 18 bp, Homo sapiens
aggtctttctcctcagga

SEQ ID NO: 692375 - DNA, 21 bp, Homo sapiens
aggtctttctcctcaggacaa

SEQ ID NO: 692376 - DNA, 14 bp, Homo sapiens
aggtctttctctca

SEQ ID NO: 692377 - DNA, 18 bp, Homo sapiens
aggtctttggttcagcta

SEQ ID NO: 692378 - DNA, 17 bp, Homo sapiens
aggtctttgttatgaca

SEQ ID NO: 692379 - DNA, 21 bp, Homo sapiens
aggtcttttctttgggaccct

SEQ ID NO: 692380 - DNA, 21 bp, Homo sapiens
aggtcttttgacatgtggaaa

SEQ ID NO: 692381 - DNA, 22 bp, Homo sapiens
aggtgaaacgactcaaaatgac

SEQ ID NO: 692382 - DNA, 19 bp, Homo sapiens
aggtgaaactccagatgcc

SEQ ID NO: 692383 - DNA, 21 bp, Homo sapiens
aggtgaaactccagatgccac

SEQ ID NO: 692384 - DNA, 22 bp, Homo sapiens
aggtgaaactccagatgccaca

SEQ ID NO: 692385 - DNA, 16 bp, Homo sapiens
aggtgaaagggagcta

SEQ ID NO: 692386 - DNA, 21 bp, Homo sapiens
aggtgaaagggagctatcagg

SEQ ID NO: 692387 - DNA, 14 bp, Homo sapiens
aggtgaaggaatat

SEQ ID NO: 692388 - DNA, 13 bp, Homo sapiens
aaccttgcctggt

SEQ ID NO: 692389 - DNA, 19 bp, Homo sapiens
aaccttgcctggtacagta

SEQ ID NO: 692390 - DNA, 11 bp, Homo sapiens
aaccttgctgt

SEQ ID NO: 692391 - DNA, 13 bp, Homo sapiens
aaccttgctgtcc

SEQ ID NO: 692392 - DNA, 16 bp, Homo sapiens
aaccttgctgtcctga

SEQ ID NO: 692393 - DNA, 15 bp, Homo sapiens
aaccttggaccactc

SEQ ID NO: 692394 - DNA, 22 bp, Homo sapiens
aaccttggaccactcctgtccc

SEQ ID NO: 692395 - DNA, 21 bp, Homo sapiens
aaccttgtaaaaaaagcaaaa

SEQ ID NO: 692396 - DNA, 16 bp, Homo sapiens
aaccttgttctatttt

SEQ ID NO: 692397 - DNA, 17 bp, Homo sapiens
aaccttgttctattttt

SEQ ID NO: 692398 - DNA, 20 bp, Homo sapiens
aaccttgttctatttttcaa

SEQ ID NO: 692399 - DNA, 23 bp, Homo sapiens
aaccttgttctatttttcaatca

SEQ ID NO: 692400 - DNA, 18 bp, Homo sapiens
aaccttgtttattaaatt

SEQ ID NO: 692401 - DNA, 19 bp, Homo sapiens
aacctttacatgaggactc

SEQ ID NO: 692402 - DNA, 20 bp, Homo sapiens
aacctttagaatatcttttc

SEQ ID NO: 692403 - DNA, 15 bp, Homo sapiens
aacctttagggcagc

SEQ ID NO: 692404 - DNA, 19 bp, Homo sapiens
aacctttagggcagcttgc

SEQ ID NO: 692405 - DNA, 18 bp, Homo sapiens
aacctttcaaatttcaca

SEQ ID NO: 692406 - DNA, 11 bp, Homo sapiens
aacctttccct

SEQ ID NO: 692407 - DNA, 13 bp, Homo sapiens
aacctttccctca

SEQ ID NO: 692408 - DNA, 22 bp, Homo sapiens
aacctttccctcaccccctccc

SEQ ID NO: 692409 - DNA, 15 bp, Homo sapiens
aacctttctggcctg

SEQ ID NO: 692410 - DNA, 16 bp, Homo sapiens
aacctttctggcctgt

SEQ ID NO: 692411 - DNA, 16 bp, Homo sapiens
aacctttcttcaccaa

SEQ ID NO: 692412 - DNA, 13 bp, Homo sapiens
aaccttttcttgt

SEQ ID NO: 692413 - DNA, 22 bp, Homo sapiens
aaccttttcttgtatctggatt

SEQ ID NO: 692414 - DNA, 11 bp, Homo sapiens
aacctttttct

SEQ ID NO: 692415 - DNA, 22 bp, Homo sapiens
aacctttttcttgatcttaaag

SEQ ID NO: 692416 - DNA, 13 bp, Homo sapiens
aacctttttgtaa

SEQ ID NO: 692417 - DNA, 19 bp, Homo sapiens
aaccttttttgtcttattg

SEQ ID NO: 692418 - DNA, 15 bp, Homo sapiens
aacctttttttttga

SEQ ID NO: 692419 - DNA, 15 bp, Homo sapiens
aacgaaaaggacaga

SEQ ID NO: 692420 - DNA, 18 bp, Homo sapiens
aacgaacccctagaaagg

SEQ ID NO: 692421 - DNA, 14 bp, Homo sapiens
aacgacaatagctt

SEQ ID NO: 692422 - DNA, 14 bp, Homo sapiens
aacgactcaaaatg

SEQ ID NO: 692423 - DNA, 19 bp, Homo sapiens
aacgactgtatattgctaa

SEQ ID NO: 692424 - DNA, 15 bp, Homo sapiens
aacgagacacattgc

SEQ ID NO: 692425 - DNA, 16 bp, Homo sapiens
aacgagactttccatt

SEQ ID NO: 692426 - DNA, 18 bp, Homo sapiens
aacgagcactggccagag

SEQ ID NO: 692427 - DNA, 14 bp, Homo sapiens
aacgagcctcctca

SEQ ID NO: 692428 - DNA, 23 bp, Homo sapiens
aacgatacaaatttggccttaag

SEQ ID NO: 692429 - DNA, 15 bp, Homo sapiens
aacgatccttcaaag

SEQ ID NO: 692430 - DNA, 14 bp, Homo sapiens
aacgcacttacaag

SEQ ID NO: 692431 - DNA, 13 bp, Homo sapiens
aacgcatggagtg

SEQ ID NO: 692432 - DNA, 22 bp, Homo sapiens
aacgcatggagtgtgtattgtt

SEQ ID NO: 692433 - DNA, 17 bp, Homo sapiens
aacgcattaagaggttt

SEQ ID NO: 692434 - DNA, 15 bp, Homo sapiens
aacgcattgccacgg

SEQ ID NO: 692435 - DNA, 13 bp, Homo sapiens
aacgccagtctcc

SEQ ID NO: 692436 - DNA, 17 bp, Homo sapiens
aacgccagtctcccagg

SEQ ID NO: 692437 - DNA, 20 bp, Homo sapiens
aacgccagtctcccaggccc

SEQ ID NO: 692438 - DNA, 21 bp, Homo sapiens
aacgcccctccaaacctccag

SEQ ID NO: 692439 - DNA, 22 bp, Homo sapiens
aacgcctcttttccctctctag

SEQ ID NO: 692440 - DNA, 15 bp, Homo sapiens
aacgcgtctgcctgg

SEQ ID NO: 692441 - DNA, 16 bp, Homo sapiens
aacgcgtctgcctggg

SEQ ID NO: 692442 - DNA, 14 bp, Homo sapiens
aacgctcctttgtg

SEQ ID NO: 692443 - DNA, 17 bp, Homo sapiens
aacggaaatgtgtggtc

SEQ ID NO: 692444 - DNA, 17 bp, Homo sapiens
aacggaacgttggactt

SEQ ID NO: 692445 - DNA, 14 bp, Homo sapiens
aacggaagggttgg

SEQ ID NO: 692446 - DNA, 23 bp, Homo sapiens
aacggaagggttggtgggctggc

SEQ ID NO: 692447 - DNA, 17 bp, Homo sapiens
aacggatgagttattat

SEQ ID NO: 692448 - DNA, 18 bp, Homo sapiens
aacggcaacgtagcctgg

SEQ ID NO: 692449 - DNA, 19 bp, Homo sapiens
aacggccctgcagccagct

SEQ ID NO: 692450 - DNA, 20 bp, Homo sapiens
aacggccctgcaggagcagg

SEQ ID NO: 692451 - DNA, 13 bp, Homo sapiens
aacgggcagccac

SEQ ID NO: 692452 - DNA, 14 bp, Homo sapiens
aacgggcagccaca

SEQ ID NO: 692453 - DNA, 15 bp, Homo sapiens
aacgggcagccacag

SEQ ID NO: 692454 - DNA, 16 bp, Homo sapiens
aacgggcagccacagg

SEQ ID NO: 692455 - DNA, 17 bp, Homo sapiens
aacgggcagtctgctct

SEQ ID NO: 692456 - DNA, 21 bp, Homo sapiens
aacgggcagtctgctctgctg

SEQ ID NO: 692457 - DNA, 16 bp, Homo sapiens
aacgggctccttcccc

SEQ ID NO: 692458 - DNA, 12 bp, Homo sapiens
aacggggtgggg

SEQ ID NO: 692459 - DNA, 14 bp, Homo sapiens
aacggggtggggag

SEQ ID NO: 692460 - DNA, 16 bp, Homo sapiens
aacggggtggggaggg

SEQ ID NO: 692461 - DNA, 17 bp, Homo sapiens
aacggggtggggagggt

SEQ ID NO: 692462 - DNA, 17 bp, Homo sapiens
aacggtaaatttctgtg

SEQ ID NO: 692463 - DNA, 20 bp, Homo sapiens
aacggtatcctccctgccca

SEQ ID NO: 692464 - DNA, 19 bp, Homo sapiens
aacggtgcccatcctgcca

SEQ ID NO: 692465 - DNA, 14 bp, Homo sapiens
aacggttcagtttc

SEQ ID NO: 692466 - DNA, 13 bp, Homo sapiens
aacgtatttctcc

SEQ ID NO: 692467 - DNA, 17 bp, Homo sapiens
aacgtatttctccagac

SEQ ID NO: 692468 - DNA, 19 bp, Homo sapiens
aacgtccactagcttactg

SEQ ID NO: 692469 - DNA, 22 bp, Homo sapiens
aacgtccttccttgactgtcta

SEQ ID NO: 692470 - DNA, 16 bp, Homo sapiens
aacgtctattttgtat

SEQ ID NO: 692471 - DNA, 15 bp, Homo sapiens
aacgtgcccccagag

SEQ ID NO: 692472 - DNA, 16 bp, Homo sapiens
aacgtgcccccagagt

SEQ ID NO: 692473 - DNA, 21 bp, Homo sapiens
aacgtggattttaaaaaatca

SEQ ID NO: 692474 - DNA, 20 bp, Homo sapiens
aacgtggcttgtagaatttt

SEQ ID NO: 692475 - DNA, 18 bp, Homo sapiens
aacgtgggagttcagctg

SEQ ID NO: 692476 - DNA, 17 bp, Homo sapiens
aacgtgtatagtgccta

SEQ ID NO: 692477 - DNA, 16 bp, Homo sapiens
aacgtgttcaatattt

SEQ ID NO: 692478 - DNA, 19 bp, Homo sapiens
aacgtgttgccttgaacca

SEQ ID NO: 692479 - DNA, 17 bp, Homo sapiens
aacgttactcagggctc

SEQ ID NO: 692480 - DNA, 20 bp, Homo sapiens
aacgttactcagggctcctc

SEQ ID NO: 692481 - DNA, 14 bp, Homo sapiens
aacgttgctcccca

SEQ ID NO: 692482 - DNA, 20 bp, Homo sapiens
aacgtttaagccaaaacaat

SEQ ID NO: 692483 - DNA, 16 bp, Homo sapiens
aggttctcatttctca

SEQ ID NO: 692484 - DNA, 23 bp, Homo sapiens
aggttctcatttctcaggtgacg

SEQ ID NO: 692485 - DNA, 21 bp, Homo sapiens
aggttctccaacatcacagcc

SEQ ID NO: 692486 - DNA, 19 bp, Homo sapiens
aggttctccgttagctcct

SEQ ID NO: 692487 - DNA, 12 bp, Homo sapiens
aggttctgccct

SEQ ID NO: 692488 - DNA, 17 bp, Homo sapiens
aggttctgcctgctttg

SEQ ID NO: 692489 - DNA, 16 bp, Homo sapiens
aggttctgggcctctg

SEQ ID NO: 692490 - DNA, 17 bp, Homo sapiens
aggttcttagtgtcact

SEQ ID NO: 692491 - DNA, 15 bp, Homo sapiens
aggttcttcagaagt

SEQ ID NO: 692492 - DNA, 19 bp, Homo sapiens
aggttcttcccttttacat

SEQ ID NO: 692493 - DNA, 16 bp, Homo sapiens
aggttcttcttcctga

SEQ ID NO: 692494 - DNA, 17 bp, Homo sapiens
aggttcttgttggtgca

SEQ ID NO: 692495 - DNA, 15 bp, Homo sapiens
aggttgaactatgaa

SEQ ID NO: 692496 - DNA, 23 bp, Homo sapiens
aggttgaactatgaacactgtca

SEQ ID NO: 692497 - DNA, 15 bp, Homo sapiens
aggttgaagccaagt

SEQ ID NO: 692498 - DNA, 15 bp, Homo sapiens
aggttgacctgtttc

SEQ ID NO: 692499 - DNA, 20 bp, Homo sapiens
aggttgagcaatttccccct

SEQ ID NO: 692500 - DNA, 22 bp, Homo sapiens
aggttgaggaaaagactgtggg

SEQ ID NO: 692501 - DNA, 18 bp, Homo sapiens
aggttgagtgagccggga

SEQ ID NO: 692502 - DNA, 11 bp, Homo sapiens
aggttgcagta

SEQ ID NO: 692503 - DNA, 19 bp, Homo sapiens
aggttgcagtgagctgaga

SEQ ID NO: 692504 - DNA, 12 bp, Homo sapiens
aggttgcagtgc

SEQ ID NO: 692505 - DNA, 17 bp, Homo sapiens
aggttgcctgaaaaatg

SEQ ID NO: 692506 - DNA, 16 bp, Homo sapiens
aggttggacagccccc

SEQ ID NO: 692507 - DNA, 15 bp, Homo sapiens
aggttggagcccagg

SEQ ID NO: 692508 - DNA, 16 bp, Homo sapiens
aggttggagcccaggg

SEQ ID NO: 692509 - DNA, 15 bp, Homo sapiens
aggttggatggatgg

SEQ ID NO: 692510 - DNA, 21 bp, Homo sapiens
aggttggcgtgccctggaggc

SEQ ID NO: 692511 - DNA, 19 bp, Homo sapiens
aactccgcccagcctctcc

SEQ ID NO: 692512 - DNA, 17 bp, Homo sapiens
aactccgtgtgcctggg

SEQ ID NO: 692513 - DNA, 13 bp, Homo sapiens
aactcctgccagg

SEQ ID NO: 692514 - DNA, 22 bp, Homo sapiens
aactcctgtgtcggtcagaaca

SEQ ID NO: 692515 - DNA, 17 bp, Homo sapiens
aactccttattttgtat

SEQ ID NO: 692516 - DNA, 14 bp, Homo sapiens
aactccttcctggc

SEQ ID NO: 692517 - DNA, 18 bp, Homo sapiens
aactcctttactgcagcc

SEQ ID NO: 692518 - DNA, 21 bp, Homo sapiens
aactcctttagcaggtggtcc

SEQ ID NO: 692519 - DNA, 22 bp, Homo sapiens
aactcgcttaggtagaaactat

SEQ ID NO: 692520 - DNA, 15 bp, Homo sapiens
aactcgttttttaca

SEQ ID NO: 692521 - DNA, 22 bp, Homo sapiens
aactctaaagccaagcacttta

SEQ ID NO: 692522 - DNA, 21 bp, Homo sapiens
aactctaattcccattttgca

SEQ ID NO: 692523 - DNA, 14 bp, Homo sapiens
aactctacccctgc

SEQ ID NO: 692524 - DNA, 17 bp, Homo sapiens
aactctacccctgctcc

SEQ ID NO: 692525 - DNA, 18 bp, Homo sapiens
aactctacccctgctccc

SEQ ID NO: 692526 - DNA, 20 bp, Homo sapiens
aactctagggatataaaaac

SEQ ID NO: 692527 - DNA, 17 bp, Homo sapiens
aactctatcagcattgt

SEQ ID NO: 692528 - DNA, 13 bp, Homo sapiens
aactctccccagt

SEQ ID NO: 692529 - DNA, 20 bp, Homo sapiens
aactctccccagtgcctgcc

SEQ ID NO: 692530 - DNA, 17 bp, Homo sapiens
aactctctagcttaagt

SEQ ID NO: 692531 - DNA, 21 bp, Homo sapiens
aactctctgtcttctctccac

SEQ ID NO: 692532 - DNA, 10 bp, Homo sapiens
aactctcttt

SEQ ID NO: 692533 - DNA, 16 bp, Homo sapiens
aactctctttccttga

SEQ ID NO: 692534 - DNA, 23 bp, Homo sapiens
aactctgaagctaattgtactaa

SEQ ID NO: 692535 - DNA, 13 bp, Homo sapiens
aactctgagccca

SEQ ID NO: 692536 - DNA, 10 bp, Homo sapiens
aactctgcaa

SEQ ID NO: 692537 - DNA, 15 bp, Homo sapiens
aactctgcactactc

SEQ ID NO: 692538 - DNA, 15 bp, Homo sapiens
aactctgcccaccct

SEQ ID NO: 692539 - DNA, 16 bp, Homo sapiens
aactctgcttgatttt

SEQ ID NO: 692540 - DNA, 16 bp, Homo sapiens
aactctggacactcta

SEQ ID NO: 692541 - DNA, 19 bp, Homo sapiens
aactctggacactctatat

SEQ ID NO: 692542 - DNA, 16 bp, Homo sapiens
aactctggattttgaa

SEQ ID NO: 692543 - DNA, 17 bp, Homo sapiens
aactctggattttgaat

SEQ ID NO: 692544 - DNA, 17 bp, Homo sapiens
aactctggctcagcctg

SEQ ID NO: 692545 - DNA, 22 bp, Homo sapiens
aactctggctcagcctgtctcg

SEQ ID NO: 692546 - DNA, 18 bp, Homo sapiens
aactctggcttccaggta

SEQ ID NO: 692547 - DNA, 20 bp, Homo sapiens
aactctggcttccaggtatc

SEQ ID NO: 692548 - DNA, 15 bp, Homo sapiens
aactctggcttttgg

SEQ ID NO: 692549 - DNA, 22 bp, Homo sapiens
aactctggtgataaaaataaag

SEQ ID NO: 692550 - DNA, 23 bp, Homo sapiens
aactctggtgataaaaataaagc

SEQ ID NO: 692551 - DNA, 16 bp, Homo sapiens
aactctgtataataga

SEQ ID NO: 692552 - DNA, 18 bp, Homo sapiens
aactctgtataatagaga

SEQ ID NO: 692553 - DNA, 22 bp, Homo sapiens
aactctgttacactttttggaa

SEQ ID NO: 692554 - DNA, 23 bp, Homo sapiens
aactctgttacactttttggaag

SEQ ID NO: 692555 - DNA, 14 bp, Homo sapiens
aactctgttccccc

SEQ ID NO: 692556 - DNA, 18 bp, Homo sapiens
aactctgttcccccaccc

SEQ ID NO: 692557 - DNA, 17 bp, Homo sapiens
aactcttaaatactttt

SEQ ID NO: 692558 - DNA, 16 bp, Homo sapiens
aactcttaatctgtgt

SEQ ID NO: 692559 - DNA, 20 bp, Homo sapiens
aactcttaattagacctagg

SEQ ID NO: 692560 - DNA, 19 bp, Homo sapiens
aactcttaggcacatcaat

SEQ ID NO: 692561 - DNA, 22 bp, Homo sapiens
aactcttataaatttctatttt

SEQ ID NO: 692562 - DNA, 13 bp, Homo sapiens
aactcttcagaac

SEQ ID NO: 692563 - DNA, 13 bp, Homo sapiens
aactcttcagtgc

SEQ ID NO: 692564 - DNA, 16 bp, Homo sapiens
aactcttcctcccctc

SEQ ID NO: 692565 - DNA, 17 bp, Homo sapiens
aactcttgattatccat

SEQ ID NO: 692566 - DNA, 18 bp, Homo sapiens
aactctttcattcttctc

SEQ ID NO: 692567 - DNA, 19 bp, Homo sapiens
aactctttcattcttctca

SEQ ID NO: 692568 - DNA, 14 bp, Homo sapiens
aactctttgagaaa

SEQ ID NO: 692569 - DNA, 19 bp, Homo sapiens
aactctttgttatttgaaa

SEQ ID NO: 692570 - DNA, 12 bp, Homo sapiens
aactgaaaagac

SEQ ID NO: 692571 - DNA, 20 bp, Homo sapiens
aactgaaaagactcagtgtt

SEQ ID NO: 692572 - DNA, 13 bp, Homo sapiens
aactgaaaatgta

SEQ ID NO: 692573 - DNA, 16 bp, Homo sapiens
aactgaaacatgctta

SEQ ID NO: 692574 - DNA, 14 bp, Homo sapiens
aactgaaagtgttt

SEQ ID NO: 692575 - DNA, 21 bp, Homo sapiens
aactgaaagtgttttactctt

SEQ ID NO: 692576 - DNA, 21 bp, Homo sapiens
aactgaaataaacctgcactg

SEQ ID NO: 692577 - DNA, 21 bp, Homo sapiens
aactgaacaccattgaaggct

SEQ ID NO: 692578 - DNA, 21 bp, Homo sapiens
aactgaacgaccttacaaatg

SEQ ID NO: 692579 - DNA, 18 bp, Homo sapiens
aactgaagagtaatcaat

SEQ ID NO: 692580 - DNA, 20 bp, Homo sapiens
aactgaagcagcctctcccc

SEQ ID NO: 692581 - DNA, 21 bp, Homo sapiens
aactgaagcagcctctcccca

SEQ ID NO: 692582 - DNA, 14 bp, Homo sapiens
aactgaagccactt

SEQ ID NO: 692583 - DNA, 21 bp, Homo sapiens
aactgaagccacttggcccag

SEQ ID NO: 692584 - DNA, 13 bp, Homo sapiens
aactgaagccaga

SEQ ID NO: 692585 - DNA, 10 bp, Homo sapiens
aactgaaggg

SEQ ID NO: 692586 - DNA, 19 bp, Homo sapiens
aactgaaggggtgcaccca

SEQ ID NO: 692587 - DNA, 23 bp, Homo sapiens
aactgaaggggtgcacccacctg

SEQ ID NO: 692588 - DNA, 13 bp, Homo sapiens
aactgaataccac

SEQ ID NO: 692589 - DNA, 15 bp, Homo sapiens
aactgaataccactc

SEQ ID NO: 692590 - DNA, 17 bp, Homo sapiens
aactgaataccactctg

SEQ ID NO: 692591 - DNA, 14 bp, Homo sapiens
aactgaatattttg

SEQ ID NO: 692592 - DNA, 15 bp, Homo sapiens
aactgaatattttgg

SEQ ID NO: 692593 - DNA, 17 bp, Homo sapiens
aactgaatattttggaa

SEQ ID NO: 692594 - DNA, 23 bp, Homo sapiens
aactgaatattttggaaactgct

SEQ ID NO: 692595 - DNA, 17 bp, Homo sapiens
aactgaatctatggctt

SEQ ID NO: 692596 - DNA, 22 bp, Homo sapiens
aactgaatggaaggtttgtata

SEQ ID NO: 692597 - DNA, 14 bp, Homo sapiens
aactgaatttggag

SEQ ID NO: 692598 - DNA, 19 bp, Homo sapiens
aactgacaaaggagccttg

SEQ ID NO: 692599 - DNA, 16 bp, Homo sapiens
aactgacaagccatct

SEQ ID NO: 692600 - DNA, 23 bp, Homo sapiens
aactgacctgagcggcaccctgg

SEQ ID NO: 692601 - DNA, 15 bp, Homo sapiens
aactgacgctggaga

SEQ ID NO: 692602 - DNA, 18 bp, Homo sapiens
aactgagctcctctgggc

SEQ ID NO: 692603 - DNA, 22 bp, Homo sapiens
aactgagctcctctgggcagga

SEQ ID NO: 692604 - DNA, 18 bp, Homo sapiens
aactgagctcgcagcccc

SEQ ID NO: 692605 - DNA, 16 bp, Homo sapiens
aactgaggaattttct

SEQ ID NO: 692606 - DNA, 20 bp, Homo sapiens
aactgaggaattttctttgt

SEQ ID NO: 692607 - DNA, 11 bp, Homo sapiens
aactgaggccc

SEQ ID NO: 692608 - DNA, 14 bp, Homo sapiens
aactgaggccttgt

SEQ ID NO: 692609 - DNA, 21 bp, Homo sapiens
aactgaggccttgtgtgtcag

SEQ ID NO: 692610 - DNA, 22 bp, Homo sapiens
aactgaggccttgtgtgtcagg

SEQ ID NO: 692611 - DNA, 23 bp, Homo sapiens
aactgaggccttgtgtgtcaggc

SEQ ID NO: 692612 - DNA, 18 bp, Homo sapiens
aactgagtaaattggaaa

SEQ ID NO: 692613 - DNA, 22 bp, Homo sapiens
aactgagtccatgaaaatacca

SEQ ID NO: 692614 - DNA, 20 bp, Homo sapiens
aactgatcatgtttatgaga

SEQ ID NO: 692615 - DNA, 17 bp, Homo sapiens
agtacttcttctgtaat

SEQ ID NO: 692616 - DNA, 19 bp, Homo sapiens
agtacttgaaatctaggat

SEQ ID NO: 692617 - DNA, 14 bp, Homo sapiens
agtacttgtcatat

SEQ ID NO: 692618 - DNA, 18 bp, Homo sapiens
agtactttaaaaaggaaa

SEQ ID NO: 692619 - DNA, 23 bp, Homo sapiens
agtactttattgtacagactgtt

SEQ ID NO: 692620 - DNA, 19 bp, Homo sapiens
agtactttgatgctccctt

SEQ ID NO: 692621 - DNA, 13 bp, Homo sapiens
agtacttttttaa

SEQ ID NO: 692622 - DNA, 16 bp, Homo sapiens
agtacttttttaaata

SEQ ID NO: 692623 - DNA, 16 bp, Homo sapiens
agtagaaagacatctg

SEQ ID NO: 692624 - DNA, 12 bp, Homo sapiens
agtagaaatcat

SEQ ID NO: 692625 - DNA, 17 bp, Homo sapiens
agtagaaattttacaat

SEQ ID NO: 692626 - DNA, 16 bp, Homo sapiens
agtagaattttagtcc

SEQ ID NO: 692627 - DNA, 12 bp, Homo sapiens
agtagacattta

SEQ ID NO: 692628 - DNA, 18 bp, Homo sapiens
agtagaccaaatcttgtt

SEQ ID NO: 692629 - DNA, 12 bp, Homo sapiens
agtagagccagc

SEQ ID NO: 692630 - DNA, 14 bp, Homo sapiens
agtagagtcatctc

SEQ ID NO: 692631 - DNA, 18 bp, Homo sapiens
agtagataatttcagggt

SEQ ID NO: 692632 - DNA, 19 bp, Homo sapiens
agtagataatttcagggtg

SEQ ID NO: 692633 - DNA, 14 bp, Homo sapiens
agtccatgaaaata

SEQ ID NO: 692634 - DNA, 13 bp, Homo sapiens
agtccatgttatt

SEQ ID NO: 692635 - DNA, 15 bp, Homo sapiens
agtccattctcccag

SEQ ID NO: 692636 - DNA, 19 bp, Homo sapiens
agtccattctcccaggtac

SEQ ID NO: 692637 - DNA, 10 bp, Homo sapiens
agtccatttc

SEQ ID NO: 692638 - DNA, 19 bp, Homo sapiens
agtccatttcccacatctt

SEQ ID NO: 692639 - DNA, 20 bp, Homo sapiens
agtccatttcccacatcttt

SEQ ID NO: 692640 - DNA, 21 bp, Homo sapiens
agtccatttcccacatctttc

SEQ ID NO: 692641 - DNA, 20 bp, Homo sapiens
agtcccaaggaaagccccag

SEQ ID NO: 692642 - DNA, 17 bp, Homo sapiens
agtcccacactgtgcag

SEQ ID NO: 692643 - DNA, 19 bp, Homo sapiens
agtcccagagcacctcacc

SEQ ID NO: 692644 - DNA, 18 bp, Homo sapiens
agtcccagagctcatccc

SEQ ID NO: 692645 - DNA, 11 bp, Homo sapiens
agtcccagcta

SEQ ID NO: 692646 - DNA, 22 bp, Homo sapiens
agtcccagctactcagaagcct

SEQ ID NO: 692647 - DNA, 17 bp, Homo sapiens
agtcccaggctgagcct

SEQ ID NO: 692648 - DNA, 22 bp, Homo sapiens
agtcccagtattctcagagcat

SEQ ID NO: 692649 - DNA, 13 bp, Homo sapiens
agtcccattcata

SEQ ID NO: 692650 - DNA, 12 bp, Homo sapiens
agtccccacccc

SEQ ID NO: 692651 - DNA, 17 bp, Homo sapiens
agtccccacccctgccc

SEQ ID NO: 692652 - DNA, 20 bp, Homo sapiens
agtccccacccctgccccca

SEQ ID NO: 692653 - DNA, 11 bp, Homo sapiens
agtccccagcc

SEQ ID NO: 692654 - DNA, 13 bp, Homo sapiens
agtccccagccct

SEQ ID NO: 692655 - DNA, 15 bp, Homo sapiens
agtccccagccctgg

SEQ ID NO: 692656 - DNA, 14 bp, Homo sapiens
agtccccagccctt

SEQ ID NO: 692657 - DNA, 13 bp, Homo sapiens
agtccccatccca

SEQ ID NO: 692658 - DNA, 23 bp, Homo sapiens
agtcccccaactctgagcccatg

SEQ ID NO: 692659 - DNA, 14 bp, Homo sapiens
agtcccccaccaca

SEQ ID NO: 692660 - DNA, 17 bp, Homo sapiens
agtcccccacccacctc

SEQ ID NO: 692661 - DNA, 24 bp, Homo sapiens
agtcccccacccacctcctgcggc

SEQ ID NO: 692662 - DNA, 20 bp, Homo sapiens
agtccccgagggcgaaggcc

SEQ ID NO: 692663 - DNA, 21 bp, Homo sapiens
agtccccgagggcgaaggcca

SEQ ID NO: 692664 - DNA, 15 bp, Homo sapiens
agtcccctactccct

SEQ ID NO: 692665 - DNA, 14 bp, Homo sapiens
agtcccctctctct

SEQ ID NO: 692666 - DNA, 16 bp, Homo sapiens
agtcccctctctctgg

SEQ ID NO: 692667 - DNA, 20 bp, Homo sapiens
agtcccgtcgtgcagtcagg

SEQ ID NO: 692668 - DNA, 14 bp, Homo sapiens
agtccctccctgcc

SEQ ID NO: 692669 - DNA, 16 bp, Homo sapiens
agtccctccctgcctg

SEQ ID NO: 692670 - DNA, 19 bp, Homo sapiens
agtccctgactctctgtga

SEQ ID NO: 692671 - DNA, 19 bp, Homo sapiens
agtccctgcacagtgactt

SEQ ID NO: 692672 - DNA, 22 bp, Homo sapiens
agtccctgggggaagccctgga

SEQ ID NO: 692673 - DNA, 15 bp, Homo sapiens
agtccctggttcatt

SEQ ID NO: 692674 - DNA, 16 bp, Homo sapiens
agtccctgtaattgtt

SEQ ID NO: 692675 - DNA, 22 bp, Homo sapiens
agtccctgttttctgagcccgg

SEQ ID NO: 692676 - DNA, 22 bp, Homo sapiens
agtcccttcccctccctggctc

SEQ ID NO: 692677 - DNA, 14 bp, Homo sapiens
agtcccttcctgct

SEQ ID NO: 692678 - DNA, 14 bp, Homo sapiens
agtcccttgttttg

SEQ ID NO: 692679 - DNA, 15 bp, Homo sapiens
agtccgcagaagccc

SEQ ID NO: 692680 - DNA, 14 bp, Homo sapiens
agtccgcccatccc

SEQ ID NO: 692681 - DNA, 16 bp, Homo sapiens
agtccgcccatccctg

SEQ ID NO: 692682 - DNA, 18 bp, Homo sapiens
agtccggatttctaacag

SEQ ID NO: 692683 - DNA, 14 bp, Homo sapiens
agtccgtcaaaaca

SEQ ID NO: 692684 - DNA, 20 bp, Homo sapiens
agtccgtgctgacagctgct

SEQ ID NO: 692685 - DNA, 13 bp, Homo sapiens
agtccgtgggacg

SEQ ID NO: 692686 - DNA, 23 bp, Homo sapiens
agtccgtgggacgggatggttct

SEQ ID NO: 692687 - DNA, 15 bp, Homo sapiens
agtccgttgctgaaa

SEQ ID NO: 692688 - DNA, 15 bp, Homo sapiens
agtcctatggaaaaa

SEQ ID NO: 692689 - DNA, 15 bp, Homo sapiens
agtcctcactcccag

SEQ ID NO: 692690 - DNA, 16 bp, Homo sapiens
agtcctcactcccagt

SEQ ID NO: 692691 - DNA, 15 bp, Homo sapiens
agtcctcactgtcct

SEQ ID NO: 692692 - DNA, 21 bp, Homo sapiens
agtcctcaggtacagcgggct

SEQ ID NO: 692693 - DNA, 14 bp, Homo sapiens
agtcctcattataa

SEQ ID NO: 692694 - DNA, 13 bp, Homo sapiens
agtcctccatcca

SEQ ID NO: 692695 - DNA, 22 bp, Homo sapiens
agtcctccctgacttttctgtg

SEQ ID NO: 692696 - DNA, 21 bp, Homo sapiens
agtcctcgtagccatctctct

SEQ ID NO: 692697 - DNA, 14 bp, Homo sapiens
agtcctctccagag

SEQ ID NO: 692698 - DNA, 12 bp, Homo sapiens
agtcctctgctc

SEQ ID NO: 692699 - DNA, 22 bp, Homo sapiens
agtcctctggatggcaccagag

SEQ ID NO: 692700 - DNA, 14 bp, Homo sapiens
agtcctgaagaggc

SEQ ID NO: 692701 - DNA, 19 bp, Homo sapiens
agtcctgagtgtggacttg

SEQ ID NO: 692702 - DNA, 23 bp, Homo sapiens
agtcctgcacagttttctggctg

SEQ ID NO: 692703 - DNA, 15 bp, Homo sapiens
agtcctgcctggcca

SEQ ID NO: 692704 - DNA, 21 bp, Homo sapiens
agtcctgcctggccaggcaga

SEQ ID NO: 692705 - DNA, 15 bp, Homo sapiens
agtcctgctacctcc

SEQ ID NO: 692706 - DNA, 15 bp, Homo sapiens
agtcctgctccagaa

SEQ ID NO: 692707 - DNA, 23 bp, Homo sapiens
agtcctgctccagaatttggaaa

SEQ ID NO: 692708 - DNA, 14 bp, Homo sapiens
agtcctggaagcca

SEQ ID NO: 692709 - DNA, 13 bp, Homo sapiens
agtcctggctaca

SEQ ID NO: 692710 - DNA, 22 bp, Homo sapiens
agtcctggctacatcccagcct

SEQ ID NO: 692711 - DNA, 22 bp, Homo sapiens
agtcctgggagaacctcaggct

SEQ ID NO: 692712 - DNA, 23 bp, Homo sapiens
agtcctgggttgtttccaggaga

SEQ ID NO: 692713 - DNA, 13 bp, Homo sapiens
agtcctggtcctg

SEQ ID NO: 692714 - DNA, 16 bp, Homo sapiens
agtcctggtcctggct

SEQ ID NO: 692715 - DNA, 17 bp, Homo sapiens
agtcctgtctctgcctg

SEQ ID NO: 692716 - DNA, 21 bp, Homo sapiens
agtcctgtctctgcctgcggc

SEQ ID NO: 692717 - DNA, 18 bp, Homo sapiens
agtcctgtgaatgccact

SEQ ID NO: 692718 - DNA, 20 bp, Homo sapiens
agtcctgtgaatgccactgc

SEQ ID NO: 692719 - DNA, 21 bp, Homo sapiens
agtcctgtgaatgccactgcc

SEQ ID NO: 692720 - DNA, 22 bp, Homo sapiens
agtcctgtgaatgccactgcct

SEQ ID NO: 692721 - DNA, 13 bp, Homo sapiens
agtcctgtgaatt

SEQ ID NO: 692722 - DNA, 22 bp, Homo sapiens
agtcctgtgcggtgtcaccatg

SEQ ID NO: 692723 - DNA, 15 bp, Homo sapiens
agtcctgttgaagac

SEQ ID NO: 692724 - DNA, 22 bp, Homo sapiens
agtcctgttgaagacttcctct

SEQ ID NO: 692725 - DNA, 17 bp, Homo sapiens
agtccttacctcgggga

SEQ ID NO: 692726 - DNA, 17 bp, Homo sapiens
agtccttacctcttccg

SEQ ID NO: 692727 - DNA, 16 bp, Homo sapiens
agtccttattcttctc

SEQ ID NO: 692728 - DNA, 16 bp, Homo sapiens
agtccttcacctcact

SEQ ID NO: 692729 - DNA, 13 bp, Homo sapiens
agtccttcagtga

SEQ ID NO: 692730 - DNA, 17 bp, Homo sapiens
agtccttgaaaatattt

SEQ ID NO: 692731 - DNA, 18 bp, Homo sapiens
agtcctttaattaagact

SEQ ID NO: 692732 - DNA, 14 bp, Homo sapiens
agtcctttatgtgg

SEQ ID NO: 692733 - DNA, 17 bp, Homo sapiens
agtcctttatgtggaaa

SEQ ID NO: 692734 - DNA, 22 bp, Homo sapiens
agtcctttcccaccattcctgc

SEQ ID NO: 692735 - DNA, 18 bp, Homo sapiens
agtcctttctgtgaagct

SEQ ID NO: 692736 - DNA, 19 bp, Homo sapiens
agtcctttctgtgaagcta

SEQ ID NO: 692737 - DNA, 20 bp, Homo sapiens
agtcctttgatagaagataa

SEQ ID NO: 692738 - DNA, 16 bp, Homo sapiens
agtcgagcactctaat

SEQ ID NO: 692739 - DNA, 15 bp, Homo sapiens
agtcgatgaactatt

SEQ ID NO: 692740 - DNA, 17 bp, Homo sapiens
agtcgcagaccagagct

SEQ ID NO: 692741 - DNA, 17 bp, Homo sapiens
agtcgcaggatccgctg

SEQ ID NO: 692742 - DNA, 15 bp, Homo sapiens
agtcgccagtcactg

SEQ ID NO: 692743 - DNA, 22 bp, Homo sapiens
agtcgctggcatgtttcactcc

SEQ ID NO: 692744 - DNA, 18 bp, Homo sapiens
agtcgctgtgccacaggc

SEQ ID NO: 692745 - DNA, 15 bp, Homo sapiens
agtcggagtggacac

SEQ ID NO: 692746 - DNA, 23 bp, Homo sapiens
agtcggagtggacaccgctcagt

SEQ ID NO: 692747 - DNA, 14 bp, Homo sapiens
agtcggcatgccag

SEQ ID NO: 692748 - DNA, 16 bp, Homo sapiens
agtcggcatgccagga

SEQ ID NO: 692749 - DNA, 20 bp, Homo sapiens
agtcgggacctcccaggaca

SEQ ID NO: 692750 - DNA, 14 bp, Homo sapiens
agtcggtcctcttt

SEQ ID NO: 692751 - DNA, 17 bp, Homo sapiens
agtcggtgaccccatca

SEQ ID NO: 692752 - DNA, 18 bp, Homo sapiens
agtcgtacagaaagctgc

SEQ ID NO: 692753 - DNA, 13 bp, Homo sapiens
agtcgtgcctgtg

SEQ ID NO: 692754 - DNA, 14 bp, Homo sapiens
agtcgtgcctgtgt

SEQ ID NO: 692755 - DNA, 12 bp, Homo sapiens
aagactccagta

SEQ ID NO: 692756 - DNA, 17 bp, Homo sapiens
aagactcctctgggcct

SEQ ID NO: 692757 - DNA, 18 bp, Homo sapiens
aagactcctctgggcctg

SEQ ID NO: 692758 - DNA, 23 bp, Homo sapiens
aagactcctctgggcctggggtg

SEQ ID NO: 692759 - DNA, 13 bp, Homo sapiens
aagactctgagcc

SEQ ID NO: 692760 - DNA, 16 bp, Homo sapiens
aagactgaacatgttt

SEQ ID NO: 692761 - DNA, 17 bp, Homo sapiens
aagactgaacatgttta

SEQ ID NO: 692762 - DNA, 19 bp, Homo sapiens
aagactgaagatggctttt

SEQ ID NO: 692763 - DNA, 23 bp, Homo sapiens
aagactgactgggcgtggtggct

SEQ ID NO: 692764 - DNA, 14 bp, Homo sapiens
aagactgagaactt

SEQ ID NO: 692765 - DNA, 22 bp, Homo sapiens
aagactgagtacgttgtgcatt

SEQ ID NO: 692766 - DNA, 19 bp, Homo sapiens
agtcttccttgtctctgct

SEQ ID NO: 692767 - DNA, 12 bp, Homo sapiens
agtcttctcata

SEQ ID NO: 692768 - DNA, 21 bp, Homo sapiens
agtcttctcatagcattaact

SEQ ID NO: 692769 - DNA, 14 bp, Homo sapiens
agtcttctcctcca

SEQ ID NO: 692770 - DNA, 13 bp, Homo sapiens
agtcttctgactg

SEQ ID NO: 692771 - DNA, 12 bp, Homo sapiens
agtcttgaagtt

SEQ ID NO: 692772 - DNA, 19 bp, Homo sapiens
agtcttgggtctgaattta

SEQ ID NO: 692773 - DNA, 21 bp, Homo sapiens
agtcttggtaaaacattactt

SEQ ID NO: 692774 - DNA, 13 bp, Homo sapiens
agtcttggttcta

SEQ ID NO: 692775 - DNA, 16 bp, Homo sapiens
agtcttgtattaagtt

SEQ ID NO: 692776 - DNA, 20 bp, Homo sapiens
agtcttgtcccaattaaaat

SEQ ID NO: 692777 - DNA, 22 bp, Homo sapiens
agtcttgtcccaattaaaatac

SEQ ID NO: 692778 - DNA, 12 bp, Homo sapiens
agtcttgtgctt

SEQ ID NO: 692779 - DNA, 20 bp, Homo sapiens
agtcttgtgcttttcctatt

SEQ ID NO: 692780 - DNA, 20 bp, Homo sapiens
agtctttaaaggcccagccc

SEQ ID NO: 692781 - DNA, 21 bp, Homo sapiens
agtctttaaaggcccagcccc

SEQ ID NO: 692782 - DNA, 16 bp, Homo sapiens
agtctttgccttctct

SEQ ID NO: 692783 - DNA, 20 bp, Homo sapiens
agtctttgctcagtgtccag

SEQ ID NO: 692784 - DNA, 16 bp, Homo sapiens
agtctttgtgtgttat

SEQ ID NO: 692785 - DNA, 22 bp, Homo sapiens
agtctttgtgtgttatattcca

SEQ ID NO: 692786 - DNA, 12 bp, Homo sapiens
agtcttttctgt

SEQ ID NO: 692787 - DNA, 15 bp, Homo sapiens
agtcttttctgttat

SEQ ID NO: 692788 - DNA, 15 bp, Homo sapiens
agtcttttgcatgtc

SEQ ID NO: 692789 - DNA, 14 bp, Homo sapiens
agtcttttgctttt

SEQ ID NO: 692790 - DNA, 22 bp, Homo sapiens
agtcttttgcttttgcccattt

SEQ ID NO: 692791 - DNA, 20 bp, Homo sapiens
agtcttttgcttttggcaaa

SEQ ID NO: 692792 - DNA, 19 bp, Homo sapiens
agtctttttctttttttgg

SEQ ID NO: 692793 - DNA, 16 bp, Homo sapiens
agtcttttttttcctg

SEQ ID NO: 692794 - DNA, 16 bp, Homo sapiens
agtgaaaaaaagaaac

SEQ ID NO: 692795 - DNA, 14 bp, Homo sapiens
agtgaaaaagatgt

SEQ ID NO: 692796 - DNA, 11 bp, Homo sapiens
agtgaaaaagg

SEQ ID NO: 692797 - DNA, 20 bp, Homo sapiens
agtgaaaaaggaggaagaga

SEQ ID NO: 692798 - DNA, 15 bp, Homo sapiens
agtgaaaattctgtt

SEQ ID NO: 692799 - DNA, 16 bp, Homo sapiens
agtgaaaattctgttg

SEQ ID NO: 692800 - DNA, 16 bp, Homo sapiens
agtgaaacagagaaag

SEQ ID NO: 692801 - DNA, 17 bp, Homo sapiens
agtgaaacagagaaaga

SEQ ID NO: 692802 - DNA, 18 bp, Homo sapiens
agtgaaacagagaaagaa

SEQ ID NO: 692803 - DNA, 20 bp, Homo sapiens
agtgaaacagagaaagaaaa

SEQ ID NO: 692804 - DNA, 20 bp, Homo sapiens
agtgaaacctttagggcagc

SEQ ID NO: 692805 - DNA, 22 bp, Homo sapiens
agtgaaacctttagggcagctt

SEQ ID NO: 692806 - DNA, 17 bp, Homo sapiens
agtgaaagagattactt

SEQ ID NO: 692807 - DNA, 14 bp, Homo sapiens
agtgaaataataga

SEQ ID NO: 692808 - DNA, 19 bp, Homo sapiens
agtgaacattcccagccca

SEQ ID NO: 692809 - DNA, 13 bp, Homo sapiens
agtgaaccatcat

SEQ ID NO: 692810 - DNA, 15 bp, Homo sapiens
agtgaacctgtataa

SEQ ID NO: 692811 - DNA, 23 bp, Homo sapiens
agtgaacctttaaagtaaaggcc

SEQ ID NO: 692812 - DNA, 14 bp, Homo sapiens
agtgaactcctgcc

SEQ ID NO: 692813 - DNA, 15 bp, Homo sapiens
agtgaactcctgcca

SEQ ID NO: 692814 - DNA, 16 bp, Homo sapiens
agtgaactcctgccag

SEQ ID NO: 692815 - DNA, 20 bp, Homo sapiens
agtgaacttgggccactgtg

SEQ ID NO: 692816 - DNA, 14 bp, Homo sapiens
agtgaacttttgta

SEQ ID NO: 692817 - DNA, 17 bp, Homo sapiens
agtgaacttttgtaatt

SEQ ID NO: 692818 - DNA, 18 bp, Homo sapiens
agtgaacttttgtaattt

SEQ ID NO: 692819 - DNA, 19 bp, Homo sapiens
agtgaacttttgtaatttg

SEQ ID NO: 692820 - DNA, 23 bp, Homo sapiens
agtgaacttttgtaatttgaatt

SEQ ID NO: 692821 - DNA, 14 bp, Homo sapiens
agtgaagacaatga

SEQ ID NO: 692822 - DNA, 16 bp, Homo sapiens
agtgaagacaatgact

SEQ ID NO: 692823 - DNA, 19 bp, Homo sapiens
agtgaagagggagaaggga

SEQ ID NO: 692824 - DNA, 17 bp, Homo sapiens
agtgaagaggggcagcc

SEQ ID NO: 692825 - DNA, 20 bp, Homo sapiens
agtgaagaggggcagccctt

SEQ ID NO: 692826 - DNA, 23 bp, Homo sapiens
agtgaagatggtttcaattcaga

SEQ ID NO: 692827 - DNA, 15 bp, Homo sapiens
agtgaaggaaataaa

SEQ ID NO: 692828 - DNA, 17 bp, Homo sapiens
agtgaaggagccacgtg

SEQ ID NO: 692829 - DNA, 15 bp, Homo sapiens
agtgaaggcttctct

SEQ ID NO: 692830 - DNA, 21 bp, Homo sapiens
agtgaaggcttctctctgtgg

SEQ ID NO: 692831 - DNA, 23 bp, Homo sapiens
agtgaagggaagagacagcccag

SEQ ID NO: 692832 - DNA, 15 bp, Homo sapiens
agtgaaggtctttgt

SEQ ID NO: 692833 - DNA, 21 bp, Homo sapiens
agtgaagtcatgacctccagg

SEQ ID NO: 692834 - DNA, 18 bp, Homo sapiens
agtgaagtgaatctgatt

SEQ ID NO: 692835 - DNA, 17 bp, Homo sapiens
agtgaagtgagaagttc

SEQ ID NO: 692836 - DNA, 15 bp, Homo sapiens
agtgaatacattaac

SEQ ID NO: 692837 - DNA, 22 bp, Homo sapiens
agtgaatacattaacggtgcta

SEQ ID NO: 692838 - DNA, 20 bp, Homo sapiens
agtgaatactgctacagcaa

SEQ ID NO: 692839 - DNA, 16 bp, Homo sapiens
agtgaatctaaggata

SEQ ID NO: 692840 - DNA, 15 bp, Homo sapiens
agtgaatctgattgc

SEQ ID NO: 692841 - DNA, 15 bp, Homo sapiens
agtgaatctgtttca

SEQ ID NO: 692842 - DNA, 15 bp, Homo sapiens
agtgaatgctgggac

SEQ ID NO: 692843 - DNA, 19 bp, Homo sapiens
agtgaatggtgccattttc

SEQ ID NO: 692844 - DNA, 17 bp, Homo sapiens
agtgaatgtaggctggc

SEQ ID NO: 692845 - DNA, 20 bp, Homo sapiens
agtgaatgtgtctggacctc

SEQ ID NO: 692846 - DNA, 14 bp, Homo sapiens
agtgaattgtcttt

SEQ ID NO: 692847 - DNA, 20 bp, Homo sapiens
agtgaattgtcttttagaca

SEQ ID NO: 692848 - DNA, 17 bp, Homo sapiens
agtgaatttcagtataa

SEQ ID NO: 692849 - DNA, 11 bp, Homo sapiens
agtgaatttga

SEQ ID NO: 692850 - DNA, 20 bp, Homo sapiens
agtgaatttgaatgaaaaat

SEQ ID NO: 692851 - DNA, 19 bp, Homo sapiens
agtgaatttgggctgctgt

SEQ ID NO: 692852 - DNA, 20 bp, Homo sapiens
agtgaatttgtccattgtaa

SEQ ID NO: 692853 - DNA, 15 bp, Homo sapiens
agtgaatttttctct

SEQ ID NO: 692854 - DNA, 20 bp, Homo sapiens
agtgacaaaagcagcacaag

SEQ ID NO: 692855 - DNA, 23 bp, Homo sapiens
agtgacaaaagcagcacaaggaa

SEQ ID NO: 692856 - DNA, 13 bp, Homo sapiens
agtgacaaaccat

SEQ ID NO: 692857 - DNA, 17 bp, Homo sapiens
agtgacaaagactcctc

SEQ ID NO: 692858 - DNA, 20 bp, Homo sapiens
agtgacaaagccagaggaga

SEQ ID NO: 692859 - DNA, 16 bp, Homo sapiens
agtgacaaggccccag

SEQ ID NO: 692860 - DNA, 21 bp, Homo sapiens
agtgacaaggccccagagact

SEQ ID NO: 692861 - DNA, 23 bp, Homo sapiens
agtgacaaggccccagagactca

SEQ ID NO: 692862 - DNA, 15 bp, Homo sapiens
agtgacaagtgaaga

SEQ ID NO: 692863 - DNA, 17 bp, Homo sapiens
agtgacacaagcacttt

SEQ ID NO: 692864 - DNA, 24 bp, Homo sapiens
agtgacacacctcacgcaggctga

SEQ ID NO: 692865 - DNA, 17 bp, Homo sapiens
agtgacacagcagcttc

SEQ ID NO: 692866 - DNA, 18 bp, Homo sapiens
agtgacacagcagcttca

SEQ ID NO: 692867 - DNA, 22 bp, Homo sapiens
agtgacacctcagtcatatttc

SEQ ID NO: 692868 - DNA, 20 bp, Homo sapiens
agtgacacttcagagagctg

SEQ ID NO: 692869 - DNA, 22 bp, Homo sapiens
agtgacacttcagagagctggt

SEQ ID NO: 692870 - DNA, 14 bp, Homo sapiens
agtgacagactgga

SEQ ID NO: 692871 - DNA, 20 bp, Homo sapiens
agtgacagactggattaaaa

SEQ ID NO: 692872 - DNA, 15 bp, Homo sapiens
agtgacagagttcac

SEQ ID NO: 692873 - DNA, 11 bp, Homo sapiens
agtgacagcta

SEQ ID NO: 692874 - DNA, 12 bp, Homo sapiens
agtgacagctag

SEQ ID NO: 692875 - DNA, 16 bp, Homo sapiens
agtgacagctttctgg

SEQ ID NO: 692876 - DNA, 21 bp, Homo sapiens
agtgacagtttcttttgtgtt

SEQ ID NO: 692877 - DNA, 18 bp, Homo sapiens
agtgccggctgtggagca

SEQ ID NO: 692878 - DNA, 17 bp, Homo sapiens
agtgcctactggggggc

SEQ ID NO: 692879 - DNA, 19 bp, Homo sapiens
agtgcctactggggggctt

SEQ ID NO: 692880 - DNA, 16 bp, Homo sapiens
agtgcctcacctcgaa

SEQ ID NO: 692881 - DNA, 12 bp, Homo sapiens
agtgcctccaca

SEQ ID NO: 692882 - DNA, 14 bp, Homo sapiens
agtgcctccacatg

SEQ ID NO: 692883 - DNA, 23 bp, Homo sapiens
agtgcctccacatgctgcctggc

SEQ ID NO: 692884 - DNA, 13 bp, Homo sapiens
agtgcctcttgtt

SEQ ID NO: 692885 - DNA, 18 bp, Homo sapiens
agtgcctgagctggggaa

SEQ ID NO: 692886 - DNA, 22 bp, Homo sapiens
agtgcctgcattcccaggaaaa

SEQ ID NO: 692887 - DNA, 21 bp, Homo sapiens
agtgcctgccactctctggga

SEQ ID NO: 692888 - DNA, 12 bp, Homo sapiens
agtgcctgctga

SEQ ID NO: 692889 - DNA, 16 bp, Homo sapiens
agtgcctgcttttgat

SEQ ID NO: 692890 - DNA, 13 bp, Homo sapiens
agtgccttcctct

SEQ ID NO: 692891 - DNA, 15 bp, Homo sapiens
agtgccttctgggct

SEQ ID NO: 692892 - DNA, 22 bp, Homo sapiens
agtgccttggggaatttcctct

SEQ ID NO: 692893 - DNA, 17 bp, Homo sapiens
agtgcctttatctcagc

SEQ ID NO: 692894 - DNA, 22 bp, Homo sapiens
agtgcctttctgcagtttttca

SEQ ID NO: 692895 - DNA, 19 bp, Homo sapiens
agtgccttttgcagaagag

SEQ ID NO: 692896 - DNA, 15 bp, Homo sapiens
agtgccttttggaac

SEQ ID NO: 692897 - DNA, 17 bp, Homo sapiens
agtgccttttggtttca

SEQ ID NO: 692898 - DNA, 21 bp, Homo sapiens
agtgcgcagatctgtgcctgg

SEQ ID NO: 692899 - DNA, 20 bp, Homo sapiens
agtgcgctcttggtccctgg

SEQ ID NO: 692900 - DNA, 17 bp, Homo sapiens
aagatgatctactcaga

SEQ ID NO: 692901 - DNA, 15 bp, Homo sapiens
aagatgcaaggacca

SEQ ID NO: 692902 - DNA, 20 bp, Homo sapiens
aagatgcaaggaccaggact

SEQ ID NO: 692903 - DNA, 23 bp, Homo sapiens
aagatgcactgaaaacttagcca

SEQ ID NO: 692904 - DNA, 18 bp, Homo sapiens
aagatgccaattattgtt

SEQ ID NO: 692905 - DNA, 22 bp, Homo sapiens
aagatgccagcttctctctcca

SEQ ID NO: 692906 - DNA, 23 bp, Homo sapiens
aagatgccatagcataatatgaa

SEQ ID NO: 692907 - DNA, 11 bp, Homo sapiens
aagatgccctc

SEQ ID NO: 692908 - DNA, 21 bp, Homo sapiens
aagatgccctccaatcctttc

SEQ ID NO: 692909 - DNA, 23 bp, Homo sapiens
aagatgcctgttaatttataatg

SEQ ID NO: 692910 - DNA, 16 bp, Homo sapiens
aagatgcgtttgcctc

SEQ ID NO: 692911 - DNA, 14 bp, Homo sapiens
aagatgctgggttg

SEQ ID NO: 692912 - DNA, 16 bp, Homo sapiens
aagatgctgggttggt

SEQ ID NO: 692913 - DNA, 19 bp, Homo sapiens
aagatgcttctcactgcca

SEQ ID NO: 692914 - DNA, 19 bp, Homo sapiens
aagatggacacgagccaca

SEQ ID NO: 692915 - DNA, 16 bp, Homo sapiens
aagatggactctgaaa

SEQ ID NO: 692916 - DNA, 15 bp, Homo sapiens
aagatggattaaaga

SEQ ID NO: 692917 - DNA, 17 bp, Homo sapiens
aagatggattctcagat

SEQ ID NO: 692918 - DNA, 19 bp, Homo sapiens
aagatggcataacctgtct

SEQ ID NO: 692919 - DNA, 21 bp, Homo sapiens
aagatggcgaccaccaaagtc

SEQ ID NO: 692920 - DNA, 16 bp, Homo sapiens
aagatggctgtgcctc

SEQ ID NO: 692921 - DNA, 19 bp, Homo sapiens
aagatggcttatgtcatca

SEQ ID NO: 692922 - DNA, 15 bp, Homo sapiens
aagatggcttttcct

SEQ ID NO: 692923 - DNA, 11 bp, Homo sapiens
aagatgggagg

SEQ ID NO: 692924 - DNA, 18 bp, Homo sapiens
aagatgggcagctagttc

SEQ ID NO: 692925 - DNA, 20 bp, Homo sapiens
aagatgggcatcttttgtat

SEQ ID NO: 692926 - DNA, 23 bp, Homo sapiens
aagatggtccatttgttcctgct

SEQ ID NO: 692927 - DNA, 19 bp, Homo sapiens
aagatggtccgtgcccagg

SEQ ID NO: 692928 - DNA, 21 bp, Homo sapiens
aagatggtggctgtgtctctc

SEQ ID NO: 692929 - DNA, 17 bp, Homo sapiens
aagatggttaaacattt

SEQ ID NO: 692930 - DNA, 12 bp, Homo sapiens
aagatgtacatt

SEQ ID NO: 692931 - DNA, 22 bp, Homo sapiens
aagatgtagatttatttcatca

SEQ ID NO: 692932 - DNA, 17 bp, Homo sapiens
aagatgtctatgtagct

SEQ ID NO: 692933 - DNA, 17 bp, Homo sapiens
aagatgtctcagagcct

SEQ ID NO: 692934 - DNA, 23 bp, Homo sapiens
aagatgtctcaggtttgttttgt

SEQ ID NO: 692935 - DNA, 13 bp, Homo sapiens
aagatgtgaatta

SEQ ID NO: 692936 - DNA, 19 bp, Homo sapiens
aagatgtggatccctttag

SEQ ID NO: 692937 - DNA, 16 bp, Homo sapiens
aagatgtgtaaacagg

SEQ ID NO: 692938 - DNA, 17 bp, Homo sapiens
aagatgtgtaaacaggt

SEQ ID NO: 692939 - DNA, 18 bp, Homo sapiens
aagatgtgtaaacaggta

SEQ ID NO: 692940 - DNA, 15 bp, Homo sapiens
aagatgtgttcttat

SEQ ID NO: 692941 - DNA, 16 bp, Homo sapiens
aagatgtgttcttatt

SEQ ID NO: 692942 - DNA, 15 bp, Homo sapiens
aagatgttcattttt

SEQ ID NO: 692943 - DNA, 16 bp, Homo sapiens
aagatgttctcctgat

SEQ ID NO: 692944 - DNA, 12 bp, Homo sapiens
aagatgtttctt

SEQ ID NO: 692945 - DNA, 14 bp, Homo sapiens
aagatgtttcttat

SEQ ID NO: 692946 - DNA, 16 bp, Homo sapiens
aagatgtttgtcagat

SEQ ID NO: 692947 - DNA, 12 bp, Homo sapiens
aagattaaagga

SEQ ID NO: 692948 - DNA, 13 bp, Homo sapiens
aagattaaaggaa

SEQ ID NO: 692949 - DNA, 16 bp, Homo sapiens
aagattaaaggaagga

SEQ ID NO: 692950 - DNA, 21 bp, Homo sapiens
aagattacaaatcagaagtca

SEQ ID NO: 692951 - DNA, 18 bp, Homo sapiens
aagattaggagaaacaca

SEQ ID NO: 692952 - DNA, 18 bp, Homo sapiens
aagattagggaaaatgga

SEQ ID NO: 692953 - DNA, 22 bp, Homo sapiens
aagattatatgaagtttaaatt

SEQ ID NO: 692954 - DNA, 19 bp, Homo sapiens
aagattatctgattccttt

SEQ ID NO: 692955 - DNA, 20 bp, Homo sapiens
aagattatgatgcatacagt

SEQ ID NO: 692956 - DNA, 20 bp, Homo sapiens
aagattatgtgacttgcaat

SEQ ID NO: 692957 - DNA, 16 bp, Homo sapiens
aagattcaagaggata

SEQ ID NO: 692958 - DNA, 13 bp, Homo sapiens
aagattcccagag

SEQ ID NO: 692959 - DNA, 18 bp, Homo sapiens
aagattctaaagctcaat

SEQ ID NO: 692960 - DNA, 11 bp, Homo sapiens
aagattctact

SEQ ID NO: 692961 - DNA, 23 bp, Homo sapiens
aagattctactcttgtcattttt

SEQ ID NO: 692962 - DNA, 14 bp, Homo sapiens
aagattcttttaaa

SEQ ID NO: 692963 - DNA, 19 bp, Homo sapiens
aagattgcttaataaattg

SEQ ID NO: 692964 - DNA, 16 bp, Homo sapiens
aagattggaaagacag

SEQ ID NO: 692965 - DNA, 19 bp, Homo sapiens
aagattggaaagacaggaa

SEQ ID NO: 692966 - DNA, 20 bp, Homo sapiens
aagattggaaagacaggaag

SEQ ID NO: 692967 - DNA, 23 bp, Homo sapiens
aagattggtctcccatatgcaga

SEQ ID NO: 692968 - DNA, 14 bp, Homo sapiens
aagattgtagcaat

SEQ ID NO: 692969 - DNA, 21 bp, Homo sapiens
aagattgtccttttctcccat

SEQ ID NO: 692970 - DNA, 19 bp, Homo sapiens
aagattgttattaaatgta

SEQ ID NO: 692971 - DNA, 12 bp, Homo sapiens
aagatttacatt

SEQ ID NO: 692972 - DNA, 12 bp, Homo sapiens
aagatttcagta

SEQ ID NO: 692973 - DNA, 15 bp, Homo sapiens
aagatttcagtagaa

SEQ ID NO: 692974 - DNA, 20 bp, Homo sapiens
aagatttctagtaggcagca

SEQ ID NO: 692975 - DNA, 17 bp, Homo sapiens
aagatttggaagctctt

SEQ ID NO: 692976 - DNA, 22 bp, Homo sapiens
aagatttgtgtttttctttttc

SEQ ID NO: 692977 - DNA, 19 bp, Homo sapiens
aagatttgttactgtattt

SEQ ID NO: 692978 - DNA, 16 bp, Homo sapiens
aagatttgtttttaaa

SEQ ID NO: 692979 - DNA, 19 bp, Homo sapiens
aagatttgtttttaaactg

SEQ ID NO: 692980 - DNA, 19 bp, Homo sapiens
aagattttagggcttttat

SEQ ID NO: 692981 - DNA, 20 bp, Homo sapiens
aagattttattgtataaaaa

SEQ ID NO: 692982 - DNA, 23 bp, Homo sapiens
aagattttattgtataaaaagtt

SEQ ID NO: 692983 - DNA, 13 bp, Homo sapiens
aagattttattta

SEQ ID NO: 692984 - DNA, 19 bp, Homo sapiens
aagattttgaaatttttat

SEQ ID NO: 692985 - DNA, 16 bp, Homo sapiens
aagattttgaaggaaa

SEQ ID NO: 692986 - DNA, 21 bp, Homo sapiens
aagattttgaatgcttcctga

SEQ ID NO: 692987 - DNA, 17 bp, Homo sapiens
aagattttggtaatgat

SEQ ID NO: 692988 - DNA, 20 bp, Homo sapiens
aagattttgttttgttggac

SEQ ID NO: 692989 - DNA, 20 bp, Homo sapiens
aagattttttaattgtttaa

SEQ ID NO: 692990 - DNA, 23 bp, Homo sapiens
aagattttttttttaagtgacat

SEQ ID NO: 692991 - DNA, 17 bp, Homo sapiens
aagcaaaaattcacaaa

SEQ ID NO: 692992 - DNA, 20 bp, Homo sapiens
aagcaaaactcccaatggat

SEQ ID NO: 692993 - DNA, 13 bp, Homo sapiens
aagcaaaagaaaa

SEQ ID NO: 692994 - DNA, 23 bp, Homo sapiens
aagcaaaatcattttatatgtca

SEQ ID NO: 692995 - DNA, 21 bp, Homo sapiens
aagcaaaccgccctgcagcat

SEQ ID NO: 692996 - DNA, 16 bp, Homo sapiens
aagcaaacgtctattt

SEQ ID NO: 692997 - DNA, 13 bp, Homo sapiens
aagcaaagaaaat

SEQ ID NO: 692998 - DNA, 18 bp, Homo sapiens
aagccatctgacagcagg

SEQ ID NO: 692999 - DNA, 22 bp, Homo sapiens
aagccatgagttccagaaagta

SEQ ID NO: 693000 - DNA, 15 bp, Homo sapiens
aagccatgccaataa

SEQ ID NO: 693001 - DNA, 20 bp, Homo sapiens
aagccatggagattctcata

SEQ ID NO: 693002 - DNA, 22 bp, Homo sapiens
aagccatgtatttcagggacct

SEQ ID NO: 693003 - DNA, 23 bp, Homo sapiens
aagccatgtatttcagggacctc

SEQ ID NO: 693004 - DNA, 19 bp, Homo sapiens
aagccatgtggggttgctg

SEQ ID NO: 693005 - DNA, 20 bp, Homo sapiens
aagccatgtggggttgctga

SEQ ID NO: 693006 - DNA, 23 bp, Homo sapiens
aagccatgttaaatgacttgatt

SEQ ID NO: 693007 - DNA, 15 bp, Homo sapiens
aagccattccaaagt

SEQ ID NO: 693008 - DNA, 14 bp, Homo sapiens
aagccattctttta

SEQ ID NO: 693009 - DNA, 17 bp, Homo sapiens
aagccattgaccaccca

SEQ ID NO: 693010 - DNA, 17 bp, Homo sapiens
aagcccaacctcctgac

SEQ ID NO: 693011 - DNA, 22 bp, Homo sapiens
aagcccaacctcctgacctgtc

SEQ ID NO: 693012 - DNA, 13 bp, Homo sapiens
aagcccacctggg

SEQ ID NO: 693013 - DNA, 14 bp, Homo sapiens
aagcccacctgggc

SEQ ID NO: 693014 - DNA, 17 bp, Homo sapiens
aagcccacctgggctgg

SEQ ID NO: 693015 - DNA, 23 bp, Homo sapiens
aagcccagcactgcttgaggaaa

SEQ ID NO: 693016 - DNA, 19 bp, Homo sapiens
aagcccagcccctactgct

SEQ ID NO: 693017 - DNA, 22 bp, Homo sapiens
aagcccagcccctactgctgtg

SEQ ID NO: 693018 - DNA, 17 bp, Homo sapiens
aagcccagtgctgctgt

SEQ ID NO: 693019 - DNA, 14 bp, Homo sapiens
aagcccagttcatc

SEQ ID NO: 693020 - DNA, 20 bp, Homo sapiens
aagcccatgagtccttgaaa

SEQ ID NO: 693021 - DNA, 14 bp, Homo sapiens
aagcccatgtcttc

SEQ ID NO: 693022 - DNA, 20 bp, Homo sapiens
aagcccatgtcttctgctgt

SEQ ID NO: 693023 - DNA, 17 bp, Homo sapiens
aagccccagggcctggg

SEQ ID NO: 693024 - DNA, 20 bp, Homo sapiens
aagcccccaccgtgggcagg

SEQ ID NO: 693025 - DNA, 12 bp, Homo sapiens
aagccccctggc

SEQ ID NO: 693026 - DNA, 16 bp, Homo sapiens
aagccccctggcagct

SEQ ID NO: 693027 - DNA, 23 bp, Homo sapiens
aagccccctggcagctgcccctc

SEQ ID NO: 693028 - DNA, 13 bp, Homo sapiens
aagcccctcagcc

SEQ ID NO: 693029 - DNA, 19 bp, Homo sapiens
aagcccctcagcccttgcc

SEQ ID NO: 693030 - DNA, 14 bp, Homo sapiens
aagcccctctttct

SEQ ID NO: 693031 - DNA, 14 bp, Homo sapiens
aagcccctgccctg

SEQ ID NO: 693032 - DNA, 18 bp, Homo sapiens
agtggcatggctccagtc

SEQ ID NO: 693033 - DNA, 17 bp, Homo sapiens
agtggccaagcctgctg

SEQ ID NO: 693034 - DNA, 18 bp, Homo sapiens
agtggccaagcctgctgt

SEQ ID NO: 693035 - DNA, 16 bp, Homo sapiens
agtggccacagcaccc

SEQ ID NO: 693036 - DNA, 14 bp, Homo sapiens
agtggccagccagt

SEQ ID NO: 693037 - DNA, 17 bp, Homo sapiens
agtggccagcgccaggg

SEQ ID NO: 693038 - DNA, 19 bp, Homo sapiens
agtggcccccgggcctgca

SEQ ID NO: 693039 - DNA, 20 bp, Homo sapiens
agtggcccccgggcctgcac

SEQ ID NO: 693040 - DNA, 23 bp, Homo sapiens
agtggcccccgggcctgcacaga

SEQ ID NO: 693041 - DNA, 17 bp, Homo sapiens
agtggcctagagcactc

SEQ ID NO: 693042 - DNA, 21 bp, Homo sapiens
agtggcctcaaccctccctca

SEQ ID NO: 693043 - DNA, 18 bp, Homo sapiens
agtggcctccctgctgtg

SEQ ID NO: 693044 - DNA, 23 bp, Homo sapiens
agtggcctcttgagttcctctgc

SEQ ID NO: 693045 - DNA, 23 bp, Homo sapiens
agtggcctgctaaggctcctcct

SEQ ID NO: 693046 - DNA, 15 bp, Homo sapiens
agtggcctggccagg

SEQ ID NO: 693047 - DNA, 17 bp, Homo sapiens
agtggccttccccagca

SEQ ID NO: 693048 - DNA, 18 bp, Homo sapiens
agtggccttccccagcat

SEQ ID NO: 693049 - DNA, 17 bp, Homo sapiens
agtggcgtgagctgccc

SEQ ID NO: 693050 - DNA, 15 bp, Homo sapiens
agtggcgtggcctcc

SEQ ID NO: 693051 - DNA, 19 bp, Homo sapiens
agtggcgtgggagccagcc

SEQ ID NO: 693052 - DNA, 17 bp, Homo sapiens
agtggctcactggctgg

SEQ ID NO: 693053 - DNA, 21 bp, Homo sapiens
agtggctccccacctggacac

SEQ ID NO: 693054 - DNA, 21 bp, Homo sapiens
agtggctcgtatcccaaatct

SEQ ID NO: 693055 - DNA, 12 bp, Homo sapiens
agtggctgcggt

SEQ ID NO: 693056 - DNA, 11 bp, Homo sapiens
agtggctgctg

SEQ ID NO: 693057 - DNA, 21 bp, Homo sapiens
agtggctggaattaaaacaaa

SEQ ID NO: 693058 - DNA, 12 bp, Homo sapiens
agtggctgggtg

SEQ ID NO: 693059 - DNA, 21 bp, Homo sapiens
agtggctgggtgggcccagaa

SEQ ID NO: 693060 - DNA, 23 bp, Homo sapiens
agtggctgggtgggcccagaact

SEQ ID NO: 693061 - DNA, 15 bp, Homo sapiens
agtggctggtccagg

SEQ ID NO: 693062 - DNA, 17 bp, Homo sapiens
agtggctggtccagggc

SEQ ID NO: 693063 - DNA, 19 bp, Homo sapiens
agtggctggtccagggcta

SEQ ID NO: 693064 - DNA, 14 bp, Homo sapiens
agtggctggtctgg

SEQ ID NO: 693065 - DNA, 17 bp, Homo sapiens
agtggctggtgcccatg

SEQ ID NO: 693066 - DNA, 18 bp, Homo sapiens
agtggctggtgcccatga

SEQ ID NO: 693067 - DNA, 15 bp, Homo sapiens
agtggcttctttcca

SEQ ID NO: 693068 - DNA, 19 bp, Homo sapiens
agtggcttttgccccagaa

SEQ ID NO: 693069 - DNA, 22 bp, Homo sapiens
agtgggacccatagatcttctg

SEQ ID NO: 693070 - DNA, 20 bp, Homo sapiens
agtgggactcggtgagccgg

SEQ ID NO: 693071 - DNA, 17 bp, Homo sapiens
agtgggacttggagagc

SEQ ID NO: 693072 - DNA, 12 bp, Homo sapiens
agtgggagaaaa

SEQ ID NO: 693073 - DNA, 17 bp, Homo sapiens
agtgggagaaaacactt

SEQ ID NO: 693074 - DNA, 21 bp, Homo sapiens
agtgggagaaattagaaaaca

SEQ ID NO: 693075 - DNA, 19 bp, Homo sapiens
agtgggagaaggcagtgat

SEQ ID NO: 693076 - DNA, 16 bp, Homo sapiens
agtgggaggcgtgccc

SEQ ID NO: 693077 - DNA, 22 bp, Homo sapiens
agtgggaggggcaggctgacat

SEQ ID NO: 693078 - DNA, 13 bp, Homo sapiens
agtgggatgggct

SEQ ID NO: 693079 - DNA, 20 bp, Homo sapiens
agtgggattatcgagcatgt

SEQ ID NO: 693080 - DNA, 16 bp, Homo sapiens
agtgggcacctcagaa

SEQ ID NO: 693081 - DNA, 15 bp, Homo sapiens
agtgggccaggacag

SEQ ID NO: 693082 - DNA, 19 bp, Homo sapiens
agtgggccaggacaggccc

SEQ ID NO: 693083 - DNA, 22 bp, Homo sapiens
agtgggccctgcccggggagct

SEQ ID NO: 693084 - DNA, 15 bp, Homo sapiens
agtgggctgcacgct

SEQ ID NO: 693085 - DNA, 20 bp, Homo sapiens
agtgggctgcacgctcccct

SEQ ID NO: 693086 - DNA, 10 bp, Homo sapiens
agtgggctgt

SEQ ID NO: 693087 - DNA, 22 bp, Homo sapiens
agtgggcttgattctgcagtaa

SEQ ID NO: 693088 - DNA, 19 bp, Homo sapiens
agtggggaaggaggccaag

SEQ ID NO: 693089 - DNA, 13 bp, Homo sapiens
agtggggacagat

SEQ ID NO: 693090 - DNA, 19 bp, Homo sapiens
agtggggacagggaggggg

SEQ ID NO: 693091 - DNA, 12 bp, Homo sapiens
agtggggcctgg

SEQ ID NO: 693092 - DNA, 14 bp, Homo sapiens
agtggggcctggga

SEQ ID NO: 693093 - DNA, 16 bp, Homo sapiens
agtgggggagagcagg

SEQ ID NO: 693094 - DNA, 21 bp, Homo sapiens
agtgggggagagcaggctggc

SEQ ID NO: 693095 - DNA, 18 bp, Homo sapiens
agtgggggatcacagcct

SEQ ID NO: 693096 - DNA, 19 bp, Homo sapiens
agtggggtctccctctcct

SEQ ID NO: 693097 - DNA, 20 bp, Homo sapiens
agtggggtgaaattttctta

SEQ ID NO: 693098 - DNA, 22 bp, Homo sapiens
agtggggtgaacagctggtgcc

SEQ ID NO: 693099 - DNA, 14 bp, Homo sapiens
agtggggtgctggg

SEQ ID NO: 693100 - DNA, 20 bp, Homo sapiens
agtggggttatctctgtgtt

SEQ ID NO: 693101 - DNA, 12 bp, Homo sapiens
agtggggttgat

SEQ ID NO: 693102 - DNA, 22 bp, Homo sapiens
agtggggttgcaaccactgcaa

SEQ ID NO: 693103 - DNA, 18 bp, Homo sapiens
agtgggtgaataatacag

SEQ ID NO: 693104 - DNA, 19 bp, Homo sapiens
agtgggtgaataatacagt

SEQ ID NO: 693105 - DNA, 18 bp, Homo sapiens
agtgggtgacaagagcct

SEQ ID NO: 693106 - DNA, 19 bp, Homo sapiens
agtgggtgacaagagcctg

SEQ ID NO: 693107 - DNA, 14 bp, Homo sapiens
agtgggtggcacct

SEQ ID NO: 693108 - DNA, 18 bp, Homo sapiens
agtgggtggtggatctgt

SEQ ID NO: 693109 - DNA, 21 bp, Homo sapiens
agtgggtgtgtggcctccctg

SEQ ID NO: 693110 - DNA, 21 bp, Homo sapiens
agtgggtttcacaagtgaaaa

SEQ ID NO: 693111 - DNA, 20 bp, Homo sapiens
agtggtaatcatatgtgtct

SEQ ID NO: 693112 - DNA, 15 bp, Homo sapiens
agtggtacaggaagg

SEQ ID NO: 693113 - DNA, 18 bp, Homo sapiens
agtggtatagaaatgctg

SEQ ID NO: 693114 - DNA, 14 bp, Homo sapiens
agtggtatgtctct

SEQ ID NO: 693115 - DNA, 23 bp, Homo sapiens
agtggtcaaaccgcactcaccca

SEQ ID NO: 693116 - DNA, 21 bp, Homo sapiens
agtggtcataaaatagaataa

SEQ ID NO: 693117 - DNA, 20 bp, Homo sapiens
agtggtctcacctggaggca

SEQ ID NO: 693118 - DNA, 12 bp, Homo sapiens
agtggtctctgc

SEQ ID NO: 693119 - DNA, 17 bp, Homo sapiens
agttacagttgatgttt

SEQ ID NO: 693120 - DNA, 19 bp, Homo sapiens
agttacattaatgcccagc

SEQ ID NO: 693121 - DNA, 22 bp, Homo sapiens
agttaccattatttaatttgta

SEQ ID NO: 693122 - DNA, 20 bp, Homo sapiens
agttacctggaatcaaataa

SEQ ID NO: 693123 - DNA, 22 bp, Homo sapiens
agttaccttatagttactgtgt

SEQ ID NO: 693124 - DNA, 22 bp, Homo sapiens
agttacggagggaggacatcat

SEQ ID NO: 693125 - DNA, 16 bp, Homo sapiens
agttactaggtaactt

SEQ ID NO: 693126 - DNA, 18 bp, Homo sapiens
agttactaggtaacttca

SEQ ID NO: 693127 - DNA, 19 bp, Homo sapiens
agttactaggtaacttcat

SEQ ID NO: 693128 - DNA, 13 bp, Homo sapiens
agttactcagaat

SEQ ID NO: 693129 - DNA, 16 bp, Homo sapiens
agttactcagccctgg

SEQ ID NO: 693130 - DNA, 19 bp, Homo sapiens
agttactcagccctgggcc

SEQ ID NO: 693131 - DNA, 16 bp, Homo sapiens
agttactctgaagggc

SEQ ID NO: 693132 - DNA, 18 bp, Homo sapiens
agttactgattcactgca

SEQ ID NO: 693133 - DNA, 14 bp, Homo sapiens
agttacttcctatc

SEQ ID NO: 693134 - DNA, 14 bp, Homo sapiens
agttactttagatg

SEQ ID NO: 693135 - DNA, 15 bp, Homo sapiens
agttactttttgtag

SEQ ID NO: 693136 - DNA, 14 bp, Homo sapiens
agttagccctcagt

SEQ ID NO: 693137 - DNA, 23 bp, Homo sapiens
agttagctccataaagtacaaat

SEQ ID NO: 693138 - DNA, 15 bp, Homo sapiens
agttagctttaactt

SEQ ID NO: 693139 - DNA, 13 bp, Homo sapiens
agttaggaaataa

SEQ ID NO: 693140 - DNA, 18 bp, Homo sapiens
agttaggaaataaaacct

SEQ ID NO: 693141 - DNA, 21 bp, Homo sapiens
agttaggattcagatcgaaat

SEQ ID NO: 693142 - DNA, 18 bp, Homo sapiens
agttagggttttgcaata

SEQ ID NO: 693143 - DNA, 14 bp, Homo sapiens
agttagtagcatgt

SEQ ID NO: 693144 - DNA, 17 bp, Homo sapiens
agttagtggaaatctga

SEQ ID NO: 693145 - DNA, 17 bp, Homo sapiens
agttagtttttaggtca

SEQ ID NO: 693146 - DNA, 14 bp, Homo sapiens
agttataaaactat

SEQ ID NO: 693147 - DNA, 20 bp, Homo sapiens
agttataaaactatgtgttc

SEQ ID NO: 693148 - DNA, 19 bp, Homo sapiens
agttataaaattaaaagtt

SEQ ID NO: 693149 - DNA, 17 bp, Homo sapiens
agttataagcgtattta

SEQ ID NO: 693150 - DNA, 15 bp, Homo sapiens
agttataataactga

SEQ ID NO: 693151 - DNA, 21 bp, Homo sapiens
agttataataactgaactgtt

SEQ ID NO: 693152 - DNA, 18 bp, Homo sapiens
agttatacagttataaaa

SEQ ID NO: 693153 - DNA, 15 bp, Homo sapiens
agttatagtgaatac

SEQ ID NO: 693154 - DNA, 20 bp, Homo sapiens
agttatagtgaatactgcta

SEQ ID NO: 693155 - DNA, 14 bp, Homo sapiens
agttatagtgttta

SEQ ID NO: 693156 - DNA, 18 bp, Homo sapiens
agttatagtgtttaactg

SEQ ID NO: 693157 - DNA, 20 bp, Homo sapiens
agttatagtgtttaactggc

SEQ ID NO: 693158 - DNA, 20 bp, Homo sapiens
agttatatcaagcttaatat

SEQ ID NO: 693159 - DNA, 14 bp, Homo sapiens
agttatatgatatt

SEQ ID NO: 693160 - DNA, 18 bp, Homo sapiens
agttatatgatattcttt

SEQ ID NO: 693161 - DNA, 15 bp, Homo sapiens
agttatattgaatat

SEQ ID NO: 693162 - DNA, 22 bp, Homo sapiens
aagctattcagtaataactcta

SEQ ID NO: 693163 - DNA, 21 bp, Homo sapiens
aagctattccctcaaatctga

SEQ ID NO: 693164 - DNA, 18 bp, Homo sapiens
aagctatttaaagcatct

SEQ ID NO: 693165 - DNA, 23 bp, Homo sapiens
aagctatttaatatctggcactg

SEQ ID NO: 693166 - DNA, 20 bp, Homo sapiens
aagctcaaaggtttggaagg

SEQ ID NO: 693167 - DNA, 22 bp, Homo sapiens
aagctcaaagtatgcaatgctt

SEQ ID NO: 693168 - DNA, 19 bp, Homo sapiens
aagctcaaatgaaatgtat

SEQ ID NO: 693169 - DNA, 16 bp, Homo sapiens
aagctcacaccaaatt

SEQ ID NO: 693170 - DNA, 12 bp, Homo sapiens
aagctcacactg

SEQ ID NO: 693171 - DNA, 15 bp, Homo sapiens
aagctcacagttcct

SEQ ID NO: 693172 - DNA, 21 bp, Homo sapiens
aagctcacatccagccttgga

SEQ ID NO: 693173 - DNA, 18 bp, Homo sapiens
aagctcacgtcctgagaa

SEQ ID NO: 693174 - DNA, 19 bp, Homo sapiens
aagctcacgtcctgagaaa

SEQ ID NO: 693175 - DNA, 23 bp, Homo sapiens
aagctcactgctgatcgtagaaa

SEQ ID NO: 693176 - DNA, 23 bp, Homo sapiens
aagctcacttctgggcttcatct

SEQ ID NO: 693177 - DNA, 13 bp, Homo sapiens
aagctcagaatcc

SEQ ID NO: 693178 - DNA, 23 bp, Homo sapiens
aagctcagaggcgcactgtgacc

SEQ ID NO: 693179 - DNA, 13 bp, Homo sapiens
aagctcagcccac

SEQ ID NO: 693180 - DNA, 15 bp, Homo sapiens
aagctcagcccaccc

SEQ ID NO: 693181 - DNA, 16 bp, Homo sapiens
aagctcagcccacccc

SEQ ID NO: 693182 - DNA, 17 bp, Homo sapiens
aagctcagctactgatt

SEQ ID NO: 693183 - DNA, 17 bp, Homo sapiens
aagctcaggatatggct

SEQ ID NO: 693184 - DNA, 22 bp, Homo sapiens
aagctcatattttgtatatatc

SEQ ID NO: 693185 - DNA, 22 bp, Homo sapiens
aagctcatgcatttcaagcagc

SEQ ID NO: 693186 - DNA, 23 bp, Homo sapiens
aagctcatggctgtgtccactgc

SEQ ID NO: 693187 - DNA, 15 bp, Homo sapiens
aagctccatcaatga

SEQ ID NO: 693188 - DNA, 16 bp, Homo sapiens
aagctcccaccccact

SEQ ID NO: 693189 - DNA, 15 bp, Homo sapiens
aagctccctgcccca

SEQ ID NO: 693190 - DNA, 17 bp, Homo sapiens
aagctccctgccccaaa

SEQ ID NO: 693191 - DNA, 15 bp, Homo sapiens
aagctccctggagcc

SEQ ID NO: 693192 - DNA, 19 bp, Homo sapiens
aagctccctggagccctgt

SEQ ID NO: 693193 - DNA, 17 bp, Homo sapiens
aagctcctatctgtttt

SEQ ID NO: 693194 - DNA, 15 bp, Homo sapiens
aagctcctcctccct

SEQ ID NO: 693195 - DNA, 19 bp, Homo sapiens
aagctcctggtcttgagat

SEQ ID NO: 693196 - DNA, 14 bp, Homo sapiens
aagctccttccaga

SEQ ID NO: 693197 - DNA, 20 bp, Homo sapiens
aagctctagttcttaacaac

SEQ ID NO: 693198 - DNA, 15 bp, Homo sapiens
aagctctattaagat

SEQ ID NO: 693199 - DNA, 20 bp, Homo sapiens
aagctctcgggactagctgc

SEQ ID NO: 693200 - DNA, 20 bp, Homo sapiens
aagctctgaaaacaaggttt

SEQ ID NO: 693201 - DNA, 16 bp, Homo sapiens
aagctctgaagtcaca

SEQ ID NO: 693202 - DNA, 13 bp, Homo sapiens
aagctctggctga

SEQ ID NO: 693203 - DNA, 22 bp, Homo sapiens
aagctctggctgaaccctgtgc

SEQ ID NO: 693204 - DNA, 23 bp, Homo sapiens
aagctctggctgaaccctgtgct

SEQ ID NO: 693205 - DNA, 15 bp, Homo sapiens
aagctcttggacaac

SEQ ID NO: 693206 - DNA, 22 bp, Homo sapiens
aagctcttggacaacagctctc

SEQ ID NO: 693207 - DNA, 13 bp, Homo sapiens
aagctgaaatttt

SEQ ID NO: 693208 - DNA, 20 bp, Homo sapiens
aagctgaaattttagaaata

SEQ ID NO: 693209 - DNA, 14 bp, Homo sapiens
aagctgaatatttt

SEQ ID NO: 693210 - DNA, 22 bp, Homo sapiens
aagctgactgttttttttgcag

SEQ ID NO: 693211 - DNA, 17 bp, Homo sapiens
aagctgacttggcactt

SEQ ID NO: 693212 - DNA, 22 bp, Homo sapiens
aagctgagcaggacagccagca

SEQ ID NO: 693213 - DNA, 13 bp, Homo sapiens
aagctgaggccta

SEQ ID NO: 693214 - DNA, 14 bp, Homo sapiens
aagctgaggcggga

SEQ ID NO: 693215 - DNA, 22 bp, Homo sapiens
aagctgagttaggtgtctgtcc

SEQ ID NO: 693216 - DNA, 16 bp, Homo sapiens
aagctgattactgtca

SEQ ID NO: 693217 - DNA, 17 bp, Homo sapiens
aagctgattactgtcaa

SEQ ID NO: 693218 - DNA, 23 bp, Homo sapiens
aagctgattactgtcaataaaca

SEQ ID NO: 693219 - DNA, 18 bp, Homo sapiens
aagctgattttttttaat

SEQ ID NO: 693220 - DNA, 12 bp, Homo sapiens
aagctgcacatg

SEQ ID NO: 693221 - DNA, 20 bp, Homo sapiens
aagctgcaccctcaggcagg

SEQ ID NO: 693222 - DNA, 13 bp, Homo sapiens
aagctgcactgtg

SEQ ID NO: 693223 - DNA, 20 bp, Homo sapiens
aagctgccacccctcttctg

SEQ ID NO: 693224 - DNA, 21 bp, Homo sapiens
aagctgccacccctcttctgc

SEQ ID NO: 693225 - DNA, 20 bp, Homo sapiens
aagctgccgaaccaaaagaa

SEQ ID NO: 693226 - DNA, 21 bp, Homo sapiens
aagctgccgaaccaaaagaat

SEQ ID NO: 693227 - DNA, 16 bp, Homo sapiens
aagctgcctcaaggaa

SEQ ID NO: 693228 - DNA, 23 bp, Homo sapiens
aagctgcctcccctctccttcct

SEQ ID NO: 693229 - DNA, 11 bp, Homo sapiens
aagctgcctct

SEQ ID NO: 693230 - DNA, 13 bp, Homo sapiens
aagctgcctctga

SEQ ID NO: 693231 - DNA, 22 bp, Homo sapiens
aagctgcctctgacagcagcct

SEQ ID NO: 693232 - DNA, 15 bp, Homo sapiens
aagctgcctggtata

SEQ ID NO: 693233 - DNA, 12 bp, Homo sapiens
aagctgcctgtg

SEQ ID NO: 693234 - DNA, 16 bp, Homo sapiens
aagctgctccaggcct

SEQ ID NO: 693235 - DNA, 13 bp, Homo sapiens
aagctgctgtgtc

SEQ ID NO: 693236 - DNA, 14 bp, Homo sapiens
aagctgctgtgtcc

SEQ ID NO: 693237 - DNA, 19 bp, Homo sapiens
aagctgctgtgtcctctag

SEQ ID NO: 693238 - DNA, 21 bp, Homo sapiens
aagctgctttaaaaaaataca

SEQ ID NO: 693239 - DNA, 11 bp, Homo sapiens
aagctggaagc

SEQ ID NO: 693240 - DNA, 14 bp, Homo sapiens
agttgatctgctct

SEQ ID NO: 693241 - DNA, 16 bp, Homo sapiens
agttgatgactttctg

SEQ ID NO: 693242 - DNA, 15 bp, Homo sapiens
agttgattcagctct

SEQ ID NO: 693243 - DNA, 23 bp, Homo sapiens
agttgattcagctctgcaagaat

SEQ ID NO: 693244 - DNA, 19 bp, Homo sapiens
agttgattttgaacttttt

SEQ ID NO: 693245 - DNA, 20 bp, Homo sapiens
agttgcaaggcaaatgttta

SEQ ID NO: 693246 - DNA, 19 bp, Homo sapiens
agttgcaattgaattaaat

SEQ ID NO: 693247 - DNA, 11 bp, Homo sapiens
agttgcagaaa

SEQ ID NO: 693248 - DNA, 16 bp, Homo sapiens
agttgcagactcagtt

SEQ ID NO: 693249 - DNA, 17 bp, Homo sapiens
agttgcagactcagttt

SEQ ID NO: 693250 - DNA, 23 bp, Homo sapiens
agttgcagactcagtttgtcaga

SEQ ID NO: 693251 - DNA, 21 bp, Homo sapiens
agttgcagatgtattgactgt

SEQ ID NO: 693252 - DNA, 22 bp, Homo sapiens
agttgcagatgtattgactgta

SEQ ID NO: 693253 - DNA, 14 bp, Homo sapiens
agttgcagctgttt

SEQ ID NO: 693254 - DNA, 21 bp, Homo sapiens
agttgcagctgttttgttgac

SEQ ID NO: 693255 - DNA, 16 bp, Homo sapiens
agttgcagtattggac

SEQ ID NO: 693256 - DNA, 11 bp, Homo sapiens
agttgcagttt

SEQ ID NO: 693257 - DNA, 13 bp, Homo sapiens
agttgcatgtagt

SEQ ID NO: 693258 - DNA, 18 bp, Homo sapiens
agttgcatgtagtaacac

SEQ ID NO: 693259 - DNA, 22 bp, Homo sapiens
agttgcatgtagtaacactaat

SEQ ID NO: 693260 - DNA, 17 bp, Homo sapiens
agttgccaagacaaatc

SEQ ID NO: 693261 - DNA, 19 bp, Homo sapiens
agttgccaagacaaatcaa

SEQ ID NO: 693262 - DNA, 20 bp, Homo sapiens
agttgccatgtagacccctt

SEQ ID NO: 693263 - DNA, 21 bp, Homo sapiens
agttgcgacggagagaaaaaa

SEQ ID NO: 693264 - DNA, 16 bp, Homo sapiens
agttgctcaaaaagaa

SEQ ID NO: 693265 - DNA, 18 bp, Homo sapiens
agttgctcacatgtcttt

SEQ ID NO: 693266 - DNA, 13 bp, Homo sapiens
agttgctgtaaaa

SEQ ID NO: 693267 - DNA, 16 bp, Homo sapiens
agttgctgtcactgtt

SEQ ID NO: 693268 - DNA, 19 bp, Homo sapiens
agttgctgtgaactttcat

SEQ ID NO: 693269 - DNA, 20 bp, Homo sapiens
agttgcttaattttgatttt

SEQ ID NO: 693270 - DNA, 19 bp, Homo sapiens
agttgctttgccagagcag

SEQ ID NO: 693271 - DNA, 14 bp, Homo sapiens
agttggaaatattc

SEQ ID NO: 693272 - DNA, 15 bp, Homo sapiens
agttggaatttacca

SEQ ID NO: 693273 - DNA, 20 bp, Homo sapiens
agttggacagcaaaaccatt

SEQ ID NO: 693274 - DNA, 15 bp, Homo sapiens
agttggactctcagg

SEQ ID NO: 693275 - DNA, 18 bp, Homo sapiens
agttggagtttgtgtctg

SEQ ID NO: 693276 - DNA, 18 bp, Homo sapiens
agttggattaaattctgg

SEQ ID NO: 693277 - DNA, 21 bp, Homo sapiens
agttggcagaaatacagtctt

SEQ ID NO: 693278 - DNA, 20 bp, Homo sapiens
agttggcagagaaggcctct

SEQ ID NO: 693279 - DNA, 18 bp, Homo sapiens
agttggccaccttgcttg

SEQ ID NO: 693280 - DNA, 20 bp, Homo sapiens
agttggccagattgtggggt

SEQ ID NO: 693281 - DNA, 20 bp, Homo sapiens
agttggccatgatgtctttt

SEQ ID NO: 693282 - DNA, 18 bp, Homo sapiens
agttggctggatgaaatt

SEQ ID NO: 693283 - DNA, 14 bp, Homo sapiens
agttggctgtgttc

SEQ ID NO: 693284 - DNA, 22 bp, Homo sapiens
agttggctgtgttcgggggagc

SEQ ID NO: 693285 - DNA, 24 bp, Homo sapiens
agttggctttgcccacccctcact

SEQ ID NO: 693286 - DNA, 13 bp, Homo sapiens
agttgggagcact

SEQ ID NO: 693287 - DNA, 15 bp, Homo sapiens
agttgggagcactgg

SEQ ID NO: 693288 - DNA, 17 bp, Homo sapiens
agttggggcactgggcg

SEQ ID NO: 693289 - DNA, 19 bp, Homo sapiens
agttggggccctcttgcca

SEQ ID NO: 693290 - DNA, 21 bp, Homo sapiens
agttgggggtcagtgctgcct

SEQ ID NO: 693291 - DNA, 15 bp, Homo sapiens
agttgggtgtttcca

SEQ ID NO: 693292 - DNA, 14 bp, Homo sapiens
agttggtattaata

SEQ ID NO: 693293 - DNA, 18 bp, Homo sapiens
agttggtgactgggaaag

SEQ ID NO: 693294 - DNA, 17 bp, Homo sapiens
aaggagcagtgtgacct

SEQ ID NO: 693295 - DNA, 23 bp, Homo sapiens
aaggagccttgataatacttgac

SEQ ID NO: 693296 - DNA, 13 bp, Homo sapiens
aaggagcgggcag

SEQ ID NO: 693297 - DNA, 21 bp, Homo sapiens
aaggagctactgacattccta

SEQ ID NO: 693298 - DNA, 13 bp, Homo sapiens
aaggagctcaccc

SEQ ID NO: 693299 - DNA, 19 bp, Homo sapiens
aaggagcttacccaagctg

SEQ ID NO: 693300 - DNA, 19 bp, Homo sapiens
aaggaggaaataactaaga

SEQ ID NO: 693301 - DNA, 18 bp, Homo sapiens
aaggaggaagagaaaaaa

SEQ ID NO: 693302 - DNA, 13 bp, Homo sapiens
aaggaggacccag

SEQ ID NO: 693303 - DNA, 22 bp, Homo sapiens
aaggaggacccaggacaggatc

SEQ ID NO: 693304 - DNA, 16 bp, Homo sapiens
aaggaggccaaccagc

SEQ ID NO: 693305 - DNA, 20 bp, Homo sapiens
aaggaggccaaccagcccga

SEQ ID NO: 693306 - DNA, 23 bp, Homo sapiens
aaggaggccaaccagcccgacag

SEQ ID NO: 693307 - DNA, 20 bp, Homo sapiens
aaggaggcctggggaggccc

SEQ ID NO: 693308 - DNA, 16 bp, Homo sapiens
aaggagggagaaagga

SEQ ID NO: 693309 - DNA, 18 bp, Homo sapiens
aaggagggagaaaggaga

SEQ ID NO: 693310 - DNA, 18 bp, Homo sapiens
aaggagggcacattaact

SEQ ID NO: 693311 - DNA, 13 bp, Homo sapiens
aaggagggcagag

SEQ ID NO: 693312 - DNA, 15 bp, Homo sapiens
aaggagggcagagcc

SEQ ID NO: 693313 - DNA, 19 bp, Homo sapiens
aaggaggggaaaaaaatgt

SEQ ID NO: 693314 - DNA, 17 bp, Homo sapiens
aaggaggggctgtaaaa

SEQ ID NO: 693315 - DNA, 13 bp, Homo sapiens
aaggagtagaaaa

SEQ ID NO: 693316 - DNA, 20 bp, Homo sapiens
aaggagtcagacattttaag

SEQ ID NO: 693317 - DNA, 18 bp, Homo sapiens
aaggagtggccacagcac

SEQ ID NO: 693318 - DNA, 17 bp, Homo sapiens
aaggagtttattacaat

SEQ ID NO: 693319 - DNA, 15 bp, Homo sapiens
aaggataaatcataa

SEQ ID NO: 693320 - DNA, 19 bp, Homo sapiens
aaggataaatcataaagtc

SEQ ID NO: 693321 - DNA, 13 bp, Homo sapiens
aaggataactctg

SEQ ID NO: 693322 - DNA, 15 bp, Homo sapiens
aaggataactctgta

SEQ ID NO: 693323 - DNA, 13 bp, Homo sapiens
aaggatacaaaag

SEQ ID NO: 693324 - DNA, 21 bp, Homo sapiens
aaggatacaaaagcatgtgag

SEQ ID NO: 693325 - DNA, 14 bp, Homo sapiens
aaggatacataatg

SEQ ID NO: 693326 - DNA, 19 bp, Homo sapiens
aaggatactgtaacacttt

SEQ ID NO: 693327 - DNA, 20 bp, Homo sapiens
aaggatagtgcgatgtttca

SEQ ID NO: 693328 - DNA, 22 bp, Homo sapiens
aaggatataaaaggatgttaca

SEQ ID NO: 693329 - DNA, 14 bp, Homo sapiens
aaggatatgattaa

SEQ ID NO: 693330 - DNA, 23 bp, Homo sapiens
aaggatatgattaatattattaa

SEQ ID NO: 693331 - DNA, 22 bp, Homo sapiens
aaggatattatctacctgttct

SEQ ID NO: 693332 - DNA, 17 bp, Homo sapiens
aaggatatttaagaaaa

SEQ ID NO: 693333 - DNA, 15 bp, Homo sapiens
aaggatcaggctgct

SEQ ID NO: 693334 - DNA, 16 bp, Homo sapiens
aaggatccggaaagaa

SEQ ID NO: 693335 - DNA, 17 bp, Homo sapiens
aaggatccggaaagaag

SEQ ID NO: 693336 - DNA, 16 bp, Homo sapiens
aaggatcctctccact

SEQ ID NO: 693337 - DNA, 18 bp, Homo sapiens
aaggatcctctccactcc

SEQ ID NO: 693338 - DNA, 16 bp, Homo sapiens
aaggatctctcaggag

SEQ ID NO: 693339 - DNA, 20 bp, Homo sapiens
aaggatctgctgaggcccag

SEQ ID NO: 693340 - DNA, 16 bp, Homo sapiens
aaggatctttgtggcc

SEQ ID NO: 693341 - DNA, 23 bp, Homo sapiens
aaggatgaatgaggtcccaggca

SEQ ID NO: 693342 - DNA, 15 bp, Homo sapiens
aaggatgaccacacc

SEQ ID NO: 693343 - DNA, 16 bp, Homo sapiens
aaggatgaccacaccc

SEQ ID NO: 693344 - DNA, 15 bp, Homo sapiens
aaggatgagaatgtg

SEQ ID NO: 693345 - DNA, 19 bp, Homo sapiens
aaggatgagaatgtgacct

SEQ ID NO: 693346 - DNA, 19 bp, Homo sapiens
aaggatgccttagcatgtg

SEQ ID NO: 693347 - DNA, 21 bp, Homo sapiens
aaggatggtggttattttaaa

SEQ ID NO: 693348 - DNA, 15 bp, Homo sapiens
aaggatgtgattgtg

SEQ ID NO: 693349 - DNA, 17 bp, Homo sapiens
aaggatgtgattgtgga

SEQ ID NO: 693350 - DNA, 21 bp, Homo sapiens
aaggattcctctttgtttatc

SEQ ID NO: 693351 - DNA, 16 bp, Homo sapiens
aaggattgcatcctgc

SEQ ID NO: 693352 - DNA, 17 bp, Homo sapiens
aaggattttaccaaagc

SEQ ID NO: 693353 - DNA, 18 bp, Homo sapiens
aaggattttaccaaagca

SEQ ID NO: 693354 - DNA, 18 bp, Homo sapiens
aaggattttcatgttgat

SEQ ID NO: 693355 - DNA, 12 bp, Homo sapiens
aaggcaaaagac

SEQ ID NO: 693356 - DNA, 13 bp, Homo sapiens
aaggcaaaagact

SEQ ID NO: 693357 - DNA, 14 bp, Homo sapiens
aaggcaaaattgca

SEQ ID NO: 693358 - DNA, 15 bp, Homo sapiens
aaggcaaacccatca

SEQ ID NO: 693359 - DNA, 17 bp, Homo sapiens
aaggcaaagtttacaga

SEQ ID NO: 693360 - DNA, 17 bp, Homo sapiens
aaggcaaataatggaaa

SEQ ID NO: 693361 - DNA, 21 bp, Homo sapiens
aaggcaacattcctttcttgt

SEQ ID NO: 693362 - DNA, 15 bp, Homo sapiens
agtttgtgttagaaa

SEQ ID NO: 693363 - DNA, 17 bp, Homo sapiens
agtttgtgttagaaaag

SEQ ID NO: 693364 - DNA, 22 bp, Homo sapiens
agtttgttcacttaaattcttt

SEQ ID NO: 693365 - DNA, 16 bp, Homo sapiens
agtttgttctgttctg

SEQ ID NO: 693366 - DNA, 20 bp, Homo sapiens
agtttgttctgttctggggg

SEQ ID NO: 693367 - DNA, 15 bp, Homo sapiens
agtttgttgaaaaca

SEQ ID NO: 693368 - DNA, 18 bp, Homo sapiens
agttttaactagaattta

SEQ ID NO: 693369 - DNA, 14 bp, Homo sapiens
agttttaataagaa

SEQ ID NO: 693370 - DNA, 17 bp, Homo sapiens
agttttaatctcttaat

SEQ ID NO: 693371 - DNA, 16 bp, Homo sapiens
agttttaattaaaaaa

SEQ ID NO: 693372 - DNA, 17 bp, Homo sapiens
agttttaattaaaaaaa

SEQ ID NO: 693373 - DNA, 22 bp, Homo sapiens
agttttacagagaggatacatt

SEQ ID NO: 693374 - DNA, 23 bp, Homo sapiens
agttttacagagaggatacattt

SEQ ID NO: 693375 - DNA, 15 bp, Homo sapiens
agttttacattttaa

SEQ ID NO: 693376 - DNA, 18 bp, Homo sapiens
agttttactcttaaatca

SEQ ID NO: 693377 - DNA, 23 bp, Homo sapiens
agttttactcttaaatcatttgg

SEQ ID NO: 693378 - DNA, 19 bp, Homo sapiens
agttttacttttaaactgt

SEQ ID NO: 693379 - DNA, 20 bp, Homo sapiens
agttttacttttaaactgtg

SEQ ID NO: 693380 - DNA, 19 bp, Homo sapiens
agttttagaatcttttaaa

SEQ ID NO: 693381 - DNA, 20 bp, Homo sapiens
agttttagggtacagtttgg

SEQ ID NO: 693382 - DNA, 15 bp, Homo sapiens
agttttatcattttc

SEQ ID NO: 693383 - DNA, 20 bp, Homo sapiens
agttttatcattttcaaaat

SEQ ID NO: 693384 - DNA, 22 bp, Homo sapiens
agttttatgcgacagctttact

SEQ ID NO: 693385 - DNA, 19 bp, Homo sapiens
agttttatggcatgattta

SEQ ID NO: 693386 - DNA, 21 bp, Homo sapiens
agttttattgagaattttaaa

SEQ ID NO: 693387 - DNA, 16 bp, Homo sapiens
agttttatttttaaga

SEQ ID NO: 693388 - DNA, 18 bp, Homo sapiens
agttttatttttaagaaa

SEQ ID NO: 693389 - DNA, 14 bp, Homo sapiens
agttttcaaactgc

SEQ ID NO: 693390 - DNA, 22 bp, Homo sapiens
agttttcaaactgctgcatact

SEQ ID NO: 693391 - DNA, 22 bp, Homo sapiens
agttttcaagtcaaattaataa

SEQ ID NO: 693392 - DNA, 12 bp, Homo sapiens
agttttcagaaa

SEQ ID NO: 693393 - DNA, 18 bp, Homo sapiens
agttttcagaaaaagaaa

SEQ ID NO: 693394 - DNA, 18 bp, Homo sapiens
agttttcagaacctcttc

SEQ ID NO: 693395 - DNA, 16 bp, Homo sapiens
agttttcagccttggg

SEQ ID NO: 693396 - DNA, 15 bp, Homo sapiens
agttttcagtttgta

SEQ ID NO: 693397 - DNA, 18 bp, Homo sapiens
agttttcatagtatccat

SEQ ID NO: 693398 - DNA, 15 bp, Homo sapiens
agttttccagtattg

SEQ ID NO: 693399 - DNA, 18 bp, Homo sapiens
agttttccagtattgaaa

SEQ ID NO: 693400 - DNA, 13 bp, Homo sapiens
agttttccatgaa

SEQ ID NO: 693401 - DNA, 13 bp, Homo sapiens
agttttcccctgg

SEQ ID NO: 693402 - DNA, 15 bp, Homo sapiens
agttttcccctggcc

SEQ ID NO: 693403 - DNA, 16 bp, Homo sapiens
agttttcccctggcct

SEQ ID NO: 693404 - DNA, 17 bp, Homo sapiens
agttttcccctggcctc

SEQ ID NO: 693405 - DNA, 11 bp, Homo sapiens
agttttcctga

SEQ ID NO: 693406 - DNA, 14 bp, Homo sapiens
agttttccttctca

SEQ ID NO: 693407 - DNA, 18 bp, Homo sapiens
agttttccttctcatctg

SEQ ID NO: 693408 - DNA, 13 bp, Homo sapiens
agttttccttctg

SEQ ID NO: 693409 - DNA, 21 bp, Homo sapiens
agttttccttctgttaaaatg

SEQ ID NO: 693410 - DNA, 19 bp, Homo sapiens
agttttccttgctatttca

SEQ ID NO: 693411 - DNA, 22 bp, Homo sapiens
agttttctccttgatatcattc

SEQ ID NO: 693412 - DNA, 17 bp, Homo sapiens
agttttctccttttact

SEQ ID NO: 693413 - DNA, 15 bp, Homo sapiens
agttttgaaagaaaa

SEQ ID NO: 693414 - DNA, 18 bp, Homo sapiens
agttttgagtaattcaag

SEQ ID NO: 693415 - DNA, 17 bp, Homo sapiens
agttttgagtgtactgt

SEQ ID NO: 693416 - DNA, 14 bp, Homo sapiens
agttttgagtgtat

SEQ ID NO: 693417 - DNA, 17 bp, Homo sapiens
agttttgataaagtaat

SEQ ID NO: 693418 - DNA, 17 bp, Homo sapiens
agttttgatataatctt

SEQ ID NO: 693419 - DNA, 21 bp, Homo sapiens
agttttgatataatcttggct

SEQ ID NO: 693420 - DNA, 20 bp, Homo sapiens
agttttgattttggaaagat

SEQ ID NO: 693421 - DNA, 16 bp, Homo sapiens
agttttgcaaagtgca

SEQ ID NO: 693422 - DNA, 17 bp, Homo sapiens
agttttggagagggaag

SEQ ID NO: 693423 - DNA, 15 bp, Homo sapiens
agttttggcagccag

SEQ ID NO: 693424 - DNA, 20 bp, Homo sapiens
agttttgtaacttagcttta

SEQ ID NO: 693425 - DNA, 22 bp, Homo sapiens
agttttgtaacttagctttatt

SEQ ID NO: 693426 - DNA, 17 bp, Homo sapiens
aagggcctggccagtcc

SEQ ID NO: 693427 - DNA, 15 bp, Homo sapiens
aagggctccagcatc

SEQ ID NO: 693428 - DNA, 23 bp, Homo sapiens
aagggctccagcatccagcctgt

SEQ ID NO: 693429 - DNA, 13 bp, Homo sapiens
aagggctgcatga

SEQ ID NO: 693430 - DNA, 13 bp, Homo sapiens
aagggctgccttg

SEQ ID NO: 693431 - DNA, 22 bp, Homo sapiens
aagggctggctccccctcccca

SEQ ID NO: 693432 - DNA, 23 bp, Homo sapiens
aagggctggctccccctccccag

SEQ ID NO: 693433 - DNA, 14 bp, Homo sapiens
aagggcttactatt

SEQ ID NO: 693434 - DNA, 19 bp, Homo sapiens
aagggcttctgcaccctcc

SEQ ID NO: 693435 - DNA, 22 bp, Homo sapiens
aagggcttctgcaccctccacc

SEQ ID NO: 693436 - DNA, 20 bp, Homo sapiens
aagggctttggttccttctc

SEQ ID NO: 693437 - DNA, 22 bp, Homo sapiens
aagggctttggttccttctctg

SEQ ID NO: 693438 - DNA, 23 bp, Homo sapiens
aagggctttggttccttctctgg

SEQ ID NO: 693439 - DNA, 12 bp, Homo sapiens
aaggggacaggc

SEQ ID NO: 693440 - DNA, 16 bp, Homo sapiens
aaggggacaggcctca

SEQ ID NO: 693441 - DNA, 22 bp, Homo sapiens
aaggggagaaactgaaagtgtt

SEQ ID NO: 693442 - DNA, 23 bp, Homo sapiens
aaggggagaaactgaaagtgttt

SEQ ID NO: 693443 - DNA, 15 bp, Homo sapiens
aaggggagagcctgc

SEQ ID NO: 693444 - DNA, 18 bp, Homo sapiens
aaggggagagcctgctgg

SEQ ID NO: 693445 - DNA, 19 bp, Homo sapiens
aaggggagagcctgctggc

SEQ ID NO: 693446 - DNA, 22 bp, Homo sapiens
aaggggagccagaaatgggcag

SEQ ID NO: 693447 - DNA, 12 bp, Homo sapiens
aaggggaggaga

SEQ ID NO: 693448 - DNA, 22 bp, Homo sapiens
aaggggagggtgttcagaggca

SEQ ID NO: 693449 - DNA, 15 bp, Homo sapiens
aaggggatggaggcc

SEQ ID NO: 693450 - DNA, 18 bp, Homo sapiens
aaggggatggaggccaga

SEQ ID NO: 693451 - DNA, 14 bp, Homo sapiens
aaggggatttttat

SEQ ID NO: 693452 - DNA, 14 bp, Homo sapiens
aaggggcacaccac

SEQ ID NO: 693453 - DNA, 17 bp, Homo sapiens
aaggggcacaccactgc

SEQ ID NO: 693454 - DNA, 21 bp, Homo sapiens
aaggggcccaagccccatctc

SEQ ID NO: 693455 - DNA, 18 bp, Homo sapiens
aaggggccccggggctgg

SEQ ID NO: 693456 - DNA, 16 bp, Homo sapiens
aaggggctgaaagaac

SEQ ID NO: 693457 - DNA, 12 bp, Homo sapiens
aaggggctgctg

SEQ ID NO: 693458 - DNA, 14 bp, Homo sapiens
aaggggctgctggg

SEQ ID NO: 693459 - DNA, 21 bp, Homo sapiens
aaggggctgctggggcatgtg

SEQ ID NO: 693460 - DNA, 13 bp, Homo sapiens
aaggggcttctgg

SEQ ID NO: 693461 - DNA, 22 bp, Homo sapiens
aagggggcggggactgctggct

SEQ ID NO: 693462 - DNA, 13 bp, Homo sapiens
aaggggggagggg

SEQ ID NO: 693463 - DNA, 18 bp, Homo sapiens
aaggggggcagggagtga

SEQ ID NO: 693464 - DNA, 17 bp, Homo sapiens
aagggggtcaaaggaag

SEQ ID NO: 693465 - DNA, 17 bp, Homo sapiens
aagggggtcccagtggg

SEQ ID NO: 693466 - DNA, 14 bp, Homo sapiens
aagggggtgactgg

SEQ ID NO: 693467 - DNA, 19 bp, Homo sapiens
aagggggtgactggaagtt

SEQ ID NO: 693468 - DNA, 21 bp, Homo sapiens
aagggggtgcaaagactctga

SEQ ID NO: 693469 - DNA, 16 bp, Homo sapiens
aaggggtcctgcaggg

SEQ ID NO: 693470 - DNA, 16 bp, Homo sapiens
aaggggtgcacccacc

SEQ ID NO: 693471 - DNA, 14 bp, Homo sapiens
aaggggtgctttta

SEQ ID NO: 693472 - DNA, 22 bp, Homo sapiens
aaggggttggggtgacagtcat

SEQ ID NO: 693473 - DNA, 16 bp, Homo sapiens
aagggtaggatgttgc

SEQ ID NO: 693474 - DNA, 12 bp, Homo sapiens
aagggtcctctt

SEQ ID NO: 693475 - DNA, 17 bp, Homo sapiens
aagggtctagggagaga

SEQ ID NO: 693476 - DNA, 18 bp, Homo sapiens
aagggtctagggagagac

SEQ ID NO: 693477 - DNA, 22 bp, Homo sapiens
aagggtctagggagagaccctt

SEQ ID NO: 693478 - DNA, 16 bp, Homo sapiens
aagggtgctgcttccc

SEQ ID NO: 693479 - DNA, 19 bp, Homo sapiens
aagggtgctgcttccctct

SEQ ID NO: 693480 - DNA, 12 bp, Homo sapiens
aagggtggaaat

SEQ ID NO: 693481 - DNA, 16 bp, Homo sapiens
aagggtgggtgctcag

SEQ ID NO: 693482 - DNA, 19 bp, Homo sapiens
aagggtgggtgctcagaat

SEQ ID NO: 693483 - DNA, 16 bp, Homo sapiens
aagggttctgccctgc

SEQ ID NO: 693484 - DNA, 12 bp, Homo sapiens
aagtatttataa

SEQ ID NO: 693485 - DNA, 14 bp, Homo sapiens
aagtatttataaaa

SEQ ID NO: 693486 - DNA, 16 bp, Homo sapiens
aagtatttataaaaat

SEQ ID NO: 693487 - DNA, 19 bp, Homo sapiens
aagtatttataaaaatata

SEQ ID NO: 693488 - DNA, 15 bp, Homo sapiens
aagtatttatatatt

SEQ ID NO: 693489 - DNA, 16 bp, Homo sapiens
aagtatttatatattt

SEQ ID NO: 693490 - DNA, 20 bp, Homo sapiens
aagtatttatatatttataa

SEQ ID NO: 693491 - DNA, 21 bp, Homo sapiens
aagtatttcaaattggagctt

SEQ ID NO: 693492 - DNA, 15 bp, Homo sapiens
aagtattttcctgtt

SEQ ID NO: 693493 - DNA, 22 bp, Homo sapiens
aagtatttttgtctcttagaaa

SEQ ID NO: 693494 - DNA, 15 bp, Homo sapiens
aagtatttttttatc

SEQ ID NO: 693495 - DNA, 16 bp, Homo sapiens
aagtcaaaaggtgcct

SEQ ID NO: 693496 - DNA, 19 bp, Homo sapiens
aagtcaaaaggtgcctgtg

SEQ ID NO: 693497 - DNA, 14 bp, Homo sapiens
aagtcaaagtaaaa

SEQ ID NO: 693498 - DNA, 19 bp, Homo sapiens
aagtcaaattaataatctt

SEQ ID NO: 693499 - DNA, 13 bp, Homo sapiens
aagtcaacagtaa

SEQ ID NO: 693500 - DNA, 19 bp, Homo sapiens
aagtcaacagtaaaccact

SEQ ID NO: 693501 - DNA, 21 bp, Homo sapiens
aagtcaacagtaaaccactga

SEQ ID NO: 693502 - DNA, 14 bp, Homo sapiens
aagtcaagaagaat

SEQ ID NO: 693503 - DNA, 13 bp, Homo sapiens
aagtcaagcacat

SEQ ID NO: 693504 - DNA, 19 bp, Homo sapiens
aagtcaataaaagagctgt

SEQ ID NO: 693505 - DNA, 22 bp, Homo sapiens
aagtcaataaaagagctgtctg

SEQ ID NO: 693506 - DNA, 23 bp, Homo sapiens
aagtcaataaaagagctgtctga

SEQ ID NO: 693507 - DNA, 14 bp, Homo sapiens
aagtcaatgtactt

SEQ ID NO: 693508 - DNA, 16 bp, Homo sapiens
aagtcacatcacagga

SEQ ID NO: 693509 - DNA, 22 bp, Homo sapiens
aagtcacatccctgtaaattgc

SEQ ID NO: 693510 - DNA, 18 bp, Homo sapiens
aagtcacgttgttttcag

SEQ ID NO: 693511 - DNA, 14 bp, Homo sapiens
aagtcactgaacaa

SEQ ID NO: 693512 - DNA, 14 bp, Homo sapiens
aagtcacttccagt

SEQ ID NO: 693513 - DNA, 16 bp, Homo sapiens
aagtcacttccagtgt

SEQ ID NO: 693514 - DNA, 23 bp, Homo sapiens
aagtcagatggaaaattcatttt

SEQ ID NO: 693515 - DNA, 22 bp, Homo sapiens
aagtcagccacactgggcctgg

SEQ ID NO: 693516 - DNA, 20 bp, Homo sapiens
aagtcagctccagctttctg

SEQ ID NO: 693517 - DNA, 16 bp, Homo sapiens
aagtcagctgaaggat

SEQ ID NO: 693518 - DNA, 20 bp, Homo sapiens
aagtcagctttcagagccag

SEQ ID NO: 693519 - DNA, 15 bp, Homo sapiens
aagtcaggccaggtg

SEQ ID NO: 693520 - DNA, 23 bp, Homo sapiens
aagtcagtccaggatgctaacat

SEQ ID NO: 693521 - DNA, 20 bp, Homo sapiens
aagtcagtgcccaactgtta

SEQ ID NO: 693522 - DNA, 17 bp, Homo sapiens
aagtcatagccataaat

SEQ ID NO: 693523 - DNA, 21 bp, Homo sapiens
aagtcatcccctctcaggaga

SEQ ID NO: 693524 - DNA, 19 bp, Homo sapiens
aagtcatctacttaataaa

SEQ ID NO: 693525 - DNA, 21 bp, Homo sapiens
aagtcatctgtttaatttaca

SEQ ID NO: 693526 - DNA, 14 bp, Homo sapiens
aagtcatcttgcta

SEQ ID NO: 693527 - DNA, 17 bp, Homo sapiens
aagtcatgtatgtttct

SEQ ID NO: 693528 - DNA, 15 bp, Homo sapiens
aagtcattaaagaca

SEQ ID NO: 693529 - DNA, 14 bp, Homo sapiens
aagtcatttgtgaa

SEQ ID NO: 693530 - DNA, 20 bp, Homo sapiens
aagtcattttaactttatca

SEQ ID NO: 693531 - DNA, 22 bp, Homo sapiens
aagtcattttaactttatcaca

SEQ ID NO: 693532 - DNA, 20 bp, Homo sapiens
aagtcccagagcacctcacc

SEQ ID NO: 693533 - DNA, 22 bp, Homo sapiens
aagtccccgagggcgaaggcca

SEQ ID NO: 693534 - DNA, 13 bp, Homo sapiens
aagtccctccctg

SEQ ID NO: 693535 - DNA, 22 bp, Homo sapiens
aagtccctgtaattgttgtttg

SEQ ID NO: 693536 - DNA, 11 bp, Homo sapiens
aagtcccttcc

SEQ ID NO: 693537 - DNA, 17 bp, Homo sapiens
aagtcccttcctattct

SEQ ID NO: 693538 - DNA, 14 bp, Homo sapiens
aagtcccttcctgc

SEQ ID NO: 693539 - DNA, 20 bp, Homo sapiens
aagtcccttgagactcccca

SEQ ID NO: 693540 - DNA, 19 bp, Homo sapiens
aagtccgcagaagccctga

SEQ ID NO: 693541 - DNA, 17 bp, Homo sapiens
aagtcctacaagctaaa

SEQ ID NO: 693542 - DNA, 23 bp, Homo sapiens
aagtcctccctgacttttctgtg

SEQ ID NO: 693543 - DNA, 12 bp, Homo sapiens
aagtcctctgct

SEQ ID NO: 693544 - DNA, 21 bp, Homo sapiens
aagtcctgaactcctggcttt

SEQ ID NO: 693545 - DNA, 23 bp, Homo sapiens
aagtcctgaagaggcgggccagc

SEQ ID NO: 693546 - DNA, 23 bp, Homo sapiens
aagtcctggctacatcccagcct

SEQ ID NO: 693547 - DNA, 22 bp, Homo sapiens
aagtccttcagtgagcccctcc

SEQ ID NO: 693548 - DNA, 20 bp, Homo sapiens
aagtccttgacctctataaa

SEQ ID NO: 693549 - DNA, 15 bp, Homo sapiens
aagtcgaattaatag

SEQ ID NO: 693550 - DNA, 21 bp, Homo sapiens
aagtcgggtcaaaaataaaat

SEQ ID NO: 693551 - DNA, 21 bp, Homo sapiens
aagtctaaaaagacctggcct

SEQ ID NO: 693552 - DNA, 23 bp, Homo sapiens
aagtctaaaaagacctggccttt

SEQ ID NO: 693553 - DNA, 17 bp, Homo sapiens
aagtctaaactgttaaa

SEQ ID NO: 693554 - DNA, 15 bp, Homo sapiens
aagtctaattcacag

SEQ ID NO: 693555 - DNA, 13 bp, Homo sapiens
aagtctagaatca

SEQ ID NO: 693556 - DNA, 14 bp, Homo sapiens
aagtctagaatcat

SEQ ID NO: 693557 - DNA, 20 bp, Homo sapiens
aagtctaggttggtagagtt

SEQ ID NO: 693558 - DNA, 13 bp, Homo sapiens
aagtctagtcttc

SEQ ID NO: 693559 - DNA, 12 bp, Homo sapiens
ataaagtggaaa

SEQ ID NO: 693560 - DNA, 14 bp, Homo sapiens
ataaagtgtaacaa

SEQ ID NO: 693561 - DNA, 17 bp, Homo sapiens
ataaagttgtaaataat

SEQ ID NO: 693562 - DNA, 22 bp, Homo sapiens
ataaagttgtaaataattttct

SEQ ID NO: 693563 - DNA, 23 bp, Homo sapiens
ataaagttgtaaataattttcta

SEQ ID NO: 693564 - DNA, 18 bp, Homo sapiens
ataaagttgttttatctt

SEQ ID NO: 693565 - DNA, 22 bp, Homo sapiens
ataaagtttttttccttaaaaa

SEQ ID NO: 693566 - DNA, 14 bp, Homo sapiens
ataaataaaactga

SEQ ID NO: 693567 - DNA, 15 bp, Homo sapiens
ataaataaaactgaa

SEQ ID NO: 693568 - DNA, 19 bp, Homo sapiens
ataaataaaactgaatctc

SEQ ID NO: 693569 - DNA, 13 bp, Homo sapiens
ataaataacaaaa

SEQ ID NO: 693570 - DNA, 14 bp, Homo sapiens
ataaataacttttt

SEQ ID NO: 693571 - DNA, 21 bp, Homo sapiens
ataaataatcggcccacagct

SEQ ID NO: 693572 - DNA, 11 bp, Homo sapiens
ataaataattt

SEQ ID NO: 693573 - DNA, 15 bp, Homo sapiens
ataaataattttaat

SEQ ID NO: 693574 - DNA, 12 bp, Homo sapiens
ataaatacatac

SEQ ID NO: 693575 - DNA, 14 bp, Homo sapiens
ataaatacctctta

SEQ ID NO: 693576 - DNA, 20 bp, Homo sapiens
ataaatacgtattacaaaca

SEQ ID NO: 693577 - DNA, 18 bp, Homo sapiens
ataaatactgcaaatcag

SEQ ID NO: 693578 - DNA, 14 bp, Homo sapiens
ataaatagaactat

SEQ ID NO: 693579 - DNA, 11 bp, Homo sapiens
ataaatagcta

SEQ ID NO: 693580 - DNA, 21 bp, Homo sapiens
ataaatagctatatccatgta

SEQ ID NO: 693581 - DNA, 23 bp, Homo sapiens
ataaatatataaaaagaaaagat

SEQ ID NO: 693582 - DNA, 16 bp, Homo sapiens
ataaatatatataaac

SEQ ID NO: 693583 - DNA, 22 bp, Homo sapiens
ataaatatatataaacctaaaa

SEQ ID NO: 693584 - DNA, 21 bp, Homo sapiens
ataaatatatatatatataaa

SEQ ID NO: 693585 - DNA, 22 bp, Homo sapiens
ataaatatatatatatataaaa

SEQ ID NO: 693586 - DNA, 14 bp, Homo sapiens
ataaatatcagtat

SEQ ID NO: 693587 - DNA, 18 bp, Homo sapiens
ataaatatccccagggac

SEQ ID NO: 693588 - DNA, 14 bp, Homo sapiens
ataaatatgtaata

SEQ ID NO: 693589 - DNA, 16 bp, Homo sapiens
ataaatatttatgctt

SEQ ID NO: 693590 - DNA, 20 bp, Homo sapiens
ataaatatttatgtagatgt

SEQ ID NO: 693591 - DNA, 20 bp, Homo sapiens
ataaatatttgacttgcatg

SEQ ID NO: 693592 - DNA, 18 bp, Homo sapiens
ataaatatttttggggca

SEQ ID NO: 693593 - DNA, 15 bp, Homo sapiens
ataaatcagaaagtt

SEQ ID NO: 693594 - DNA, 17 bp, Homo sapiens
ataaatcagtatttttt

SEQ ID NO: 693595 - DNA, 17 bp, Homo sapiens
ataaatcagtgaactgt

SEQ ID NO: 693596 - DNA, 12 bp, Homo sapiens
ataaatcataaa

SEQ ID NO: 693597 - DNA, 16 bp, Homo sapiens
ataaatcataaagtca

SEQ ID NO: 693598 - DNA, 15 bp, Homo sapiens
ataaatcatgttgtt

SEQ ID NO: 693599 - DNA, 21 bp, Homo sapiens
ataaatcattcttactaaaaa

SEQ ID NO: 693600 - DNA, 15 bp, Homo sapiens
ataaatcatttcagt

SEQ ID NO: 693601 - DNA, 17 bp, Homo sapiens
ataaatccaatatcatg

SEQ ID NO: 693602 - DNA, 21 bp, Homo sapiens
ataaatctaataattattcat

SEQ ID NO: 693603 - DNA, 19 bp, Homo sapiens
ataaatctaggatgtgatg

SEQ ID NO: 693604 - DNA, 21 bp, Homo sapiens
ataaatgaaacttggccagtt

SEQ ID NO: 693605 - DNA, 22 bp, Homo sapiens
aagtgtcatatgtaggtgtctg

SEQ ID NO: 693606 - DNA, 14 bp, Homo sapiens
aagtgtccttcttg

SEQ ID NO: 693607 - DNA, 16 bp, Homo sapiens
aagtgtctctgccttg

SEQ ID NO: 693608 - DNA, 20 bp, Homo sapiens
aagtgtcttctgttcccaag

SEQ ID NO: 693609 - DNA, 16 bp, Homo sapiens
aagtgtgaagtgcaga

SEQ ID NO: 693610 - DNA, 11 bp, Homo sapiens
aagtgtgagta

SEQ ID NO: 693611 - DNA, 21 bp, Homo sapiens
aagtgtggaaaaatagctctg

SEQ ID NO: 693612 - DNA, 12 bp, Homo sapiens
aagtgtggctgg

SEQ ID NO: 693613 - DNA, 17 bp, Homo sapiens
aagtgtggctggtgtcc

SEQ ID NO: 693614 - DNA, 23 bp, Homo sapiens
aagtgtgggtttggttagaggaa

SEQ ID NO: 693615 - DNA, 17 bp, Homo sapiens
aagtgtgtatctagctt

SEQ ID NO: 693616 - DNA, 12 bp, Homo sapiens
aagtgtgtatgt

SEQ ID NO: 693617 - DNA, 15 bp, Homo sapiens
aagtgtgtattaaaa

SEQ ID NO: 693618 - DNA, 11 bp, Homo sapiens
aagtgtgtgtg

SEQ ID NO: 693619 - DNA, 13 bp, Homo sapiens
aagtgtgtgtgcg

SEQ ID NO: 693620 - DNA, 17 bp, Homo sapiens
aagtgtgtgtgttctgt

SEQ ID NO: 693621 - DNA, 18 bp, Homo sapiens
aagtgttcaagaaataaa

SEQ ID NO: 693622 - DNA, 19 bp, Homo sapiens
aagtgttcaagaaataaaa

SEQ ID NO: 693623 - DNA, 18 bp, Homo sapiens
aagtgttcactgctcctt

SEQ ID NO: 693624 - DNA, 21 bp, Homo sapiens
aagtgttctcatgaagcagga

SEQ ID NO: 693625 - DNA, 18 bp, Homo sapiens
aagtgttgaagggaggtg

SEQ ID NO: 693626 - DNA, 16 bp, Homo sapiens
aagtgttgctcttgga

SEQ ID NO: 693627 - DNA, 18 bp, Homo sapiens
aagtgttgctcttggaaa

SEQ ID NO: 693628 - DNA, 22 bp, Homo sapiens
aagtgttgtatcaaagtgtgat

SEQ ID NO: 693629 - DNA, 14 bp, Homo sapiens
aagtgtttctgtta

SEQ ID NO: 693630 - DNA, 15 bp, Homo sapiens
aagtgttttactctt

SEQ ID NO: 693631 - DNA, 19 bp, Homo sapiens
aagtgttttactctttttc

SEQ ID NO: 693632 - DNA, 22 bp, Homo sapiens
aagtgttttctcagaacagctg

SEQ ID NO: 693633 - DNA, 22 bp, Homo sapiens
aagtgttttctctgaacacatt

SEQ ID NO: 693634 - DNA, 12 bp, Homo sapiens
aagttaaaacaa

SEQ ID NO: 693635 - DNA, 18 bp, Homo sapiens
aagttaaacattgaagta

SEQ ID NO: 693636 - DNA, 13 bp, Homo sapiens
aagttaaactaaa

SEQ ID NO: 693637 - DNA, 17 bp, Homo sapiens
aagttaaagtgaataac

SEQ ID NO: 693638 - DNA, 15 bp, Homo sapiens
aagttaacaaggaat

SEQ ID NO: 693639 - DNA, 20 bp, Homo sapiens
aagttaagctgctatagtaa

SEQ ID NO: 693640 - DNA, 12 bp, Homo sapiens
aagttaatagat

SEQ ID NO: 693641 - DNA, 16 bp, Homo sapiens
aagttacatgtttgca

SEQ ID NO: 693642 - DNA, 19 bp, Homo sapiens
aagttacatgtttgcacct

SEQ ID NO: 693643 - DNA, 22 bp, Homo sapiens
aagttacttaattgccagcaaa

SEQ ID NO: 693644 - DNA, 22 bp, Homo sapiens
aagttagaactagccaaaccag

SEQ ID NO: 693645 - DNA, 22 bp, Homo sapiens
aagttagagaactaaactagtt

SEQ ID NO: 693646 - DNA, 17 bp, Homo sapiens
aagttagcctttgaatg

SEQ ID NO: 693647 - DNA, 15 bp, Homo sapiens
aagttagggggttct

SEQ ID NO: 693648 - DNA, 17 bp, Homo sapiens
aagttagggggttctta

SEQ ID NO: 693649 - DNA, 20 bp, Homo sapiens
aagttagtatcttttgatat

SEQ ID NO: 693650 - DNA, 16 bp, Homo sapiens
aagttagtggaaatct

SEQ ID NO: 693651 - DNA, 23 bp, Homo sapiens
aagttagtggaaatctgaacatt

SEQ ID NO: 693652 - DNA, 19 bp, Homo sapiens
aagttagttccactgagac

SEQ ID NO: 693653 - DNA, 17 bp, Homo sapiens
aagttagtttgtatata

SEQ ID NO: 693654 - DNA, 22 bp, Homo sapiens
aagttagtttgtatatattatt

SEQ ID NO: 693655 - DNA, 20 bp, Homo sapiens
aagttataaatcaatgtcac

SEQ ID NO: 693656 - DNA, 18 bp, Homo sapiens
aagttataataactgaac

SEQ ID NO: 693657 - DNA, 22 bp, Homo sapiens
aagttatattgaatatatcaga

SEQ ID NO: 693658 - DNA, 12 bp, Homo sapiens
aagttatatttc

SEQ ID NO: 693659 - DNA, 23 bp, Homo sapiens
aagttatatttcagatgtaatgt

SEQ ID NO: 693660 - DNA, 23 bp, Homo sapiens
aagttattaacgggcatgtatta

SEQ ID NO: 693661 - DNA, 23 bp, Homo sapiens
aagttattaagaggtaagactta

SEQ ID NO: 693662 - DNA, 18 bp, Homo sapiens
aagttattcaaatttgta

SEQ ID NO: 693663 - DNA, 15 bp, Homo sapiens
aagttattgcagttt

SEQ ID NO: 693664 - DNA, 13 bp, Homo sapiens
aagttatttactt

SEQ ID NO: 693665 - DNA, 13 bp, Homo sapiens
aagttatttcttg

SEQ ID NO: 693666 - DNA, 19 bp, Homo sapiens
aagttatttcttgtttgtt

SEQ ID NO: 693667 - DNA, 19 bp, Homo sapiens
aagttattttcttgtttaa

SEQ ID NO: 693668 - DNA, 12 bp, Homo sapiens
aagttatttttc

SEQ ID NO: 693669 - DNA, 23 bp, Homo sapiens
aagttcagcccaccatctgtttg

SEQ ID NO: 693670 - DNA, 14 bp, Homo sapiens
aagttcaggctctg

SEQ ID NO: 693671 - DNA, 22 bp, Homo sapiens
aagttcatattccatatttatt

SEQ ID NO: 693672 - DNA, 19 bp, Homo sapiens
aagttccaagttgctaata

SEQ ID NO: 693673 - DNA, 15 bp, Homo sapiens
aagttccactgagct

SEQ ID NO: 693674 - DNA, 22 bp, Homo sapiens
aagttcccattattatttctgt

SEQ ID NO: 693675 - DNA, 23 bp, Homo sapiens
aagttcccattattatttctgtt

SEQ ID NO: 693676 - DNA, 14 bp, Homo sapiens
aagttcctctagtg

SEQ ID NO: 693677 - DNA, 11 bp, Homo sapiens
aagttccttcc

SEQ ID NO: 693678 - DNA, 15 bp, Homo sapiens
aagttcgaaagaaaa

SEQ ID NO: 693679 - DNA, 19 bp, Homo sapiens
aagttctatttcttgaaga

SEQ ID NO: 693680 - DNA, 18 bp, Homo sapiens
aagttctccagcttcagc

SEQ ID NO: 693681 - DNA, 15 bp, Homo sapiens
aagttctgagtgttt

SEQ ID NO: 693682 - DNA, 15 bp, Homo sapiens
aagttcttagttgct

SEQ ID NO: 693683 - DNA, 11 bp, Homo sapiens
aagttcttatg

SEQ ID NO: 693684 - DNA, 19 bp, Homo sapiens
aagttcttatgaggagggg

SEQ ID NO: 693685 - DNA, 20 bp, Homo sapiens
aagttcttatgaggagggga

SEQ ID NO: 693686 - DNA, 15 bp, Homo sapiens
aagttcttcaagagg

SEQ ID NO: 693687 - DNA, 14 bp, Homo sapiens
aagttcttcacctc

SEQ ID NO: 693688 - DNA, 18 bp, Homo sapiens
aagttcttcacctctatc

SEQ ID NO: 693689 - DNA, 20 bp, Homo sapiens
aagttcttcacctctatcca

SEQ ID NO: 693690 - DNA, 23 bp, Homo sapiens
aagttcttggaccagtttgcaga

SEQ ID NO: 693691 - DNA, 21 bp, Homo sapiens
aagttctttgatttgtaccat

SEQ ID NO: 693692 - DNA, 11 bp, Homo sapiens
aagttgaaaaa

SEQ ID NO: 693693 - DNA, 22 bp, Homo sapiens
ataagtcaagcacatgtaataa

SEQ ID NO: 693694 - DNA, 19 bp, Homo sapiens
ataagtccattaactgctt

SEQ ID NO: 693695 - DNA, 22 bp, Homo sapiens
ataagtcctctagtgaatgtag

SEQ ID NO: 693696 - DNA, 14 bp, Homo sapiens
ataagtctaaataa

SEQ ID NO: 693697 - DNA, 13 bp, Homo sapiens
ataagtctgattt

SEQ ID NO: 693698 - DNA, 23 bp, Homo sapiens
ataagtgacaccaataaatgttt

SEQ ID NO: 693699 - DNA, 22 bp, Homo sapiens
ataagtgagatggtatgaaata

SEQ ID NO: 693700 - DNA, 19 bp, Homo sapiens
ataagtgaggaagagttta

SEQ ID NO: 693701 - DNA, 22 bp, Homo sapiens
ataagtggacaaattttgagtt

SEQ ID NO: 693702 - DNA, 18 bp, Homo sapiens
ataagtggtgcttagaaa

SEQ ID NO: 693703 - DNA, 13 bp, Homo sapiens
ataagtgtacata

SEQ ID NO: 693704 - DNA, 13 bp, Homo sapiens
ataagtgtatttt

SEQ ID NO: 693705 - DNA, 16 bp, Homo sapiens
ataagtgtatttttca

SEQ ID NO: 693706 - DNA, 20 bp, Homo sapiens
ataagtgtgtggtagaaaca

SEQ ID NO: 693707 - DNA, 14 bp, Homo sapiens
ataagttaaaggca

SEQ ID NO: 693708 - DNA, 13 bp, Homo sapiens
ataagttattgca

SEQ ID NO: 693709 - DNA, 16 bp, Homo sapiens
ataagttattgcagtt

SEQ ID NO: 693710 - DNA, 20 bp, Homo sapiens
ataagttcaaattcttctga

SEQ ID NO: 693711 - DNA, 24 bp, Homo sapiens
ataagttcaaattcttctgaactc

SEQ ID NO: 693712 - DNA, 14 bp, Homo sapiens
ataagttcctatac

SEQ ID NO: 693713 - DNA, 16 bp, Homo sapiens
ataagttgctgtaaaa

SEQ ID NO: 693714 - DNA, 18 bp, Homo sapiens
ataagttgctgtaaaatt

SEQ ID NO: 693715 - DNA, 12 bp, Homo sapiens
ataagttgtacc

SEQ ID NO: 693716 - DNA, 21 bp, Homo sapiens
ataagttgtaccaaaacatcc

SEQ ID NO: 693717 - DNA, 15 bp, Homo sapiens
ataagtttaacttta

SEQ ID NO: 693718 - DNA, 23 bp, Homo sapiens
ataagtttaactttaaaactgta

SEQ ID NO: 693719 - DNA, 21 bp, Homo sapiens
ataagtttctattctgtcagt

SEQ ID NO: 693720 - DNA, 19 bp, Homo sapiens
ataagtttgaaggaaacag

SEQ ID NO: 693721 - DNA, 20 bp, Homo sapiens
ataagtttgaaggaaacagt

SEQ ID NO: 693722 - DNA, 14 bp, Homo sapiens
ataagttttgatat

SEQ ID NO: 693723 - DNA, 19 bp, Homo sapiens
ataagttttgatataatct

SEQ ID NO: 693724 - DNA, 19 bp, Homo sapiens
ataataaaaaattatgaca

SEQ ID NO: 693725 - DNA, 15 bp, Homo sapiens
ataataaaaatatat

SEQ ID NO: 693726 - DNA, 21 bp, Homo sapiens
aataaacttggattctctaac

SEQ ID NO: 693727 - DNA, 15 bp, Homo sapiens
aataaagaaatttgg

SEQ ID NO: 693728 - DNA, 19 bp, Homo sapiens
aataaagaaatttggtacc

SEQ ID NO: 693729 - DNA, 21 bp, Homo sapiens
aataaagaactccttattttg

SEQ ID NO: 693730 - DNA, 22 bp, Homo sapiens
aataaagaactccttattttgt

SEQ ID NO: 693731 - DNA, 23 bp, Homo sapiens
aataaagaactccttattttgta

SEQ ID NO: 693732 - DNA, 12 bp, Homo sapiens
aataaagaattc

SEQ ID NO: 693733 - DNA, 15 bp, Homo sapiens
aataaagagttagaa

SEQ ID NO: 693734 - DNA, 13 bp, Homo sapiens
aataaagatgagt

SEQ ID NO: 693735 - DNA, 12 bp, Homo sapiens
aataaagcagag

SEQ ID NO: 693736 - DNA, 13 bp, Homo sapiens
aataaagcagagc

SEQ ID NO: 693737 - DNA, 15 bp, Homo sapiens
aataaagcagagcca

SEQ ID NO: 693738 - DNA, 21 bp, Homo sapiens
aataaagcagagccaaggcca

SEQ ID NO: 693739 - DNA, 16 bp, Homo sapiens
aataaagcagtcctgt

SEQ ID NO: 693740 - DNA, 11 bp, Homo sapiens
aataaagcatt

SEQ ID NO: 693741 - DNA, 13 bp, Homo sapiens
aataaagcattct

SEQ ID NO: 693742 - DNA, 20 bp, Homo sapiens
aataaagcattctttaacag

SEQ ID NO: 693743 - DNA, 12 bp, Homo sapiens
aataaagccttt

SEQ ID NO: 693744 - DNA, 18 bp, Homo sapiens
aataaagcttgtggcccc

SEQ ID NO: 693745 - DNA, 18 bp, Homo sapiens
aataaaggataactctgt

SEQ ID NO: 693746 - DNA, 24 bp, Homo sapiens
aataaaggataactctgtattaca

SEQ ID NO: 693747 - DNA, 16 bp, Homo sapiens
aataaaggcagctgcc

SEQ ID NO: 693748 - DNA, 18 bp, Homo sapiens
aataaaggcagctgcctc

SEQ ID NO: 693749 - DNA, 22 bp, Homo sapiens
aataaaggcagctgcctctgct

SEQ ID NO: 693750 - DNA, 23 bp, Homo sapiens
aataaaggcagctgcctctgctc

SEQ ID NO: 693751 - DNA, 16 bp, Homo sapiens
aataaaggcagttttc

SEQ ID NO: 693752 - DNA, 19 bp, Homo sapiens
aataaaggcagttttctaa

SEQ ID NO: 693753 - DNA, 20 bp, Homo sapiens
aataaaggtaaaatcacttc

SEQ ID NO: 693754 - DNA, 19 bp, Homo sapiens
aataaaggtcttaaataat

SEQ ID NO: 693755 - DNA, 16 bp, Homo sapiens
aataaaggtgtagaaa

SEQ ID NO: 693756 - DNA, 9 bp, Homo sapiens
aataaagta

SEQ ID NO: 693757 - DNA, 16 bp, Homo sapiens
aataaagtacaagagc

SEQ ID NO: 693758 - DNA, 12 bp, Homo sapiens
aataaagtagtt

SEQ ID NO: 693759 - DNA, 15 bp, Homo sapiens
aataaagtataatgt

SEQ ID NO: 693760 - DNA, 15 bp, Homo sapiens
aataaagtatcatgc

SEQ ID NO: 693761 - DNA, 17 bp, Homo sapiens
aataaagtatcatgcat

SEQ ID NO: 693762 - DNA, 19 bp, Homo sapiens
aataaagtatcatgcattc

SEQ ID NO: 693763 - DNA, 11 bp, Homo sapiens
aataaagtgat

SEQ ID NO: 693764 - DNA, 16 bp, Homo sapiens
aataaagtgccttctg

SEQ ID NO: 693765 - DNA, 12 bp, Homo sapiens
aataaagtgtat

SEQ ID NO: 693766 - DNA, 20 bp, Homo sapiens
aataaagttacttgaatttc

SEQ ID NO: 693767 - DNA, 19 bp, Homo sapiens
aataaagttggtcttttga

SEQ ID NO: 693768 - DNA, 11 bp, Homo sapiens
aataaagttgt

SEQ ID NO: 693769 - DNA, 14 bp, Homo sapiens
aataaagttgtttt

SEQ ID NO: 693770 - DNA, 23 bp, Homo sapiens
aataaataaaattcatttctaca

SEQ ID NO: 693771 - DNA, 14 bp, Homo sapiens
aataaataatttta

SEQ ID NO: 693772 - DNA, 20 bp, Homo sapiens
aataaatacctcttagctga

SEQ ID NO: 693773 - DNA, 14 bp, Homo sapiens
aataaatagaaaga

SEQ ID NO: 693774 - DNA, 21 bp, Homo sapiens
aataaatagctatatccatgt

SEQ ID NO: 693775 - DNA, 12 bp, Homo sapiens
aataaatatacc

SEQ ID NO: 693776 - DNA, 15 bp, Homo sapiens
aataaatatatataa

SEQ ID NO: 693777 - DNA, 19 bp, Homo sapiens
aataaatatatataaacct

SEQ ID NO: 693778 - DNA, 15 bp, Homo sapiens
aataaatatctgtac

SEQ ID NO: 693779 - DNA, 11 bp, Homo sapiens
aataaatatgt

SEQ ID NO: 693780 - DNA, 16 bp, Homo sapiens
aataaatatgtaatat

SEQ ID NO: 693781 - DNA, 14 bp, Homo sapiens
aataaatatttatg

SEQ ID NO: 693782 - DNA, 18 bp, Homo sapiens
aataaatcagtgtttaca

SEQ ID NO: 693783 - DNA, 15 bp, Homo sapiens
aataaatcatcctca

SEQ ID NO: 693784 - DNA, 16 bp, Homo sapiens
aataaatcatcctcat

SEQ ID NO: 693785 - DNA, 22 bp, Homo sapiens
aataaatctcttctttgctgca

SEQ ID NO: 693786 - DNA, 11 bp, Homo sapiens
aataaatgaaa

SEQ ID NO: 693787 - DNA, 14 bp, Homo sapiens
aataaatgaagaaa

SEQ ID NO: 693788 - DNA, 13 bp, Homo sapiens
aataaatgattat

SEQ ID NO: 693789 - DNA, 16 bp, Homo sapiens
aataaatgattatatt

SEQ ID NO: 693790 - DNA, 17 bp, Homo sapiens
aataaatgattatattc

SEQ ID NO: 693791 - DNA, 15 bp, Homo sapiens
aataaatggccagtg

SEQ ID NO: 693792 - DNA, 22 bp, Homo sapiens
aataaatgggtgtatataattt

SEQ ID NO: 693793 - DNA, 22 bp, Homo sapiens
aataaatggtttggtgcttttt

SEQ ID NO: 693794 - DNA, 14 bp, Homo sapiens
aataaatgtacctg

SEQ ID NO: 693795 - DNA, 20 bp, Homo sapiens
aataaatgtatcttattcac

SEQ ID NO: 693796 - DNA, 14 bp, Homo sapiens
aataaatgtcttgc

SEQ ID NO: 693797 - DNA, 12 bp, Homo sapiens
aataaatgtgtt

SEQ ID NO: 693798 - DNA, 22 bp, Homo sapiens
aataaatgtttgttatttacac

SEQ ID NO: 693799 - DNA, 21 bp, Homo sapiens
aataaattaaataaaataacc

SEQ ID NO: 693800 - DNA, 21 bp, Homo sapiens
aataaattaagatcctaaact

SEQ ID NO: 693801 - DNA, 14 bp, Homo sapiens
aataaattagaaaa

SEQ ID NO: 693802 - DNA, 13 bp, Homo sapiens
aataaattcatca

SEQ ID NO: 693803 - DNA, 21 bp, Homo sapiens
aataaattcccaacttctctt

SEQ ID NO: 693804 - DNA, 23 bp, Homo sapiens
aataaattctacctccttgtgtt

SEQ ID NO: 693805 - DNA, 14 bp, Homo sapiens
aataaattgatcct

SEQ ID NO: 693806 - DNA, 17 bp, Homo sapiens
aataaattgcaacatat

SEQ ID NO: 693807 - DNA, 20 bp, Homo sapiens
aataaattgctccttgacat

SEQ ID NO: 693808 - DNA, 15 bp, Homo sapiens
aataaatttcccagt

SEQ ID NO: 693809 - DNA, 21 bp, Homo sapiens
aataaatttggttctaataga

SEQ ID NO: 693810 - DNA, 13 bp, Homo sapiens
aataaattttgtt

SEQ ID NO: 693811 - DNA, 16 bp, Homo sapiens
aataacaagtcgatga

SEQ ID NO: 693812 - DNA, 12 bp, Homo sapiens
aataacacacat

SEQ ID NO: 693813 - DNA, 23 bp, Homo sapiens
aataacacagagagacagacttg

SEQ ID NO: 693814 - DNA, 16 bp, Homo sapiens
aataacactatattta

SEQ ID NO: 693815 - DNA, 22 bp, Homo sapiens
aataacactgttggcacttata

SEQ ID NO: 693816 - DNA, 14 bp, Homo sapiens
aataacagctcctt

SEQ ID NO: 693817 - DNA, 21 bp, Homo sapiens
aataacaggcatttgttcact

SEQ ID NO: 693818 - DNA, 20 bp, Homo sapiens
aataacataatttgtacata

SEQ ID NO: 693819 - DNA, 12 bp, Homo sapiens
aataacatgtaa

SEQ ID NO: 693820 - DNA, 19 bp, Homo sapiens
aataacatgtaattaagta

SEQ ID NO: 693821 - DNA, 13 bp, Homo sapiens
aataacattgcac

SEQ ID NO: 693822 - DNA, 21 bp, Homo sapiens
aataacattgcactttataaa

SEQ ID NO: 693823 - DNA, 15 bp, Homo sapiens
aataacccagttact

SEQ ID NO: 693824 - DNA, 16 bp, Homo sapiens
aataacccagttactt

SEQ ID NO: 693825 - DNA, 18 bp, Homo sapiens
aataaccctttggttttt

SEQ ID NO: 693826 - DNA, 16 bp, Homo sapiens
aataaccgtaaaggtt

SEQ ID NO: 693827 - DNA, 15 bp, Homo sapiens
atacaagaaaatgta

SEQ ID NO: 693828 - DNA, 16 bp, Homo sapiens
atacaagaaaatgtat

SEQ ID NO: 693829 - DNA, 17 bp, Homo sapiens
atacaaggacattcact

SEQ ID NO: 693830 - DNA, 12 bp, Homo sapiens
atacaaggcaag

SEQ ID NO: 693831 - DNA, 19 bp, Homo sapiens
atacaaggcaagcattttt

SEQ ID NO: 693832 - DNA, 11 bp, Homo sapiens
atacaataaaa

SEQ ID NO: 693833 - DNA, 13 bp, Homo sapiens
atacaataaaaga

SEQ ID NO: 693834 - DNA, 17 bp, Homo sapiens
atacaataaaagagctt

SEQ ID NO: 693835 - DNA, 20 bp, Homo sapiens
atacaataaaagagctttat

SEQ ID NO: 693836 - DNA, 14 bp, Homo sapiens
atacaataacataa

SEQ ID NO: 693837 - DNA, 20 bp, Homo sapiens
atacaataacccagttactt

SEQ ID NO: 693838 - DNA, 14 bp, Homo sapiens
atacaatagcattg

SEQ ID NO: 693839 - DNA, 19 bp, Homo sapiens
atacaatcctgtttataat

SEQ ID NO: 693840 - DNA, 18 bp, Homo sapiens
atacaatgaacacttata

SEQ ID NO: 693841 - DNA, 23 bp, Homo sapiens
atacaatgctgtgccctaaagtg

SEQ ID NO: 693842 - DNA, 20 bp, Homo sapiens
atacaatggtcatttccaga

SEQ ID NO: 693843 - DNA, 12 bp, Homo sapiens
atacaatgtaca

SEQ ID NO: 693844 - DNA, 17 bp, Homo sapiens
atacaatgtacaattat

SEQ ID NO: 693845 - DNA, 22 bp, Homo sapiens
atacaattaaaggtcctgccct

SEQ ID NO: 693846 - DNA, 18 bp, Homo sapiens
atacaatttttatttctt

SEQ ID NO: 693847 - DNA, 20 bp, Homo sapiens
atacaattttttttattagt

SEQ ID NO: 693848 - DNA, 17 bp, Homo sapiens
atacacaactttgcaaa

SEQ ID NO: 693849 - DNA, 18 bp, Homo sapiens
atactgagccaagtataa

SEQ ID NO: 693850 - DNA, 18 bp, Homo sapiens
atactgagccatttatac

SEQ ID NO: 693851 - DNA, 19 bp, Homo sapiens
atactgcacagtggcacaa

SEQ ID NO: 693852 - DNA, 23 bp, Homo sapiens
atactgcatgtaagccaagtcat

SEQ ID NO: 693853 - DNA, 20 bp, Homo sapiens
atactgcctactgttactct

SEQ ID NO: 693854 - DNA, 19 bp, Homo sapiens
atactgctacagcaatttc

SEQ ID NO: 693855 - DNA, 15 bp, Homo sapiens
atactgctactgtaa

SEQ ID NO: 693856 - DNA, 11 bp, Homo sapiens
atactgctctg

SEQ ID NO: 693857 - DNA, 13 bp, Homo sapiens
atactgctctgaa

SEQ ID NO: 693858 - DNA, 19 bp, Homo sapiens
atactggaataatttgtaa

SEQ ID NO: 693859 - DNA, 23 bp, Homo sapiens
atactggaataatttgtaaatga

SEQ ID NO: 693860 - DNA, 19 bp, Homo sapiens
atactggactcaggaactt

SEQ ID NO: 693861 - DNA, 15 bp, Homo sapiens
atactggcacagagg

SEQ ID NO: 693862 - DNA, 14 bp, Homo sapiens
atactggcctctgt

SEQ ID NO: 693863 - DNA, 15 bp, Homo sapiens
atactggcctctgtg

SEQ ID NO: 693864 - DNA, 22 bp, Homo sapiens
atactggcctctgtgattacat

SEQ ID NO: 693865 - DNA, 14 bp, Homo sapiens
atactggcctggac

SEQ ID NO: 693866 - DNA, 16 bp, Homo sapiens
atactgggttcttgtt

SEQ ID NO: 693867 - DNA, 18 bp, Homo sapiens
atactgggtttcaagaaa

SEQ ID NO: 693868 - DNA, 14 bp, Homo sapiens
atactggtctcagg

SEQ ID NO: 693869 - DNA, 16 bp, Homo sapiens
atactgtaaaagttat

SEQ ID NO: 693870 - DNA, 23 bp, Homo sapiens
atactgtaaaagttataataact

SEQ ID NO: 693871 - DNA, 20 bp, Homo sapiens
atactgtacaatgactttat

SEQ ID NO: 693872 - DNA, 16 bp, Homo sapiens
atactgtacatgctat

SEQ ID NO: 693873 - DNA, 16 bp, Homo sapiens
atactgtacttaataa

SEQ ID NO: 693874 - DNA, 13 bp, Homo sapiens
atactgtatttct

SEQ ID NO: 693875 - DNA, 19 bp, Homo sapiens
atactgtattttgtattgt

SEQ ID NO: 693876 - DNA, 15 bp, Homo sapiens
atactgtctctggag

SEQ ID NO: 693877 - DNA, 13 bp, Homo sapiens
atactgtgcagaa

SEQ ID NO: 693878 - DNA, 17 bp, Homo sapiens
atactgtgcagaataat

SEQ ID NO: 693879 - DNA, 18 bp, Homo sapiens
atactgtgcagaataatg

SEQ ID NO: 693880 - DNA, 19 bp, Homo sapiens
atactgtgcagaataatgg

SEQ ID NO: 693881 - DNA, 15 bp, Homo sapiens
atactgttgatacaa

SEQ ID NO: 693882 - DNA, 18 bp, Homo sapiens
atactgttgatacaaacc

SEQ ID NO: 693883 - DNA, 15 bp, Homo sapiens
atactgtttcttgca

SEQ ID NO: 693884 - DNA, 16 bp, Homo sapiens
atacttaaaatatctc

SEQ ID NO: 693885 - DNA, 11 bp, Homo sapiens
atacttaagaa

SEQ ID NO: 693886 - DNA, 16 bp, Homo sapiens
atacttaagcaaaagt

SEQ ID NO: 693887 - DNA, 22 bp, Homo sapiens
atacttacatgtgtgtatatgt

SEQ ID NO: 693888 - DNA, 19 bp, Homo sapiens
atacttacctagtgaaact

SEQ ID NO: 693889 - DNA, 20 bp, Homo sapiens
atacttacctagtgaaactt

SEQ ID NO: 693890 - DNA, 16 bp, Homo sapiens
atacttactataattt

SEQ ID NO: 693891 - DNA, 20 bp, Homo sapiens
atacttagtggtatgtctct

SEQ ID NO: 693892 - DNA, 18 bp, Homo sapiens
atacttatttgtatatgg

SEQ ID NO: 693893 - DNA, 22 bp, Homo sapiens
atacttattttattttttacca

SEQ ID NO: 693894 - DNA, 23 bp, Homo sapiens
atacttattttcagtgcatcatt

SEQ ID NO: 693895 - DNA, 16 bp, Homo sapiens
atacttcaaaagccat

SEQ ID NO: 693896 - DNA, 16 bp, Homo sapiens
atacttctcatttttt

SEQ ID NO: 693897 - DNA, 15 bp, Homo sapiens
atacttctctcagat

SEQ ID NO: 693898 - DNA, 15 bp, Homo sapiens
atacttgaatatgga

SEQ ID NO: 693899 - DNA, 17 bp, Homo sapiens
atacttgaattttttga

SEQ ID NO: 693900 - DNA, 13 bp, Homo sapiens
atacttgcaacta

SEQ ID NO: 693901 - DNA, 14 bp, Homo sapiens
atacttgcaactaa

SEQ ID NO: 693902 - DNA, 17 bp, Homo sapiens
atacttgcaactaagga

SEQ ID NO: 693903 - DNA, 20 bp, Homo sapiens
atacttgcaactaaggacaa

SEQ ID NO: 693904 - DNA, 22 bp, Homo sapiens
atacttgcaactaaggacaaat

SEQ ID NO: 693905 - DNA, 13 bp, Homo sapiens
atacttgcagttg

SEQ ID NO: 693906 - DNA, 14 bp, Homo sapiens
atacttgcagttgt

SEQ ID NO: 693907 - DNA, 15 bp, Homo sapiens
atacttgcagttgtg

SEQ ID NO: 693908 - DNA, 12 bp, Homo sapiens
atacttggattt

SEQ ID NO: 693909 - DNA, 15 bp, Homo sapiens
atacttgtattccct

SEQ ID NO: 693910 - DNA, 17 bp, Homo sapiens
atacttgtattccctta

SEQ ID NO: 693911 - DNA, 14 bp, Homo sapiens
atactttaaaggaa

SEQ ID NO: 693912 - DNA, 12 bp, Homo sapiens
atactttacagg

SEQ ID NO: 693913 - DNA, 23 bp, Homo sapiens
atactttagaagtagaattgaca

SEQ ID NO: 693914 - DNA, 15 bp, Homo sapiens
atactttatcaatgt

SEQ ID NO: 693915 - DNA, 14 bp, Homo sapiens
atactttatttctg

SEQ ID NO: 693916 - DNA, 17 bp, Homo sapiens
atactttgacaaggaaa

SEQ ID NO: 693917 - DNA, 21 bp, Homo sapiens
atacttttacaagtaacaaaa

SEQ ID NO: 693918 - DNA, 16 bp, Homo sapiens
atacttttgccctttg

SEQ ID NO: 693919 - DNA, 20 bp, Homo sapiens
atactttttaaaaaactatt

SEQ ID NO: 693920 - DNA, 14 bp, Homo sapiens
atactttttatcac

SEQ ID NO: 693921 - DNA, 17 bp, Homo sapiens
atactttttcagttgtt

SEQ ID NO: 693922 - DNA, 15 bp, Homo sapiens
atagaaaaaaaatct

SEQ ID NO: 693923 - DNA, 17 bp, Homo sapiens
atagaaaaaaacattct

SEQ ID NO: 693924 - DNA, 16 bp, Homo sapiens
atagaaaaaaagaaaa

SEQ ID NO: 693925 - DNA, 22 bp, Homo sapiens
atagaaaacaggaaaaaaactt

SEQ ID NO: 693926 - DNA, 17 bp, Homo sapiens
atagaaaactgaaaatc

SEQ ID NO: 693927 - DNA, 14 bp, Homo sapiens
atagaaaagttatt

SEQ ID NO: 693928 - DNA, 15 bp, Homo sapiens
atagaaaagttatta

SEQ ID NO: 693929 - DNA, 14 bp, Homo sapiens
atagaaaattattt

SEQ ID NO: 693930 - DNA, 18 bp, Homo sapiens
atagaaaattatttgtat

SEQ ID NO: 693931 - DNA, 18 bp, Homo sapiens
atagaaacttcatggttt

SEQ ID NO: 693932 - DNA, 23 bp, Homo sapiens
atagaaagaaactaaacagaaaa

SEQ ID NO: 693933 - DNA, 14 bp, Homo sapiens
atagaaagaagcca

SEQ ID NO: 693934 - DNA, 15 bp, Homo sapiens
atagaaagaagccat

SEQ ID NO: 693935 - DNA, 12 bp, Homo sapiens
atagaaagctat

SEQ ID NO: 693936 - DNA, 13 bp, Homo sapiens
atagaaataaatt

SEQ ID NO: 693937 - DNA, 20 bp, Homo sapiens
atagaaatatagccaaaaat

SEQ ID NO: 693938 - DNA, 20 bp, Homo sapiens
atagaaatggtttcctctgg

SEQ ID NO: 693939 - DNA, 22 bp, Homo sapiens
atagaaatggtttcctctggat

SEQ ID NO: 693940 - DNA, 16 bp, Homo sapiens
atagaaatttccagag

SEQ ID NO: 693941 - DNA, 14 bp, Homo sapiens
atagaaattttgta

SEQ ID NO: 693942 - DNA, 17 bp, Homo sapiens
atagaaattttgtaaga

SEQ ID NO: 693943 - DNA, 23 bp, Homo sapiens
atagaaattttgtaagaaggcaa

SEQ ID NO: 693944 - DNA, 19 bp, Homo sapiens
atagaacacaaaacttgaa

SEQ ID NO: 693945 - DNA, 15 bp, Homo sapiens
atagaacacttcaga

SEQ ID NO: 693946 - DNA, 16 bp, Homo sapiens
atagaacttcatggat

SEQ ID NO: 693947 - DNA, 19 bp, Homo sapiens
atagaagaactgcaaaggt

SEQ ID NO: 693948 - DNA, 14 bp, Homo sapiens
atagaagctgtagt

SEQ ID NO: 693949 - DNA, 21 bp, Homo sapiens
atagaaggaagtgtgtttgcc

SEQ ID NO: 693950 - DNA, 20 bp, Homo sapiens
atagaaggaatttgtacttc

SEQ ID NO: 693951 - DNA, 17 bp, Homo sapiens
atagaagttttcctgat

SEQ ID NO: 693952 - DNA, 17 bp, Homo sapiens
atagaataaaggcagtt

SEQ ID NO: 693953 - DNA, 18 bp, Homo sapiens
atagaataaaggcagttt

SEQ ID NO: 693954 - DNA, 22 bp, Homo sapiens
atagaataaaggcagttttcta

SEQ ID NO: 693955 - DNA, 15 bp, Homo sapiens
atagaatacattgat

SEQ ID NO: 693956 - DNA, 21 bp, Homo sapiens
atagaatacttttttctagtt

SEQ ID NO: 693957 - DNA, 23 bp, Homo sapiens
atagaatagcctgaggtcccctc

SEQ ID NO: 693958 - DNA, 19 bp, Homo sapiens
atagaatataattatcgga

SEQ ID NO: 693959 - DNA, 12 bp, Homo sapiens
atagaatattta

SEQ ID NO: 693960 - DNA, 14 bp, Homo sapiens
atagaatgatgttt

SEQ ID NO: 693961 - DNA, 18 bp, Homo sapiens
atagaattgacattgaaa

SEQ ID NO: 693962 - DNA, 15 bp, Homo sapiens
atagacaaaaagtat

SEQ ID NO: 693963 - DNA, 14 bp, Homo sapiens
aatagagactgtag

SEQ ID NO: 693964 - DNA, 15 bp, Homo sapiens
aatagagactgtaga

SEQ ID NO: 693965 - DNA, 20 bp, Homo sapiens
aatagagagagaggtattta

SEQ ID NO: 693966 - DNA, 14 bp, Homo sapiens
aatagagcctgagg

SEQ ID NO: 693967 - DNA, 15 bp, Homo sapiens
aatagagctgccact

SEQ ID NO: 693968 - DNA, 18 bp, Homo sapiens
aatagagctgccactggg

SEQ ID NO: 693969 - DNA, 14 bp, Homo sapiens
aatagaggaagaaa

SEQ ID NO: 693970 - DNA, 15 bp, Homo sapiens
aatagaggaagaaat

SEQ ID NO: 693971 - DNA, 18 bp, Homo sapiens
aatagagttggagtttta

SEQ ID NO: 693972 - DNA, 20 bp, Homo sapiens
atagtaggggttgaagaaaa

SEQ ID NO: 693973 - DNA, 22 bp, Homo sapiens
aatattagaataaagttcctgt

SEQ ID NO: 693974 - DNA, 16 bp, Homo sapiens
aatattagttggcttt

SEQ ID NO: 693975 - DNA, 15 bp, Homo sapiens
aatattatttgatat

SEQ ID NO: 693976 - DNA, 17 bp, Homo sapiens
aatattatttgatatct

SEQ ID NO: 693977 - DNA, 18 bp, Homo sapiens
aatattatttgatatctg

SEQ ID NO: 693978 - DNA, 19 bp, Homo sapiens
aatattatttgtgtttcct

SEQ ID NO: 693979 - DNA, 19 bp, Homo sapiens
aatattcaagtaacacttt

SEQ ID NO: 693980 - DNA, 19 bp, Homo sapiens
aatattcagacaaaatgga

SEQ ID NO: 693981 - DNA, 21 bp, Homo sapiens
aatattcagacaaaatggata

SEQ ID NO: 693982 - DNA, 18 bp, Homo sapiens
aatattcagccagcttaa

SEQ ID NO: 693983 - DNA, 22 bp, Homo sapiens
aatattcagccagcttaaaccc

SEQ ID NO: 693984 - DNA, 15 bp, Homo sapiens
aatattcattttact

SEQ ID NO: 693985 - DNA, 17 bp, Homo sapiens
aatattccaagcttcat

SEQ ID NO: 693986 - DNA, 21 bp, Homo sapiens
aatattcctttgcatattata

SEQ ID NO: 693987 - DNA, 17 bp, Homo sapiens
aatattctacacatgta

SEQ ID NO: 693988 - DNA, 16 bp, Homo sapiens
aatattctatatgaat

SEQ ID NO: 693989 - DNA, 23 bp, Homo sapiens
aatattcttgtccacattctact

SEQ ID NO: 693990 - DNA, 17 bp, Homo sapiens
aatattctttctcataa

SEQ ID NO: 693991 - DNA, 13 bp, Homo sapiens
aatattgaaaatt

SEQ ID NO: 693992 - DNA, 16 bp, Homo sapiens
aatattgaagttgttt

SEQ ID NO: 693993 - DNA, 13 bp, Homo sapiens
aatattgaatttt

SEQ ID NO: 693994 - DNA, 12 bp, Homo sapiens
aatattgacatt

SEQ ID NO: 693995 - DNA, 20 bp, Homo sapiens
aatattgacatttgtagttg

SEQ ID NO: 693996 - DNA, 14 bp, Homo sapiens
aatattgagaatca

SEQ ID NO: 693997 - DNA, 21 bp, Homo sapiens
aatattgatgttaacaagagg

SEQ ID NO: 693998 - DNA, 14 bp, Homo sapiens
aatattgcaaaata

SEQ ID NO: 693999 - DNA, 19 bp, Homo sapiens
aatattgcaaaatacatga

SEQ ID NO: 694000 - DNA, 23 bp, Homo sapiens
aatattgcaaaatacatgaagct

SEQ ID NO: 694001 - DNA, 17 bp, Homo sapiens
aatattggttagtattt

SEQ ID NO: 694002 - DNA, 10 bp, Homo sapiens
aatattgtaa

SEQ ID NO: 694003 - DNA, 18 bp, Homo sapiens
aatattgtaaatactgga

SEQ ID NO: 694004 - DNA, 13 bp, Homo sapiens
aatattgtacagt

SEQ ID NO: 694005 - DNA, 14 bp, Homo sapiens
aatattgtcatctt

SEQ ID NO: 694006 - DNA, 20 bp, Homo sapiens
aatattgttgacaactgtga

SEQ ID NO: 694007 - DNA, 15 bp, Homo sapiens
aatattgtttctgca

SEQ ID NO: 694008 - DNA, 14 bp, Homo sapiens
aatatttaaaaatg

SEQ ID NO: 694009 - DNA, 12 bp, Homo sapiens
aatatttaaaca

SEQ ID NO: 694010 - DNA, 19 bp, Homo sapiens
aatatttaaacagcagtgt

SEQ ID NO: 694011 - DNA, 14 bp, Homo sapiens
aatatttaactttt

SEQ ID NO: 694012 - DNA, 18 bp, Homo sapiens
aatatttaagtatatagt

SEQ ID NO: 694013 - DNA, 14 bp, Homo sapiens
aatatttactgtta

SEQ ID NO: 694014 - DNA, 15 bp, Homo sapiens
aatatttagaaaatt

SEQ ID NO: 694015 - DNA, 14 bp, Homo sapiens
aatatttagcaaat

SEQ ID NO: 694016 - DNA, 20 bp, Homo sapiens
aatatttagcaaataatttc

SEQ ID NO: 694017 - DNA, 12 bp, Homo sapiens
aatatttataac

SEQ ID NO: 694018 - DNA, 14 bp, Homo sapiens
aatatttatatatt

SEQ ID NO: 694019 - DNA, 17 bp, Homo sapiens
aatatttatatttcact

SEQ ID NO: 694020 - DNA, 18 bp, Homo sapiens
aatatttatatttcacta

SEQ ID NO: 694021 - DNA, 12 bp, Homo sapiens
aatatttattac

SEQ ID NO: 694022 - DNA, 14 bp, Homo sapiens
aatatttattacct

SEQ ID NO: 694023 - DNA, 18 bp, Homo sapiens
aatatttattacctctga

SEQ ID NO: 694024 - DNA, 19 bp, Homo sapiens
aatatttattattttcacc

SEQ ID NO: 694025 - DNA, 11 bp, Homo sapiens
aatatttcatt

SEQ ID NO: 694026 - DNA, 17 bp, Homo sapiens
aatatttcccctagttt

SEQ ID NO: 694027 - DNA, 19 bp, Homo sapiens
aatatttcctgacttgagt

SEQ ID NO: 694028 - DNA, 12 bp, Homo sapiens
aatatttctgaa

SEQ ID NO: 694029 - DNA, 20 bp, Homo sapiens
aatatttcttcaaatatctc

SEQ ID NO: 694030 - DNA, 20 bp, Homo sapiens
aatatttcttcacaaaggaa

SEQ ID NO: 694031 - DNA, 14 bp, Homo sapiens
aatatttgaataat

SEQ ID NO: 694032 - DNA, 20 bp, Homo sapiens
aatatttgaataatgacaga

SEQ ID NO: 694033 - DNA, 16 bp, Homo sapiens
aatatttgacttgcat

SEQ ID NO: 694034 - DNA, 12 bp, Homo sapiens
aatatttgctga

SEQ ID NO: 694035 - DNA, 12 bp, Homo sapiens
aatatttggaat

SEQ ID NO: 694036 - DNA, 14 bp, Homo sapiens
aatatttgtacata

SEQ ID NO: 694037 - DNA, 15 bp, Homo sapiens
aatattttaaagaat

SEQ ID NO: 694038 - DNA, 16 bp, Homo sapiens
aatattttaagaaaga

SEQ ID NO: 694039 - DNA, 18 bp, Homo sapiens
aatattttaagaaagaga

SEQ ID NO: 694040 - DNA, 12 bp, Homo sapiens
aatattttatgg

SEQ ID NO: 694041 - DNA, 13 bp, Homo sapiens
aatattttcaaga

SEQ ID NO: 694042 - DNA, 18 bp, Homo sapiens
aatattttctttaatgct

SEQ ID NO: 694043 - DNA, 20 bp, Homo sapiens
aatattttgaatcaataata

SEQ ID NO: 694044 - DNA, 18 bp, Homo sapiens
aatattttgatgcagata

SEQ ID NO: 694045 - DNA, 10 bp, Homo sapiens
aatattttgg

SEQ ID NO: 694046 - DNA, 12 bp, Homo sapiens
aatattttggaa

SEQ ID NO: 694047 - DNA, 14 bp, Homo sapiens
aatattttggaaac

SEQ ID NO: 694048 - DNA, 10 bp, Homo sapiens
aatattttgt

SEQ ID NO: 694049 - DNA, 14 bp, Homo sapiens
aatattttgtaata

SEQ ID NO: 694050 - DNA, 20 bp, Homo sapiens
aatattttgtaatattctgt

SEQ ID NO: 694051 - DNA, 14 bp, Homo sapiens
aatattttgtattt

SEQ ID NO: 694052 - DNA, 13 bp, Homo sapiens
aatattttgtcta

SEQ ID NO: 694053 - DNA, 14 bp, Homo sapiens
aatattttgtctaa

SEQ ID NO: 694054 - DNA, 15 bp, Homo sapiens
aatatttttatatca

SEQ ID NO: 694055 - DNA, 19 bp, Homo sapiens
aatatttttatatttcctt

SEQ ID NO: 694056 - DNA, 21 bp, Homo sapiens
aatatttttatatttccttta

SEQ ID NO: 694057 - DNA, 16 bp, Homo sapiens
aatatttttggggcat

SEQ ID NO: 694058 - DNA, 22 bp, Homo sapiens
aatatttttggggcatcctgga

SEQ ID NO: 694059 - DNA, 17 bp, Homo sapiens
aatattttttatatata

SEQ ID NO: 694060 - DNA, 13 bp, Homo sapiens
aatattttttgaa

SEQ ID NO: 694061 - DNA, 14 bp, Homo sapiens
aatattttttgaag

SEQ ID NO: 694062 - DNA, 18 bp, Homo sapiens
aatcaaaagggccaaaga

SEQ ID NO: 694063 - DNA, 19 bp, Homo sapiens
aatcaaaagggccaaagaa

SEQ ID NO: 694064 - DNA, 20 bp, Homo sapiens
aatcaaaataacgccccaga

SEQ ID NO: 694065 - DNA, 13 bp, Homo sapiens
aatcaaaattgtc

SEQ ID NO: 694066 - DNA, 16 bp, Homo sapiens
aatcaaagaacagatg

SEQ ID NO: 694067 - DNA, 16 bp, Homo sapiens
aatcaaagaattacag

SEQ ID NO: 694068 - DNA, 16 bp, Homo sapiens
aatcaaagacatggaa

SEQ ID NO: 694069 - DNA, 14 bp, Homo sapiens
aatcaaataagtat

SEQ ID NO: 694070 - DNA, 15 bp, Homo sapiens
aatcaaataagtatt

SEQ ID NO: 694071 - DNA, 16 bp, Homo sapiens
aatcaaataagtattt

SEQ ID NO: 694072 - DNA, 18 bp, Homo sapiens
aatcaaataagtatttat

SEQ ID NO: 694073 - DNA, 17 bp, Homo sapiens
aatcaacaccttaatat

SEQ ID NO: 694074 - DNA, 20 bp, Homo sapiens
aatcaaccacctatttttga

SEQ ID NO: 694075 - DNA, 20 bp, Homo sapiens
aatcaaccctctcctgtctg

SEQ ID NO: 694076 - DNA, 21 bp, Homo sapiens
aatcaaccctctcctgtctgc

SEQ ID NO: 694077 - DNA, 15 bp, Homo sapiens
aatcaactcatcatt

SEQ ID NO: 694078 - DNA, 16 bp, Homo sapiens
aatcaacttgtgtact

SEQ ID NO: 694079 - DNA, 11 bp, Homo sapiens
aatcaacttta

SEQ ID NO: 694080 - DNA, 14 bp, Homo sapiens
aatcaactttactg

SEQ ID NO: 694081 - DNA, 20 bp, Homo sapiens
aatcaagcctttatggctgc

SEQ ID NO: 694082 - DNA, 18 bp, Homo sapiens
aatcaaggaaaggctcat

SEQ ID NO: 694083 - DNA, 13 bp, Homo sapiens
aatcaagtattta

SEQ ID NO: 694084 - DNA, 20 bp, Homo sapiens
aatcaagtttgaccagtgca

SEQ ID NO: 694085 - DNA, 20 bp, Homo sapiens
aatcaatatcccaacattct

SEQ ID NO: 694086 - DNA, 22 bp, Homo sapiens
aatcaatatcccaacattctgc

SEQ ID NO: 694087 - DNA, 12 bp, Homo sapiens
aatcaatcaatg

SEQ ID NO: 694088 - DNA, 13 bp, Homo sapiens
aatcaatcaatgg

SEQ ID NO: 694089 - DNA, 21 bp, Homo sapiens
aatcaatcatgtcagtctgct

SEQ ID NO: 694090 - DNA, 21 bp, Homo sapiens
aatcaatgaaaaatgtaattt

SEQ ID NO: 694091 - DNA, 18 bp, Homo sapiens
aatcaattattacattta

SEQ ID NO: 694092 - DNA, 12 bp, Homo sapiens
aatcaattattt

SEQ ID NO: 694093 - DNA, 13 bp, Homo sapiens
aatcacaaaaaca

SEQ ID NO: 694094 - DNA, 14 bp, Homo sapiens
aatcacaaaaacaa

SEQ ID NO: 694095 - DNA, 23 bp, Homo sapiens
aatcacaaaaacaaaaaaactat

SEQ ID NO: 694096 - DNA, 21 bp, Homo sapiens
aatgacaatatcaatcacatt

SEQ ID NO: 694097 - DNA, 16 bp, Homo sapiens
aatgacacccatgcca

SEQ ID NO: 694098 - DNA, 15 bp, Homo sapiens
aatgacaggcctgtc

SEQ ID NO: 694099 - DNA, 13 bp, Homo sapiens
aatgacagggatg

SEQ ID NO: 694100 - DNA, 18 bp, Homo sapiens
aatgacatcttcaaagct

SEQ ID NO: 694101 - DNA, 14 bp, Homo sapiens
aatgacattcccct

SEQ ID NO: 694102 - DNA, 16 bp, Homo sapiens
aatgacccaaagacca

SEQ ID NO: 694103 - DNA, 24 bp, Homo sapiens
aatgactaaaaatattataactta

SEQ ID NO: 694104 - DNA, 15 bp, Homo sapiens
aatgactcaaagtct

SEQ ID NO: 694105 - DNA, 16 bp, Homo sapiens
aatgactctttctgaa

SEQ ID NO: 694106 - DNA, 14 bp, Homo sapiens
aatgacttatttct

SEQ ID NO: 694107 - DNA, 21 bp, Homo sapiens
aatgacttatttctgctctgg

SEQ ID NO: 694108 - DNA, 13 bp, Homo sapiens
aatgacttctaat

SEQ ID NO: 694109 - DNA, 17 bp, Homo sapiens
aatgacttgattgtact

SEQ ID NO: 694110 - DNA, 18 bp, Homo sapiens
aatgacttgattgtactt

SEQ ID NO: 694111 - DNA, 13 bp, Homo sapiens
aatgactttgaac

SEQ ID NO: 694112 - DNA, 14 bp, Homo sapiens
aatgactttgaact

SEQ ID NO: 694113 - DNA, 17 bp, Homo sapiens
aatgactttgaactgaa

SEQ ID NO: 694114 - DNA, 19 bp, Homo sapiens
aatgagactctagggtcca

SEQ ID NO: 694115 - DNA, 17 bp, Homo sapiens
aatgagactttaaaagc

SEQ ID NO: 694116 - DNA, 20 bp, Homo sapiens
aatgagactttaaaagcatt

SEQ ID NO: 694117 - DNA, 19 bp, Homo sapiens
aatgagagcgacacagacg

SEQ ID NO: 694118 - DNA, 19 bp, Homo sapiens
aatgagagggcagtgtttc

SEQ ID NO: 694119 - DNA, 17 bp, Homo sapiens
aatgagagtgcactgct

SEQ ID NO: 694120 - DNA, 18 bp, Homo sapiens
aatgagagttccttctca

SEQ ID NO: 694121 - DNA, 16 bp, Homo sapiens
aatgagatagtagcat

SEQ ID NO: 694122 - DNA, 19 bp, Homo sapiens
aatgagatgttattactgt

SEQ ID NO: 694123 - DNA, 14 bp, Homo sapiens
aatgagcacctcca

SEQ ID NO: 694124 - DNA, 13 bp, Homo sapiens
aatgagcccagag

SEQ ID NO: 694125 - DNA, 19 bp, Homo sapiens
aatgagcccagagaacagc

SEQ ID NO: 694126 - DNA, 11 bp, Homo sapiens
aatgagccctg

SEQ ID NO: 694127 - DNA, 14 bp, Homo sapiens
aatgaggagacaca

SEQ ID NO: 694128 - DNA, 19 bp, Homo sapiens
atattctaatagtttttca

SEQ ID NO: 694129 - DNA, 17 bp, Homo sapiens
atattctgaaaggaaat

SEQ ID NO: 694130 - DNA, 20 bp, Homo sapiens
atattctgaaaggaaataca

SEQ ID NO: 694131 - DNA, 23 bp, Homo sapiens
atattctgaaaggaaatacactt

SEQ ID NO: 694132 - DNA, 23 bp, Homo sapiens
atattctggaaaaaaaatatata

SEQ ID NO: 694133 - DNA, 20 bp, Homo sapiens
atattctgttttgttaatat

SEQ ID NO: 694134 - DNA, 15 bp, Homo sapiens
atattcttattggaa

SEQ ID NO: 694135 - DNA, 15 bp, Homo sapiens
atattcttgtccaca

SEQ ID NO: 694136 - DNA, 20 bp, Homo sapiens
atattcttgtccacattcta

SEQ ID NO: 694137 - DNA, 17 bp, Homo sapiens
atattctttctcataaa

SEQ ID NO: 694138 - DNA, 20 bp, Homo sapiens
atattctttctcataaaact

SEQ ID NO: 694139 - DNA, 19 bp, Homo sapiens
atattcttttgatcacatt

SEQ ID NO: 694140 - DNA, 13 bp, Homo sapiens
atattcttttgtt

SEQ ID NO: 694141 - DNA, 19 bp, Homo sapiens
atattgaaaagcacagagg

SEQ ID NO: 694142 - DNA, 14 bp, Homo sapiens
atattgaaaattga

SEQ ID NO: 694143 - DNA, 23 bp, Homo sapiens
atattgaaaattgaaaagtacaa

SEQ ID NO: 694144 - DNA, 19 bp, Homo sapiens
atattgaaagttgctttta

SEQ ID NO: 694145 - DNA, 18 bp, Homo sapiens
atattgaacttttgtact

SEQ ID NO: 694146 - DNA, 18 bp, Homo sapiens
atattgaagaatttgttt

SEQ ID NO: 694147 - DNA, 21 bp, Homo sapiens
atattgaagacaatttgatac

SEQ ID NO: 694148 - DNA, 21 bp, Homo sapiens
atattgaatataatatatttg

SEQ ID NO: 694149 - DNA, 15 bp, Homo sapiens
atattgaatatatca

SEQ ID NO: 694150 - DNA, 13 bp, Homo sapiens
atattgaattttt

SEQ ID NO: 694151 - DNA, 13 bp, Homo sapiens
atattgacatttg

SEQ ID NO: 694152 - DNA, 16 bp, Homo sapiens
atattgacttgtatat

SEQ ID NO: 694153 - DNA, 14 bp, Homo sapiens
atattgagcaatat

SEQ ID NO: 694154 - DNA, 16 bp, Homo sapiens
atattgagcagaattc

SEQ ID NO: 694155 - DNA, 18 bp, Homo sapiens
atattgaggccaagaata

SEQ ID NO: 694156 - DNA, 22 bp, Homo sapiens
atattgaggccaagaatattgc

SEQ ID NO: 694157 - DNA, 14 bp, Homo sapiens
atattgaggctgca

SEQ ID NO: 694158 - DNA, 17 bp, Homo sapiens
atattgagtcaaatggt

SEQ ID NO: 694159 - DNA, 17 bp, Homo sapiens
atattgatttaaaattg

SEQ ID NO: 694160 - DNA, 18 bp, Homo sapiens
atattgcaaaatacatga

SEQ ID NO: 694161 - DNA, 23 bp, Homo sapiens
atattgcaaaatacatgaagctt

SEQ ID NO: 694162 - DNA, 17 bp, Homo sapiens
atattgccattatgctt

SEQ ID NO: 694163 - DNA, 16 bp, Homo sapiens
atattgctaaaagtgc

SEQ ID NO: 694164 - DNA, 22 bp, Homo sapiens
atattgctgagagaaatatgga

SEQ ID NO: 694165 - DNA, 15 bp, Homo sapiens
atattgctttttcta

SEQ ID NO: 694166 - DNA, 16 bp, Homo sapiens
atattgctttttctaa

SEQ ID NO: 694167 - DNA, 12 bp, Homo sapiens
atattggaactt

SEQ ID NO: 694168 - DNA, 22 bp, Homo sapiens
atattggaagctgctgaggccc

SEQ ID NO: 694169 - DNA, 16 bp, Homo sapiens
atattgggtgtagatt

SEQ ID NO: 694170 - DNA, 20 bp, Homo sapiens
atattgggtgtagatttctg

SEQ ID NO: 694171 - DNA, 23 bp, Homo sapiens
atattgggtgtagatttctgaca

SEQ ID NO: 694172 - DNA, 15 bp, Homo sapiens
atattggtaattaaa

SEQ ID NO: 694173 - DNA, 21 bp, Homo sapiens
atattggtaattaaaagactc

SEQ ID NO: 694174 - DNA, 23 bp, Homo sapiens
atattggtccagaagttcaaaat

SEQ ID NO: 694175 - DNA, 19 bp, Homo sapiens
atattggtgcgtttttaca

SEQ ID NO: 694176 - DNA, 22 bp, Homo sapiens
atattggtgcgtttttacagtt

SEQ ID NO: 694177 - DNA, 17 bp, Homo sapiens
atattggtttatgtagt

SEQ ID NO: 694178 - DNA, 12 bp, Homo sapiens
atattgtaaata

SEQ ID NO: 694179 - DNA, 12 bp, Homo sapiens
atattgtaagaa

SEQ ID NO: 694180 - DNA, 16 bp, Homo sapiens
atattgtaatcacatt

SEQ ID NO: 694181 - DNA, 13 bp, Homo sapiens
atattgtacataa

SEQ ID NO: 694182 - DNA, 16 bp, Homo sapiens
atattgtacataaaag

SEQ ID NO: 694183 - DNA, 14 bp, Homo sapiens
atattgtatattct

SEQ ID NO: 694184 - DNA, 13 bp, Homo sapiens
atattgtatgtaa

SEQ ID NO: 694185 - DNA, 18 bp, Homo sapiens
atattgtatgtaagtaat

SEQ ID NO: 694186 - DNA, 18 bp, Homo sapiens
atattgtgccaatatgta

SEQ ID NO: 694187 - DNA, 17 bp, Homo sapiens
atattgtgcttactcaa

SEQ ID NO: 694188 - DNA, 21 bp, Homo sapiens
atattgtgggtgttaattttt

SEQ ID NO: 694189 - DNA, 21 bp, Homo sapiens
atattgtgtttgtgtatttac

SEQ ID NO: 694190 - DNA, 20 bp, Homo sapiens
atattgttgcattgcttttt

SEQ ID NO: 694191 - DNA, 17 bp, Homo sapiens
atattgtttaaaattca

SEQ ID NO: 694192 - DNA, 14 bp, Homo sapiens
atattgtttccctc

SEQ ID NO: 694193 - DNA, 12 bp, Homo sapiens
atattgtttcta

SEQ ID NO: 694194 - DNA, 14 bp, Homo sapiens
atattgtttctgca

SEQ ID NO: 694195 - DNA, 12 bp, Homo sapiens
atattgtttgct

SEQ ID NO: 694196 - DNA, 20 bp, Homo sapiens
atattgttttcagtgtacat

SEQ ID NO: 694197 - DNA, 9 bp, Homo sapiens
atatttaaa

SEQ ID NO: 694198 - DNA, 20 bp, Homo sapiens
atatttaaaaaaaaaatcag

SEQ ID NO: 694199 - DNA, 17 bp, Homo sapiens
atatttaaaaaattaaa

SEQ ID NO: 694200 - DNA, 13 bp, Homo sapiens
atatttaaaaata

SEQ ID NO: 694201 - DNA, 16 bp, Homo sapiens
atatttaaaaataagt

SEQ ID NO: 694202 - DNA, 18 bp, Homo sapiens
atatttaaaaattgtttc

SEQ ID NO: 694203 - DNA, 19 bp, Homo sapiens
atatttaaaaattgtttct

SEQ ID NO: 694204 - DNA, 20 bp, Homo sapiens
atatttaaaaattgtttctt

SEQ ID NO: 694205 - DNA, 21 bp, Homo sapiens
atatttaaacatggttacaat

SEQ ID NO: 694206 - DNA, 23 bp, Homo sapiens
atatttaaacatggttacaatca

SEQ ID NO: 694207 - DNA, 19 bp, Homo sapiens
atatttaacattatttata

SEQ ID NO: 694208 - DNA, 19 bp, Homo sapiens
atatttaactctctttatg

SEQ ID NO: 694209 - DNA, 13 bp, Homo sapiens
atatttaactttt

SEQ ID NO: 694210 - DNA, 14 bp, Homo sapiens
atatttaacttttt

SEQ ID NO: 694211 - DNA, 22 bp, Homo sapiens
atatttaagaaaatacaataaa

SEQ ID NO: 694212 - DNA, 18 bp, Homo sapiens
atatttaagcaacatctt

SEQ ID NO: 694213 - DNA, 19 bp, Homo sapiens
atatttaagccttttgtgt

SEQ ID NO: 694214 - DNA, 17 bp, Homo sapiens
atatttaagtgaaggag

SEQ ID NO: 694215 - DNA, 9 bp, Homo sapiens
atatttaat

SEQ ID NO: 694216 - DNA, 19 bp, Homo sapiens
atatttaatatattgaata

SEQ ID NO: 694217 - DNA, 14 bp, Homo sapiens
atatttaatatgtc

SEQ ID NO: 694218 - DNA, 21 bp, Homo sapiens
aatgcagaaccacaaacaatt

SEQ ID NO: 694219 - DNA, 23 bp, Homo sapiens
aatgcagaatacttgactcattt

SEQ ID NO: 694220 - DNA, 20 bp, Homo sapiens
aatgcagattcctgggcctg

SEQ ID NO: 694221 - DNA, 13 bp, Homo sapiens
aatgcagcaggaa

SEQ ID NO: 694222 - DNA, 19 bp, Homo sapiens
aatgcagcaggaaggaaca

SEQ ID NO: 694223 - DNA, 15 bp, Homo sapiens
aatgcagtatatttc

SEQ ID NO: 694224 - DNA, 15 bp, Homo sapiens
aatgcagttttaaga

SEQ ID NO: 694225 - DNA, 14 bp, Homo sapiens
aatgcatacaataa

SEQ ID NO: 694226 - DNA, 21 bp, Homo sapiens
aatgcatacaataaaagagct

SEQ ID NO: 694227 - DNA, 22 bp, Homo sapiens
aatgcatacaataaaagagctt

SEQ ID NO: 694228 - DNA, 18 bp, Homo sapiens
aatgcatactgttgatac

SEQ ID NO: 694229 - DNA, 21 bp, Homo sapiens
aatgcatactgttgatacaaa

SEQ ID NO: 694230 - DNA, 23 bp, Homo sapiens
aatgcatactgttgatacaaacc

SEQ ID NO: 694231 - DNA, 15 bp, Homo sapiens
aatgcatcaggtcct

SEQ ID NO: 694232 - DNA, 23 bp, Homo sapiens
aatgcatccattcctcagggaca

SEQ ID NO: 694233 - DNA, 21 bp, Homo sapiens
aatgcatgaacaagttttaat

SEQ ID NO: 694234 - DNA, 17 bp, Homo sapiens
aatgcatgattttgtaa

SEQ ID NO: 694235 - DNA, 12 bp, Homo sapiens
aatgcatgtctt

SEQ ID NO: 694236 - DNA, 14 bp, Homo sapiens
aatgcatgtcttaa

SEQ ID NO: 694237 - DNA, 15 bp, Homo sapiens
aatgcatgtcttaaa

SEQ ID NO: 694238 - DNA, 18 bp, Homo sapiens
aatgcattaaacctgtct

SEQ ID NO: 694239 - DNA, 22 bp, Homo sapiens
aatgcattataggatcatttgt

SEQ ID NO: 694240 - DNA, 17 bp, Homo sapiens
aatgcattattttgaat

SEQ ID NO: 694241 - DNA, 13 bp, Homo sapiens
aatgcattcaaaa

SEQ ID NO: 694242 - DNA, 18 bp, Homo sapiens
aatgcattccctgaatct

SEQ ID NO: 694243 - DNA, 19 bp, Homo sapiens
aatgcattcttctctgttg

SEQ ID NO: 694244 - DNA, 21 bp, Homo sapiens
aatgcatttggaaccaaagtc

SEQ ID NO: 694245 - DNA, 23 bp, Homo sapiens
aatgcattttgctgcctttatta

SEQ ID NO: 694246 - DNA, 19 bp, Homo sapiens
aatgccaagggggtgactg

SEQ ID NO: 694247 - DNA, 17 bp, Homo sapiens
aatgccaagtgcctgct

SEQ ID NO: 694248 - DNA, 19 bp, Homo sapiens
aatgccacacattgtgctt

SEQ ID NO: 694249 - DNA, 17 bp, Homo sapiens
aatgccaccacacgtgt

SEQ ID NO: 694250 - DNA, 17 bp, Homo sapiens
aatgccactccctaccc

SEQ ID NO: 694251 - DNA, 19 bp, Homo sapiens
aatgccaggcggacaaagt

SEQ ID NO: 694252 - DNA, 12 bp, Homo sapiens
aatgccagggcc

SEQ ID NO: 694253 - DNA, 15 bp, Homo sapiens
aatgccatcaaatga

SEQ ID NO: 694254 - DNA, 14 bp, Homo sapiens
aatgccatcagccc

SEQ ID NO: 694255 - DNA, 16 bp, Homo sapiens
aatgccatcagcccct

SEQ ID NO: 694256 - DNA, 21 bp, Homo sapiens
atatttccatatggattttct

SEQ ID NO: 694257 - DNA, 17 bp, Homo sapiens
atatttcctgacttgag

SEQ ID NO: 694258 - DNA, 22 bp, Homo sapiens
atatttcctgacttgagtgttc

SEQ ID NO: 694259 - DNA, 14 bp, Homo sapiens
atatttcctgtatt

SEQ ID NO: 694260 - DNA, 15 bp, Homo sapiens
atatttcctttatgt

SEQ ID NO: 694261 - DNA, 17 bp, Homo sapiens
atatttcctttatgtga

SEQ ID NO: 694262 - DNA, 18 bp, Homo sapiens
atatttcctttatgtgaa

SEQ ID NO: 694263 - DNA, 16 bp, Homo sapiens
atatttctaactatat

SEQ ID NO: 694264 - DNA, 22 bp, Homo sapiens
atatttctacagagaaaatgaa

SEQ ID NO: 694265 - DNA, 12 bp, Homo sapiens
atatttctgtat

SEQ ID NO: 694266 - DNA, 20 bp, Homo sapiens
atatttctgtatatttgtca

SEQ ID NO: 694267 - DNA, 21 bp, Homo sapiens
atatttctgtgtacacatcta

SEQ ID NO: 694268 - DNA, 14 bp, Homo sapiens
atatttcttaattt

SEQ ID NO: 694269 - DNA, 22 bp, Homo sapiens
atatttcttaatttggataata

SEQ ID NO: 694270 - DNA, 13 bp, Homo sapiens
atatttcttcaaa

SEQ ID NO: 694271 - DNA, 15 bp, Homo sapiens
atatttcttcaaata

SEQ ID NO: 694272 - DNA, 12 bp, Homo sapiens
atatttgaatga

SEQ ID NO: 694273 - DNA, 16 bp, Homo sapiens
atatttgaatgaaaac

SEQ ID NO: 694274 - DNA, 18 bp, Homo sapiens
atatttgactctttcaaa

SEQ ID NO: 694275 - DNA, 21 bp, Homo sapiens
atatttgactctttcaaagaa

SEQ ID NO: 694276 - DNA, 22 bp, Homo sapiens
atatttgactctttcaaagaaa

SEQ ID NO: 694277 - DNA, 16 bp, Homo sapiens
atatttgacttgcatg

SEQ ID NO: 694278 - DNA, 20 bp, Homo sapiens
atatttgacttgcatgaaga

SEQ ID NO: 694279 - DNA, 13 bp, Homo sapiens
atatttgatttct

SEQ ID NO: 694280 - DNA, 19 bp, Homo sapiens
atatttgcagtttttcatt

SEQ ID NO: 694281 - DNA, 21 bp, Homo sapiens
atatttgctagactctagaca

SEQ ID NO: 694282 - DNA, 13 bp, Homo sapiens
atatttgctgcaa

SEQ ID NO: 694283 - DNA, 18 bp, Homo sapiens
atatttgctgcaaagaga

SEQ ID NO: 694284 - DNA, 18 bp, Homo sapiens
atatttgctttatactga

SEQ ID NO: 694285 - DNA, 16 bp, Homo sapiens
atatttgtaacattgt

SEQ ID NO: 694286 - DNA, 18 bp, Homo sapiens
atatttgtactgtttaat

SEQ ID NO: 694287 - DNA, 22 bp, Homo sapiens
atatttgtactgtttaatgttc

SEQ ID NO: 694288 - DNA, 23 bp, Homo sapiens
atatttgtcaatttatgaatata

SEQ ID NO: 694289 - DNA, 17 bp, Homo sapiens
atatttgtcttccgatc

SEQ ID NO: 694290 - DNA, 16 bp, Homo sapiens
atatttgtctttgaat

SEQ ID NO: 694291 - DNA, 18 bp, Homo sapiens
atatttgtgacaaaaaat

SEQ ID NO: 694292 - DNA, 14 bp, Homo sapiens
atatttgtggaata

SEQ ID NO: 694293 - DNA, 17 bp, Homo sapiens
atatttgtgtatttaac

SEQ ID NO: 694294 - DNA, 23 bp, Homo sapiens
atatttgttactttacttttgct

SEQ ID NO: 694295 - DNA, 16 bp, Homo sapiens
atatttgtttatggta

SEQ ID NO: 694296 - DNA, 15 bp, Homo sapiens
atatttgttttaata

SEQ ID NO: 694297 - DNA, 15 bp, Homo sapiens
atattttaaagaatt

SEQ ID NO: 694298 - DNA, 16 bp, Homo sapiens
atattttaaagaattg

SEQ ID NO: 694299 - DNA, 20 bp, Homo sapiens
atattttaaagaattgtgtc

SEQ ID NO: 694300 - DNA, 17 bp, Homo sapiens
atattttaactccactg

SEQ ID NO: 694301 - DNA, 13 bp, Homo sapiens
atattttaataga

SEQ ID NO: 694302 - DNA, 15 bp, Homo sapiens
atattttaatgaata

SEQ ID NO: 694303 - DNA, 23 bp, Homo sapiens
atattttacattcttggaaagtc

SEQ ID NO: 694304 - DNA, 23 bp, Homo sapiens
atattttacctcttattgcaaaa

SEQ ID NO: 694305 - DNA, 23 bp, Homo sapiens
atattttagcattttaattctct

SEQ ID NO: 694306 - DNA, 16 bp, Homo sapiens
atattttatatgttca

SEQ ID NO: 694307 - DNA, 20 bp, Homo sapiens
atattttatatgttcatatt

SEQ ID NO: 694308 - DNA, 14 bp, Homo sapiens
atattttatcctgt

SEQ ID NO: 694309 - DNA, 15 bp, Homo sapiens
atattttatgaacat

SEQ ID NO: 694310 - DNA, 19 bp, Homo sapiens
atattttatgaacattgta

SEQ ID NO: 694311 - DNA, 15 bp, Homo sapiens
atattttatttcaat

SEQ ID NO: 694312 - DNA, 20 bp, Homo sapiens
atattttatttcaatgtaat

SEQ ID NO: 694313 - DNA, 19 bp, Homo sapiens
atattttcaacgcagccct

SEQ ID NO: 694314 - DNA, 20 bp, Homo sapiens
atattttcaacgcagccctg

SEQ ID NO: 694315 - DNA, 14 bp, Homo sapiens
atattttcagcaaa

SEQ ID NO: 694316 - DNA, 12 bp, Homo sapiens
atattttctcta

SEQ ID NO: 694317 - DNA, 16 bp, Homo sapiens
atattttctctaggaa

SEQ ID NO: 694318 - DNA, 19 bp, Homo sapiens
atattttctctaggaaata

SEQ ID NO: 694319 - DNA, 13 bp, Homo sapiens
atattttctctgt

SEQ ID NO: 694320 - DNA, 19 bp, Homo sapiens
atattttcttccaagcaaa

SEQ ID NO: 694321 - DNA, 18 bp, Homo sapiens
atattttctttaatgctt

SEQ ID NO: 694322 - DNA, 13 bp, Homo sapiens
atattttcttttc

SEQ ID NO: 694323 - DNA, 17 bp, Homo sapiens
atattttgatacaaatg

SEQ ID NO: 694324 - DNA, 16 bp, Homo sapiens
atattttgattttaca

SEQ ID NO: 694325 - DNA, 17 bp, Homo sapiens
atattttgattttacat

SEQ ID NO: 694326 - DNA, 13 bp, Homo sapiens
atattttggaaac

SEQ ID NO: 694327 - DNA, 17 bp, Homo sapiens
atattttggaaactgct

SEQ ID NO: 694328 - DNA, 23 bp, Homo sapiens
atattttggaaactgctaaattc

SEQ ID NO: 694329 - DNA, 19 bp, Homo sapiens
atattttgggaatcttttc

SEQ ID NO: 694330 - DNA, 14 bp, Homo sapiens
atattttgtatata

SEQ ID NO: 694331 - DNA, 13 bp, Homo sapiens
atattttgtattt

SEQ ID NO: 694332 - DNA, 14 bp, Homo sapiens
atattttgtctaaa

SEQ ID NO: 694333 - DNA, 17 bp, Homo sapiens
atattttgtctaaaatg

SEQ ID NO: 694334 - DNA, 13 bp, Homo sapiens
atatttttaaaga

SEQ ID NO: 694335 - DNA, 16 bp, Homo sapiens
atatttttagactcat

SEQ ID NO: 694336 - DNA, 16 bp, Homo sapiens
atatttttatacttta

SEQ ID NO: 694337 - DNA, 18 bp, Homo sapiens
atatttttatatttagtt

SEQ ID NO: 694338 - DNA, 18 bp, Homo sapiens
atatttttatatttcctt

SEQ ID NO: 694339 - DNA, 20 bp, Homo sapiens
atatttttatatttccttta

SEQ ID NO: 694340 - DNA, 12 bp, Homo sapiens
atcaatttaagt

SEQ ID NO: 694341 - DNA, 13 bp, Homo sapiens
atcaatttttccc

SEQ ID NO: 694342 - DNA, 15 bp, Homo sapiens
atcaatttttcccag

SEQ ID NO: 694343 - DNA, 21 bp, Homo sapiens
atcaatttttcccagtatttt

SEQ ID NO: 694344 - DNA, 11 bp, Homo sapiens
atcacaaaaac

SEQ ID NO: 694345 - DNA, 13 bp, Homo sapiens
atcacaaaaattt

SEQ ID NO: 694346 - DNA, 14 bp, Homo sapiens
atcacaaagtggaa

SEQ ID NO: 694347 - DNA, 15 bp, Homo sapiens
atcacaaggtcagga

SEQ ID NO: 694348 - DNA, 18 bp, Homo sapiens
atcacacctctgggcttc

SEQ ID NO: 694349 - DNA, 19 bp, Homo sapiens
atcacactcaaggacagga

SEQ ID NO: 694350 - DNA, 22 bp, Homo sapiens
atcacactcaaggacaggagcc

SEQ ID NO: 694351 - DNA, 23 bp, Homo sapiens
atcacacttatattttatgaaca

SEQ ID NO: 694352 - DNA, 21 bp, Homo sapiens
atcacagatgggtattaaact

SEQ ID NO: 694353 - DNA, 13 bp, Homo sapiens
atcacagcccagc

SEQ ID NO: 694354 - DNA, 15 bp, Homo sapiens
atcacagcctccagg

SEQ ID NO: 694355 - DNA, 16 bp, Homo sapiens
atcacagcctccaggg

SEQ ID NO: 694356 - DNA, 18 bp, Homo sapiens
atcacagcctccagggcc

SEQ ID NO: 694357 - DNA, 21 bp, Homo sapiens
atcacagcctctgaaaaccaa

SEQ ID NO: 694358 - DNA, 17 bp, Homo sapiens
atcacagcgtttcagga

SEQ ID NO: 694359 - DNA, 22 bp, Homo sapiens
atcacaggagcaatcacaggaa

SEQ ID NO: 694360 - DNA, 12 bp, Homo sapiens
atcacagggcag

SEQ ID NO: 694361 - DNA, 20 bp, Homo sapiens
atcacagggcagagccggga

SEQ ID NO: 694362 - DNA, 16 bp, Homo sapiens
atcacagggccccaga

SEQ ID NO: 694363 - DNA, 18 bp, Homo sapiens
atcacagggttgggccca

SEQ ID NO: 694364 - DNA, 20 bp, Homo sapiens
atcacagggttgggcccaga

SEQ ID NO: 694365 - DNA, 14 bp, Homo sapiens
atcacagtcaatgg

SEQ ID NO: 694366 - DNA, 21 bp, Homo sapiens
atcacagtgtttttattgctc

SEQ ID NO: 694367 - DNA, 20 bp, Homo sapiens
atcacataagagagatgaga

SEQ ID NO: 694368 - DNA, 13 bp, Homo sapiens
atcacatcacctt

SEQ ID NO: 694369 - DNA, 20 bp, Homo sapiens
atcacatgaattattacagt

SEQ ID NO: 694370 - DNA, 18 bp, Homo sapiens
atcacattaatctcaaag

SEQ ID NO: 694371 - DNA, 16 bp, Homo sapiens
atcacattcttcaaag

SEQ ID NO: 694372 - DNA, 17 bp, Homo sapiens
atcaccaccgcctctgg

SEQ ID NO: 694373 - DNA, 13 bp, Homo sapiens
atcaccagtctgt

SEQ ID NO: 694374 - DNA, 18 bp, Homo sapiens
atcaccattatattttga

SEQ ID NO: 694375 - DNA, 13 bp, Homo sapiens
atcaccatttctt

SEQ ID NO: 694376 - DNA, 17 bp, Homo sapiens
atcacccactcctatgt

SEQ ID NO: 694377 - DNA, 16 bp, Homo sapiens
atcaccgactgaaaat

SEQ ID NO: 694378 - DNA, 13 bp, Homo sapiens
atcaccgctgggt

SEQ ID NO: 694379 - DNA, 14 bp, Homo sapiens
atcaccgctgggtg

SEQ ID NO: 694380 - DNA, 16 bp, Homo sapiens
atcaccgctgggtggt

SEQ ID NO: 694381 - DNA, 16 bp, Homo sapiens
atcaccgtcccgcaca

SEQ ID NO: 694382 - DNA, 22 bp, Homo sapiens
atcaccgtgggctccctgactg

SEQ ID NO: 694383 - DNA, 19 bp, Homo sapiens
atcacctaagcacttctag

SEQ ID NO: 694384 - DNA, 15 bp, Homo sapiens
atcacctatttccat

SEQ ID NO: 694385 - DNA, 21 bp, Homo sapiens
atcacctctaatagaggcagt

SEQ ID NO: 694386 - DNA, 14 bp, Homo sapiens
atcacctctcttca

SEQ ID NO: 694387 - DNA, 22 bp, Homo sapiens
aatggcgcgatctcagctcacc

SEQ ID NO: 694388 - DNA, 19 bp, Homo sapiens
aatggcgtgaacccgggag

SEQ ID NO: 694389 - DNA, 15 bp, Homo sapiens
aatggctaataaact

SEQ ID NO: 694390 - DNA, 16 bp, Homo sapiens
aatggctaattcccag

SEQ ID NO: 694391 - DNA, 15 bp, Homo sapiens
aatggctagtactgt

SEQ ID NO: 694392 - DNA, 20 bp, Homo sapiens
aatggctatgtttttaatgt

SEQ ID NO: 694393 - DNA, 16 bp, Homo sapiens
aatggctcaagtagaa

SEQ ID NO: 694394 - DNA, 20 bp, Homo sapiens
aatggctcaagtagaaaagc

SEQ ID NO: 694395 - DNA, 18 bp, Homo sapiens
aatggctgataattttaa

SEQ ID NO: 694396 - DNA, 19 bp, Homo sapiens
aatggctgataattttaaa

SEQ ID NO: 694397 - DNA, 15 bp, Homo sapiens
aatggctgctttgac

SEQ ID NO: 694398 - DNA, 13 bp, Homo sapiens
aatggctgggtca

SEQ ID NO: 694399 - DNA, 16 bp, Homo sapiens
aatggctgggtcaggg

SEQ ID NO: 694400 - DNA, 21 bp, Homo sapiens
aatggctgggtcagggccaga

SEQ ID NO: 694401 - DNA, 13 bp, Homo sapiens
aatggcttcagtg

SEQ ID NO: 694402 - DNA, 15 bp, Homo sapiens
aatgggaaaaaaaca

SEQ ID NO: 694403 - DNA, 20 bp, Homo sapiens
aatgggaaatactactcctg

SEQ ID NO: 694404 - DNA, 18 bp, Homo sapiens
aatgggactggagtccct

SEQ ID NO: 694405 - DNA, 14 bp, Homo sapiens
aatgggagacctgt

SEQ ID NO: 694406 - DNA, 21 bp, Homo sapiens
aatgggagctgaggccacact

SEQ ID NO: 694407 - DNA, 23 bp, Homo sapiens
aatgggatggtcggatctcacag

SEQ ID NO: 694408 - DNA, 19 bp, Homo sapiens
aatgggcagctccatcctc

SEQ ID NO: 694409 - DNA, 13 bp, Homo sapiens
aatgggcatttat

SEQ ID NO: 694410 - DNA, 17 bp, Homo sapiens
aatgggcatttatttta

SEQ ID NO: 694411 - DNA, 15 bp, Homo sapiens
aatgggcctgcccaa

SEQ ID NO: 694412 - DNA, 16 bp, Homo sapiens
aatgggcctgcctgcc

SEQ ID NO: 694413 - DNA, 18 bp, Homo sapiens
aatgggcctgcctgcctc

SEQ ID NO: 694414 - DNA, 15 bp, Homo sapiens
aatgggctctccggg

SEQ ID NO: 694415 - DNA, 20 bp, Homo sapiens
aatgggctcttccaacaagg

SEQ ID NO: 694416 - DNA, 19 bp, Homo sapiens
aatggggaaagcagaactg

SEQ ID NO: 694417 - DNA, 15 bp, Homo sapiens
aatgggggagggagg

SEQ ID NO: 694418 - DNA, 22 bp, Homo sapiens
aatgggggctttcggggagggc

SEQ ID NO: 694419 - DNA, 18 bp, Homo sapiens
aatggggggcgggccagg

SEQ ID NO: 694420 - DNA, 18 bp, Homo sapiens
aatgggggtagcagctgg

SEQ ID NO: 694421 - DNA, 19 bp, Homo sapiens
aatgggggtagcagctgga

SEQ ID NO: 694422 - DNA, 15 bp, Homo sapiens
aatgggggtgcattt

SEQ ID NO: 694423 - DNA, 21 bp, Homo sapiens
aatggggtagaaacattgtaa

SEQ ID NO: 694424 - DNA, 18 bp, Homo sapiens
aatggggtcctggccatc

SEQ ID NO: 694425 - DNA, 21 bp, Homo sapiens
aatggggtttgggcccctcag

SEQ ID NO: 694426 - DNA, 12 bp, Homo sapiens
aatgggtaatat

SEQ ID NO: 694427 - DNA, 22 bp, Homo sapiens
aatggtaaaataaaatgcctca

SEQ ID NO: 694428 - DNA, 19 bp, Homo sapiens
aatggtacatgtcttccat

SEQ ID NO: 694429 - DNA, 14 bp, Homo sapiens
aatggtagcatttt

SEQ ID NO: 694430 - DNA, 18 bp, Homo sapiens
aatggtaggcatttccta

SEQ ID NO: 694431 - DNA, 20 bp, Homo sapiens
aatggtaggtcaagtaataa

SEQ ID NO: 694432 - DNA, 23 bp, Homo sapiens
aatggtagtaatcacagttggcc

SEQ ID NO: 694433 - DNA, 16 bp, Homo sapiens
aatggtatcaaaatta

SEQ ID NO: 694434 - DNA, 15 bp, Homo sapiens
aatggtatgagctga

SEQ ID NO: 694435 - DNA, 18 bp, Homo sapiens
aatggtatgagctgaggg

SEQ ID NO: 694436 - DNA, 23 bp, Homo sapiens
aatggtcacgtttggtgcttctc

SEQ ID NO: 694437 - DNA, 16 bp, Homo sapiens
aatggtcgcccaggag

SEQ ID NO: 694438 - DNA, 13 bp, Homo sapiens
aatggtctggcaa

SEQ ID NO: 694439 - DNA, 15 bp, Homo sapiens
aatggtctttgctcc

SEQ ID NO: 694440 - DNA, 21 bp, Homo sapiens
aatggtgagcgatcatttatt

SEQ ID NO: 694441 - DNA, 23 bp, Homo sapiens
aatggtgagcgatcatttatttc

SEQ ID NO: 694442 - DNA, 18 bp, Homo sapiens
aatggtgatccacccagt

SEQ ID NO: 694443 - DNA, 20 bp, Homo sapiens
aatggtgatcctctattttg

SEQ ID NO: 694444 - DNA, 21 bp, Homo sapiens
aatggtgcaaaaaaaaactta

SEQ ID NO: 694445 - DNA, 20 bp, Homo sapiens
aatggtgcttcccccacccc

SEQ ID NO: 694446 - DNA, 23 bp, Homo sapiens
aatggtggtcttctccaccagcc

SEQ ID NO: 694447 - DNA, 16 bp, Homo sapiens
aatggtgtacataatg

SEQ ID NO: 694448 - DNA, 17 bp, Homo sapiens
aatggttaaaatcacta

SEQ ID NO: 694449 - DNA, 17 bp, Homo sapiens
aatggttaaattttaca

SEQ ID NO: 694450 - DNA, 18 bp, Homo sapiens
aatggttaatttttcctg

SEQ ID NO: 694451 - DNA, 21 bp, Homo sapiens
aatggttccatgcctgagggt

SEQ ID NO: 694452 - DNA, 15 bp, Homo sapiens
aatggttctgaaata

SEQ ID NO: 694453 - DNA, 19 bp, Homo sapiens
aatggttgatggaaaataa

SEQ ID NO: 694454 - DNA, 13 bp, Homo sapiens
aatggttggtttt

SEQ ID NO: 694455 - DNA, 21 bp, Homo sapiens
aatggtttggtgctttttata

SEQ ID NO: 694456 - DNA, 17 bp, Homo sapiens
aatggtttttaaatttt

SEQ ID NO: 694457 - DNA, 21 bp, Homo sapiens
aatggtttttaaattttgtaa

SEQ ID NO: 694458 - DNA, 18 bp, Homo sapiens
aatggtttttatttctcg

SEQ ID NO: 694459 - DNA, 12 bp, Homo sapiens
aatgtaaaaaag

SEQ ID NO: 694460 - DNA, 20 bp, Homo sapiens
aatgtaaaaagatctacata

SEQ ID NO: 694461 - DNA, 23 bp, Homo sapiens
aatgtaaaacacatacaaaagaa

SEQ ID NO: 694462 - DNA, 15 bp, Homo sapiens
aatgtctctgctcct

SEQ ID NO: 694463 - DNA, 16 bp, Homo sapiens
aatgtctcttcctctg

SEQ ID NO: 694464 - DNA, 16 bp, Homo sapiens
aatgtctgaagtacaa

SEQ ID NO: 694465 - DNA, 17 bp, Homo sapiens
aatgtctgaagtacaaa

SEQ ID NO: 694466 - DNA, 16 bp, Homo sapiens
aatgtctgacacatta

SEQ ID NO: 694467 - DNA, 17 bp, Homo sapiens
aatgtctgagtgaacct

SEQ ID NO: 694468 - DNA, 16 bp, Homo sapiens
aatgtctgctgaggag

SEQ ID NO: 694469 - DNA, 23 bp, Homo sapiens
aatgtctgtaataatagactgta

SEQ ID NO: 694470 - DNA, 13 bp, Homo sapiens
aatgtctgttgaa

SEQ ID NO: 694471 - DNA, 20 bp, Homo sapiens
aatgtctgttgaacagctat

SEQ ID NO: 694472 - DNA, 23 bp, Homo sapiens
aatgtctgtttattaactactga

SEQ ID NO: 694473 - DNA, 21 bp, Homo sapiens
aatgtcttcatttcattgtat

SEQ ID NO: 694474 - DNA, 20 bp, Homo sapiens
aatgtcttgatgcatgcact

SEQ ID NO: 694475 - DNA, 17 bp, Homo sapiens
aatgtcttgctgttgac

SEQ ID NO: 694476 - DNA, 23 bp, Homo sapiens
aatgtctttccaaattatttctt

SEQ ID NO: 694477 - DNA, 13 bp, Homo sapiens
aatgtcttttgaa

SEQ ID NO: 694478 - DNA, 15 bp, Homo sapiens
aatgtcttttgaata

SEQ ID NO: 694479 - DNA, 17 bp, Homo sapiens
aatgtcttttgaatatt

SEQ ID NO: 694480 - DNA, 17 bp, Homo sapiens
aatgtgaaacacatgcc

SEQ ID NO: 694481 - DNA, 19 bp, Homo sapiens
aatgtgaaacacatgccag

SEQ ID NO: 694482 - DNA, 19 bp, Homo sapiens
aatgtgaaatttaaataat

SEQ ID NO: 694483 - DNA, 17 bp, Homo sapiens
aatgtgaaggcccaaga

SEQ ID NO: 694484 - DNA, 12 bp, Homo sapiens
aatgtgaatttc

SEQ ID NO: 694485 - DNA, 22 bp, Homo sapiens
aatgtgaatttttgcctatctt

SEQ ID NO: 694486 - DNA, 19 bp, Homo sapiens
aatgtgaggaactcacata

SEQ ID NO: 694487 - DNA, 23 bp, Homo sapiens
aatgtgagtttggtctggactga

SEQ ID NO: 694488 - DNA, 23 bp, Homo sapiens
aatgtgataatatattgctaaaa

SEQ ID NO: 694489 - DNA, 13 bp, Homo sapiens
aatgtgatcatat

SEQ ID NO: 694490 - DNA, 12 bp, Homo sapiens
aatgtgatgaat

SEQ ID NO: 694491 - DNA, 20 bp, Homo sapiens
aatgtgatgaatactgtatt

SEQ ID NO: 694492 - DNA, 17 bp, Homo sapiens
aatgtgattcttctaaa

SEQ ID NO: 694493 - DNA, 18 bp, Homo sapiens
aatgtgcaaattttgcat

SEQ ID NO: 694494 - DNA, 20 bp, Homo sapiens
aatgtgcagatgcaattgtt

SEQ ID NO: 694495 - DNA, 23 bp, Homo sapiens
aatgtgcagggatattgccttat

SEQ ID NO: 694496 - DNA, 22 bp, Homo sapiens
aatgtgcaggtttgttacatag

SEQ ID NO: 694497 - DNA, 14 bp, Homo sapiens
aatgtgccacctgt

SEQ ID NO: 694498 - DNA, 18 bp, Homo sapiens
aatgtgccatactaatga

SEQ ID NO: 694499 - DNA, 21 bp, Homo sapiens
aatgtgccatactaatgatga

SEQ ID NO: 694500 - DNA, 12 bp, Homo sapiens
aatgtgcccctg

SEQ ID NO: 694501 - DNA, 23 bp, Homo sapiens
aatgtgcctccaagcggccctgt

SEQ ID NO: 694502 - DNA, 22 bp, Homo sapiens
aatgtgctggtgaacactgtga

SEQ ID NO: 694503 - DNA, 21 bp, Homo sapiens
aatgtggaaggaaaatatttc

SEQ ID NO: 694504 - DNA, 14 bp, Homo sapiens
aatgtggacgtgca

SEQ ID NO: 694505 - DNA, 18 bp, Homo sapiens
aatgtggacgtgcactga

SEQ ID NO: 694506 - DNA, 21 bp, Homo sapiens
aatgtggactcaatccctagg

SEQ ID NO: 694507 - DNA, 19 bp, Homo sapiens
aatgtggatttgattcatt

SEQ ID NO: 694508 - DNA, 20 bp, Homo sapiens
aatgtggcctaaaaatgcaa

SEQ ID NO: 694509 - DNA, 21 bp, Homo sapiens
aatgtgggttatcctcctctc

SEQ ID NO: 694510 - DNA, 15 bp, Homo sapiens
aatgtggtctcagga

SEQ ID NO: 694511 - DNA, 21 bp, Homo sapiens
aatgtggttagttaactgaat

SEQ ID NO: 694512 - DNA, 21 bp, Homo sapiens
aatgtgtacagtgaattgtct

SEQ ID NO: 694513 - DNA, 22 bp, Homo sapiens
aatgtgtatttttcaaggcatt

SEQ ID NO: 694514 - DNA, 21 bp, Homo sapiens
aatgtgtcagaataggaaaac

SEQ ID NO: 694515 - DNA, 19 bp, Homo sapiens
aatgtgtcctatctatctt

SEQ ID NO: 694516 - DNA, 20 bp, Homo sapiens
atcagggccctgccccaggc

SEQ ID NO: 694517 - DNA, 14 bp, Homo sapiens
atcagggcctgggg

SEQ ID NO: 694518 - DNA, 17 bp, Homo sapiens
atcagggcctggggcct

SEQ ID NO: 694519 - DNA, 21 bp, Homo sapiens
atcagggcctggggcctgaga

SEQ ID NO: 694520 - DNA, 22 bp, Homo sapiens
atcagggcctggggcctgagag

SEQ ID NO: 694521 - DNA, 23 bp, Homo sapiens
atcagggcctggggcctgagaga

SEQ ID NO: 694522 - DNA, 24 bp, Homo sapiens
atcagggcctggggcctgagagaa

SEQ ID NO: 694523 - DNA, 18 bp, Homo sapiens
atcagggcctttctcctc

SEQ ID NO: 694524 - DNA, 22 bp, Homo sapiens
atcagggcctttctcctcccca

SEQ ID NO: 694525 - DNA, 12 bp, Homo sapiens
atcaggggccag

SEQ ID NO: 694526 - DNA, 20 bp, Homo sapiens
atcaggggccagagagcagg

SEQ ID NO: 694527 - DNA, 21 bp, Homo sapiens
atcagggggaagaagcagaga

SEQ ID NO: 694528 - DNA, 21 bp, Homo sapiens
atcagggtaaaaggtgcaggt

SEQ ID NO: 694529 - DNA, 21 bp, Homo sapiens
atcaggtagaccatattctaa

SEQ ID NO: 694530 - DNA, 14 bp, Homo sapiens
atcaggtagacttt

SEQ ID NO: 694531 - DNA, 13 bp, Homo sapiens
atcaggtgtttta

SEQ ID NO: 694532 - DNA, 19 bp, Homo sapiens
atcagtaaaattatactgt

SEQ ID NO: 694533 - DNA, 21 bp, Homo sapiens
atcagtaaaattatactgtgt

SEQ ID NO: 694534 - DNA, 21 bp, Homo sapiens
atcagtaaagtacctttatgt

SEQ ID NO: 694535 - DNA, 19 bp, Homo sapiens
atcagtaagaaaaagaaga

SEQ ID NO: 694536 - DNA, 23 bp, Homo sapiens
atcagtaagaggtgttatttgga

SEQ ID NO: 694537 - DNA, 16 bp, Homo sapiens
atcagtataaacaaag

SEQ ID NO: 694538 - DNA, 13 bp, Homo sapiens
atcagtattctga

SEQ ID NO: 694539 - DNA, 15 bp, Homo sapiens
atcagtattctgaca

SEQ ID NO: 694540 - DNA, 20 bp, Homo sapiens
atcagtattctgacatgtaa

SEQ ID NO: 694541 - DNA, 23 bp, Homo sapiens
atcagtattctgacatgtaagaa

SEQ ID NO: 694542 - DNA, 15 bp, Homo sapiens
atcagtatttccttc

SEQ ID NO: 694543 - DNA, 18 bp, Homo sapiens
atcagtatttccttccac

SEQ ID NO: 694544 - DNA, 21 bp, Homo sapiens
atcagtatttccttccactgt

SEQ ID NO: 694545 - DNA, 17 bp, Homo sapiens
atcagtcccctcccatc

SEQ ID NO: 694546 - DNA, 21 bp, Homo sapiens
atcagtccctatgtatttgca

SEQ ID NO: 694547 - DNA, 17 bp, Homo sapiens
atcagtgatctatgttt

SEQ ID NO: 694548 - DNA, 22 bp, Homo sapiens
atcagtgatctatgtttgtgtg

SEQ ID NO: 694549 - DNA, 17 bp, Homo sapiens
atcagtgcctctttgaa

SEQ ID NO: 694550 - DNA, 20 bp, Homo sapiens
atcagtgcctctttgaaggt

SEQ ID NO: 694551 - DNA, 22 bp, Homo sapiens
atcagtgcctggtgttctgaag

SEQ ID NO: 694552 - DNA, 22 bp, Homo sapiens
atcagtggcatggctccagtct

SEQ ID NO: 694553 - DNA, 19 bp, Homo sapiens
atcagtggttatttaggga

SEQ ID NO: 694554 - DNA, 19 bp, Homo sapiens
atcagtgtaaaaaggaaaa

SEQ ID NO: 694555 - DNA, 15 bp, Homo sapiens
atcagtgtctgtttc

SEQ ID NO: 694556 - DNA, 16 bp, Homo sapiens
atcagtgtgtaaataa

SEQ ID NO: 694557 - DNA, 19 bp, Homo sapiens
atcagtgttaaaaaatttt

SEQ ID NO: 694558 - DNA, 13 bp, Homo sapiens
atcagtgtttaaa

SEQ ID NO: 694559 - DNA, 17 bp, Homo sapiens
atcagtgtttaaataaa

SEQ ID NO: 694560 - DNA, 18 bp, Homo sapiens
atcagtgtttaaataaag

SEQ ID NO: 694561 - DNA, 15 bp, Homo sapiens
atcagttaaaatcac

SEQ ID NO: 694562 - DNA, 22 bp, Homo sapiens
atcagttaaaatcacattttaa

SEQ ID NO: 694563 - DNA, 22 bp, Homo sapiens
atcagttaagaaatttcacata

SEQ ID NO: 694564 - DNA, 22 bp, Homo sapiens
atcagttacccactcggtccca

SEQ ID NO: 694565 - DNA, 22 bp, Homo sapiens
atcagttatacagttataaaat

SEQ ID NO: 694566 - DNA, 14 bp, Homo sapiens
atcagttatatgat

SEQ ID NO: 694567 - DNA, 15 bp, Homo sapiens
atcagttatatgata

SEQ ID NO: 694568 - DNA, 19 bp, Homo sapiens
atcagttcccccagtacct

SEQ ID NO: 694569 - DNA, 22 bp, Homo sapiens
atcagttcttagattcagggga

SEQ ID NO: 694570 - DNA, 18 bp, Homo sapiens
atcagtttcatgaaatga

SEQ ID NO: 694571 - DNA, 14 bp, Homo sapiens
atcagtttttcata

SEQ ID NO: 694572 - DNA, 12 bp, Homo sapiens
atcataaaataa

SEQ ID NO: 694573 - DNA, 11 bp, Homo sapiens
atcataaatct

SEQ ID NO: 694574 - DNA, 21 bp, Homo sapiens
atcataaatcttcttattaaa

SEQ ID NO: 694575 - DNA, 24 bp, Homo sapiens
atcataaggagttggtgtaatcat

SEQ ID NO: 694576 - DNA, 22 bp, Homo sapiens
atcataaggttttattcatata

SEQ ID NO: 694577 - DNA, 13 bp, Homo sapiens
atcataattacat

SEQ ID NO: 694578 - DNA, 14 bp, Homo sapiens
atcataattaccaa

SEQ ID NO: 694579 - DNA, 16 bp, Homo sapiens
atcatacaaactctca

SEQ ID NO: 694580 - DNA, 18 bp, Homo sapiens
atcatacttaacatttca

SEQ ID NO: 694581 - DNA, 15 bp, Homo sapiens
atcatagaaatgtaa

SEQ ID NO: 694582 - DNA, 14 bp, Homo sapiens
atcatttgtttaaa

SEQ ID NO: 694583 - DNA, 22 bp, Homo sapiens
atcattttaaattccactgaaa

SEQ ID NO: 694584 - DNA, 17 bp, Homo sapiens
atcattttaataaagtt

SEQ ID NO: 694585 - DNA, 19 bp, Homo sapiens
atcattttatatgtcaaag

SEQ ID NO: 694586 - DNA, 22 bp, Homo sapiens
atcattttctccccttggcagt

SEQ ID NO: 694587 - DNA, 15 bp, Homo sapiens
atcattttgcattca

SEQ ID NO: 694588 - DNA, 19 bp, Homo sapiens
atcattttgcctcttttct

SEQ ID NO: 694589 - DNA, 17 bp, Homo sapiens
atcatttttatatgaaa

SEQ ID NO: 694590 - DNA, 20 bp, Homo sapiens
atcatttttatatgaaataa

SEQ ID NO: 694591 - DNA, 12 bp, Homo sapiens
atcatttttcca

SEQ ID NO: 694592 - DNA, 13 bp, Homo sapiens
atcatttttccag

SEQ ID NO: 694593 - DNA, 15 bp, Homo sapiens
atcatttttgtataa

SEQ ID NO: 694594 - DNA, 23 bp, Homo sapiens
atcatttttgtataaaaaggaaa

SEQ ID NO: 694595 - DNA, 14 bp, Homo sapiens
atcatttttgtgca

SEQ ID NO: 694596 - DNA, 14 bp, Homo sapiens
atcattttttactt

SEQ ID NO: 694597 - DNA, 17 bp, Homo sapiens
atccaaaaaagcaaaca

SEQ ID NO: 694598 - DNA, 21 bp, Homo sapiens
atccaaaaagctctgaaaaca

SEQ ID NO: 694599 - DNA, 18 bp, Homo sapiens
atccaaaaatagccctgc

SEQ ID NO: 694600 - DNA, 14 bp, Homo sapiens
atccaaaatatttt

SEQ ID NO: 694601 - DNA, 16 bp, Homo sapiens
atccaaaatgaatgca

SEQ ID NO: 694602 - DNA, 13 bp, Homo sapiens
atccaaaatgctt

SEQ ID NO: 694603 - DNA, 20 bp, Homo sapiens
atccaaacttggatttttga

SEQ ID NO: 694604 - DNA, 20 bp, Homo sapiens
atccaaagaacttgatttgc

SEQ ID NO: 694605 - DNA, 21 bp, Homo sapiens
atccaaagaacttgatttgca

SEQ ID NO: 694606 - DNA, 18 bp, Homo sapiens
atccaaagactgtactgg

SEQ ID NO: 694607 - DNA, 15 bp, Homo sapiens
atccaaagcagacag

SEQ ID NO: 694608 - DNA, 20 bp, Homo sapiens
atccaaagggaatactcaca

SEQ ID NO: 694609 - DNA, 15 bp, Homo sapiens
atccaaatctgtcct

SEQ ID NO: 694610 - DNA, 19 bp, Homo sapiens
atccaaatctgtcctctgt

SEQ ID NO: 694611 - DNA, 19 bp, Homo sapiens
atccaaatcttgaatttct

SEQ ID NO: 694612 - DNA, 22 bp, Homo sapiens
atccaacaagaagaaatatgaa

SEQ ID NO: 694613 - DNA, 17 bp, Homo sapiens
atccaaccattttcatt

SEQ ID NO: 694614 - DNA, 18 bp, Homo sapiens
atccaactaatgccttac

SEQ ID NO: 694615 - DNA, 20 bp, Homo sapiens
atccaactaatgccttactc

SEQ ID NO: 694616 - DNA, 18 bp, Homo sapiens
atccaactggaaattcca

SEQ ID NO: 694617 - DNA, 14 bp, Homo sapiens
atccaagcctccac

SEQ ID NO: 694618 - DNA, 19 bp, Homo sapiens
atccaagctccctgcccca

SEQ ID NO: 694619 - DNA, 23 bp, Homo sapiens
atccaagcttttttaaagtaaaa

SEQ ID NO: 694620 - DNA, 19 bp, Homo sapiens
atccaaggaaacattttat

SEQ ID NO: 694621 - DNA, 21 bp, Homo sapiens
atccaaggaagggatgtattt

SEQ ID NO: 694622 - DNA, 13 bp, Homo sapiens
atccaaggcaaac

SEQ ID NO: 694623 - DNA, 16 bp, Homo sapiens
atccaaggcaaacaat

SEQ ID NO: 694624 - DNA, 19 bp, Homo sapiens
atccaaggggctagctgga

SEQ ID NO: 694625 - DNA, 22 bp, Homo sapiens
atccaagtctttcttctttttt

SEQ ID NO: 694626 - DNA, 14 bp, Homo sapiens
atccaatactgccc

SEQ ID NO: 694627 - DNA, 22 bp, Homo sapiens
atccaatatcatgtcttgtgca

SEQ ID NO: 694628 - DNA, 22 bp, Homo sapiens
atccaatattttctttaatgct

SEQ ID NO: 694629 - DNA, 16 bp, Homo sapiens
atccaatattttgcct

SEQ ID NO: 694630 - DNA, 20 bp, Homo sapiens
atccaatgggtttttccctg

SEQ ID NO: 694631 - DNA, 16 bp, Homo sapiens
atccaatttattatag

SEQ ID NO: 694632 - DNA, 20 bp, Homo sapiens
atccacaactaatgagggaa

SEQ ID NO: 694633 - DNA, 14 bp, Homo sapiens
atccacaagccatt

SEQ ID NO: 694634 - DNA, 17 bp, Homo sapiens
atccacacaaattcagt

SEQ ID NO: 694635 - DNA, 19 bp, Homo sapiens
atccacacacgcaggaact

SEQ ID NO: 694636 - DNA, 17 bp, Homo sapiens
atccacagctatatcct

SEQ ID NO: 694637 - DNA, 23 bp, Homo sapiens
atccacaggatattaaacgtgta

SEQ ID NO: 694638 - DNA, 16 bp, Homo sapiens
atccacataaatgctc

SEQ ID NO: 694639 - DNA, 22 bp, Homo sapiens
atccacataaatgctccttgtg

SEQ ID NO: 694640 - DNA, 16 bp, Homo sapiens
atccacatgtttcaga

SEQ ID NO: 694641 - DNA, 18 bp, Homo sapiens
atccacccacctcggcct

SEQ ID NO: 694642 - DNA, 14 bp, Homo sapiens
atccacccagtgct

SEQ ID NO: 694643 - DNA, 18 bp, Homo sapiens
atccacccagtgctgcca

SEQ ID NO: 694644 - DNA, 12 bp, Homo sapiens
aattaaagtatg

SEQ ID NO: 694645 - DNA, 18 bp, Homo sapiens
aattaaagtctattcaaa

SEQ ID NO: 694646 - DNA, 17 bp, Homo sapiens
aattaaataaaataacc

SEQ ID NO: 694647 - DNA, 15 bp, Homo sapiens
aattaaataaactgt

SEQ ID NO: 694648 - DNA, 24 bp, Homo sapiens
aattaaataaactgttttcaagtc

SEQ ID NO: 694649 - DNA, 14 bp, Homo sapiens
aattaaatagtgtg

SEQ ID NO: 694650 - DNA, 16 bp, Homo sapiens
aattaaatagtgtgat

SEQ ID NO: 694651 - DNA, 16 bp, Homo sapiens
aattaaatatatgtat

SEQ ID NO: 694652 - DNA, 19 bp, Homo sapiens
aattaaatatatgtatgta

SEQ ID NO: 694653 - DNA, 18 bp, Homo sapiens
aattaaatctctttaaga

SEQ ID NO: 694654 - DNA, 17 bp, Homo sapiens
aattaaatgccttgtat

SEQ ID NO: 694655 - DNA, 11 bp, Homo sapiens
aattaaatgta

SEQ ID NO: 694656 - DNA, 12 bp, Homo sapiens
aattaaatgtat

SEQ ID NO: 694657 - DNA, 14 bp, Homo sapiens
aattaaattaggaa

SEQ ID NO: 694658 - DNA, 12 bp, Homo sapiens
aattaaatttaa

SEQ ID NO: 694659 - DNA, 21 bp, Homo sapiens
aattaacaaatttctttgttt

SEQ ID NO: 694660 - DNA, 20 bp, Homo sapiens
aattaaccccataattagat

SEQ ID NO: 694661 - DNA, 16 bp, Homo sapiens
aattaaccgagacact

SEQ ID NO: 694662 - DNA, 14 bp, Homo sapiens
aattaacctggtgc

SEQ ID NO: 694663 - DNA, 18 bp, Homo sapiens
aattaacctggtgctgga

SEQ ID NO: 694664 - DNA, 14 bp, Homo sapiens
aattaactgaaaca

SEQ ID NO: 694665 - DNA, 16 bp, Homo sapiens
aattaacttaactgaa

SEQ ID NO: 694666 - DNA, 18 bp, Homo sapiens
aattaacttaactgaaga

SEQ ID NO: 694667 - DNA, 11 bp, Homo sapiens
aattaacttga

SEQ ID NO: 694668 - DNA, 11 bp, Homo sapiens
aattaactttt

SEQ ID NO: 694669 - DNA, 15 bp, Homo sapiens
aattaacttttataa

SEQ ID NO: 694670 - DNA, 22 bp, Homo sapiens
aattaacttttataaactttac

SEQ ID NO: 694671 - DNA, 16 bp, Homo sapiens
aattaagaaattccat

SEQ ID NO: 694672 - DNA, 13 bp, Homo sapiens
aattaagaaggca

SEQ ID NO: 694673 - DNA, 14 bp, Homo sapiens
aattaagaaggcaa

SEQ ID NO: 694674 - DNA, 16 bp, Homo sapiens
aattaagaaggcaaaa

SEQ ID NO: 694675 - DNA, 21 bp, Homo sapiens
aattaagaatatgtttccttg

SEQ ID NO: 694676 - DNA, 19 bp, Homo sapiens
aattaagaggatacacacg

SEQ ID NO: 694677 - DNA, 20 bp, Homo sapiens
aattaagatcctaaactctc

SEQ ID NO: 694678 - DNA, 16 bp, Homo sapiens
aattaagcattttgaa

SEQ ID NO: 694679 - DNA, 17 bp, Homo sapiens
aattaagtactatgtat

SEQ ID NO: 694680 - DNA, 12 bp, Homo sapiens
aattaagtagaa

SEQ ID NO: 694681 - DNA, 20 bp, Homo sapiens
aattaagtcattttgtaata

SEQ ID NO: 694682 - DNA, 14 bp, Homo sapiens
aattaagttatctt

SEQ ID NO: 694683 - DNA, 13 bp, Homo sapiens
aattaagttgaaa

SEQ ID NO: 694684 - DNA, 19 bp, Homo sapiens
aattaagttttaaataaac

SEQ ID NO: 694685 - DNA, 12 bp, Homo sapiens
aattaatacaga

SEQ ID NO: 694686 - DNA, 12 bp, Homo sapiens
aattaatacatt

SEQ ID NO: 694687 - DNA, 21 bp, Homo sapiens
aattaatatccctacatgtat

SEQ ID NO: 694688 - DNA, 17 bp, Homo sapiens
aattaatatctttctgc

SEQ ID NO: 694689 - DNA, 22 bp, Homo sapiens
aattaatgaaatgataaagact

SEQ ID NO: 694690 - DNA, 15 bp, Homo sapiens
aattaatttgtgaat

SEQ ID NO: 694691 - DNA, 12 bp, Homo sapiens
aattaattttac

SEQ ID NO: 694692 - DNA, 19 bp, Homo sapiens
aattaattttcagccatgt

SEQ ID NO: 694693 - DNA, 15 bp, Homo sapiens
aattacaagccctgg

SEQ ID NO: 694694 - DNA, 14 bp, Homo sapiens
aattacaattttat

SEQ ID NO: 694695 - DNA, 15 bp, Homo sapiens
aattacaattttatc

SEQ ID NO: 694696 - DNA, 19 bp, Homo sapiens
aattacaattttatctgtt

SEQ ID NO: 694697 - DNA, 18 bp, Homo sapiens
aattacacaataaagcag

SEQ ID NO: 694698 - DNA, 20 bp, Homo sapiens
aattacacaataaagcagtc

SEQ ID NO: 694699 - DNA, 17 bp, Homo sapiens
aattacactgtgccttt

SEQ ID NO: 694700 - DNA, 16 bp, Homo sapiens
aattacagcaaaaagg

SEQ ID NO: 694701 - DNA, 17 bp, Homo sapiens
aattacagcttcaccct

SEQ ID NO: 694702 - DNA, 12 bp, Homo sapiens
aattacatattt

SEQ ID NO: 694703 - DNA, 19 bp, Homo sapiens
aattacattcctaactaga

SEQ ID NO: 694704 - DNA, 19 bp, Homo sapiens
aattacattttatatgtga

SEQ ID NO: 694705 - DNA, 19 bp, Homo sapiens
atcccctccctgtcaaagc

SEQ ID NO: 694706 - DNA, 15 bp, Homo sapiens
atcccctcctagcac

SEQ ID NO: 694707 - DNA, 14 bp, Homo sapiens
atcccctccttggg

SEQ ID NO: 694708 - DNA, 15 bp, Homo sapiens
atcccctccttgggc

SEQ ID NO: 694709 - DNA, 16 bp, Homo sapiens
atcccctcgtcctgtc

SEQ ID NO: 694710 - DNA, 19 bp, Homo sapiens
atcccctcgtcctgtccca

SEQ ID NO: 694711 - DNA, 20 bp, Homo sapiens
atcccctcgtcctgtcccag

SEQ ID NO: 694712 - DNA, 14 bp, Homo sapiens
atcccctctcagga

SEQ ID NO: 694713 - DNA, 17 bp, Homo sapiens
atcccctctcaggagag

SEQ ID NO: 694714 - DNA, 12 bp, Homo sapiens
atcccctgcctc

SEQ ID NO: 694715 - DNA, 18 bp, Homo sapiens
atcccctgcctcctgcca

SEQ ID NO: 694716 - DNA, 15 bp, Homo sapiens
atcccctgtagagtg

SEQ ID NO: 694717 - DNA, 18 bp, Homo sapiens
atccccttagaggacctg

SEQ ID NO: 694718 - DNA, 19 bp, Homo sapiens
atccccttcccccatccct

SEQ ID NO: 694719 - DNA, 21 bp, Homo sapiens
atccccttcccccatccctac

SEQ ID NO: 694720 - DNA, 18 bp, Homo sapiens
atcccctttactatcatt

SEQ ID NO: 694721 - DNA, 12 bp, Homo sapiens
atcccctttcct

SEQ ID NO: 694722 - DNA, 16 bp, Homo sapiens
atcccctttcctcccc

SEQ ID NO: 694723 - DNA, 19 bp, Homo sapiens
atcccctttcctccccacc

SEQ ID NO: 694724 - DNA, 17 bp, Homo sapiens
atcccgaagccatcact

SEQ ID NO: 694725 - DNA, 23 bp, Homo sapiens
atcccgaagccatcacttctccc

SEQ ID NO: 694726 - DNA, 16 bp, Homo sapiens
atcccgagtctgggac

SEQ ID NO: 694727 - DNA, 15 bp, Homo sapiens
atcccgcttagcctg

SEQ ID NO: 694728 - DNA, 17 bp, Homo sapiens
atcccgcttagcctgcc

SEQ ID NO: 694729 - DNA, 20 bp, Homo sapiens
atcccgcttagcctgcctca

SEQ ID NO: 694730 - DNA, 21 bp, Homo sapiens
atcccgcttagcctgcctcac

SEQ ID NO: 694731 - DNA, 23 bp, Homo sapiens
atcccgcttagcgctctggacag

SEQ ID NO: 694732 - DNA, 17 bp, Homo sapiens
atcccggaggaaatctg

SEQ ID NO: 694733 - DNA, 13 bp, Homo sapiens
atcccggcctctt

SEQ ID NO: 694734 - DNA, 14 bp, Homo sapiens
atcccggcctcttc

SEQ ID NO: 694735 - DNA, 18 bp, Homo sapiens
atcccggcctcttccacc

SEQ ID NO: 694736 - DNA, 22 bp, Homo sapiens
atcccgggtttggctgagcctg

SEQ ID NO: 694737 - DNA, 22 bp, Homo sapiens
atcccgtacctcttcccatgac

SEQ ID NO: 694738 - DNA, 15 bp, Homo sapiens
atcccgtatcacagt

SEQ ID NO: 694739 - DNA, 18 bp, Homo sapiens
atcccgtatcacagtgtt

SEQ ID NO: 694740 - DNA, 16 bp, Homo sapiens
atcccgtgttctcctt

SEQ ID NO: 694741 - DNA, 18 bp, Homo sapiens
atccctaatgtgtgccat

SEQ ID NO: 694742 - DNA, 14 bp, Homo sapiens
atccctaatgtttt

SEQ ID NO: 694743 - DNA, 18 bp, Homo sapiens
atccctacatgtattgca

SEQ ID NO: 694744 - DNA, 12 bp, Homo sapiens
atccctaccact

SEQ ID NO: 694745 - DNA, 20 bp, Homo sapiens
atccctagtccccctgtttt

SEQ ID NO: 694746 - DNA, 14 bp, Homo sapiens
atccctcacctgta

SEQ ID NO: 694747 - DNA, 17 bp, Homo sapiens
atccctcacctgtagca

SEQ ID NO: 694748 - DNA, 20 bp, Homo sapiens
atccctcgatatttttaaag

SEQ ID NO: 694749 - DNA, 22 bp, Homo sapiens
atccctcggaagccgtctgact

SEQ ID NO: 694750 - DNA, 22 bp, Homo sapiens
atccctctacagagcttccctg

SEQ ID NO: 694751 - DNA, 23 bp, Homo sapiens
atccctctccactcttctctcct

SEQ ID NO: 694752 - DNA, 18 bp, Homo sapiens
atccctgaacccctggcc

SEQ ID NO: 694753 - DNA, 19 bp, Homo sapiens
atccctgaacccctggcca

SEQ ID NO: 694754 - DNA, 15 bp, Homo sapiens
atccctgaggactga

SEQ ID NO: 694755 - DNA, 15 bp, Homo sapiens
atccctgattctctc

SEQ ID NO: 694756 - DNA, 18 bp, Homo sapiens
atccctgccactgggctc

SEQ ID NO: 694757 - DNA, 22 bp, Homo sapiens
atccctgccactgggctctgga

SEQ ID NO: 694758 - DNA, 23 bp, Homo sapiens
atccctgccactgggctctggac

SEQ ID NO: 694759 - DNA, 17 bp, Homo sapiens
atccctgcccagcctgt

SEQ ID NO: 694760 - DNA, 18 bp, Homo sapiens
atccctgcccttctcaag

SEQ ID NO: 694761 - DNA, 17 bp, Homo sapiens
atccctgcttgcccgct

SEQ ID NO: 694762 - DNA, 14 bp, Homo sapiens
atccctggagcagg

SEQ ID NO: 694763 - DNA, 18 bp, Homo sapiens
atccctggagcaggagcc

SEQ ID NO: 694764 - DNA, 22 bp, Homo sapiens
atccctggagcaggagccccgc

SEQ ID NO: 694765 - DNA, 14 bp, Homo sapiens
atccctggccactg

SEQ ID NO: 694766 - DNA, 14 bp, Homo sapiens
atccctgggcaagt

SEQ ID NO: 694767 - DNA, 16 bp, Homo sapiens
atccctgggcattgct

SEQ ID NO: 694768 - DNA, 16 bp, Homo sapiens
atccctgttcattgta

SEQ ID NO: 694769 - DNA, 17 bp, Homo sapiens
atccctgtttaatattt

SEQ ID NO: 694770 - DNA, 18 bp, Homo sapiens
atccctgtttaatattta

SEQ ID NO: 694771 - DNA, 21 bp, Homo sapiens
atccctgtttaatatttaaac

SEQ ID NO: 694772 - DNA, 20 bp, Homo sapiens
atcccttaatatcctaaaca

SEQ ID NO: 694773 - DNA, 23 bp, Homo sapiens
atcccttcaagagtcctgaagat

SEQ ID NO: 694774 - DNA, 13 bp, Homo sapiens
atcccttcctgga

SEQ ID NO: 694775 - DNA, 19 bp, Homo sapiens
atcccttcctggaaacagc

SEQ ID NO: 694776 - DNA, 21 bp, Homo sapiens
atcccttggggaagggtgggg

SEQ ID NO: 694777 - DNA, 13 bp, Homo sapiens
atccctttattac

SEQ ID NO: 694778 - DNA, 16 bp, Homo sapiens
aattccaatatgatga

SEQ ID NO: 694779 - DNA, 20 bp, Homo sapiens
aattccacaccttttattga

SEQ ID NO: 694780 - DNA, 16 bp, Homo sapiens
aattccactgaaaatt

SEQ ID NO: 694781 - DNA, 17 bp, Homo sapiens
aattccactgaaaattt

SEQ ID NO: 694782 - DNA, 20 bp, Homo sapiens
aattccactgaaaatttaac

SEQ ID NO: 694783 - DNA, 13 bp, Homo sapiens
aattccactggac

SEQ ID NO: 694784 - DNA, 22 bp, Homo sapiens
aattccagaggactctgcttaa

SEQ ID NO: 694785 - DNA, 16 bp, Homo sapiens
aattccaggaaccaaa

SEQ ID NO: 694786 - DNA, 20 bp, Homo sapiens
aattccatacttctctcaga

SEQ ID NO: 694787 - DNA, 19 bp, Homo sapiens
aattcccaacatttcttaa

SEQ ID NO: 694788 - DNA, 19 bp, Homo sapiens
aattcccattttgcaaaat

SEQ ID NO: 694789 - DNA, 14 bp, Homo sapiens
aattccccaccctg

SEQ ID NO: 694790 - DNA, 14 bp, Homo sapiens
aattcccccttaaa

SEQ ID NO: 694791 - DNA, 22 bp, Homo sapiens
aattccctatcttttagtttta

SEQ ID NO: 694792 - DNA, 14 bp, Homo sapiens
aattccctggggaa

SEQ ID NO: 694793 - DNA, 14 bp, Homo sapiens
aattcccttcctgt

SEQ ID NO: 694794 - DNA, 14 bp, Homo sapiens
aattcccttctttt

SEQ ID NO: 694795 - DNA, 13 bp, Homo sapiens
aattccgtcacca

SEQ ID NO: 694796 - DNA, 14 bp, Homo sapiens
aattcctacaactt

SEQ ID NO: 694797 - DNA, 18 bp, Homo sapiens
aattcctacaacttaatg

SEQ ID NO: 694798 - DNA, 14 bp, Homo sapiens
aattcctacagcac

SEQ ID NO: 694799 - DNA, 14 bp, Homo sapiens
aattcctagaatta

SEQ ID NO: 694800 - DNA, 17 bp, Homo sapiens
aattcctagaattaaac

SEQ ID NO: 694801 - DNA, 15 bp, Homo sapiens
aattcctataaggaa

SEQ ID NO: 694802 - DNA, 12 bp, Homo sapiens
aattcctatgaa

SEQ ID NO: 694803 - DNA, 17 bp, Homo sapiens
aattcctcctctattta

SEQ ID NO: 694804 - DNA, 15 bp, Homo sapiens
aattcctccttcccc

SEQ ID NO: 694805 - DNA, 21 bp, Homo sapiens
aattcctctcactaaacttta

SEQ ID NO: 694806 - DNA, 14 bp, Homo sapiens
aattcctctgggaa

SEQ ID NO: 694807 - DNA, 16 bp, Homo sapiens
aattcctgaagccaga

SEQ ID NO: 694808 - DNA, 17 bp, Homo sapiens
aattcctgaagccagat

SEQ ID NO: 694809 - DNA, 22 bp, Homo sapiens
aattcctgctatgacagctggc

SEQ ID NO: 694810 - DNA, 16 bp, Homo sapiens
aattcctggcatgaca

SEQ ID NO: 694811 - DNA, 17 bp, Homo sapiens
aattcctgtagcatctt

SEQ ID NO: 694812 - DNA, 21 bp, Homo sapiens
aattcctgtagcatcttctgg

SEQ ID NO: 694813 - DNA, 17 bp, Homo sapiens
aattcctttacaactaa

SEQ ID NO: 694814 - DNA, 21 bp, Homo sapiens
aattcctttacaactaaataa

SEQ ID NO: 694815 - DNA, 19 bp, Homo sapiens
aattcgatgcgtattctgt

SEQ ID NO: 694816 - DNA, 19 bp, Homo sapiens
aattcgctttctaaagtta

SEQ ID NO: 694817 - DNA, 13 bp, Homo sapiens
aattcgtgtgttt

SEQ ID NO: 694818 - DNA, 22 bp, Homo sapiens
aattcgtgtgtttttttatgaa

SEQ ID NO: 694819 - DNA, 15 bp, Homo sapiens
aattcgtgttatgaa

SEQ ID NO: 694820 - DNA, 20 bp, Homo sapiens
aattctaaataaatttccca

SEQ ID NO: 694821 - DNA, 13 bp, Homo sapiens
aattctaaatgaa

SEQ ID NO: 694822 - DNA, 13 bp, Homo sapiens
aattctaaatgta

SEQ ID NO: 694823 - DNA, 21 bp, Homo sapiens
aattctaacccaagacatgac

SEQ ID NO: 694824 - DNA, 22 bp, Homo sapiens
aattctacacctcctttaagat

SEQ ID NO: 694825 - DNA, 15 bp, Homo sapiens
aattctacattgtca

SEQ ID NO: 694826 - DNA, 17 bp, Homo sapiens
aattctacctccttgtg

SEQ ID NO: 694827 - DNA, 20 bp, Homo sapiens
atcctgtattcttgtttgaa

SEQ ID NO: 694828 - DNA, 15 bp, Homo sapiens
atcctgtctttctga

SEQ ID NO: 694829 - DNA, 23 bp, Homo sapiens
atcctgtctttctgagcacactt

SEQ ID NO: 694830 - DNA, 12 bp, Homo sapiens
atcctgtgaagt

SEQ ID NO: 694831 - DNA, 18 bp, Homo sapiens
atcctgtgacatgtaaca

SEQ ID NO: 694832 - DNA, 23 bp, Homo sapiens
atcctgtgccagaggaaggaaaa

SEQ ID NO: 694833 - DNA, 23 bp, Homo sapiens
atcctgtgtaacacttggctctt

SEQ ID NO: 694834 - DNA, 14 bp, Homo sapiens
atcctgtttataat

SEQ ID NO: 694835 - DNA, 16 bp, Homo sapiens
atcctgttttctctgt

SEQ ID NO: 694836 - DNA, 13 bp, Homo sapiens
atccttacaagtt

SEQ ID NO: 694837 - DNA, 21 bp, Homo sapiens
atccttagaggtcctctggag

SEQ ID NO: 694838 - DNA, 21 bp, Homo sapiens
atccttaggaaaatgcttctg

SEQ ID NO: 694839 - DNA, 16 bp, Homo sapiens
atccttatcagagcta

SEQ ID NO: 694840 - DNA, 16 bp, Homo sapiens
atccttatcccaagct

SEQ ID NO: 694841 - DNA, 16 bp, Homo sapiens
atccttatgccacccc

SEQ ID NO: 694842 - DNA, 20 bp, Homo sapiens
atccttcaaaataaaaagta

SEQ ID NO: 694843 - DNA, 14 bp, Homo sapiens
atccttcagcacag

SEQ ID NO: 694844 - DNA, 14 bp, Homo sapiens
atccttccagtggc

SEQ ID NO: 694845 - DNA, 23 bp, Homo sapiens
atccttccatcttgtggggccag

SEQ ID NO: 694846 - DNA, 13 bp, Homo sapiens
atccttcctccca

SEQ ID NO: 694847 - DNA, 14 bp, Homo sapiens
atccttccttccca

SEQ ID NO: 694848 - DNA, 19 bp, Homo sapiens
atccttcgggtgctggaag

SEQ ID NO: 694849 - DNA, 17 bp, Homo sapiens
atccttctagtttccca

SEQ ID NO: 694850 - DNA, 21 bp, Homo sapiens
atccttctgagctccacctct

SEQ ID NO: 694851 - DNA, 17 bp, Homo sapiens
atccttgaatcctatgt

SEQ ID NO: 694852 - DNA, 16 bp, Homo sapiens
atccttgactggacct

SEQ ID NO: 694853 - DNA, 13 bp, Homo sapiens
atccttgcctgtc

SEQ ID NO: 694854 - DNA, 15 bp, Homo sapiens
atccttgcctgtcta

SEQ ID NO: 694855 - DNA, 20 bp, Homo sapiens
atccttgcctgtctaaagcc

SEQ ID NO: 694856 - DNA, 19 bp, Homo sapiens
atccttgctgcagcttcta

SEQ ID NO: 694857 - DNA, 15 bp, Homo sapiens
atccttggagagcag

SEQ ID NO: 694858 - DNA, 18 bp, Homo sapiens
atccttggagagcagctg

SEQ ID NO: 694859 - DNA, 19 bp, Homo sapiens
atccttggagagcagctgg

SEQ ID NO: 694860 - DNA, 24 bp, Homo sapiens
atccttggagagcagctggctctc

SEQ ID NO: 694861 - DNA, 21 bp, Homo sapiens
atccttggctgaattaaaatg

SEQ ID NO: 694862 - DNA, 21 bp, Homo sapiens
atccttggctttcagagccag

SEQ ID NO: 694863 - DNA, 22 bp, Homo sapiens
atccttgggccataattatgaa

SEQ ID NO: 694864 - DNA, 19 bp, Homo sapiens
atccttgtgttcagctctt

SEQ ID NO: 694865 - DNA, 20 bp, Homo sapiens
atcctttattttattgaaat

SEQ ID NO: 694866 - DNA, 24 bp, Homo sapiens
atcctttcattaggcaaagtacaa

SEQ ID NO: 694867 - DNA, 13 bp, Homo sapiens
atcctttccctct

SEQ ID NO: 694868 - DNA, 14 bp, Homo sapiens
atcctttccctctc

SEQ ID NO: 694869 - DNA, 20 bp, Homo sapiens
atcctttcctcattaaatta

SEQ ID NO: 694870 - DNA, 19 bp, Homo sapiens
atcctttcctctagctttt

SEQ ID NO: 694871 - DNA, 14 bp, Homo sapiens
atcctttctgcccc

SEQ ID NO: 694872 - DNA, 18 bp, Homo sapiens
atcctttgcctgcctggt

SEQ ID NO: 694873 - DNA, 20 bp, Homo sapiens
atcctttgtgagcctatgat

SEQ ID NO: 694874 - DNA, 17 bp, Homo sapiens
atcctttgttctgagca

SEQ ID NO: 694875 - DNA, 19 bp, Homo sapiens
atcctttgttctgagcatt

SEQ ID NO: 694876 - DNA, 21 bp, Homo sapiens
atcctttgttttctgactaat

SEQ ID NO: 694877 - DNA, 18 bp, Homo sapiens
atccttttgttttgaagc

SEQ ID NO: 694878 - DNA, 19 bp, Homo sapiens
atccttttgttttgaagct

SEQ ID NO: 694879 - DNA, 13 bp, Homo sapiens
atccttttttaaa

SEQ ID NO: 694880 - DNA, 22 bp, Homo sapiens
atccttttttaaaagtaaatgt

SEQ ID NO: 694881 - DNA, 15 bp, Homo sapiens
atccttttttctctt

SEQ ID NO: 694882 - DNA, 17 bp, Homo sapiens
atccttttttgtcattt

SEQ ID NO: 694883 - DNA, 18 bp, Homo sapiens
atccttttttgtcatttt

SEQ ID NO: 694884 - DNA, 13 bp, Homo sapiens
atcgaaaaaataa

SEQ ID NO: 694885 - DNA, 13 bp, Homo sapiens
atcgaaaagaagg

SEQ ID NO: 694886 - DNA, 18 bp, Homo sapiens
atcgaagggattgtgtat

SEQ ID NO: 694887 - DNA, 23 bp, Homo sapiens
atcgaagggtttttagagaatgt

SEQ ID NO: 694888 - DNA, 13 bp, Homo sapiens
atcgaagtgttta

SEQ ID NO: 694889 - DNA, 18 bp, Homo sapiens
atcgaagtgtttatgtaa

SEQ ID NO: 694890 - DNA, 14 bp, Homo sapiens
atcgactttttaaa

SEQ ID NO: 694891 - DNA, 16 bp, Homo sapiens
atcgagaccatcctgg

SEQ ID NO: 694892 - DNA, 17 bp, Homo sapiens
atcgagaccatcctggc

SEQ ID NO: 694893 - DNA, 20 bp, Homo sapiens
atcgagcatgttgttttttc

SEQ ID NO: 694894 - DNA, 15 bp, Homo sapiens
atcgaggaaccagag

SEQ ID NO: 694895 - DNA, 16 bp, Homo sapiens
atcgagtgtagctgtg

SEQ ID NO: 694896 - DNA, 18 bp, Homo sapiens
atcgatgagcgccacctc

SEQ ID NO: 694897 - DNA, 13 bp, Homo sapiens
atcgatggccttg

SEQ ID NO: 694898 - DNA, 15 bp, Homo sapiens
atcgatgtgctcagc

SEQ ID NO: 694899 - DNA, 20 bp, Homo sapiens
atcgcagaccttttttagga

SEQ ID NO: 694900 - DNA, 20 bp, Homo sapiens
atcgcagcttcctgtctgtt

SEQ ID NO: 694901 - DNA, 21 bp, Homo sapiens
atcgcaggagtctctgccacc

SEQ ID NO: 694902 - DNA, 19 bp, Homo sapiens
atcgccagaggtgcttcac

SEQ ID NO: 694903 - DNA, 11 bp, Homo sapiens
atcgccccacc

SEQ ID NO: 694904 - DNA, 21 bp, Homo sapiens
atcgccccaccgcagctactc

SEQ ID NO: 694905 - DNA, 23 bp, Homo sapiens
atcgcgccactacactccagcct

SEQ ID NO: 694906 - DNA, 20 bp, Homo sapiens
atcgcgccagcgacctctct

SEQ ID NO: 694907 - DNA, 22 bp, Homo sapiens
atcgcggcggagctggccccgc

SEQ ID NO: 694908 - DNA, 16 bp, Homo sapiens
atcgcttgaacctggg

SEQ ID NO: 694909 - DNA, 18 bp, Homo sapiens
atcgcttgaacctgggaa

SEQ ID NO: 694910 - DNA, 19 bp, Homo sapiens
atcgcttgaacctgggaag

SEQ ID NO: 694911 - DNA, 20 bp, Homo sapiens
aattgttttttaaagcaagt

SEQ ID NO: 694912 - DNA, 17 bp, Homo sapiens
aatttaaaaatatattt

SEQ ID NO: 694913 - DNA, 16 bp, Homo sapiens
aatttaaaattacgtt

SEQ ID NO: 694914 - DNA, 19 bp, Homo sapiens
aatttaaacacctcctcat

SEQ ID NO: 694915 - DNA, 11 bp, Homo sapiens
aatttaaacag

SEQ ID NO: 694916 - DNA, 18 bp, Homo sapiens
aatttaaacaggcccagc

SEQ ID NO: 694917 - DNA, 12 bp, Homo sapiens
aatttaaagcag

SEQ ID NO: 694918 - DNA, 20 bp, Homo sapiens
aatttaaagcaggttcttgt

SEQ ID NO: 694919 - DNA, 18 bp, Homo sapiens
aatttaaagggtgtactt

SEQ ID NO: 694920 - DNA, 14 bp, Homo sapiens
aatttaaataaagt

SEQ ID NO: 694921 - DNA, 14 bp, Homo sapiens
aatttaaatataat

SEQ ID NO: 694922 - DNA, 23 bp, Homo sapiens
aatttaaatataattctgtaaat

SEQ ID NO: 694923 - DNA, 17 bp, Homo sapiens
aatttaaatgatattta

SEQ ID NO: 694924 - DNA, 11 bp, Homo sapiens
aatttaagcaa

SEQ ID NO: 694925 - DNA, 14 bp, Homo sapiens
aatttaagtatctt

SEQ ID NO: 694926 - DNA, 19 bp, Homo sapiens
aatttaagtcattttcatg

SEQ ID NO: 694927 - DNA, 21 bp, Homo sapiens
aatttaagtcattttcatgtg

SEQ ID NO: 694928 - DNA, 17 bp, Homo sapiens
aatttaataaaaaggaa

SEQ ID NO: 694929 - DNA, 18 bp, Homo sapiens
aatttaatggactgtgaa

SEQ ID NO: 694930 - DNA, 21 bp, Homo sapiens
aatttaatggactgtgaattt

SEQ ID NO: 694931 - DNA, 14 bp, Homo sapiens
aatttaatggggtc

SEQ ID NO: 694932 - DNA, 21 bp, Homo sapiens
aatttacaaaaatataaaata

SEQ ID NO: 694933 - DNA, 15 bp, Homo sapiens
aatttacaaaattta

SEQ ID NO: 694934 - DNA, 14 bp, Homo sapiens
aatttacaaagtgt

SEQ ID NO: 694935 - DNA, 16 bp, Homo sapiens
aatttacaaagtgtgt

SEQ ID NO: 694936 - DNA, 18 bp, Homo sapiens
aatttacaaagtgtgtat

SEQ ID NO: 694937 - DNA, 21 bp, Homo sapiens
aatttacaaagtgtgtattaa

SEQ ID NO: 694938 - DNA, 20 bp, Homo sapiens
aatttacaagagctgttcat

SEQ ID NO: 694939 - DNA, 14 bp, Homo sapiens
aatttacctaagat

SEQ ID NO: 694940 - DNA, 21 bp, Homo sapiens
aatttacctaagattacaaat

SEQ ID NO: 694941 - DNA, 19 bp, Homo sapiens
aatttactggacaaagaat

SEQ ID NO: 694942 - DNA, 17 bp, Homo sapiens
aatttactttgtagact

SEQ ID NO: 694943 - DNA, 16 bp, Homo sapiens
aatttagaaaacttta

SEQ ID NO: 694944 - DNA, 18 bp, Homo sapiens
aatttagaaactaattga

SEQ ID NO: 694945 - DNA, 19 bp, Homo sapiens
aatttagaaactaattgac

SEQ ID NO: 694946 - DNA, 20 bp, Homo sapiens
aatttagaaactgatttctt

SEQ ID NO: 694947 - DNA, 13 bp, Homo sapiens
aatttagaaatat

SEQ ID NO: 694948 - DNA, 17 bp, Homo sapiens
atctaaagttatatttc

SEQ ID NO: 694949 - DNA, 13 bp, Homo sapiens
atctaaatctatt

SEQ ID NO: 694950 - DNA, 13 bp, Homo sapiens
atctaaatggaac

SEQ ID NO: 694951 - DNA, 17 bp, Homo sapiens
atctaaatggaaccact

SEQ ID NO: 694952 - DNA, 18 bp, Homo sapiens
atctaaatggaaccactc

SEQ ID NO: 694953 - DNA, 16 bp, Homo sapiens
atctaacattattact

SEQ ID NO: 694954 - DNA, 14 bp, Homo sapiens
atctaacctcatct

SEQ ID NO: 694955 - DNA, 15 bp, Homo sapiens
atctaacctcatctt

SEQ ID NO: 694956 - DNA, 20 bp, Homo sapiens
atctaactgatgagtaaact

SEQ ID NO: 694957 - DNA, 22 bp, Homo sapiens
atctaactgatgagtaaactga

SEQ ID NO: 694958 - DNA, 16 bp, Homo sapiens
atctaactttccttcc

SEQ ID NO: 694959 - DNA, 16 bp, Homo sapiens
atctaagaataataaa

SEQ ID NO: 694960 - DNA, 17 bp, Homo sapiens
atctaagaataataaaa

SEQ ID NO: 694961 - DNA, 18 bp, Homo sapiens
atctaagaataataaaat

SEQ ID NO: 694962 - DNA, 20 bp, Homo sapiens
atctaaggatgtcacagggc

SEQ ID NO: 694963 - DNA, 19 bp, Homo sapiens
atctaagggaagatcactg

SEQ ID NO: 694964 - DNA, 14 bp, Homo sapiens
atctaagtgatata

SEQ ID NO: 694965 - DNA, 21 bp, Homo sapiens
atctaagtgcctcacattttt

SEQ ID NO: 694966 - DNA, 18 bp, Homo sapiens
atctaagttaatttaaag

SEQ ID NO: 694967 - DNA, 21 bp, Homo sapiens
atctaatagcgggttactttc

SEQ ID NO: 694968 - DNA, 14 bp, Homo sapiens
atctaatatttcta

SEQ ID NO: 694969 - DNA, 17 bp, Homo sapiens
atctaatatttctagta

SEQ ID NO: 694970 - DNA, 15 bp, Homo sapiens
atctaatctcttatt

SEQ ID NO: 694971 - DNA, 18 bp, Homo sapiens
atctaatctcttattcta

SEQ ID NO: 694972 - DNA, 16 bp, Homo sapiens
atctaatctgaactga

SEQ ID NO: 694973 - DNA, 17 bp, Homo sapiens
atctaatgaaaaacaaa

SEQ ID NO: 694974 - DNA, 18 bp, Homo sapiens
atctaatgaaaaacaaaa

SEQ ID NO: 694975 - DNA, 23 bp, Homo sapiens
atctaatgcttgtttatgatatt

SEQ ID NO: 694976 - DNA, 16 bp, Homo sapiens
atctaattattttgca

SEQ ID NO: 694977 - DNA, 14 bp, Homo sapiens
atctaatttataaa

SEQ ID NO: 694978 - DNA, 19 bp, Homo sapiens
atctaatttataaaaaggt

SEQ ID NO: 694979 - DNA, 13 bp, Homo sapiens
atctacaagccaa

SEQ ID NO: 694980 - DNA, 14 bp, Homo sapiens
atctacagtaatga

SEQ ID NO: 694981 - DNA, 16 bp, Homo sapiens
atctacagtaatgaaa

SEQ ID NO: 694982 - DNA, 22 bp, Homo sapiens
atctaccccagggagaatctga

SEQ ID NO: 694983 - DNA, 15 bp, Homo sapiens
atctacctatactta

SEQ ID NO: 694984 - DNA, 15 bp, Homo sapiens
atctactcaaagcat

SEQ ID NO: 694985 - DNA, 16 bp, Homo sapiens
atctactcagaaattt

SEQ ID NO: 694986 - DNA, 18 bp, Homo sapiens
atctacttcatagctcct

SEQ ID NO: 694987 - DNA, 13 bp, Homo sapiens
atctacttgcctc

SEQ ID NO: 694988 - DNA, 17 bp, Homo sapiens
atctactttttgaactt

SEQ ID NO: 694989 - DNA, 21 bp, Homo sapiens
atctactttttgtatttagta

SEQ ID NO: 694990 - DNA, 17 bp, Homo sapiens
atctagaactatcattt

SEQ ID NO: 694991 - DNA, 12 bp, Homo sapiens
atctagaagact

SEQ ID NO: 694992 - DNA, 13 bp, Homo sapiens
atctagaagatgt

SEQ ID NO: 694993 - DNA, 17 bp, Homo sapiens
atctagacaatatacaa

SEQ ID NO: 694994 - DNA, 19 bp, Homo sapiens
atctagatactgtatcatg

SEQ ID NO: 694995 - DNA, 23 bp, Homo sapiens
atctagataggtaagtgggggcg

SEQ ID NO: 694996 - DNA, 15 bp, Homo sapiens
atctagcaatcacaa

SEQ ID NO: 694997 - DNA, 22 bp, Homo sapiens
atctagcaatcacaacactggc

SEQ ID NO: 694998 - DNA, 21 bp, Homo sapiens
atctagcactcctcaagactt

SEQ ID NO: 694999 - DNA, 11 bp, Homo sapiens
atctagcagct

SEQ ID NO: 695000 - DNA, 17 bp, Homo sapiens
atctagcagctggccta

SEQ ID NO: 695001 - DNA, 16 bp, Homo sapiens
atctagcatttatttc

SEQ ID NO: 695002 - DNA, 12 bp, Homo sapiens
atctagccagcc

SEQ ID NO: 695003 - DNA, 17 bp, Homo sapiens
atctaggatgtgatgat

SEQ ID NO: 695004 - DNA, 22 bp, Homo sapiens
atctaggcatttcattatgctt

SEQ ID NO: 695005 - DNA, 19 bp, Homo sapiens
atctaggtgtggctgtgaa

SEQ ID NO: 695006 - DNA, 21 bp, Homo sapiens
atctaggtgtggctgtgaagg

SEQ ID NO: 695007 - DNA, 21 bp, Homo sapiens
atctagtagttgttctgaaat

SEQ ID NO: 695008 - DNA, 18 bp, Homo sapiens
atctagtgacacctcagt

SEQ ID NO: 695009 - DNA, 20 bp, Homo sapiens
atctagtgacacctcagtca

SEQ ID NO: 695010 - DNA, 15 bp, Homo sapiens
atctagtgcagctga

SEQ ID NO: 695011 - DNA, 19 bp, Homo sapiens
atctagtgcagctgatttt

SEQ ID NO: 695012 - DNA, 22 bp, Homo sapiens
atctagtgcagctgattttaac

SEQ ID NO: 695013 - DNA, 19 bp, Homo sapiens
atctagtgggttgaccttt

SEQ ID NO: 695014 - DNA, 17 bp, Homo sapiens
atctagttttttttgta

SEQ ID NO: 695015 - DNA, 16 bp, Homo sapiens
atctataatttaccta

SEQ ID NO: 695016 - DNA, 14 bp, Homo sapiens
atctatacctgcct

SEQ ID NO: 695017 - DNA, 22 bp, Homo sapiens
atctatacctgccttttaagtt

SEQ ID NO: 695018 - DNA, 15 bp, Homo sapiens
atctatacgtaattt

SEQ ID NO: 695019 - DNA, 16 bp, Homo sapiens
atctatagaaagctat

SEQ ID NO: 695020 - DNA, 11 bp, Homo sapiens
atctatataaa

SEQ ID NO: 695021 - DNA, 12 bp, Homo sapiens
atctatataaaa

SEQ ID NO: 695022 - DNA, 15 bp, Homo sapiens
atctatatatgtgta

SEQ ID NO: 695023 - DNA, 17 bp, Homo sapiens
atctatatatgtgtatg

SEQ ID NO: 695024 - DNA, 19 bp, Homo sapiens
atctatatatgtgtatgta

SEQ ID NO: 695025 - DNA, 16 bp, Homo sapiens
atctatatgtacttgt

SEQ ID NO: 695026 - DNA, 21 bp, Homo sapiens
atctatatgtacttgtcaaag

SEQ ID NO: 695027 - DNA, 16 bp, Homo sapiens
atctatattaaatgag

SEQ ID NO: 695028 - DNA, 13 bp, Homo sapiens
atctatccctgcg

SEQ ID NO: 695029 - DNA, 21 bp, Homo sapiens
atctatgaacaacagtagttt

SEQ ID NO: 695030 - DNA, 14 bp, Homo sapiens
atctatgcaaagca

SEQ ID NO: 695031 - DNA, 23 bp, Homo sapiens
atctatgcaaagcactctctgca

SEQ ID NO: 695032 - DNA, 21 bp, Homo sapiens
atctatggaaatgtgagaaat

SEQ ID NO: 695033 - DNA, 22 bp, Homo sapiens
atctatggccctgcaaaaatat

SEQ ID NO: 695034 - DNA, 23 bp, Homo sapiens
atctatggccctgcaaaaatata

SEQ ID NO: 695035 - DNA, 13 bp, Homo sapiens
atctatggcttat

SEQ ID NO: 695036 - DNA, 20 bp, Homo sapiens
atctatggctttaaataaat

SEQ ID NO: 695037 - DNA, 22 bp, Homo sapiens
atctatggctttaaataaatta

SEQ ID NO: 695038 - DNA, 22 bp, Homo sapiens
atctatgtcatattttgccact

SEQ ID NO: 695039 - DNA, 14 bp, Homo sapiens
aatttcttatgtga

SEQ ID NO: 695040 - DNA, 14 bp, Homo sapiens
aatttcttccttcc

SEQ ID NO: 695041 - DNA, 19 bp, Homo sapiens
aatttctttgtcattcaag

SEQ ID NO: 695042 - DNA, 20 bp, Homo sapiens
aatttctttgtttaacaaaa

SEQ ID NO: 695043 - DNA, 23 bp, Homo sapiens
aatttcttttccttcattcatag

SEQ ID NO: 695044 - DNA, 22 bp, Homo sapiens
aatttctttttttcctttttaa

SEQ ID NO: 695045 - DNA, 15 bp, Homo sapiens
aatttgaaaatgtcc

SEQ ID NO: 695046 - DNA, 17 bp, Homo sapiens
aatttgaagacttcaaa

SEQ ID NO: 695047 - DNA, 18 bp, Homo sapiens
aatttgaagacttcaaaa

SEQ ID NO: 695048 - DNA, 13 bp, Homo sapiens
aatttgaatgaaa

SEQ ID NO: 695049 - DNA, 14 bp, Homo sapiens
aatttgaatgaaaa

SEQ ID NO: 695050 - DNA, 16 bp, Homo sapiens
aatttgaatgtatttg

SEQ ID NO: 695051 - DNA, 22 bp, Homo sapiens
aatttgaattatcagcaaagaa

SEQ ID NO: 695052 - DNA, 17 bp, Homo sapiens
aatttgacttttctgta

SEQ ID NO: 695053 - DNA, 14 bp, Homo sapiens
aatttgacttttgt

SEQ ID NO: 695054 - DNA, 17 bp, Homo sapiens
aatttgagaattattcc

SEQ ID NO: 695055 - DNA, 14 bp, Homo sapiens
aatttgaggacaac

SEQ ID NO: 695056 - DNA, 22 bp, Homo sapiens
aatttgaggtctacattcttgg

SEQ ID NO: 695057 - DNA, 18 bp, Homo sapiens
aatttgatggtatttctt

SEQ ID NO: 695058 - DNA, 16 bp, Homo sapiens
aatttgattgatttga

SEQ ID NO: 695059 - DNA, 17 bp, Homo sapiens
aatttgattgatttgaa

SEQ ID NO: 695060 - DNA, 14 bp, Homo sapiens
aatttgattgcttt

SEQ ID NO: 695061 - DNA, 15 bp, Homo sapiens
aatttgattgctttg

SEQ ID NO: 695062 - DNA, 18 bp, Homo sapiens
aatttgattgctttgctg

SEQ ID NO: 695063 - DNA, 13 bp, Homo sapiens
aatttgatttcca

SEQ ID NO: 695064 - DNA, 17 bp, Homo sapiens
aatttgcacagtgatat

SEQ ID NO: 695065 - DNA, 16 bp, Homo sapiens
aatttgcatattctat

SEQ ID NO: 695066 - DNA, 17 bp, Homo sapiens
aatttgcattaaattca

SEQ ID NO: 695067 - DNA, 18 bp, Homo sapiens
aatttgcattactctggt

SEQ ID NO: 695068 - DNA, 22 bp, Homo sapiens
aatttgccatttttattagaaa

SEQ ID NO: 695069 - DNA, 16 bp, Homo sapiens
aatttgcctgtaacaa

SEQ ID NO: 695070 - DNA, 18 bp, Homo sapiens
acaaacaaacaatgcata

SEQ ID NO: 695071 - DNA, 22 bp, Homo sapiens
acaaacactgcagtttcctgga

SEQ ID NO: 695072 - DNA, 22 bp, Homo sapiens
acaaacatggatacttcctggg

SEQ ID NO: 695073 - DNA, 15 bp, Homo sapiens
acaaacattgctgcc

SEQ ID NO: 695074 - DNA, 17 bp, Homo sapiens
acaaaccaacatctttg

SEQ ID NO: 695075 - DNA, 23 bp, Homo sapiens
acaaaccaagagcttttacagat

SEQ ID NO: 695076 - DNA, 22 bp, Homo sapiens
acaaaccaggtcaccatcctca

SEQ ID NO: 695077 - DNA, 16 bp, Homo sapiens
acaaaccatttccaac

SEQ ID NO: 695078 - DNA, 20 bp, Homo sapiens
acaaaccattttattttttg

SEQ ID NO: 695079 - DNA, 23 bp, Homo sapiens
acaaaccattttattttttgggc

SEQ ID NO: 695080 - DNA, 20 bp, Homo sapiens
acaaaccgaaaatggacatt

SEQ ID NO: 695081 - DNA, 21 bp, Homo sapiens
acaaaccgagtgcaatgaatg

SEQ ID NO: 695082 - DNA, 21 bp, Homo sapiens
acaaacctaccaaaatggaat

SEQ ID NO: 695083 - DNA, 23 bp, Homo sapiens
acaaacctactgcccacatttgg

SEQ ID NO: 695084 - DNA, 16 bp, Homo sapiens
acaaacctcactgaga

SEQ ID NO: 695085 - DNA, 17 bp, Homo sapiens
acaaacgcattaagagg

SEQ ID NO: 695086 - DNA, 14 bp, Homo sapiens
acaaacggagcccc

SEQ ID NO: 695087 - DNA, 21 bp, Homo sapiens
acaaacggagcccctgaaagc

SEQ ID NO: 695088 - DNA, 16 bp, Homo sapiens
acaaactacatgtaat

SEQ ID NO: 695089 - DNA, 17 bp, Homo sapiens
acaaactacctctggac

SEQ ID NO: 695090 - DNA, 13 bp, Homo sapiens
acaaactcttgaa

SEQ ID NO: 695091 - DNA, 11 bp, Homo sapiens
acaaactgcaa

SEQ ID NO: 695092 - DNA, 14 bp, Homo sapiens
acaaactgcaatag

SEQ ID NO: 695093 - DNA, 19 bp, Homo sapiens
acaaactgcaatagagact

SEQ ID NO: 695094 - DNA, 20 bp, Homo sapiens
acaaactgcaatagagactg

SEQ ID NO: 695095 - DNA, 18 bp, Homo sapiens
acaaactgcagctgtgag

SEQ ID NO: 695096 - DNA, 13 bp, Homo sapiens
acaaactgtaaat

SEQ ID NO: 695097 - DNA, 16 bp, Homo sapiens
acaaactgtgaaaata

SEQ ID NO: 695098 - DNA, 20 bp, Homo sapiens
acaaactgtgaaaatagtgt

SEQ ID NO: 695099 - DNA, 21 bp, Homo sapiens
acaaactgtgaaaatagtgta

SEQ ID NO: 695100 - DNA, 10 bp, Homo sapiens
acaaacttcc

SEQ ID NO: 695101 - DNA, 22 bp, Homo sapiens
acaaagaaatccccccttcaga

SEQ ID NO: 695102 - DNA, 14 bp, Homo sapiens
acaaagacaggcaa

SEQ ID NO: 695103 - DNA, 15 bp, Homo sapiens
acaaagacattgatt

SEQ ID NO: 695104 - DNA, 13 bp, Homo sapiens
acaaagactcctc

SEQ ID NO: 695105 - DNA, 20 bp, Homo sapiens
acaaagactcctctgggcct

SEQ ID NO: 695106 - DNA, 20 bp, Homo sapiens
acaaagactccttgtggact

SEQ ID NO: 695107 - DNA, 21 bp, Homo sapiens
acaaagagaaaaagaaatgca

SEQ ID NO: 695108 - DNA, 16 bp, Homo sapiens
acaaagagttcaagaa

SEQ ID NO: 695109 - DNA, 21 bp, Homo sapiens
acaaagagttcaagaaataag

SEQ ID NO: 695110 - DNA, 22 bp, Homo sapiens
acaaagagttcaagaaataagt

SEQ ID NO: 695111 - DNA, 20 bp, Homo sapiens
acaaagatggctcagagggg

SEQ ID NO: 695112 - DNA, 21 bp, Homo sapiens
acaaagatgtttgtcagatat

SEQ ID NO: 695113 - DNA, 22 bp, Homo sapiens
acaaagatgtttgtcagatatg

SEQ ID NO: 695114 - DNA, 23 bp, Homo sapiens
acaaagatgtttgtcagatatga

SEQ ID NO: 695115 - DNA, 24 bp, Homo sapiens
acaaagatgtttgtcagatatgat

SEQ ID NO: 695116 - DNA, 21 bp, Homo sapiens
acaaagattctccacttggcc

SEQ ID NO: 695117 - DNA, 14 bp, Homo sapiens
acaaagcacagtgt

SEQ ID NO: 695118 - DNA, 17 bp, Homo sapiens
acaaagcacagtttgaa

SEQ ID NO: 695119 - DNA, 14 bp, Homo sapiens
acaaagcagccacg

SEQ ID NO: 695120 - DNA, 19 bp, Homo sapiens
acaaagccaaactctgcca

SEQ ID NO: 695121 - DNA, 16 bp, Homo sapiens
acaaagccagaggaga

SEQ ID NO: 695122 - DNA, 20 bp, Homo sapiens
acaaagccattcttttaaat

SEQ ID NO: 695123 - DNA, 17 bp, Homo sapiens
acaaagccttaagcaaa

SEQ ID NO: 695124 - DNA, 19 bp, Homo sapiens
acaaagccttaagcaaatt

SEQ ID NO: 695125 - DNA, 18 bp, Homo sapiens
acaaagccttatcaagtg

SEQ ID NO: 695126 - DNA, 23 bp, Homo sapiens
acaaagccttatcaagtgtcttc

SEQ ID NO: 695127 - DNA, 22 bp, Homo sapiens
acaaagcggctttctaatagag

SEQ ID NO: 695128 - DNA, 17 bp, Homo sapiens
acaaagctgttaaactg

SEQ ID NO: 695129 - DNA, 18 bp, Homo sapiens
acaaagctgttaaactgt

SEQ ID NO: 695130 - DNA, 17 bp, Homo sapiens
acaaagcttctaaagca

SEQ ID NO: 695131 - DNA, 20 bp, Homo sapiens
acaaagcttctatcccagga

SEQ ID NO: 695132 - DNA, 14 bp, Homo sapiens
acaaaggagccttg

SEQ ID NO: 695133 - DNA, 16 bp, Homo sapiens
acaaaggatgaagaac

SEQ ID NO: 695134 - DNA, 14 bp, Homo sapiens
acaaaggccacagg

SEQ ID NO: 695135 - DNA, 19 bp, Homo sapiens
acaaaggtggaataaacat

SEQ ID NO: 695136 - DNA, 22 bp, Homo sapiens
acaaaggtggaataaacattaa

SEQ ID NO: 695137 - DNA, 21 bp, Homo sapiens
acaaaggttttcctcttctat

SEQ ID NO: 695138 - DNA, 15 bp, Homo sapiens
acaaagtaaaatgaa

SEQ ID NO: 695139 - DNA, 21 bp, Homo sapiens
acaaagtactcctcacttttc

SEQ ID NO: 695140 - DNA, 23 bp, Homo sapiens
acaaagtactcctcacttttcaa

SEQ ID NO: 695141 - DNA, 22 bp, Homo sapiens
acaaagtactgtcctcaaataa

SEQ ID NO: 695142 - DNA, 22 bp, Homo sapiens
acaaagtcaataaaagagctgt

SEQ ID NO: 695143 - DNA, 14 bp, Homo sapiens
acaaagtgggtgtg

SEQ ID NO: 695144 - DNA, 13 bp, Homo sapiens
acaaagtgtgtat

SEQ ID NO: 695145 - DNA, 17 bp, Homo sapiens
acaaagtgtgtattaaa

SEQ ID NO: 695146 - DNA, 19 bp, Homo sapiens
acaaagtgtgtattaaaaa

SEQ ID NO: 695147 - DNA, 14 bp, Homo sapiens
acaaagttcagtgt

SEQ ID NO: 695148 - DNA, 17 bp, Homo sapiens
acaaagttctcagagct

SEQ ID NO: 695149 - DNA, 16 bp, Homo sapiens
acaaagtttacattgt

SEQ ID NO: 695150 - DNA, 19 bp, Homo sapiens
acaaagtttcagagtatat

SEQ ID NO: 695151 - DNA, 19 bp, Homo sapiens
acaaagttttaaacgaaat

SEQ ID NO: 695152 - DNA, 18 bp, Homo sapiens
acaaataaaatacttttt

SEQ ID NO: 695153 - DNA, 17 bp, Homo sapiens
acaaataaacagttgtt

SEQ ID NO: 695154 - DNA, 16 bp, Homo sapiens
acaaataataagcaaa

SEQ ID NO: 695155 - DNA, 20 bp, Homo sapiens
acaaatacaaagtggaaact

SEQ ID NO: 695156 - DNA, 17 bp, Homo sapiens
acaaatactcttaggaa

SEQ ID NO: 695157 - DNA, 23 bp, Homo sapiens
acaaatactcttaggaagagaaa

SEQ ID NO: 695158 - DNA, 13 bp, Homo sapiens
acaaatagaaaat

SEQ ID NO: 695159 - DNA, 13 bp, Homo sapiens
acaaatagatgat

SEQ ID NO: 695160 - DNA, 15 bp, Homo sapiens
acaaatatgctttgg

SEQ ID NO: 695161 - DNA, 14 bp, Homo sapiens
acaaatattgtcat

SEQ ID NO: 695162 - DNA, 22 bp, Homo sapiens
acaaatattgtcatctttttct

SEQ ID NO: 695163 - DNA, 22 bp, Homo sapiens
acaaatatttattttctttctg

SEQ ID NO: 695164 - DNA, 17 bp, Homo sapiens
acaaatcaacagaagca

SEQ ID NO: 695165 - DNA, 19 bp, Homo sapiens
acaaatcaacagaagcatt

SEQ ID NO: 695166 - DNA, 21 bp, Homo sapiens
acaaatcaacagaagcatttg

SEQ ID NO: 695167 - DNA, 15 bp, Homo sapiens
acaaatcagaagtca

SEQ ID NO: 695168 - DNA, 13 bp, Homo sapiens
acaaatcagtaat

SEQ ID NO: 695169 - DNA, 16 bp, Homo sapiens
acaaatcagtaatttt

SEQ ID NO: 695170 - DNA, 17 bp, Homo sapiens
acaaatctaatctctta

SEQ ID NO: 695171 - DNA, 16 bp, Homo sapiens
acaaatctcagaacct

SEQ ID NO: 695172 - DNA, 13 bp, Homo sapiens
acaaatgaaaatg

SEQ ID NO: 695173 - DNA, 15 bp, Homo sapiens
acaaatgaaaatgaa

SEQ ID NO: 695174 - DNA, 18 bp, Homo sapiens
acaaatgaaaatgaatag

SEQ ID NO: 695175 - DNA, 23 bp, Homo sapiens
atctgcgtgacaataaaacatta

SEQ ID NO: 695176 - DNA, 14 bp, Homo sapiens
atctgctaataaaa

SEQ ID NO: 695177 - DNA, 18 bp, Homo sapiens
atctgctaccaaaacagt

SEQ ID NO: 695178 - DNA, 16 bp, Homo sapiens
atctgctagtgctgta

SEQ ID NO: 695179 - DNA, 20 bp, Homo sapiens
atctgctctgttttatacta

SEQ ID NO: 695180 - DNA, 18 bp, Homo sapiens
atctgctggagtttcatg

SEQ ID NO: 695181 - DNA, 19 bp, Homo sapiens
atctgctgttgccatagcc

SEQ ID NO: 695182 - DNA, 20 bp, Homo sapiens
atctgctgttgccatagccc

SEQ ID NO: 695183 - DNA, 22 bp, Homo sapiens
atctgctgttgccatagcccca

SEQ ID NO: 695184 - DNA, 21 bp, Homo sapiens
atctgcttaggagtttaggga

SEQ ID NO: 695185 - DNA, 12 bp, Homo sapiens
atctgcttcagt

SEQ ID NO: 695186 - DNA, 17 bp, Homo sapiens
atctgcttggttggctg

SEQ ID NO: 695187 - DNA, 21 bp, Homo sapiens
atctgcttggttggctggcag

SEQ ID NO: 695188 - DNA, 14 bp, Homo sapiens
atctgcttttatta

SEQ ID NO: 695189 - DNA, 16 bp, Homo sapiens
atctgcttttattaaa

SEQ ID NO: 695190 - DNA, 14 bp, Homo sapiens
atctggaagaaaaa

SEQ ID NO: 695191 - DNA, 17 bp, Homo sapiens
atctgtttacctggcag

SEQ ID NO: 695192 - DNA, 13 bp, Homo sapiens
atctgtttcaaca

SEQ ID NO: 695193 - DNA, 12 bp, Homo sapiens
atctgtttctct

SEQ ID NO: 695194 - DNA, 17 bp, Homo sapiens
atctgtttctctgctgt

SEQ ID NO: 695195 - DNA, 15 bp, Homo sapiens
atctgtttgaggaga

SEQ ID NO: 695196 - DNA, 16 bp, Homo sapiens
atctgtttgaggagag

SEQ ID NO: 695197 - DNA, 21 bp, Homo sapiens
atctgtttgtatatttgcaaa

SEQ ID NO: 695198 - DNA, 13 bp, Homo sapiens
atctgtttgttga

SEQ ID NO: 695199 - DNA, 14 bp, Homo sapiens
atctgttttaaatt

SEQ ID NO: 695200 - DNA, 22 bp, Homo sapiens
atctgttttaaatttatttcaa

SEQ ID NO: 695201 - DNA, 15 bp, Homo sapiens
atctgttttgtatat

SEQ ID NO: 695202 - DNA, 18 bp, Homo sapiens
atctgtttttacgtatgt

SEQ ID NO: 695203 - DNA, 14 bp, Homo sapiens
atctgtttttctca

SEQ ID NO: 695204 - DNA, 13 bp, Homo sapiens
atcttaaaaacaa

SEQ ID NO: 695205 - DNA, 14 bp, Homo sapiens
atcttaaaaacaac

SEQ ID NO: 695206 - DNA, 21 bp, Homo sapiens
atcttaaaaacaacgaaagaa

SEQ ID NO: 695207 - DNA, 14 bp, Homo sapiens
atcttaaacaatgt

SEQ ID NO: 695208 - DNA, 18 bp, Homo sapiens
atcttaaacaatgtataa

SEQ ID NO: 695209 - DNA, 23 bp, Homo sapiens
atcttaaacaatgtataaagatt

SEQ ID NO: 695210 - DNA, 17 bp, Homo sapiens
atcttaaactaatacgt

SEQ ID NO: 695211 - DNA, 18 bp, Homo sapiens
atcttaaagaaacagctt

SEQ ID NO: 695212 - DNA, 23 bp, Homo sapiens
atcttaaagaaacagctttcaag

SEQ ID NO: 695213 - DNA, 12 bp, Homo sapiens
atcttaagcagg

SEQ ID NO: 695214 - DNA, 18 bp, Homo sapiens
atcttaaggtctaactgt

SEQ ID NO: 695215 - DNA, 12 bp, Homo sapiens
atcttaatataa

SEQ ID NO: 695216 - DNA, 18 bp, Homo sapiens
atcttaatatatacattt

SEQ ID NO: 695217 - DNA, 20 bp, Homo sapiens
atcttaatatatacattttt

SEQ ID NO: 695218 - DNA, 14 bp, Homo sapiens
atcttaatgtatat

SEQ ID NO: 695219 - DNA, 12 bp, Homo sapiens
atcttaatgttc

SEQ ID NO: 695220 - DNA, 14 bp, Homo sapiens
atcttaatgttcct

SEQ ID NO: 695221 - DNA, 19 bp, Homo sapiens
atcttaattctttgttctg

SEQ ID NO: 695222 - DNA, 13 bp, Homo sapiens
atcttacaaaatc

SEQ ID NO: 695223 - DNA, 21 bp, Homo sapiens
atcttacaaaatcctggaaga

SEQ ID NO: 695224 - DNA, 22 bp, Homo sapiens
atcttacaacaggcttatgaat

SEQ ID NO: 695225 - DNA, 16 bp, Homo sapiens
atcttacctctcatgc

SEQ ID NO: 695226 - DNA, 14 bp, Homo sapiens
atcttactgaaggt

SEQ ID NO: 695227 - DNA, 15 bp, Homo sapiens
atcttactgaaggta

SEQ ID NO: 695228 - DNA, 15 bp, Homo sapiens
atcttagagtttaca

SEQ ID NO: 695229 - DNA, 16 bp, Homo sapiens
atcttagagtttacag

SEQ ID NO: 695230 - DNA, 21 bp, Homo sapiens
atcttagagtttacagtttgt

SEQ ID NO: 695231 - DNA, 22 bp, Homo sapiens
atcttagctggatataatgtat

SEQ ID NO: 695232 - DNA, 15 bp, Homo sapiens
atcttagtgtatgat

SEQ ID NO: 695233 - DNA, 15 bp, Homo sapiens
atcttataactgttt

SEQ ID NO: 695234 - DNA, 14 bp, Homo sapiens
atcttattataaaa

SEQ ID NO: 695235 - DNA, 23 bp, Homo sapiens
atcttattccgagcattccagta

SEQ ID NO: 695236 - DNA, 23 bp, Homo sapiens
atcttattttcatgtatatgtgt

SEQ ID NO: 695237 - DNA, 17 bp, Homo sapiens
atcttattttgtgaact

SEQ ID NO: 695238 - DNA, 13 bp, Homo sapiens
atcttcacctcag

SEQ ID NO: 695239 - DNA, 14 bp, Homo sapiens
atcttcacctcaga

SEQ ID NO: 695240 - DNA, 23 bp, Homo sapiens
atcttcagatttaagttaaataa

SEQ ID NO: 695241 - DNA, 23 bp, Homo sapiens
atcttcagcccaggcttttgcta

SEQ ID NO: 695242 - DNA, 14 bp, Homo sapiens
atcttcagttttat

SEQ ID NO: 695243 - DNA, 22 bp, Homo sapiens
atcttcagttttatctttaatc

SEQ ID NO: 695244 - DNA, 20 bp, Homo sapiens
atcttccacctgtgccctca

SEQ ID NO: 695245 - DNA, 11 bp, Homo sapiens
atcttcccagc

SEQ ID NO: 695246 - DNA, 12 bp, Homo sapiens
atcttcctctgc

SEQ ID NO: 695247 - DNA, 13 bp, Homo sapiens
atcttcctgtgtc

SEQ ID NO: 695248 - DNA, 14 bp, Homo sapiens
atcttcctgtgtcc

SEQ ID NO: 695249 - DNA, 15 bp, Homo sapiens
atcttcctgtgtcct

SEQ ID NO: 695250 - DNA, 11 bp, Homo sapiens
atcttccttcc

SEQ ID NO: 695251 - DNA, 21 bp, Homo sapiens
atcttcctttggggaagttta

SEQ ID NO: 695252 - DNA, 22 bp, Homo sapiens
atcttcctttggggaagtttat

SEQ ID NO: 695253 - DNA, 19 bp, Homo sapiens
atcttcgttagtaatctgt

SEQ ID NO: 695254 - DNA, 15 bp, Homo sapiens
atcttctatttttat

SEQ ID NO: 695255 - DNA, 20 bp, Homo sapiens
atcttctcatcttttatcta

SEQ ID NO: 695256 - DNA, 23 bp, Homo sapiens
atcttctcccccacggtatccta

SEQ ID NO: 695257 - DNA, 19 bp, Homo sapiens
atcttctccccgaggctgc

SEQ ID NO: 695258 - DNA, 15 bp, Homo sapiens
atcttctctcatctg

SEQ ID NO: 695259 - DNA, 19 bp, Homo sapiens
atcttctgaaatgaaacaa

SEQ ID NO: 695260 - DNA, 17 bp, Homo sapiens
atcttctgcaattgctt

SEQ ID NO: 695261 - DNA, 18 bp, Homo sapiens
atcttctgccttctcatg

SEQ ID NO: 695262 - DNA, 14 bp, Homo sapiens
atcttctggcttga

SEQ ID NO: 695263 - DNA, 16 bp, Homo sapiens
atcttctgtgaaatat

SEQ ID NO: 695264 - DNA, 20 bp, Homo sapiens
atcttcttaaaccaggaaaa

SEQ ID NO: 695265 - DNA, 23 bp, Homo sapiens
atcttcttcccttaactccaaga

SEQ ID NO: 695266 - DNA, 14 bp, Homo sapiens
atcttcttgcatct

SEQ ID NO: 695267 - DNA, 14 bp, Homo sapiens
atcttctttataat

SEQ ID NO: 695268 - DNA, 14 bp, Homo sapiens
atcttctttcctca

SEQ ID NO: 695269 - DNA, 23 bp, Homo sapiens
atcttgaaattaagaaggcaaaa

SEQ ID NO: 695270 - DNA, 18 bp, Homo sapiens
atcttgaatactctgccc

SEQ ID NO: 695271 - DNA, 19 bp, Homo sapiens
atcttgaatactctgccct

SEQ ID NO: 695272 - DNA, 13 bp, Homo sapiens
atcttgaatgtgg

SEQ ID NO: 695273 - DNA, 19 bp, Homo sapiens
atcttgaatgtggtctcag

SEQ ID NO: 695274 - DNA, 17 bp, Homo sapiens
atcttgacattcaaggc

SEQ ID NO: 695275 - DNA, 16 bp, Homo sapiens
atcttgactttctgat

SEQ ID NO: 695276 - DNA, 22 bp, Homo sapiens
atcttgagcaagttccttctgg

SEQ ID NO: 695277 - DNA, 13 bp, Homo sapiens
atcttgatgttta

SEQ ID NO: 695278 - DNA, 24 bp, Homo sapiens
atcttgcaccccaaagctttcctg

SEQ ID NO: 695279 - DNA, 17 bp, Homo sapiens
atcttgcagttttgtaa

SEQ ID NO: 695280 - DNA, 17 bp, Homo sapiens
atcttgccggtcatttt

SEQ ID NO: 695281 - DNA, 22 bp, Homo sapiens
atcttgcctaaatcccaagaaa

SEQ ID NO: 695282 - DNA, 16 bp, Homo sapiens
atcttgcctgtctggc

SEQ ID NO: 695283 - DNA, 20 bp, Homo sapiens
atcttgcctgtctggctcag

SEQ ID NO: 695284 - DNA, 15 bp, Homo sapiens
atcttgccttctggt

SEQ ID NO: 695285 - DNA, 16 bp, Homo sapiens
atcttgcgaatccaag

SEQ ID NO: 695286 - DNA, 21 bp, Homo sapiens
atcttgcgaatccaagctccc

SEQ ID NO: 695287 - DNA, 22 bp, Homo sapiens
atcttgcgaatccaagctccct

SEQ ID NO: 695288 - DNA, 23 bp, Homo sapiens
atcttgctaccagtatttagaag

SEQ ID NO: 695289 - DNA, 19 bp, Homo sapiens
atcttgctgcaggccctcc

SEQ ID NO: 695290 - DNA, 22 bp, Homo sapiens
atcttgctgcaggccctccctc

SEQ ID NO: 695291 - DNA, 21 bp, Homo sapiens
atcttgctggattaatgtttt

SEQ ID NO: 695292 - DNA, 14 bp, Homo sapiens
atcttgcttcagac

SEQ ID NO: 695293 - DNA, 14 bp, Homo sapiens
atcttgcttcccta

SEQ ID NO: 695294 - DNA, 16 bp, Homo sapiens
atcttggacaaatcac

SEQ ID NO: 695295 - DNA, 14 bp, Homo sapiens
atcttggactgaca

SEQ ID NO: 695296 - DNA, 16 bp, Homo sapiens
atcttggactgacatt

SEQ ID NO: 695297 - DNA, 19 bp, Homo sapiens
atcttggatggtgacattg

SEQ ID NO: 695298 - DNA, 16 bp, Homo sapiens
atcttggcctcccaga

SEQ ID NO: 695299 - DNA, 22 bp, Homo sapiens
atcttggctatgtaattcttgt

SEQ ID NO: 695300 - DNA, 16 bp, Homo sapiens
atcttggctcactgca

SEQ ID NO: 695301 - DNA, 21 bp, Homo sapiens
atcttggcttaatttaatgta

SEQ ID NO: 695302 - DNA, 16 bp, Homo sapiens
atcttggcttcttaaa

SEQ ID NO: 695303 - DNA, 18 bp, Homo sapiens
atcttggcttcttaaaaa

SEQ ID NO: 695304 - DNA, 18 bp, Homo sapiens
atcttgggactgggtttg

SEQ ID NO: 695305 - DNA, 18 bp, Homo sapiens
atcttggggcaagactgc

SEQ ID NO: 695306 - DNA, 18 bp, Homo sapiens
acaagatagagagctatt

SEQ ID NO: 695307 - DNA, 16 bp, Homo sapiens
acaagatattgtacat

SEQ ID NO: 695308 - DNA, 17 bp, Homo sapiens
acaagatattgtacata

SEQ ID NO: 695309 - DNA, 18 bp, Homo sapiens
acaagatattgtacataa

SEQ ID NO: 695310 - DNA, 20 bp, Homo sapiens
acaagatggcgaccaccaaa

SEQ ID NO: 695311 - DNA, 23 bp, Homo sapiens
acaagatggcgaccaccaaagtc

SEQ ID NO: 695312 - DNA, 24 bp, Homo sapiens
acaagatggcgaccaccaaagtca

SEQ ID NO: 695313 - DNA, 20 bp, Homo sapiens
acacaggacccccttcccct

SEQ ID NO: 695314 - DNA, 19 bp, Homo sapiens
acacaggcaactgaggcag

SEQ ID NO: 695315 - DNA, 20 bp, Homo sapiens
acacaggcaactgaggcaga

SEQ ID NO: 695316 - DNA, 10 bp, Homo sapiens
acacaggcct

SEQ ID NO: 695317 - DNA, 14 bp, Homo sapiens
acacaggccttctg

SEQ ID NO: 695318 - DNA, 14 bp, Homo sapiens
acacagggacttga

SEQ ID NO: 695319 - DNA, 12 bp, Homo sapiens
acacagggctca

SEQ ID NO: 695320 - DNA, 21 bp, Homo sapiens
atgaatatctattaatatatg

SEQ ID NO: 695321 - DNA, 21 bp, Homo sapiens
atgaatattgatgttaacaag

SEQ ID NO: 695322 - DNA, 12 bp, Homo sapiens
atgaatcaatgg

SEQ ID NO: 695323 - DNA, 14 bp, Homo sapiens
atgaatcagaacag

SEQ ID NO: 695324 - DNA, 20 bp, Homo sapiens
atgaatccattggagaagcg

SEQ ID NO: 695325 - DNA, 11 bp, Homo sapiens
atgaatctatg

SEQ ID NO: 695326 - DNA, 21 bp, Homo sapiens
atgaatctatgccaaagatca

SEQ ID NO: 695327 - DNA, 20 bp, Homo sapiens
atgaatctcccactccagcg

SEQ ID NO: 695328 - DNA, 16 bp, Homo sapiens
atgaatctctgcctct

SEQ ID NO: 695329 - DNA, 18 bp, Homo sapiens
atgaatctgtgctggcca

SEQ ID NO: 695330 - DNA, 17 bp, Homo sapiens
atgaatctttcatacat

SEQ ID NO: 695331 - DNA, 12 bp, Homo sapiens
atgaatgaaaat

SEQ ID NO: 695332 - DNA, 17 bp, Homo sapiens
atgaatgaaacattttg

SEQ ID NO: 695333 - DNA, 18 bp, Homo sapiens
atgaatgagccaaaatga

SEQ ID NO: 695334 - DNA, 12 bp, Homo sapiens
atgaatgcagat

SEQ ID NO: 695335 - DNA, 16 bp, Homo sapiens
atgaatgcttttagtg

SEQ ID NO: 695336 - DNA, 21 bp, Homo sapiens
atgaatgggctgagctgcctg

SEQ ID NO: 695337 - DNA, 22 bp, Homo sapiens
atgaatgtaaggatgagggaag

SEQ ID NO: 695338 - DNA, 16 bp, Homo sapiens
atgaatgtaatctaat

SEQ ID NO: 695339 - DNA, 15 bp, Homo sapiens
atgaatgtactatgt

SEQ ID NO: 695340 - DNA, 18 bp, Homo sapiens
atgaatgtcacatttgaa

SEQ ID NO: 695341 - DNA, 21 bp, Homo sapiens
atgaatgtcacttctggatat

SEQ ID NO: 695342 - DNA, 21 bp, Homo sapiens
atgaatgtgctggtgaacact

SEQ ID NO: 695343 - DNA, 14 bp, Homo sapiens
atgaattaaataaa

SEQ ID NO: 695344 - DNA, 15 bp, Homo sapiens
atgaattattacagt

SEQ ID NO: 695345 - DNA, 17 bp, Homo sapiens
atgaattattacagtgt

SEQ ID NO: 695346 - DNA, 15 bp, Homo sapiens
atgaattatttttga

SEQ ID NO: 695347 - DNA, 20 bp, Homo sapiens
atgaattcaagaaaggaaat

SEQ ID NO: 695348 - DNA, 14 bp, Homo sapiens
atgaatttaaatat

SEQ ID NO: 695349 - DNA, 17 bp, Homo sapiens
atgaatttaaggcaaaa

SEQ ID NO: 695350 - DNA, 16 bp, Homo sapiens
atgaatttatctttac

SEQ ID NO: 695351 - DNA, 18 bp, Homo sapiens
atgaatttgggatactaa

SEQ ID NO: 695352 - DNA, 21 bp, Homo sapiens
atgaattttatcagccatgtt

SEQ ID NO: 695353 - DNA, 23 bp, Homo sapiens
atgaattttgtttggacttcttt

SEQ ID NO: 695354 - DNA, 13 bp, Homo sapiens
atgacaaaaataa

SEQ ID NO: 695355 - DNA, 15 bp, Homo sapiens
atgacaaaaataaca

SEQ ID NO: 695356 - DNA, 19 bp, Homo sapiens
atgacaaaaataacactgt

SEQ ID NO: 695357 - DNA, 16 bp, Homo sapiens
atgacaaacctagctt

SEQ ID NO: 695358 - DNA, 17 bp, Homo sapiens
atgacaaataagtggaa

SEQ ID NO: 695359 - DNA, 14 bp, Homo sapiens
atgacaaattatat

SEQ ID NO: 695360 - DNA, 13 bp, Homo sapiens
atgacaacactta

SEQ ID NO: 695361 - DNA, 14 bp, Homo sapiens
atgacaacagaaaa

SEQ ID NO: 695362 - DNA, 16 bp, Homo sapiens
atgacaacagaaaaac

SEQ ID NO: 695363 - DNA, 17 bp, Homo sapiens
atgacaacagaaaaaca

SEQ ID NO: 695364 - DNA, 21 bp, Homo sapiens
atgacaacagaaaaacaatct

SEQ ID NO: 695365 - DNA, 23 bp, Homo sapiens
atgacaacctgtgtgagagaatt

SEQ ID NO: 695366 - DNA, 16 bp, Homo sapiens
atgacaagccccaggc

SEQ ID NO: 695367 - DNA, 19 bp, Homo sapiens
atgacaagtgagacaaaaa

SEQ ID NO: 695368 - DNA, 19 bp, Homo sapiens
atgacaataactaaagcta

SEQ ID NO: 695369 - DNA, 14 bp, Homo sapiens
atgacaatgatgat

SEQ ID NO: 695370 - DNA, 14 bp, Homo sapiens
atgacaatgcaatg

SEQ ID NO: 695371 - DNA, 23 bp, Homo sapiens
atgacaccatcttttattctttt

SEQ ID NO: 695372 - DNA, 17 bp, Homo sapiens
atgacaccctggcctga

SEQ ID NO: 695373 - DNA, 17 bp, Homo sapiens
atgacacgcgctctcca

SEQ ID NO: 695374 - DNA, 16 bp, Homo sapiens
atgacactagaaaact

SEQ ID NO: 695375 - DNA, 12 bp, Homo sapiens
atgacagagcga

SEQ ID NO: 695376 - DNA, 21 bp, Homo sapiens
atgacagaggctgcacccctg

SEQ ID NO: 695377 - DNA, 19 bp, Homo sapiens
atgacagatggtgaagtaa

SEQ ID NO: 695378 - DNA, 17 bp, Homo sapiens
atgacagattctgacat

SEQ ID NO: 695379 - DNA, 17 bp, Homo sapiens
atgacagctgtccctgt

SEQ ID NO: 695380 - DNA, 17 bp, Homo sapiens
atgacaggctgttcagc

SEQ ID NO: 695381 - DNA, 16 bp, Homo sapiens
atgacaggtaaattaa

SEQ ID NO: 695382 - DNA, 17 bp, Homo sapiens
atgacagtgcttgcatc

SEQ ID NO: 695383 - DNA, 17 bp, Homo sapiens
atgacagtgttccccga

SEQ ID NO: 695384 - DNA, 22 bp, Homo sapiens
atgacagttatactgtcggttt

SEQ ID NO: 695385 - DNA, 16 bp, Homo sapiens
atgacataggccaagg

SEQ ID NO: 695386 - DNA, 18 bp, Homo sapiens
atgacatctcaggggcca

SEQ ID NO: 695387 - DNA, 22 bp, Homo sapiens
atgacatgaggaaaataatgta

SEQ ID NO: 695388 - DNA, 23 bp, Homo sapiens
atgacattaaatgcaataatttt

SEQ ID NO: 695389 - DNA, 18 bp, Homo sapiens
atgacatttatttttcat

SEQ ID NO: 695390 - DNA, 14 bp, Homo sapiens
atgacatttcatct

SEQ ID NO: 695391 - DNA, 16 bp, Homo sapiens
atgaccacgcacctcc

SEQ ID NO: 695392 - DNA, 16 bp, Homo sapiens
atgaccactgggcctg

SEQ ID NO: 695393 - DNA, 17 bp, Homo sapiens
atgaccactgggcctgc

SEQ ID NO: 695394 - DNA, 19 bp, Homo sapiens
atgaccagggatgctgggc

SEQ ID NO: 695395 - DNA, 20 bp, Homo sapiens
atgaccagggatgctgggct

SEQ ID NO: 695396 - DNA, 13 bp, Homo sapiens
atgaccagtaaag

SEQ ID NO: 695397 - DNA, 14 bp, Homo sapiens
atgacccacactgc

SEQ ID NO: 695398 - DNA, 21 bp, Homo sapiens
atgacccacactgccagaaga

SEQ ID NO: 695399 - DNA, 14 bp, Homo sapiens
atgacccacccctg

SEQ ID NO: 695400 - DNA, 16 bp, Homo sapiens
atgacccacccctgtg

SEQ ID NO: 695401 - DNA, 14 bp, Homo sapiens
atgacccagaccca

SEQ ID NO: 695402 - DNA, 19 bp, Homo sapiens
atgacccctaccccctcat

SEQ ID NO: 695403 - DNA, 22 bp, Homo sapiens
atgaccccttctctctccagaa

SEQ ID NO: 695404 - DNA, 16 bp, Homo sapiens
atgaccctctgtcccc

SEQ ID NO: 695405 - DNA, 18 bp, Homo sapiens
atgaccctctgtccccag

SEQ ID NO: 695406 - DNA, 22 bp, Homo sapiens
atgaccctctgtccccaggcct

SEQ ID NO: 695407 - DNA, 16 bp, Homo sapiens
atgaccgctctccctt

SEQ ID NO: 695408 - DNA, 17 bp, Homo sapiens
atgaccggtttggagta

SEQ ID NO: 695409 - DNA, 22 bp, Homo sapiens
atgacctaagtcaggtaatata

SEQ ID NO: 695410 - DNA, 18 bp, Homo sapiens
atgacctacagtgctgtg

SEQ ID NO: 695411 - DNA, 19 bp, Homo sapiens
atgacctaccaggacagaa

SEQ ID NO: 695412 - DNA, 15 bp, Homo sapiens
atgacctatcaaaaa

SEQ ID NO: 695413 - DNA, 13 bp, Homo sapiens
atgacctcccctc

SEQ ID NO: 695414 - DNA, 18 bp, Homo sapiens
atgacctcccctccccag

SEQ ID NO: 695415 - DNA, 23 bp, Homo sapiens
atgacctctctacttccccttct

SEQ ID NO: 695416 - DNA, 11 bp, Homo sapiens
atgactaaaga

SEQ ID NO: 695417 - DNA, 12 bp, Homo sapiens
atgactaaagag

SEQ ID NO: 695418 - DNA, 15 bp, Homo sapiens
atgactaaagagaga

SEQ ID NO: 695419 - DNA, 21 bp, Homo sapiens
atgactaaagagagaatgtag

SEQ ID NO: 695420 - DNA, 14 bp, Homo sapiens
atgactaatgcttt

SEQ ID NO: 695421 - DNA, 15 bp, Homo sapiens
atgactaatgctttt

SEQ ID NO: 695422 - DNA, 23 bp, Homo sapiens
atgactagaagtatgtaagaaat

SEQ ID NO: 695423 - DNA, 22 bp, Homo sapiens
atgactagaggcagggagggga

SEQ ID NO: 695424 - DNA, 14 bp, Homo sapiens
atgactcaaagtct

SEQ ID NO: 695425 - DNA, 16 bp, Homo sapiens
atgactcgaaactgac

SEQ ID NO: 695426 - DNA, 16 bp, Homo sapiens
atgactcgggggtggg

SEQ ID NO: 695427 - DNA, 20 bp, Homo sapiens
atgactcttggagcctcttt

SEQ ID NO: 695428 - DNA, 15 bp, Homo sapiens
atgactctttattgt

SEQ ID NO: 695429 - DNA, 16 bp, Homo sapiens
atgactctttctgaag

SEQ ID NO: 695430 - DNA, 18 bp, Homo sapiens
atgactgcacccagctcc

SEQ ID NO: 695431 - DNA, 13 bp, Homo sapiens
atgactgcatttt

SEQ ID NO: 695432 - DNA, 21 bp, Homo sapiens
atgactgctccccagccctgg

SEQ ID NO: 695433 - DNA, 22 bp, Homo sapiens
atgactgctccccagccctggc

SEQ ID NO: 695434 - DNA, 16 bp, Homo sapiens
atgactgctgtgaaat

SEQ ID NO: 695435 - DNA, 17 bp, Homo sapiens
acactaatatatggacc

SEQ ID NO: 695436 - DNA, 23 bp, Homo sapiens
acactaatatatggacctagctt

SEQ ID NO: 695437 - DNA, 14 bp, Homo sapiens
acactaatatattt

SEQ ID NO: 695438 - DNA, 20 bp, Homo sapiens
acactaatatatttaaaaat

SEQ ID NO: 695439 - DNA, 12 bp, Homo sapiens
acactaattcat

SEQ ID NO: 695440 - DNA, 12 bp, Homo sapiens
acactaattcct

SEQ ID NO: 695441 - DNA, 17 bp, Homo sapiens
acactaattcctttcta

SEQ ID NO: 695442 - DNA, 13 bp, Homo sapiens
acactacacccag

SEQ ID NO: 695443 - DNA, 18 bp, Homo sapiens
acactaccgaatgtgtct

SEQ ID NO: 695444 - DNA, 21 bp, Homo sapiens
acactaccgaatgtgtcttta

SEQ ID NO: 695445 - DNA, 15 bp, Homo sapiens
acactacctcttttg

SEQ ID NO: 695446 - DNA, 17 bp, Homo sapiens
acactactgctaaatcc

SEQ ID NO: 695447 - DNA, 18 bp, Homo sapiens
acactactgctaaatcct

SEQ ID NO: 695448 - DNA, 19 bp, Homo sapiens
acactagccagacactctg

SEQ ID NO: 695449 - DNA, 17 bp, Homo sapiens
acactagcccaatgaaa

SEQ ID NO: 695450 - DNA, 13 bp, Homo sapiens
acactagcctctc

SEQ ID NO: 695451 - DNA, 15 bp, Homo sapiens
acactagcctctcca

SEQ ID NO: 695452 - DNA, 18 bp, Homo sapiens
acactagtctgtgtaact

SEQ ID NO: 695453 - DNA, 19 bp, Homo sapiens
acactagttttgtgccagc

SEQ ID NO: 695454 - DNA, 20 bp, Homo sapiens
atgagtggccagcgccaggg

SEQ ID NO: 695455 - DNA, 16 bp, Homo sapiens
atgagtgggaatccgg

SEQ ID NO: 695456 - DNA, 18 bp, Homo sapiens
atgagtgtattttttaaa

SEQ ID NO: 695457 - DNA, 12 bp, Homo sapiens
atgagtgtgtgt

SEQ ID NO: 695458 - DNA, 14 bp, Homo sapiens
atgagttattatct

SEQ ID NO: 695459 - DNA, 20 bp, Homo sapiens
atgagttattatctatggaa

SEQ ID NO: 695460 - DNA, 12 bp, Homo sapiens
atgagttgcagt

SEQ ID NO: 695461 - DNA, 16 bp, Homo sapiens
atgagttgcatttgta

SEQ ID NO: 695462 - DNA, 19 bp, Homo sapiens
atgagttgttttcagactc

SEQ ID NO: 695463 - DNA, 20 bp, Homo sapiens
atgagttgttttcagactca

SEQ ID NO: 695464 - DNA, 23 bp, Homo sapiens
atgagttgttttcagactcagac

SEQ ID NO: 695465 - DNA, 16 bp, Homo sapiens
atgagtttcactgtac

SEQ ID NO: 695466 - DNA, 18 bp, Homo sapiens
atgagtttcactgtactg

SEQ ID NO: 695467 - DNA, 21 bp, Homo sapiens
atgagtttttgatagctttat

SEQ ID NO: 695468 - DNA, 15 bp, Homo sapiens
atgataaaacacaaa

SEQ ID NO: 695469 - DNA, 12 bp, Homo sapiens
atgataaaagga

SEQ ID NO: 695470 - DNA, 13 bp, Homo sapiens
atgataaaaggaa

SEQ ID NO: 695471 - DNA, 12 bp, Homo sapiens
atgataaaataa

SEQ ID NO: 695472 - DNA, 19 bp, Homo sapiens
atgataaaataaataattt

SEQ ID NO: 695473 - DNA, 18 bp, Homo sapiens
atgataaactcagatctg

SEQ ID NO: 695474 - DNA, 21 bp, Homo sapiens
atgataaactcagatctgatc

SEQ ID NO: 695475 - DNA, 14 bp, Homo sapiens
atgataaagacttt

SEQ ID NO: 695476 - DNA, 14 bp, Homo sapiens
atgataaagagaca

SEQ ID NO: 695477 - DNA, 17 bp, Homo sapiens
atgataaagagacagtg

SEQ ID NO: 695478 - DNA, 18 bp, Homo sapiens
atgataaatatttatgct

SEQ ID NO: 695479 - DNA, 18 bp, Homo sapiens
atgataagaacagagtgc

SEQ ID NO: 695480 - DNA, 22 bp, Homo sapiens
atgataccctgaatttggcctg

SEQ ID NO: 695481 - DNA, 20 bp, Homo sapiens
atgatactctcagattttaa

SEQ ID NO: 695482 - DNA, 13 bp, Homo sapiens
atgatactgatgc

SEQ ID NO: 695483 - DNA, 19 bp, Homo sapiens
atgatactgtagaacctgt

SEQ ID NO: 695484 - DNA, 14 bp, Homo sapiens
atgatactgtttct

SEQ ID NO: 695485 - DNA, 22 bp, Homo sapiens
atgatagcccagaacaaaaaga

SEQ ID NO: 695486 - DNA, 17 bp, Homo sapiens
atgatagtaagaaaagt

SEQ ID NO: 695487 - DNA, 15 bp, Homo sapiens
atgatagtccaattt

SEQ ID NO: 695488 - DNA, 22 bp, Homo sapiens
atgatatgtaaacataattctt

SEQ ID NO: 695489 - DNA, 19 bp, Homo sapiens
atgatattccccatttcct

SEQ ID NO: 695490 - DNA, 22 bp, Homo sapiens
atgatattccccatttcctgta

SEQ ID NO: 695491 - DNA, 17 bp, Homo sapiens
atgatattgctgaagaa

SEQ ID NO: 695492 - DNA, 14 bp, Homo sapiens
atgatattgtttaa

SEQ ID NO: 695493 - DNA, 20 bp, Homo sapiens
atgatattgtttaaaattca

SEQ ID NO: 695494 - DNA, 12 bp, Homo sapiens
atgatatttctt

SEQ ID NO: 695495 - DNA, 15 bp, Homo sapiens
atgatatttcttgct

SEQ ID NO: 695496 - DNA, 18 bp, Homo sapiens
atgatatttcttgctttc

SEQ ID NO: 695497 - DNA, 17 bp, Homo sapiens
atgatattttaaaatct

SEQ ID NO: 695498 - DNA, 18 bp, Homo sapiens
atgatcacagtgacttta

SEQ ID NO: 695499 - DNA, 18 bp, Homo sapiens
atgatcacatctaaagct

SEQ ID NO: 695500 - DNA, 19 bp, Homo sapiens
atgatcaccatgttagcct

SEQ ID NO: 695501 - DNA, 22 bp, Homo sapiens
atgatcaccatgttagccttag

SEQ ID NO: 695502 - DNA, 18 bp, Homo sapiens
atgatcaccgactgaaaa

SEQ ID NO: 695503 - DNA, 19 bp, Homo sapiens
atgatcagctgtttgtcat

SEQ ID NO: 695504 - DNA, 13 bp, Homo sapiens
atgatcagggatc

SEQ ID NO: 695505 - DNA, 21 bp, Homo sapiens
atgatcattgaaatacttttt

SEQ ID NO: 695506 - DNA, 16 bp, Homo sapiens
atgatccagaacagtg

SEQ ID NO: 695507 - DNA, 14 bp, Homo sapiens
atgatccagagcag

SEQ ID NO: 695508 - DNA, 18 bp, Homo sapiens
atgatccctgtgttgtct

SEQ ID NO: 695509 - DNA, 16 bp, Homo sapiens
atgatcctagtaattg

SEQ ID NO: 695510 - DNA, 15 bp, Homo sapiens
atgatccttttttgt

SEQ ID NO: 695511 - DNA, 22 bp, Homo sapiens
atgatccttttttgtcatttta

SEQ ID NO: 695512 - DNA, 19 bp, Homo sapiens
atgatctaagaagctacag

SEQ ID NO: 695513 - DNA, 18 bp, Homo sapiens
atgatctaatacaaagat

SEQ ID NO: 695514 - DNA, 14 bp, Homo sapiens
atgatctactcaga

SEQ ID NO: 695515 - DNA, 15 bp, Homo sapiens
atgatctccctgccg

SEQ ID NO: 695516 - DNA, 18 bp, Homo sapiens
atgatctcggatgaccaa

SEQ ID NO: 695517 - DNA, 20 bp, Homo sapiens
atgatctcggatgaccaaac

SEQ ID NO: 695518 - DNA, 22 bp, Homo sapiens
atgatctcggatgaccaaacca

SEQ ID NO: 695519 - DNA, 22 bp, Homo sapiens
atgatctcttcttttggcttcc

SEQ ID NO: 695520 - DNA, 14 bp, Homo sapiens
atgatctgaaaaat

SEQ ID NO: 695521 - DNA, 21 bp, Homo sapiens
atgatctgagtcccaggagct

SEQ ID NO: 695522 - DNA, 19 bp, Homo sapiens
atgatctgcctctaaaagc

SEQ ID NO: 695523 - DNA, 18 bp, Homo sapiens
atgatcttctttataatt

SEQ ID NO: 695524 - DNA, 18 bp, Homo sapiens
atgatgaaaaggttgcct

SEQ ID NO: 695525 - DNA, 16 bp, Homo sapiens
atgatgaaacattcat

SEQ ID NO: 695526 - DNA, 14 bp, Homo sapiens
atgatgaagaaatg

SEQ ID NO: 695527 - DNA, 15 bp, Homo sapiens
atgatgaatgagaat

SEQ ID NO: 695528 - DNA, 22 bp, Homo sapiens
atgatgacgacgacaacgatga

SEQ ID NO: 695529 - DNA, 20 bp, Homo sapiens
atgatgatgtggaagaactt

SEQ ID NO: 695530 - DNA, 15 bp, Homo sapiens
atgatgcatacagtt

SEQ ID NO: 695531 - DNA, 17 bp, Homo sapiens
atgatgcatgatgccct

SEQ ID NO: 695532 - DNA, 10 bp, Homo sapiens
atgatgccac

SEQ ID NO: 695533 - DNA, 22 bp, Homo sapiens
atgatgccgaacattaggaatt

SEQ ID NO: 695534 - DNA, 22 bp, Homo sapiens
atgatgctcaaaatctttccaa

SEQ ID NO: 695535 - DNA, 20 bp, Homo sapiens
atgatggacaaaggcctggc

SEQ ID NO: 695536 - DNA, 22 bp, Homo sapiens
atgatggacaaaggcctggcgt

SEQ ID NO: 695537 - DNA, 17 bp, Homo sapiens
atgatggagcgcacctg

SEQ ID NO: 695538 - DNA, 15 bp, Homo sapiens
atgatggagtcaggt

SEQ ID NO: 695539 - DNA, 15 bp, Homo sapiens
atgatggatgccaat

SEQ ID NO: 695540 - DNA, 19 bp, Homo sapiens
atgatggatgccaatatta

SEQ ID NO: 695541 - DNA, 16 bp, Homo sapiens
atgatgggaaaatatt

SEQ ID NO: 695542 - DNA, 21 bp, Homo sapiens
atgatgggaaaatatttcctg

SEQ ID NO: 695543 - DNA, 23 bp, Homo sapiens
atgatgggcttctgttctctgct

SEQ ID NO: 695544 - DNA, 16 bp, Homo sapiens
atgatggggaaggagt

SEQ ID NO: 695545 - DNA, 14 bp, Homo sapiens
atgatgggggaaaa

SEQ ID NO: 695546 - DNA, 21 bp, Homo sapiens
atgatggggtgggagactttc

SEQ ID NO: 695547 - DNA, 20 bp, Homo sapiens
atgatgtaagtttacctatg

SEQ ID NO: 695548 - DNA, 21 bp, Homo sapiens
atgatgtaatctctctgcagc

SEQ ID NO: 695549 - DNA, 21 bp, Homo sapiens
atgatgtagtgcctctttcat

SEQ ID NO: 695550 - DNA, 16 bp, Homo sapiens
atgatgtatatccata

SEQ ID NO: 695551 - DNA, 14 bp, Homo sapiens
atgatgtccagaag

SEQ ID NO: 695552 - DNA, 23 bp, Homo sapiens
atgatgtccagaagaatattcag

SEQ ID NO: 695553 - DNA, 14 bp, Homo sapiens
atgatgtccttgga

SEQ ID NO: 695554 - DNA, 18 bp, Homo sapiens
atgatgtcggtcttgcaa

SEQ ID NO: 695555 - DNA, 17 bp, Homo sapiens
atgatgtctacagaaaa

SEQ ID NO: 695556 - DNA, 19 bp, Homo sapiens
atgatgtctacagaaaatg

SEQ ID NO: 695557 - DNA, 17 bp, Homo sapiens
acagaatgtatctgtga

SEQ ID NO: 695558 - DNA, 18 bp, Homo sapiens
acagaatgtatctgtgaa

SEQ ID NO: 695559 - DNA, 21 bp, Homo sapiens
acagaatgttttactgtgaaa

SEQ ID NO: 695560 - DNA, 23 bp, Homo sapiens
acagaattagaaaagttaacatt

SEQ ID NO: 695561 - DNA, 15 bp, Homo sapiens
acagaattctgctac

SEQ ID NO: 695562 - DNA, 19 bp, Homo sapiens
acagaattgactgcagttg

SEQ ID NO: 695563 - DNA, 21 bp, Homo sapiens
acagaattgactgcagttgaa

SEQ ID NO: 695564 - DNA, 17 bp, Homo sapiens
acagacacaatatgtat

SEQ ID NO: 695565 - DNA, 15 bp, Homo sapiens
acagacacacacacg

SEQ ID NO: 695566 - DNA, 17 bp, Homo sapiens
acagacacacacacgca

SEQ ID NO: 695567 - DNA, 23 bp, Homo sapiens
acagacacacacacgcacgcaca

SEQ ID NO: 695568 - DNA, 17 bp, Homo sapiens
acagacacacagcctca

SEQ ID NO: 695569 - DNA, 20 bp, Homo sapiens
acagacacctccccctaccc

SEQ ID NO: 695570 - DNA, 20 bp, Homo sapiens
acagacacgagccacctcac

SEQ ID NO: 695571 - DNA, 15 bp, Homo sapiens
acagacactacatat

SEQ ID NO: 695572 - DNA, 17 bp, Homo sapiens
acagacactgttgcaaa

SEQ ID NO: 695573 - DNA, 21 bp, Homo sapiens
acagacacttggttagtggct

SEQ ID NO: 695574 - DNA, 16 bp, Homo sapiens
acagacagacacacac

SEQ ID NO: 695575 - DNA, 15 bp, Homo sapiens
acagacatacataga

SEQ ID NO: 695576 - DNA, 19 bp, Homo sapiens
acagacatactaaccagca

SEQ ID NO: 695577 - DNA, 16 bp, Homo sapiens
acagacatgagccact

SEQ ID NO: 695578 - DNA, 16 bp, Homo sapiens
acagaccaatagacat

SEQ ID NO: 695579 - DNA, 18 bp, Homo sapiens
acagaccgagaggccagt

SEQ ID NO: 695580 - DNA, 21 bp, Homo sapiens
acagacctcaagggacaggga

SEQ ID NO: 695581 - DNA, 15 bp, Homo sapiens
acagacctgcagtga

SEQ ID NO: 695582 - DNA, 17 bp, Homo sapiens
acagacctggagcccct

SEQ ID NO: 695583 - DNA, 21 bp, Homo sapiens
acagacctggagcccctgggt

SEQ ID NO: 695584 - DNA, 22 bp, Homo sapiens
acagacctggagcccctgggtg

SEQ ID NO: 695585 - DNA, 14 bp, Homo sapiens
atgcactgtaaata

SEQ ID NO: 695586 - DNA, 14 bp, Homo sapiens
atgcactgtggttt

SEQ ID NO: 695587 - DNA, 20 bp, Homo sapiens
atgcacttcaaataattaaa

SEQ ID NO: 695588 - DNA, 22 bp, Homo sapiens
atgcactttaattgaagaactg

SEQ ID NO: 695589 - DNA, 16 bp, Homo sapiens
atgcacttttagaaat

SEQ ID NO: 695590 - DNA, 22 bp, Homo sapiens
atgcacttttagaaatgcatat

SEQ ID NO: 695591 - DNA, 11 bp, Homo sapiens
atgcagaaata

SEQ ID NO: 695592 - DNA, 21 bp, Homo sapiens
atgcagaaatagacaaaaagt

SEQ ID NO: 695593 - DNA, 15 bp, Homo sapiens
atgcagaacgtattt

SEQ ID NO: 695594 - DNA, 19 bp, Homo sapiens
atgcagaacgtatttagcc

SEQ ID NO: 695595 - DNA, 22 bp, Homo sapiens
atgcagaatacttgactcattt

SEQ ID NO: 695596 - DNA, 23 bp, Homo sapiens
atgcagacaacaccttcctcctg

SEQ ID NO: 695597 - DNA, 21 bp, Homo sapiens
atgcagactcctcagatctga

SEQ ID NO: 695598 - DNA, 23 bp, Homo sapiens
atgcagaggtctccaaactgatt

SEQ ID NO: 695599 - DNA, 17 bp, Homo sapiens
atgcagattcctgggcc

SEQ ID NO: 695600 - DNA, 23 bp, Homo sapiens
atgcagcaggaaggaacaaagac

SEQ ID NO: 695601 - DNA, 19 bp, Homo sapiens
atgcagcagggatgccctg

SEQ ID NO: 695602 - DNA, 20 bp, Homo sapiens
atgcagcagggatgccctgg

SEQ ID NO: 695603 - DNA, 19 bp, Homo sapiens
atgcagcccaccaggagca

SEQ ID NO: 695604 - DNA, 15 bp, Homo sapiens
atgcagcccatgccc

SEQ ID NO: 695605 - DNA, 14 bp, Homo sapiens
atgcagcccctggg

SEQ ID NO: 695606 - DNA, 17 bp, Homo sapiens
atgcagcccctgggccc

SEQ ID NO: 695607 - DNA, 20 bp, Homo sapiens
atgcagcccctgggcccttg

SEQ ID NO: 695608 - DNA, 21 bp, Homo sapiens
atgcagcccctgggcccttgt

SEQ ID NO: 695609 - DNA, 16 bp, Homo sapiens
atgcagccttggggca

SEQ ID NO: 695610 - DNA, 15 bp, Homo sapiens
atgcagctactggaa

SEQ ID NO: 695611 - DNA, 14 bp, Homo sapiens
atgcagctgcctgg

SEQ ID NO: 695612 - DNA, 20 bp, Homo sapiens
atgcagctgcctggggccca

SEQ ID NO: 695613 - DNA, 19 bp, Homo sapiens
atgcagctgttgagaaaac

SEQ ID NO: 695614 - DNA, 19 bp, Homo sapiens
atgcaggaagaggcccact

SEQ ID NO: 695615 - DNA, 21 bp, Homo sapiens
atgcaggaagaggcccactag

SEQ ID NO: 695616 - DNA, 14 bp, Homo sapiens
atgcaggaggtgga

SEQ ID NO: 695617 - DNA, 16 bp, Homo sapiens
atgcagggagcactgt

SEQ ID NO: 695618 - DNA, 12 bp, Homo sapiens
atgcagggaggc

SEQ ID NO: 695619 - DNA, 16 bp, Homo sapiens
atgcagggggctcctg

SEQ ID NO: 695620 - DNA, 17 bp, Homo sapiens
atgcagtacaggacata

SEQ ID NO: 695621 - DNA, 19 bp, Homo sapiens
atgcagtcctgaggagagg

SEQ ID NO: 695622 - DNA, 19 bp, Homo sapiens
atgcagttcattattttgt

SEQ ID NO: 695623 - DNA, 13 bp, Homo sapiens
atgcagttcctgg

SEQ ID NO: 695624 - DNA, 15 bp, Homo sapiens
atgcagttcctggcc

SEQ ID NO: 695625 - DNA, 15 bp, Homo sapiens
atgcagttctgagca

SEQ ID NO: 695626 - DNA, 14 bp, Homo sapiens
atgcagttttaaga

SEQ ID NO: 695627 - DNA, 15 bp, Homo sapiens
atgcagttttaagaa

SEQ ID NO: 695628 - DNA, 17 bp, Homo sapiens
atgcataaaaaaatgat

SEQ ID NO: 695629 - DNA, 15 bp, Homo sapiens
atgcataaagtcagt

SEQ ID NO: 695630 - DNA, 14 bp, Homo sapiens
atgcataaatgcat

SEQ ID NO: 695631 - DNA, 14 bp, Homo sapiens
atgcatacaagttt

SEQ ID NO: 695632 - DNA, 20 bp, Homo sapiens
atgcatacaataaaagagct

SEQ ID NO: 695633 - DNA, 22 bp, Homo sapiens
atgcatacaataaaagagcttt

SEQ ID NO: 695634 - DNA, 14 bp, Homo sapiens
atgcatactgttga

SEQ ID NO: 695635 - DNA, 15 bp, Homo sapiens
atgcatactgttgat

SEQ ID NO: 695636 - DNA, 14 bp, Homo sapiens
atgcatactttatt

SEQ ID NO: 695637 - DNA, 16 bp, Homo sapiens
atgcatagagtgtgat

SEQ ID NO: 695638 - DNA, 15 bp, Homo sapiens
atgcatatgtagata

SEQ ID NO: 695639 - DNA, 17 bp, Homo sapiens
atgcatattgattctga

SEQ ID NO: 695640 - DNA, 12 bp, Homo sapiens
atgcatatttgc

SEQ ID NO: 695641 - DNA, 17 bp, Homo sapiens
atgcatatttgcaaagt

SEQ ID NO: 695642 - DNA, 21 bp, Homo sapiens
atgcatcacgtaccccactgg

SEQ ID NO: 695643 - DNA, 14 bp, Homo sapiens
atgcatccattcct

SEQ ID NO: 695644 - DNA, 23 bp, Homo sapiens
atgcatccattcctcagggacag

SEQ ID NO: 695645 - DNA, 20 bp, Homo sapiens
atgcatccatttactgacac

SEQ ID NO: 695646 - DNA, 19 bp, Homo sapiens
atgcatcctttgcactgtc

SEQ ID NO: 695647 - DNA, 16 bp, Homo sapiens
atgcatcgggaaagaa

SEQ ID NO: 695648 - DNA, 20 bp, Homo sapiens
atgcatcgggaaagaagaaa

SEQ ID NO: 695649 - DNA, 12 bp, Homo sapiens
atgcatctcttt

SEQ ID NO: 695650 - DNA, 13 bp, Homo sapiens
atgcatctcttta

SEQ ID NO: 695651 - DNA, 18 bp, Homo sapiens
atgcatcttactgaaggt

SEQ ID NO: 695652 - DNA, 12 bp, Homo sapiens
atgcatgaacaa

SEQ ID NO: 695653 - DNA, 20 bp, Homo sapiens
atgcatgaagtaatatgcac

SEQ ID NO: 695654 - DNA, 20 bp, Homo sapiens
atgcatgcagccactgtgct

SEQ ID NO: 695655 - DNA, 19 bp, Homo sapiens
atgcatgccaggctgggca

SEQ ID NO: 695656 - DNA, 16 bp, Homo sapiens
atgcatgcgcaggctc

SEQ ID NO: 695657 - DNA, 12 bp, Homo sapiens
atgcatggaaac

SEQ ID NO: 695658 - DNA, 19 bp, Homo sapiens
atgcatggtgcagttgaca

SEQ ID NO: 695659 - DNA, 21 bp, Homo sapiens
atgcatgtaaggtcttcttgt

SEQ ID NO: 695660 - DNA, 12 bp, Homo sapiens
atgcatgtctta

SEQ ID NO: 695661 - DNA, 15 bp, Homo sapiens
atgcatgtcttttaa

SEQ ID NO: 695662 - DNA, 13 bp, Homo sapiens
atgcatgtgctgt

SEQ ID NO: 695663 - DNA, 12 bp, Homo sapiens
atgcattaaaaa

SEQ ID NO: 695664 - DNA, 13 bp, Homo sapiens
atgcattaaaaaa

SEQ ID NO: 695665 - DNA, 14 bp, Homo sapiens
atgcattaaaaaaa

SEQ ID NO: 695666 - DNA, 20 bp, Homo sapiens
atgcattaaaagaaaataaa

SEQ ID NO: 695667 - DNA, 12 bp, Homo sapiens
atgcattaaacc

SEQ ID NO: 695668 - DNA, 20 bp, Homo sapiens
atgcattaaacctgtctcca

SEQ ID NO: 695669 - DNA, 21 bp, Homo sapiens
atgcattataggatcatttgt

SEQ ID NO: 695670 - DNA, 22 bp, Homo sapiens
atgcattataggatcatttgtt

SEQ ID NO: 695671 - DNA, 16 bp, Homo sapiens
atgcattattaaattg

SEQ ID NO: 695672 - DNA, 19 bp, Homo sapiens
atgcattcacatttagaaa

SEQ ID NO: 695673 - DNA, 21 bp, Homo sapiens
atgcattctgataggaggggg

SEQ ID NO: 695674 - DNA, 17 bp, Homo sapiens
atgcattcttctctgtt

SEQ ID NO: 695675 - DNA, 18 bp, Homo sapiens
atgcattgtcttgtggag

SEQ ID NO: 695676 - DNA, 12 bp, Homo sapiens
atgcatttaata

SEQ ID NO: 695677 - DNA, 17 bp, Homo sapiens
atgcatttaataaagat

SEQ ID NO: 695678 - DNA, 19 bp, Homo sapiens
atgcatttaataaagatga

SEQ ID NO: 695679 - DNA, 23 bp, Homo sapiens
atgctcccttttacattctgtgt

SEQ ID NO: 695680 - DNA, 14 bp, Homo sapiens
atgctcctccgggt

SEQ ID NO: 695681 - DNA, 15 bp, Homo sapiens
atgctccttgggccc

SEQ ID NO: 695682 - DNA, 17 bp, Homo sapiens
atgctcgccatcaaggt

SEQ ID NO: 695683 - DNA, 22 bp, Homo sapiens
atgctcgccatcaaggtccagt

SEQ ID NO: 695684 - DNA, 13 bp, Homo sapiens
atgctcggctttt

SEQ ID NO: 695685 - DNA, 21 bp, Homo sapiens
atgctcgtgtgatttcctaca

SEQ ID NO: 695686 - DNA, 16 bp, Homo sapiens
atgctctagtgccttc

SEQ ID NO: 695687 - DNA, 22 bp, Homo sapiens
atgctctcactgtttgttttta

SEQ ID NO: 695688 - DNA, 21 bp, Homo sapiens
atgctctgccccaagccccca

SEQ ID NO: 695689 - DNA, 12 bp, Homo sapiens
atgctctggaag

SEQ ID NO: 695690 - DNA, 13 bp, Homo sapiens
atgctctgtgaca

SEQ ID NO: 695691 - DNA, 18 bp, Homo sapiens
atgctcttaaaatatctt

SEQ ID NO: 695692 - DNA, 20 bp, Homo sapiens
atgctcttaaaatatcttcc

SEQ ID NO: 695693 - DNA, 13 bp, Homo sapiens
atgctcttctgtg

SEQ ID NO: 695694 - DNA, 15 bp, Homo sapiens
atgctctttttttaa

SEQ ID NO: 695695 - DNA, 17 bp, Homo sapiens
atgctgaacgcagaaga

SEQ ID NO: 695696 - DNA, 12 bp, Homo sapiens
atgctgaaggga

SEQ ID NO: 695697 - DNA, 16 bp, Homo sapiens
atgctgaatatctgtt

SEQ ID NO: 695698 - DNA, 14 bp, Homo sapiens
atgctgaggcctcg

SEQ ID NO: 695699 - DNA, 17 bp, Homo sapiens
atgctgagggtgtttct

SEQ ID NO: 695700 - DNA, 18 bp, Homo sapiens
atgctgaggttttgaata

SEQ ID NO: 695701 - DNA, 24 bp, Homo sapiens
atgctgatcatcgccagaggtgct

SEQ ID NO: 695702 - DNA, 21 bp, Homo sapiens
atgctgatcttttaaaatcat

SEQ ID NO: 695703 - DNA, 17 bp, Homo sapiens
atgctgcaaaggagaag

SEQ ID NO: 695704 - DNA, 14 bp, Homo sapiens
atgctgcagcagag

SEQ ID NO: 695705 - DNA, 18 bp, Homo sapiens
atgctgcaggacttgaga

SEQ ID NO: 695706 - DNA, 15 bp, Homo sapiens
atgctgcctccagaa

SEQ ID NO: 695707 - DNA, 12 bp, Homo sapiens
atgctgcctgag

SEQ ID NO: 695708 - DNA, 11 bp, Homo sapiens
atgctgcctgc

SEQ ID NO: 695709 - DNA, 13 bp, Homo sapiens
atgctgcctgcct

SEQ ID NO: 695710 - DNA, 11 bp, Homo sapiens
atgctgcctgg

SEQ ID NO: 695711 - DNA, 23 bp, Homo sapiens
atgctgcctggcacagaccaggc

SEQ ID NO: 695712 - DNA, 12 bp, Homo sapiens
atgctgccttca

SEQ ID NO: 695713 - DNA, 17 bp, Homo sapiens
atgctgcgcttcgcttg

SEQ ID NO: 695714 - DNA, 19 bp, Homo sapiens
atgctgctaattcaaagct

SEQ ID NO: 695715 - DNA, 11 bp, Homo sapiens
atgctgctctc

SEQ ID NO: 695716 - DNA, 11 bp, Homo sapiens
atgctgctgtg

SEQ ID NO: 695717 - DNA, 16 bp, Homo sapiens
atgctgctgtgaattt

SEQ ID NO: 695718 - DNA, 17 bp, Homo sapiens
atgctgctttcccctgt

SEQ ID NO: 695719 - DNA, 19 bp, Homo sapiens
atgctgctttttggcacag

SEQ ID NO: 695720 - DNA, 22 bp, Homo sapiens
atgctgctttttggcacagttg

SEQ ID NO: 695721 - DNA, 12 bp, Homo sapiens
atgctggagagg

SEQ ID NO: 695722 - DNA, 20 bp, Homo sapiens
acagctaatcagcattctca

SEQ ID NO: 695723 - DNA, 21 bp, Homo sapiens
acagctaattctactcacagt

SEQ ID NO: 695724 - DNA, 14 bp, Homo sapiens
acagctactctccc

SEQ ID NO: 695725 - DNA, 17 bp, Homo sapiens
acagctatgggagcccc

SEQ ID NO: 695726 - DNA, 21 bp, Homo sapiens
acagctatgggagccccaggg

SEQ ID NO: 695727 - DNA, 15 bp, Homo sapiens
acagctcacctctga

SEQ ID NO: 695728 - DNA, 14 bp, Homo sapiens
acagctcaggaggc

SEQ ID NO: 695729 - DNA, 23 bp, Homo sapiens
acagctcagttctagtctctctg

SEQ ID NO: 695730 - DNA, 14 bp, Homo sapiens
acagctcattaaac

SEQ ID NO: 695731 - DNA, 19 bp, Homo sapiens
acagctcccaaacggaaga

SEQ ID NO: 695732 - DNA, 16 bp, Homo sapiens
acagctcccaccccac

SEQ ID NO: 695733 - DNA, 12 bp, Homo sapiens
acagctcctgcc

SEQ ID NO: 695734 - DNA, 14 bp, Homo sapiens
acagctctgagatc

SEQ ID NO: 695735 - DNA, 15 bp, Homo sapiens
acagctctggccaca

SEQ ID NO: 695736 - DNA, 14 bp, Homo sapiens
acagctctggggta

SEQ ID NO: 695737 - DNA, 22 bp, Homo sapiens
acagctcttccagggcagcggc

SEQ ID NO: 695738 - DNA, 16 bp, Homo sapiens
acagctgagagacttt

SEQ ID NO: 695739 - DNA, 23 bp, Homo sapiens
acagctgatatttgttttgaaag

SEQ ID NO: 695740 - DNA, 15 bp, Homo sapiens
acagctgcagctgat

SEQ ID NO: 695741 - DNA, 15 bp, Homo sapiens
acagctgcagctggg

SEQ ID NO: 695742 - DNA, 16 bp, Homo sapiens
acagctgccctagctg

SEQ ID NO: 695743 - DNA, 19 bp, Homo sapiens
acagctgccctagctgacc

SEQ ID NO: 695744 - DNA, 12 bp, Homo sapiens
acagctgccctg

SEQ ID NO: 695745 - DNA, 16 bp, Homo sapiens
acagctgccctgctgc

SEQ ID NO: 695746 - DNA, 17 bp, Homo sapiens
acagctgccctgctgcc

SEQ ID NO: 695747 - DNA, 11 bp, Homo sapiens
acagctgctgg

SEQ ID NO: 695748 - DNA, 12 bp, Homo sapiens
acagctgcttct

SEQ ID NO: 695749 - DNA, 13 bp, Homo sapiens
acagctgcttctc

SEQ ID NO: 695750 - DNA, 14 bp, Homo sapiens
acagctgcttctcc

SEQ ID NO: 695751 - DNA, 18 bp, Homo sapiens
acagctgcttctcccccc

SEQ ID NO: 695752 - DNA, 19 bp, Homo sapiens
acagctgcttctcccccca

SEQ ID NO: 695753 - DNA, 22 bp, Homo sapiens
acagctgcttgtcctgctctct

SEQ ID NO: 695754 - DNA, 13 bp, Homo sapiens
acagctgctttct

SEQ ID NO: 695755 - DNA, 23 bp, Homo sapiens
acagctgctttctgttgtcattg

SEQ ID NO: 695756 - DNA, 15 bp, Homo sapiens
acagctgctttgagc

SEQ ID NO: 695757 - DNA, 16 bp, Homo sapiens
acagctggaccctgct

SEQ ID NO: 695758 - DNA, 18 bp, Homo sapiens
acagctggaggaatacat

SEQ ID NO: 695759 - DNA, 22 bp, Homo sapiens
acagctggtgcaaattcagaac

SEQ ID NO: 695760 - DNA, 19 bp, Homo sapiens
acagctgtattgtctgaac

SEQ ID NO: 695761 - DNA, 13 bp, Homo sapiens
acagctgtattta

SEQ ID NO: 695762 - DNA, 14 bp, Homo sapiens
acagctgtccctgt

SEQ ID NO: 695763 - DNA, 15 bp, Homo sapiens
acagctgtccctgtc

SEQ ID NO: 695764 - DNA, 18 bp, Homo sapiens
acagctgtccctgtcacc

SEQ ID NO: 695765 - DNA, 15 bp, Homo sapiens
acagctgtgagccat

SEQ ID NO: 695766 - DNA, 17 bp, Homo sapiens
acagctgtgagccatgc

SEQ ID NO: 695767 - DNA, 20 bp, Homo sapiens
acagctgtgagccatgcctc

SEQ ID NO: 695768 - DNA, 21 bp, Homo sapiens
acagctgtgctgtaacacaag

SEQ ID NO: 695769 - DNA, 22 bp, Homo sapiens
acagctgtgttattctttgcgt

SEQ ID NO: 695770 - DNA, 17 bp, Homo sapiens
acagcttagatttcata

SEQ ID NO: 695771 - DNA, 18 bp, Homo sapiens
acagcttagatttcatag

SEQ ID NO: 695772 - DNA, 13 bp, Homo sapiens
acagcttcagaaa

SEQ ID NO: 695773 - DNA, 20 bp, Homo sapiens
acagcttcatgcctttgtaa

SEQ ID NO: 695774 - DNA, 21 bp, Homo sapiens
acagcttcattttatttttga

SEQ ID NO: 695775 - DNA, 16 bp, Homo sapiens
acagcttcctcacacc

SEQ ID NO: 695776 - DNA, 23 bp, Homo sapiens
acagcttcctcacacccctgtcc

SEQ ID NO: 695777 - DNA, 14 bp, Homo sapiens
acagcttctccaag

SEQ ID NO: 695778 - DNA, 12 bp, Homo sapiens
acagcttctctg

SEQ ID NO: 695779 - DNA, 17 bp, Homo sapiens
acagcttctctgcagta

SEQ ID NO: 695780 - DNA, 21 bp, Homo sapiens
acagcttgacctgaggctgtg

SEQ ID NO: 695781 - DNA, 14 bp, Homo sapiens
acagctttctggga

SEQ ID NO: 695782 - DNA, 18 bp, Homo sapiens
acagcttttcccaggaga

SEQ ID NO: 695783 - DNA, 13 bp, Homo sapiens
acagcttttgcaa

SEQ ID NO: 695784 - DNA, 21 bp, Homo sapiens
acagcttttgcaacttaatac

SEQ ID NO: 695785 - DNA, 20 bp, Homo sapiens
acaggaaaaaaaattctgtt

SEQ ID NO: 695786 - DNA, 14 bp, Homo sapiens
acaggaaaaaaact

SEQ ID NO: 695787 - DNA, 16 bp, Homo sapiens
acaggaaaaaaacttt

SEQ ID NO: 695788 - DNA, 14 bp, Homo sapiens
acaggaaaaacaaa

SEQ ID NO: 695789 - DNA, 13 bp, Homo sapiens
acaggaaaaataa

SEQ ID NO: 695790 - DNA, 16 bp, Homo sapiens
acaggaaaatcctctg

SEQ ID NO: 695791 - DNA, 16 bp, Homo sapiens
acaggaaaatgtatcc

SEQ ID NO: 695792 - DNA, 22 bp, Homo sapiens
acaggaaaatgtatccagagga

SEQ ID NO: 695793 - DNA, 20 bp, Homo sapiens
acaggaaaattttaaaaata

SEQ ID NO: 695794 - DNA, 19 bp, Homo sapiens
acaggaaagccctccccct

SEQ ID NO: 695795 - DNA, 16 bp, Homo sapiens
acaggaaagtgttatt

SEQ ID NO: 695796 - DNA, 16 bp, Homo sapiens
acaggaacggccctgc

SEQ ID NO: 695797 - DNA, 17 bp, Homo sapiens
acaggaacggccctgca

SEQ ID NO: 695798 - DNA, 22 bp, Homo sapiens
acaggaacggccctgcaggagc

SEQ ID NO: 695799 - DNA, 13 bp, Homo sapiens
acaggaagaccaa

SEQ ID NO: 695800 - DNA, 15 bp, Homo sapiens
acaggaagcacccca

SEQ ID NO: 695801 - DNA, 20 bp, Homo sapiens
acaggaagcaccccatgcca

SEQ ID NO: 695802 - DNA, 20 bp, Homo sapiens
atggccatgcaggaggtgga

SEQ ID NO: 695803 - DNA, 12 bp, Homo sapiens
atggccatgccc

SEQ ID NO: 695804 - DNA, 13 bp, Homo sapiens
atggccatgccct

SEQ ID NO: 695805 - DNA, 16 bp, Homo sapiens
atggccatgccctaga

SEQ ID NO: 695806 - DNA, 13 bp, Homo sapiens
atggccatgctca

SEQ ID NO: 695807 - DNA, 12 bp, Homo sapiens
atggccatggaa

SEQ ID NO: 695808 - DNA, 16 bp, Homo sapiens
atggccattttaaaat

SEQ ID NO: 695809 - DNA, 15 bp, Homo sapiens
atggcccagcaggca

SEQ ID NO: 695810 - DNA, 16 bp, Homo sapiens
atggcccagcaggcag

SEQ ID NO: 695811 - DNA, 13 bp, Homo sapiens
atggcccaggcag

SEQ ID NO: 695812 - DNA, 20 bp, Homo sapiens
atggcccattggagcacctg

SEQ ID NO: 695813 - DNA, 15 bp, Homo sapiens
atggccccagcacag

SEQ ID NO: 695814 - DNA, 20 bp, Homo sapiens
atggccccagcacagcttga

SEQ ID NO: 695815 - DNA, 22 bp, Homo sapiens
atggccccaggcatctgcctct

SEQ ID NO: 695816 - DNA, 13 bp, Homo sapiens
atggcccccaata

SEQ ID NO: 695817 - DNA, 16 bp, Homo sapiens
atggcccccaataaag

SEQ ID NO: 695818 - DNA, 22 bp, Homo sapiens
atggcccccaataaaggcagct

SEQ ID NO: 695819 - DNA, 15 bp, Homo sapiens
atggccccccactcc

SEQ ID NO: 695820 - DNA, 15 bp, Homo sapiens
atggcccctccttgc

SEQ ID NO: 695821 - DNA, 11 bp, Homo sapiens
atggcccctct

SEQ ID NO: 695822 - DNA, 18 bp, Homo sapiens
atggcccctctgacctgc

SEQ ID NO: 695823 - DNA, 17 bp, Homo sapiens
atggccctgtcccaggc

SEQ ID NO: 695824 - DNA, 18 bp, Homo sapiens
atggccctgtcccaggcc

SEQ ID NO: 695825 - DNA, 17 bp, Homo sapiens
atggcccttcaaattgg

SEQ ID NO: 695826 - DNA, 20 bp, Homo sapiens
atggccgaagccccttggag

SEQ ID NO: 695827 - DNA, 20 bp, Homo sapiens
atggccgcttctagagcctc

SEQ ID NO: 695828 - DNA, 16 bp, Homo sapiens
atggccgtggatggcc

SEQ ID NO: 695829 - DNA, 15 bp, Homo sapiens
atggcctaaatttat

SEQ ID NO: 695830 - DNA, 21 bp, Homo sapiens
atggcctattatattaaaata

SEQ ID NO: 695831 - DNA, 15 bp, Homo sapiens
atggcctcagctgcc

SEQ ID NO: 695832 - DNA, 16 bp, Homo sapiens
atggcctcagctgcct

SEQ ID NO: 695833 - DNA, 18 bp, Homo sapiens
atggcctcagctgcctca

SEQ ID NO: 695834 - DNA, 20 bp, Homo sapiens
atggcctcgcctccccaccc

SEQ ID NO: 695835 - DNA, 21 bp, Homo sapiens
atggcctcgcctccccaccct

SEQ ID NO: 695836 - DNA, 18 bp, Homo sapiens
atggcctcttcagatctc

SEQ ID NO: 695837 - DNA, 14 bp, Homo sapiens
atggcctggaggga

SEQ ID NO: 695838 - DNA, 18 bp, Homo sapiens
atggccttaatttccttt

SEQ ID NO: 695839 - DNA, 19 bp, Homo sapiens
atggccttaatttcctttt

SEQ ID NO: 695840 - DNA, 16 bp, Homo sapiens
atggccttacactgaa

SEQ ID NO: 695841 - DNA, 19 bp, Homo sapiens
atggccttgcagcactcac

SEQ ID NO: 695842 - DNA, 17 bp, Homo sapiens
atggcctttccttccct

SEQ ID NO: 695843 - DNA, 22 bp, Homo sapiens
atggcctttccttccctctctg

SEQ ID NO: 695844 - DNA, 18 bp, Homo sapiens
atggcctttgataaatgt

SEQ ID NO: 695845 - DNA, 13 bp, Homo sapiens
atggcctttgctt

SEQ ID NO: 695846 - DNA, 17 bp, Homo sapiens
atggcctttggacccag

SEQ ID NO: 695847 - DNA, 18 bp, Homo sapiens
atggcgaccaccaaagtc

SEQ ID NO: 695848 - DNA, 18 bp, Homo sapiens
atggcgattccctctcac

SEQ ID NO: 695849 - DNA, 20 bp, Homo sapiens
atggcgccaccagctctgcc

SEQ ID NO: 695850 - DNA, 20 bp, Homo sapiens
atggcgccctgcctcctgga

SEQ ID NO: 695851 - DNA, 23 bp, Homo sapiens
atggcgccctgcctcctggagga

SEQ ID NO: 695852 - DNA, 15 bp, Homo sapiens
atggcgcgggaggca

SEQ ID NO: 695853 - DNA, 18 bp, Homo sapiens
atggcgcgggaggcacca

SEQ ID NO: 695854 - DNA, 17 bp, Homo sapiens
atggcggcctgcagtgg

SEQ ID NO: 695855 - DNA, 17 bp, Homo sapiens
atggcgtaatgggcctg

SEQ ID NO: 695856 - DNA, 21 bp, Homo sapiens
agctgcttctccccccatccc

SEQ ID NO: 695857 - DNA, 20 bp, Homo sapiens
agctgcttctgctgcctagg

SEQ ID NO: 695858 - DNA, 15 bp, Homo sapiens
agctgcttgtgggcc

SEQ ID NO: 695859 - DNA, 20 bp, Homo sapiens
agctgctttctgttgtcatt

SEQ ID NO: 695860 - DNA, 20 bp, Homo sapiens
agctgctttgagctacagga

SEQ ID NO: 695861 - DNA, 13 bp, Homo sapiens
agctgctttgtgg

SEQ ID NO: 695862 - DNA, 14 bp, Homo sapiens
agctggaacatttg

SEQ ID NO: 695863 - DNA, 17 bp, Homo sapiens
agctggaacatttgata

SEQ ID NO: 695864 - DNA, 13 bp, Homo sapiens
agctggaagcctg

SEQ ID NO: 695865 - DNA, 16 bp, Homo sapiens
agctggaaggcagggc

SEQ ID NO: 695866 - DNA, 17 bp, Homo sapiens
agctggaaggcagggca

SEQ ID NO: 695867 - DNA, 21 bp, Homo sapiens
agctggaaggcagggcagagg

SEQ ID NO: 695868 - DNA, 22 bp, Homo sapiens
agctggaaggcagggcagaggg

SEQ ID NO: 695869 - DNA, 20 bp, Homo sapiens
agctggaaggggccacgtgg

SEQ ID NO: 695870 - DNA, 17 bp, Homo sapiens
agctggacagaggggac

SEQ ID NO: 695871 - DNA, 21 bp, Homo sapiens
agctggacagaggggactctg

SEQ ID NO: 695872 - DNA, 18 bp, Homo sapiens
agctggacagcggcagtg

SEQ ID NO: 695873 - DNA, 14 bp, Homo sapiens
agctggaccatctc

SEQ ID NO: 695874 - DNA, 15 bp, Homo sapiens
agctggagaagaccc

SEQ ID NO: 695875 - DNA, 20 bp, Homo sapiens
agctggagatgaggccagac

SEQ ID NO: 695876 - DNA, 22 bp, Homo sapiens
agctggagatgaggccagacca

SEQ ID NO: 695877 - DNA, 23 bp, Homo sapiens
agctggagatgaggccagaccat

SEQ ID NO: 695878 - DNA, 15 bp, Homo sapiens
agctggagcagcgga

SEQ ID NO: 695879 - DNA, 14 bp, Homo sapiens
agctggagccccca

SEQ ID NO: 695880 - DNA, 15 bp, Homo sapiens
agctggagcccccag

SEQ ID NO: 695881 - DNA, 23 bp, Homo sapiens
agctggagcccccagcagaggca

SEQ ID NO: 695882 - DNA, 16 bp, Homo sapiens
agctggagctcttgga

SEQ ID NO: 695883 - DNA, 23 bp, Homo sapiens
agctggagctcttggaagagctc

SEQ ID NO: 695884 - DNA, 20 bp, Homo sapiens
agctggaggaatacatttta

SEQ ID NO: 695885 - DNA, 17 bp, Homo sapiens
agctggaggctgtggga

SEQ ID NO: 695886 - DNA, 22 bp, Homo sapiens
agctggagtgagggcctcagag

SEQ ID NO: 695887 - DNA, 24 bp, Homo sapiens
agctggagtgagggcctcagagcc

SEQ ID NO: 695888 - DNA, 16 bp, Homo sapiens
agctggatagacttgg

SEQ ID NO: 695889 - DNA, 19 bp, Homo sapiens
agctggcaaaggtggctct

SEQ ID NO: 695890 - DNA, 18 bp, Homo sapiens
agctggcagtgcaatgct

SEQ ID NO: 695891 - DNA, 15 bp, Homo sapiens
agctggcattacagc

SEQ ID NO: 695892 - DNA, 18 bp, Homo sapiens
agctggccaaagagcctt

SEQ ID NO: 695893 - DNA, 19 bp, Homo sapiens
agctggccaaagagccttt

SEQ ID NO: 695894 - DNA, 21 bp, Homo sapiens
agctggccaaagagcctttcc

SEQ ID NO: 695895 - DNA, 22 bp, Homo sapiens
agctggccaaagagcctttcca

SEQ ID NO: 695896 - DNA, 17 bp, Homo sapiens
agctggcccccagccct

SEQ ID NO: 695897 - DNA, 21 bp, Homo sapiens
agctggcccccagccctgggg

SEQ ID NO: 695898 - DNA, 19 bp, Homo sapiens
agctggccccgccgcctgg

SEQ ID NO: 695899 - DNA, 15 bp, Homo sapiens
agctggcccgtgaca

SEQ ID NO: 695900 - DNA, 18 bp, Homo sapiens
agctggccgggagcctga

SEQ ID NO: 695901 - DNA, 19 bp, Homo sapiens
agctggccgggagcctgat

SEQ ID NO: 695902 - DNA, 19 bp, Homo sapiens
agctggcctcccccaacac

SEQ ID NO: 695903 - DNA, 12 bp, Homo sapiens
agctggcctgag

SEQ ID NO: 695904 - DNA, 21 bp, Homo sapiens
agctggcctgagaggggaagc

SEQ ID NO: 695905 - DNA, 12 bp, Homo sapiens
agctggcctggg

SEQ ID NO: 695906 - DNA, 12 bp, Homo sapiens
agctggcctgtc

SEQ ID NO: 695907 - DNA, 19 bp, Homo sapiens
agctggcctgtctgcgtgg

SEQ ID NO: 695908 - DNA, 23 bp, Homo sapiens
agctggctctgagcgcctccatc

SEQ ID NO: 695909 - DNA, 14 bp, Homo sapiens
agctggctctgtga

SEQ ID NO: 695910 - DNA, 18 bp, Homo sapiens
agctggctctgtgagggt

SEQ ID NO: 695911 - DNA, 22 bp, Homo sapiens
agctggctctgtgagggtgctg

SEQ ID NO: 695912 - DNA, 14 bp, Homo sapiens
agctggctgtgcct

SEQ ID NO: 695913 - DNA, 18 bp, Homo sapiens
agctggctgtgcctgctt

SEQ ID NO: 695914 - DNA, 21 bp, Homo sapiens
agctggctttgaaacctcagg

SEQ ID NO: 695915 - DNA, 22 bp, Homo sapiens
agctggctttgaaacctcaggg

SEQ ID NO: 695916 - DNA, 23 bp, Homo sapiens
agctggctttgaaacctcagggc

SEQ ID NO: 695917 - DNA, 22 bp, Homo sapiens
agctgggaaaaaagttttgatg

SEQ ID NO: 695918 - DNA, 14 bp, Homo sapiens
agctgggaaagcat

SEQ ID NO: 695919 - DNA, 15 bp, Homo sapiens
agctgggaaagcata

SEQ ID NO: 695920 - DNA, 18 bp, Homo sapiens
agctgggaagctgtactc

SEQ ID NO: 695921 - DNA, 22 bp, Homo sapiens
agctgggacctaatgctggcct

SEQ ID NO: 695922 - DNA, 18 bp, Homo sapiens
agctgggactacaggtgc

SEQ ID NO: 695923 - DNA, 21 bp, Homo sapiens
agctgggactacaggtgtgca

SEQ ID NO: 695924 - DNA, 23 bp, Homo sapiens
agctgggactacaggtgtgcacc

SEQ ID NO: 695925 - DNA, 15 bp, Homo sapiens
agctgggagccaggc

SEQ ID NO: 695926 - DNA, 17 bp, Homo sapiens
agctgggagccaggctc

SEQ ID NO: 695927 - DNA, 18 bp, Homo sapiens
agctgggagccaggctct

SEQ ID NO: 695928 - DNA, 21 bp, Homo sapiens
agctgggagccagtgtgccca

SEQ ID NO: 695929 - DNA, 19 bp, Homo sapiens
agctgggagcctggttcag

SEQ ID NO: 695930 - DNA, 18 bp, Homo sapiens
agctgggaggaaaagaaa

SEQ ID NO: 695931 - DNA, 19 bp, Homo sapiens
agctgggaggcatggccct

SEQ ID NO: 695932 - DNA, 23 bp, Homo sapiens
agctgggaggtagaaggggagga

SEQ ID NO: 695933 - DNA, 13 bp, Homo sapiens
agctgggaggtct

SEQ ID NO: 695934 - DNA, 23 bp, Homo sapiens
agctgggaggtctcgtcccagcc

SEQ ID NO: 695935 - DNA, 15 bp, Homo sapiens
agctgggagtagcat

SEQ ID NO: 695936 - DNA, 15 bp, Homo sapiens
agctgggattacagg

SEQ ID NO: 695937 - DNA, 16 bp, Homo sapiens
agctgggcagtgccag

SEQ ID NO: 695938 - DNA, 10 bp, Homo sapiens
agctgggccc

SEQ ID NO: 695939 - DNA, 20 bp, Homo sapiens
agctgggcccaaaggcccag

SEQ ID NO: 695940 - DNA, 13 bp, Homo sapiens
agctgggcccagc

SEQ ID NO: 695941 - DNA, 14 bp, Homo sapiens
agctgggcccagcc

SEQ ID NO: 695942 - DNA, 21 bp, Homo sapiens
agctgggcccagcccctccac

SEQ ID NO: 695943 - DNA, 20 bp, Homo sapiens
agctgggccccatgctctgc

SEQ ID NO: 695944 - DNA, 21 bp, Homo sapiens
agctgggccccatgctctgcc

SEQ ID NO: 695945 - DNA, 22 bp, Homo sapiens
agctgggccccatgctctgccc

SEQ ID NO: 695946 - DNA, 14 bp, Homo sapiens
agctgggcctgtgc

SEQ ID NO: 695947 - DNA, 16 bp, Homo sapiens
agctgggcctgtgcac

SEQ ID NO: 695948 - DNA, 15 bp, Homo sapiens
agctgggctctgcaa

SEQ ID NO: 695949 - DNA, 15 bp, Homo sapiens
agctgggctctgcca

SEQ ID NO: 695950 - DNA, 22 bp, Homo sapiens
agctgggctctgccaccctacc

SEQ ID NO: 695951 - DNA, 15 bp, Homo sapiens
agctgggctgtctct

SEQ ID NO: 695952 - DNA, 15 bp, Homo sapiens
agctgggcttggcct

SEQ ID NO: 695953 - DNA, 19 bp, Homo sapiens
agctgggcttggcctggag

SEQ ID NO: 695954 - DNA, 18 bp, Homo sapiens
agctggggactcagggac

SEQ ID NO: 695955 - DNA, 19 bp, Homo sapiens
actttggtacatggccagt

SEQ ID NO: 695956 - DNA, 23 bp, Homo sapiens
actttggtagctgggaaagcata

SEQ ID NO: 695957 - DNA, 15 bp, Homo sapiens
actttggtaggcaaa

SEQ ID NO: 695958 - DNA, 12 bp, Homo sapiens
actttgtaaata

SEQ ID NO: 695959 - DNA, 13 bp, Homo sapiens
actttgtaaatag

SEQ ID NO: 695960 - DNA, 15 bp, Homo sapiens
actttgtcagaggca

SEQ ID NO: 695961 - DNA, 16 bp, Homo sapiens
actttgtcattatgat

SEQ ID NO: 695962 - DNA, 13 bp, Homo sapiens
actttgtcccgct

SEQ ID NO: 695963 - DNA, 17 bp, Homo sapiens
actttgtcgtggttctt

SEQ ID NO: 695964 - DNA, 20 bp, Homo sapiens
actttgtcgtggttcttaaa

SEQ ID NO: 695965 - DNA, 21 bp, Homo sapiens
actttgtcgtggttcttaaat

SEQ ID NO: 695966 - DNA, 22 bp, Homo sapiens
actttgtcgtggttcttaaatg

SEQ ID NO: 695967 - DNA, 23 bp, Homo sapiens
actttgtcgtggttcttaaatgt

SEQ ID NO: 695968 - DNA, 15 bp, Homo sapiens
actttgtctgaaaaa

SEQ ID NO: 695969 - DNA, 12 bp, Homo sapiens
actttgtctgta

SEQ ID NO: 695970 - DNA, 16 bp, Homo sapiens
actttgtctgtacata

SEQ ID NO: 695971 - DNA, 19 bp, Homo sapiens
actttgtggatgtcttcct

SEQ ID NO: 695972 - DNA, 16 bp, Homo sapiens
actttgtgtattaaat

SEQ ID NO: 695973 - DNA, 20 bp, Homo sapiens
actttgtgtattaaatggtt

SEQ ID NO: 695974 - DNA, 15 bp, Homo sapiens
actttgtgttcattt

SEQ ID NO: 695975 - DNA, 19 bp, Homo sapiens
actttgtgtttttttaatt

SEQ ID NO: 695976 - DNA, 20 bp, Homo sapiens
actttgttaggattttcaca

SEQ ID NO: 695977 - DNA, 15 bp, Homo sapiens
actttgttgcaagat

SEQ ID NO: 695978 - DNA, 22 bp, Homo sapiens
actttgttgcaagatgtgaatt

SEQ ID NO: 695979 - DNA, 18 bp, Homo sapiens
actttgttggcccttcca

SEQ ID NO: 695980 - DNA, 14 bp, Homo sapiens
actttgtttagaaa

SEQ ID NO: 695981 - DNA, 15 bp, Homo sapiens
actttgtttagaaaa

SEQ ID NO: 695982 - DNA, 16 bp, Homo sapiens
actttgtttagaaaaa

SEQ ID NO: 695983 - DNA, 23 bp, Homo sapiens
actttgtttagaaaaaaaactga

SEQ ID NO: 695984 - DNA, 16 bp, Homo sapiens
actttgttttcaagat

SEQ ID NO: 695985 - DNA, 17 bp, Homo sapiens
acttttaaaaaacaaaa

SEQ ID NO: 695986 - DNA, 19 bp, Homo sapiens
acttttaaaaaacaaaaaa

SEQ ID NO: 695987 - DNA, 15 bp, Homo sapiens
acttttaaacagtga

SEQ ID NO: 695988 - DNA, 14 bp, Homo sapiens
acttttaaactgtg

SEQ ID NO: 695989 - DNA, 17 bp, Homo sapiens
acttttaaactgtgtac

SEQ ID NO: 695990 - DNA, 19 bp, Homo sapiens
acttttaaggataaatcat

SEQ ID NO: 695991 - DNA, 12 bp, Homo sapiens
acttttaatggt

SEQ ID NO: 695992 - DNA, 21 bp, Homo sapiens
acttttacaagtaacaaaaat

SEQ ID NO: 695993 - DNA, 23 bp, Homo sapiens
acttttacagaatgcattaaaaa

SEQ ID NO: 695994 - DNA, 21 bp, Homo sapiens
acttttaccactatttaagtt

SEQ ID NO: 695995 - DNA, 17 bp, Homo sapiens
acttttagaaatgcata

SEQ ID NO: 695996 - DNA, 19 bp, Homo sapiens
acttttagttggcatttgt

SEQ ID NO: 695997 - DNA, 13 bp, Homo sapiens
acttttataaact

SEQ ID NO: 695998 - DNA, 19 bp, Homo sapiens
acttttataaactttacct

SEQ ID NO: 695999 - DNA, 22 bp, Homo sapiens
acttttataaactttacctttt

SEQ ID NO: 696000 - DNA, 15 bp, Homo sapiens
acttttatgtgagat

SEQ ID NO: 696001 - DNA, 16 bp, Homo sapiens
acttttattttcattg

SEQ ID NO: 696002 - DNA, 22 bp, Homo sapiens
acttttattttcattgtgattt

SEQ ID NO: 696003 - DNA, 17 bp, Homo sapiens
acttttcaatgtgattc

SEQ ID NO: 696004 - DNA, 15 bp, Homo sapiens
acttttcacactgtc

SEQ ID NO: 696005 - DNA, 16 bp, Homo sapiens
acttttcacactgtct

SEQ ID NO: 696006 - DNA, 19 bp, Homo sapiens
acttttcacactgtcttcc

SEQ ID NO: 696007 - DNA, 17 bp, Homo sapiens
acttttcatatcatttc

SEQ ID NO: 696008 - DNA, 18 bp, Homo sapiens
acttttcatatcatttct

SEQ ID NO: 696009 - DNA, 15 bp, Homo sapiens
acttttcattccctg

SEQ ID NO: 696010 - DNA, 17 bp, Homo sapiens
acttttcccctgtcctg

SEQ ID NO: 696011 - DNA, 18 bp, Homo sapiens
acttttcccctgttaaac

SEQ ID NO: 696012 - DNA, 21 bp, Homo sapiens
acttttcccctgttaaacagt

SEQ ID NO: 696013 - DNA, 13 bp, Homo sapiens
acttttccttttc

SEQ ID NO: 696014 - DNA, 16 bp, Homo sapiens
acttttcgttaacatt

SEQ ID NO: 696015 - DNA, 19 bp, Homo sapiens
acttttctaagaaaagcat

SEQ ID NO: 696016 - DNA, 20 bp, Homo sapiens
acttttctaagaaaagcatt

SEQ ID NO: 696017 - DNA, 19 bp, Homo sapiens
acttttctgattaatatat

SEQ ID NO: 696018 - DNA, 22 bp, Homo sapiens
acttttctgattaatatattta

SEQ ID NO: 696019 - DNA, 11 bp, Homo sapiens
acttttctggg

SEQ ID NO: 696020 - DNA, 16 bp, Homo sapiens
acttttctggttccaa

SEQ ID NO: 696021 - DNA, 12 bp, Homo sapiens
acttttcttaag

SEQ ID NO: 696022 - DNA, 19 bp, Homo sapiens
acttttctttattagcttt

SEQ ID NO: 696023 - DNA, 16 bp, Homo sapiens
acttttctttcttttc

SEQ ID NO: 696024 - DNA, 22 bp, Homo sapiens
acttttgaaaagaccaagactt

SEQ ID NO: 696025 - DNA, 22 bp, Homo sapiens
acttttgaagtcttccctcaga

SEQ ID NO: 696026 - DNA, 16 bp, Homo sapiens
acttttgagtgtgtgt

SEQ ID NO: 696027 - DNA, 18 bp, Homo sapiens
acttttgatgacttcagt

SEQ ID NO: 696028 - DNA, 13 bp, Homo sapiens
acttttgctgttt

SEQ ID NO: 696029 - DNA, 19 bp, Homo sapiens
acttttgcttaccttttcc

SEQ ID NO: 696030 - DNA, 13 bp, Homo sapiens
acttttggaatca

SEQ ID NO: 696031 - DNA, 11 bp, Homo sapiens
acttttgtaaa

SEQ ID NO: 696032 - DNA, 12 bp, Homo sapiens
acttttgtaaat

SEQ ID NO: 696033 - DNA, 13 bp, Homo sapiens
acttttgtaaata

SEQ ID NO: 696034 - DNA, 18 bp, Homo sapiens
acttttgtaaatattctt

SEQ ID NO: 696035 - DNA, 17 bp, Homo sapiens
acttttgtaagacaaag

SEQ ID NO: 696036 - DNA, 18 bp, Homo sapiens
acttttgtaatttgaatt

SEQ ID NO: 696037 - DNA, 19 bp, Homo sapiens
acttttgtgtaatgaaaat

SEQ ID NO: 696038 - DNA, 16 bp, Homo sapiens
acttttgttaacagta

SEQ ID NO: 696039 - DNA, 18 bp, Homo sapiens
acttttgttaacagtatt

SEQ ID NO: 696040 - DNA, 22 bp, Homo sapiens
acttttgttaggaaaaaattga

SEQ ID NO: 696041 - DNA, 20 bp, Homo sapiens
acttttgttccagtgtttaa

SEQ ID NO: 696042 - DNA, 21 bp, Homo sapiens
acttttgttccagtgtttaaa

SEQ ID NO: 696043 - DNA, 15 bp, Homo sapiens
acttttgttctcttc

SEQ ID NO: 696044 - DNA, 16 bp, Homo sapiens
acttttgttctcttct

SEQ ID NO: 696045 - DNA, 16 bp, Homo sapiens
acttttgttctgcttt

SEQ ID NO: 696046 - DNA, 16 bp, Homo sapiens
acttttgttgaaatag

SEQ ID NO: 696047 - DNA, 18 bp, Homo sapiens
actttttaaatgtaaaga

SEQ ID NO: 696048 - DNA, 18 bp, Homo sapiens
actttttaactggcttca

SEQ ID NO: 696049 - DNA, 18 bp, Homo sapiens
actttttaattcaccaaa

SEQ ID NO: 696050 - DNA, 12 bp, Homo sapiens
actttttataaa

SEQ ID NO: 696051 - DNA, 12 bp, Homo sapiens
actttttatact

SEQ ID NO: 696052 - DNA, 14 bp, Homo sapiens
actttttatactcc

SEQ ID NO: 696053 - DNA, 21 bp, Homo sapiens
actttttatatagcaaaatga

SEQ ID NO: 696054 - DNA, 11 bp, Homo sapiens
actttttccag

SEQ ID NO: 696055 - DNA, 21 bp, Homo sapiens
actttttccatttcttcagag

SEQ ID NO: 696056 - DNA, 22 bp, Homo sapiens
actttttccatttcttcagagg

SEQ ID NO: 696057 - DNA, 11 bp, Homo sapiens
actttttctga

SEQ ID NO: 696058 - DNA, 20 bp, Homo sapiens
actttttgaacttttcattc

SEQ ID NO: 696059 - DNA, 13 bp, Homo sapiens
actttttgcattt

SEQ ID NO: 696060 - DNA, 21 bp, Homo sapiens
actttttggaattcagcagtt

SEQ ID NO: 696061 - DNA, 14 bp, Homo sapiens
actttttggaattg

SEQ ID NO: 696062 - DNA, 16 bp, Homo sapiens
actttttgtatttagt

SEQ ID NO: 696063 - DNA, 17 bp, Homo sapiens
actttttgtatttagta

SEQ ID NO: 696064 - DNA, 18 bp, Homo sapiens
actttttgtatttagtag

SEQ ID NO: 696065 - DNA, 19 bp, Homo sapiens
actttttgtattttttcct

SEQ ID NO: 696066 - DNA, 20 bp, Homo sapiens
actttttgtattttttcctt

SEQ ID NO: 696067 - DNA, 18 bp, Homo sapiens
agctgctgaagttctgag

SEQ ID NO: 696068 - DNA, 21 bp, Homo sapiens
agctgctgaccaattgtgctg

SEQ ID NO: 696069 - DNA, 22 bp, Homo sapiens
agctgctgaccaattgtgctgc

SEQ ID NO: 696070 - DNA, 13 bp, Homo sapiens
agctgctggctga

SEQ ID NO: 696071 - DNA, 17 bp, Homo sapiens
agctgctggcttgcagt

SEQ ID NO: 696072 - DNA, 13 bp, Homo sapiens
agctgctgtgccc

SEQ ID NO: 696073 - DNA, 16 bp, Homo sapiens
agctgctgtgcccagc

SEQ ID NO: 696074 - DNA, 15 bp, Homo sapiens
agctgctgtgcccca

SEQ ID NO: 696075 - DNA, 14 bp, Homo sapiens
agctgctgtgtcct

SEQ ID NO: 696076 - DNA, 17 bp, Homo sapiens
agctgctgtgtcctcta

SEQ ID NO: 696077 - DNA, 21 bp, Homo sapiens
agctgctgttctcaggacagc

SEQ ID NO: 696078 - DNA, 12 bp, Homo sapiens
agctgcttctcc

SEQ ID NO: 696079 - DNA, 16 bp, Homo sapiens
agctgcttctcccccc

SEQ ID NO: 696080 - DNA, 17 bp, Homo sapiens
agctgcttctcccccca

SEQ ID NO: 696081 - DNA, 16 bp, Homo sapiens
aacaactaggcttcag

SEQ ID NO: 696082 - DNA, 13 bp, Homo sapiens
aacaacttcagaa

SEQ ID NO: 696083 - DNA, 21 bp, Homo sapiens
aacaacttgctacttatcatt

SEQ ID NO: 696084 - DNA, 16 bp, Homo sapiens
aacaacttggcatttc

SEQ ID NO: 696085 - DNA, 14 bp, Homo sapiens
aacaacttgtagca

SEQ ID NO: 696086 - DNA, 12 bp, Homo sapiens
aacaagaaaaca

SEQ ID NO: 696087 - DNA, 14 bp, Homo sapiens
aacaagaaaacata

SEQ ID NO: 696088 - DNA, 22 bp, Homo sapiens
aacaagaaaccaagtgggctgg

SEQ ID NO: 696089 - DNA, 23 bp, Homo sapiens
aacaagaaaccaagtgggctggt

SEQ ID NO: 696090 - DNA, 15 bp, Homo sapiens
aacaagaaagtggtc

SEQ ID NO: 696091 - DNA, 14 bp, Homo sapiens
aacaagaaatctga

SEQ ID NO: 696092 - DNA, 12 bp, Homo sapiens
aacaagaaatgg

SEQ ID NO: 696093 - DNA, 12 bp, Homo sapiens
aacaagaagaaa

SEQ ID NO: 696094 - DNA, 17 bp, Homo sapiens
aacaagaagaatttgaa

SEQ ID NO: 696095 - DNA, 21 bp, Homo sapiens
aacaagaagccacagacctag

SEQ ID NO: 696096 - DNA, 22 bp, Homo sapiens
aacaagaccaccacttcgaaac

SEQ ID NO: 696097 - DNA, 17 bp, Homo sapiens
aacaagaccgccccagg

SEQ ID NO: 696098 - DNA, 18 bp, Homo sapiens
aacaagaccgccccaggg

SEQ ID NO: 696099 - DNA, 22 bp, Homo sapiens
aacaagaccgccccagggctat

SEQ ID NO: 696100 - DNA, 16 bp, Homo sapiens
aacaagactgcctccc

SEQ ID NO: 696101 - DNA, 17 bp, Homo sapiens
aacaagaggggaaaaca

SEQ ID NO: 696102 - DNA, 18 bp, Homo sapiens
aacaagagtttgttctgt

SEQ ID NO: 696103 - DNA, 23 bp, Homo sapiens
aacaagagtttgttctgttctgg

SEQ ID NO: 696104 - DNA, 20 bp, Homo sapiens
aacaagattttaaagacatg

SEQ ID NO: 696105 - DNA, 17 bp, Homo sapiens
aacaagcatgtctctct

SEQ ID NO: 696106 - DNA, 18 bp, Homo sapiens
aacaagccaagaaagatg

SEQ ID NO: 696107 - DNA, 12 bp, Homo sapiens
aacaagcttcag

SEQ ID NO: 696108 - DNA, 19 bp, Homo sapiens
aacaaggaatgcctgtgcc

SEQ ID NO: 696109 - DNA, 17 bp, Homo sapiens
aacaaggagctcaccct

SEQ ID NO: 696110 - DNA, 22 bp, Homo sapiens
aacaaggagctcaccctgcccg

SEQ ID NO: 696111 - DNA, 24 bp, Homo sapiens
aacaaggagctcaccctgcccgct

SEQ ID NO: 696112 - DNA, 16 bp, Homo sapiens
aacaaggtagttttta

SEQ ID NO: 696113 - DNA, 12 bp, Homo sapiens
aacaaggtgtct

SEQ ID NO: 696114 - DNA, 14 bp, Homo sapiens
aacaagtaagaaaa

SEQ ID NO: 696115 - DNA, 16 bp, Homo sapiens
aacaagtaagaaaaat

SEQ ID NO: 696116 - DNA, 17 bp, Homo sapiens
aacaagtaagaaaaata

SEQ ID NO: 696117 - DNA, 16 bp, Homo sapiens
aacaagtcacagctgc

SEQ ID NO: 696118 - DNA, 21 bp, Homo sapiens
aacaagtcacagctgcagctg

SEQ ID NO: 696119 - DNA, 19 bp, Homo sapiens
aacaagtcgatgaactatt

SEQ ID NO: 696120 - DNA, 22 bp, Homo sapiens
aacaagtggatgtttttaatga

SEQ ID NO: 696121 - DNA, 13 bp, Homo sapiens
aacaagttttaga

SEQ ID NO: 696122 - DNA, 14 bp, Homo sapiens
aacaagttttagaa

SEQ ID NO: 696123 - DNA, 15 bp, Homo sapiens
aacaagttttagaaa

SEQ ID NO: 696124 - DNA, 14 bp, Homo sapiens
aacaataaaatttt

SEQ ID NO: 696125 - DNA, 16 bp, Homo sapiens
aacaataaaatttttt

SEQ ID NO: 696126 - DNA, 15 bp, Homo sapiens
aacaataaatgtgca

SEQ ID NO: 696127 - DNA, 17 bp, Homo sapiens
aacaataactactgtgt

SEQ ID NO: 696128 - DNA, 19 bp, Homo sapiens
aacaataactactgtgttc

SEQ ID NO: 696129 - DNA, 16 bp, Homo sapiens
aacaatacaaatggat

SEQ ID NO: 696130 - DNA, 22 bp, Homo sapiens
aacaatactgttctatacgagt

SEQ ID NO: 696131 - DNA, 21 bp, Homo sapiens
aacaatattttatggttatgt

SEQ ID NO: 696132 - DNA, 22 bp, Homo sapiens
aacaatattttatggttatgtt

SEQ ID NO: 696133 - DNA, 13 bp, Homo sapiens
atttgtaaattta

SEQ ID NO: 696134 - DNA, 19 bp, Homo sapiens
atttgtaacattgtaaagt

SEQ ID NO: 696135 - DNA, 13 bp, Homo sapiens
atttgtaagatat

SEQ ID NO: 696136 - DNA, 18 bp, Homo sapiens
atttgtaagatatttgca

SEQ ID NO: 696137 - DNA, 18 bp, Homo sapiens
atttgtaagcaacttgct

SEQ ID NO: 696138 - DNA, 22 bp, Homo sapiens
atttgtaagcaacttgcttcta

SEQ ID NO: 696139 - DNA, 21 bp, Homo sapiens
atttgtaagtgtaaaaaatgt

SEQ ID NO: 696140 - DNA, 13 bp, Homo sapiens
atttgtaattaaa

SEQ ID NO: 696141 - DNA, 22 bp, Homo sapiens
atttgtaattaaaagcaaatca

SEQ ID NO: 696142 - DNA, 19 bp, Homo sapiens
atttgtaattgcttacatt

SEQ ID NO: 696143 - DNA, 13 bp, Homo sapiens
atttgtacaaaaa

SEQ ID NO: 696144 - DNA, 20 bp, Homo sapiens
atttgtacaaggtaattgtt

SEQ ID NO: 696145 - DNA, 18 bp, Homo sapiens
atttgtacaatggtttat

SEQ ID NO: 696146 - DNA, 18 bp, Homo sapiens
atttgtacaattttaaag

SEQ ID NO: 696147 - DNA, 18 bp, Homo sapiens
atttgtacaggggccatg

SEQ ID NO: 696148 - DNA, 18 bp, Homo sapiens
atttgtacatatgtaaaa

SEQ ID NO: 696149 - DNA, 23 bp, Homo sapiens
atttgtaccattccttcaaataa

SEQ ID NO: 696150 - DNA, 15 bp, Homo sapiens
atttgtacttcttat

SEQ ID NO: 696151 - DNA, 9 bp, Homo sapiens
atttgtagc

SEQ ID NO: 696152 - DNA, 15 bp, Homo sapiens
atttgtagcactgag

SEQ ID NO: 696153 - DNA, 18 bp, Homo sapiens
atttgtagcactgagggt

SEQ ID NO: 696154 - DNA, 16 bp, Homo sapiens
atttgtagctttgccc

SEQ ID NO: 696155 - DNA, 23 bp, Homo sapiens
atttgtataaagcattactcttt

SEQ ID NO: 696156 - DNA, 16 bp, Homo sapiens
atttgtatagttgctt

SEQ ID NO: 696157 - DNA, 16 bp, Homo sapiens
atttgtatatcatgaa

SEQ ID NO: 696158 - DNA, 16 bp, Homo sapiens
atttgtatatggtatt

SEQ ID NO: 696159 - DNA, 12 bp, Homo sapiens
atttgtatatta

SEQ ID NO: 696160 - DNA, 19 bp, Homo sapiens
atttgtatattaaaatagc

SEQ ID NO: 696161 - DNA, 21 bp, Homo sapiens
atttgtatattaaaatagcat

SEQ ID NO: 696162 - DNA, 19 bp, Homo sapiens
atttgtatctctgaagcat

SEQ ID NO: 696163 - DNA, 20 bp, Homo sapiens
atttgtatctctgaagcatg

SEQ ID NO: 696164 - DNA, 21 bp, Homo sapiens
atttgtatctctgaagcatgt

SEQ ID NO: 696165 - DNA, 15 bp, Homo sapiens
atttgtatgctaaat

SEQ ID NO: 696166 - DNA, 17 bp, Homo sapiens
atttgtatgctaaatga

SEQ ID NO: 696167 - DNA, 18 bp, Homo sapiens
atttgtatgtcaaagctt

SEQ ID NO: 696168 - DNA, 16 bp, Homo sapiens
atttgtattaataaag

SEQ ID NO: 696169 - DNA, 17 bp, Homo sapiens
atttgtattaataaagc

SEQ ID NO: 696170 - DNA, 19 bp, Homo sapiens
atttgtattaataaagcat

SEQ ID NO: 696171 - DNA, 20 bp, Homo sapiens
atttgtattaataaagcatt

SEQ ID NO: 696172 - DNA, 16 bp, Homo sapiens
atttgtattttgtgtg

SEQ ID NO: 696173 - DNA, 14 bp, Homo sapiens
atttgtcaaattgt

SEQ ID NO: 696174 - DNA, 20 bp, Homo sapiens
atttgtcaatttatgaatat

SEQ ID NO: 696175 - DNA, 16 bp, Homo sapiens
atttgtcacagaaatc

SEQ ID NO: 696176 - DNA, 21 bp, Homo sapiens
atttgtcacagaaatcagagg

SEQ ID NO: 696177 - DNA, 22 bp, Homo sapiens
atttgtcacagaaatcagagga

SEQ ID NO: 696178 - DNA, 19 bp, Homo sapiens
atttgtcagtatttttgcc

SEQ ID NO: 696179 - DNA, 23 bp, Homo sapiens
atttgtcatgacagtgcttgcat

SEQ ID NO: 696180 - DNA, 11 bp, Homo sapiens
atttgtcccag

SEQ ID NO: 696181 - DNA, 20 bp, Homo sapiens
atttgtctctgtcacccttg

SEQ ID NO: 696182 - DNA, 21 bp, Homo sapiens
atttgtctgaaacatttcata

SEQ ID NO: 696183 - DNA, 20 bp, Homo sapiens
atttgtcttaaaaaatgtga

SEQ ID NO: 696184 - DNA, 19 bp, Homo sapiens
atttgtcttaaaaatttat

SEQ ID NO: 696185 - DNA, 20 bp, Homo sapiens
atttgtcttaaaaatttata

SEQ ID NO: 696186 - DNA, 14 bp, Homo sapiens
atttgtctttgaat

SEQ ID NO: 696187 - DNA, 23 bp, Homo sapiens
atttgtctttgtaatattttcca

SEQ ID NO: 696188 - DNA, 21 bp, Homo sapiens
atttgtctttttgttgtaaaa

SEQ ID NO: 696189 - DNA, 14 bp, Homo sapiens
atttgtgacaaaaa

SEQ ID NO: 696190 - DNA, 18 bp, Homo sapiens
atttgtgacttttaaaaa

SEQ ID NO: 696191 - DNA, 20 bp, Homo sapiens
atttgtgatacaatgctgtg

SEQ ID NO: 696192 - DNA, 18 bp, Homo sapiens
atttgtgatagcactttc

SEQ ID NO: 696193 - DNA, 18 bp, Homo sapiens
atttgtgatcagcattgt

SEQ ID NO: 696194 - DNA, 23 bp, Homo sapiens
atttgtgatcagcattgtgactt

SEQ ID NO: 696195 - DNA, 16 bp, Homo sapiens
atttgtgcccattcct

SEQ ID NO: 696196 - DNA, 20 bp, Homo sapiens
atttgtgctagaaattttca

SEQ ID NO: 696197 - DNA, 14 bp, Homo sapiens
atttgtgctgggtt

SEQ ID NO: 696198 - DNA, 11 bp, Homo sapiens
atttgtggaat

SEQ ID NO: 696199 - DNA, 13 bp, Homo sapiens
atttgtggtcaca

SEQ ID NO: 696200 - DNA, 21 bp, Homo sapiens
atttgtgtaaatgagtaaaac

SEQ ID NO: 696201 - DNA, 14 bp, Homo sapiens
atttgtgtaaattt

SEQ ID NO: 696202 - DNA, 15 bp, Homo sapiens
atttgtgtaaatttg

SEQ ID NO: 696203 - DNA, 15 bp, Homo sapiens
atttgtgtctgtgtt

SEQ ID NO: 696204 - DNA, 14 bp, Homo sapiens
atttgtgtgcttct

SEQ ID NO: 696205 - DNA, 20 bp, Homo sapiens
atttgtgtgtgtgcaagtgt

SEQ ID NO: 696206 - DNA, 15 bp, Homo sapiens
atttgtgttgaagga

SEQ ID NO: 696207 - DNA, 21 bp, Homo sapiens
atttgtgttttaatttaaaca

SEQ ID NO: 696208 - DNA, 13 bp, Homo sapiens
atttgtgtttttc

SEQ ID NO: 696209 - DNA, 23 bp, Homo sapiens
atttgttaagaaaaactacagca

SEQ ID NO: 696210 - DNA, 15 bp, Homo sapiens
atttgttactttact

SEQ ID NO: 696211 - DNA, 22 bp, Homo sapiens
atttgttatcctcttgtatact

SEQ ID NO: 696212 - DNA, 16 bp, Homo sapiens
atttgttatggttaca

SEQ ID NO: 696213 - DNA, 13 bp, Homo sapiens
atttgttcctgct

SEQ ID NO: 696214 - DNA, 14 bp, Homo sapiens
atttgttcctgctt

SEQ ID NO: 696215 - DNA, 17 bp, Homo sapiens
atttgttctttttctga

SEQ ID NO: 696216 - DNA, 19 bp, Homo sapiens
atttgtttaattaaattta

SEQ ID NO: 696217 - DNA, 18 bp, Homo sapiens
atttgtttatgtaatttc

SEQ ID NO: 696218 - DNA, 19 bp, Homo sapiens
atttgtttatgtaatttca

SEQ ID NO: 696219 - DNA, 16 bp, Homo sapiens
atttgtttcatttctg

SEQ ID NO: 696220 - DNA, 21 bp, Homo sapiens
atttgtttcatttctgcagat

SEQ ID NO: 696221 - DNA, 16 bp, Homo sapiens
atttgtttccagcatg

SEQ ID NO: 696222 - DNA, 21 bp, Homo sapiens
atttgtttcccccacagtttt

SEQ ID NO: 696223 - DNA, 20 bp, Homo sapiens
atttgtttctttctctgagg

SEQ ID NO: 696224 - DNA, 20 bp, Homo sapiens
atttgtttgaactgataaag

SEQ ID NO: 696225 - DNA, 11 bp, Homo sapiens
atttgtttgac

SEQ ID NO: 696226 - DNA, 14 bp, Homo sapiens
atttgttttcatgg

SEQ ID NO: 696227 - DNA, 15 bp, Homo sapiens
atttgttttgaattt

SEQ ID NO: 696228 - DNA, 17 bp, Homo sapiens
atttgttttgtgtttca

SEQ ID NO: 696229 - DNA, 16 bp, Homo sapiens
atttgtttttaaactg

SEQ ID NO: 696230 - DNA, 18 bp, Homo sapiens
atttgtttttaaactgta

SEQ ID NO: 696231 - DNA, 22 bp, Homo sapiens
atttgtttttaaactgtacagt

SEQ ID NO: 696232 - DNA, 15 bp, Homo sapiens
atttgtttttcattc

SEQ ID NO: 696233 - DNA, 15 bp, Homo sapiens
atttgtttttctcac

SEQ ID NO: 696234 - DNA, 16 bp, Homo sapiens
atttgtttttgcattt

SEQ ID NO: 696235 - DNA, 15 bp, Homo sapiens
attttaaaaacttta

SEQ ID NO: 696236 - DNA, 19 bp, Homo sapiens
attttaaaaagatttgttt

SEQ ID NO: 696237 - DNA, 19 bp, Homo sapiens
attttaaaaagtcaattca

SEQ ID NO: 696238 - DNA, 22 bp, Homo sapiens
attttaaaaatacagatagata

SEQ ID NO: 696239 - DNA, 15 bp, Homo sapiens
attttaaaaatacat

SEQ ID NO: 696240 - DNA, 18 bp, Homo sapiens
attttaaaaatacatatc

SEQ ID NO: 696241 - DNA, 14 bp, Homo sapiens
attttaaaacattt

SEQ ID NO: 696242 - DNA, 14 bp, Homo sapiens
attttaaaagccac

SEQ ID NO: 696243 - DNA, 18 bp, Homo sapiens
attttaaaatatttaaac

SEQ ID NO: 696244 - DNA, 13 bp, Homo sapiens
attttaaaatcag

SEQ ID NO: 696245 - DNA, 20 bp, Homo sapiens
attttaaaatctcctaaatg

SEQ ID NO: 696246 - DNA, 19 bp, Homo sapiens
attttaaaatctgatttaa

SEQ ID NO: 696247 - DNA, 13 bp, Homo sapiens
attttaaaatgaa

SEQ ID NO: 696248 - DNA, 15 bp, Homo sapiens
attttaaaatgaata

SEQ ID NO: 696249 - DNA, 14 bp, Homo sapiens
attttaaaatttca

SEQ ID NO: 696250 - DNA, 16 bp, Homo sapiens
attttaaaatttcata

SEQ ID NO: 696251 - DNA, 21 bp, Homo sapiens
attttaaacaaaatagaaagt

SEQ ID NO: 696252 - DNA, 22 bp, Homo sapiens
attttaaacaaaggttgagatg

SEQ ID NO: 696253 - DNA, 13 bp, Homo sapiens
attttaaagaatt

SEQ ID NO: 696254 - DNA, 18 bp, Homo sapiens
attttaaagacccaactt

SEQ ID NO: 696255 - DNA, 18 bp, Homo sapiens
attttaaagccattctga

SEQ ID NO: 696256 - DNA, 22 bp, Homo sapiens
attttaaagttaaacattttta

SEQ ID NO: 696257 - DNA, 19 bp, Homo sapiens
atttcttcctaccaagtca

SEQ ID NO: 696258 - DNA, 20 bp, Homo sapiens
atttcttcctaccaagtcaa

SEQ ID NO: 696259 - DNA, 14 bp, Homo sapiens
atttcttcctctgc

SEQ ID NO: 696260 - DNA, 17 bp, Homo sapiens
atttcttcgtgaacata

SEQ ID NO: 696261 - DNA, 14 bp, Homo sapiens
atttcttctctctg

SEQ ID NO: 696262 - DNA, 13 bp, Homo sapiens
atttcttctctta

SEQ ID NO: 696263 - DNA, 22 bp, Homo sapiens
atttcttctcttatcctctctc

SEQ ID NO: 696264 - DNA, 22 bp, Homo sapiens
atttcttctctttagtataatt

SEQ ID NO: 696265 - DNA, 18 bp, Homo sapiens
atttcttcttctaagaag

SEQ ID NO: 696266 - DNA, 19 bp, Homo sapiens
atttcttcttctaagaaga

SEQ ID NO: 696267 - DNA, 21 bp, Homo sapiens
atttcttctttagatgccaaa

SEQ ID NO: 696268 - DNA, 13 bp, Homo sapiens
atttcttcttttc

SEQ ID NO: 696269 - DNA, 18 bp, Homo sapiens
atttcttcttttcctgca

SEQ ID NO: 696270 - DNA, 18 bp, Homo sapiens
atttcttgaaaagccttg

SEQ ID NO: 696271 - DNA, 20 bp, Homo sapiens
atttcttgaaaagccttgga

SEQ ID NO: 696272 - DNA, 20 bp, Homo sapiens
atttcttgaagaataaattc

SEQ ID NO: 696273 - DNA, 16 bp, Homo sapiens
atttcttggcaaattt

SEQ ID NO: 696274 - DNA, 22 bp, Homo sapiens
atttcttggcattggaattcta

SEQ ID NO: 696275 - DNA, 23 bp, Homo sapiens
atttcttggcattggaattctac

SEQ ID NO: 696276 - DNA, 14 bp, Homo sapiens
atttcttgggccct

SEQ ID NO: 696277 - DNA, 17 bp, Homo sapiens
atttcttgggccctcct

SEQ ID NO: 696278 - DNA, 19 bp, Homo sapiens
atttcttggtaagaagccg

SEQ ID NO: 696279 - DNA, 23 bp, Homo sapiens
atttcttggtattattctgtttt

SEQ ID NO: 696280 - DNA, 21 bp, Homo sapiens
atttcttgtagctaaaaataa

SEQ ID NO: 696281 - DNA, 18 bp, Homo sapiens
atttctttaaaagaatga

SEQ ID NO: 696282 - DNA, 21 bp, Homo sapiens
atttctttaaaagaatgacta

SEQ ID NO: 696283 - DNA, 11 bp, Homo sapiens
atttctttctt

SEQ ID NO: 696284 - DNA, 15 bp, Homo sapiens
atttctttcttccat

SEQ ID NO: 696285 - DNA, 23 bp, Homo sapiens
atttctttcttccattccttcat

SEQ ID NO: 696286 - DNA, 23 bp, Homo sapiens
atttctttctttgcaccaaagac

SEQ ID NO: 696287 - DNA, 20 bp, Homo sapiens
atttctttgatctggacaga

SEQ ID NO: 696288 - DNA, 17 bp, Homo sapiens
atttctttgtagaataa

SEQ ID NO: 696289 - DNA, 22 bp, Homo sapiens
atttctttgtagaataaatggt

SEQ ID NO: 696290 - DNA, 18 bp, Homo sapiens
atttctttgtctttttcc

SEQ ID NO: 696291 - DNA, 19 bp, Homo sapiens
atttctttgtctttttcct

SEQ ID NO: 696292 - DNA, 23 bp, Homo sapiens
atttctttgttatcaaacttcag

SEQ ID NO: 696293 - DNA, 11 bp, Homo sapiens
atttcttttac

SEQ ID NO: 696294 - DNA, 17 bp, Homo sapiens
atttcttttactctgtg

SEQ ID NO: 696295 - DNA, 20 bp, Homo sapiens
atttcttttactctgtgtaa

SEQ ID NO: 696296 - DNA, 13 bp, Homo sapiens
atttcttttcctt

SEQ ID NO: 696297 - DNA, 17 bp, Homo sapiens
atttcttttttatgtga

SEQ ID NO: 696298 - DNA, 22 bp, Homo sapiens
atttgaaaaaaacttcattctc

SEQ ID NO: 696299 - DNA, 16 bp, Homo sapiens
atttgaaaaaaagcat

SEQ ID NO: 696300 - DNA, 18 bp, Homo sapiens
atttgaaaatggttttga

SEQ ID NO: 696301 - DNA, 16 bp, Homo sapiens
atttgaaaatgtcctt

SEQ ID NO: 696302 - DNA, 12 bp, Homo sapiens
atttgaaaatta

SEQ ID NO: 696303 - DNA, 14 bp, Homo sapiens
atttgaaaattttg

SEQ ID NO: 696304 - DNA, 15 bp, Homo sapiens
atttgaaaattttga

SEQ ID NO: 696305 - DNA, 16 bp, Homo sapiens
atttgaaaattttgat

SEQ ID NO: 696306 - DNA, 16 bp, Homo sapiens
atttgaaataagaatt

SEQ ID NO: 696307 - DNA, 22 bp, Homo sapiens
atttgaacactggctaaagata

SEQ ID NO: 696308 - DNA, 16 bp, Homo sapiens
atttgaaggacctaaa

SEQ ID NO: 696309 - DNA, 13 bp, Homo sapiens
atttgaagtgtaa

SEQ ID NO: 696310 - DNA, 14 bp, Homo sapiens
atttgaataaatga

SEQ ID NO: 696311 - DNA, 18 bp, Homo sapiens
atttgaatctgagtgaat

SEQ ID NO: 696312 - DNA, 11 bp, Homo sapiens
atttgaatgaa

SEQ ID NO: 696313 - DNA, 13 bp, Homo sapiens
atttgaatgaaaa

SEQ ID NO: 696314 - DNA, 22 bp, Homo sapiens
atttgaatgatttttctttaca

SEQ ID NO: 696315 - DNA, 18 bp, Homo sapiens
atttgaattatcagcaaa

SEQ ID NO: 696316 - DNA, 23 bp, Homo sapiens
atttgaattatcagcaaagaaaa

SEQ ID NO: 696317 - DNA, 19 bp, Homo sapiens
atttgaattcttgatctct

SEQ ID NO: 696318 - DNA, 20 bp, Homo sapiens
atttgaattttaaatctaaa

SEQ ID NO: 696319 - DNA, 22 bp, Homo sapiens
atttgacacaaagcttctaaag

SEQ ID NO: 696320 - DNA, 19 bp, Homo sapiens
atttgaccattttagtttt

SEQ ID NO: 696321 - DNA, 12 bp, Homo sapiens
atttgactcttt

SEQ ID NO: 696322 - DNA, 15 bp, Homo sapiens
atttgactctttcaa

SEQ ID NO: 696323 - DNA, 17 bp, Homo sapiens
atttgactctttcaaag

SEQ ID NO: 696324 - DNA, 18 bp, Homo sapiens
atttgacttgcatgaaga

SEQ ID NO: 696325 - DNA, 19 bp, Homo sapiens
atttgacttgcatgaagag

SEQ ID NO: 696326 - DNA, 21 bp, Homo sapiens
atttgacttgcatgaagagaa

SEQ ID NO: 696327 - DNA, 13 bp, Homo sapiens
atttgacttgtgg

SEQ ID NO: 696328 - DNA, 15 bp, Homo sapiens
atttgacttttctgt

SEQ ID NO: 696329 - DNA, 16 bp, Homo sapiens
atttgacttttctgta

SEQ ID NO: 696330 - DNA, 19 bp, Homo sapiens
atttgagaagataatcatt

SEQ ID NO: 696331 - DNA, 23 bp, Homo sapiens
atttgagaatagacccttactag

SEQ ID NO: 696332 - DNA, 21 bp, Homo sapiens
atttgagaatataaaaaactt

SEQ ID NO: 696333 - DNA, 21 bp, Homo sapiens
atttgagactgaaatttagta

SEQ ID NO: 696334 - DNA, 14 bp, Homo sapiens
atttgagagaagcc

SEQ ID NO: 696335 - DNA, 22 bp, Homo sapiens
atttgagcatgcacagctgctt

SEQ ID NO: 696336 - DNA, 14 bp, Homo sapiens
atttgagcccagga

SEQ ID NO: 696337 - DNA, 16 bp, Homo sapiens
atttgaggagtgttaa

SEQ ID NO: 696338 - DNA, 18 bp, Homo sapiens
atttgagggcccagccag

SEQ ID NO: 696339 - DNA, 20 bp, Homo sapiens
atttgagggcccagccagga

SEQ ID NO: 696340 - DNA, 22 bp, Homo sapiens
atttgaggtcaagtaagaagac

SEQ ID NO: 696341 - DNA, 23 bp, Homo sapiens
atttgaggtctgttctttccaaa

SEQ ID NO: 696342 - DNA, 17 bp, Homo sapiens
atttgaggtgaaattca

SEQ ID NO: 696343 - DNA, 21 bp, Homo sapiens
atttgagtctcttaatagcca

SEQ ID NO: 696344 - DNA, 12 bp, Homo sapiens
atttgagtgttt

SEQ ID NO: 696345 - DNA, 15 bp, Homo sapiens
atttgatacataata

SEQ ID NO: 696346 - DNA, 23 bp, Homo sapiens
atttgatcgttccagttcccact

SEQ ID NO: 696347 - DNA, 13 bp, Homo sapiens
atttgatctttgt

SEQ ID NO: 696348 - DNA, 17 bp, Homo sapiens
atttgatctttgtttaa

SEQ ID NO: 696349 - DNA, 18 bp, Homo sapiens
atttgatctttgtttaaa

SEQ ID NO: 696350 - DNA, 15 bp, Homo sapiens
atttgatgaaagctg

SEQ ID NO: 696351 - DNA, 17 bp, Homo sapiens
atttgatgcgatctgct

SEQ ID NO: 696352 - DNA, 19 bp, Homo sapiens
atttgatggtatttctttc

SEQ ID NO: 696353 - DNA, 15 bp, Homo sapiens
atttgatgtgacttt

SEQ ID NO: 696354 - DNA, 18 bp, Homo sapiens
atttgattagcatattaa

SEQ ID NO: 696355 - DNA, 20 bp, Homo sapiens
atttgattcgccctcctccc

SEQ ID NO: 696356 - DNA, 23 bp, Homo sapiens
atttgattctgtgtgttttcata

SEQ ID NO: 696357 - DNA, 19 bp, Homo sapiens
atttgattgctttgctgca

SEQ ID NO: 696358 - DNA, 21 bp, Homo sapiens
atttgatttgttcatgaatat

SEQ ID NO: 696359 - DNA, 22 bp, Homo sapiens
atttgatttttctaaccttgaa

SEQ ID NO: 696360 - DNA, 18 bp, Homo sapiens
atttgcaaaccctttgta

SEQ ID NO: 696361 - DNA, 20 bp, Homo sapiens
atttgcaacaggggaggaaa

SEQ ID NO: 696362 - DNA, 21 bp, Homo sapiens
atttgcaacaggggaggaaaa

SEQ ID NO: 696363 - DNA, 22 bp, Homo sapiens
atttgcaacaggggaggaaaaa

SEQ ID NO: 696364 - DNA, 15 bp, Homo sapiens
atttgcaagggaaaa

SEQ ID NO: 696365 - DNA, 16 bp, Homo sapiens
atttgcaataacagct

SEQ ID NO: 696366 - DNA, 19 bp, Homo sapiens
atttgcaataacagctgca

SEQ ID NO: 696367 - DNA, 19 bp, Homo sapiens
atttgcaattcatgtaaca

SEQ ID NO: 696368 - DNA, 22 bp, Homo sapiens
atttgcaattcatgtaacagtt

SEQ ID NO: 696369 - DNA, 15 bp, Homo sapiens
atttgcacaatattt

SEQ ID NO: 696370 - DNA, 14 bp, Homo sapiens
atttgcacctctgt

SEQ ID NO: 696371 - DNA, 23 bp, Homo sapiens
atttgcacctctgttcatttcac

SEQ ID NO: 696372 - DNA, 20 bp, Homo sapiens
atttgcacggtttgtgagag

SEQ ID NO: 696373 - DNA, 23 bp, Homo sapiens
atttgcagataattctggaccag

SEQ ID NO: 696374 - DNA, 15 bp, Homo sapiens
atttgcatacttacc

SEQ ID NO: 696375 - DNA, 14 bp, Homo sapiens
atttgcatatttat

SEQ ID NO: 696376 - DNA, 17 bp, Homo sapiens
atttgcatatttattgc

SEQ ID NO: 696377 - DNA, 19 bp, Homo sapiens
atttgcatatttattgcat

SEQ ID NO: 696378 - DNA, 20 bp, Homo sapiens
atttgcatatttatttcaga

SEQ ID NO: 696379 - DNA, 21 bp, Homo sapiens
atttgcatatttatttcagat

SEQ ID NO: 696380 - DNA, 13 bp, Homo sapiens
atttgcatggatt

SEQ ID NO: 696381 - DNA, 13 bp, Homo sapiens
atttgcatgttat

SEQ ID NO: 696382 - DNA, 18 bp, Homo sapiens
atttgcattaaattcaca

SEQ ID NO: 696383 - DNA, 23 bp, Homo sapiens
atttgcattaaattcacaaactt

SEQ ID NO: 696384 - DNA, 15 bp, Homo sapiens
atttgcattgggcat

SEQ ID NO: 696385 - DNA, 21 bp, Homo sapiens
atttgcatttgtttatgtaat

SEQ ID NO: 696386 - DNA, 16 bp, Homo sapiens
atttgccagcacaggg

SEQ ID NO: 696387 - DNA, 23 bp, Homo sapiens
atttgccatgacatttcatctgg

SEQ ID NO: 696388 - DNA, 20 bp, Homo sapiens
atttgcctaattcctggcat

SEQ ID NO: 696389 - DNA, 16 bp, Homo sapiens
atttgcctccagtgca

SEQ ID NO: 696390 - DNA, 14 bp, Homo sapiens
atttgcctctgtcc

SEQ ID NO: 696391 - DNA, 15 bp, Homo sapiens
atttgccttgcagaa

SEQ ID NO: 696392 - DNA, 17 bp, Homo sapiens
atttgccttgcagaact

SEQ ID NO: 696393 - DNA, 23 bp, Homo sapiens
atttgccttgcagaactgccatt

SEQ ID NO: 696394 - DNA, 15 bp, Homo sapiens
atttgcgaatggttc

SEQ ID NO: 696395 - DNA, 17 bp, Homo sapiens
atttgctaagcatattt

SEQ ID NO: 696396 - DNA, 23 bp, Homo sapiens
atttgctaatcaaagccagggtc

SEQ ID NO: 696397 - DNA, 13 bp, Homo sapiens
atttgctaatttt

SEQ ID NO: 696398 - DNA, 17 bp, Homo sapiens
atttgctagttctgctg

SEQ ID NO: 696399 - DNA, 19 bp, Homo sapiens
atttgctagttctgctgcc

SEQ ID NO: 696400 - DNA, 15 bp, Homo sapiens
atttgctgaaaacat

SEQ ID NO: 696401 - DNA, 14 bp, Homo sapiens
atttgctgaactca

SEQ ID NO: 696402 - DNA, 16 bp, Homo sapiens
atttgctgaactcagc

SEQ ID NO: 696403 - DNA, 21 bp, Homo sapiens
atttgctgaactcagcacatt

SEQ ID NO: 696404 - DNA, 17 bp, Homo sapiens
atttgctgatttctagt

SEQ ID NO: 696405 - DNA, 14 bp, Homo sapiens
atttgctgcaaaga

SEQ ID NO: 696406 - DNA, 18 bp, Homo sapiens
atttgctgcaaagagaaa

SEQ ID NO: 696407 - DNA, 20 bp, Homo sapiens
atttgctgccaaatgcgtat

SEQ ID NO: 696408 - DNA, 23 bp, Homo sapiens
atttgctgggctttttttttctc

SEQ ID NO: 696409 - DNA, 14 bp, Homo sapiens
atttgctgtgacta

SEQ ID NO: 696410 - DNA, 13 bp, Homo sapiens
atttgctgttgat

SEQ ID NO: 696411 - DNA, 14 bp, Homo sapiens
atttgcttcattgt

SEQ ID NO: 696412 - DNA, 22 bp, Homo sapiens
atttgcttgcaatctaatctga

SEQ ID NO: 696413 - DNA, 13 bp, Homo sapiens
atttgctttggaa

SEQ ID NO: 696414 - DNA, 15 bp, Homo sapiens
atttgctttggaagt

SEQ ID NO: 696415 - DNA, 11 bp, Homo sapiens
atttgcttttt

SEQ ID NO: 696416 - DNA, 18 bp, Homo sapiens
atttgctttttcaccaga

SEQ ID NO: 696417 - DNA, 12 bp, Homo sapiens
atttggaaatcc

SEQ ID NO: 696418 - DNA, 21 bp, Homo sapiens
atttggaaatcctagtttcct

SEQ ID NO: 696419 - DNA, 21 bp, Homo sapiens
atttggaaccaaagtctaaac

SEQ ID NO: 696420 - DNA, 17 bp, Homo sapiens
atttggaaccttgtttt

SEQ ID NO: 696421 - DNA, 16 bp, Homo sapiens
atttggaagagaggca

SEQ ID NO: 696422 - DNA, 14 bp, Homo sapiens
atttggaatacttt

SEQ ID NO: 696423 - DNA, 15 bp, Homo sapiens
atttggaatactttt

SEQ ID NO: 696424 - DNA, 11 bp, Homo sapiens
atttggaatag

SEQ ID NO: 696425 - DNA, 17 bp, Homo sapiens
atttggaatatttgaat

SEQ ID NO: 696426 - DNA, 20 bp, Homo sapiens
atttggagcctgccaagagg

SEQ ID NO: 696427 - DNA, 20 bp, Homo sapiens
atttggagttaggtcctcac

SEQ ID NO: 696428 - DNA, 20 bp, Homo sapiens
atttggataataaaaattgt

SEQ ID NO: 696429 - DNA, 14 bp, Homo sapiens
atttggatatttgg

SEQ ID NO: 696430 - DNA, 18 bp, Homo sapiens
atttggatgattgtcata

SEQ ID NO: 696431 - DNA, 18 bp, Homo sapiens
atttggcatgggacagac

SEQ ID NO: 696432 - DNA, 19 bp, Homo sapiens
atttggccccaggggacgt

SEQ ID NO: 696433 - DNA, 17 bp, Homo sapiens
atttggccttaagaact

SEQ ID NO: 696434 - DNA, 20 bp, Homo sapiens
atttggctgggctacaattt

SEQ ID NO: 696435 - DNA, 20 bp, Homo sapiens
atttggcttgctgtttactc

SEQ ID NO: 696436 - DNA, 17 bp, Homo sapiens
atttgggagggaaaagg

SEQ ID NO: 696437 - DNA, 21 bp, Homo sapiens
atttgggcttggaccagatct

SEQ ID NO: 696438 - DNA, 17 bp, Homo sapiens
atttgggttactatttc

SEQ ID NO: 696439 - DNA, 19 bp, Homo sapiens
atttggtaaaaatgctgct

SEQ ID NO: 696440 - DNA, 12 bp, Homo sapiens
atttggtacttt

SEQ ID NO: 696441 - DNA, 17 bp, Homo sapiens
atttggtccaaaaaaag

SEQ ID NO: 696442 - DNA, 22 bp, Homo sapiens
atttggtccaaaaaaaggaaaa

SEQ ID NO: 696443 - DNA, 23 bp, Homo sapiens
atttggtctcaggcagcaccaca

SEQ ID NO: 696444 - DNA, 20 bp, Homo sapiens
atttggtctgccagaatact

SEQ ID NO: 696445 - DNA, 20 bp, Homo sapiens
atttggtggtttcagaaatg

SEQ ID NO: 696446 - DNA, 21 bp, Homo sapiens
atttggtggtttcagaaatgt

SEQ ID NO: 696447 - DNA, 20 bp, Homo sapiens
atttggtgtaggtaggtctg

SEQ ID NO: 696448 - DNA, 19 bp, Homo sapiens
atttggtgttcctggaagc

SEQ ID NO: 696449 - DNA, 15 bp, Homo sapiens
atttggttatggtta

SEQ ID NO: 696450 - DNA, 21 bp, Homo sapiens
atttggttcattaattctata

SEQ ID NO: 696451 - DNA, 22 bp, Homo sapiens
atttgtaaaaacagcattgctt

SEQ ID NO: 696452 - DNA, 20 bp, Homo sapiens
atttgtaaaaatgagacttt

SEQ ID NO: 696453 - DNA, 22 bp, Homo sapiens
atttgtaaaaatgagacttttt

SEQ ID NO: 696454 - DNA, 18 bp, Homo sapiens
atttgtaaacttctgaag

SEQ ID NO: 696455 - DNA, 11 bp, Homo sapiens
atttgtaaatg

SEQ ID NO: 696456 - DNA, 16 bp, Homo sapiens
caaagtgcaaggacct

SEQ ID NO: 696457 - DNA, 16 bp, Homo sapiens
caaagtgcagcccttc

SEQ ID NO: 696458 - DNA, 17 bp, Homo sapiens
caaagtgcagcccttcc

SEQ ID NO: 696459 - DNA, 22 bp, Homo sapiens
caaagtgcagcccttcctcctg

SEQ ID NO: 696460 - DNA, 22 bp, Homo sapiens
caaagtgctgagattgcagatg

SEQ ID NO: 696461 - DNA, 11 bp, Homo sapiens
caaagtgctgg

SEQ ID NO: 696462 - DNA, 14 bp, Homo sapiens
caaagtgctgtacc

SEQ ID NO: 696463 - DNA, 21 bp, Homo sapiens
caaagtgctgtacccttccac

SEQ ID NO: 696464 - DNA, 11 bp, Homo sapiens
caaagtggaac

SEQ ID NO: 696465 - DNA, 23 bp, Homo sapiens
caaagtggtacaggaaggcttgc

SEQ ID NO: 696466 - DNA, 19 bp, Homo sapiens
caaagtggtatagaaatgc

SEQ ID NO: 696467 - DNA, 20 bp, Homo sapiens
caaagtgtatatttattcat

SEQ ID NO: 696468 - DNA, 19 bp, Homo sapiens
caaagtgtcttttgacatt

SEQ ID NO: 696469 - DNA, 19 bp, Homo sapiens
caaagtgttgtgttcctgg

SEQ ID NO: 696470 - DNA, 21 bp, Homo sapiens
caaagtgttttctcagaacag

SEQ ID NO: 696471 - DNA, 15 bp, Homo sapiens
caaagtgttttctct

SEQ ID NO: 696472 - DNA, 18 bp, Homo sapiens
caaagtgttttctctgaa

SEQ ID NO: 696473 - DNA, 16 bp, Homo sapiens
caaagttaacagattt

SEQ ID NO: 696474 - DNA, 19 bp, Homo sapiens
caaagttaatgggatggtc

SEQ ID NO: 696475 - DNA, 16 bp, Homo sapiens
caaagttactaggtaa

SEQ ID NO: 696476 - DNA, 24 bp, Homo sapiens
caaagttagagaactaaactagtt

SEQ ID NO: 696477 - DNA, 14 bp, Homo sapiens
caaagttcaacttg

SEQ ID NO: 696478 - DNA, 19 bp, Homo sapiens
caaagttcccactccttca

SEQ ID NO: 696479 - DNA, 21 bp, Homo sapiens
caaagttccctacttcctgtg

SEQ ID NO: 696480 - DNA, 13 bp, Homo sapiens
caaagtttaataa

SEQ ID NO: 696481 - DNA, 14 bp, Homo sapiens
caaagtttctgttg

SEQ ID NO: 696482 - DNA, 16 bp, Homo sapiens
caaagttttacagaga

SEQ ID NO: 696483 - DNA, 14 bp, Homo sapiens
caaagttttcaaac

SEQ ID NO: 696484 - DNA, 18 bp, Homo sapiens
caaagttttcaaactgct

SEQ ID NO: 696485 - DNA, 18 bp, Homo sapiens
caaataaaaaacagaaac

SEQ ID NO: 696486 - DNA, 14 bp, Homo sapiens
caaataaaacccaa

SEQ ID NO: 696487 - DNA, 20 bp, Homo sapiens
caaataaaacccaatacttt

SEQ ID NO: 696488 - DNA, 14 bp, Homo sapiens
caaataaaattggc

SEQ ID NO: 696489 - DNA, 16 bp, Homo sapiens
caaataaacagttgtt

SEQ ID NO: 696490 - DNA, 17 bp, Homo sapiens
caaataaacagttgtta

SEQ ID NO: 696491 - DNA, 19 bp, Homo sapiens
caaataaacagttgttact

SEQ ID NO: 696492 - DNA, 18 bp, Homo sapiens
caaataaactctaaacat

SEQ ID NO: 696493 - DNA, 14 bp, Homo sapiens
caaataaagaaatt

SEQ ID NO: 696494 - DNA, 12 bp, Homo sapiens
caaataaagcct

SEQ ID NO: 696495 - DNA, 16 bp, Homo sapiens
caaataaagcctttta

SEQ ID NO: 696496 - DNA, 15 bp, Homo sapiens
caaataaatgattat

SEQ ID NO: 696497 - DNA, 24 bp, Homo sapiens
caaataatccattccaaaatacaa

SEQ ID NO: 696498 - DNA, 22 bp, Homo sapiens
caaataatgatcgaaaaaataa

SEQ ID NO: 696499 - DNA, 12 bp, Homo sapiens
caaataatttca

SEQ ID NO: 696500 - DNA, 20 bp, Homo sapiens
caaatacaaagtggaaactt

SEQ ID NO: 696501 - DNA, 12 bp, Homo sapiens
caaatacctcaa

SEQ ID NO: 696502 - DNA, 13 bp, Homo sapiens
caaatacctcaat

SEQ ID NO: 696503 - DNA, 18 bp, Homo sapiens
caaatactgtatattcag

SEQ ID NO: 696504 - DNA, 16 bp, Homo sapiens
caaatactttaaagga

SEQ ID NO: 696505 - DNA, 19 bp, Homo sapiens
caaatagattaatgacgta

SEQ ID NO: 696506 - DNA, 23 bp, Homo sapiens
caaatagatttttgattcagctc

SEQ ID NO: 696507 - DNA, 15 bp, Homo sapiens
caaatagcataagtt

SEQ ID NO: 696508 - DNA, 17 bp, Homo sapiens
caaatagccccagactg

SEQ ID NO: 696509 - DNA, 18 bp, Homo sapiens
caaatagccccagactgg

SEQ ID NO: 696510 - DNA, 23 bp, Homo sapiens
caaataggagggagactgtggta

SEQ ID NO: 696511 - DNA, 11 bp, Homo sapiens
caaataggtag

SEQ ID NO: 696512 - DNA, 20 bp, Homo sapiens
caaataggtagagtcattca

SEQ ID NO: 696513 - DNA, 20 bp, Homo sapiens
caaatagtttataaatgtga

SEQ ID NO: 696514 - DNA, 23 bp, Homo sapiens
caaatataagacatttgtttgct

SEQ ID NO: 696515 - DNA, 21 bp, Homo sapiens
caaatatacattttctaaata

SEQ ID NO: 696516 - DNA, 23 bp, Homo sapiens
caaatatacattttctaaataaa

SEQ ID NO: 696517 - DNA, 23 bp, Homo sapiens
caaatatagaaagttgatattca

SEQ ID NO: 696518 - DNA, 13 bp, Homo sapiens
caaatatgcactt

SEQ ID NO: 696519 - DNA, 22 bp, Homo sapiens
caaatatgcactttccctagaa

SEQ ID NO: 696520 - DNA, 17 bp, Homo sapiens
caaatatgtattttcct

SEQ ID NO: 696521 - DNA, 15 bp, Homo sapiens
caaatattaaagatt

SEQ ID NO: 696522 - DNA, 22 bp, Homo sapiens
caaatattaaagattctcttta

SEQ ID NO: 696523 - DNA, 17 bp, Homo sapiens
caaatattagcaaagaa

SEQ ID NO: 696524 - DNA, 14 bp, Homo sapiens
caaatattattcaa

SEQ ID NO: 696525 - DNA, 12 bp, Homo sapiens
caaatattattt

SEQ ID NO: 696526 - DNA, 13 bp, Homo sapiens
caaatattgaagt

SEQ ID NO: 696527 - DNA, 18 bp, Homo sapiens
caaatattgaagttgttt

SEQ ID NO: 696528 - DNA, 23 bp, Homo sapiens
caaatattgaagttgtttatcaa

SEQ ID NO: 696529 - DNA, 23 bp, Homo sapiens
caaatatttagatgtaattttgt

SEQ ID NO: 696530 - DNA, 20 bp, Homo sapiens
caaatatttattttctttct

SEQ ID NO: 696531 - DNA, 13 bp, Homo sapiens
caaatatttggag

SEQ ID NO: 696532 - DNA, 17 bp, Homo sapiens
caaatattttagaagct

SEQ ID NO: 696533 - DNA, 16 bp, Homo sapiens
caaatcaaagcaaggg

SEQ ID NO: 696534 - DNA, 17 bp, Homo sapiens
caaatcaataagaaggt

SEQ ID NO: 696535 - DNA, 17 bp, Homo sapiens
caaatcacacctctggg

SEQ ID NO: 696536 - DNA, 18 bp, Homo sapiens
caaatcacatattttaaa

SEQ ID NO: 696537 - DNA, 22 bp, Homo sapiens
caaatcagaagtcatcttgcta

SEQ ID NO: 696538 - DNA, 13 bp, Homo sapiens
caaatcagctgct

SEQ ID NO: 696539 - DNA, 17 bp, Homo sapiens
caaatcagctgctacta

SEQ ID NO: 696540 - DNA, 13 bp, Homo sapiens
caaatcaggcttt

SEQ ID NO: 696541 - DNA, 16 bp, Homo sapiens
caaatcaggcttttgt

SEQ ID NO: 696542 - DNA, 23 bp, Homo sapiens
caaatcaggttttcttttaagaa

SEQ ID NO: 696543 - DNA, 18 bp, Homo sapiens
caaatcagtcttccttgt

SEQ ID NO: 696544 - DNA, 17 bp, Homo sapiens
caaatcagtgatctatg

SEQ ID NO: 696545 - DNA, 21 bp, Homo sapiens
caaatcagttactaagaagaa

SEQ ID NO: 696546 - DNA, 16 bp, Homo sapiens
caaatcagttagtttt

SEQ ID NO: 696547 - DNA, 20 bp, Homo sapiens
caaatcatctgcattcctga

SEQ ID NO: 696548 - DNA, 18 bp, Homo sapiens
caaatcattccttagata

SEQ ID NO: 696549 - DNA, 13 bp, Homo sapiens
caaatcatttgtt

SEQ ID NO: 696550 - DNA, 16 bp, Homo sapiens
caaatcatttgtttaa

SEQ ID NO: 696551 - DNA, 20 bp, Homo sapiens
caaatcccaaaccattactg

SEQ ID NO: 696552 - DNA, 14 bp, Homo sapiens
aacagctgaaagag

SEQ ID NO: 696553 - DNA, 19 bp, Homo sapiens
aacagctgaggtctcttga

SEQ ID NO: 696554 - DNA, 20 bp, Homo sapiens
aacagctgaggtctcttgag

SEQ ID NO: 696555 - DNA, 21 bp, Homo sapiens
aacagctgcaattccctggat

SEQ ID NO: 696556 - DNA, 16 bp, Homo sapiens
aacagctgcattagaa

SEQ ID NO: 696557 - DNA, 19 bp, Homo sapiens
aacagctgcttctcccccc

SEQ ID NO: 696558 - DNA, 23 bp, Homo sapiens
aacagctgtgagccatgcctccc

SEQ ID NO: 696559 - DNA, 11 bp, Homo sapiens
aacagctgtgt

SEQ ID NO: 696560 - DNA, 13 bp, Homo sapiens
aacagctgtgtct

SEQ ID NO: 696561 - DNA, 23 bp, Homo sapiens
aacagctgtgtctgccaaacaca

SEQ ID NO: 696562 - DNA, 17 bp, Homo sapiens
aacagctgttcctgtgt

SEQ ID NO: 696563 - DNA, 18 bp, Homo sapiens
aacagctgttcctgtgtt

SEQ ID NO: 696564 - DNA, 20 bp, Homo sapiens
aacagcttcatgcctttgta

SEQ ID NO: 696565 - DNA, 13 bp, Homo sapiens
aacagcttgctgt

SEQ ID NO: 696566 - DNA, 16 bp, Homo sapiens
aacaggaaaaaaactt

SEQ ID NO: 696567 - DNA, 13 bp, Homo sapiens
aacaggacagcac

SEQ ID NO: 696568 - DNA, 20 bp, Homo sapiens
aacaggaccacaaaaatgaa

SEQ ID NO: 696569 - DNA, 13 bp, Homo sapiens
aacaggagagaga

SEQ ID NO: 696570 - DNA, 20 bp, Homo sapiens
aacaggatcagttaactatt

SEQ ID NO: 696571 - DNA, 20 bp, Homo sapiens
aacaggattacagtgtagct

SEQ ID NO: 696572 - DNA, 12 bp, Homo sapiens
aacaggcccagc

SEQ ID NO: 696573 - DNA, 20 bp, Homo sapiens
aacaggccccacgccctctc

SEQ ID NO: 696574 - DNA, 18 bp, Homo sapiens
aacaggctactctcctcg

SEQ ID NO: 696575 - DNA, 20 bp, Homo sapiens
aacaggctcaatattcctga

SEQ ID NO: 696576 - DNA, 20 bp, Homo sapiens
aacaggctccaagaggctga

SEQ ID NO: 696577 - DNA, 22 bp, Homo sapiens
aacaggctccaagaggctgagg

SEQ ID NO: 696578 - DNA, 17 bp, Homo sapiens
aacagggcccaggcctg

SEQ ID NO: 696579 - DNA, 18 bp, Homo sapiens
aacagggcccaggcctgg

SEQ ID NO: 696580 - DNA, 14 bp, Homo sapiens
aacagggctgcctt

SEQ ID NO: 696581 - DNA, 16 bp, Homo sapiens
aacaggggaggaaaaa

SEQ ID NO: 696582 - DNA, 22 bp, Homo sapiens
aacaggtatttttttaaatcaa

SEQ ID NO: 696583 - DNA, 17 bp, Homo sapiens
aacaggtctcctcttaa

SEQ ID NO: 696584 - DNA, 20 bp, Homo sapiens
aacaggtctcctcttaaaaa

SEQ ID NO: 696585 - DNA, 12 bp, Homo sapiens
aacaggtgggct

SEQ ID NO: 696586 - DNA, 13 bp, Homo sapiens
aacaggtgtgtgt

SEQ ID NO: 696587 - DNA, 17 bp, Homo sapiens
aacaggttcctgtggag

SEQ ID NO: 696588 - DNA, 16 bp, Homo sapiens
aacaggttttataatt

SEQ ID NO: 696589 - DNA, 15 bp, Homo sapiens
aacagtaaaccactg

SEQ ID NO: 696590 - DNA, 23 bp, Homo sapiens
aacagtaaaccactgaaaaaata

SEQ ID NO: 696591 - DNA, 19 bp, Homo sapiens
aacagtaaagaaagcagaa

SEQ ID NO: 696592 - DNA, 17 bp, Homo sapiens
aacagtaatctatgtgt

SEQ ID NO: 696593 - DNA, 17 bp, Homo sapiens
aacagtaggattgctgt

SEQ ID NO: 696594 - DNA, 21 bp, Homo sapiens
aacagtattctgtaaagctta

SEQ ID NO: 696595 - DNA, 22 bp, Homo sapiens
aacagtatttcattgcctgtgt

SEQ ID NO: 696596 - DNA, 17 bp, Homo sapiens
aacagtcaaaacagaga

SEQ ID NO: 696597 - DNA, 23 bp, Homo sapiens
aacagtcaaatatcatttactct

SEQ ID NO: 696598 - DNA, 12 bp, Homo sapiens
aacagtcaagaa

SEQ ID NO: 696599 - DNA, 13 bp, Homo sapiens
aacagtccttgct

SEQ ID NO: 696600 - DNA, 17 bp, Homo sapiens
aacagtctaaaaattga

SEQ ID NO: 696601 - DNA, 21 bp, Homo sapiens
aacagtcttactctgtctccc

SEQ ID NO: 696602 - DNA, 17 bp, Homo sapiens
aacagtcttcaggcaaa

SEQ ID NO: 696603 - DNA, 20 bp, Homo sapiens
aacagtgagcatatctggta

SEQ ID NO: 696604 - DNA, 15 bp, Homo sapiens
aacagtgcctgctga

SEQ ID NO: 696605 - DNA, 15 bp, Homo sapiens
aacagtgctgtttcc

SEQ ID NO: 696606 - DNA, 13 bp, Homo sapiens
aacagtgtttaaa

SEQ ID NO: 696607 - DNA, 23 bp, Homo sapiens
aacagtgtttcccataattttct

SEQ ID NO: 696608 - DNA, 20 bp, Homo sapiens
aacagttaactttcagaaga

SEQ ID NO: 696609 - DNA, 19 bp, Homo sapiens
aacagttaataccattttt

SEQ ID NO: 696610 - DNA, 16 bp, Homo sapiens
aacagttagctggagc

SEQ ID NO: 696611 - DNA, 15 bp, Homo sapiens
aacagttatattttt

SEQ ID NO: 696612 - DNA, 23 bp, Homo sapiens
aacagttcatgtttgcttcataa

SEQ ID NO: 696613 - DNA, 18 bp, Homo sapiens
aacagttctgagctgtaa

SEQ ID NO: 696614 - DNA, 21 bp, Homo sapiens
aacagttctgagctgtaattt

SEQ ID NO: 696615 - DNA, 21 bp, Homo sapiens
aacagttgcatgtagtaacac

SEQ ID NO: 696616 - DNA, 22 bp, Homo sapiens
aacagttgcatgtagtaacact

SEQ ID NO: 696617 - DNA, 14 bp, Homo sapiens
aacagttggtaact

SEQ ID NO: 696618 - DNA, 20 bp, Homo sapiens
caaaactccgcccccagcct

SEQ ID NO: 696619 - DNA, 16 bp, Homo sapiens
caaaactcctgtcttt

SEQ ID NO: 696620 - DNA, 11 bp, Homo sapiens
caaaactctac

SEQ ID NO: 696621 - DNA, 19 bp, Homo sapiens
caaaactctacttaatcca

SEQ ID NO: 696622 - DNA, 22 bp, Homo sapiens
caaaactgcctcaggaggcagg

SEQ ID NO: 696623 - DNA, 12 bp, Homo sapiens
caaaactgctcc

SEQ ID NO: 696624 - DNA, 16 bp, Homo sapiens
caaaactgtaaataaa

SEQ ID NO: 696625 - DNA, 20 bp, Homo sapiens
caaaactgtaaataaaatgt

SEQ ID NO: 696626 - DNA, 13 bp, Homo sapiens
caaaactgttctt

SEQ ID NO: 696627 - DNA, 15 bp, Homo sapiens
caaaactgttctttt

SEQ ID NO: 696628 - DNA, 19 bp, Homo sapiens
caaaacttccaaggccctg

SEQ ID NO: 696629 - DNA, 13 bp, Homo sapiens
caaaacttctctt

SEQ ID NO: 696630 - DNA, 21 bp, Homo sapiens
caaaacttctcttgaaaagtt

SEQ ID NO: 696631 - DNA, 12 bp, Homo sapiens
caaaacttgaaa

SEQ ID NO: 696632 - DNA, 18 bp, Homo sapiens
caaaagaaaccatgacaa

SEQ ID NO: 696633 - DNA, 13 bp, Homo sapiens
caaaagaaactta

SEQ ID NO: 696634 - DNA, 22 bp, Homo sapiens
caaaagaaacttaccaattgat

SEQ ID NO: 696635 - DNA, 21 bp, Homo sapiens
caaaagaaatttaagttctat

SEQ ID NO: 696636 - DNA, 19 bp, Homo sapiens
caaaagaacaagaatttct

SEQ ID NO: 696637 - DNA, 15 bp, Homo sapiens
caaaagaagaagttt

SEQ ID NO: 696638 - DNA, 19 bp, Homo sapiens
caaaagaagttgtagtgtt

SEQ ID NO: 696639 - DNA, 19 bp, Homo sapiens
caaaagaatcagaaacagg

SEQ ID NO: 696640 - DNA, 19 bp, Homo sapiens
caaaagaatctattagatt

SEQ ID NO: 696641 - DNA, 19 bp, Homo sapiens
caaaagaatggcagaaaag

SEQ ID NO: 696642 - DNA, 21 bp, Homo sapiens
caaaagacaaaaatcaaagaa

SEQ ID NO: 696643 - DNA, 16 bp, Homo sapiens
caaaagactggtttgt

SEQ ID NO: 696644 - DNA, 20 bp, Homo sapiens
caaaagactggtttgtttgc

SEQ ID NO: 696645 - DNA, 23 bp, Homo sapiens
caaaagactggtttgtttgctta

SEQ ID NO: 696646 - DNA, 14 bp, Homo sapiens
caaaagagccctgg

SEQ ID NO: 696647 - DNA, 23 bp, Homo sapiens
caaaagagccctggctctgcccc

SEQ ID NO: 696648 - DNA, 18 bp, Homo sapiens
caaaagagctactcagaa

SEQ ID NO: 696649 - DNA, 14 bp, Homo sapiens
caaaagagggttta

SEQ ID NO: 696650 - DNA, 19 bp, Homo sapiens
caaaagaggtgtcatgctt

SEQ ID NO: 696651 - DNA, 23 bp, Homo sapiens
caaaagaggtgtcatgctttggg

SEQ ID NO: 696652 - DNA, 19 bp, Homo sapiens
caaaagatgctcttctgtg

SEQ ID NO: 696653 - DNA, 18 bp, Homo sapiens
caaaagatgcttctcact

SEQ ID NO: 696654 - DNA, 18 bp, Homo sapiens
caaaagattaatctttaa

SEQ ID NO: 696655 - DNA, 20 bp, Homo sapiens
caaaagattgctgaaatttt

SEQ ID NO: 696656 - DNA, 23 bp, Homo sapiens
caaaagattggagctgaagacct

SEQ ID NO: 696657 - DNA, 21 bp, Homo sapiens
caaaagcaaaacatctctgca

SEQ ID NO: 696658 - DNA, 23 bp, Homo sapiens
caaaagcaaaacatctctgcagt

SEQ ID NO: 696659 - DNA, 14 bp, Homo sapiens
caaaagcaagactg

SEQ ID NO: 696660 - DNA, 23 bp, Homo sapiens
caaaagcaagactgttgctcaaa

SEQ ID NO: 696661 - DNA, 23 bp, Homo sapiens
caaaagccatgtatttcagggac

SEQ ID NO: 696662 - DNA, 11 bp, Homo sapiens
caaaagcctgg

SEQ ID NO: 696663 - DNA, 21 bp, Homo sapiens
caaaagcgccctcactattct

SEQ ID NO: 696664 - DNA, 12 bp, Homo sapiens
caaaagctgctc

SEQ ID NO: 696665 - DNA, 19 bp, Homo sapiens
caaaagctgggcaggttgg

SEQ ID NO: 696666 - DNA, 17 bp, Homo sapiens
caaaagctgtaaattac

SEQ ID NO: 696667 - DNA, 11 bp, Homo sapiens
caaaaggaaag

SEQ ID NO: 696668 - DNA, 20 bp, Homo sapiens
caaaaggaaagctgtgttta

SEQ ID NO: 696669 - DNA, 24 bp, Homo sapiens
caaaaggatctttgtggccaagga

SEQ ID NO: 696670 - DNA, 11 bp, Homo sapiens
caaaaggcagc

SEQ ID NO: 696671 - DNA, 22 bp, Homo sapiens
caaaaggcagctcacccctggg

SEQ ID NO: 696672 - DNA, 23 bp, Homo sapiens
caaaaggcagctcacccctgggc

SEQ ID NO: 696673 - DNA, 22 bp, Homo sapiens
caaaaggcctcttgtaaagact

SEQ ID NO: 696674 - DNA, 23 bp, Homo sapiens
caaaaggcctcttgtaaagactg

SEQ ID NO: 696675 - DNA, 18 bp, Homo sapiens
caaaaggctgattactga

SEQ ID NO: 696676 - DNA, 15 bp, Homo sapiens
caaaagggccaggtg

SEQ ID NO: 696677 - DNA, 18 bp, Homo sapiens
caaaagggttcatagaaa

SEQ ID NO: 696678 - DNA, 20 bp, Homo sapiens
caaaagggtttaaactgatt

SEQ ID NO: 696679 - DNA, 13 bp, Homo sapiens
caaaaggtgcctg

SEQ ID NO: 696680 - DNA, 15 bp, Homo sapiens
caaaaggtgcctgtg

SEQ ID NO: 696681 - DNA, 19 bp, Homo sapiens
caaaaggttcactaaagca

SEQ ID NO: 696682 - DNA, 15 bp, Homo sapiens
caaaagtacattgct

SEQ ID NO: 696683 - DNA, 17 bp, Homo sapiens
caaaagtacattgctta

SEQ ID NO: 696684 - DNA, 19 bp, Homo sapiens
caaaagtcaaaaggtgcct

SEQ ID NO: 696685 - DNA, 14 bp, Homo sapiens
caaaagtccctccc

SEQ ID NO: 696686 - DNA, 16 bp, Homo sapiens
caaaagtccctccctg

SEQ ID NO: 696687 - DNA, 14 bp, Homo sapiens
caaaagtctatttt

SEQ ID NO: 696688 - DNA, 19 bp, Homo sapiens
caaaagtctgtctttcctg

SEQ ID NO: 696689 - DNA, 21 bp, Homo sapiens
caaaagtggggctaaatgaag

SEQ ID NO: 696690 - DNA, 19 bp, Homo sapiens
caaaagttacatgtttgca

SEQ ID NO: 696691 - DNA, 18 bp, Homo sapiens
caaaagtttgtttgctta

SEQ ID NO: 696692 - DNA, 17 bp, Homo sapiens
caaaagttttcctgaga

SEQ ID NO: 696693 - DNA, 18 bp, Homo sapiens
caaaataaaaagcctcag

SEQ ID NO: 696694 - DNA, 21 bp, Homo sapiens
caaaataaaaagtgacacagc

SEQ ID NO: 696695 - DNA, 22 bp, Homo sapiens
caaaataaaaagtgacacagca

SEQ ID NO: 696696 - DNA, 15 bp, Homo sapiens
caaaataaaacatag

SEQ ID NO: 696697 - DNA, 17 bp, Homo sapiens
caaaataaaacatagca

SEQ ID NO: 696698 - DNA, 16 bp, Homo sapiens
caaaataaaacttttt

SEQ ID NO: 696699 - DNA, 20 bp, Homo sapiens
caaaataaaactttttaaaa

SEQ ID NO: 696700 - DNA, 12 bp, Homo sapiens
caaaataaagaa

SEQ ID NO: 696701 - DNA, 19 bp, Homo sapiens
caaaataaggatgacttta

SEQ ID NO: 696702 - DNA, 23 bp, Homo sapiens
caaaataaggatgactttagaat

SEQ ID NO: 696703 - DNA, 21 bp, Homo sapiens
caaaataatctatattaaatg

SEQ ID NO: 696704 - DNA, 11 bp, Homo sapiens
caaaataattc

SEQ ID NO: 696705 - DNA, 12 bp, Homo sapiens
caaaatacaatc

SEQ ID NO: 696706 - DNA, 16 bp, Homo sapiens
caaaatacaatgttat

SEQ ID NO: 696707 - DNA, 16 bp, Homo sapiens
caaaatacacgtttat

SEQ ID NO: 696708 - DNA, 20 bp, Homo sapiens
caaaatacacgtttatctta

SEQ ID NO: 696709 - DNA, 16 bp, Homo sapiens
caaaatacatttgtaa

SEQ ID NO: 696710 - DNA, 15 bp, Homo sapiens
caaaataccacccta

SEQ ID NO: 696711 - DNA, 19 bp, Homo sapiens
caaaatactgggattacag

SEQ ID NO: 696712 - DNA, 12 bp, Homo sapiens
caaaatagaaag

SEQ ID NO: 696713 - DNA, 13 bp, Homo sapiens
caaaatagagaat

SEQ ID NO: 696714 - DNA, 23 bp, Homo sapiens
caaaatatatttatcttcttcac

SEQ ID NO: 696715 - DNA, 14 bp, Homo sapiens
caaaatatgttctt

SEQ ID NO: 696716 - DNA, 16 bp, Homo sapiens
caaaatatgtttaaaa

SEQ ID NO: 696717 - DNA, 13 bp, Homo sapiens
caaaatattaaca

SEQ ID NO: 696718 - DNA, 12 bp, Homo sapiens
caaaatatttaa

SEQ ID NO: 696719 - DNA, 19 bp, Homo sapiens
caaaatatttaaaaatgtc

SEQ ID NO: 696720 - DNA, 20 bp, Homo sapiens
caaaatatttaaaaatgtct

SEQ ID NO: 696721 - DNA, 16 bp, Homo sapiens
caaaatatttaagtga

SEQ ID NO: 696722 - DNA, 18 bp, Homo sapiens
caaaatatttaagtgaag

SEQ ID NO: 696723 - DNA, 19 bp, Homo sapiens
caaaatatttaagtgaagg

SEQ ID NO: 696724 - DNA, 15 bp, Homo sapiens
caaaatatttcccat

SEQ ID NO: 696725 - DNA, 16 bp, Homo sapiens
caaaatcaattaaaat

SEQ ID NO: 696726 - DNA, 19 bp, Homo sapiens
caaaatcaggaaaggctgt

SEQ ID NO: 696727 - DNA, 16 bp, Homo sapiens
caaaatcattttaatg

SEQ ID NO: 696728 - DNA, 19 bp, Homo sapiens
caaaatcattttatatgtc

SEQ ID NO: 696729 - DNA, 22 bp, Homo sapiens
caaaatccatgtgaccattctg

SEQ ID NO: 696730 - DNA, 12 bp, Homo sapiens
caaaatcccctc

SEQ ID NO: 696731 - DNA, 14 bp, Homo sapiens
caaaatcccctcag

SEQ ID NO: 696732 - DNA, 20 bp, Homo sapiens
caaaatcctgaactttctcc

SEQ ID NO: 696733 - DNA, 18 bp, Homo sapiens
caaaatcgattggcttta

SEQ ID NO: 696734 - DNA, 18 bp, Homo sapiens
caaaatctgaactctcaa

SEQ ID NO: 696735 - DNA, 12 bp, Homo sapiens
acctgcagagaa

SEQ ID NO: 696736 - DNA, 13 bp, Homo sapiens
acctgcagagaaa

SEQ ID NO: 696737 - DNA, 21 bp, Homo sapiens
acctgcagcgcgcacacgcac

SEQ ID NO: 696738 - DNA, 22 bp, Homo sapiens
acctgcagcgggcaaagagctc

SEQ ID NO: 696739 - DNA, 23 bp, Homo sapiens
acctgcagtgaggggccctccat

SEQ ID NO: 696740 - DNA, 15 bp, Homo sapiens
acctgcagttcctga

SEQ ID NO: 696741 - DNA, 21 bp, Homo sapiens
acctgcatctaagcatctggg

SEQ ID NO: 696742 - DNA, 21 bp, Homo sapiens
acctgcatttgtatgtgtccc

SEQ ID NO: 696743 - DNA, 23 bp, Homo sapiens
acctgcatttttcactttgctct

SEQ ID NO: 696744 - DNA, 14 bp, Homo sapiens
acctgccaccaggg

SEQ ID NO: 696745 - DNA, 19 bp, Homo sapiens
caaaatgactttatacaac

SEQ ID NO: 696746 - DNA, 18 bp, Homo sapiens
caaaatgaggaatgtata

SEQ ID NO: 696747 - DNA, 19 bp, Homo sapiens
caaaatgaggaatgtatat

SEQ ID NO: 696748 - DNA, 22 bp, Homo sapiens
caaaatgaggaatgtatatgtt

SEQ ID NO: 696749 - DNA, 20 bp, Homo sapiens
caaaatgctttttatttctg

SEQ ID NO: 696750 - DNA, 23 bp, Homo sapiens
caaaatgctttttatttctgcat

SEQ ID NO: 696751 - DNA, 16 bp, Homo sapiens
caaaatggaagcaaag

SEQ ID NO: 696752 - DNA, 19 bp, Homo sapiens
caaaatggaagcaaagaca

SEQ ID NO: 696753 - DNA, 20 bp, Homo sapiens
caaaatggaagcaaagacaa

SEQ ID NO: 696754 - DNA, 16 bp, Homo sapiens
caaaatggaataaaag

SEQ ID NO: 696755 - DNA, 14 bp, Homo sapiens
caaaatgggaggag

SEQ ID NO: 696756 - DNA, 15 bp, Homo sapiens
caaaatgggaggagg

SEQ ID NO: 696757 - DNA, 19 bp, Homo sapiens
caaaatgggaggaggaaag

SEQ ID NO: 696758 - DNA, 20 bp, Homo sapiens
caaaatggggcagaagagaa

SEQ ID NO: 696759 - DNA, 18 bp, Homo sapiens
caaaatgtaatgtcagac

SEQ ID NO: 696760 - DNA, 16 bp, Homo sapiens
caaaatgtacttaaat

SEQ ID NO: 696761 - DNA, 18 bp, Homo sapiens
caaaatgtagaatattca

SEQ ID NO: 696762 - DNA, 14 bp, Homo sapiens
caaaatgtagcttt

SEQ ID NO: 696763 - DNA, 17 bp, Homo sapiens
caaaatgtcttaacaaa

SEQ ID NO: 696764 - DNA, 22 bp, Homo sapiens
caaaatgttgaaatatgatgtt

SEQ ID NO: 696765 - DNA, 15 bp, Homo sapiens
caaaattaatagctt

SEQ ID NO: 696766 - DNA, 19 bp, Homo sapiens
caaaattcatttctaatta

SEQ ID NO: 696767 - DNA, 15 bp, Homo sapiens
caaaattccaaattt

SEQ ID NO: 696768 - DNA, 16 bp, Homo sapiens
caaaattccaaatttt

SEQ ID NO: 696769 - DNA, 16 bp, Homo sapiens
caaaattctaaatgta

SEQ ID NO: 696770 - DNA, 14 bp, Homo sapiens
caaaattgttttca

SEQ ID NO: 696771 - DNA, 16 bp, Homo sapiens
caaaattgttttcact

SEQ ID NO: 696772 - DNA, 18 bp, Homo sapiens
caaaattgttttcacttg

SEQ ID NO: 696773 - DNA, 19 bp, Homo sapiens
caaaattgttttcacttgt

SEQ ID NO: 696774 - DNA, 20 bp, Homo sapiens
caaaattgttttcacttgta

SEQ ID NO: 696775 - DNA, 21 bp, Homo sapiens
caaaattgttttcacttgtat

SEQ ID NO: 696776 - DNA, 22 bp, Homo sapiens
caaaattgttttgagctttcca

SEQ ID NO: 696777 - DNA, 23 bp, Homo sapiens
caaaattgttttgagctttccat

SEQ ID NO: 696778 - DNA, 22 bp, Homo sapiens
caaaatttattttataagaaaa

SEQ ID NO: 696779 - DNA, 14 bp, Homo sapiens
caaaatttcacagt

SEQ ID NO: 696780 - DNA, 19 bp, Homo sapiens
caaaatttccagtaccttt

SEQ ID NO: 696781 - DNA, 12 bp, Homo sapiens
caaaatttgaaa

SEQ ID NO: 696782 - DNA, 12 bp, Homo sapiens
caaaatttgaga

SEQ ID NO: 696783 - DNA, 14 bp, Homo sapiens
caaaattttaaaaa

SEQ ID NO: 696784 - DNA, 20 bp, Homo sapiens
caaaattttctcattttctt

SEQ ID NO: 696785 - DNA, 20 bp, Homo sapiens
caaacaaaaaggttctcagg

SEQ ID NO: 696786 - DNA, 15 bp, Homo sapiens
caaacaaatatgcaa

SEQ ID NO: 696787 - DNA, 22 bp, Homo sapiens
caaacaacaggcccttgggtga

SEQ ID NO: 696788 - DNA, 14 bp, Homo sapiens
caaacaacctgaat

SEQ ID NO: 696789 - DNA, 17 bp, Homo sapiens
caaacaacctgaatctt

SEQ ID NO: 696790 - DNA, 14 bp, Homo sapiens
caaacaacctgccc

SEQ ID NO: 696791 - DNA, 14 bp, Homo sapiens
caaacaactcagct

SEQ ID NO: 696792 - DNA, 12 bp, Homo sapiens
caaacaaggaag

SEQ ID NO: 696793 - DNA, 14 bp, Homo sapiens
caaacaaggaagcc

SEQ ID NO: 696794 - DNA, 16 bp, Homo sapiens
caaacaagggagaaga

SEQ ID NO: 696795 - DNA, 23 bp, Homo sapiens
caaacaagtggatgtttttaatg

SEQ ID NO: 696796 - DNA, 12 bp, Homo sapiens
caaacaataaag

SEQ ID NO: 696797 - DNA, 13 bp, Homo sapiens
caaacaattcgaa

SEQ ID NO: 696798 - DNA, 15 bp, Homo sapiens
caaacacaaaacatt

SEQ ID NO: 696799 - DNA, 21 bp, Homo sapiens
caaacacaaaacattcatgta

SEQ ID NO: 696800 - DNA, 12 bp, Homo sapiens
caaacaccttcc

SEQ ID NO: 696801 - DNA, 15 bp, Homo sapiens
caaacactgaatcat

SEQ ID NO: 696802 - DNA, 19 bp, Homo sapiens
caaacactgaatcatgtta

SEQ ID NO: 696803 - DNA, 21 bp, Homo sapiens
caaacactgcagtttcctgga

SEQ ID NO: 696804 - DNA, 14 bp, Homo sapiens
caaacacttctgct

SEQ ID NO: 696805 - DNA, 17 bp, Homo sapiens
caaacagaacagggtca

SEQ ID NO: 696806 - DNA, 21 bp, Homo sapiens
caaacagccccagtcttcctt

SEQ ID NO: 696807 - DNA, 15 bp, Homo sapiens
caaacagtgtgttgg

SEQ ID NO: 696808 - DNA, 16 bp, Homo sapiens
caaacatagcccctgc

SEQ ID NO: 696809 - DNA, 20 bp, Homo sapiens
caaacatagcccctgccccg

SEQ ID NO: 696810 - DNA, 19 bp, Homo sapiens
caaacatcaaataaatttc

SEQ ID NO: 696811 - DNA, 21 bp, Homo sapiens
caaacatcactctgctgctta

SEQ ID NO: 696812 - DNA, 18 bp, Homo sapiens
caaacatcctatcaacaa

SEQ ID NO: 696813 - DNA, 11 bp, Homo sapiens
caaacatgaaa

SEQ ID NO: 696814 - DNA, 16 bp, Homo sapiens
caaacatgagtgaata

SEQ ID NO: 696815 - DNA, 18 bp, Homo sapiens
caaacatggaaaacagag

SEQ ID NO: 696816 - DNA, 19 bp, Homo sapiens
caaacatggatacttcctg

SEQ ID NO: 696817 - DNA, 23 bp, Homo sapiens
caaacatggggttggctgggccc

SEQ ID NO: 696818 - DNA, 20 bp, Homo sapiens
caaacattaatcaccaaagt

SEQ ID NO: 696819 - DNA, 19 bp, Homo sapiens
caaacattcgtgagctggg

SEQ ID NO: 696820 - DNA, 15 bp, Homo sapiens
caaacatttcaaagt

SEQ ID NO: 696821 - DNA, 22 bp, Homo sapiens
caaacatttcatccgtgtgtat

SEQ ID NO: 696822 - DNA, 20 bp, Homo sapiens
caaacattttgaaagtctgt

SEQ ID NO: 696823 - DNA, 14 bp, Homo sapiens
caaacattttgtat

SEQ ID NO: 696824 - DNA, 15 bp, Homo sapiens
caaaccaacatcttt

SEQ ID NO: 696825 - DNA, 19 bp, Homo sapiens
caaaccaatttcttccttc

SEQ ID NO: 696826 - DNA, 16 bp, Homo sapiens
caaaccacttgcctgg

SEQ ID NO: 696827 - DNA, 17 bp, Homo sapiens
caaaccagccttcggag

SEQ ID NO: 696828 - DNA, 14 bp, Homo sapiens
caaaccaggaccct

SEQ ID NO: 696829 - DNA, 17 bp, Homo sapiens
caaaccagtatcgctca

SEQ ID NO: 696830 - DNA, 23 bp, Homo sapiens
caaaccagtttattctgtggttc

SEQ ID NO: 696831 - DNA, 12 bp, Homo sapiens
caaaccatgcct

SEQ ID NO: 696832 - DNA, 15 bp, Homo sapiens
caaacccacttctgg

SEQ ID NO: 696833 - DNA, 17 bp, Homo sapiens
caaacccagaaagattt

SEQ ID NO: 696834 - DNA, 21 bp, Homo sapiens
caaacccagacaaccaaaaca

SEQ ID NO: 696835 - DNA, 21 bp, Homo sapiens
caaacccagaggtggatgtta

SEQ ID NO: 696836 - DNA, 11 bp, Homo sapiens
caaacccagcc

SEQ ID NO: 696837 - DNA, 13 bp, Homo sapiens
caaacccagccac

SEQ ID NO: 696838 - DNA, 12 bp, Homo sapiens
caaaccccagcc

SEQ ID NO: 696839 - DNA, 22 bp, Homo sapiens
caaacccccaaaatccaaaact

SEQ ID NO: 696840 - DNA, 23 bp, Homo sapiens
caaaccccctccttacgctttgt

SEQ ID NO: 696841 - DNA, 18 bp, Homo sapiens
caaaccccgaccacctgc

SEQ ID NO: 696842 - DNA, 14 bp, Homo sapiens
caaaccccttccca

SEQ ID NO: 696843 - DNA, 18 bp, Homo sapiens
caaaccccttcccacgac

SEQ ID NO: 696844 - DNA, 23 bp, Homo sapiens
caaaccctcccagaaacatctct

SEQ ID NO: 696845 - DNA, 18 bp, Homo sapiens
caaacccttaactgacat

SEQ ID NO: 696846 - DNA, 16 bp, Homo sapiens
caaacccttgctttcc

SEQ ID NO: 696847 - DNA, 21 bp, Homo sapiens
caaaccctttgtattataatt

SEQ ID NO: 696848 - DNA, 22 bp, Homo sapiens
caaaccgtggtacccccccttt

SEQ ID NO: 696849 - DNA, 14 bp, Homo sapiens
caaacctactgccc

SEQ ID NO: 696850 - DNA, 15 bp, Homo sapiens
caaacctactgccca

SEQ ID NO: 696851 - DNA, 18 bp, Homo sapiens
caaacctatggaagttgt

SEQ ID NO: 696852 - DNA, 16 bp, Homo sapiens
caaacctccagcctcc

SEQ ID NO: 696853 - DNA, 19 bp, Homo sapiens
caaacctccagcctccctg

SEQ ID NO: 696854 - DNA, 18 bp, Homo sapiens
caaacctggagctgagga

SEQ ID NO: 696855 - DNA, 12 bp, Homo sapiens
caaaccttcctg

SEQ ID NO: 696856 - DNA, 14 bp, Homo sapiens
caaaccttcctggg

SEQ ID NO: 696857 - DNA, 13 bp, Homo sapiens
caaagcaaaggca

SEQ ID NO: 696858 - DNA, 22 bp, Homo sapiens
caaagcaaaggcagtcccggga

SEQ ID NO: 696859 - DNA, 17 bp, Homo sapiens
caaagcaagggctccag

SEQ ID NO: 696860 - DNA, 18 bp, Homo sapiens
caaagcaagggctccagc

SEQ ID NO: 696861 - DNA, 19 bp, Homo sapiens
caaagcaagggctccagca

SEQ ID NO: 696862 - DNA, 13 bp, Homo sapiens
caaagcacagtgt

SEQ ID NO: 696863 - DNA, 19 bp, Homo sapiens
caaagcacatgcttagctt

SEQ ID NO: 696864 - DNA, 17 bp, Homo sapiens
caaagcacattgaaaga

SEQ ID NO: 696865 - DNA, 12 bp, Homo sapiens
caaagcaccagc

SEQ ID NO: 696866 - DNA, 16 bp, Homo sapiens
caaagcactctctgca

SEQ ID NO: 696867 - DNA, 17 bp, Homo sapiens
caaagcactctctgcag

SEQ ID NO: 696868 - DNA, 23 bp, Homo sapiens
caaagcacttggactcttgctct

SEQ ID NO: 696869 - DNA, 12 bp, Homo sapiens
caaagcagacag

SEQ ID NO: 696870 - DNA, 13 bp, Homo sapiens
caaagcagacagc

SEQ ID NO: 696871 - DNA, 18 bp, Homo sapiens
caaagcagcaggcctctg

SEQ ID NO: 696872 - DNA, 12 bp, Homo sapiens
caaagcaggagt

SEQ ID NO: 696873 - DNA, 22 bp, Homo sapiens
caaagcaggggagtatgcaaaa

SEQ ID NO: 696874 - DNA, 17 bp, Homo sapiens
caaagcatggacattta

SEQ ID NO: 696875 - DNA, 21 bp, Homo sapiens
caaagcatgtgctagtggcaa

SEQ ID NO: 696876 - DNA, 16 bp, Homo sapiens
caaagccaagaaagaa

SEQ ID NO: 696877 - DNA, 18 bp, Homo sapiens
caaagccacaaggctggc

SEQ ID NO: 696878 - DNA, 16 bp, Homo sapiens
caaagccagaggagaa

SEQ ID NO: 696879 - DNA, 21 bp, Homo sapiens
caaagccagaggagaagacaa

SEQ ID NO: 696880 - DNA, 23 bp, Homo sapiens
caaagccagggtctctccctcag

SEQ ID NO: 696881 - DNA, 17 bp, Homo sapiens
caaagcccaaagtggta

SEQ ID NO: 696882 - DNA, 13 bp, Homo sapiens
caaagcccagctt

SEQ ID NO: 696883 - DNA, 14 bp, Homo sapiens
caaagccccatgtg

SEQ ID NO: 696884 - DNA, 19 bp, Homo sapiens
caaagccccatgtgccttg

SEQ ID NO: 696885 - DNA, 15 bp, Homo sapiens
caaagcccttttata

SEQ ID NO: 696886 - DNA, 21 bp, Homo sapiens
caaagcctagacaacctttct

SEQ ID NO: 696887 - DNA, 15 bp, Homo sapiens
caaagcctccttttt

SEQ ID NO: 696888 - DNA, 14 bp, Homo sapiens
caaagcctcttatt

SEQ ID NO: 696889 - DNA, 21 bp, Homo sapiens
caaagcctcttcaaaaagcag

SEQ ID NO: 696890 - DNA, 22 bp, Homo sapiens
caaagcctcttcaaaaagcaga

SEQ ID NO: 696891 - DNA, 18 bp, Homo sapiens
caaagcctgtcccaggac

SEQ ID NO: 696892 - DNA, 19 bp, Homo sapiens
caaagcctgtcccaggact

SEQ ID NO: 696893 - DNA, 16 bp, Homo sapiens
caaagccttaagcaaa

SEQ ID NO: 696894 - DNA, 18 bp, Homo sapiens
caaagccttaagcaaatt

SEQ ID NO: 696895 - DNA, 21 bp, Homo sapiens
caaagccttaagcaaattttg

SEQ ID NO: 696896 - DNA, 17 bp, Homo sapiens
caaagcgcccacccagg

SEQ ID NO: 696897 - DNA, 13 bp, Homo sapiens
caaagcgctcgcc

SEQ ID NO: 696898 - DNA, 16 bp, Homo sapiens
caaagcggggggaggg

SEQ ID NO: 696899 - DNA, 20 bp, Homo sapiens
caaagctaaaaaattgttaa

SEQ ID NO: 696900 - DNA, 14 bp, Homo sapiens
caaagctcaaagta

SEQ ID NO: 696901 - DNA, 23 bp, Homo sapiens
caaagctctattaagatttccaa

SEQ ID NO: 696902 - DNA, 14 bp, Homo sapiens
caaagctgaatatt

SEQ ID NO: 696903 - DNA, 15 bp, Homo sapiens
caaagctgaatattt

SEQ ID NO: 696904 - DNA, 16 bp, Homo sapiens
caaagctgaatatttt

SEQ ID NO: 696905 - DNA, 20 bp, Homo sapiens
caaagctgcccactgtttct

SEQ ID NO: 696906 - DNA, 11 bp, Homo sapiens
caaagctgcct

SEQ ID NO: 696907 - DNA, 21 bp, Homo sapiens
caaagctgcctgtccctaccc

SEQ ID NO: 696908 - DNA, 15 bp, Homo sapiens
caaagctgcctgtgc

SEQ ID NO: 696909 - DNA, 16 bp, Homo sapiens
caaagctgcctgtgcc

SEQ ID NO: 696910 - DNA, 13 bp, Homo sapiens
caaagctgttaaa

SEQ ID NO: 696911 - DNA, 19 bp, Homo sapiens
caaagctgttaaactgtta

SEQ ID NO: 696912 - DNA, 14 bp, Homo sapiens
caaagcttaaaaag

SEQ ID NO: 696913 - DNA, 15 bp, Homo sapiens
caaagcttaaaaaga

SEQ ID NO: 696914 - DNA, 18 bp, Homo sapiens
caaagcttctatcccagg

SEQ ID NO: 696915 - DNA, 19 bp, Homo sapiens
caaagcttgaagatcgtta

SEQ ID NO: 696916 - DNA, 20 bp, Homo sapiens
caaagcttggattaaataca

SEQ ID NO: 696917 - DNA, 18 bp, Homo sapiens
caaagcttgtcaaagatg

SEQ ID NO: 696918 - DNA, 20 bp, Homo sapiens
caaagcttgtcaaagatgcc

SEQ ID NO: 696919 - DNA, 17 bp, Homo sapiens
caaagctttactactgt

SEQ ID NO: 696920 - DNA, 13 bp, Homo sapiens
caaagctttcctg

SEQ ID NO: 696921 - DNA, 14 bp, Homo sapiens
caaagctttcctgc

SEQ ID NO: 696922 - DNA, 22 bp, Homo sapiens
caaagctttcctgccccaggcc

SEQ ID NO: 696923 - DNA, 13 bp, Homo sapiens
caaagctttgcta

SEQ ID NO: 696924 - DNA, 21 bp, Homo sapiens
caaagctttgctacaaattta

SEQ ID NO: 696925 - DNA, 18 bp, Homo sapiens
caaaggaaatccaaaaaa

SEQ ID NO: 696926 - DNA, 21 bp, Homo sapiens
caaaggaataacctttctgga

SEQ ID NO: 696927 - DNA, 18 bp, Homo sapiens
caaaggaatataagaaaa

SEQ ID NO: 696928 - DNA, 22 bp, Homo sapiens
caaaggaatataagaaaagtaa

SEQ ID NO: 696929 - DNA, 19 bp, Homo sapiens
caaaggaatctccagtttt

SEQ ID NO: 696930 - DNA, 22 bp, Homo sapiens
caaaggaatctccagttttcag

SEQ ID NO: 696931 - DNA, 11 bp, Homo sapiens
caaaggagaaa

SEQ ID NO: 696932 - DNA, 19 bp, Homo sapiens
caaaggagacaaagcagga

SEQ ID NO: 696933 - DNA, 23 bp, Homo sapiens
caaaggagcattaagcccaatct

SEQ ID NO: 696934 - DNA, 15 bp, Homo sapiens
caaaggagccttgat

SEQ ID NO: 696935 - DNA, 17 bp, Homo sapiens
caaaggagctcgaagga

SEQ ID NO: 696936 - DNA, 17 bp, Homo sapiens
caaaggaggctggcagg

SEQ ID NO: 696937 - DNA, 12 bp, Homo sapiens
caaaggatgaag

SEQ ID NO: 696938 - DNA, 14 bp, Homo sapiens
caaaggatgtgata

SEQ ID NO: 696939 - DNA, 17 bp, Homo sapiens
caaaggatgtgatatat

SEQ ID NO: 696940 - DNA, 16 bp, Homo sapiens
caaaggcagaggaatt

SEQ ID NO: 696941 - DNA, 12 bp, Homo sapiens
caaaggcagggc

SEQ ID NO: 696942 - DNA, 14 bp, Homo sapiens
caaaggcagggcca

SEQ ID NO: 696943 - DNA, 20 bp, Homo sapiens
caaaggcccagggaggcagc

SEQ ID NO: 696944 - DNA, 23 bp, Homo sapiens
caaaggcccatgcccccttcgct

SEQ ID NO: 696945 - DNA, 20 bp, Homo sapiens
caaaggctcagcttggattt

SEQ ID NO: 696946 - DNA, 22 bp, Homo sapiens
caaaggctgacagactcactgg

SEQ ID NO: 696947 - DNA, 15 bp, Homo sapiens
caaaggctggtggca

SEQ ID NO: 696948 - DNA, 15 bp, Homo sapiens
caaagggaaatatca

SEQ ID NO: 696949 - DNA, 17 bp, Homo sapiens
caaagggaagtgaggcc

SEQ ID NO: 696950 - DNA, 15 bp, Homo sapiens
caaagggaatactca

SEQ ID NO: 696951 - DNA, 13 bp, Homo sapiens
caaagggactttg

SEQ ID NO: 696952 - DNA, 22 bp, Homo sapiens
caaagggagcactgggttgact

SEQ ID NO: 696953 - DNA, 13 bp, Homo sapiens
caaagggcagttt

SEQ ID NO: 696954 - DNA, 20 bp, Homo sapiens
caaagggccatcgttcatcc

SEQ ID NO: 696955 - DNA, 14 bp, Homo sapiens
caaagggctgaaag

SEQ ID NO: 696956 - DNA, 18 bp, Homo sapiens
caaagggctgccttgctg

SEQ ID NO: 696957 - DNA, 15 bp, Homo sapiens
caaaggggacaggcc

SEQ ID NO: 696958 - DNA, 19 bp, Homo sapiens
caaaggggacaggcctcac

SEQ ID NO: 696959 - DNA, 13 bp, Homo sapiens
caaaggggagcca

SEQ ID NO: 696960 - DNA, 19 bp, Homo sapiens
caaaggggagccagaaatg

SEQ ID NO: 696961 - DNA, 16 bp, Homo sapiens
caaaggggctgctggg

SEQ ID NO: 696962 - DNA, 12 bp, Homo sapiens
caaaggggggag

SEQ ID NO: 696963 - DNA, 13 bp, Homo sapiens
caaaggggggagg

SEQ ID NO: 696964 - DNA, 21 bp, Homo sapiens
caaagggtgaagctatttatc

SEQ ID NO: 696965 - DNA, 16 bp, Homo sapiens
caaaggtcaatgtcaa

SEQ ID NO: 696966 - DNA, 14 bp, Homo sapiens
caaaggtgcctcat

SEQ ID NO: 696967 - DNA, 20 bp, Homo sapiens
caaaggtggaataaacatta

SEQ ID NO: 696968 - DNA, 14 bp, Homo sapiens
caaaggtggctctc

SEQ ID NO: 696969 - DNA, 16 bp, Homo sapiens
caaaggtttggaagga

SEQ ID NO: 696970 - DNA, 11 bp, Homo sapiens
caaaggttttc

SEQ ID NO: 696971 - DNA, 18 bp, Homo sapiens
caaagtaaaacttgctgc

SEQ ID NO: 696972 - DNA, 16 bp, Homo sapiens
caaagtacactgtttc

SEQ ID NO: 696973 - DNA, 20 bp, Homo sapiens
caaagtacactgtttcaaac

SEQ ID NO: 696974 - DNA, 21 bp, Homo sapiens
caaagtacactgtttcaaact

SEQ ID NO: 696975 - DNA, 22 bp, Homo sapiens
caaagtacagaatagaatacat

SEQ ID NO: 696976 - DNA, 16 bp, Homo sapiens
caaagtactcctcact

SEQ ID NO: 696977 - DNA, 14 bp, Homo sapiens
caaagtagaagtct

SEQ ID NO: 696978 - DNA, 21 bp, Homo sapiens
caaagtagaagtcttagatgt

SEQ ID NO: 696979 - DNA, 22 bp, Homo sapiens
caaagtagaagtcttagatgta

SEQ ID NO: 696980 - DNA, 16 bp, Homo sapiens
caaagtatcaaagaaa

SEQ ID NO: 696981 - DNA, 23 bp, Homo sapiens
caaagtattaatgtacagagtgg

SEQ ID NO: 696982 - DNA, 15 bp, Homo sapiens
caaagtattgtaaat

SEQ ID NO: 696983 - DNA, 22 bp, Homo sapiens
caaagtattgtaaattatattt

SEQ ID NO: 696984 - DNA, 22 bp, Homo sapiens
caaagtatttttttatcttggg

SEQ ID NO: 696985 - DNA, 21 bp, Homo sapiens
caaagtcaataaaagagctgt

SEQ ID NO: 696986 - DNA, 17 bp, Homo sapiens
caaagtcatcccctctc

SEQ ID NO: 696987 - DNA, 18 bp, Homo sapiens
caaagtcatcccctctca

SEQ ID NO: 696988 - DNA, 12 bp, Homo sapiens
caaagtcattaa

SEQ ID NO: 696989 - DNA, 19 bp, Homo sapiens
caaagtcccttcctgcttc

SEQ ID NO: 696990 - DNA, 16 bp, Homo sapiens
caaagtcctctgctcc

SEQ ID NO: 696991 - DNA, 14 bp, Homo sapiens
caaagtcctttttt

SEQ ID NO: 696992 - DNA, 23 bp, Homo sapiens
caaagtcctttttttccatcttt

SEQ ID NO: 696993 - DNA, 14 bp, Homo sapiens
caaagtcgccagtc

SEQ ID NO: 696994 - DNA, 12 bp, Homo sapiens
caaagtctaaac

SEQ ID NO: 696995 - DNA, 13 bp, Homo sapiens
caaagtctaaact

SEQ ID NO: 696996 - DNA, 19 bp, Homo sapiens
caaagtctcaatgaaatag

SEQ ID NO: 696997 - DNA, 19 bp, Homo sapiens
caaagtctgccgcccacct

SEQ ID NO: 696998 - DNA, 22 bp, Homo sapiens
caaagtctgccgcccacctcgc

SEQ ID NO: 696999 - DNA, 13 bp, Homo sapiens
caaagtctgtgtg

SEQ ID NO: 697000 - DNA, 21 bp, Homo sapiens
caaagtgagaaaatgcctcaa

SEQ ID NO: 697001 - DNA, 19 bp, Homo sapiens
acccctgcccccacttcct

SEQ ID NO: 697002 - DNA, 17 bp, Homo sapiens
acccctgcccccagccc

SEQ ID NO: 697003 - DNA, 20 bp, Homo sapiens
acccctgcccccagccccgg

SEQ ID NO: 697004 - DNA, 13 bp, Homo sapiens
acccctgccctgc

SEQ ID NO: 697005 - DNA, 14 bp, Homo sapiens
acccctgccctgct

SEQ ID NO: 697006 - DNA, 13 bp, Homo sapiens
acccctgcctcga

SEQ ID NO: 697007 - DNA, 15 bp, Homo sapiens
acccctgcctcgagg

SEQ ID NO: 697008 - DNA, 16 bp, Homo sapiens
acccctgcctcgaggg

SEQ ID NO: 697009 - DNA, 23 bp, Homo sapiens
acccctgcctcgagggccgcctg

SEQ ID NO: 697010 - DNA, 11 bp, Homo sapiens
acccctgcctt

SEQ ID NO: 697011 - DNA, 14 bp, Homo sapiens
acccctgccttcct

SEQ ID NO: 697012 - DNA, 15 bp, Homo sapiens
acccctgccttcctc

SEQ ID NO: 697013 - DNA, 11 bp, Homo sapiens
acccctgctcc

SEQ ID NO: 697014 - DNA, 17 bp, Homo sapiens
acccctgctcccagcct

SEQ ID NO: 697015 - DNA, 20 bp, Homo sapiens
acccctgctcccagcctgct

SEQ ID NO: 697016 - DNA, 21 bp, Homo sapiens
acccctgctcccagcctgctg

SEQ ID NO: 697017 - DNA, 23 bp, Homo sapiens
acccctgctcccagcctgctgag

SEQ ID NO: 697018 - DNA, 21 bp, Homo sapiens
acccctggccagctctgaggg

SEQ ID NO: 697019 - DNA, 12 bp, Homo sapiens
acccctggctct

SEQ ID NO: 697020 - DNA, 11 bp, Homo sapiens
acccctggctg

SEQ ID NO: 697021 - DNA, 21 bp, Homo sapiens
acccctggctgtactgctcag

SEQ ID NO: 697022 - DNA, 18 bp, Homo sapiens
acccctggcttttcactg

SEQ ID NO: 697023 - DNA, 19 bp, Homo sapiens
acccctggcttttcactgc

SEQ ID NO: 697024 - DNA, 11 bp, Homo sapiens
acccctgggca

SEQ ID NO: 697025 - DNA, 12 bp, Homo sapiens
acccctgggcag

SEQ ID NO: 697026 - DNA, 13 bp, Homo sapiens
acccctgggcagg

SEQ ID NO: 697027 - DNA, 14 bp, Homo sapiens
acccctgggcaggc

SEQ ID NO: 697028 - DNA, 14 bp, Homo sapiens
acccctggggtggc

SEQ ID NO: 697029 - DNA, 19 bp, Homo sapiens
acccctggggtggccaggg

SEQ ID NO: 697030 - DNA, 20 bp, Homo sapiens
acccctggggtggccagggc

SEQ ID NO: 697031 - DNA, 16 bp, Homo sapiens
acccctgtacccagct

SEQ ID NO: 697032 - DNA, 11 bp, Homo sapiens
acccctgtagg

SEQ ID NO: 697033 - DNA, 23 bp, Homo sapiens
acccctgtagggaaaccttggag

SEQ ID NO: 697034 - DNA, 21 bp, Homo sapiens
acccctgtcccacccacacag

SEQ ID NO: 697035 - DNA, 18 bp, Homo sapiens
acccctgtgctcccctgc

SEQ ID NO: 697036 - DNA, 17 bp, Homo sapiens
accctggccgccccctg

SEQ ID NO: 697037 - DNA, 19 bp, Homo sapiens
accctggccgccccctgcc

SEQ ID NO: 697038 - DNA, 12 bp, Homo sapiens
accctggcctca

SEQ ID NO: 697039 - DNA, 16 bp, Homo sapiens
accctggcctgaactg

SEQ ID NO: 697040 - DNA, 16 bp, Homo sapiens
accctggcctgagaag

SEQ ID NO: 697041 - DNA, 15 bp, Homo sapiens
accctgggccctggg

SEQ ID NO: 697042 - DNA, 17 bp, Homo sapiens
accctgggccctgggct

SEQ ID NO: 697043 - DNA, 16 bp, Homo sapiens
accctgggctggggag

SEQ ID NO: 697044 - DNA, 18 bp, Homo sapiens
accctgggctggggagga

SEQ ID NO: 697045 - DNA, 19 bp, Homo sapiens
accctgggctggggaggag

SEQ ID NO: 697046 - DNA, 23 bp, Homo sapiens
accctgggctggggaggaggaga

SEQ ID NO: 697047 - DNA, 16 bp, Homo sapiens
accctgggctgtccag

SEQ ID NO: 697048 - DNA, 21 bp, Homo sapiens
accctgggctgtccagcctta

SEQ ID NO: 697049 - DNA, 23 bp, Homo sapiens
accctgggctgtccagccttaat

SEQ ID NO: 697050 - DNA, 13 bp, Homo sapiens
accctggggcctg

SEQ ID NO: 697051 - DNA, 19 bp, Homo sapiens
accctggggcctggacctg

SEQ ID NO: 697052 - DNA, 20 bp, Homo sapiens
accctgggtgggctctgtgc

SEQ ID NO: 697053 - DNA, 16 bp, Homo sapiens
accctggtgacctcct

SEQ ID NO: 697054 - DNA, 17 bp, Homo sapiens
accctggtggtatttta

SEQ ID NO: 697055 - DNA, 20 bp, Homo sapiens
accctggtttttttcctgtg

SEQ ID NO: 697056 - DNA, 20 bp, Homo sapiens
accctgtatatagcccagcc

SEQ ID NO: 697057 - DNA, 20 bp, Homo sapiens
accctgtcccccagctctgg

SEQ ID NO: 697058 - DNA, 21 bp, Homo sapiens
accctgtcccccagctctggt

SEQ ID NO: 697059 - DNA, 22 bp, Homo sapiens
accctgtcccccagctctggtg

SEQ ID NO: 697060 - DNA, 11 bp, Homo sapiens
accctgtctct

SEQ ID NO: 697061 - DNA, 15 bp, Homo sapiens
accctgtctgtccct

SEQ ID NO: 697062 - DNA, 21 bp, Homo sapiens
accctgtgaccctctcacttt

SEQ ID NO: 697063 - DNA, 14 bp, Homo sapiens
accctgtgctggtg

SEQ ID NO: 697064 - DNA, 15 bp, Homo sapiens
accctgtgctggtgt

SEQ ID NO: 697065 - DNA, 19 bp, Homo sapiens
accctgtgctggtgtcctg

SEQ ID NO: 697066 - DNA, 14 bp, Homo sapiens
accctgtgggaccg

SEQ ID NO: 697067 - DNA, 19 bp, Homo sapiens
accctgtgggaccgcctgg

SEQ ID NO: 697068 - DNA, 23 bp, Homo sapiens
accctgtgggaccgcctggccct

SEQ ID NO: 697069 - DNA, 21 bp, Homo sapiens
accctgtgggtgtctccctcg

SEQ ID NO: 697070 - DNA, 22 bp, Homo sapiens
accctgtgggtgtctccctcgg

SEQ ID NO: 697071 - DNA, 10 bp, Homo sapiens
accctgtgtc

SEQ ID NO: 697072 - DNA, 17 bp, Homo sapiens
accctgtgtcagagcct

SEQ ID NO: 697073 - DNA, 22 bp, Homo sapiens
accctgtgtcagagcctacctt

SEQ ID NO: 697074 - DNA, 18 bp, Homo sapiens
accctgttagttttgtaa

SEQ ID NO: 697075 - DNA, 14 bp, Homo sapiens
accctgtttcctga

SEQ ID NO: 697076 - DNA, 17 bp, Homo sapiens
accctgtttctgtagaa

SEQ ID NO: 697077 - DNA, 18 bp, Homo sapiens
accctgtttctgtagaaa

SEQ ID NO: 697078 - DNA, 16 bp, Homo sapiens
accctgttttatactg

SEQ ID NO: 697079 - DNA, 16 bp, Homo sapiens
acccttaacccaagga

SEQ ID NO: 697080 - DNA, 23 bp, Homo sapiens
acccttaacccaaggagcacagg

SEQ ID NO: 697081 - DNA, 18 bp, Homo sapiens
acccttacagcctctgac

SEQ ID NO: 697082 - DNA, 12 bp, Homo sapiens
acccttagaaaa

SEQ ID NO: 697083 - DNA, 19 bp, Homo sapiens
acccttagagattgcccca

SEQ ID NO: 697084 - DNA, 17 bp, Homo sapiens
acccttattgctgtcct

SEQ ID NO: 697085 - DNA, 21 bp, Homo sapiens
acccttattgctgtcctggag

SEQ ID NO: 697086 - DNA, 13 bp, Homo sapiens
acccttcaactcc

SEQ ID NO: 697087 - DNA, 14 bp, Homo sapiens
acccttcaactcct

SEQ ID NO: 697088 - DNA, 21 bp, Homo sapiens
acccttcacataccctccccc

SEQ ID NO: 697089 - DNA, 14 bp, Homo sapiens
acccttcagggcca

SEQ ID NO: 697090 - DNA, 17 bp, Homo sapiens
acccttcagggccagaa

SEQ ID NO: 697091 - DNA, 14 bp, Homo sapiens
acccttcccagccc

SEQ ID NO: 697092 - DNA, 18 bp, Homo sapiens
acccttcccagccctcat

SEQ ID NO: 697093 - DNA, 22 bp, Homo sapiens
acccttcccctccttctccctt

SEQ ID NO: 697094 - DNA, 22 bp, Homo sapiens
acccttccctgcactaaagcca

SEQ ID NO: 697095 - DNA, 19 bp, Homo sapiens
acccttcctcaccacttcc

SEQ ID NO: 697096 - DNA, 22 bp, Homo sapiens
acccttcctgcatttctcttct

SEQ ID NO: 697097 - DNA, 14 bp, Homo sapiens
acccttcctggccc

SEQ ID NO: 697098 - DNA, 13 bp, Homo sapiens
acccttcttttct

SEQ ID NO: 697099 - DNA, 14 bp, Homo sapiens
acccttcttttctc

SEQ ID NO: 697100 - DNA, 20 bp, Homo sapiens
acccttcttttctcatgtgt

SEQ ID NO: 697101 - DNA, 16 bp, Homo sapiens
acccttgcctgcctcc

SEQ ID NO: 697102 - DNA, 23 bp, Homo sapiens
acccttgcctgcctcctaggctg

SEQ ID NO: 697103 - DNA, 15 bp, Homo sapiens
acccttgctgcttta

SEQ ID NO: 697104 - DNA, 16 bp, Homo sapiens
acccttgctgtgaatt

SEQ ID NO: 697105 - DNA, 21 bp, Homo sapiens
acccttggaaaacaaaagttt

SEQ ID NO: 697106 - DNA, 15 bp, Homo sapiens
acccttggcctgtcc

SEQ ID NO: 697107 - DNA, 16 bp, Homo sapiens
acccttggcctgtcca

SEQ ID NO: 697108 - DNA, 16 bp, Homo sapiens
acccttgggccagaag

SEQ ID NO: 697109 - DNA, 17 bp, Homo sapiens
acccttggtgtttccct

SEQ ID NO: 697110 - DNA, 23 bp, Homo sapiens
acccttggtgtttcccttcctcg

SEQ ID NO: 697111 - DNA, 18 bp, Homo sapiens
acccttgtgagagcccat

SEQ ID NO: 697112 - DNA, 17 bp, Homo sapiens
acccttgtgcttggtgg

SEQ ID NO: 697113 - DNA, 20 bp, Homo sapiens
accctttagtgtacatttat

SEQ ID NO: 697114 - DNA, 21 bp, Homo sapiens
accctttcatagagaggcctg

SEQ ID NO: 697115 - DNA, 20 bp, Homo sapiens
accctttcccccttctctta

SEQ ID NO: 697116 - DNA, 17 bp, Homo sapiens
accctttccttccttcc

SEQ ID NO: 697117 - DNA, 19 bp, Homo sapiens
accctttcgctggctttcc

SEQ ID NO: 697118 - DNA, 17 bp, Homo sapiens
accctttcttcagctct

SEQ ID NO: 697119 - DNA, 17 bp, Homo sapiens
accctttcttgacaaaa

SEQ ID NO: 697120 - DNA, 12 bp, Homo sapiens
accctttgcccc

SEQ ID NO: 697121 - DNA, 22 bp, Homo sapiens
accctttgcctttcttctgccc

SEQ ID NO: 697122 - DNA, 22 bp, Homo sapiens
accctttgctgtgaggctgtcc

SEQ ID NO: 697123 - DNA, 16 bp, Homo sapiens
accctttggccccact

SEQ ID NO: 697124 - DNA, 21 bp, Homo sapiens
accctttggtttttttcttct

SEQ ID NO: 697125 - DNA, 17 bp, Homo sapiens
acccttttcatgatttt

SEQ ID NO: 697126 - DNA, 13 bp, Homo sapiens
acccttttctcag

SEQ ID NO: 697127 - DNA, 15 bp, Homo sapiens
acccttttctgatcg

SEQ ID NO: 697128 - DNA, 14 bp, Homo sapiens
acccttttggcccc

SEQ ID NO: 697129 - DNA, 20 bp, Homo sapiens
accgaacatatcatttgtga

SEQ ID NO: 697130 - DNA, 15 bp, Homo sapiens
accgaatgtgtcttt

SEQ ID NO: 697131 - DNA, 19 bp, Homo sapiens
accgaatgtgtctttagat

SEQ ID NO: 697132 - DNA, 17 bp, Homo sapiens
accgaccatcgtccagc

SEQ ID NO: 697133 - DNA, 18 bp, Homo sapiens
accgaccatcgtccagcc

SEQ ID NO: 697134 - DNA, 19 bp, Homo sapiens
accgaccatcgtccagccc

SEQ ID NO: 697135 - DNA, 20 bp, Homo sapiens
accgaccatcgtccagccct

SEQ ID NO: 697136 - DNA, 16 bp, Homo sapiens
accgaccccgggccgg

SEQ ID NO: 697137 - DNA, 20 bp, Homo sapiens
accgacccgaggcccagatc

SEQ ID NO: 697138 - DNA, 16 bp, Homo sapiens
accgacgcgtctcctg

SEQ ID NO: 697139 - DNA, 14 bp, Homo sapiens
accgactgaccctg

SEQ ID NO: 697140 - DNA, 13 bp, Homo sapiens
accgactgcccag

SEQ ID NO: 697141 - DNA, 14 bp, Homo sapiens
accgagacatgaat

SEQ ID NO: 697142 - DNA, 18 bp, Homo sapiens
accgagataggggagggg

SEQ ID NO: 697143 - DNA, 17 bp, Homo sapiens
accgagcaaagatcaaa

SEQ ID NO: 697144 - DNA, 18 bp, Homo sapiens
accgagcgctttctggaa

SEQ ID NO: 697145 - DNA, 18 bp, Homo sapiens
accgaggctggagctggc

SEQ ID NO: 697146 - DNA, 18 bp, Homo sapiens
accgagtagaaaatgtga

SEQ ID NO: 697147 - DNA, 16 bp, Homo sapiens
accgagtatctgtaac

SEQ ID NO: 697148 - DNA, 23 bp, Homo sapiens
accgagtatctgtaacccttgaa

SEQ ID NO: 697149 - DNA, 13 bp, Homo sapiens
accgatgctccag

SEQ ID NO: 697150 - DNA, 23 bp, Homo sapiens
accgatgctccagccaacccctg

SEQ ID NO: 697151 - DNA, 13 bp, Homo sapiens
accgatggagccc

SEQ ID NO: 697152 - DNA, 16 bp, Homo sapiens
accgattatgctttct

SEQ ID NO: 697153 - DNA, 20 bp, Homo sapiens
accgcatatgcatgccaggc

SEQ ID NO: 697154 - DNA, 19 bp, Homo sapiens
accgccacgggtttccctc

SEQ ID NO: 697155 - DNA, 20 bp, Homo sapiens
accgccacgtcccagcatcc

SEQ ID NO: 697156 - DNA, 16 bp, Homo sapiens
accgcccagctctccc

SEQ ID NO: 697157 - DNA, 21 bp, Homo sapiens
attttgcctcttttctctgtg

SEQ ID NO: 697158 - DNA, 13 bp, Homo sapiens
attttgcctgtgt

SEQ ID NO: 697159 - DNA, 20 bp, Homo sapiens
attttgctaaatgtgaatga

SEQ ID NO: 697160 - DNA, 19 bp, Homo sapiens
attttgctatcaacaataa

SEQ ID NO: 697161 - DNA, 17 bp, Homo sapiens
attttgctattgtaaat

SEQ ID NO: 697162 - DNA, 19 bp, Homo sapiens
attttgctattgtaaatat

SEQ ID NO: 697163 - DNA, 14 bp, Homo sapiens
attttgctggaata

SEQ ID NO: 697164 - DNA, 19 bp, Homo sapiens
attttgctggaattcctaa

SEQ ID NO: 697165 - DNA, 20 bp, Homo sapiens
attttgctgtagaagatggc

SEQ ID NO: 697166 - DNA, 22 bp, Homo sapiens
attttgcttcactttgccttct

SEQ ID NO: 697167 - DNA, 23 bp, Homo sapiens
attttgcttcttggtcaagaaag

SEQ ID NO: 697168 - DNA, 19 bp, Homo sapiens
attttgctttggttaaaaa

SEQ ID NO: 697169 - DNA, 19 bp, Homo sapiens
attttggaaaataaattat

SEQ ID NO: 697170 - DNA, 23 bp, Homo sapiens
attttggaaactgctaaattcta

SEQ ID NO: 697171 - DNA, 20 bp, Homo sapiens
attttggaataatttctatt

SEQ ID NO: 697172 - DNA, 14 bp, Homo sapiens
attttggaatttgc

SEQ ID NO: 697173 - DNA, 22 bp, Homo sapiens
attttggataaatcatttcagt

SEQ ID NO: 697174 - DNA, 15 bp, Homo sapiens
attttggctttctcc

SEQ ID NO: 697175 - DNA, 16 bp, Homo sapiens
attttgggaatctttt

SEQ ID NO: 697176 - DNA, 21 bp, Homo sapiens
attttggtgaatgtgggtagt

SEQ ID NO: 697177 - DNA, 15 bp, Homo sapiens
attttggtgagaaat

SEQ ID NO: 697178 - DNA, 23 bp, Homo sapiens
attttggttcccttgtaaagaca

SEQ ID NO: 697179 - DNA, 20 bp, Homo sapiens
attttggttgctgatgttta

SEQ ID NO: 697180 - DNA, 11 bp, Homo sapiens
attttgtaaaa

SEQ ID NO: 697181 - DNA, 12 bp, Homo sapiens
attttgtaaaat

SEQ ID NO: 697182 - DNA, 19 bp, Homo sapiens
attttgtaacgaagacaca

SEQ ID NO: 697183 - DNA, 16 bp, Homo sapiens
attttgtaagaaggca

SEQ ID NO: 697184 - DNA, 17 bp, Homo sapiens
attttgtaatatttgaa

SEQ ID NO: 697185 - DNA, 18 bp, Homo sapiens
attttgtaatatttgaat

SEQ ID NO: 697186 - DNA, 12 bp, Homo sapiens
attttgtaatga

SEQ ID NO: 697187 - DNA, 20 bp, Homo sapiens
attttgtaatgtatcaaata

SEQ ID NO: 697188 - DNA, 21 bp, Homo sapiens
attttgtaattcttatgacta

SEQ ID NO: 697189 - DNA, 16 bp, Homo sapiens
attttgtagatgtgat

SEQ ID NO: 697190 - DNA, 18 bp, Homo sapiens
attttgtataacttttga

SEQ ID NO: 697191 - DNA, 13 bp, Homo sapiens
attttgtatctgc

SEQ ID NO: 697192 - DNA, 16 bp, Homo sapiens
attttgtatgaaatat

SEQ ID NO: 697193 - DNA, 21 bp, Homo sapiens
attttgtatgaaatatatgtg

SEQ ID NO: 697194 - DNA, 15 bp, Homo sapiens
attttgtatgctgaa

SEQ ID NO: 697195 - DNA, 15 bp, Homo sapiens
attttgtatgtaaat

SEQ ID NO: 697196 - DNA, 17 bp, Homo sapiens
attttgtattaatttct

SEQ ID NO: 697197 - DNA, 20 bp, Homo sapiens
attttgtattacatctaatg

SEQ ID NO: 697198 - DNA, 17 bp, Homo sapiens
attttgtattgttaata

SEQ ID NO: 697199 - DNA, 19 bp, Homo sapiens
attttgtattgtttcaatt

SEQ ID NO: 697200 - DNA, 21 bp, Homo sapiens
attttgtcacattatttatta

SEQ ID NO: 697201 - DNA, 19 bp, Homo sapiens
attttgtccaagttcacag

SEQ ID NO: 697202 - DNA, 15 bp, Homo sapiens
attttgtccatttta

SEQ ID NO: 697203 - DNA, 18 bp, Homo sapiens
attttgtcccattttccc

SEQ ID NO: 697204 - DNA, 13 bp, Homo sapiens
attttgtctaaaa

SEQ ID NO: 697205 - DNA, 14 bp, Homo sapiens
attttgtctcactt

SEQ ID NO: 697206 - DNA, 22 bp, Homo sapiens
attttgtctcctacctgctgct

SEQ ID NO: 697207 - DNA, 15 bp, Homo sapiens
attttgtcttattct

SEQ ID NO: 697208 - DNA, 16 bp, Homo sapiens
attttgtcttattctt

SEQ ID NO: 697209 - DNA, 22 bp, Homo sapiens
attttgtctttttgtttgggat

SEQ ID NO: 697210 - DNA, 14 bp, Homo sapiens
attttgtgcattct

SEQ ID NO: 697211 - DNA, 19 bp, Homo sapiens
attttgtgcattctttggt

SEQ ID NO: 697212 - DNA, 16 bp, Homo sapiens
attttgtgctcattta

SEQ ID NO: 697213 - DNA, 23 bp, Homo sapiens
attttgtgtacaagttgttattg

SEQ ID NO: 697214 - DNA, 13 bp, Homo sapiens
attttgtgtgacc

SEQ ID NO: 697215 - DNA, 14 bp, Homo sapiens
attttgtgtgacca

SEQ ID NO: 697216 - DNA, 15 bp, Homo sapiens
attttgtgtgaccaa

SEQ ID NO: 697217 - DNA, 14 bp, Homo sapiens
attttgttaaagct

SEQ ID NO: 697218 - DNA, 18 bp, Homo sapiens
attttgttaagaagttga

SEQ ID NO: 697219 - DNA, 22 bp, Homo sapiens
attttgttacataaggatgact

SEQ ID NO: 697220 - DNA, 14 bp, Homo sapiens
attttgttctctgg

SEQ ID NO: 697221 - DNA, 14 bp, Homo sapiens
attttgttcttatt

SEQ ID NO: 697222 - DNA, 19 bp, Homo sapiens
attttgttgctgttttgat

SEQ ID NO: 697223 - DNA, 20 bp, Homo sapiens
attttgttgcttttgtgaac

SEQ ID NO: 697224 - DNA, 15 bp, Homo sapiens
attttgttggcatag

SEQ ID NO: 697225 - DNA, 22 bp, Homo sapiens
attttgtttcagaattttgtat

SEQ ID NO: 697226 - DNA, 17 bp, Homo sapiens
attttgtttctgtatat

SEQ ID NO: 697227 - DNA, 23 bp, Homo sapiens
attttgttttacttttttaacat

SEQ ID NO: 697228 - DNA, 20 bp, Homo sapiens
attttgttttattttgaatg

SEQ ID NO: 697229 - DNA, 18 bp, Homo sapiens
atttttaaaaaatatttt

SEQ ID NO: 697230 - DNA, 23 bp, Homo sapiens
atttttaaaaaatattttctctg

SEQ ID NO: 697231 - DNA, 13 bp, Homo sapiens
atttttaaaaaga

SEQ ID NO: 697232 - DNA, 23 bp, Homo sapiens
atttttaaaaagaaatctggtct

SEQ ID NO: 697233 - DNA, 17 bp, Homo sapiens
atttttaaaatatttat

SEQ ID NO: 697234 - DNA, 13 bp, Homo sapiens
atttttaaacaag

SEQ ID NO: 697235 - DNA, 13 bp, Homo sapiens
atttttaaagaat

SEQ ID NO: 697236 - DNA, 12 bp, Homo sapiens
atttttaaagat

SEQ ID NO: 697237 - DNA, 15 bp, Homo sapiens
atttttaaagcctgg

SEQ ID NO: 697238 - DNA, 18 bp, Homo sapiens
atttttaaagcctggctt

SEQ ID NO: 697239 - DNA, 15 bp, Homo sapiens
atttttaaaggcatt

SEQ ID NO: 697240 - DNA, 19 bp, Homo sapiens
atttttaaagtagaagagg

SEQ ID NO: 697241 - DNA, 19 bp, Homo sapiens
atttttaaatgtaaaacat

SEQ ID NO: 697242 - DNA, 16 bp, Homo sapiens
atttttaacacttaaa

SEQ ID NO: 697243 - DNA, 18 bp, Homo sapiens
atttttaacacttaaatt

SEQ ID NO: 697244 - DNA, 13 bp, Homo sapiens
atttttaaccact

SEQ ID NO: 697245 - DNA, 13 bp, Homo sapiens
atttttaactctt

SEQ ID NO: 697246 - DNA, 24 bp, Homo sapiens
atttttaacttttggaatcatact

SEQ ID NO: 697247 - DNA, 13 bp, Homo sapiens
atttttaagaact

SEQ ID NO: 697248 - DNA, 12 bp, Homo sapiens
atttttaagagc

SEQ ID NO: 697249 - DNA, 22 bp, Homo sapiens
atttttaagctccatgtgcata

SEQ ID NO: 697250 - DNA, 23 bp, Homo sapiens
atttttaagctccatgtgcatat

SEQ ID NO: 697251 - DNA, 18 bp, Homo sapiens
atttttaagtgctgcatt

SEQ ID NO: 697252 - DNA, 15 bp, Homo sapiens
atttttaatgtatct

SEQ ID NO: 697253 - DNA, 19 bp, Homo sapiens
atttttaatgtatctattt

SEQ ID NO: 697254 - DNA, 21 bp, Homo sapiens
atttttaatgtatctatttgt

SEQ ID NO: 697255 - DNA, 20 bp, Homo sapiens
atttttacaaataggtagag

SEQ ID NO: 697256 - DNA, 20 bp, Homo sapiens
atttttacaagaagtttatt

SEQ ID NO: 697257 - DNA, 22 bp, Homo sapiens
atttttacaagaagtttattct

SEQ ID NO: 697258 - DNA, 16 bp, Homo sapiens
atttttacaagttata

SEQ ID NO: 697259 - DNA, 19 bp, Homo sapiens
atttttacaataaataatc

SEQ ID NO: 697260 - DNA, 17 bp, Homo sapiens
atttttacactattgtg

SEQ ID NO: 697261 - DNA, 19 bp, Homo sapiens
atttttacatggagaaaac

SEQ ID NO: 697262 - DNA, 14 bp, Homo sapiens
atttttacatttaa

SEQ ID NO: 697263 - DNA, 21 bp, Homo sapiens
atttttacatttaaacctttt

SEQ ID NO: 697264 - DNA, 17 bp, Homo sapiens
atttttacctgtttaaa

SEQ ID NO: 697265 - DNA, 19 bp, Homo sapiens
atttttagaataagaattt

SEQ ID NO: 697266 - DNA, 21 bp, Homo sapiens
atttttagaattaaaaaagca

SEQ ID NO: 697267 - DNA, 23 bp, Homo sapiens
atttttagccataattttgcata

SEQ ID NO: 697268 - DNA, 21 bp, Homo sapiens
acctaagattacaaatcagaa

SEQ ID NO: 697269 - DNA, 14 bp, Homo sapiens
acctaagcacttct

SEQ ID NO: 697270 - DNA, 19 bp, Homo sapiens
acctaagcacttctagaat

SEQ ID NO: 697271 - DNA, 14 bp, Homo sapiens
acctaagccctgcc

SEQ ID NO: 697272 - DNA, 16 bp, Homo sapiens
acctaagtctctgtga

SEQ ID NO: 697273 - DNA, 13 bp, Homo sapiens
acctaagtgttga

SEQ ID NO: 697274 - DNA, 21 bp, Homo sapiens
acctaatctctgtaaagctaa

SEQ ID NO: 697275 - DNA, 12 bp, Homo sapiens
acctaatgctgg

SEQ ID NO: 697276 - DNA, 23 bp, Homo sapiens
acctacacactgtcatgcttcat

SEQ ID NO: 697277 - DNA, 16 bp, Homo sapiens
acctacacccctgtgc

SEQ ID NO: 697278 - DNA, 17 bp, Homo sapiens
atttttatataatatct

SEQ ID NO: 697279 - DNA, 13 bp, Homo sapiens
atttttatatcat

SEQ ID NO: 697280 - DNA, 14 bp, Homo sapiens
atttttatatttcc

SEQ ID NO: 697281 - DNA, 16 bp, Homo sapiens
atttttatcatgaatt

SEQ ID NO: 697282 - DNA, 16 bp, Homo sapiens
atttttatctatataa

SEQ ID NO: 697283 - DNA, 12 bp, Homo sapiens
atttttatgcag

SEQ ID NO: 697284 - DNA, 14 bp, Homo sapiens
atttttatgcagac

SEQ ID NO: 697285 - DNA, 16 bp, Homo sapiens
atttttatgcagacag

SEQ ID NO: 697286 - DNA, 13 bp, Homo sapiens
atttttatgtgca

SEQ ID NO: 697287 - DNA, 16 bp, Homo sapiens
atttttattaaatgta

SEQ ID NO: 697288 - DNA, 21 bp, Homo sapiens
atttttattaaatgtatttta

SEQ ID NO: 697289 - DNA, 22 bp, Homo sapiens
atttttattaattttagttttt

SEQ ID NO: 697290 - DNA, 20 bp, Homo sapiens
atttttattactttttttgt

SEQ ID NO: 697291 - DNA, 14 bp, Homo sapiens
atttttatttatat

SEQ ID NO: 697292 - DNA, 12 bp, Homo sapiens
atttttatttct

SEQ ID NO: 697293 - DNA, 21 bp, Homo sapiens
atttttatttttgctgagact

SEQ ID NO: 697294 - DNA, 23 bp, Homo sapiens
atttttcaaagcaattgaaatgc

SEQ ID NO: 697295 - DNA, 13 bp, Homo sapiens
atttttcaaatag

SEQ ID NO: 697296 - DNA, 16 bp, Homo sapiens
atttttcaaatagatt

SEQ ID NO: 697297 - DNA, 22 bp, Homo sapiens
atttttcaacatttttttttct

SEQ ID NO: 697298 - DNA, 14 bp, Homo sapiens
atttttcaaggcat

SEQ ID NO: 697299 - DNA, 17 bp, Homo sapiens
atttttcaataaagcat

SEQ ID NO: 697300 - DNA, 17 bp, Homo sapiens
atttttcaatatattga

SEQ ID NO: 697301 - DNA, 15 bp, Homo sapiens
atttttcagatgctt

SEQ ID NO: 697302 - DNA, 18 bp, Homo sapiens
atttttcagatgcttctg

SEQ ID NO: 697303 - DNA, 15 bp, Homo sapiens
atttttcagttccaa

SEQ ID NO: 697304 - DNA, 18 bp, Homo sapiens
atttttcagttccaagaa

SEQ ID NO: 697305 - DNA, 21 bp, Homo sapiens
atttttcatacttttcttact

SEQ ID NO: 697306 - DNA, 22 bp, Homo sapiens
atttttcatcagtcatcactct

SEQ ID NO: 697307 - DNA, 17 bp, Homo sapiens
atttttccaatcacagt

SEQ ID NO: 697308 - DNA, 14 bp, Homo sapiens
atttttccaggact

SEQ ID NO: 697309 - DNA, 15 bp, Homo sapiens
atttttccaggactc

SEQ ID NO: 697310 - DNA, 15 bp, Homo sapiens
atttttccatctgtg

SEQ ID NO: 697311 - DNA, 14 bp, Homo sapiens
atttttccatgtgt

SEQ ID NO: 697312 - DNA, 20 bp, Homo sapiens
atttttccatttatttatga

SEQ ID NO: 697313 - DNA, 15 bp, Homo sapiens
atttttcccagtatt

SEQ ID NO: 697314 - DNA, 19 bp, Homo sapiens
atttttcctctgttcacaa

SEQ ID NO: 697315 - DNA, 12 bp, Homo sapiens
atttttctaaaa

SEQ ID NO: 697316 - DNA, 17 bp, Homo sapiens
atttttctaaccttgaa

SEQ ID NO: 697317 - DNA, 16 bp, Homo sapiens
atttttctatctggtt

SEQ ID NO: 697318 - DNA, 10 bp, Homo sapiens
atttttctgt

SEQ ID NO: 697319 - DNA, 14 bp, Homo sapiens
atttttctgtactt

SEQ ID NO: 697320 - DNA, 21 bp, Homo sapiens
atttttcttagggaaggatac

SEQ ID NO: 697321 - DNA, 15 bp, Homo sapiens
atttttgaaaaatat

SEQ ID NO: 697322 - DNA, 16 bp, Homo sapiens
atttttgaaaaatatt

SEQ ID NO: 697323 - DNA, 14 bp, Homo sapiens
atttttgacacttt

SEQ ID NO: 697324 - DNA, 20 bp, Homo sapiens
atttttgactgtagccacag

SEQ ID NO: 697325 - DNA, 19 bp, Homo sapiens
atttttgaggaattatcat

SEQ ID NO: 697326 - DNA, 23 bp, Homo sapiens
atttttgatacagttttcagaaa

SEQ ID NO: 697327 - DNA, 19 bp, Homo sapiens
atttttgatatctcaatct

SEQ ID NO: 697328 - DNA, 11 bp, Homo sapiens
atttttgattt

SEQ ID NO: 697329 - DNA, 13 bp, Homo sapiens
atttttgatttat

SEQ ID NO: 697330 - DNA, 15 bp, Homo sapiens
atttttgcaaaataa

SEQ ID NO: 697331 - DNA, 22 bp, Homo sapiens
atttttgccctgagtccaagag

SEQ ID NO: 697332 - DNA, 16 bp, Homo sapiens
atttttgcctatcttt

SEQ ID NO: 697333 - DNA, 22 bp, Homo sapiens
atttttgcctatctttaaacat

SEQ ID NO: 697334 - DNA, 20 bp, Homo sapiens
atttttgcttttagaaaagg

SEQ ID NO: 697335 - DNA, 12 bp, Homo sapiens
atttttggactg

SEQ ID NO: 697336 - DNA, 15 bp, Homo sapiens
atttttggtatttat

SEQ ID NO: 697337 - DNA, 20 bp, Homo sapiens
atttttggtatttatgtaaa

SEQ ID NO: 697338 - DNA, 19 bp, Homo sapiens
atttttggtgggaatccaa

SEQ ID NO: 697339 - DNA, 15 bp, Homo sapiens
atttttggttgaata

SEQ ID NO: 697340 - DNA, 11 bp, Homo sapiens
atttttgtaca

SEQ ID NO: 697341 - DNA, 14 bp, Homo sapiens
atttttgtacatat

SEQ ID NO: 697342 - DNA, 16 bp, Homo sapiens
atttttgtataaaaag

SEQ ID NO: 697343 - DNA, 21 bp, Homo sapiens
atttttgtataaaaaggaaat

SEQ ID NO: 697344 - DNA, 22 bp, Homo sapiens
atttttgtataaaaaggaaatt

SEQ ID NO: 697345 - DNA, 16 bp, Homo sapiens
atttttgtctcagaag

SEQ ID NO: 697346 - DNA, 14 bp, Homo sapiens
atttttgtcttgtg

SEQ ID NO: 697347 - DNA, 13 bp, Homo sapiens
atttttgtgcaca

SEQ ID NO: 697348 - DNA, 19 bp, Homo sapiens
atttttgtgttttcttgta

SEQ ID NO: 697349 - DNA, 20 bp, Homo sapiens
atttttgtgttttcttgtaa

SEQ ID NO: 697350 - DNA, 16 bp, Homo sapiens
atttttgttactctct

SEQ ID NO: 697351 - DNA, 17 bp, Homo sapiens
atttttgttagcaaaga

SEQ ID NO: 697352 - DNA, 22 bp, Homo sapiens
atttttgtttcttccaaagcac

SEQ ID NO: 697353 - DNA, 22 bp, Homo sapiens
atttttgtttggactgttttca

SEQ ID NO: 697354 - DNA, 14 bp, Homo sapiens
atttttgttttgaa

SEQ ID NO: 697355 - DNA, 16 bp, Homo sapiens
atttttgttttgaaag

SEQ ID NO: 697356 - DNA, 12 bp, Homo sapiens
attttttaaagc

SEQ ID NO: 697357 - DNA, 13 bp, Homo sapiens
attttttaaatgc

SEQ ID NO: 697358 - DNA, 19 bp, Homo sapiens
attttttaaatgtaaaatt

SEQ ID NO: 697359 - DNA, 13 bp, Homo sapiens
attttttaaattc

SEQ ID NO: 697360 - DNA, 15 bp, Homo sapiens
attttttaagagaca

SEQ ID NO: 697361 - DNA, 11 bp, Homo sapiens
attttttaagt

SEQ ID NO: 697362 - DNA, 18 bp, Homo sapiens
attttttaagtatttata

SEQ ID NO: 697363 - DNA, 21 bp, Homo sapiens
attttttaagtgaaaatatag

SEQ ID NO: 697364 - DNA, 16 bp, Homo sapiens
attttttaataaactg

SEQ ID NO: 697365 - DNA, 20 bp, Homo sapiens
attttttaattattatttat

SEQ ID NO: 697366 - DNA, 23 bp, Homo sapiens
attttttacttttcacactgtct

SEQ ID NO: 697367 - DNA, 18 bp, Homo sapiens
attttttaggacatctta

SEQ ID NO: 697368 - DNA, 14 bp, Homo sapiens
attttttagtctgt

SEQ ID NO: 697369 - DNA, 15 bp, Homo sapiens
attttttatactgta

SEQ ID NO: 697370 - DNA, 13 bp, Homo sapiens
attttttatatat

SEQ ID NO: 697371 - DNA, 18 bp, Homo sapiens
attttttatatatacagt

SEQ ID NO: 697372 - DNA, 19 bp, Homo sapiens
attttttatgtacaaccct

SEQ ID NO: 697373 - DNA, 16 bp, Homo sapiens
attttttatttacatt

SEQ ID NO: 697374 - DNA, 17 bp, Homo sapiens
attttttatttacattt

SEQ ID NO: 697375 - DNA, 13 bp, Homo sapiens
attttttccaaaa

SEQ ID NO: 697376 - DNA, 15 bp, Homo sapiens
attttttccctcctg

SEQ ID NO: 697377 - DNA, 19 bp, Homo sapiens
attttttccctcctgacaa

SEQ ID NO: 697378 - DNA, 12 bp, Homo sapiens
attttttccctt

SEQ ID NO: 697379 - DNA, 11 bp, Homo sapiens
attttttcctt

SEQ ID NO: 697380 - DNA, 20 bp, Homo sapiens
attttttccttcaaagttta

SEQ ID NO: 697381 - DNA, 21 bp, Homo sapiens
attttttcgtgcactctgcta

SEQ ID NO: 697382 - DNA, 14 bp, Homo sapiens
attttttctacaca

SEQ ID NO: 697383 - DNA, 20 bp, Homo sapiens
attttttgggccattacccc

SEQ ID NO: 697384 - DNA, 17 bp, Homo sapiens
attttttggtacaaaaa

SEQ ID NO: 697385 - DNA, 17 bp, Homo sapiens
attttttgttgacatta

SEQ ID NO: 697386 - DNA, 21 bp, Homo sapiens
attttttgttgacattagtct

SEQ ID NO: 697387 - DNA, 16 bp, Homo sapiens
atttttttaaatttca

SEQ ID NO: 697388 - DNA, 19 bp, Homo sapiens
atttttttaactacataaa

SEQ ID NO: 697389 - DNA, 18 bp, Homo sapiens
atttttttaatagtgctt

SEQ ID NO: 697390 - DNA, 15 bp, Homo sapiens
atttttttagattga

SEQ ID NO: 697391 - DNA, 21 bp, Homo sapiens
atttttttatcttgggactgg

SEQ ID NO: 697392 - DNA, 22 bp, Homo sapiens
atttttttcactggagttacat

SEQ ID NO: 697393 - DNA, 12 bp, Homo sapiens
atttttttctac

SEQ ID NO: 697394 - DNA, 20 bp, Homo sapiens
atttttttctgatttgtcct

SEQ ID NO: 697395 - DNA, 19 bp, Homo sapiens
attttttttaaaatagaaa

SEQ ID NO: 697396 - DNA, 18 bp, Homo sapiens
acctcatcactggactgc

SEQ ID NO: 697397 - DNA, 17 bp, Homo sapiens
acctcatcatccacccg

SEQ ID NO: 697398 - DNA, 19 bp, Homo sapiens
acctcatcatccacccgct

SEQ ID NO: 697399 - DNA, 18 bp, Homo sapiens
acctcatccatgcacttt

SEQ ID NO: 697400 - DNA, 14 bp, Homo sapiens
acctcatctctgaa

SEQ ID NO: 697401 - DNA, 18 bp, Homo sapiens
attttttttaagtattta

SEQ ID NO: 697402 - DNA, 14 bp, Homo sapiens
attttttttacatt

SEQ ID NO: 697403 - DNA, 22 bp, Homo sapiens
attttttttatattgccttatt

SEQ ID NO: 697404 - DNA, 16 bp, Homo sapiens
attttttttatattta

SEQ ID NO: 697405 - DNA, 20 bp, Homo sapiens
attttttttattagtattgt

SEQ ID NO: 697406 - DNA, 19 bp, Homo sapiens
attttttttccttgcctgt

SEQ ID NO: 697407 - DNA, 15 bp, Homo sapiens
attttttttgtagct

SEQ ID NO: 697408 - DNA, 21 bp, Homo sapiens
atttttttttaattttgatat

SEQ ID NO: 697409 - DNA, 15 bp, Homo sapiens
atttttttttcaatc

SEQ ID NO: 697410 - DNA, 19 bp, Homo sapiens
atttttttttcaatcaact

SEQ ID NO: 697411 - DNA, 14 bp, Homo sapiens
atttttttttctaa

SEQ ID NO: 697412 - DNA, 19 bp, Homo sapiens
attttttttttaaattatt

SEQ ID NO: 697413 - DNA, 22 bp, Homo sapiens
caaaaaaaaaaaaaagcatcta

SEQ ID NO: 697414 - DNA, 21 bp, Homo sapiens
caaaaaaaaaatagagagaga

SEQ ID NO: 697415 - DNA, 16 bp, Homo sapiens
caaaaaaaaagtttta

SEQ ID NO: 697416 - DNA, 15 bp, Homo sapiens
caaaaaaaaattttt

SEQ ID NO: 697417 - DNA, 12 bp, Homo sapiens
caaaaaaaacaa

SEQ ID NO: 697418 - DNA, 20 bp, Homo sapiens
caaaaaaaagaaaatgtctt

SEQ ID NO: 697419 - DNA, 19 bp, Homo sapiens
caaaaaaaatttagccggg

SEQ ID NO: 697420 - DNA, 21 bp, Homo sapiens
caaaaaaaatttagccgggcg

SEQ ID NO: 697421 - DNA, 15 bp, Homo sapiens
caaaaaaacaaaaaa

SEQ ID NO: 697422 - DNA, 13 bp, Homo sapiens
caaaaaaacacta

SEQ ID NO: 697423 - DNA, 13 bp, Homo sapiens
caaaaaaagcctc

SEQ ID NO: 697424 - DNA, 22 bp, Homo sapiens
caaaaaaaggaaaaataatcaa

SEQ ID NO: 697425 - DNA, 20 bp, Homo sapiens
caaaaaaagggaaggattta

SEQ ID NO: 697426 - DNA, 20 bp, Homo sapiens
caaaaaaagttgaaggcctt

SEQ ID NO: 697427 - DNA, 21 bp, Homo sapiens
caaaaaaatatcagacaagca

SEQ ID NO: 697428 - DNA, 14 bp, Homo sapiens
caaaaaaattaaat

SEQ ID NO: 697429 - DNA, 15 bp, Homo sapiens
caaaaaaatttaaaa

SEQ ID NO: 697430 - DNA, 18 bp, Homo sapiens
caaaaaaatttaaaatta

SEQ ID NO: 697431 - DNA, 20 bp, Homo sapiens
caaaaaaatttaaaattacg

SEQ ID NO: 697432 - DNA, 12 bp, Homo sapiens
caaaaaacagat

SEQ ID NO: 697433 - DNA, 12 bp, Homo sapiens
caaaaaagaaaa

SEQ ID NO: 697434 - DNA, 18 bp, Homo sapiens
caaaaaaggtaactaact

SEQ ID NO: 697435 - DNA, 22 bp, Homo sapiens
caaaaaagtccaattttaattt

SEQ ID NO: 697436 - DNA, 13 bp, Homo sapiens
caaaaaatcatgt

SEQ ID NO: 697437 - DNA, 19 bp, Homo sapiens
caaaaaattaaagcattta

SEQ ID NO: 697438 - DNA, 18 bp, Homo sapiens
caaaaaattagccgggcg

SEQ ID NO: 697439 - DNA, 11 bp, Homo sapiens
caaaaaattat

SEQ ID NO: 697440 - DNA, 14 bp, Homo sapiens
caaaaaattcttta

SEQ ID NO: 697441 - DNA, 14 bp, Homo sapiens
caaaaacaaagaaa

SEQ ID NO: 697442 - DNA, 15 bp, Homo sapiens
caaaaacaaagaaaa

SEQ ID NO: 697443 - DNA, 18 bp, Homo sapiens
caaaaacagaatttgaga

SEQ ID NO: 697444 - DNA, 13 bp, Homo sapiens
caaaaacagcctc

SEQ ID NO: 697445 - DNA, 19 bp, Homo sapiens
caaaaacatacttcaaaaa

SEQ ID NO: 697446 - DNA, 15 bp, Homo sapiens
caaaaaccaaaaaaa

SEQ ID NO: 697447 - DNA, 15 bp, Homo sapiens
caaaaaccatgttgc

SEQ ID NO: 697448 - DNA, 21 bp, Homo sapiens
caaaaacccagcaacagaaaa

SEQ ID NO: 697449 - DNA, 19 bp, Homo sapiens
caaaaaccctaattttgta

SEQ ID NO: 697450 - DNA, 22 bp, Homo sapiens
caaaaaccctaattttgtacat

SEQ ID NO: 697451 - DNA, 23 bp, Homo sapiens
caaaaaccctaattttgtacata

SEQ ID NO: 697452 - DNA, 15 bp, Homo sapiens
caaaaacttccttta

SEQ ID NO: 697453 - DNA, 16 bp, Homo sapiens
caaaaacttcctttac

SEQ ID NO: 697454 - DNA, 16 bp, Homo sapiens
caaaaagaaatgtcaa

SEQ ID NO: 697455 - DNA, 18 bp, Homo sapiens
caaaaagagacccacaat

SEQ ID NO: 697456 - DNA, 16 bp, Homo sapiens
caaaaagcaaaatcat

SEQ ID NO: 697457 - DNA, 14 bp, Homo sapiens
caaaaagcaaggga

SEQ ID NO: 697458 - DNA, 21 bp, Homo sapiens
caaaaagcaagggagaaaaga

SEQ ID NO: 697459 - DNA, 16 bp, Homo sapiens
caaaaagcagagtgga

SEQ ID NO: 697460 - DNA, 21 bp, Homo sapiens
caaaaagcagagtggactgca

SEQ ID NO: 697461 - DNA, 23 bp, Homo sapiens
caaaaagcagagtggactgcatt

SEQ ID NO: 697462 - DNA, 12 bp, Homo sapiens
caaaaagctaac

SEQ ID NO: 697463 - DNA, 13 bp, Homo sapiens
caaaaagctaatg

SEQ ID NO: 697464 - DNA, 18 bp, Homo sapiens
caaaaagctaatgtgcag

SEQ ID NO: 697465 - DNA, 14 bp, Homo sapiens
caaaaagctctgaa

SEQ ID NO: 697466 - DNA, 22 bp, Homo sapiens
caaaaaggaccaactggcttct

SEQ ID NO: 697467 - DNA, 17 bp, Homo sapiens
caaaaaggcaaatattg

SEQ ID NO: 697468 - DNA, 23 bp, Homo sapiens
caaaaaggcaaatattgaagttg

SEQ ID NO: 697469 - DNA, 13 bp, Homo sapiens
caaaaaggcagga

SEQ ID NO: 697470 - DNA, 14 bp, Homo sapiens
caaaaagtatatta

SEQ ID NO: 697471 - DNA, 17 bp, Homo sapiens
caaaaagtcatttttct

SEQ ID NO: 697472 - DNA, 12 bp, Homo sapiens
caaaaagtgttt

SEQ ID NO: 697473 - DNA, 10 bp, Homo sapiens
caaaaataaa

SEQ ID NO: 697474 - DNA, 14 bp, Homo sapiens
caaaaataaaatat

SEQ ID NO: 697475 - DNA, 12 bp, Homo sapiens
caaaaataaatt

SEQ ID NO: 697476 - DNA, 15 bp, Homo sapiens
caaaaataacactgt

SEQ ID NO: 697477 - DNA, 16 bp, Homo sapiens
caaaaataatcatgaa

SEQ ID NO: 697478 - DNA, 15 bp, Homo sapiens
caaaaatagccctgc

SEQ ID NO: 697479 - DNA, 14 bp, Homo sapiens
caaaaatagctaaa

SEQ ID NO: 697480 - DNA, 22 bp, Homo sapiens
caaaaatatttataaaacttct

SEQ ID NO: 697481 - DNA, 19 bp, Homo sapiens
caaaaatgaaagcatgtct

SEQ ID NO: 697482 - DNA, 13 bp, Homo sapiens
caaaaatgatttt

SEQ ID NO: 697483 - DNA, 14 bp, Homo sapiens
caaaaatgttccct

SEQ ID NO: 697484 - DNA, 22 bp, Homo sapiens
caaaaatgttcccttgaccatt

SEQ ID NO: 697485 - DNA, 15 bp, Homo sapiens
caaaaattagccggg

SEQ ID NO: 697486 - DNA, 17 bp, Homo sapiens
caaaaattagccgggca

SEQ ID NO: 697487 - DNA, 17 bp, Homo sapiens
caaaaattgacttagat

SEQ ID NO: 697488 - DNA, 20 bp, Homo sapiens
caaaaattgacttagatatt

SEQ ID NO: 697489 - DNA, 15 bp, Homo sapiens
caaaaattgccaagt

SEQ ID NO: 697490 - DNA, 23 bp, Homo sapiens
caaaaatttattatatatttaca

SEQ ID NO: 697491 - DNA, 22 bp, Homo sapiens
caaaaatttctgtaaaacaggt

SEQ ID NO: 697492 - DNA, 17 bp, Homo sapiens
caaaacaaaaattaggt

SEQ ID NO: 697493 - DNA, 23 bp, Homo sapiens
caaaacaaaaattaggtattttg

SEQ ID NO: 697494 - DNA, 16 bp, Homo sapiens
caaaacaaaacaaact

SEQ ID NO: 697495 - DNA, 13 bp, Homo sapiens
caaaacaaattca

SEQ ID NO: 697496 - DNA, 20 bp, Homo sapiens
caaaacaagtttttctgtca

SEQ ID NO: 697497 - DNA, 16 bp, Homo sapiens
caaaacaatgtttaaa

SEQ ID NO: 697498 - DNA, 18 bp, Homo sapiens
caaaacaatgtttaaacc

SEQ ID NO: 697499 - DNA, 16 bp, Homo sapiens
caaaacatcacattcc

SEQ ID NO: 697500 - DNA, 17 bp, Homo sapiens
caaaacatctctgcagt

SEQ ID NO: 697501 - DNA, 13 bp, Homo sapiens
caaaacattcatg

SEQ ID NO: 697502 - DNA, 12 bp, Homo sapiens
caaaacatttct

SEQ ID NO: 697503 - DNA, 21 bp, Homo sapiens
caaaacatttctggacagtac

SEQ ID NO: 697504 - DNA, 12 bp, Homo sapiens
caaaaccaaaca

SEQ ID NO: 697505 - DNA, 22 bp, Homo sapiens
caaaaccaaacttgttcattta

SEQ ID NO: 697506 - DNA, 13 bp, Homo sapiens
caaaaccacagcc

SEQ ID NO: 697507 - DNA, 16 bp, Homo sapiens
caaaaccacagccctg

SEQ ID NO: 697508 - DNA, 23 bp, Homo sapiens
caaaaccacatgggctgggggcc

SEQ ID NO: 697509 - DNA, 22 bp, Homo sapiens
caaaaccatgcctggtattttc

SEQ ID NO: 697510 - DNA, 23 bp, Homo sapiens
caaaaccattgatgtttaagtgt

SEQ ID NO: 697511 - DNA, 20 bp, Homo sapiens
caaaacctgcagttcctgag

SEQ ID NO: 697512 - DNA, 14 bp, Homo sapiens
caaaacctgcttcc

SEQ ID NO: 697513 - DNA, 15 bp, Homo sapiens
caaaacctgcttcct

SEQ ID NO: 697514 - DNA, 18 bp, Homo sapiens
caaaacctgcttccttca

SEQ ID NO: 697515 - DNA, 20 bp, Homo sapiens
caaaacctgcttccttcagt

SEQ ID NO: 697516 - DNA, 16 bp, Homo sapiens
caaaacctgtgccagg

SEQ ID NO: 697517 - DNA, 20 bp, Homo sapiens
caaaacctgtgccaggctga

SEQ ID NO: 697518 - DNA, 15 bp, Homo sapiens
caaaaccttttactg

SEQ ID NO: 697519 - DNA, 15 bp, Homo sapiens
caaaacgagggctga

SEQ ID NO: 697520 - DNA, 19 bp, Homo sapiens
caaaacgcatggagtgtgt

SEQ ID NO: 697521 - DNA, 21 bp, Homo sapiens
caaaacggttttactgcagct

SEQ ID NO: 697522 - DNA, 19 bp, Homo sapiens
caaaactacttttctaaaa

SEQ ID NO: 697523 - DNA, 19 bp, Homo sapiens
cagagcattacgtgagcca

SEQ ID NO: 697524 - DNA, 20 bp, Homo sapiens
cagagcattacgtgagccag

SEQ ID NO: 697525 - DNA, 22 bp, Homo sapiens
cagagcattacgtgagccaggt

SEQ ID NO: 697526 - DNA, 22 bp, Homo sapiens
cagagccacccctaaagagata

SEQ ID NO: 697527 - DNA, 13 bp, Homo sapiens
cagagccacctgg

SEQ ID NO: 697528 - DNA, 14 bp, Homo sapiens
cagagccacctgga

SEQ ID NO: 697529 - DNA, 13 bp, Homo sapiens
cagagccagcctg

SEQ ID NO: 697530 - DNA, 15 bp, Homo sapiens
cagagccagcctggc

SEQ ID NO: 697531 - DNA, 22 bp, Homo sapiens
cagagccagcctggctctgccc

SEQ ID NO: 697532 - DNA, 12 bp, Homo sapiens
cagagccaggag

SEQ ID NO: 697533 - DNA, 13 bp, Homo sapiens
cagagccaggaga

SEQ ID NO: 697534 - DNA, 17 bp, Homo sapiens
cagagccaggagaagct

SEQ ID NO: 697535 - DNA, 23 bp, Homo sapiens
cagagccaggagaagctcagctg

SEQ ID NO: 697536 - DNA, 17 bp, Homo sapiens
cagagccagggctgtcc

SEQ ID NO: 697537 - DNA, 19 bp, Homo sapiens
cagagccagggctgtcctt

SEQ ID NO: 697538 - DNA, 20 bp, Homo sapiens
cagagccagggctgtcctta

SEQ ID NO: 697539 - DNA, 17 bp, Homo sapiens
cagagccatgccaggct

SEQ ID NO: 697540 - DNA, 19 bp, Homo sapiens
cagagccatgccaggctgc

SEQ ID NO: 697541 - DNA, 17 bp, Homo sapiens
cagagccatgctgggaa

SEQ ID NO: 697542 - DNA, 14 bp, Homo sapiens
cagagccatggact

SEQ ID NO: 697543 - DNA, 15 bp, Homo sapiens
cagagccatgggcct

SEQ ID NO: 697544 - DNA, 17 bp, Homo sapiens
cagagccatgggcctgg

SEQ ID NO: 697545 - DNA, 16 bp, Homo sapiens
cagagcccaccagcca

SEQ ID NO: 697546 - DNA, 18 bp, Homo sapiens
cagagcccaccagccagc

SEQ ID NO: 697547 - DNA, 15 bp, Homo sapiens
cagagcccagctctt

SEQ ID NO: 697548 - DNA, 17 bp, Homo sapiens
cagagcccagctcttgc

SEQ ID NO: 697549 - DNA, 19 bp, Homo sapiens
cagagccccaagcaggacg

SEQ ID NO: 697550 - DNA, 13 bp, Homo sapiens
cagagccccacac

SEQ ID NO: 697551 - DNA, 15 bp, Homo sapiens
cagagccccacgctg

SEQ ID NO: 697552 - DNA, 16 bp, Homo sapiens
cagagccccacgctgt

SEQ ID NO: 697553 - DNA, 18 bp, Homo sapiens
cagagccccactcccggc

SEQ ID NO: 697554 - DNA, 23 bp, Homo sapiens
cagagccccactcccggccaggc

SEQ ID NO: 697555 - DNA, 16 bp, Homo sapiens
cagagcccccagccct

SEQ ID NO: 697556 - DNA, 22 bp, Homo sapiens
cagagcccctcctccagcccct

SEQ ID NO: 697557 - DNA, 13 bp, Homo sapiens
cagagccctctga

SEQ ID NO: 697558 - DNA, 21 bp, Homo sapiens
cagagccctgaggggctgggc

SEQ ID NO: 697559 - DNA, 14 bp, Homo sapiens
cagagccctgccct

SEQ ID NO: 697560 - DNA, 20 bp, Homo sapiens
cagagccctggaccttgggc

SEQ ID NO: 697561 - DNA, 22 bp, Homo sapiens
cagagccctggaccttgggcct

SEQ ID NO: 697562 - DNA, 12 bp, Homo sapiens
cagagccctggc

SEQ ID NO: 697563 - DNA, 15 bp, Homo sapiens
cagagccctggctgg

SEQ ID NO: 697564 - DNA, 13 bp, Homo sapiens
cagagcccttgac

SEQ ID NO: 697565 - DNA, 20 bp, Homo sapiens
cagagcccttgactgtacag

SEQ ID NO: 697566 - DNA, 23 bp, Homo sapiens
cagagccgggaggaaaaggcccc

SEQ ID NO: 697567 - DNA, 19 bp, Homo sapiens
cagagcctctgagatgatg

SEQ ID NO: 697568 - DNA, 16 bp, Homo sapiens
cagagcctctgctgga

SEQ ID NO: 697569 - DNA, 14 bp, Homo sapiens
cagagcctctggcc

SEQ ID NO: 697570 - DNA, 17 bp, Homo sapiens
cagagcctctggcccct

SEQ ID NO: 697571 - DNA, 18 bp, Homo sapiens
cagagcctctggcccctc

SEQ ID NO: 697572 - DNA, 14 bp, Homo sapiens
cagagcctggcccc

SEQ ID NO: 697573 - DNA, 13 bp, Homo sapiens
cagagcctggctt

SEQ ID NO: 697574 - DNA, 13 bp, Homo sapiens
cagagcctgtccc

SEQ ID NO: 697575 - DNA, 17 bp, Homo sapiens
cagagccttccatgacc

SEQ ID NO: 697576 - DNA, 13 bp, Homo sapiens
cagagccttctca

SEQ ID NO: 697577 - DNA, 20 bp, Homo sapiens
cagagccttctcagaagcac

SEQ ID NO: 697578 - DNA, 18 bp, Homo sapiens
cagagcctttggatgacc

SEQ ID NO: 697579 - DNA, 20 bp, Homo sapiens
cagagcgagagtctgtctca

SEQ ID NO: 697580 - DNA, 20 bp, Homo sapiens
cagagcgagattccgtctca

SEQ ID NO: 697581 - DNA, 20 bp, Homo sapiens
cagagcgaggaaaggatttt

SEQ ID NO: 697582 - DNA, 20 bp, Homo sapiens
cagagcgccaggaagccaga

SEQ ID NO: 697583 - DNA, 21 bp, Homo sapiens
cagagcgccaggaagccagag

SEQ ID NO: 697584 - DNA, 19 bp, Homo sapiens
cagagcggaggctgtgtgc

SEQ ID NO: 697585 - DNA, 14 bp, Homo sapiens
cagagcgggaggga

SEQ ID NO: 697586 - DNA, 19 bp, Homo sapiens
cagagcggggtcccctctg

SEQ ID NO: 697587 - DNA, 21 bp, Homo sapiens
cagagcggggtcccctctgtg

SEQ ID NO: 697588 - DNA, 14 bp, Homo sapiens
cagagcgtccttcc

SEQ ID NO: 697589 - DNA, 17 bp, Homo sapiens
cagagcgtccttccccc

SEQ ID NO: 697590 - DNA, 22 bp, Homo sapiens
cagagcgtccttccccctgtag

SEQ ID NO: 697591 - DNA, 23 bp, Homo sapiens
cagagcgtccttccccctgtaga

SEQ ID NO: 697592 - DNA, 20 bp, Homo sapiens
cagagctaaactccttcctg

SEQ ID NO: 697593 - DNA, 22 bp, Homo sapiens
cagagctaagggtgggtgctca

SEQ ID NO: 697594 - DNA, 16 bp, Homo sapiens
cagagctagggctgct

SEQ ID NO: 697595 - DNA, 19 bp, Homo sapiens
cagagctagggctgctgct

SEQ ID NO: 697596 - DNA, 17 bp, Homo sapiens
cagagctctcgaggaaa

SEQ ID NO: 697597 - DNA, 22 bp, Homo sapiens
cagagctctcgaggaaagtggt

SEQ ID NO: 697598 - DNA, 21 bp, Homo sapiens
cagagctcttcaagctgtccc

SEQ ID NO: 697599 - DNA, 14 bp, Homo sapiens
cagagctgaacctt

SEQ ID NO: 697600 - DNA, 20 bp, Homo sapiens
cagagctgaggatttcctgg

SEQ ID NO: 697601 - DNA, 22 bp, Homo sapiens
cagagctgaggatttcctggag

SEQ ID NO: 697602 - DNA, 20 bp, Homo sapiens
cagagctgagggccctgtgg

SEQ ID NO: 697603 - DNA, 21 bp, Homo sapiens
cagagctgagggccctgtgga

SEQ ID NO: 697604 - DNA, 23 bp, Homo sapiens
cagagctggagatgaggccagac

SEQ ID NO: 697605 - DNA, 15 bp, Homo sapiens
cagagctggagcccc

SEQ ID NO: 697606 - DNA, 18 bp, Homo sapiens
cagagctggagcccccag

SEQ ID NO: 697607 - DNA, 21 bp, Homo sapiens
cagagctggagcccccagcag

SEQ ID NO: 697608 - DNA, 18 bp, Homo sapiens
cagagctggctctgagcg

SEQ ID NO: 697609 - DNA, 13 bp, Homo sapiens
cagagctgggagg

SEQ ID NO: 697610 - DNA, 13 bp, Homo sapiens
cagagctggggct

SEQ ID NO: 697611 - DNA, 21 bp, Homo sapiens
cagagctggggctgccagcct

SEQ ID NO: 697612 - DNA, 11 bp, Homo sapiens
cagagctgtgc

SEQ ID NO: 697613 - DNA, 16 bp, Homo sapiens
cagagctgtgccagca

SEQ ID NO: 697614 - DNA, 17 bp, Homo sapiens
cagagctgtgccagcag

SEQ ID NO: 697615 - DNA, 21 bp, Homo sapiens
cagagctgtgcctgctcagca

SEQ ID NO: 697616 - DNA, 12 bp, Homo sapiens
cagagctgtgga

SEQ ID NO: 697617 - DNA, 15 bp, Homo sapiens
cagagctgtggagga

SEQ ID NO: 697618 - DNA, 22 bp, Homo sapiens
cagagctgtttatggcctcagc

SEQ ID NO: 697619 - DNA, 20 bp, Homo sapiens
cagagcttattggccactgg

SEQ ID NO: 697620 - DNA, 16 bp, Homo sapiens
cagagctttaaaagta

SEQ ID NO: 697621 - DNA, 23 bp, Homo sapiens
cagagctttaaaagtatctttaa

SEQ ID NO: 697622 - DNA, 20 bp, Homo sapiens
cagagctttcttttgtatta

SEQ ID NO: 697623 - DNA, 21 bp, Homo sapiens
cagagctttcttttgtattaa

SEQ ID NO: 697624 - DNA, 12 bp, Homo sapiens
cagagctttgtc

SEQ ID NO: 697625 - DNA, 15 bp, Homo sapiens
cagagctttgtcact

SEQ ID NO: 697626 - DNA, 19 bp, Homo sapiens
cagagctttgtcacttgcc

SEQ ID NO: 697627 - DNA, 20 bp, Homo sapiens
cagagctttgtcacttgcca

SEQ ID NO: 697628 - DNA, 22 bp, Homo sapiens
cagagctttgtcacttgccaca

SEQ ID NO: 697629 - DNA, 14 bp, Homo sapiens
cagagcttttcaga

SEQ ID NO: 697630 - DNA, 19 bp, Homo sapiens
cagaggaaagggctggctc

SEQ ID NO: 697631 - DNA, 20 bp, Homo sapiens
cagaggaaagggctggctcc

SEQ ID NO: 697632 - DNA, 21 bp, Homo sapiens
cagaggaactgtccagagagc

SEQ ID NO: 697633 - DNA, 12 bp, Homo sapiens
cagaggaagagc

SEQ ID NO: 697634 - DNA, 14 bp, Homo sapiens
cagaggaagagcag

SEQ ID NO: 697635 - DNA, 15 bp, Homo sapiens
cagaggaagagcagg

SEQ ID NO: 697636 - DNA, 18 bp, Homo sapiens
cagaggaaggggccagag

SEQ ID NO: 697637 - DNA, 21 bp, Homo sapiens
cagaggaaggggccagaggct

SEQ ID NO: 697638 - DNA, 17 bp, Homo sapiens
cagaggaatcctggcag

SEQ ID NO: 697639 - DNA, 22 bp, Homo sapiens
cagaggaattgattgtcagcca

SEQ ID NO: 697640 - DNA, 23 bp, Homo sapiens
cagaggaatttggctgcttctac

SEQ ID NO: 697641 - DNA, 18 bp, Homo sapiens
cagaggacagctctgggg

SEQ ID NO: 697642 - DNA, 14 bp, Homo sapiens
cagaggaccccagg

SEQ ID NO: 697643 - DNA, 15 bp, Homo sapiens
cagaggaccccaggg

SEQ ID NO: 697644 - DNA, 17 bp, Homo sapiens
cagaggaccccagggtg

SEQ ID NO: 697645 - DNA, 12 bp, Homo sapiens
cagaggaccctt

SEQ ID NO: 697646 - DNA, 22 bp, Homo sapiens
cagaggacccttacgtgagaaa

SEQ ID NO: 697647 - DNA, 17 bp, Homo sapiens
agatgaatgtcctgaaa

SEQ ID NO: 697648 - DNA, 17 bp, Homo sapiens
agatgacaaaccataac

SEQ ID NO: 697649 - DNA, 17 bp, Homo sapiens
agatgacaaattatatt

SEQ ID NO: 697650 - DNA, 22 bp, Homo sapiens
agatgacacgcgctctccacca

SEQ ID NO: 697651 - DNA, 19 bp, Homo sapiens
agatgaccagggatgctgg

SEQ ID NO: 697652 - DNA, 16 bp, Homo sapiens
agatgaccgtgtacaa

SEQ ID NO: 697653 - DNA, 17 bp, Homo sapiens
agatgaccgtgtacaat

SEQ ID NO: 697654 - DNA, 13 bp, Homo sapiens
agatgactctctc

SEQ ID NO: 697655 - DNA, 14 bp, Homo sapiens
agatgactctctcc

SEQ ID NO: 697656 - DNA, 14 bp, Homo sapiens
agatgactgagtcc

SEQ ID NO: 697657 - DNA, 13 bp, Homo sapiens
agatgagaaagct

SEQ ID NO: 697658 - DNA, 20 bp, Homo sapiens
agatgagaaatgatgaaaag

SEQ ID NO: 697659 - DNA, 11 bp, Homo sapiens
agatgagaaca

SEQ ID NO: 697660 - DNA, 15 bp, Homo sapiens
agatgagaacaaagc

SEQ ID NO: 697661 - DNA, 13 bp, Homo sapiens
agatgagcttttc

SEQ ID NO: 697662 - DNA, 19 bp, Homo sapiens
agatgaggagcagctgggg

SEQ ID NO: 697663 - DNA, 21 bp, Homo sapiens
agatgaggccagaccatggac

SEQ ID NO: 697664 - DNA, 21 bp, Homo sapiens
agatgagggatgggcctggca

SEQ ID NO: 697665 - DNA, 18 bp, Homo sapiens
agatgaggggttgaggga

SEQ ID NO: 697666 - DNA, 18 bp, Homo sapiens
agatgaggtcagttgtgt

SEQ ID NO: 697667 - DNA, 20 bp, Homo sapiens
agatgataaaaggaatctgg

SEQ ID NO: 697668 - DNA, 19 bp, Homo sapiens
agatgataaatatttatgc

SEQ ID NO: 697669 - DNA, 16 bp, Homo sapiens
agatgatacatccaaa

SEQ ID NO: 697670 - DNA, 19 bp, Homo sapiens
agatgatcccagtcactcc

SEQ ID NO: 697671 - DNA, 14 bp, Homo sapiens
agatgatctctcca

SEQ ID NO: 697672 - DNA, 14 bp, Homo sapiens
agatgatgaagaaa

SEQ ID NO: 697673 - DNA, 15 bp, Homo sapiens
agatgatgatgttaa

SEQ ID NO: 697674 - DNA, 13 bp, Homo sapiens
agatgatggaaac

SEQ ID NO: 697675 - DNA, 17 bp, Homo sapiens
agatgatggccatttct

SEQ ID NO: 697676 - DNA, 15 bp, Homo sapiens
agatgattatatatt

SEQ ID NO: 697677 - DNA, 21 bp, Homo sapiens
agatgatttaatgttgatttt

SEQ ID NO: 697678 - DNA, 14 bp, Homo sapiens
agatgattttcctc

SEQ ID NO: 697679 - DNA, 17 bp, Homo sapiens
agatgattttttgaaag

SEQ ID NO: 697680 - DNA, 14 bp, Homo sapiens
agatgcaacctcac

SEQ ID NO: 697681 - DNA, 15 bp, Homo sapiens
agatgcaagtctctt

SEQ ID NO: 697682 - DNA, 18 bp, Homo sapiens
agatgcaagttattttat

SEQ ID NO: 697683 - DNA, 18 bp, Homo sapiens
agatgcaccaccaagcca

SEQ ID NO: 697684 - DNA, 20 bp, Homo sapiens
agatgcaccaccaagccaag

SEQ ID NO: 697685 - DNA, 21 bp, Homo sapiens
agatgcaccaccaagccaagg

SEQ ID NO: 697686 - DNA, 21 bp, Homo sapiens
agatgcacgtggggcccactg

SEQ ID NO: 697687 - DNA, 22 bp, Homo sapiens
agatgcactatatgtttacaca

SEQ ID NO: 697688 - DNA, 23 bp, Homo sapiens
agatgcacttaagttagcctcca

SEQ ID NO: 697689 - DNA, 17 bp, Homo sapiens
agatgcagctactggaa

SEQ ID NO: 697690 - DNA, 16 bp, Homo sapiens
agatgcagggcagtca

SEQ ID NO: 697691 - DNA, 19 bp, Homo sapiens
agatgcatcgggaaagaag

SEQ ID NO: 697692 - DNA, 21 bp, Homo sapiens
agatgcatcgggaaagaagaa

SEQ ID NO: 697693 - DNA, 18 bp, Homo sapiens
agatgcatgcgcaggctc

SEQ ID NO: 697694 - DNA, 22 bp, Homo sapiens
agatgccaaaccacaagactct

SEQ ID NO: 697695 - DNA, 16 bp, Homo sapiens
agatgccacacctgct

SEQ ID NO: 697696 - DNA, 15 bp, Homo sapiens
agatgccaccctagc

SEQ ID NO: 697697 - DNA, 21 bp, Homo sapiens
agatgccagcttctctctcca

SEQ ID NO: 697698 - DNA, 23 bp, Homo sapiens
agatgccagcttctctctccagg

SEQ ID NO: 697699 - DNA, 14 bp, Homo sapiens
agatgccagtgaag

SEQ ID NO: 697700 - DNA, 17 bp, Homo sapiens
agatgccatagcataat

SEQ ID NO: 697701 - DNA, 14 bp, Homo sapiens
agatgccccattcc

SEQ ID NO: 697702 - DNA, 14 bp, Homo sapiens
agatgccccctcca

SEQ ID NO: 697703 - DNA, 19 bp, Homo sapiens
agatgccccgagcccaggc

SEQ ID NO: 697704 - DNA, 14 bp, Homo sapiens
agatgcctccaccg

SEQ ID NO: 697705 - DNA, 13 bp, Homo sapiens
agatgccttctag

SEQ ID NO: 697706 - DNA, 18 bp, Homo sapiens
agatgcggggacaggctg

SEQ ID NO: 697707 - DNA, 16 bp, Homo sapiens
agatgcgtttgcctcc

SEQ ID NO: 697708 - DNA, 18 bp, Homo sapiens
agatgcgtttgcctcctg

SEQ ID NO: 697709 - DNA, 15 bp, Homo sapiens
agatgctaatttatt

SEQ ID NO: 697710 - DNA, 11 bp, Homo sapiens
agatgctactg

SEQ ID NO: 697711 - DNA, 22 bp, Homo sapiens
agatgctcttggggttcatagg

SEQ ID NO: 697712 - DNA, 17 bp, Homo sapiens
agatgctgaatatctgt

SEQ ID NO: 697713 - DNA, 20 bp, Homo sapiens
agatgctgactgtactcctc

SEQ ID NO: 697714 - DNA, 13 bp, Homo sapiens
agatgctgagcca

SEQ ID NO: 697715 - DNA, 11 bp, Homo sapiens
agatgctgatg

SEQ ID NO: 697716 - DNA, 20 bp, Homo sapiens
agatgctgggctgtctctcc

SEQ ID NO: 697717 - DNA, 22 bp, Homo sapiens
agatgctgtaacttaaaatagg

SEQ ID NO: 697718 - DNA, 18 bp, Homo sapiens
agatgctgtcactggcag

SEQ ID NO: 697719 - DNA, 18 bp, Homo sapiens
agatgctgttgtgaagct

SEQ ID NO: 697720 - DNA, 16 bp, Homo sapiens
agatgcttctcactgc

SEQ ID NO: 697721 - DNA, 18 bp, Homo sapiens
agatgcttctcactgcca

SEQ ID NO: 697722 - DNA, 16 bp, Homo sapiens
agatgcttctctcctt

SEQ ID NO: 697723 - DNA, 14 bp, Homo sapiens
agatgcttttgtga

SEQ ID NO: 697724 - DNA, 17 bp, Homo sapiens
agatgcttttgtgagaa

SEQ ID NO: 697725 - DNA, 17 bp, Homo sapiens
agatggaaagaaagcac

SEQ ID NO: 697726 - DNA, 17 bp, Homo sapiens
agatggaaggaatcaaa

SEQ ID NO: 697727 - DNA, 15 bp, Homo sapiens
agatggaaggccttt

SEQ ID NO: 697728 - DNA, 15 bp, Homo sapiens
agatggaagtcacct

SEQ ID NO: 697729 - DNA, 20 bp, Homo sapiens
agatggacatggctcattgt

SEQ ID NO: 697730 - DNA, 15 bp, Homo sapiens
agatggactcaggat

SEQ ID NO: 697731 - DNA, 13 bp, Homo sapiens
agatggagaggct

SEQ ID NO: 697732 - DNA, 17 bp, Homo sapiens
agatggagaggctgagg

SEQ ID NO: 697733 - DNA, 14 bp, Homo sapiens
agatggagcccata

SEQ ID NO: 697734 - DNA, 22 bp, Homo sapiens
agatggagcccataggccaccc

SEQ ID NO: 697735 - DNA, 17 bp, Homo sapiens
agatggagggcttggcc

SEQ ID NO: 697736 - DNA, 19 bp, Homo sapiens
agatggagggcttggccca

SEQ ID NO: 697737 - DNA, 21 bp, Homo sapiens
agatggaggtttccttttgga

SEQ ID NO: 697738 - DNA, 17 bp, Homo sapiens
agatggattctcagata

SEQ ID NO: 697739 - DNA, 15 bp, Homo sapiens
agatggatttgcctg

SEQ ID NO: 697740 - DNA, 20 bp, Homo sapiens
agatggatttgcctgtgcca

SEQ ID NO: 697741 - DNA, 16 bp, Homo sapiens
agatggcaaatgacca

SEQ ID NO: 697742 - DNA, 20 bp, Homo sapiens
agatggcatcaaaaaagata

SEQ ID NO: 697743 - DNA, 19 bp, Homo sapiens
agatggcatcctgtgaagt

SEQ ID NO: 697744 - DNA, 15 bp, Homo sapiens
agatggccatgctca

SEQ ID NO: 697745 - DNA, 13 bp, Homo sapiens
agatggcccaagg

SEQ ID NO: 697746 - DNA, 16 bp, Homo sapiens
agatggcccaagggat

SEQ ID NO: 697747 - DNA, 18 bp, Homo sapiens
agatggcccaagggatgg

SEQ ID NO: 697748 - DNA, 18 bp, Homo sapiens
agatggcgaccaccaaag

SEQ ID NO: 697749 - DNA, 16 bp, Homo sapiens
agatggctcagagggg

SEQ ID NO: 697750 - DNA, 17 bp, Homo sapiens
agatggctgtgcctctg

SEQ ID NO: 697751 - DNA, 14 bp, Homo sapiens
agatggctgtggca

SEQ ID NO: 697752 - DNA, 14 bp, Homo sapiens
agatggcttatttt

SEQ ID NO: 697753 - DNA, 18 bp, Homo sapiens
agatgggaatgaggtggg

SEQ ID NO: 697754 - DNA, 17 bp, Homo sapiens
agatgggaattgcacag

SEQ ID NO: 697755 - DNA, 21 bp, Homo sapiens
agatgggcatcttttgtatta

SEQ ID NO: 697756 - DNA, 19 bp, Homo sapiens
agatgggcctgtatgagac

SEQ ID NO: 697757 - DNA, 18 bp, Homo sapiens
agatgggccttttcttga

SEQ ID NO: 697758 - DNA, 19 bp, Homo sapiens
agatgggcttgttttcttg

SEQ ID NO: 697759 - DNA, 20 bp, Homo sapiens
agatggggagggtgccctcc

SEQ ID NO: 697760 - DNA, 19 bp, Homo sapiens
agatgggggcttcttcctc

SEQ ID NO: 697761 - DNA, 14 bp, Homo sapiens
agatggggtctgtg

SEQ ID NO: 697762 - DNA, 19 bp, Homo sapiens
agatggggtctgtgactgg

SEQ ID NO: 697763 - DNA, 20 bp, Homo sapiens
agatggggtctgtgactgga

SEQ ID NO: 697764 - DNA, 18 bp, Homo sapiens
agatgggtattaaacttg

SEQ ID NO: 697765 - DNA, 16 bp, Homo sapiens
agatgggtccaggggt

SEQ ID NO: 697766 - DNA, 20 bp, Homo sapiens
agatgggtctgatattaatc

SEQ ID NO: 697767 - DNA, 23 bp, Homo sapiens
agatgggtctggctgagctgaac

SEQ ID NO: 697768 - DNA, 18 bp, Homo sapiens
agatggtaaaccagatct

SEQ ID NO: 697769 - DNA, 19 bp, Homo sapiens
agatggtatatttggtact

SEQ ID NO: 697770 - DNA, 14 bp, Homo sapiens
agatggtatgaaat

SEQ ID NO: 697771 - DNA, 23 bp, Homo sapiens
agatggtcagtgtggagaggggt

SEQ ID NO: 697772 - DNA, 19 bp, Homo sapiens
agatattgtgaagtacata

SEQ ID NO: 697773 - DNA, 18 bp, Homo sapiens
agatattgttataaataa

SEQ ID NO: 697774 - DNA, 17 bp, Homo sapiens
agatattgttttctgta

SEQ ID NO: 697775 - DNA, 20 bp, Homo sapiens
agatattgttttctgtaaat

SEQ ID NO: 697776 - DNA, 22 bp, Homo sapiens
agatattgttttctgtaaataa

SEQ ID NO: 697777 - DNA, 23 bp, Homo sapiens
agatattgttttctgtaaataac

SEQ ID NO: 697778 - DNA, 23 bp, Homo sapiens
agatatttacatgaattgcattt

SEQ ID NO: 697779 - DNA, 12 bp, Homo sapiens
agatatttctta

SEQ ID NO: 697780 - DNA, 13 bp, Homo sapiens
agatatttcttat

SEQ ID NO: 697781 - DNA, 22 bp, Homo sapiens
agatattttgctttgtgatttt

SEQ ID NO: 697782 - DNA, 13 bp, Homo sapiens
agatattttgtaa

SEQ ID NO: 697783 - DNA, 21 bp, Homo sapiens
agatatttttatctttatatg

SEQ ID NO: 697784 - DNA, 18 bp, Homo sapiens
agatattttttcagaaat

SEQ ID NO: 697785 - DNA, 17 bp, Homo sapiens
agatcaaaataaaaagt

SEQ ID NO: 697786 - DNA, 17 bp, Homo sapiens
agatcaaaatgcctttc

SEQ ID NO: 697787 - DNA, 12 bp, Homo sapiens
agatcaaagatg

SEQ ID NO: 697788 - DNA, 17 bp, Homo sapiens
agatcaacgcctcactg

SEQ ID NO: 697789 - DNA, 15 bp, Homo sapiens
agatcaagagatcaa

SEQ ID NO: 697790 - DNA, 20 bp, Homo sapiens
agatcaagagttttggagat

SEQ ID NO: 697791 - DNA, 18 bp, Homo sapiens
agatcaagctgtgagaca

SEQ ID NO: 697792 - DNA, 14 bp, Homo sapiens
agatcaatttctcc

SEQ ID NO: 697793 - DNA, 21 bp, Homo sapiens
agatcaatttgtaattgctta

SEQ ID NO: 697794 - DNA, 21 bp, Homo sapiens
agatcacagcctccagggccc

SEQ ID NO: 697795 - DNA, 15 bp, Homo sapiens
agatcaccagcccgg

SEQ ID NO: 697796 - DNA, 16 bp, Homo sapiens
agatcaccttgtattc

SEQ ID NO: 697797 - DNA, 17 bp, Homo sapiens
agatcaccttgtattct

SEQ ID NO: 697798 - DNA, 13 bp, Homo sapiens
agatcacgaggtc

SEQ ID NO: 697799 - DNA, 12 bp, Homo sapiens
agatcactcctg

SEQ ID NO: 697800 - DNA, 18 bp, Homo sapiens
agatcactgaatttataa

SEQ ID NO: 697801 - DNA, 14 bp, Homo sapiens
agatcactgtagtt

SEQ ID NO: 697802 - DNA, 22 bp, Homo sapiens
agatcactgtagtttagttctg

SEQ ID NO: 697803 - DNA, 23 bp, Homo sapiens
agatcactttctcagttttcata

SEQ ID NO: 697804 - DNA, 15 bp, Homo sapiens
agatcagccattaaa

SEQ ID NO: 697805 - DNA, 17 bp, Homo sapiens
agatcagccattaaaat

SEQ ID NO: 697806 - DNA, 14 bp, Homo sapiens
agatcaggaaccag

SEQ ID NO: 697807 - DNA, 19 bp, Homo sapiens
agatcaggaaccagggcct

SEQ ID NO: 697808 - DNA, 21 bp, Homo sapiens
agatcaggaattctaaataaa

SEQ ID NO: 697809 - DNA, 21 bp, Homo sapiens
agatcagtgtaccatttgcct

SEQ ID NO: 697810 - DNA, 16 bp, Homo sapiens
agatcatatttaaaga

SEQ ID NO: 697811 - DNA, 22 bp, Homo sapiens
agatcatctggggacctggttt

SEQ ID NO: 697812 - DNA, 19 bp, Homo sapiens
agatccaaggcagggaaag

SEQ ID NO: 697813 - DNA, 15 bp, Homo sapiens
agatccacacacaga

SEQ ID NO: 697814 - DNA, 16 bp, Homo sapiens
agatccacacacagag

SEQ ID NO: 697815 - DNA, 19 bp, Homo sapiens
agatccacgtgtggcctcc

SEQ ID NO: 697816 - DNA, 14 bp, Homo sapiens
agatccagactgta

SEQ ID NO: 697817 - DNA, 22 bp, Homo sapiens
agatccagactgtaagatgttg

SEQ ID NO: 697818 - DNA, 15 bp, Homo sapiens
agatcccactggaag

SEQ ID NO: 697819 - DNA, 16 bp, Homo sapiens
agatcccactggaaga

SEQ ID NO: 697820 - DNA, 23 bp, Homo sapiens
agatcccactggaagatcccctc

SEQ ID NO: 697821 - DNA, 23 bp, Homo sapiens
agatcccatgtcacctcagctga

SEQ ID NO: 697822 - DNA, 15 bp, Homo sapiens
agatcccccagaaaa

SEQ ID NO: 697823 - DNA, 16 bp, Homo sapiens
agatcccttaagaagt

SEQ ID NO: 697824 - DNA, 14 bp, Homo sapiens
agatcctaaactct

SEQ ID NO: 697825 - DNA, 19 bp, Homo sapiens
agatcctaaactctctagc

SEQ ID NO: 697826 - DNA, 14 bp, Homo sapiens
agatcctaagatgt

SEQ ID NO: 697827 - DNA, 16 bp, Homo sapiens
agatcctaaggtccaa

SEQ ID NO: 697828 - DNA, 12 bp, Homo sapiens
agatcctcctgc

SEQ ID NO: 697829 - DNA, 14 bp, Homo sapiens
agatcctctggaca

SEQ ID NO: 697830 - DNA, 20 bp, Homo sapiens
agatcctctttactctgggc

SEQ ID NO: 697831 - DNA, 13 bp, Homo sapiens
agatcctgagctc

SEQ ID NO: 697832 - DNA, 21 bp, Homo sapiens
agatcctgcaccccagcattc

SEQ ID NO: 697833 - DNA, 18 bp, Homo sapiens
agatcctgcgggtggggc

SEQ ID NO: 697834 - DNA, 13 bp, Homo sapiens
agatcctggagtg

SEQ ID NO: 697835 - DNA, 16 bp, Homo sapiens
agatccttcacaggca

SEQ ID NO: 697836 - DNA, 17 bp, Homo sapiens
agatcctttcaaaagaa

SEQ ID NO: 697837 - DNA, 13 bp, Homo sapiens
agatccttttcca

SEQ ID NO: 697838 - DNA, 13 bp, Homo sapiens
agatcgagaccat

SEQ ID NO: 697839 - DNA, 21 bp, Homo sapiens
agatcgagaccatcctggcta

SEQ ID NO: 697840 - DNA, 14 bp, Homo sapiens
agatcgcagtttgc

SEQ ID NO: 697841 - DNA, 19 bp, Homo sapiens
agatcgcgccactgcactc

SEQ ID NO: 697842 - DNA, 20 bp, Homo sapiens
agatcgcgccactgcactcc

SEQ ID NO: 697843 - DNA, 14 bp, Homo sapiens
agatcgcttgagcc

SEQ ID NO: 697844 - DNA, 17 bp, Homo sapiens
agatcgcttgagcccag

SEQ ID NO: 697845 - DNA, 22 bp, Homo sapiens
agatcgtgccgttactctccaa

SEQ ID NO: 697846 - DNA, 19 bp, Homo sapiens
agatcgtgctactgcactc

SEQ ID NO: 697847 - DNA, 14 bp, Homo sapiens
agatcgtgtattga

SEQ ID NO: 697848 - DNA, 23 bp, Homo sapiens
agatcgtgtattgagatttctta

SEQ ID NO: 697849 - DNA, 15 bp, Homo sapiens
agatctaatgtgaaa

SEQ ID NO: 697850 - DNA, 18 bp, Homo sapiens
agatctacagaacaagaa

SEQ ID NO: 697851 - DNA, 22 bp, Homo sapiens
agatctaccccagggagaatct

SEQ ID NO: 697852 - DNA, 22 bp, Homo sapiens
agatctatagcagagtccttat

SEQ ID NO: 697853 - DNA, 19 bp, Homo sapiens
agatctatatttttgtact

SEQ ID NO: 697854 - DNA, 12 bp, Homo sapiens
agatctccagcg

SEQ ID NO: 697855 - DNA, 23 bp, Homo sapiens
agatctcccactgcggggagaca

SEQ ID NO: 697856 - DNA, 18 bp, Homo sapiens
agatctctaacttcacca

SEQ ID NO: 697857 - DNA, 16 bp, Homo sapiens
agatctgaacccagct

SEQ ID NO: 697858 - DNA, 13 bp, Homo sapiens
agatctgactgcc

SEQ ID NO: 697859 - DNA, 15 bp, Homo sapiens
agatctgactgccaa

SEQ ID NO: 697860 - DNA, 14 bp, Homo sapiens
agatctgatcaaga

SEQ ID NO: 697861 - DNA, 16 bp, Homo sapiens
agatctgatggtgagc

SEQ ID NO: 697862 - DNA, 20 bp, Homo sapiens
agatctgcaccaccatgccc

SEQ ID NO: 697863 - DNA, 12 bp, Homo sapiens
agatctgcctgg

SEQ ID NO: 697864 - DNA, 16 bp, Homo sapiens
agatctgcctgggcct

SEQ ID NO: 697865 - DNA, 13 bp, Homo sapiens
agatctgggcatt

SEQ ID NO: 697866 - DNA, 16 bp, Homo sapiens
agatctggggaggcag

SEQ ID NO: 697867 - DNA, 14 bp, Homo sapiens
agatctgtataaat

SEQ ID NO: 697868 - DNA, 19 bp, Homo sapiens
agatctgtcccttaataaa

SEQ ID NO: 697869 - DNA, 12 bp, Homo sapiens
agatctgtgccc

SEQ ID NO: 697870 - DNA, 16 bp, Homo sapiens
agatctgtgccccatg

SEQ ID NO: 697871 - DNA, 19 bp, Homo sapiens
agatctgtgccccatgcct

SEQ ID NO: 697872 - DNA, 13 bp, Homo sapiens
agatctgttaaaa

SEQ ID NO: 697873 - DNA, 21 bp, Homo sapiens
agatctgttttgaaggcaaaa

SEQ ID NO: 697874 - DNA, 23 bp, Homo sapiens
agatctgttttgtggtttggaat

SEQ ID NO: 697875 - DNA, 13 bp, Homo sapiens
agatcttaatata

SEQ ID NO: 697876 - DNA, 19 bp, Homo sapiens
agatcttcaaacagaataa

SEQ ID NO: 697877 - DNA, 11 bp, Homo sapiens
agatcttcctt

SEQ ID NO: 697878 - DNA, 15 bp, Homo sapiens
agatcttccttccgc

SEQ ID NO: 697879 - DNA, 17 bp, Homo sapiens
agatcttctgaaatgaa

SEQ ID NO: 697880 - DNA, 12 bp, Homo sapiens
agatctttcagg

SEQ ID NO: 697881 - DNA, 21 bp, Homo sapiens
agatctttcaggaaagacgga

SEQ ID NO: 697882 - DNA, 13 bp, Homo sapiens
agatctttctctt

SEQ ID NO: 697883 - DNA, 14 bp, Homo sapiens
agatctttctcttc

SEQ ID NO: 697884 - DNA, 15 bp, Homo sapiens
agatctttctcttcc

SEQ ID NO: 697885 - DNA, 12 bp, Homo sapiens
agatctttgcta

SEQ ID NO: 697886 - DNA, 12 bp, Homo sapiens
agatgaaataat

SEQ ID NO: 697887 - DNA, 17 bp, Homo sapiens
agatgaaatgcactgta

SEQ ID NO: 697888 - DNA, 20 bp, Homo sapiens
agatgaactgactgaaggaa

SEQ ID NO: 697889 - DNA, 11 bp, Homo sapiens
agatgaacttg

SEQ ID NO: 697890 - DNA, 21 bp, Homo sapiens
agatgaactttgtcattatga

SEQ ID NO: 697891 - DNA, 17 bp, Homo sapiens
agatgaagagtgagagg

SEQ ID NO: 697892 - DNA, 17 bp, Homo sapiens
agatgaaggctgtatct

SEQ ID NO: 697893 - DNA, 16 bp, Homo sapiens
agatgaaggggctctt

SEQ ID NO: 697894 - DNA, 14 bp, Homo sapiens
agatgaagttttat

SEQ ID NO: 697895 - DNA, 13 bp, Homo sapiens
agatgaatcaatg

SEQ ID NO: 697896 - DNA, 18 bp, Homo sapiens
agatgaatcaatgggaaa

SEQ ID NO: 697897 - DNA, 18 bp, Homo sapiens
agatgaatggtctggcaa

SEQ ID NO: 697898 - DNA, 18 bp, Homo sapiens
agaggttttaaagtgatt

SEQ ID NO: 697899 - DNA, 20 bp, Homo sapiens
agaggttttgtattgagggc

SEQ ID NO: 697900 - DNA, 17 bp, Homo sapiens
agaggtttttcttggga

SEQ ID NO: 697901 - DNA, 16 bp, Homo sapiens
agagtaactttactct

SEQ ID NO: 697902 - DNA, 20 bp, Homo sapiens
agagtaactttactctgtgt

SEQ ID NO: 697903 - DNA, 23 bp, Homo sapiens
agagtaactttactctgtgttta

SEQ ID NO: 697904 - DNA, 19 bp, Homo sapiens
agagtacagtgagccaaga

SEQ ID NO: 697905 - DNA, 14 bp, Homo sapiens
agagtaccatgctg

SEQ ID NO: 697906 - DNA, 17 bp, Homo sapiens
agagtacgttaaaagca

SEQ ID NO: 697907 - DNA, 14 bp, Homo sapiens
agagtactgggaga

SEQ ID NO: 697908 - DNA, 19 bp, Homo sapiens
agagtactttggtttctga

SEQ ID NO: 697909 - DNA, 21 bp, Homo sapiens
agagtagaataacctttcaga

SEQ ID NO: 697910 - DNA, 17 bp, Homo sapiens
agagtagaattgcattg

SEQ ID NO: 697911 - DNA, 18 bp, Homo sapiens
agagtagaattgcattga

SEQ ID NO: 697912 - DNA, 22 bp, Homo sapiens
agagtagcaagttctagagaag

SEQ ID NO: 697913 - DNA, 13 bp, Homo sapiens
agagtagccgaga

SEQ ID NO: 697914 - DNA, 17 bp, Homo sapiens
agagtagccgagagcct

SEQ ID NO: 697915 - DNA, 21 bp, Homo sapiens
agagtaggctattcctgagag

SEQ ID NO: 697916 - DNA, 23 bp, Homo sapiens
agagtagttatataattgttgaa

SEQ ID NO: 697917 - DNA, 21 bp, Homo sapiens
agagtatatattttatatata

SEQ ID NO: 697918 - DNA, 12 bp, Homo sapiens
agagtatttccc

SEQ ID NO: 697919 - DNA, 20 bp, Homo sapiens
agagtatttcccttccaaag

SEQ ID NO: 697920 - DNA, 21 bp, Homo sapiens
agagtattttaagaagacata

SEQ ID NO: 697921 - DNA, 22 bp, Homo sapiens
agagtatttttaacacttaaat

SEQ ID NO: 697922 - DNA, 13 bp, Homo sapiens
agagtcaaagctg

SEQ ID NO: 697923 - DNA, 21 bp, Homo sapiens
agagtcagaactaactttggt

SEQ ID NO: 697924 - DNA, 21 bp, Homo sapiens
agagtcagccccgacttcctg

SEQ ID NO: 697925 - DNA, 22 bp, Homo sapiens
agagtcatatacattagtttta

SEQ ID NO: 697926 - DNA, 14 bp, Homo sapiens
agagtcatctccat

SEQ ID NO: 697927 - DNA, 19 bp, Homo sapiens
agagtcatctccatcagct

SEQ ID NO: 697928 - DNA, 12 bp, Homo sapiens
agagtcatgtga

SEQ ID NO: 697929 - DNA, 14 bp, Homo sapiens
agagtcattcatat

SEQ ID NO: 697930 - DNA, 21 bp, Homo sapiens
agagtccaactcacttccagt

SEQ ID NO: 697931 - DNA, 17 bp, Homo sapiens
agagtccaatttaagga

SEQ ID NO: 697932 - DNA, 16 bp, Homo sapiens
agagtccaggccccaa

SEQ ID NO: 697933 - DNA, 17 bp, Homo sapiens
agagtccagtgctctgc

SEQ ID NO: 697934 - DNA, 20 bp, Homo sapiens
agagtccagtgctctgcctc

SEQ ID NO: 697935 - DNA, 21 bp, Homo sapiens
agagtcccagagcaggaggcc

SEQ ID NO: 697936 - DNA, 22 bp, Homo sapiens
agagtcccaggaccttgagtgt

SEQ ID NO: 697937 - DNA, 16 bp, Homo sapiens
agagtccggaggcagc

SEQ ID NO: 697938 - DNA, 17 bp, Homo sapiens
agagtcctcattataaa

SEQ ID NO: 697939 - DNA, 12 bp, Homo sapiens
agagtcctctga

SEQ ID NO: 697940 - DNA, 17 bp, Homo sapiens
agagtcctgtgctgaat

SEQ ID NO: 697941 - DNA, 17 bp, Homo sapiens
agagtctattgtctcct

SEQ ID NO: 697942 - DNA, 20 bp, Homo sapiens
agagtctcagaaactcccct

SEQ ID NO: 697943 - DNA, 21 bp, Homo sapiens
agagtctcccagtgggtgatg

SEQ ID NO: 697944 - DNA, 17 bp, Homo sapiens
agagtctgaaagacaga

SEQ ID NO: 697945 - DNA, 19 bp, Homo sapiens
agagtctgagcccccggct

SEQ ID NO: 697946 - DNA, 13 bp, Homo sapiens
agagtctgggcct

SEQ ID NO: 697947 - DNA, 23 bp, Homo sapiens
agagtctggtgaagctcacttct

SEQ ID NO: 697948 - DNA, 12 bp, Homo sapiens
agagtctgtctc

SEQ ID NO: 697949 - DNA, 18 bp, Homo sapiens
agagtcttacaatcaaat

SEQ ID NO: 697950 - DNA, 22 bp, Homo sapiens
agagtcttacaatcaaatctcc

SEQ ID NO: 697951 - DNA, 23 bp, Homo sapiens
agagtcttacaatcaaatctcct

SEQ ID NO: 697952 - DNA, 19 bp, Homo sapiens
agagtcttccaaggccaga

SEQ ID NO: 697953 - DNA, 17 bp, Homo sapiens
agagtgaaaccatgact

SEQ ID NO: 697954 - DNA, 21 bp, Homo sapiens
agagtgaaaccatgactgtga

SEQ ID NO: 697955 - DNA, 23 bp, Homo sapiens
agagtgaaaccatgactgtgacc

SEQ ID NO: 697956 - DNA, 14 bp, Homo sapiens
agagtgaaagggct

SEQ ID NO: 697957 - DNA, 16 bp, Homo sapiens
agagtgaatttcagta

SEQ ID NO: 697958 - DNA, 17 bp, Homo sapiens
agagtgaccctcagctg

SEQ ID NO: 697959 - DNA, 22 bp, Homo sapiens
agagtgacttattttgtcttat

SEQ ID NO: 697960 - DNA, 20 bp, Homo sapiens
agagtgatagtcttttgctt

SEQ ID NO: 697961 - DNA, 22 bp, Homo sapiens
agagtgatagtcttttgctttt

SEQ ID NO: 697962 - DNA, 13 bp, Homo sapiens
agagtgcaatggt

SEQ ID NO: 697963 - DNA, 16 bp, Homo sapiens
agagtgcaatggtgca

SEQ ID NO: 697964 - DNA, 17 bp, Homo sapiens
agagtgcactgacctgt

SEQ ID NO: 697965 - DNA, 13 bp, Homo sapiens
agagtgcccagca

SEQ ID NO: 697966 - DNA, 23 bp, Homo sapiens
agagtgctgtcgggaccacatct

SEQ ID NO: 697967 - DNA, 16 bp, Homo sapiens
agagtggaataagaca

SEQ ID NO: 697968 - DNA, 20 bp, Homo sapiens
agagtggactgaatgtgcct

SEQ ID NO: 697969 - DNA, 12 bp, Homo sapiens
agagtggactgc

SEQ ID NO: 697970 - DNA, 18 bp, Homo sapiens
agagtggcctagagcact

SEQ ID NO: 697971 - DNA, 20 bp, Homo sapiens
agagtggcctccctgctgtg

SEQ ID NO: 697972 - DNA, 21 bp, Homo sapiens
agagtggcctccctgctgtgc

SEQ ID NO: 697973 - DNA, 12 bp, Homo sapiens
agagtggcctgg

SEQ ID NO: 697974 - DNA, 18 bp, Homo sapiens
agagtggcgtgagctgcc

SEQ ID NO: 697975 - DNA, 18 bp, Homo sapiens
agagtggcgtggcctccc

SEQ ID NO: 697976 - DNA, 19 bp, Homo sapiens
agagtggctcctcccggtg

SEQ ID NO: 697977 - DNA, 19 bp, Homo sapiens
agagtggggatatgattta

SEQ ID NO: 697978 - DNA, 21 bp, Homo sapiens
agagtggggggaggaagcaga

SEQ ID NO: 697979 - DNA, 17 bp, Homo sapiens
agagtggggttttcttg

SEQ ID NO: 697980 - DNA, 15 bp, Homo sapiens
agagtggtatttgca

SEQ ID NO: 697981 - DNA, 21 bp, Homo sapiens
agagtggtgggggaaggctgt

SEQ ID NO: 697982 - DNA, 21 bp, Homo sapiens
agagtgtagcctaaagggcag

SEQ ID NO: 697983 - DNA, 14 bp, Homo sapiens
agagtgtagctgta

SEQ ID NO: 697984 - DNA, 20 bp, Homo sapiens
agagtgtagggggccttgcg

SEQ ID NO: 697985 - DNA, 21 bp, Homo sapiens
agagtgtgaccaaaagttaca

SEQ ID NO: 697986 - DNA, 15 bp, Homo sapiens
agagtgtgcagactg

SEQ ID NO: 697987 - DNA, 14 bp, Homo sapiens
agagtgtgcctgaa

SEQ ID NO: 697988 - DNA, 16 bp, Homo sapiens
agagtgtgtgggcagg

SEQ ID NO: 697989 - DNA, 17 bp, Homo sapiens
agagtgtgtgggcaggg

SEQ ID NO: 697990 - DNA, 18 bp, Homo sapiens
agagtgtgtgggcagggt

SEQ ID NO: 697991 - DNA, 20 bp, Homo sapiens
agagttaatatatagaaggg

SEQ ID NO: 697992 - DNA, 16 bp, Homo sapiens
agagttacagttctgt

SEQ ID NO: 697993 - DNA, 17 bp, Homo sapiens
agagttacagttctgtg

SEQ ID NO: 697994 - DNA, 16 bp, Homo sapiens
agagttatcttcttta

SEQ ID NO: 697995 - DNA, 12 bp, Homo sapiens
agagttattcaa

SEQ ID NO: 697996 - DNA, 21 bp, Homo sapiens
agagttgaccgttttcatcct

SEQ ID NO: 697997 - DNA, 16 bp, Homo sapiens
agagttgctgggagct

SEQ ID NO: 697998 - DNA, 18 bp, Homo sapiens
agagttggctcaggcaga

SEQ ID NO: 697999 - DNA, 17 bp, Homo sapiens
agagttgtaaatatata

SEQ ID NO: 698000 - DNA, 19 bp, Homo sapiens
agagttgtaaatatataaa

SEQ ID NO: 698001 - DNA, 20 bp, Homo sapiens
agagttgtaaatatataaat

SEQ ID NO: 698002 - DNA, 21 bp, Homo sapiens
agagttgtaaatatataaata

SEQ ID NO: 698003 - DNA, 20 bp, Homo sapiens
agagttgtctgtccaggccc

SEQ ID NO: 698004 - DNA, 16 bp, Homo sapiens
agagttgttacatttt

SEQ ID NO: 698005 - DNA, 20 bp, Homo sapiens
agagttgttacatttttaag

SEQ ID NO: 698006 - DNA, 21 bp, Homo sapiens
agagttgttacatttttaagt

SEQ ID NO: 698007 - DNA, 19 bp, Homo sapiens
agagttgttgtttgccaag

SEQ ID NO: 698008 - DNA, 22 bp, Homo sapiens
agagtttaacacaagtcctgtg

SEQ ID NO: 698009 - DNA, 15 bp, Homo sapiens
agagtttcaaaagca

SEQ ID NO: 698010 - DNA, 14 bp, Homo sapiens
agagtttctgtttg

SEQ ID NO: 698011 - DNA, 22 bp, Homo sapiens
agagtttctgtttgattctttt

SEQ ID NO: 698012 - DNA, 19 bp, Homo sapiens
agagtttgaaggaggtgag

SEQ ID NO: 698013 - DNA, 21 bp, Homo sapiens
agagtttgccttcctttctcc

SEQ ID NO: 698014 - DNA, 23 bp, Homo sapiens
agagtttggggccgaaaatgttt

SEQ ID NO: 698015 - DNA, 13 bp, Homo sapiens
agagtttgtgtgt

SEQ ID NO: 698016 - DNA, 23 bp, Homo sapiens
agagtttgtgtgtatttgtatta

SEQ ID NO: 698017 - DNA, 14 bp, Homo sapiens
agagttttgtcttg

SEQ ID NO: 698018 - DNA, 16 bp, Homo sapiens
agagttttgtcttgaa

SEQ ID NO: 698019 - DNA, 12 bp, Homo sapiens
agataaaaagat

SEQ ID NO: 698020 - DNA, 14 bp, Homo sapiens
agataaaaagatgg

SEQ ID NO: 698021 - DNA, 21 bp, Homo sapiens
agataaaaagatggcctttgc

SEQ ID NO: 698022 - DNA, 13 bp, Homo sapiens
agataaaagcaat

SEQ ID NO: 698023 - DNA, 14 bp, Homo sapiens
agataaaagcaatt

SEQ ID NO: 698024 - DNA, 15 bp, Homo sapiens
agataaaagcaattc

SEQ ID NO: 698025 - DNA, 22 bp, Homo sapiens
agataaaaggtggagtttctct

SEQ ID NO: 698026 - DNA, 18 bp, Homo sapiens
agataaaatatcctcagg

SEQ ID NO: 698027 - DNA, 20 bp, Homo sapiens
agataaacaccaacccagga

SEQ ID NO: 698028 - DNA, 19 bp, Homo sapiens
agataaaccgtttttaaca

SEQ ID NO: 698029 - DNA, 17 bp, Homo sapiens
agataaagaccagaaat

SEQ ID NO: 698030 - DNA, 19 bp, Homo sapiens
agataaagaccagaaattc

SEQ ID NO: 698031 - DNA, 13 bp, Homo sapiens
agataaagatgat

SEQ ID NO: 698032 - DNA, 15 bp, Homo sapiens
agataaagatgatct

SEQ ID NO: 698033 - DNA, 18 bp, Homo sapiens
agataaagtaagcctagg

SEQ ID NO: 698034 - DNA, 13 bp, Homo sapiens
agataaagtcaaa

SEQ ID NO: 698035 - DNA, 21 bp, Homo sapiens
agataaagtcaaatgccaaac

SEQ ID NO: 698036 - DNA, 14 bp, Homo sapiens
agataaataaaaat

SEQ ID NO: 698037 - DNA, 14 bp, Homo sapiens
agataaatagaact

SEQ ID NO: 698038 - DNA, 17 bp, Homo sapiens
agataaatagaactatc

SEQ ID NO: 698039 - DNA, 20 bp, Homo sapiens
agataaatatttgacttgca

SEQ ID NO: 698040 - DNA, 17 bp, Homo sapiens
agataaatttgttgaat

SEQ ID NO: 698041 - DNA, 21 bp, Homo sapiens
agataaccagctgtaacacag

SEQ ID NO: 698042 - DNA, 20 bp, Homo sapiens
agataactctctttccttga

SEQ ID NO: 698043 - DNA, 12 bp, Homo sapiens
agataacttact

SEQ ID NO: 698044 - DNA, 21 bp, Homo sapiens
agataacttactgtatatgta

SEQ ID NO: 698045 - DNA, 17 bp, Homo sapiens
agataacttcttgaaaa

SEQ ID NO: 698046 - DNA, 19 bp, Homo sapiens
agataactttgactttctt

SEQ ID NO: 698047 - DNA, 13 bp, Homo sapiens
agataagcaagag

SEQ ID NO: 698048 - DNA, 17 bp, Homo sapiens
agataagcaagagagat

SEQ ID NO: 698049 - DNA, 20 bp, Homo sapiens
agataagcaagagagatgtt

SEQ ID NO: 698050 - DNA, 12 bp, Homo sapiens
agataagtgtaa

SEQ ID NO: 698051 - DNA, 16 bp, Homo sapiens
agataagtgtaaatag

SEQ ID NO: 698052 - DNA, 16 bp, Homo sapiens
agataagtgtattttt

SEQ ID NO: 698053 - DNA, 20 bp, Homo sapiens
agataagtgtatttttcaat

SEQ ID NO: 698054 - DNA, 21 bp, Homo sapiens
agataataaattgatttgtta

SEQ ID NO: 698055 - DNA, 15 bp, Homo sapiens
agataatatgagaat

SEQ ID NO: 698056 - DNA, 17 bp, Homo sapiens
agataatatgagaatca

SEQ ID NO: 698057 - DNA, 20 bp, Homo sapiens
agataatattttacatacac

SEQ ID NO: 698058 - DNA, 16 bp, Homo sapiens
agataatcagcctctt

SEQ ID NO: 698059 - DNA, 23 bp, Homo sapiens
agataatctagaacacaggcaaa

SEQ ID NO: 698060 - DNA, 16 bp, Homo sapiens
agataatctcagtgct

SEQ ID NO: 698061 - DNA, 14 bp, Homo sapiens
agataatgatactt

SEQ ID NO: 698062 - DNA, 14 bp, Homo sapiens
agataatggagaat

SEQ ID NO: 698063 - DNA, 12 bp, Homo sapiens
agataatgtgaa

SEQ ID NO: 698064 - DNA, 13 bp, Homo sapiens
agataatgtgaaa

SEQ ID NO: 698065 - DNA, 18 bp, Homo sapiens
agataattcatttgtatt

SEQ ID NO: 698066 - DNA, 13 bp, Homo sapiens
agataatttgcat

SEQ ID NO: 698067 - DNA, 14 bp, Homo sapiens
agataatttgcata

SEQ ID NO: 698068 - DNA, 23 bp, Homo sapiens
agataatttgcatattctattgt

SEQ ID NO: 698069 - DNA, 15 bp, Homo sapiens
agatacaagtttcag

SEQ ID NO: 698070 - DNA, 20 bp, Homo sapiens
agatacaagtttcagacagg

SEQ ID NO: 698071 - DNA, 15 bp, Homo sapiens
agatacactgcactt

SEQ ID NO: 698072 - DNA, 19 bp, Homo sapiens
agatacactgcactttgtt

SEQ ID NO: 698073 - DNA, 18 bp, Homo sapiens
agatacactgcagctgaa

SEQ ID NO: 698074 - DNA, 14 bp, Homo sapiens
agatacaggaaaaa

SEQ ID NO: 698075 - DNA, 13 bp, Homo sapiens
agatacagttact

SEQ ID NO: 698076 - DNA, 22 bp, Homo sapiens
agatacagttactcagaattct

SEQ ID NO: 698077 - DNA, 22 bp, Homo sapiens
agatacatatgagtgtggaagc

SEQ ID NO: 698078 - DNA, 13 bp, Homo sapiens
agatacatcactg

SEQ ID NO: 698079 - DNA, 20 bp, Homo sapiens
agatacatcactgcttgatg

SEQ ID NO: 698080 - DNA, 22 bp, Homo sapiens
agataccacaaaccctgctgaa

SEQ ID NO: 698081 - DNA, 21 bp, Homo sapiens
agataccagcgaggaggctcc

SEQ ID NO: 698082 - DNA, 15 bp, Homo sapiens
agatacccagtggaa

SEQ ID NO: 698083 - DNA, 22 bp, Homo sapiens
agataccggtgcttctggaaac

SEQ ID NO: 698084 - DNA, 14 bp, Homo sapiens
agatacctccaacc

SEQ ID NO: 698085 - DNA, 19 bp, Homo sapiens
agataccttgaaaggaaga

SEQ ID NO: 698086 - DNA, 22 bp, Homo sapiens
agatacgggggctgtgactctg

SEQ ID NO: 698087 - DNA, 16 bp, Homo sapiens
agatactaaagcaaat

SEQ ID NO: 698088 - DNA, 18 bp, Homo sapiens
agatactattttcatttt

SEQ ID NO: 698089 - DNA, 19 bp, Homo sapiens
agatactgctactgtaatt

SEQ ID NO: 698090 - DNA, 20 bp, Homo sapiens
agatactggaagttttgcat

SEQ ID NO: 698091 - DNA, 11 bp, Homo sapiens
agatactgtat

SEQ ID NO: 698092 - DNA, 15 bp, Homo sapiens
agatactgtatcatg

SEQ ID NO: 698093 - DNA, 16 bp, Homo sapiens
agatactgtatcatga

SEQ ID NO: 698094 - DNA, 21 bp, Homo sapiens
agatactgtctttgtgctgaa

SEQ ID NO: 698095 - DNA, 14 bp, Homo sapiens
agatacttcccaaa

SEQ ID NO: 698096 - DNA, 16 bp, Homo sapiens
agatacttcctgccct

SEQ ID NO: 698097 - DNA, 22 bp, Homo sapiens
agatacttggggggctgaggtg

SEQ ID NO: 698098 - DNA, 15 bp, Homo sapiens
agatagaaataaata

SEQ ID NO: 698099 - DNA, 21 bp, Homo sapiens
agatagaacacaaaacttgaa

SEQ ID NO: 698100 - DNA, 15 bp, Homo sapiens
agatagagaaatagt

SEQ ID NO: 698101 - DNA, 14 bp, Homo sapiens
agatagagctgggt

SEQ ID NO: 698102 - DNA, 20 bp, Homo sapiens
agatagagctgggtggcctg

SEQ ID NO: 698103 - DNA, 16 bp, Homo sapiens
agatagatttggaata

SEQ ID NO: 698104 - DNA, 16 bp, Homo sapiens
agatagcattgtgaac

SEQ ID NO: 698105 - DNA, 15 bp, Homo sapiens
agatagcccaggagc

SEQ ID NO: 698106 - DNA, 15 bp, Homo sapiens
agatagccctgtcct

SEQ ID NO: 698107 - DNA, 12 bp, Homo sapiens
agataggacctt

SEQ ID NO: 698108 - DNA, 16 bp, Homo sapiens
agataggaccttgggc

SEQ ID NO: 698109 - DNA, 16 bp, Homo sapiens
agataggctctgcaca

SEQ ID NO: 698110 - DNA, 22 bp, Homo sapiens
agataggctctgcacagatgga

SEQ ID NO: 698111 - DNA, 12 bp, Homo sapiens
agatagggaaaa

SEQ ID NO: 698112 - DNA, 12 bp, Homo sapiens
agatagggaaca

SEQ ID NO: 698113 - DNA, 13 bp, Homo sapiens
agatagggaacac

SEQ ID NO: 698114 - DNA, 14 bp, Homo sapiens
agataggggagggg

SEQ ID NO: 698115 - DNA, 17 bp, Homo sapiens
agataggggagggggga

SEQ ID NO: 698116 - DNA, 19 bp, Homo sapiens
agatagtatctagcaatca

SEQ ID NO: 698117 - DNA, 13 bp, Homo sapiens
agatagtgccagg

SEQ ID NO: 698118 - DNA, 15 bp, Homo sapiens
agatagtgccaggtg

SEQ ID NO: 698119 - DNA, 22 bp, Homo sapiens
agatagttaaaagactgcagct

SEQ ID NO: 698120 - DNA, 15 bp, Homo sapiens
agatataaaagactg

SEQ ID NO: 698121 - DNA, 17 bp, Homo sapiens
agatataaatggctggt

SEQ ID NO: 698122 - DNA, 22 bp, Homo sapiens
agatataactgtcttgtttcag

SEQ ID NO: 698123 - DNA, 22 bp, Homo sapiens
agatataagagaagtctcattc

SEQ ID NO: 698124 - DNA, 16 bp, Homo sapiens
agatataatgaacaaa

SEQ ID NO: 698125 - DNA, 14 bp, Homo sapiens
agatatacaaatat

SEQ ID NO: 698126 - DNA, 20 bp, Homo sapiens
agatatagggtgtggctcct

SEQ ID NO: 698127 - DNA, 14 bp, Homo sapiens
agatatatgccttc

SEQ ID NO: 698128 - DNA, 17 bp, Homo sapiens
agatatatgtgtataca

SEQ ID NO: 698129 - DNA, 14 bp, Homo sapiens
agatatatttttca

SEQ ID NO: 698130 - DNA, 15 bp, Homo sapiens
agatatcaaaattct

SEQ ID NO: 698131 - DNA, 13 bp, Homo sapiens
agatatccatctt

SEQ ID NO: 698132 - DNA, 21 bp, Homo sapiens
agatatctgagggaggaggcc

SEQ ID NO: 698133 - DNA, 13 bp, Homo sapiens
agatatctgcatg

SEQ ID NO: 698134 - DNA, 15 bp, Homo sapiens
agatatctgcatgtg

SEQ ID NO: 698135 - DNA, 16 bp, Homo sapiens
agatatctgcatgtgt

SEQ ID NO: 698136 - DNA, 22 bp, Homo sapiens
agatatcttggacaaatcacat

SEQ ID NO: 698137 - DNA, 15 bp, Homo sapiens
agatatgaaagctga

SEQ ID NO: 698138 - DNA, 22 bp, Homo sapiens
agatatgggtgtttttaataaa

SEQ ID NO: 698139 - DNA, 15 bp, Homo sapiens
agatattatttgtct

SEQ ID NO: 698140 - DNA, 21 bp, Homo sapiens
agatattattttagcttcagt

SEQ ID NO: 698141 - DNA, 22 bp, Homo sapiens
agatattattttagcttcagtt

SEQ ID NO: 698142 - DNA, 16 bp, Homo sapiens
agatattcttatttca

SEQ ID NO: 698143 - DNA, 16 bp, Homo sapiens
agatattgatattgaa

SEQ ID NO: 698144 - DNA, 14 bp, Homo sapiens
agatattgtacata

SEQ ID NO: 698145 - DNA, 19 bp, Homo sapiens
agatattgtacataaaaga

SEQ ID NO: 698146 - DNA, 16 bp, Homo sapiens
agagctggtgcccgga

SEQ ID NO: 698147 - DNA, 16 bp, Homo sapiens
agagctggtggtttga

SEQ ID NO: 698148 - DNA, 17 bp, Homo sapiens
agagctggtgtctgatt

SEQ ID NO: 698149 - DNA, 17 bp, Homo sapiens
agagctgtattaagcca

SEQ ID NO: 698150 - DNA, 12 bp, Homo sapiens
agagctgtctga

SEQ ID NO: 698151 - DNA, 14 bp, Homo sapiens
agagctgtcttccc

SEQ ID NO: 698152 - DNA, 20 bp, Homo sapiens
agagctgtttatggcctcag

SEQ ID NO: 698153 - DNA, 21 bp, Homo sapiens
agagctgtttatggcctcagc

SEQ ID NO: 698154 - DNA, 17 bp, Homo sapiens
agagcttattggccact

SEQ ID NO: 698155 - DNA, 12 bp, Homo sapiens
agagcttccctg

SEQ ID NO: 698156 - DNA, 16 bp, Homo sapiens
agagcttccctgactc

SEQ ID NO: 698157 - DNA, 20 bp, Homo sapiens
agagcttccctgactcattc

SEQ ID NO: 698158 - DNA, 17 bp, Homo sapiens
agagcttgaggtgggag

SEQ ID NO: 698159 - DNA, 15 bp, Homo sapiens
agagcttgctccaga

SEQ ID NO: 698160 - DNA, 16 bp, Homo sapiens
agagcttgctccagat

SEQ ID NO: 698161 - DNA, 23 bp, Homo sapiens
agagcttgctccagattctgatg

SEQ ID NO: 698162 - DNA, 23 bp, Homo sapiens
agagctttaaaagtatctttaac

SEQ ID NO: 698163 - DNA, 15 bp, Homo sapiens
agagctttctgcctt

SEQ ID NO: 698164 - DNA, 13 bp, Homo sapiens
agagctttgtcac

SEQ ID NO: 698165 - DNA, 17 bp, Homo sapiens
agagctttgtcacttgc

SEQ ID NO: 698166 - DNA, 15 bp, Homo sapiens
agagctttgtgcttg

SEQ ID NO: 698167 - DNA, 20 bp, Homo sapiens
agagctttgtgcttgtcatt

SEQ ID NO: 698168 - DNA, 15 bp, Homo sapiens
agagcttttcagatt

SEQ ID NO: 698169 - DNA, 20 bp, Homo sapiens
agagcttttcagattgtgga

SEQ ID NO: 698170 - DNA, 20 bp, Homo sapiens
agagctttttaatagcacta

SEQ ID NO: 698171 - DNA, 16 bp, Homo sapiens
agaggaaaaaaatgac

SEQ ID NO: 698172 - DNA, 12 bp, Homo sapiens
agaggaaaagaa

SEQ ID NO: 698173 - DNA, 19 bp, Homo sapiens
agaggaaaagtaaggtgca

SEQ ID NO: 698174 - DNA, 22 bp, Homo sapiens
agaggaaaagtaaggtgcagtt

SEQ ID NO: 698175 - DNA, 17 bp, Homo sapiens
agaggaaaggcgccccc

SEQ ID NO: 698176 - DNA, 15 bp, Homo sapiens
agaggaaagggctgg

SEQ ID NO: 698177 - DNA, 19 bp, Homo sapiens
agaggaaataacagagaga

SEQ ID NO: 698178 - DNA, 15 bp, Homo sapiens
agaggaactgtccag

SEQ ID NO: 698179 - DNA, 12 bp, Homo sapiens
agaggaagaaat

SEQ ID NO: 698180 - DNA, 16 bp, Homo sapiens
agaggaagagaagccc

SEQ ID NO: 698181 - DNA, 19 bp, Homo sapiens
agaggaagccagtggagct

SEQ ID NO: 698182 - DNA, 15 bp, Homo sapiens
agaggaaggggccag

SEQ ID NO: 698183 - DNA, 16 bp, Homo sapiens
agaggaaggggccaga

SEQ ID NO: 698184 - DNA, 20 bp, Homo sapiens
agaggaaggggccagaggct

SEQ ID NO: 698185 - DNA, 15 bp, Homo sapiens
agaggaatcctggca

SEQ ID NO: 698186 - DNA, 12 bp, Homo sapiens
agaggaatctgt

SEQ ID NO: 698187 - DNA, 23 bp, Homo sapiens
agaggaatctgtttctctgctgt

SEQ ID NO: 698188 - DNA, 19 bp, Homo sapiens
agaggaatgatgggctttt

SEQ ID NO: 698189 - DNA, 21 bp, Homo sapiens
agaggaatgatgggcttttgt

SEQ ID NO: 698190 - DNA, 18 bp, Homo sapiens
agaggaattacgtgctct

SEQ ID NO: 698191 - DNA, 14 bp, Homo sapiens
agaggaatttggct

SEQ ID NO: 698192 - DNA, 14 bp, Homo sapiens
agaggacacaatgg

SEQ ID NO: 698193 - DNA, 15 bp, Homo sapiens
agaggacagctctgg

SEQ ID NO: 698194 - DNA, 22 bp, Homo sapiens
agaggacgcacgctcgctgcca

SEQ ID NO: 698195 - DNA, 19 bp, Homo sapiens
agaggacggccctgcctgc

SEQ ID NO: 698196 - DNA, 12 bp, Homo sapiens
agaggactctgc

SEQ ID NO: 698197 - DNA, 20 bp, Homo sapiens
agaggactgagactggcact

SEQ ID NO: 698198 - DNA, 14 bp, Homo sapiens
agaggactgtgtga

SEQ ID NO: 698199 - DNA, 22 bp, Homo sapiens
agaggagaaaaaaaaagtgaaa

SEQ ID NO: 698200 - DNA, 14 bp, Homo sapiens
agaggagaaacaca

SEQ ID NO: 698201 - DNA, 15 bp, Homo sapiens
agaggagaaacacat

SEQ ID NO: 698202 - DNA, 19 bp, Homo sapiens
agaggagaaatgcaataac

SEQ ID NO: 698203 - DNA, 11 bp, Homo sapiens
agaggagaagg

SEQ ID NO: 698204 - DNA, 13 bp, Homo sapiens
agaggagagtggc

SEQ ID NO: 698205 - DNA, 13 bp, Homo sapiens
agaggagcacctg

SEQ ID NO: 698206 - DNA, 14 bp, Homo sapiens
agaggagcacctga

SEQ ID NO: 698207 - DNA, 17 bp, Homo sapiens
agaggagccaccagttc

SEQ ID NO: 698208 - DNA, 13 bp, Homo sapiens
agaggagcccagt

SEQ ID NO: 698209 - DNA, 19 bp, Homo sapiens
agaggagcccagtgggctg

SEQ ID NO: 698210 - DNA, 21 bp, Homo sapiens
agaggagcgcaggcagcgcag

SEQ ID NO: 698211 - DNA, 14 bp, Homo sapiens
agaggagctctccc

SEQ ID NO: 698212 - DNA, 16 bp, Homo sapiens
agaggaggaggaggag

SEQ ID NO: 698213 - DNA, 13 bp, Homo sapiens
agaggaggcagcc

SEQ ID NO: 698214 - DNA, 21 bp, Homo sapiens
agaggaggcagccccctccac

SEQ ID NO: 698215 - DNA, 16 bp, Homo sapiens
agaggaggcctggacc

SEQ ID NO: 698216 - DNA, 17 bp, Homo sapiens
agaggaggcctggaccg

SEQ ID NO: 698217 - DNA, 18 bp, Homo sapiens
agaggaggcctggaccga

SEQ ID NO: 698218 - DNA, 13 bp, Homo sapiens
agaggagggcatg

SEQ ID NO: 698219 - DNA, 19 bp, Homo sapiens
agaggagggcgtgactcac

SEQ ID NO: 698220 - DNA, 20 bp, Homo sapiens
agaggaggggccgctgccac

SEQ ID NO: 698221 - DNA, 19 bp, Homo sapiens
agaggagtgattgaaccag

SEQ ID NO: 698222 - DNA, 19 bp, Homo sapiens
agaggagtgcagccttctc

SEQ ID NO: 698223 - DNA, 14 bp, Homo sapiens
agaggagtgttatt

SEQ ID NO: 698224 - DNA, 15 bp, Homo sapiens
agaggatacatttaa

SEQ ID NO: 698225 - DNA, 14 bp, Homo sapiens
agaggatgagcaga

SEQ ID NO: 698226 - DNA, 18 bp, Homo sapiens
agaggatgatttcagaag

SEQ ID NO: 698227 - DNA, 13 bp, Homo sapiens
agaggatgtgcaa

SEQ ID NO: 698228 - DNA, 20 bp, Homo sapiens
agaggatttttttctgagcg

SEQ ID NO: 698229 - DNA, 11 bp, Homo sapiens
agaggcaccag

SEQ ID NO: 698230 - DNA, 16 bp, Homo sapiens
agaggcacctgctgga

SEQ ID NO: 698231 - DNA, 17 bp, Homo sapiens
agaggcagaagaaccct

SEQ ID NO: 698232 - DNA, 13 bp, Homo sapiens
agaggcagagaaa

SEQ ID NO: 698233 - DNA, 18 bp, Homo sapiens
agaggcagagaaagaaga

SEQ ID NO: 698234 - DNA, 22 bp, Homo sapiens
agaggcagagaaagaagagaca

SEQ ID NO: 698235 - DNA, 20 bp, Homo sapiens
agaggcagagttctgtgaag

SEQ ID NO: 698236 - DNA, 12 bp, Homo sapiens
agaggcagcatg

SEQ ID NO: 698237 - DNA, 20 bp, Homo sapiens
agaggcagcatgcttgggct

SEQ ID NO: 698238 - DNA, 13 bp, Homo sapiens
agaggcagccaga

SEQ ID NO: 698239 - DNA, 16 bp, Homo sapiens
agaggcagcccgcaca

SEQ ID NO: 698240 - DNA, 21 bp, Homo sapiens
agaggcagcctctgcactccc

SEQ ID NO: 698241 - DNA, 19 bp, Homo sapiens
agaggcaggaatgggggtc

SEQ ID NO: 698242 - DNA, 14 bp, Homo sapiens
agaggcaggctggg

SEQ ID NO: 698243 - DNA, 17 bp, Homo sapiens
agaggcaggctgggacg

SEQ ID NO: 698244 - DNA, 21 bp, Homo sapiens
agaggcagtgagactgcaggt

SEQ ID NO: 698245 - DNA, 15 bp, Homo sapiens
agaggcatcttttct

SEQ ID NO: 698246 - DNA, 18 bp, Homo sapiens
agaggccagccccaccca

SEQ ID NO: 698247 - DNA, 23 bp, Homo sapiens
agaggccagccccacccaggagg

SEQ ID NO: 698248 - DNA, 19 bp, Homo sapiens
agaggccagggcagcaagg

SEQ ID NO: 698249 - DNA, 20 bp, Homo sapiens
agaggccatggcagaataat

SEQ ID NO: 698250 - DNA, 18 bp, Homo sapiens
agaggcccactagagggc

SEQ ID NO: 698251 - DNA, 21 bp, Homo sapiens
agaggcccactagagggccca

SEQ ID NO: 698252 - DNA, 12 bp, Homo sapiens
agaggcccaggc

SEQ ID NO: 698253 - DNA, 22 bp, Homo sapiens
agaggcccaggcaccaccagga

SEQ ID NO: 698254 - DNA, 17 bp, Homo sapiens
agaggcccccagcccag

SEQ ID NO: 698255 - DNA, 21 bp, Homo sapiens
agaggcccccagtggggacag

SEQ ID NO: 698256 - DNA, 20 bp, Homo sapiens
agaggccctaggcgggatgg

SEQ ID NO: 698257 - DNA, 16 bp, Homo sapiens
agaggccggggtccag

SEQ ID NO: 698258 - DNA, 23 bp, Homo sapiens
agaggcctgctgccagtgcagcc

SEQ ID NO: 698259 - DNA, 14 bp, Homo sapiens
agaggcctggagcc

SEQ ID NO: 698260 - DNA, 15 bp, Homo sapiens
agaggcctggagccc

SEQ ID NO: 698261 - DNA, 20 bp, Homo sapiens
agaggccttcccatggccat

SEQ ID NO: 698262 - DNA, 19 bp, Homo sapiens
agaggccttttggaatgtg

SEQ ID NO: 698263 - DNA, 14 bp, Homo sapiens
agaggccttttgtt

SEQ ID NO: 698264 - DNA, 17 bp, Homo sapiens
agaggcgggagaactga

SEQ ID NO: 698265 - DNA, 18 bp, Homo sapiens
agaggcgggccagccagg

SEQ ID NO: 698266 - DNA, 18 bp, Homo sapiens
agaggcgtgtgcaggccg

SEQ ID NO: 698267 - DNA, 19 bp, Homo sapiens
agaggctattattttcact

SEQ ID NO: 698268 - DNA, 10 bp, Homo sapiens
agaggctcag

SEQ ID NO: 698269 - DNA, 22 bp, Homo sapiens
agaggctcgttgactggctgtg

SEQ ID NO: 698270 - DNA, 12 bp, Homo sapiens
agaggctctgga

SEQ ID NO: 698271 - DNA, 21 bp, Homo sapiens
agaggctctggacagcagaag

SEQ ID NO: 698272 - DNA, 19 bp, Homo sapiens
agaggctgaaagaggccaa

SEQ ID NO: 698273 - DNA, 13 bp, Homo sapiens
agaggctgagccc

SEQ ID NO: 698274 - DNA, 16 bp, Homo sapiens
agaggctgaggctggc

SEQ ID NO: 698275 - DNA, 20 bp, Homo sapiens
agaggctgcacccctgggcc

SEQ ID NO: 698276 - DNA, 14 bp, Homo sapiens
agaggctgcccctc

SEQ ID NO: 698277 - DNA, 18 bp, Homo sapiens
agaggctgcccctctcac

SEQ ID NO: 698278 - DNA, 19 bp, Homo sapiens
agaggctgcccctctcacc

SEQ ID NO: 698279 - DNA, 15 bp, Homo sapiens
agaggctgcctcagc

SEQ ID NO: 698280 - DNA, 22 bp, Homo sapiens
agaggctgcctctcccatcact

SEQ ID NO: 698281 - DNA, 16 bp, Homo sapiens
agaggctggaggcagg

SEQ ID NO: 698282 - DNA, 20 bp, Homo sapiens
agaggctggaggcagggcct

SEQ ID NO: 698283 - DNA, 22 bp, Homo sapiens
agaggctggcactgagcctgct

SEQ ID NO: 698284 - DNA, 19 bp, Homo sapiens
agaggctggcctctacatc

SEQ ID NO: 698285 - DNA, 16 bp, Homo sapiens
agaggctgggaggttg

SEQ ID NO: 698286 - DNA, 21 bp, Homo sapiens
agaggctggtgctgtggccag

SEQ ID NO: 698287 - DNA, 22 bp, Homo sapiens
agaggctggtgtatgcactgct

SEQ ID NO: 698288 - DNA, 16 bp, Homo sapiens
agaggctggttccaga

SEQ ID NO: 698289 - DNA, 15 bp, Homo sapiens
agaggctgtctgggg

SEQ ID NO: 698290 - DNA, 14 bp, Homo sapiens
agaggctgtgtggc

SEQ ID NO: 698291 - DNA, 17 bp, Homo sapiens
agaggctgtgtggccaa

SEQ ID NO: 698292 - DNA, 20 bp, Homo sapiens
agaggctgtgtggccaacca

SEQ ID NO: 698293 - DNA, 22 bp, Homo sapiens
agaggcttatgagatctaatgt

SEQ ID NO: 698294 - DNA, 21 bp, Homo sapiens
agaggcttctccgccagcctc

SEQ ID NO: 698295 - DNA, 23 bp, Homo sapiens
agaggcttctccgccagcctcct

SEQ ID NO: 698296 - DNA, 14 bp, Homo sapiens
agaggcttcttcag

SEQ ID NO: 698297 - DNA, 14 bp, Homo sapiens
agaggctttcaaat

SEQ ID NO: 698298 - DNA, 17 bp, Homo sapiens
agaggctttcaaatgta

SEQ ID NO: 698299 - DNA, 16 bp, Homo sapiens
agaggctttggcccaa

SEQ ID NO: 698300 - DNA, 17 bp, Homo sapiens
agaggctttggggtcct

SEQ ID NO: 698301 - DNA, 15 bp, Homo sapiens
agagggaagccatgt

SEQ ID NO: 698302 - DNA, 16 bp, Homo sapiens
agagggaagccatgtg

SEQ ID NO: 698303 - DNA, 17 bp, Homo sapiens
agagggaatggatgggg

SEQ ID NO: 698304 - DNA, 14 bp, Homo sapiens
agagggaccatgtg

SEQ ID NO: 698305 - DNA, 16 bp, Homo sapiens
agagggagactcctgg

SEQ ID NO: 698306 - DNA, 13 bp, Homo sapiens
agagggagagaga

SEQ ID NO: 698307 - DNA, 20 bp, Homo sapiens
agagggagtagaatacgcag

SEQ ID NO: 698308 - DNA, 17 bp, Homo sapiens
agagggatgggttcctg

SEQ ID NO: 698309 - DNA, 22 bp, Homo sapiens
agagggatttccctgcagacct

SEQ ID NO: 698310 - DNA, 14 bp, Homo sapiens
agagggcaaggaag

SEQ ID NO: 698311 - DNA, 16 bp, Homo sapiens
agagggcagtacctgg

SEQ ID NO: 698312 - DNA, 17 bp, Homo sapiens
agagggccagagctagg

SEQ ID NO: 698313 - DNA, 22 bp, Homo sapiens
agagggccagagctagggctgc

SEQ ID NO: 698314 - DNA, 15 bp, Homo sapiens
agagggcccagccca

SEQ ID NO: 698315 - DNA, 17 bp, Homo sapiens
agagggcccagcccaga

SEQ ID NO: 698316 - DNA, 19 bp, Homo sapiens
agagggcccagcccagagc

SEQ ID NO: 698317 - DNA, 14 bp, Homo sapiens
agagggcccagctg

SEQ ID NO: 698318 - DNA, 15 bp, Homo sapiens
agagggcccagctgt

SEQ ID NO: 698319 - DNA, 15 bp, Homo sapiens
agagggcctgtggga

SEQ ID NO: 698320 - DNA, 16 bp, Homo sapiens
agagggcctgtgggag

SEQ ID NO: 698321 - DNA, 14 bp, Homo sapiens
agagggccttgctt

SEQ ID NO: 698322 - DNA, 17 bp, Homo sapiens
agagggccttgcttctc

SEQ ID NO: 698323 - DNA, 21 bp, Homo sapiens
agagggccttgcttctcttct

SEQ ID NO: 698324 - DNA, 15 bp, Homo sapiens
agagggctagccctg

SEQ ID NO: 698325 - DNA, 16 bp, Homo sapiens
agagggctagccctga

SEQ ID NO: 698326 - DNA, 17 bp, Homo sapiens
agagggctttaattttt

SEQ ID NO: 698327 - DNA, 19 bp, Homo sapiens
agagggctttttaaatttg

SEQ ID NO: 698328 - DNA, 22 bp, Homo sapiens
agaggggaaaccagtgtagcct

SEQ ID NO: 698329 - DNA, 15 bp, Homo sapiens
agaggggaaggaaat

SEQ ID NO: 698330 - DNA, 15 bp, Homo sapiens
agaggggagggaggg

SEQ ID NO: 698331 - DNA, 13 bp, Homo sapiens
agaggggatgggg

SEQ ID NO: 698332 - DNA, 12 bp, Homo sapiens
agaggggcagcc

SEQ ID NO: 698333 - DNA, 18 bp, Homo sapiens
agaggggcagcccttgct

SEQ ID NO: 698334 - DNA, 19 bp, Homo sapiens
agaggggcagcccttgctt

SEQ ID NO: 698335 - DNA, 20 bp, Homo sapiens
agaggggcagccgctaggag

SEQ ID NO: 698336 - DNA, 16 bp, Homo sapiens
agaggggcctgatgag

SEQ ID NO: 698337 - DNA, 21 bp, Homo sapiens
agaggggcgctgtcctgcgtt

SEQ ID NO: 698338 - DNA, 18 bp, Homo sapiens
agaggggcgggctcagag

SEQ ID NO: 698339 - DNA, 19 bp, Homo sapiens
agaggggcgggctcagagc

SEQ ID NO: 698340 - DNA, 20 bp, Homo sapiens
agaggggcgggctcagagct

SEQ ID NO: 698341 - DNA, 21 bp, Homo sapiens
agaggggcgggctcagagctt

SEQ ID NO: 698342 - DNA, 15 bp, Homo sapiens
agaggggctggggca

SEQ ID NO: 698343 - DNA, 13 bp, Homo sapiens
agagggggacctg

SEQ ID NO: 698344 - DNA, 14 bp, Homo sapiens
agagggggaggttg

SEQ ID NO: 698345 - DNA, 13 bp, Homo sapiens
agagggggctctc

SEQ ID NO: 698346 - DNA, 14 bp, Homo sapiens
agagggggctctcc

SEQ ID NO: 698347 - DNA, 22 bp, Homo sapiens
agagggggctctgcccacctgg

SEQ ID NO: 698348 - DNA, 13 bp, Homo sapiens
agaggggtgcaga

SEQ ID NO: 698349 - DNA, 23 bp, Homo sapiens
agaggggtgcagaggctgtggct

SEQ ID NO: 698350 - DNA, 17 bp, Homo sapiens
agagggtagacaggggc

SEQ ID NO: 698351 - DNA, 16 bp, Homo sapiens
agagggtcccagggct

SEQ ID NO: 698352 - DNA, 22 bp, Homo sapiens
agagggtctggagaagcagtga

SEQ ID NO: 698353 - DNA, 13 bp, Homo sapiens
agagggttcctgt

SEQ ID NO: 698354 - DNA, 20 bp, Homo sapiens
agaggtaaaagtgtgagcag

SEQ ID NO: 698355 - DNA, 20 bp, Homo sapiens
agaggtactgtaatgggtaa

SEQ ID NO: 698356 - DNA, 19 bp, Homo sapiens
agaggtagcgagctgctct

SEQ ID NO: 698357 - DNA, 20 bp, Homo sapiens
agaggtagcgagctgctctg

SEQ ID NO: 698358 - DNA, 23 bp, Homo sapiens
agaggtagcgagctgctctgcta

SEQ ID NO: 698359 - DNA, 14 bp, Homo sapiens
agaggtcaccagct

SEQ ID NO: 698360 - DNA, 22 bp, Homo sapiens
agaggtcaggacggctcctcag

SEQ ID NO: 698361 - DNA, 19 bp, Homo sapiens
agaggtccacaacacacag

SEQ ID NO: 698362 - DNA, 14 bp, Homo sapiens
agaggtccagccca

SEQ ID NO: 698363 - DNA, 23 bp, Homo sapiens
agaggtctccaaactgattaaat

SEQ ID NO: 698364 - DNA, 14 bp, Homo sapiens
agaggtctgtgctg

SEQ ID NO: 698365 - DNA, 19 bp, Homo sapiens
agaggtctgtgctgaggcc

SEQ ID NO: 698366 - DNA, 19 bp, Homo sapiens
agaggtgagaactcagaag

SEQ ID NO: 698367 - DNA, 18 bp, Homo sapiens
agaggtgattctcagggc

SEQ ID NO: 698368 - DNA, 15 bp, Homo sapiens
agaggtgcaagacct

SEQ ID NO: 698369 - DNA, 14 bp, Homo sapiens
agaggtgccagcaa

SEQ ID NO: 698370 - DNA, 18 bp, Homo sapiens
agaggtgccagcaactga

SEQ ID NO: 698371 - DNA, 19 bp, Homo sapiens
agaggtgccagcaactgaa

SEQ ID NO: 698372 - DNA, 20 bp, Homo sapiens
agaggtgccagcaactgaat

SEQ ID NO: 698373 - DNA, 22 bp, Homo sapiens
agaggtgccagcaactgaataa

SEQ ID NO: 698374 - DNA, 21 bp, Homo sapiens
agaggtgccggggaggggcag

SEQ ID NO: 698375 - DNA, 13 bp, Homo sapiens
agaggtgcttcac

SEQ ID NO: 698376 - DNA, 16 bp, Homo sapiens
agaggtgcttcaccct

SEQ ID NO: 698377 - DNA, 12 bp, Homo sapiens
agaggtggatgt

SEQ ID NO: 698378 - DNA, 21 bp, Homo sapiens
agaggtggatgttatgaacag

SEQ ID NO: 698379 - DNA, 12 bp, Homo sapiens
agaggtggcagg

SEQ ID NO: 698380 - DNA, 13 bp, Homo sapiens
agaggtggccctt

SEQ ID NO: 698381 - DNA, 23 bp, Homo sapiens
agaggtggcccttgtttacagtg

SEQ ID NO: 698382 - DNA, 22 bp, Homo sapiens
agaggtggctgcgcccccagct

SEQ ID NO: 698383 - DNA, 14 bp, Homo sapiens
agaggtgggagggc

SEQ ID NO: 698384 - DNA, 17 bp, Homo sapiens
agaggtgggagggccct

SEQ ID NO: 698385 - DNA, 18 bp, Homo sapiens
agaggtgggcagctgggc

SEQ ID NO: 698386 - DNA, 21 bp, Homo sapiens
agaggtgggccagtctgtgga

SEQ ID NO: 698387 - DNA, 16 bp, Homo sapiens
agaggtgtcatgcttt

SEQ ID NO: 698388 - DNA, 16 bp, Homo sapiens
agaggtgttatttgga

SEQ ID NO: 698389 - DNA, 16 bp, Homo sapiens
agaggttaaggtgcaa

SEQ ID NO: 698390 - DNA, 16 bp, Homo sapiens
agaggttatctgcctg

SEQ ID NO: 698391 - DNA, 19 bp, Homo sapiens
agaggttatctgcctggcc

SEQ ID NO: 698392 - DNA, 21 bp, Homo sapiens
agaggttatctgcctggcctg

SEQ ID NO: 698393 - DNA, 22 bp, Homo sapiens
agaggttatctgcctggcctgg

SEQ ID NO: 698394 - DNA, 13 bp, Homo sapiens
agaggttcaaaga

SEQ ID NO: 698395 - DNA, 16 bp, Homo sapiens
agaggttcaaagatat

SEQ ID NO: 698396 - DNA, 21 bp, Homo sapiens
agaggtttatttgggtacatg

SEQ ID NO: 698397 - DNA, 22 bp, Homo sapiens
agagccaggatgcccagatgaa

SEQ ID NO: 698398 - DNA, 11 bp, Homo sapiens
agagccagggc

SEQ ID NO: 698399 - DNA, 16 bp, Homo sapiens
agagccagggctgtcc

SEQ ID NO: 698400 - DNA, 17 bp, Homo sapiens
agagccagggctgtcct

SEQ ID NO: 698401 - DNA, 18 bp, Homo sapiens
agagccagggctgtcctt

SEQ ID NO: 698402 - DNA, 23 bp, Homo sapiens
agagccagtggcgggtgatggcc

SEQ ID NO: 698403 - DNA, 18 bp, Homo sapiens
agagccatacataaaaga

SEQ ID NO: 698404 - DNA, 19 bp, Homo sapiens
agagccatataagtttgaa

SEQ ID NO: 698405 - DNA, 20 bp, Homo sapiens
agagccatataagtttgaag

SEQ ID NO: 698406 - DNA, 22 bp, Homo sapiens
agagccatataagtttgaagga

SEQ ID NO: 698407 - DNA, 16 bp, Homo sapiens
agagccatgaagcatt

SEQ ID NO: 698408 - DNA, 17 bp, Homo sapiens
agagccatgaagcatta

SEQ ID NO: 698409 - DNA, 16 bp, Homo sapiens
agagccatgctgggaa

SEQ ID NO: 698410 - DNA, 18 bp, Homo sapiens
agagcccaaggtcaggga

SEQ ID NO: 698411 - DNA, 19 bp, Homo sapiens
agagcccaccagccagccc

SEQ ID NO: 698412 - DNA, 22 bp, Homo sapiens
agagcccaccagccagccctgg

SEQ ID NO: 698413 - DNA, 23 bp, Homo sapiens
agagcccaccagccagccctggc

SEQ ID NO: 698414 - DNA, 21 bp, Homo sapiens
agagcccagcagggcctcaaa

SEQ ID NO: 698415 - DNA, 11 bp, Homo sapiens
agagcccagct

SEQ ID NO: 698416 - DNA, 18 bp, Homo sapiens
agagcccagctcttgctc

SEQ ID NO: 698417 - DNA, 14 bp, Homo sapiens
agagccccacacgg

SEQ ID NO: 698418 - DNA, 14 bp, Homo sapiens
agagccccagctga

SEQ ID NO: 698419 - DNA, 18 bp, Homo sapiens
agagcccccaccagcagc

SEQ ID NO: 698420 - DNA, 19 bp, Homo sapiens
agagcccccaccagcagca

SEQ ID NO: 698421 - DNA, 15 bp, Homo sapiens
agagcccccaccttg

SEQ ID NO: 698422 - DNA, 17 bp, Homo sapiens
agagcccccagccctgg

SEQ ID NO: 698423 - DNA, 22 bp, Homo sapiens
agagcccgccgtctgcaggggc

SEQ ID NO: 698424 - DNA, 14 bp, Homo sapiens
agagcccggcccca

SEQ ID NO: 698425 - DNA, 21 bp, Homo sapiens
agagcccggccccacctccct

SEQ ID NO: 698426 - DNA, 22 bp, Homo sapiens
agagcccggccccacctccctg

SEQ ID NO: 698427 - DNA, 18 bp, Homo sapiens
agagccctgaggcctaga

SEQ ID NO: 698428 - DNA, 20 bp, Homo sapiens
agagccctgaggggctgggc

SEQ ID NO: 698429 - DNA, 22 bp, Homo sapiens
agagccctgaggggctgggctg

SEQ ID NO: 698430 - DNA, 13 bp, Homo sapiens
agagccctggaca

SEQ ID NO: 698431 - DNA, 22 bp, Homo sapiens
agagccctggctctgcccctca

SEQ ID NO: 698432 - DNA, 13 bp, Homo sapiens
agagccctggctg

SEQ ID NO: 698433 - DNA, 14 bp, Homo sapiens
agagccctggctgg

SEQ ID NO: 698434 - DNA, 15 bp, Homo sapiens
agagccctggctggg

SEQ ID NO: 698435 - DNA, 15 bp, Homo sapiens
agagccctgtggccg

SEQ ID NO: 698436 - DNA, 19 bp, Homo sapiens
agagcccttcactgccatg

SEQ ID NO: 698437 - DNA, 15 bp, Homo sapiens
agagcccttcatttg

SEQ ID NO: 698438 - DNA, 19 bp, Homo sapiens
agagcccttgcctccccat

SEQ ID NO: 698439 - DNA, 19 bp, Homo sapiens
agagccggccgccttctcc

SEQ ID NO: 698440 - DNA, 16 bp, Homo sapiens
agagccgggaagcgat

SEQ ID NO: 698441 - DNA, 15 bp, Homo sapiens
agagccggtggtgcc

SEQ ID NO: 698442 - DNA, 16 bp, Homo sapiens
agagccgtggtccctg

SEQ ID NO: 698443 - DNA, 19 bp, Homo sapiens
agagcctattttggtgagg

SEQ ID NO: 698444 - DNA, 20 bp, Homo sapiens
agagcctcgacaccccccca

SEQ ID NO: 698445 - DNA, 12 bp, Homo sapiens
agagcctctgag

SEQ ID NO: 698446 - DNA, 13 bp, Homo sapiens
agagcctctgctg

SEQ ID NO: 698447 - DNA, 12 bp, Homo sapiens
agagcctctggc

SEQ ID NO: 698448 - DNA, 19 bp, Homo sapiens
agagcctgaagctggcctg

SEQ ID NO: 698449 - DNA, 15 bp, Homo sapiens
agagcctgaatttgt

SEQ ID NO: 698450 - DNA, 12 bp, Homo sapiens
agagcctgacct

SEQ ID NO: 698451 - DNA, 13 bp, Homo sapiens
agagcctgaggga

SEQ ID NO: 698452 - DNA, 14 bp, Homo sapiens
agagcctgatctct

SEQ ID NO: 698453 - DNA, 13 bp, Homo sapiens
agagcctgctccc

SEQ ID NO: 698454 - DNA, 15 bp, Homo sapiens
agagcctgctccccc

SEQ ID NO: 698455 - DNA, 20 bp, Homo sapiens
agagcctgctcccccacccc

SEQ ID NO: 698456 - DNA, 12 bp, Homo sapiens
agagcctgctgg

SEQ ID NO: 698457 - DNA, 19 bp, Homo sapiens
agagcctgctggcacccac

SEQ ID NO: 698458 - DNA, 15 bp, Homo sapiens
agagcctggagaagc

SEQ ID NO: 698459 - DNA, 11 bp, Homo sapiens
agagcctggca

SEQ ID NO: 698460 - DNA, 17 bp, Homo sapiens
agagcctggccccaggc

SEQ ID NO: 698461 - DNA, 18 bp, Homo sapiens
agagcctggccccaggcc

SEQ ID NO: 698462 - DNA, 15 bp, Homo sapiens
agagcctggctttgg

SEQ ID NO: 698463 - DNA, 22 bp, Homo sapiens
agagcctggctttggtccccag

SEQ ID NO: 698464 - DNA, 12 bp, Homo sapiens
agagcctgtccc

SEQ ID NO: 698465 - DNA, 13 bp, Homo sapiens
agagcctgtcccc

SEQ ID NO: 698466 - DNA, 15 bp, Homo sapiens
agagcctgtccccgc

SEQ ID NO: 698467 - DNA, 22 bp, Homo sapiens
agagccttccatgacctcccct

SEQ ID NO: 698468 - DNA, 20 bp, Homo sapiens
agagccttggtgtccacctg

SEQ ID NO: 698469 - DNA, 21 bp, Homo sapiens
agagccttggtgtccacctgg

SEQ ID NO: 698470 - DNA, 19 bp, Homo sapiens
agagcctttcctcaaaact

SEQ ID NO: 698471 - DNA, 13 bp, Homo sapiens
agagcgacacaga

SEQ ID NO: 698472 - DNA, 17 bp, Homo sapiens
agagcgagagtctgtct

SEQ ID NO: 698473 - DNA, 17 bp, Homo sapiens
agagcgagattccgtct

SEQ ID NO: 698474 - DNA, 21 bp, Homo sapiens
agagcgaggaaaggattttac

SEQ ID NO: 698475 - DNA, 14 bp, Homo sapiens
agagcgccaggaag

SEQ ID NO: 698476 - DNA, 19 bp, Homo sapiens
agagcgccaggaagccaga

SEQ ID NO: 698477 - DNA, 22 bp, Homo sapiens
agagcgcctcttcctctgggca

SEQ ID NO: 698478 - DNA, 19 bp, Homo sapiens
agagctaaactccttcctg

SEQ ID NO: 698479 - DNA, 23 bp, Homo sapiens
agagctaagggtgggtgctcaga

SEQ ID NO: 698480 - DNA, 20 bp, Homo sapiens
agagctaataaatctcttct

SEQ ID NO: 698481 - DNA, 14 bp, Homo sapiens
agagctacataatt

SEQ ID NO: 698482 - DNA, 16 bp, Homo sapiens
agagctacgtatttaa

SEQ ID NO: 698483 - DNA, 16 bp, Homo sapiens
agagctagaaaaataa

SEQ ID NO: 698484 - DNA, 20 bp, Homo sapiens
agagctagaaaaataaaatg

SEQ ID NO: 698485 - DNA, 20 bp, Homo sapiens
agagctagcagcagggaggg

SEQ ID NO: 698486 - DNA, 18 bp, Homo sapiens
agagctagggctgctgct

SEQ ID NO: 698487 - DNA, 21 bp, Homo sapiens
agagctagggctgctgcttct

SEQ ID NO: 698488 - DNA, 22 bp, Homo sapiens
agagctagggctgctgcttctg

SEQ ID NO: 698489 - DNA, 15 bp, Homo sapiens
agagctatggtgagg

SEQ ID NO: 698490 - DNA, 17 bp, Homo sapiens
agagctatgttccctcc

SEQ ID NO: 698491 - DNA, 17 bp, Homo sapiens
agagctcagctttctga

SEQ ID NO: 698492 - DNA, 21 bp, Homo sapiens
agagctcccctccacagctgc

SEQ ID NO: 698493 - DNA, 14 bp, Homo sapiens
agagctctgcacgt

SEQ ID NO: 698494 - DNA, 19 bp, Homo sapiens
agagctcttcaagctgtcc

SEQ ID NO: 698495 - DNA, 22 bp, Homo sapiens
agagctcttcggtttctgagca

SEQ ID NO: 698496 - DNA, 19 bp, Homo sapiens
agagctgaaccttgagggg

SEQ ID NO: 698497 - DNA, 23 bp, Homo sapiens
agagctgacccagagtggagtct

SEQ ID NO: 698498 - DNA, 12 bp, Homo sapiens
agagctgagcca

SEQ ID NO: 698499 - DNA, 17 bp, Homo sapiens
agagctgagccagttgt

SEQ ID NO: 698500 - DNA, 13 bp, Homo sapiens
agagctgatccag

SEQ ID NO: 698501 - DNA, 17 bp, Homo sapiens
agagctgatccagagca

SEQ ID NO: 698502 - DNA, 18 bp, Homo sapiens
agagctgatccagagcac

SEQ ID NO: 698503 - DNA, 21 bp, Homo sapiens
agagctgatccagagcacaga

SEQ ID NO: 698504 - DNA, 15 bp, Homo sapiens
agagctgcacagcaa

SEQ ID NO: 698505 - DNA, 22 bp, Homo sapiens
agagctgccactgggcacctgc

SEQ ID NO: 698506 - DNA, 16 bp, Homo sapiens
agagctgccatcgctg

SEQ ID NO: 698507 - DNA, 15 bp, Homo sapiens
agagctgctctggaa

SEQ ID NO: 698508 - DNA, 22 bp, Homo sapiens
agagctgctctggaaaatgtga

SEQ ID NO: 698509 - DNA, 15 bp, Homo sapiens
agagctggaaggcag

SEQ ID NO: 698510 - DNA, 17 bp, Homo sapiens
agagctggaaggcaggg

SEQ ID NO: 698511 - DNA, 19 bp, Homo sapiens
agagctggaaggcagggca

SEQ ID NO: 698512 - DNA, 23 bp, Homo sapiens
agagctggaaggcagggcagagg

SEQ ID NO: 698513 - DNA, 23 bp, Homo sapiens
agagctggagatgaggccagacc

SEQ ID NO: 698514 - DNA, 15 bp, Homo sapiens
agagctggagccccc

SEQ ID NO: 698515 - DNA, 15 bp, Homo sapiens
agagctggcaaaggt

SEQ ID NO: 698516 - DNA, 20 bp, Homo sapiens
agagctgggaaattcatgtg

SEQ ID NO: 698517 - DNA, 12 bp, Homo sapiens
agagctgggagg

SEQ ID NO: 698518 - DNA, 23 bp, Homo sapiens
agagctgggaggcatggccctgg

SEQ ID NO: 698519 - DNA, 13 bp, Homo sapiens
agagctgggaggg

SEQ ID NO: 698520 - DNA, 18 bp, Homo sapiens
agagctggggctgccagc

SEQ ID NO: 698521 - DNA, 12 bp, Homo sapiens
agagagggggct

SEQ ID NO: 698522 - DNA, 19 bp, Homo sapiens
agagaggtagcgagctgct

SEQ ID NO: 698523 - DNA, 16 bp, Homo sapiens
agagaggtatttaact

SEQ ID NO: 698524 - DNA, 16 bp, Homo sapiens
agagagtacagactgc

SEQ ID NO: 698525 - DNA, 16 bp, Homo sapiens
agagagtcctctggat

SEQ ID NO: 698526 - DNA, 16 bp, Homo sapiens
agagagtggctcctcc

SEQ ID NO: 698527 - DNA, 17 bp, Homo sapiens
agagagtggctcctccc

SEQ ID NO: 698528 - DNA, 15 bp, Homo sapiens
agagagtgtacatca

SEQ ID NO: 698529 - DNA, 14 bp, Homo sapiens
agagagtttgtaag

SEQ ID NO: 698530 - DNA, 21 bp, Homo sapiens
agagataaaccaataaatcca

SEQ ID NO: 698531 - DNA, 13 bp, Homo sapiens
agagatacagagg

SEQ ID NO: 698532 - DNA, 17 bp, Homo sapiens
agagatatggcagcgaa

SEQ ID NO: 698533 - DNA, 18 bp, Homo sapiens
agagatattgatattgaa

SEQ ID NO: 698534 - DNA, 15 bp, Homo sapiens
agagatattttgtaa

SEQ ID NO: 698535 - DNA, 15 bp, Homo sapiens
agagatcaaagatga

SEQ ID NO: 698536 - DNA, 17 bp, Homo sapiens
agagatcacccactcct

SEQ ID NO: 698537 - DNA, 15 bp, Homo sapiens
agagatccctgcaga

SEQ ID NO: 698538 - DNA, 19 bp, Homo sapiens
agagatccctgcagaaccc

SEQ ID NO: 698539 - DNA, 20 bp, Homo sapiens
agagatccctgcagaaccca

SEQ ID NO: 698540 - DNA, 16 bp, Homo sapiens
agagatcgagaccatc

SEQ ID NO: 698541 - DNA, 13 bp, Homo sapiens
agagatctgggca

SEQ ID NO: 698542 - DNA, 12 bp, Homo sapiens
agagatgaatta

SEQ ID NO: 698543 - DNA, 15 bp, Homo sapiens
agagatgagaaagct

SEQ ID NO: 698544 - DNA, 15 bp, Homo sapiens
agagatgagaagcca

SEQ ID NO: 698545 - DNA, 20 bp, Homo sapiens
agagatgcactatatgttta

SEQ ID NO: 698546 - DNA, 14 bp, Homo sapiens
agagatgcctccac

SEQ ID NO: 698547 - DNA, 17 bp, Homo sapiens
agagatgcctccaccgc

SEQ ID NO: 698548 - DNA, 22 bp, Homo sapiens
agagatgtttttaaaagtttca

SEQ ID NO: 698549 - DNA, 16 bp, Homo sapiens
agagattacctcctga

SEQ ID NO: 698550 - DNA, 20 bp, Homo sapiens
agagattagtaaatatgtga

SEQ ID NO: 698551 - DNA, 15 bp, Homo sapiens
agagattataacaaa

SEQ ID NO: 698552 - DNA, 13 bp, Homo sapiens
agagattcatttt

SEQ ID NO: 698553 - DNA, 16 bp, Homo sapiens
agagattcattttcta

SEQ ID NO: 698554 - DNA, 21 bp, Homo sapiens
agagattctggatctcctgct

SEQ ID NO: 698555 - DNA, 18 bp, Homo sapiens
agagattgccccagagcc

SEQ ID NO: 698556 - DNA, 20 bp, Homo sapiens
agagattggatcaagtatta

SEQ ID NO: 698557 - DNA, 21 bp, Homo sapiens
agagattggatcaagtattac

SEQ ID NO: 698558 - DNA, 16 bp, Homo sapiens
agagattgtggtttca

SEQ ID NO: 698559 - DNA, 18 bp, Homo sapiens
agagatttcaacaagaat

SEQ ID NO: 698560 - DNA, 18 bp, Homo sapiens
agagcaaaataattttaa

SEQ ID NO: 698561 - DNA, 13 bp, Homo sapiens
agagcaaaggaga

SEQ ID NO: 698562 - DNA, 17 bp, Homo sapiens
agagcaaaggcccatgc

SEQ ID NO: 698563 - DNA, 18 bp, Homo sapiens
agagcaaatgagggaggg

SEQ ID NO: 698564 - DNA, 13 bp, Homo sapiens
agagcaacccctg

SEQ ID NO: 698565 - DNA, 22 bp, Homo sapiens
agagcaacccctgtacccagct

SEQ ID NO: 698566 - DNA, 23 bp, Homo sapiens
agagcaagatcctgtctttaagg

SEQ ID NO: 698567 - DNA, 22 bp, Homo sapiens
agagcaaggtttcgtggcagca

SEQ ID NO: 698568 - DNA, 14 bp, Homo sapiens
agagcaagtctgga

SEQ ID NO: 698569 - DNA, 12 bp, Homo sapiens
agagcaataaca

SEQ ID NO: 698570 - DNA, 21 bp, Homo sapiens
agagcaataacactatattta

SEQ ID NO: 698571 - DNA, 21 bp, Homo sapiens
agagcaatgcttttaatgaat

SEQ ID NO: 698572 - DNA, 16 bp, Homo sapiens
agagcaattgcagcag

SEQ ID NO: 698573 - DNA, 22 bp, Homo sapiens
agagcaatttacctggtactaa

SEQ ID NO: 698574 - DNA, 14 bp, Homo sapiens
agagcacactgtag

SEQ ID NO: 698575 - DNA, 15 bp, Homo sapiens
agagcacacttattt

SEQ ID NO: 698576 - DNA, 21 bp, Homo sapiens
agagcacacttatttatgaat

SEQ ID NO: 698577 - DNA, 15 bp, Homo sapiens
agagcacagagccct

SEQ ID NO: 698578 - DNA, 16 bp, Homo sapiens
agagcacagcttcttc

SEQ ID NO: 698579 - DNA, 20 bp, Homo sapiens
agagcacccccaagcctggg

SEQ ID NO: 698580 - DNA, 15 bp, Homo sapiens
agagcaccccctgct

SEQ ID NO: 698581 - DNA, 19 bp, Homo sapiens
agagcacctagtccagtga

SEQ ID NO: 698582 - DNA, 21 bp, Homo sapiens
agagcaccttcctcacttcca

SEQ ID NO: 698583 - DNA, 15 bp, Homo sapiens
agagcacgcctgcca

SEQ ID NO: 698584 - DNA, 22 bp, Homo sapiens
agagcacgcctgccatcttctc

SEQ ID NO: 698585 - DNA, 23 bp, Homo sapiens
agagcactgcctctatgccctgc

SEQ ID NO: 698586 - DNA, 20 bp, Homo sapiens
agagcacttaagagaatatt

SEQ ID NO: 698587 - DNA, 22 bp, Homo sapiens
agagcacttaagagaatatttt

SEQ ID NO: 698588 - DNA, 23 bp, Homo sapiens
agagcagaacggagccccaggcc

SEQ ID NO: 698589 - DNA, 12 bp, Homo sapiens
agagcagacagg

SEQ ID NO: 698590 - DNA, 13 bp, Homo sapiens
agagcagagagca

SEQ ID NO: 698591 - DNA, 12 bp, Homo sapiens
agagcagaggtc

SEQ ID NO: 698592 - DNA, 18 bp, Homo sapiens
agagcagagtctgggcct

SEQ ID NO: 698593 - DNA, 13 bp, Homo sapiens
agagcagagttta

SEQ ID NO: 698594 - DNA, 14 bp, Homo sapiens
agagcagcagcacc

SEQ ID NO: 698595 - DNA, 16 bp, Homo sapiens
agagcagcctcgtgga

SEQ ID NO: 698596 - DNA, 12 bp, Homo sapiens
agagcagcctga

SEQ ID NO: 698597 - DNA, 13 bp, Homo sapiens
agagcagcctgat

SEQ ID NO: 698598 - DNA, 16 bp, Homo sapiens
agagcagcctgtggca

SEQ ID NO: 698599 - DNA, 11 bp, Homo sapiens
agagcagctgg

SEQ ID NO: 698600 - DNA, 21 bp, Homo sapiens
agagcagcttcggtgtgcaga

SEQ ID NO: 698601 - DNA, 23 bp, Homo sapiens
agagcaggaagcattcagagagc

SEQ ID NO: 698602 - DNA, 14 bp, Homo sapiens
agagcaggaaggac

SEQ ID NO: 698603 - DNA, 13 bp, Homo sapiens
agagcaggactcc

SEQ ID NO: 698604 - DNA, 20 bp, Homo sapiens
agagcaggactccaggccca

SEQ ID NO: 698605 - DNA, 12 bp, Homo sapiens
agagcaggagcc

SEQ ID NO: 698606 - DNA, 22 bp, Homo sapiens
agagcaggaggcccctggccca

SEQ ID NO: 698607 - DNA, 12 bp, Homo sapiens
agagcaggcaca

SEQ ID NO: 698608 - DNA, 13 bp, Homo sapiens
agagcaggcacat

SEQ ID NO: 698609 - DNA, 13 bp, Homo sapiens
agagcaggccagg

SEQ ID NO: 698610 - DNA, 13 bp, Homo sapiens
agagcaggctggc

SEQ ID NO: 698611 - DNA, 17 bp, Homo sapiens
agagcaggctggcagct

SEQ ID NO: 698612 - DNA, 22 bp, Homo sapiens
agagcaggctggcagctctcca

SEQ ID NO: 698613 - DNA, 23 bp, Homo sapiens
agagcaggctggcagctctccag

SEQ ID NO: 698614 - DNA, 14 bp, Homo sapiens
agagcaggggagct

SEQ ID NO: 698615 - DNA, 18 bp, Homo sapiens
agagcaggggagcttggg

SEQ ID NO: 698616 - DNA, 21 bp, Homo sapiens
agagcaggggagcttgggact

SEQ ID NO: 698617 - DNA, 22 bp, Homo sapiens
agagcaggggagcttgggactc

SEQ ID NO: 698618 - DNA, 16 bp, Homo sapiens
agagcaggggctccag

SEQ ID NO: 698619 - DNA, 18 bp, Homo sapiens
agagcaggggctccagca

SEQ ID NO: 698620 - DNA, 20 bp, Homo sapiens
agagcaggtgactgtgctgt

SEQ ID NO: 698621 - DNA, 13 bp, Homo sapiens
agagcagtgggca

SEQ ID NO: 698622 - DNA, 17 bp, Homo sapiens
agagcagtggtaagaat

SEQ ID NO: 698623 - DNA, 19 bp, Homo sapiens
agagcagtggtaagaatag

SEQ ID NO: 698624 - DNA, 16 bp, Homo sapiens
agagcataaaacctaa

SEQ ID NO: 698625 - DNA, 14 bp, Homo sapiens
agagcataatttaa

SEQ ID NO: 698626 - DNA, 21 bp, Homo sapiens
agagcataatttaaaaatata

SEQ ID NO: 698627 - DNA, 20 bp, Homo sapiens
agagcatccggccaaatgca

SEQ ID NO: 698628 - DNA, 21 bp, Homo sapiens
agagcatcgtgacccttcagg

SEQ ID NO: 698629 - DNA, 17 bp, Homo sapiens
agagcattacgtgagcc

SEQ ID NO: 698630 - DNA, 20 bp, Homo sapiens
agagcattacgtgagccagg

SEQ ID NO: 698631 - DNA, 17 bp, Homo sapiens
agagcattagctggcgc

SEQ ID NO: 698632 - DNA, 20 bp, Homo sapiens
agagcatttccaacaccaca

SEQ ID NO: 698633 - DNA, 14 bp, Homo sapiens
agagccaaggccac

SEQ ID NO: 698634 - DNA, 14 bp, Homo sapiens
agagccacctgcaa

SEQ ID NO: 698635 - DNA, 16 bp, Homo sapiens
agagccacctgcaaga

SEQ ID NO: 698636 - DNA, 20 bp, Homo sapiens
agagccacctgcaagatgga

SEQ ID NO: 698637 - DNA, 13 bp, Homo sapiens
agagccacctgga

SEQ ID NO: 698638 - DNA, 19 bp, Homo sapiens
agagccactgggcccctgt

SEQ ID NO: 698639 - DNA, 14 bp, Homo sapiens
agagccagcctggc

SEQ ID NO: 698640 - DNA, 22 bp, Homo sapiens
agagccagcctggctctgcccc

SEQ ID NO: 698641 - DNA, 18 bp, Homo sapiens
agagccagcctgggactc

SEQ ID NO: 698642 - DNA, 13 bp, Homo sapiens
agagccagctctc

SEQ ID NO: 698643 - DNA, 13 bp, Homo sapiens
agagccagcttgg

SEQ ID NO: 698644 - DNA, 18 bp, Homo sapiens
agagccaggagaagctca

SEQ ID NO: 698645 - DNA, 19 bp, Homo sapiens
agagccaggagaagctcag

SEQ ID NO: 698646 - DNA, 12 bp, Homo sapiens
agagaaggcagg

SEQ ID NO: 698647 - DNA, 20 bp, Homo sapiens
agagaaggcaggaatgtgtg

SEQ ID NO: 698648 - DNA, 23 bp, Homo sapiens
agagaaggcccataccttctggt

SEQ ID NO: 698649 - DNA, 22 bp, Homo sapiens
agagaaggggaagcactcgtgt

SEQ ID NO: 698650 - DNA, 16 bp, Homo sapiens
agagaagtagaaatca

SEQ ID NO: 698651 - DNA, 15 bp, Homo sapiens
agagaagtctcattc

SEQ ID NO: 698652 - DNA, 15 bp, Homo sapiens
agagaagtgcccctg

SEQ ID NO: 698653 - DNA, 17 bp, Homo sapiens
agagaagtgcccctgct

SEQ ID NO: 698654 - DNA, 18 bp, Homo sapiens
agagaagtgcccctgctg

SEQ ID NO: 698655 - DNA, 12 bp, Homo sapiens
agagaagttgta

SEQ ID NO: 698656 - DNA, 20 bp, Homo sapiens
agagaagtttgtagccaggt

SEQ ID NO: 698657 - DNA, 15 bp, Homo sapiens
agagaagtttgtggt

SEQ ID NO: 698658 - DNA, 19 bp, Homo sapiens
agagaatagagctgccact

SEQ ID NO: 698659 - DNA, 21 bp, Homo sapiens
agagaatatgtatgcctgcaa

SEQ ID NO: 698660 - DNA, 22 bp, Homo sapiens
agagaatattagctttactgtt

SEQ ID NO: 698661 - DNA, 13 bp, Homo sapiens
agagaatatttta

SEQ ID NO: 698662 - DNA, 16 bp, Homo sapiens
agagaatgaactgtgg

SEQ ID NO: 698663 - DNA, 20 bp, Homo sapiens
agagaatgaactgtggaatt

SEQ ID NO: 698664 - DNA, 23 bp, Homo sapiens
agagaatgagagcgacacagacg

SEQ ID NO: 698665 - DNA, 14 bp, Homo sapiens
agagaatgaggaag

SEQ ID NO: 698666 - DNA, 16 bp, Homo sapiens
agagaatgatgctcaa

SEQ ID NO: 698667 - DNA, 15 bp, Homo sapiens
agagaatggaaaaca

SEQ ID NO: 698668 - DNA, 17 bp, Homo sapiens
agagaatggagacagag

SEQ ID NO: 698669 - DNA, 17 bp, Homo sapiens
agagaatgtagatattg

SEQ ID NO: 698670 - DNA, 18 bp, Homo sapiens
agagaatgtattttcata

SEQ ID NO: 698671 - DNA, 14 bp, Homo sapiens
agagaatgtcactg

SEQ ID NO: 698672 - DNA, 20 bp, Homo sapiens
agagaatgtgtgtgtgtggc

SEQ ID NO: 698673 - DNA, 16 bp, Homo sapiens
agagaattatatattt

SEQ ID NO: 698674 - DNA, 18 bp, Homo sapiens
agagaattcagtattttt

SEQ ID NO: 698675 - DNA, 12 bp, Homo sapiens
agagaattggct

SEQ ID NO: 698676 - DNA, 19 bp, Homo sapiens
agagaattgtttgaacccg

SEQ ID NO: 698677 - DNA, 19 bp, Homo sapiens
agagacaaacacctcccag

SEQ ID NO: 698678 - DNA, 14 bp, Homo sapiens
agagacaaatcttt

SEQ ID NO: 698679 - DNA, 18 bp, Homo sapiens
agagacaaatctttaaga

SEQ ID NO: 698680 - DNA, 14 bp, Homo sapiens
agagacaagaagca

SEQ ID NO: 698681 - DNA, 14 bp, Homo sapiens
agagacaagtaatt

SEQ ID NO: 698682 - DNA, 15 bp, Homo sapiens
agagacacctgcacc

SEQ ID NO: 698683 - DNA, 16 bp, Homo sapiens
agagacacctgcacct

SEQ ID NO: 698684 - DNA, 18 bp, Homo sapiens
agagacacctgcacctcc

SEQ ID NO: 698685 - DNA, 20 bp, Homo sapiens
agagacacctgcacctcccc

SEQ ID NO: 698686 - DNA, 14 bp, Homo sapiens
agagacaggagggc

SEQ ID NO: 698687 - DNA, 17 bp, Homo sapiens
agagacaggcagcccag

SEQ ID NO: 698688 - DNA, 15 bp, Homo sapiens
agagacaggcccaag

SEQ ID NO: 698689 - DNA, 16 bp, Homo sapiens
agagacagttctctgt

SEQ ID NO: 698690 - DNA, 17 bp, Homo sapiens
agagacatgagaaaggg

SEQ ID NO: 698691 - DNA, 14 bp, Homo sapiens
agagaccacacatt

SEQ ID NO: 698692 - DNA, 21 bp, Homo sapiens
agagaccagcactcagcctca

SEQ ID NO: 698693 - DNA, 13 bp, Homo sapiens
agagaccagggct

SEQ ID NO: 698694 - DNA, 13 bp, Homo sapiens
agagacccaagga

SEQ ID NO: 698695 - DNA, 13 bp, Homo sapiens
agagacccagctg

SEQ ID NO: 698696 - DNA, 14 bp, Homo sapiens
agagacccagctgc

SEQ ID NO: 698697 - DNA, 18 bp, Homo sapiens
agagacccagctgcagac

SEQ ID NO: 698698 - DNA, 12 bp, Homo sapiens
agagacccccag

SEQ ID NO: 698699 - DNA, 15 bp, Homo sapiens
agagacccccaggcc

SEQ ID NO: 698700 - DNA, 17 bp, Homo sapiens
agagacccttgtttgat

SEQ ID NO: 698701 - DNA, 21 bp, Homo sapiens
agagaccgtcgggggctgagg

SEQ ID NO: 698702 - DNA, 14 bp, Homo sapiens
agagacctgaccca

SEQ ID NO: 698703 - DNA, 14 bp, Homo sapiens
agagacgccactcc

SEQ ID NO: 698704 - DNA, 18 bp, Homo sapiens
agagacgccctatttcta

SEQ ID NO: 698705 - DNA, 20 bp, Homo sapiens
agagacgccctatttctatg

SEQ ID NO: 698706 - DNA, 15 bp, Homo sapiens
agagacggtgttttg

SEQ ID NO: 698707 - DNA, 17 bp, Homo sapiens
agagactaatgttggac

SEQ ID NO: 698708 - DNA, 20 bp, Homo sapiens
agagactcagggccccagca

SEQ ID NO: 698709 - DNA, 21 bp, Homo sapiens
agagactcatttcacagcctt

SEQ ID NO: 698710 - DNA, 12 bp, Homo sapiens
agagactctatt

SEQ ID NO: 698711 - DNA, 14 bp, Homo sapiens
agagactctatttt

SEQ ID NO: 698712 - DNA, 15 bp, Homo sapiens
agagactctatttta

SEQ ID NO: 698713 - DNA, 17 bp, Homo sapiens
agagactctattttaat

SEQ ID NO: 698714 - DNA, 22 bp, Homo sapiens
agagactctttatttttctctt

SEQ ID NO: 698715 - DNA, 16 bp, Homo sapiens
agagactgaaagcagc

SEQ ID NO: 698716 - DNA, 18 bp, Homo sapiens
agagactgaaagcagcag

SEQ ID NO: 698717 - DNA, 16 bp, Homo sapiens
agagactgagcagccg

SEQ ID NO: 698718 - DNA, 21 bp, Homo sapiens
agagactgatcatccaggcct

SEQ ID NO: 698719 - DNA, 21 bp, Homo sapiens
agagactgatccaaaaattat

SEQ ID NO: 698720 - DNA, 21 bp, Homo sapiens
agagactggagcatctgactc

SEQ ID NO: 698721 - DNA, 18 bp, Homo sapiens
agagacttaaaggacagg

SEQ ID NO: 698722 - DNA, 17 bp, Homo sapiens
agagacttggaagagga

SEQ ID NO: 698723 - DNA, 19 bp, Homo sapiens
agagagaaaaaaaaaatag

SEQ ID NO: 698724 - DNA, 21 bp, Homo sapiens
agagagaaagaagtaggcatg

SEQ ID NO: 698725 - DNA, 13 bp, Homo sapiens
agagagaaagaga

SEQ ID NO: 698726 - DNA, 11 bp, Homo sapiens
agagagaagcc

SEQ ID NO: 698727 - DNA, 19 bp, Homo sapiens
agagagaatagagctgcca

SEQ ID NO: 698728 - DNA, 21 bp, Homo sapiens
agagagaatagagctgccact

SEQ ID NO: 698729 - DNA, 22 bp, Homo sapiens
agagagaatagagctgccactg

SEQ ID NO: 698730 - DNA, 13 bp, Homo sapiens
agagagacctcat

SEQ ID NO: 698731 - DNA, 19 bp, Homo sapiens
agagagacctcatcctgct

SEQ ID NO: 698732 - DNA, 13 bp, Homo sapiens
agagagactgatg

SEQ ID NO: 698733 - DNA, 12 bp, Homo sapiens
agagagagaaaa

SEQ ID NO: 698734 - DNA, 13 bp, Homo sapiens
agagagagaagtg

SEQ ID NO: 698735 - DNA, 14 bp, Homo sapiens
agagagagaccctc

SEQ ID NO: 698736 - DNA, 14 bp, Homo sapiens
agagagagagaaaa

SEQ ID NO: 698737 - DNA, 15 bp, Homo sapiens
agagagagagagaaa

SEQ ID NO: 698738 - DNA, 15 bp, Homo sapiens
agagagagagagaga

SEQ ID NO: 698739 - DNA, 13 bp, Homo sapiens
agagagagagagg

SEQ ID NO: 698740 - DNA, 15 bp, Homo sapiens
agagagagctgtatt

SEQ ID NO: 698741 - DNA, 12 bp, Homo sapiens
agagagaggagg

SEQ ID NO: 698742 - DNA, 22 bp, Homo sapiens
agagagagggagaaacaagtgg

SEQ ID NO: 698743 - DNA, 14 bp, Homo sapiens
agagagaggggaag

SEQ ID NO: 698744 - DNA, 14 bp, Homo sapiens
agagagagtgtttg

SEQ ID NO: 698745 - DNA, 12 bp, Homo sapiens
agagagatgaga

SEQ ID NO: 698746 - DNA, 18 bp, Homo sapiens
agagagatgagaaagctt

SEQ ID NO: 698747 - DNA, 14 bp, Homo sapiens
agagagatgttttg

SEQ ID NO: 698748 - DNA, 17 bp, Homo sapiens
agagagattggccagca

SEQ ID NO: 698749 - DNA, 14 bp, Homo sapiens
agagagcaggcagg

SEQ ID NO: 698750 - DNA, 13 bp, Homo sapiens
agagagcagggga

SEQ ID NO: 698751 - DNA, 14 bp, Homo sapiens
agagagcaggggag

SEQ ID NO: 698752 - DNA, 23 bp, Homo sapiens
agagagcaggggagcttgggact

SEQ ID NO: 698753 - DNA, 22 bp, Homo sapiens
agagagcctagaacatccctgg

SEQ ID NO: 698754 - DNA, 19 bp, Homo sapiens
agagagctgtattaagtga

SEQ ID NO: 698755 - DNA, 17 bp, Homo sapiens
agagagctgttcccaaa

SEQ ID NO: 698756 - DNA, 18 bp, Homo sapiens
agagaggaaggacccctc

SEQ ID NO: 698757 - DNA, 20 bp, Homo sapiens
agagaggaagtggtctgtct

SEQ ID NO: 698758 - DNA, 14 bp, Homo sapiens
agagaggaatcaga

SEQ ID NO: 698759 - DNA, 17 bp, Homo sapiens
agagaggaatcagactt

SEQ ID NO: 698760 - DNA, 18 bp, Homo sapiens
agagaggagaaacacatc

SEQ ID NO: 698761 - DNA, 20 bp, Homo sapiens
agagaggaggcagccccctc

SEQ ID NO: 698762 - DNA, 19 bp, Homo sapiens
agagaggatgtgcaagcga

SEQ ID NO: 698763 - DNA, 18 bp, Homo sapiens
agagaggcacctgctgga

SEQ ID NO: 698764 - DNA, 16 bp, Homo sapiens
agagaggcctgctttg

SEQ ID NO: 698765 - DNA, 24 bp, Homo sapiens
agagaggctgagaaatgcagagaa

SEQ ID NO: 698766 - DNA, 18 bp, Homo sapiens
agagagggaggcaagccc

SEQ ID NO: 698767 - DNA, 16 bp, Homo sapiens
agagagggatgggttc

SEQ ID NO: 698768 - DNA, 15 bp, Homo sapiens
agagagggcagaggg

SEQ ID NO: 698769 - DNA, 14 bp, Homo sapiens
agagagggcccagc

SEQ ID NO: 698770 - DNA, 13 bp, Homo sapiens
agagaggggaaga

SEQ ID NO: 698771 - DNA, 21 bp, Homo sapiens
agagaggggaagaatttaatg

SEQ ID NO: 698772 - DNA, 20 bp, Homo sapiens
agactgggctgagggagcct

SEQ ID NO: 698773 - DNA, 19 bp, Homo sapiens
agactgggtaatttataaa

SEQ ID NO: 698774 - DNA, 21 bp, Homo sapiens
agactgggtgaggataacaca

SEQ ID NO: 698775 - DNA, 17 bp, Homo sapiens
agactggtcctgtgtgc

SEQ ID NO: 698776 - DNA, 16 bp, Homo sapiens
agactggttttctgcc

SEQ ID NO: 698777 - DNA, 14 bp, Homo sapiens
agactgtaactttt

SEQ ID NO: 698778 - DNA, 23 bp, Homo sapiens
agactgtaactttttttcagttc

SEQ ID NO: 698779 - DNA, 14 bp, Homo sapiens
agactgtacaaagt

SEQ ID NO: 698780 - DNA, 19 bp, Homo sapiens
agactgtactggccagtgt

SEQ ID NO: 698781 - DNA, 18 bp, Homo sapiens
agactgtagcctggatat

SEQ ID NO: 698782 - DNA, 15 bp, Homo sapiens
agactgtcaaatgaa

SEQ ID NO: 698783 - DNA, 20 bp, Homo sapiens
agactgtcaaatgaactttt

SEQ ID NO: 698784 - DNA, 19 bp, Homo sapiens
agactgtcccgacacagcg

SEQ ID NO: 698785 - DNA, 20 bp, Homo sapiens
agactgtcggagaggctgtc

SEQ ID NO: 698786 - DNA, 19 bp, Homo sapiens
agactgtgaacagcttgct

SEQ ID NO: 698787 - DNA, 18 bp, Homo sapiens
agactgtgaacttgactg

SEQ ID NO: 698788 - DNA, 21 bp, Homo sapiens
agactgtgaacttgactgggt

SEQ ID NO: 698789 - DNA, 22 bp, Homo sapiens
agactgtgaacttgactgggtg

SEQ ID NO: 698790 - DNA, 16 bp, Homo sapiens
agactgtgattcagaa

SEQ ID NO: 698791 - DNA, 17 bp, Homo sapiens
agactgtgattcagaaa

SEQ ID NO: 698792 - DNA, 11 bp, Homo sapiens
agactgtggct

SEQ ID NO: 698793 - DNA, 20 bp, Homo sapiens
agactgtggctgctagcact

SEQ ID NO: 698794 - DNA, 23 bp, Homo sapiens
agactgtgggtggggaggccctg

SEQ ID NO: 698795 - DNA, 13 bp, Homo sapiens
agactgtggtagg

SEQ ID NO: 698796 - DNA, 14 bp, Homo sapiens
agactgttgctcaa

SEQ ID NO: 698797 - DNA, 23 bp, Homo sapiens
agactgttttactgttttaattg

SEQ ID NO: 698798 - DNA, 19 bp, Homo sapiens
agactgtttttaagtaact

SEQ ID NO: 698799 - DNA, 18 bp, Homo sapiens
agacttaagcccagtgca

SEQ ID NO: 698800 - DNA, 15 bp, Homo sapiens
agacttaccaggaag

SEQ ID NO: 698801 - DNA, 16 bp, Homo sapiens
agacttagggcaccag

SEQ ID NO: 698802 - DNA, 22 bp, Homo sapiens
agacttagtatattttcttttc

SEQ ID NO: 698803 - DNA, 20 bp, Homo sapiens
agacttccaaacctgacaga

SEQ ID NO: 698804 - DNA, 21 bp, Homo sapiens
agacttccaaacctgacagat

SEQ ID NO: 698805 - DNA, 17 bp, Homo sapiens
agacttcccaacagcct

SEQ ID NO: 698806 - DNA, 18 bp, Homo sapiens
agacttcccaacagcctt

SEQ ID NO: 698807 - DNA, 18 bp, Homo sapiens
agacttcccactgttctg

SEQ ID NO: 698808 - DNA, 17 bp, Homo sapiens
agacttccccatcccga

SEQ ID NO: 698809 - DNA, 12 bp, Homo sapiens
agacttcctctc

SEQ ID NO: 698810 - DNA, 14 bp, Homo sapiens
agacttcctctcta

SEQ ID NO: 698811 - DNA, 15 bp, Homo sapiens
agacttcctctctac

SEQ ID NO: 698812 - DNA, 20 bp, Homo sapiens
agacttcgactcaggatcca

SEQ ID NO: 698813 - DNA, 22 bp, Homo sapiens
agacttcggggaagatacactg

SEQ ID NO: 698814 - DNA, 23 bp, Homo sapiens
agacttctattttttaaagactg

SEQ ID NO: 698815 - DNA, 22 bp, Homo sapiens
agacttctctacccatcttaaa

SEQ ID NO: 698816 - DNA, 17 bp, Homo sapiens
agacttctcttacattt

SEQ ID NO: 698817 - DNA, 14 bp, Homo sapiens
agacttctgagtaa

SEQ ID NO: 698818 - DNA, 19 bp, Homo sapiens
agacttctggaaggctggc

SEQ ID NO: 698819 - DNA, 22 bp, Homo sapiens
agacttctggaaggctggctga

SEQ ID NO: 698820 - DNA, 18 bp, Homo sapiens
agacttctggttgtattt

SEQ ID NO: 698821 - DNA, 22 bp, Homo sapiens
agacttctggttgtatttctat

SEQ ID NO: 698822 - DNA, 14 bp, Homo sapiens
agacttgaaatact

SEQ ID NO: 698823 - DNA, 18 bp, Homo sapiens
agacttgacaacatccca

SEQ ID NO: 698824 - DNA, 20 bp, Homo sapiens
agacttgacaacatcccaca

SEQ ID NO: 698825 - DNA, 23 bp, Homo sapiens
agacttgacaacatcccacagtg

SEQ ID NO: 698826 - DNA, 18 bp, Homo sapiens
agacttgagacaatgttt

SEQ ID NO: 698827 - DNA, 14 bp, Homo sapiens
agacttgccaggct

SEQ ID NO: 698828 - DNA, 19 bp, Homo sapiens
agacttggacatctctctg

SEQ ID NO: 698829 - DNA, 21 bp, Homo sapiens
agacttggattctttccattt

SEQ ID NO: 698830 - DNA, 19 bp, Homo sapiens
agacttggcaacagaagca

SEQ ID NO: 698831 - DNA, 21 bp, Homo sapiens
agacttggccataaagataat

SEQ ID NO: 698832 - DNA, 20 bp, Homo sapiens
agacttgggatggggaggga

SEQ ID NO: 698833 - DNA, 21 bp, Homo sapiens
agacttgtatagcatgaaata

SEQ ID NO: 698834 - DNA, 18 bp, Homo sapiens
agacttgtatgaaagatg

SEQ ID NO: 698835 - DNA, 20 bp, Homo sapiens
agacttgttcttggttcctg

SEQ ID NO: 698836 - DNA, 22 bp, Homo sapiens
agacttgttcttggttcctgtt

SEQ ID NO: 698837 - DNA, 14 bp, Homo sapiens
agactttaattata

SEQ ID NO: 698838 - DNA, 20 bp, Homo sapiens
agactttccattaaatcaat

SEQ ID NO: 698839 - DNA, 15 bp, Homo sapiens
agactttccattaca

SEQ ID NO: 698840 - DNA, 22 bp, Homo sapiens
agactttccattacaagtattt

SEQ ID NO: 698841 - DNA, 20 bp, Homo sapiens
agactttccccaacaatgtg

SEQ ID NO: 698842 - DNA, 16 bp, Homo sapiens
agactttctgttacta

SEQ ID NO: 698843 - DNA, 15 bp, Homo sapiens
agactttcttctagt

SEQ ID NO: 698844 - DNA, 23 bp, Homo sapiens
agactttgagcctgcatcttctt

SEQ ID NO: 698845 - DNA, 19 bp, Homo sapiens
agactttgatccttggaaa

SEQ ID NO: 698846 - DNA, 23 bp, Homo sapiens
agactttgcccagggtcctgtgc

SEQ ID NO: 698847 - DNA, 15 bp, Homo sapiens
agactttgctgcatt

SEQ ID NO: 698848 - DNA, 18 bp, Homo sapiens
agactttggacagtggcc

SEQ ID NO: 698849 - DNA, 20 bp, Homo sapiens
agactttggacagtggcctc

SEQ ID NO: 698850 - DNA, 21 bp, Homo sapiens
agactttgtgttcatttcatt

SEQ ID NO: 698851 - DNA, 18 bp, Homo sapiens
agacttttaatcagacaa

SEQ ID NO: 698852 - DNA, 18 bp, Homo sapiens
agacttttatgtgagatt

SEQ ID NO: 698853 - DNA, 22 bp, Homo sapiens
agacttttttttttcatgttat

SEQ ID NO: 698854 - DNA, 21 bp, Homo sapiens
agagaaaaaaagtttgccaga

SEQ ID NO: 698855 - DNA, 22 bp, Homo sapiens
agagaaaaaatattttcctgcc

SEQ ID NO: 698856 - DNA, 16 bp, Homo sapiens
agagaaaaagaaatgc

SEQ ID NO: 698857 - DNA, 20 bp, Homo sapiens
agagaaaaagaaatgcaaaa

SEQ ID NO: 698858 - DNA, 11 bp, Homo sapiens
agagaaaagaa

SEQ ID NO: 698859 - DNA, 12 bp, Homo sapiens
agagaaaagaaa

SEQ ID NO: 698860 - DNA, 21 bp, Homo sapiens
agagaaaagaaaaaaaaagaa

SEQ ID NO: 698861 - DNA, 14 bp, Homo sapiens
agagaaaagggaaa

SEQ ID NO: 698862 - DNA, 14 bp, Homo sapiens
agagaaaatatatg

SEQ ID NO: 698863 - DNA, 23 bp, Homo sapiens
agagaaaatatatgtatttttat

SEQ ID NO: 698864 - DNA, 13 bp, Homo sapiens
agagaaaattcct

SEQ ID NO: 698865 - DNA, 14 bp, Homo sapiens
agagaaaatttgaa

SEQ ID NO: 698866 - DNA, 16 bp, Homo sapiens
agagaaacagttggta

SEQ ID NO: 698867 - DNA, 16 bp, Homo sapiens
agagaaaccgcttttg

SEQ ID NO: 698868 - DNA, 10 bp, Homo sapiens
agagaaactt

SEQ ID NO: 698869 - DNA, 12 bp, Homo sapiens
agagaaagaaaa

SEQ ID NO: 698870 - DNA, 17 bp, Homo sapiens
agagaaagaaaaggcaa

SEQ ID NO: 698871 - DNA, 15 bp, Homo sapiens
agagaaagaaaatga

SEQ ID NO: 698872 - DNA, 23 bp, Homo sapiens
agagaaagaaagggaaactggct

SEQ ID NO: 698873 - DNA, 15 bp, Homo sapiens
agagaaagaagagac

SEQ ID NO: 698874 - DNA, 12 bp, Homo sapiens
agagaaagagaa

SEQ ID NO: 698875 - DNA, 15 bp, Homo sapiens
agagaaatacagctg

SEQ ID NO: 698876 - DNA, 17 bp, Homo sapiens
agagaaatacagctggc

SEQ ID NO: 698877 - DNA, 21 bp, Homo sapiens
agagaaatacagctggctatc

SEQ ID NO: 698878 - DNA, 14 bp, Homo sapiens
agagaaatatggaa

SEQ ID NO: 698879 - DNA, 12 bp, Homo sapiens
agagaaatcctt

SEQ ID NO: 698880 - DNA, 14 bp, Homo sapiens
agagaaatgaatta

SEQ ID NO: 698881 - DNA, 17 bp, Homo sapiens
agagaaccagtgcagac

SEQ ID NO: 698882 - DNA, 20 bp, Homo sapiens
agagaaccgagcaaagatca

SEQ ID NO: 698883 - DNA, 22 bp, Homo sapiens
agagaactcgcgctcagtaaac

SEQ ID NO: 698884 - DNA, 14 bp, Homo sapiens
agagaactgcagac

SEQ ID NO: 698885 - DNA, 14 bp, Homo sapiens
agagaactgtggcc

SEQ ID NO: 698886 - DNA, 12 bp, Homo sapiens
agagaagaatga

SEQ ID NO: 698887 - DNA, 10 bp, Homo sapiens
agagaagaga

SEQ ID NO: 698888 - DNA, 19 bp, Homo sapiens
agagaagagggcccagccc

SEQ ID NO: 698889 - DNA, 15 bp, Homo sapiens
agagaagcaagtaaa

SEQ ID NO: 698890 - DNA, 21 bp, Homo sapiens
agagaagccccgcacgggctg

SEQ ID NO: 698891 - DNA, 18 bp, Homo sapiens
agagaagcggatttccag

SEQ ID NO: 698892 - DNA, 12 bp, Homo sapiens
agagaagctgct

SEQ ID NO: 698893 - DNA, 14 bp, Homo sapiens
agagaagctgctga

SEQ ID NO: 698894 - DNA, 17 bp, Homo sapiens
agagaaggacggtgcca

SEQ ID NO: 698895 - DNA, 13 bp, Homo sapiens
agagaaggcacac

SEQ ID NO: 698896 - DNA, 12 bp, Homo sapiens
caaccaggaaga

SEQ ID NO: 698897 - DNA, 12 bp, Homo sapiens
caaccaggaccc

SEQ ID NO: 698898 - DNA, 16 bp, Homo sapiens
caaccaggacccaggg

SEQ ID NO: 698899 - DNA, 17 bp, Homo sapiens
caaccaggacccagggt

SEQ ID NO: 698900 - DNA, 16 bp, Homo sapiens
caaccaggcacctctt

SEQ ID NO: 698901 - DNA, 13 bp, Homo sapiens
caaccaggcagct

SEQ ID NO: 698902 - DNA, 14 bp, Homo sapiens
caaccaggcagctg

SEQ ID NO: 698903 - DNA, 22 bp, Homo sapiens
caaccaggcagtagatgtgctt

SEQ ID NO: 698904 - DNA, 16 bp, Homo sapiens
caaccaggccctgcca

SEQ ID NO: 698905 - DNA, 22 bp, Homo sapiens
caaccattataaccttaattta

SEQ ID NO: 698906 - DNA, 13 bp, Homo sapiens
caaccattccaga

SEQ ID NO: 698907 - DNA, 14 bp, Homo sapiens
caaccattccagac

SEQ ID NO: 698908 - DNA, 16 bp, Homo sapiens
caaccattccagactg

SEQ ID NO: 698909 - DNA, 21 bp, Homo sapiens
caacccaaaccatgagaattt

SEQ ID NO: 698910 - DNA, 12 bp, Homo sapiens
caacccagccac

SEQ ID NO: 698911 - DNA, 21 bp, Homo sapiens
caacccagccacgactgccat

SEQ ID NO: 698912 - DNA, 20 bp, Homo sapiens
caacccataatcatgtaaat

SEQ ID NO: 698913 - DNA, 18 bp, Homo sapiens
caaccccaaacccaagtg

SEQ ID NO: 698914 - DNA, 17 bp, Homo sapiens
caaccccacccagctcc

SEQ ID NO: 698915 - DNA, 13 bp, Homo sapiens
caaccccagttct

SEQ ID NO: 698916 - DNA, 22 bp, Homo sapiens
caaccccagttctgctcctctc

SEQ ID NO: 698917 - DNA, 12 bp, Homo sapiens
caacccccagag

SEQ ID NO: 698918 - DNA, 14 bp, Homo sapiens
caacccccagaggt

SEQ ID NO: 698919 - DNA, 17 bp, Homo sapiens
caacccccagaggtggc

SEQ ID NO: 698920 - DNA, 19 bp, Homo sapiens
caacccccagaggtggccc

SEQ ID NO: 698921 - DNA, 16 bp, Homo sapiens
caaccccccacctgcc

SEQ ID NO: 698922 - DNA, 15 bp, Homo sapiens
caacccccctcccag

SEQ ID NO: 698923 - DNA, 15 bp, Homo sapiens
caacccccctcctgc

SEQ ID NO: 698924 - DNA, 17 bp, Homo sapiens
caaccccctcggagcct

SEQ ID NO: 698925 - DNA, 18 bp, Homo sapiens
caaccccctcggagcctg

SEQ ID NO: 698926 - DNA, 13 bp, Homo sapiens
caaccccgcggcc

SEQ ID NO: 698927 - DNA, 19 bp, Homo sapiens
caaccccgcggcccagacc

SEQ ID NO: 698928 - DNA, 20 bp, Homo sapiens
caaccccgcggtgctctggc

SEQ ID NO: 698929 - DNA, 21 bp, Homo sapiens
caaccccgcggtgctctggcg

SEQ ID NO: 698930 - DNA, 22 bp, Homo sapiens
caacccctgtacccagctcctt

SEQ ID NO: 698931 - DNA, 12 bp, Homo sapiens
caacccctgtgg

SEQ ID NO: 698932 - DNA, 16 bp, Homo sapiens
caacccctgtggagcc

SEQ ID NO: 698933 - DNA, 22 bp, Homo sapiens
caacccctgtggagcccgcacc

SEQ ID NO: 698934 - DNA, 17 bp, Homo sapiens
caacccgctggagccca

SEQ ID NO: 698935 - DNA, 18 bp, Homo sapiens
caaccctaggttccctgt

SEQ ID NO: 698936 - DNA, 20 bp, Homo sapiens
caaccctatctcctgacaga

SEQ ID NO: 698937 - DNA, 14 bp, Homo sapiens
caaccctccctcag

SEQ ID NO: 698938 - DNA, 22 bp, Homo sapiens
caaccctccctcagcccctctt

SEQ ID NO: 698939 - DNA, 19 bp, Homo sapiens
caaccctcctatcacctcc

SEQ ID NO: 698940 - DNA, 11 bp, Homo sapiens
caaccctgacc

SEQ ID NO: 698941 - DNA, 12 bp, Homo sapiens
caaccctgaccg

SEQ ID NO: 698942 - DNA, 11 bp, Homo sapiens
caaccctgcaa

SEQ ID NO: 698943 - DNA, 12 bp, Homo sapiens
caaccctgcaaa

SEQ ID NO: 698944 - DNA, 22 bp, Homo sapiens
caaccctgcaaaggactgtttt

SEQ ID NO: 698945 - DNA, 22 bp, Homo sapiens
caaccctgcccctgccccgtca

SEQ ID NO: 698946 - DNA, 23 bp, Homo sapiens
caaccctgcccctgccccgtcac

SEQ ID NO: 698947 - DNA, 15 bp, Homo sapiens
caaccctgccgtcac

SEQ ID NO: 698948 - DNA, 13 bp, Homo sapiens
caaccctgcctgt

SEQ ID NO: 698949 - DNA, 12 bp, Homo sapiens
caaccctgggac

SEQ ID NO: 698950 - DNA, 13 bp, Homo sapiens
caaccctgggacc

SEQ ID NO: 698951 - DNA, 16 bp, Homo sapiens
caaccctggggaagga

SEQ ID NO: 698952 - DNA, 20 bp, Homo sapiens
caaccctggggaaggagcca

SEQ ID NO: 698953 - DNA, 13 bp, Homo sapiens
caaccctgtttcc

SEQ ID NO: 698954 - DNA, 15 bp, Homo sapiens
caaccctgtttcctg

SEQ ID NO: 698955 - DNA, 16 bp, Homo sapiens
caaccctgtttcctga

SEQ ID NO: 698956 - DNA, 17 bp, Homo sapiens
caaccctgtttcctgag

SEQ ID NO: 698957 - DNA, 15 bp, Homo sapiens
caacccttacccctt

SEQ ID NO: 698958 - DNA, 20 bp, Homo sapiens
caacccttaccccttagcct

SEQ ID NO: 698959 - DNA, 17 bp, Homo sapiens
caaccgatgctccagcc

SEQ ID NO: 698960 - DNA, 21 bp, Homo sapiens
caaccgatgctccagccaacc

SEQ ID NO: 698961 - DNA, 21 bp, Homo sapiens
caaccgcttccctatttattt

SEQ ID NO: 698962 - DNA, 20 bp, Homo sapiens
caaccggggagcccccgccc

SEQ ID NO: 698963 - DNA, 12 bp, Homo sapiens
caaccgtcctgc

SEQ ID NO: 698964 - DNA, 19 bp, Homo sapiens
caaccgtcctgctgtccct

SEQ ID NO: 698965 - DNA, 22 bp, Homo sapiens
caaccgtcctgctgtccctgtc

SEQ ID NO: 698966 - DNA, 20 bp, Homo sapiens
caacctaacacattaaatgt

SEQ ID NO: 698967 - DNA, 21 bp, Homo sapiens
caacctaccaccccttcctgt

SEQ ID NO: 698968 - DNA, 22 bp, Homo sapiens
caacctaccaccccttcctgtc

SEQ ID NO: 698969 - DNA, 16 bp, Homo sapiens
caacctcaatgccctg

SEQ ID NO: 698970 - DNA, 21 bp, Homo sapiens
caacctcaatgccctgccatt

SEQ ID NO: 698971 - DNA, 16 bp, Homo sapiens
caacctcaccttcctg

SEQ ID NO: 698972 - DNA, 19 bp, Homo sapiens
caacctcaccttcctgtgg

SEQ ID NO: 698973 - DNA, 20 bp, Homo sapiens
caacctcaccttcctgtggg

SEQ ID NO: 698974 - DNA, 14 bp, Homo sapiens
caacctcagggctc

SEQ ID NO: 698975 - DNA, 15 bp, Homo sapiens
caacctcagggctcc

SEQ ID NO: 698976 - DNA, 20 bp, Homo sapiens
caacctcagggctcccaggg

SEQ ID NO: 698977 - DNA, 16 bp, Homo sapiens
caacctcgctgagggc

SEQ ID NO: 698978 - DNA, 24 bp, Homo sapiens
caacctcggcttgtgggctggtgc

SEQ ID NO: 698979 - DNA, 20 bp, Homo sapiens
caacctctgcctcccaggtt

SEQ ID NO: 698980 - DNA, 17 bp, Homo sapiens
caacctcttctggctca

SEQ ID NO: 698981 - DNA, 13 bp, Homo sapiens
caacctcttggcc

SEQ ID NO: 698982 - DNA, 19 bp, Homo sapiens
caacctctttttcctcctg

SEQ ID NO: 698983 - DNA, 20 bp, Homo sapiens
caacctctttttcctcctgg

SEQ ID NO: 698984 - DNA, 15 bp, Homo sapiens
caacctgaaatttat

SEQ ID NO: 698985 - DNA, 16 bp, Homo sapiens
caacctgaacctagga

SEQ ID NO: 698986 - DNA, 23 bp, Homo sapiens
caacctgaatcttttttttatat

SEQ ID NO: 698987 - DNA, 20 bp, Homo sapiens
caacctgaccaacatggaga

SEQ ID NO: 698988 - DNA, 21 bp, Homo sapiens
caacctgatgccccttcccca

SEQ ID NO: 698989 - DNA, 19 bp, Homo sapiens
caacctgcaggctcccgag

SEQ ID NO: 698990 - DNA, 12 bp, Homo sapiens
caacctgcctgt

SEQ ID NO: 698991 - DNA, 18 bp, Homo sapiens
caacctgctctcctcttg

SEQ ID NO: 698992 - DNA, 13 bp, Homo sapiens
caacctgctctgt

SEQ ID NO: 698993 - DNA, 17 bp, Homo sapiens
caacctggtggcaccag

SEQ ID NO: 698994 - DNA, 17 bp, Homo sapiens
caacctgtaactcacat

SEQ ID NO: 698995 - DNA, 19 bp, Homo sapiens
caacctgtggcgctgcagc

SEQ ID NO: 698996 - DNA, 12 bp, Homo sapiens
caacctgtggct

SEQ ID NO: 698997 - DNA, 17 bp, Homo sapiens
caacctgtggctcaggg

SEQ ID NO: 698998 - DNA, 22 bp, Homo sapiens
caacctgtggctcaggggagca

SEQ ID NO: 698999 - DNA, 20 bp, Homo sapiens
caacctgttacctactttga

SEQ ID NO: 699000 - DNA, 15 bp, Homo sapiens
caacctgttcttaga

SEQ ID NO: 699001 - DNA, 20 bp, Homo sapiens
caacctgttcttagagtgta

SEQ ID NO: 699002 - DNA, 17 bp, Homo sapiens
caaccttagatgttcta

SEQ ID NO: 699003 - DNA, 13 bp, Homo sapiens
caaccttcattta

SEQ ID NO: 699004 - DNA, 14 bp, Homo sapiens
caaccttcggctcc

SEQ ID NO: 699005 - DNA, 17 bp, Homo sapiens
caaccttgtcccaagga

SEQ ID NO: 699006 - DNA, 19 bp, Homo sapiens
caacctttgtgtggctcct

SEQ ID NO: 699007 - DNA, 23 bp, Homo sapiens
caacctttgtgtggctcctggta

SEQ ID NO: 699008 - DNA, 14 bp, Homo sapiens
caacgaagaaaaaa

SEQ ID NO: 699009 - DNA, 18 bp, Homo sapiens
caacgagcctcctcaggg

SEQ ID NO: 699010 - DNA, 20 bp, Homo sapiens
caacgagcctcctcaggggg

SEQ ID NO: 699011 - DNA, 15 bp, Homo sapiens
caacgcagccctgct

SEQ ID NO: 699012 - DNA, 18 bp, Homo sapiens
caacgcagccctgctttg

SEQ ID NO: 699013 - DNA, 14 bp, Homo sapiens
caacgcattgccac

SEQ ID NO: 699014 - DNA, 13 bp, Homo sapiens
caacgcccctcca

SEQ ID NO: 699015 - DNA, 18 bp, Homo sapiens
caacgcccctgtggccaa

SEQ ID NO: 699016 - DNA, 19 bp, Homo sapiens
caacgcccctgtggccaac

SEQ ID NO: 699017 - DNA, 15 bp, Homo sapiens
caacggagggagtgg

SEQ ID NO: 699018 - DNA, 15 bp, Homo sapiens
caacggggtggggag

SEQ ID NO: 699019 - DNA, 17 bp, Homo sapiens
caacggggtggggaggg

SEQ ID NO: 699020 - DNA, 14 bp, Homo sapiens
caacgtcccctccg

SEQ ID NO: 699021 - DNA, 16 bp, Homo sapiens
acctgccacccccagg

SEQ ID NO: 699022 - DNA, 18 bp, Homo sapiens
acctgccacccccaggtc

SEQ ID NO: 699023 - DNA, 20 bp, Homo sapiens
acctgccacccccaggtctt

SEQ ID NO: 699024 - DNA, 16 bp, Homo sapiens
acctgccatgccagga

SEQ ID NO: 699025 - DNA, 15 bp, Homo sapiens
acctgccatttgcac

SEQ ID NO: 699026 - DNA, 18 bp, Homo sapiens
acctgccatttgcaccct

SEQ ID NO: 699027 - DNA, 17 bp, Homo sapiens
acctgccccaactctcc

SEQ ID NO: 699028 - DNA, 13 bp, Homo sapiens
acctgccccctgg

SEQ ID NO: 699029 - DNA, 15 bp, Homo sapiens
acctgccccctggtg

SEQ ID NO: 699030 - DNA, 18 bp, Homo sapiens
acctgcccccttctccca

SEQ ID NO: 699031 - DNA, 20 bp, Homo sapiens
acctgccccggacctacctc

SEQ ID NO: 699032 - DNA, 21 bp, Homo sapiens
acctgccccggacctacctcc

SEQ ID NO: 699033 - DNA, 21 bp, Homo sapiens
acctgccccgtagagaatgtg

SEQ ID NO: 699034 - DNA, 23 bp, Homo sapiens
acctgcccctctgttctctcccc

SEQ ID NO: 699035 - DNA, 22 bp, Homo sapiens
acctgcccctgcctgacagcct

SEQ ID NO: 699036 - DNA, 13 bp, Homo sapiens
acctgccctgcct

SEQ ID NO: 699037 - DNA, 15 bp, Homo sapiens
acctgccctgcctga

SEQ ID NO: 699038 - DNA, 19 bp, Homo sapiens
acctgccctgcctgagggc

SEQ ID NO: 699039 - DNA, 20 bp, Homo sapiens
acctgccctgcctgagggcc

SEQ ID NO: 699040 - DNA, 13 bp, Homo sapiens
acctgccgacctc

SEQ ID NO: 699041 - DNA, 19 bp, Homo sapiens
acctgcctagcatggggtc

SEQ ID NO: 699042 - DNA, 16 bp, Homo sapiens
acctgcctcagctacc

SEQ ID NO: 699043 - DNA, 10 bp, Homo sapiens
acctgcctgc

SEQ ID NO: 699044 - DNA, 20 bp, Homo sapiens
acctgcctgccccacacgga

SEQ ID NO: 699045 - DNA, 22 bp, Homo sapiens
acctgcctgccccacacggact

SEQ ID NO: 699046 - DNA, 11 bp, Homo sapiens
acctgcctgcg

SEQ ID NO: 699047 - DNA, 18 bp, Homo sapiens
acctgcctgcgtcttccg

SEQ ID NO: 699048 - DNA, 16 bp, Homo sapiens
acctgcctttgtatgt

SEQ ID NO: 699049 - DNA, 16 bp, Homo sapiens
acctgccttttaagtt

SEQ ID NO: 699050 - DNA, 16 bp, Homo sapiens
acctgcgacagcttgt

SEQ ID NO: 699051 - DNA, 17 bp, Homo sapiens
acctgcgcacaggtggg

SEQ ID NO: 699052 - DNA, 18 bp, Homo sapiens
acctgcgggtcctcagct

SEQ ID NO: 699053 - DNA, 15 bp, Homo sapiens
acctgctcacaggga

SEQ ID NO: 699054 - DNA, 16 bp, Homo sapiens
acctgctcacagggat

SEQ ID NO: 699055 - DNA, 16 bp, Homo sapiens
acctgctcacgtcaaa

SEQ ID NO: 699056 - DNA, 13 bp, Homo sapiens
acctgctccagga

SEQ ID NO: 699057 - DNA, 15 bp, Homo sapiens
acctgctccgctgct

SEQ ID NO: 699058 - DNA, 22 bp, Homo sapiens
acctgctgaattgtttataatg

SEQ ID NO: 699059 - DNA, 18 bp, Homo sapiens
acctgctgccccagctga

SEQ ID NO: 699060 - DNA, 16 bp, Homo sapiens
acctgctgcgtcccca

SEQ ID NO: 699061 - DNA, 16 bp, Homo sapiens
acctgctggcccctca

SEQ ID NO: 699062 - DNA, 17 bp, Homo sapiens
acctgctggcccctcac

SEQ ID NO: 699063 - DNA, 17 bp, Homo sapiens
acctgctgggtaaactg

SEQ ID NO: 699064 - DNA, 19 bp, Homo sapiens
acctgcttcatgctcagcc

SEQ ID NO: 699065 - DNA, 21 bp, Homo sapiens
acctgcttcatgctcagccct

SEQ ID NO: 699066 - DNA, 23 bp, Homo sapiens
acctgcttcatgctcagccctga

SEQ ID NO: 699067 - DNA, 17 bp, Homo sapiens
acctgcttcctggctca

SEQ ID NO: 699068 - DNA, 16 bp, Homo sapiens
acctgcttccttcagt

SEQ ID NO: 699069 - DNA, 17 bp, Homo sapiens
acctgcttccttcagtt

SEQ ID NO: 699070 - DNA, 19 bp, Homo sapiens
acctggaaaaattccagaa

SEQ ID NO: 699071 - DNA, 23 bp, Homo sapiens
acctggaaacagaccaatagaca

SEQ ID NO: 699072 - DNA, 21 bp, Homo sapiens
acctggaatctacaagccaaa

SEQ ID NO: 699073 - DNA, 14 bp, Homo sapiens
acctggaatgttag

SEQ ID NO: 699074 - DNA, 19 bp, Homo sapiens
acctggacacacactcacc

SEQ ID NO: 699075 - DNA, 20 bp, Homo sapiens
acctggaccccctgcccgcc

SEQ ID NO: 699076 - DNA, 19 bp, Homo sapiens
acctggactgaccctgcag

SEQ ID NO: 699077 - DNA, 13 bp, Homo sapiens
acctggagcccgc

SEQ ID NO: 699078 - DNA, 17 bp, Homo sapiens
acctggagcccgcttca

SEQ ID NO: 699079 - DNA, 22 bp, Homo sapiens
acctggagcccgcttcaagctc

SEQ ID NO: 699080 - DNA, 23 bp, Homo sapiens
acctggagcccgcttcaagctct

SEQ ID NO: 699081 - DNA, 19 bp, Homo sapiens
acctggagcgccacacact

SEQ ID NO: 699082 - DNA, 13 bp, Homo sapiens
acctggagctgag

SEQ ID NO: 699083 - DNA, 16 bp, Homo sapiens
acctggagggaagagt

SEQ ID NO: 699084 - DNA, 20 bp, Homo sapiens
acctggatagttaagggctt

SEQ ID NO: 699085 - DNA, 18 bp, Homo sapiens
acctggatccagcactgg

SEQ ID NO: 699086 - DNA, 13 bp, Homo sapiens
acctggatgtact

SEQ ID NO: 699087 - DNA, 22 bp, Homo sapiens
acctggattttttatgtacaac

SEQ ID NO: 699088 - DNA, 22 bp, Homo sapiens
acctggcagtggctctcagagc

SEQ ID NO: 699089 - DNA, 14 bp, Homo sapiens
acctggcatggtgc

SEQ ID NO: 699090 - DNA, 22 bp, Homo sapiens
acctggccactgtccctgtcct

SEQ ID NO: 699091 - DNA, 21 bp, Homo sapiens
acctggccccaggctgtcacc

SEQ ID NO: 699092 - DNA, 20 bp, Homo sapiens
acctggccgcggagcctgca

SEQ ID NO: 699093 - DNA, 17 bp, Homo sapiens
acctggccgctaagttg

SEQ ID NO: 699094 - DNA, 12 bp, Homo sapiens
acctggcctgct

SEQ ID NO: 699095 - DNA, 22 bp, Homo sapiens
acctggccttaaagagggacag

SEQ ID NO: 699096 - DNA, 13 bp, Homo sapiens
acctggctccccc

SEQ ID NO: 699097 - DNA, 19 bp, Homo sapiens
acctggctgagcctggctg

SEQ ID NO: 699098 - DNA, 23 bp, Homo sapiens
acctggctgaggttcctctgcct

SEQ ID NO: 699099 - DNA, 15 bp, Homo sapiens
acctggctgctaggc

SEQ ID NO: 699100 - DNA, 17 bp, Homo sapiens
acctggctgctaggcca

SEQ ID NO: 699101 - DNA, 14 bp, Homo sapiens
acctggcttattta

SEQ ID NO: 699102 - DNA, 16 bp, Homo sapiens
acctggcttttacttt

SEQ ID NO: 699103 - DNA, 15 bp, Homo sapiens
acctggctttttaaa

SEQ ID NO: 699104 - DNA, 23 bp, Homo sapiens
acctggctttttaaaatatatgt

SEQ ID NO: 699105 - DNA, 15 bp, Homo sapiens
acctgggatttgaga

SEQ ID NO: 699106 - DNA, 13 bp, Homo sapiens
acctgggcacctg

SEQ ID NO: 699107 - DNA, 14 bp, Homo sapiens
acctgggcagctcc

SEQ ID NO: 699108 - DNA, 18 bp, Homo sapiens
acctgggcatcagggcct

SEQ ID NO: 699109 - DNA, 18 bp, Homo sapiens
acctgggcccacagagcc

SEQ ID NO: 699110 - DNA, 16 bp, Homo sapiens
acctgggccccactgg

SEQ ID NO: 699111 - DNA, 20 bp, Homo sapiens
acctgggcccgggcaggcca

SEQ ID NO: 699112 - DNA, 13 bp, Homo sapiens
acctggggagtgg

SEQ ID NO: 699113 - DNA, 15 bp, Homo sapiens
acctggggagtggga

SEQ ID NO: 699114 - DNA, 18 bp, Homo sapiens
acctggggcacagtccag

SEQ ID NO: 699115 - DNA, 20 bp, Homo sapiens
acctggggcacagtccagga

SEQ ID NO: 699116 - DNA, 23 bp, Homo sapiens
acctggggggagggacagggcag

SEQ ID NO: 699117 - DNA, 22 bp, Homo sapiens
acctgggtatcccctgcctcct

SEQ ID NO: 699118 - DNA, 19 bp, Homo sapiens
acctgggtggacacaaggc

SEQ ID NO: 699119 - DNA, 19 bp, Homo sapiens
acctgggtttccagggcac

SEQ ID NO: 699120 - DNA, 14 bp, Homo sapiens
acctggtccccact

SEQ ID NO: 699121 - DNA, 10 bp, Homo sapiens
acctggtgct

SEQ ID NO: 699122 - DNA, 21 bp, Homo sapiens
acctggtgctcgggaagggag

SEQ ID NO: 699123 - DNA, 14 bp, Homo sapiens
acctggtgctggat

SEQ ID NO: 699124 - DNA, 14 bp, Homo sapiens
acctggtgtgcgga

SEQ ID NO: 699125 - DNA, 19 bp, Homo sapiens
acctggtgtgcggaggcag

SEQ ID NO: 699126 - DNA, 14 bp, Homo sapiens
acctgtaaaacttt

SEQ ID NO: 699127 - DNA, 17 bp, Homo sapiens
acctgtaaaactttatt

SEQ ID NO: 699128 - DNA, 21 bp, Homo sapiens
acctgtaaaactttattttat

SEQ ID NO: 699129 - DNA, 15 bp, Homo sapiens
acctgtaacttttgt

SEQ ID NO: 699130 - DNA, 19 bp, Homo sapiens
acctgtaatcccagctact

SEQ ID NO: 699131 - DNA, 15 bp, Homo sapiens
acctgtaatgacagg

SEQ ID NO: 699132 - DNA, 20 bp, Homo sapiens
acctgtaatgacaggcctgt

SEQ ID NO: 699133 - DNA, 14 bp, Homo sapiens
acctgtacattctt

SEQ ID NO: 699134 - DNA, 21 bp, Homo sapiens
acctgtactatgatgggcttc

SEQ ID NO: 699135 - DNA, 12 bp, Homo sapiens
acctgtactcag

SEQ ID NO: 699136 - DNA, 14 bp, Homo sapiens
acctgtagtcccag

SEQ ID NO: 699137 - DNA, 16 bp, Homo sapiens
acctgtatacagtgca

SEQ ID NO: 699138 - DNA, 23 bp, Homo sapiens
acctgtatgtcaataaacaacag

SEQ ID NO: 699139 - DNA, 23 bp, Homo sapiens
acctgtatttaaaaagaaacaga

SEQ ID NO: 699140 - DNA, 14 bp, Homo sapiens
acctgtcaatacta

SEQ ID NO: 699141 - DNA, 14 bp, Homo sapiens
acctgtcattgtat

SEQ ID NO: 699142 - DNA, 12 bp, Homo sapiens
acctgtccaggt

SEQ ID NO: 699143 - DNA, 15 bp, Homo sapiens
acctgtcccccactc

SEQ ID NO: 699144 - DNA, 17 bp, Homo sapiens
acctgtcccccactctc

SEQ ID NO: 699145 - DNA, 18 bp, Homo sapiens
acctgtcccccactctct

SEQ ID NO: 699146 - DNA, 19 bp, Homo sapiens
caacgtcccctccgccgtg

SEQ ID NO: 699147 - DNA, 12 bp, Homo sapiens
caacgtcttgct

SEQ ID NO: 699148 - DNA, 22 bp, Homo sapiens
caacgttactcagggctcctcc

SEQ ID NO: 699149 - DNA, 23 bp, Homo sapiens
caactaaaaaaatttttgacact

SEQ ID NO: 699150 - DNA, 15 bp, Homo sapiens
caactaaaaataaat

SEQ ID NO: 699151 - DNA, 17 bp, Homo sapiens
caactaaaaataaatta

SEQ ID NO: 699152 - DNA, 13 bp, Homo sapiens
caactaaaattag

SEQ ID NO: 699153 - DNA, 21 bp, Homo sapiens
caactaacccttaaaaatgca

SEQ ID NO: 699154 - DNA, 18 bp, Homo sapiens
caactacacaaagcaggc

SEQ ID NO: 699155 - DNA, 15 bp, Homo sapiens
caactacctgagcta

SEQ ID NO: 699156 - DNA, 21 bp, Homo sapiens
caactacctgagctaaataaa

SEQ ID NO: 699157 - DNA, 13 bp, Homo sapiens
caactactaatag

SEQ ID NO: 699158 - DNA, 14 bp, Homo sapiens
caactagatttgtc

SEQ ID NO: 699159 - DNA, 22 bp, Homo sapiens
caactagatttgtccttttatt

SEQ ID NO: 699160 - DNA, 17 bp, Homo sapiens
caactaggcttcagcat

SEQ ID NO: 699161 - DNA, 14 bp, Homo sapiens
caactatcaattct

SEQ ID NO: 699162 - DNA, 18 bp, Homo sapiens
caactcacagcttctcca

SEQ ID NO: 699163 - DNA, 20 bp, Homo sapiens
caactcacagcttctccaag

SEQ ID NO: 699164 - DNA, 15 bp, Homo sapiens
caactcacttccagt

SEQ ID NO: 699165 - DNA, 16 bp, Homo sapiens
caactcacttccagtg

SEQ ID NO: 699166 - DNA, 23 bp, Homo sapiens
caactcagagaaaaatgctcccc

SEQ ID NO: 699167 - DNA, 19 bp, Homo sapiens
caactcatcattttctact

SEQ ID NO: 699168 - DNA, 15 bp, Homo sapiens
caactcattctgatc

SEQ ID NO: 699169 - DNA, 13 bp, Homo sapiens
caactccaaaacc

SEQ ID NO: 699170 - DNA, 22 bp, Homo sapiens
caactccaacctctcggcccca

SEQ ID NO: 699171 - DNA, 20 bp, Homo sapiens
caactccagcaacttcttct

SEQ ID NO: 699172 - DNA, 19 bp, Homo sapiens
caactccaggaaagagcag

SEQ ID NO: 699173 - DNA, 17 bp, Homo sapiens
caactccaggggcacct

SEQ ID NO: 699174 - DNA, 21 bp, Homo sapiens
caactccatggggttcgagac

SEQ ID NO: 699175 - DNA, 20 bp, Homo sapiens
caactccctgccccccagcc

SEQ ID NO: 699176 - DNA, 21 bp, Homo sapiens
caactcctgatgccctcttct

SEQ ID NO: 699177 - DNA, 17 bp, Homo sapiens
caactcctggaagctgt

SEQ ID NO: 699178 - DNA, 21 bp, Homo sapiens
caactcctggaagctgtgtcc

SEQ ID NO: 699179 - DNA, 19 bp, Homo sapiens
caactcgctttaggtcagc

SEQ ID NO: 699180 - DNA, 17 bp, Homo sapiens
caactcgggggcgcctg

SEQ ID NO: 699181 - DNA, 19 bp, Homo sapiens
caactcgggggcgcctgga

SEQ ID NO: 699182 - DNA, 20 bp, Homo sapiens
caactcgggggcgcctggag

SEQ ID NO: 699183 - DNA, 13 bp, Homo sapiens
caactctccactc

SEQ ID NO: 699184 - DNA, 14 bp, Homo sapiens
caactctccccagt

SEQ ID NO: 699185 - DNA, 21 bp, Homo sapiens
caactctccccagtgcctgcc

SEQ ID NO: 699186 - DNA, 22 bp, Homo sapiens
caactctccccagtgcctgcca

SEQ ID NO: 699187 - DNA, 16 bp, Homo sapiens
caactctgatgtggaa

SEQ ID NO: 699188 - DNA, 15 bp, Homo sapiens
caactctgcactcca

SEQ ID NO: 699189 - DNA, 19 bp, Homo sapiens
caactctgcactccatggc

SEQ ID NO: 699190 - DNA, 23 bp, Homo sapiens
caactctgcactccatggccacc

SEQ ID NO: 699191 - DNA, 14 bp, Homo sapiens
caactctttgagaa

SEQ ID NO: 699192 - DNA, 16 bp, Homo sapiens
caactctttgagaaac

SEQ ID NO: 699193 - DNA, 13 bp, Homo sapiens
caactctttgtta

SEQ ID NO: 699194 - DNA, 18 bp, Homo sapiens
caactctttgttatttga

SEQ ID NO: 699195 - DNA, 19 bp, Homo sapiens
caactcttttaagtgcctt

SEQ ID NO: 699196 - DNA, 15 bp, Homo sapiens
caactgaagccttct

SEQ ID NO: 699197 - DNA, 16 bp, Homo sapiens
caactgaagccttctt

SEQ ID NO: 699198 - DNA, 18 bp, Homo sapiens
caactgaataaatacctc

SEQ ID NO: 699199 - DNA, 23 bp, Homo sapiens
caactgaataaattcagtatttt

SEQ ID NO: 699200 - DNA, 18 bp, Homo sapiens
caactgaatgaggtcagc

SEQ ID NO: 699201 - DNA, 13 bp, Homo sapiens
caactgaggcaga

SEQ ID NO: 699202 - DNA, 17 bp, Homo sapiens
caactgaggcagacagc

SEQ ID NO: 699203 - DNA, 18 bp, Homo sapiens
caactgcaaaaaaagcct

SEQ ID NO: 699204 - DNA, 21 bp, Homo sapiens
caactgcaaaaaaagcctcca

SEQ ID NO: 699205 - DNA, 19 bp, Homo sapiens
caactgcaaagaaagtggg

SEQ ID NO: 699206 - DNA, 16 bp, Homo sapiens
caactgcattggcttt

SEQ ID NO: 699207 - DNA, 11 bp, Homo sapiens
caactgcccta

SEQ ID NO: 699208 - DNA, 19 bp, Homo sapiens
caactgcccttccaggtgg

SEQ ID NO: 699209 - DNA, 15 bp, Homo sapiens
caactgcctactcca

SEQ ID NO: 699210 - DNA, 21 bp, Homo sapiens
caactgcctcgaaacacagaa

SEQ ID NO: 699211 - DNA, 14 bp, Homo sapiens
caactgcggtgatg

SEQ ID NO: 699212 - DNA, 13 bp, Homo sapiens
caactgctcagct

SEQ ID NO: 699213 - DNA, 17 bp, Homo sapiens
caactgctggggagaca

SEQ ID NO: 699214 - DNA, 19 bp, Homo sapiens
caactggacattgtctgcg

SEQ ID NO: 699215 - DNA, 22 bp, Homo sapiens
caactggagcaagaaggaagga

SEQ ID NO: 699216 - DNA, 11 bp, Homo sapiens
caactggatgt

SEQ ID NO: 699217 - DNA, 23 bp, Homo sapiens
caactggatgttgacgtatatat

SEQ ID NO: 699218 - DNA, 14 bp, Homo sapiens
caactggccagcca

SEQ ID NO: 699219 - DNA, 23 bp, Homo sapiens
caactggccctatttagatgata

SEQ ID NO: 699220 - DNA, 13 bp, Homo sapiens
caactggcttctg

SEQ ID NO: 699221 - DNA, 16 bp, Homo sapiens
caactggcttctgtgc

SEQ ID NO: 699222 - DNA, 17 bp, Homo sapiens
caactggcttctgtgca

SEQ ID NO: 699223 - DNA, 19 bp, Homo sapiens
caactggcttctgtgcact

SEQ ID NO: 699224 - DNA, 15 bp, Homo sapiens
caactgtatatattc

SEQ ID NO: 699225 - DNA, 18 bp, Homo sapiens
caactgtcttatttaatg

SEQ ID NO: 699226 - DNA, 15 bp, Homo sapiens
caactgtcttcctca

SEQ ID NO: 699227 - DNA, 16 bp, Homo sapiens
caactgtcttcctcaa

SEQ ID NO: 699228 - DNA, 12 bp, Homo sapiens
caactgtgactg

SEQ ID NO: 699229 - DNA, 12 bp, Homo sapiens
caactgtgtgat

SEQ ID NO: 699230 - DNA, 15 bp, Homo sapiens
caactgtgttgtatt

SEQ ID NO: 699231 - DNA, 16 bp, Homo sapiens
caactgtgttgtatta

SEQ ID NO: 699232 - DNA, 18 bp, Homo sapiens
caactgttggattcagaa

SEQ ID NO: 699233 - DNA, 15 bp, Homo sapiens
caacttaagtatatt

SEQ ID NO: 699234 - DNA, 15 bp, Homo sapiens
caacttaatgttctg

SEQ ID NO: 699235 - DNA, 14 bp, Homo sapiens
caacttacaaaaac

SEQ ID NO: 699236 - DNA, 17 bp, Homo sapiens
caacttagctcaggtgc

SEQ ID NO: 699237 - DNA, 19 bp, Homo sapiens
caacttagctcaggtgcct

SEQ ID NO: 699238 - DNA, 14 bp, Homo sapiens
caacttatttaaaa

SEQ ID NO: 699239 - DNA, 15 bp, Homo sapiens
caacttatttaaaaa

SEQ ID NO: 699240 - DNA, 16 bp, Homo sapiens
caacttcaagtgcatg

SEQ ID NO: 699241 - DNA, 22 bp, Homo sapiens
caacttcaagtgcatgctctct

SEQ ID NO: 699242 - DNA, 18 bp, Homo sapiens
caacttcagcagtaccta

SEQ ID NO: 699243 - DNA, 15 bp, Homo sapiens
caacttcatttgaca

SEQ ID NO: 699244 - DNA, 24 bp, Homo sapiens
caacttccagaggacagctctggg

SEQ ID NO: 699245 - DNA, 19 bp, Homo sapiens
caacttcccacacggcagc

SEQ ID NO: 699246 - DNA, 15 bp, Homo sapiens
caacttcctctgcca

SEQ ID NO: 699247 - DNA, 23 bp, Homo sapiens
caacttcgctagaaaaaaaaaac

SEQ ID NO: 699248 - DNA, 15 bp, Homo sapiens
caacttctcccaccc

SEQ ID NO: 699249 - DNA, 21 bp, Homo sapiens
caacttctcccaccccttggc

SEQ ID NO: 699250 - DNA, 23 bp, Homo sapiens
caacttcttacccgaaagcatca

SEQ ID NO: 699251 - DNA, 9 bp, Homo sapiens
caacttgag

SEQ ID NO: 699252 - DNA, 21 bp, Homo sapiens
caacttgagatgtatgaaggc

SEQ ID NO: 699253 - DNA, 16 bp, Homo sapiens
caacttgagggcccag

SEQ ID NO: 699254 - DNA, 20 bp, Homo sapiens
caacttgatgttccacctgc

SEQ ID NO: 699255 - DNA, 16 bp, Homo sapiens
caacttgccaaaatgt

SEQ ID NO: 699256 - DNA, 12 bp, Homo sapiens
caacttgccaca

SEQ ID NO: 699257 - DNA, 13 bp, Homo sapiens
caacttgcttcta

SEQ ID NO: 699258 - DNA, 15 bp, Homo sapiens
caacttgcttctaaa

SEQ ID NO: 699259 - DNA, 15 bp, Homo sapiens
caacttggcatttct

SEQ ID NO: 699260 - DNA, 19 bp, Homo sapiens
caacttggcttcctttctt

SEQ ID NO: 699261 - DNA, 19 bp, Homo sapiens
caacttggttctgcttcaa

SEQ ID NO: 699262 - DNA, 16 bp, Homo sapiens
caacttgtaaatacac

SEQ ID NO: 699263 - DNA, 18 bp, Homo sapiens
caacttgtagcagctata

SEQ ID NO: 699264 - DNA, 23 bp, Homo sapiens
caacttgtattaaagacagaggc

SEQ ID NO: 699265 - DNA, 17 bp, Homo sapiens
caacttgtcacccaaag

SEQ ID NO: 699266 - DNA, 24 bp, Homo sapiens
caacttgtcacccaaagcctgtcc

SEQ ID NO: 699267 - DNA, 20 bp, Homo sapiens
caacttgtctgggaattgtg

SEQ ID NO: 699268 - DNA, 19 bp, Homo sapiens
caacttgtctttttctgga

SEQ ID NO: 699269 - DNA, 12 bp, Homo sapiens
caacttgtgaac

SEQ ID NO: 699270 - DNA, 12 bp, Homo sapiens
caacttgtgtac

SEQ ID NO: 699271 - DNA, 15 bp, Homo sapiens
acctgtcctctttgt

SEQ ID NO: 699272 - DNA, 23 bp, Homo sapiens
acctgtctaggtctcctcagggt

SEQ ID NO: 699273 - DNA, 12 bp, Homo sapiens
acctgtcttgct

SEQ ID NO: 699274 - DNA, 17 bp, Homo sapiens
acctgtcttgctcctgg

SEQ ID NO: 699275 - DNA, 18 bp, Homo sapiens
acctgtcttgctcctggg

SEQ ID NO: 699276 - DNA, 21 bp, Homo sapiens
acctgtcttgctcctggggag

SEQ ID NO: 699277 - DNA, 22 bp, Homo sapiens
acctgtcttgctcctggggaga

SEQ ID NO: 699278 - DNA, 18 bp, Homo sapiens
acctgtgacaaaggatga

SEQ ID NO: 699279 - DNA, 23 bp, Homo sapiens
acctgtgaccagcactgtctcag

SEQ ID NO: 699280 - DNA, 18 bp, Homo sapiens
acctgtgagcccagctgg

SEQ ID NO: 699281 - DNA, 19 bp, Homo sapiens
acctgtgagtttaaagcaa

SEQ ID NO: 699282 - DNA, 16 bp, Homo sapiens
acctgtgccaggctga

SEQ ID NO: 699283 - DNA, 21 bp, Homo sapiens
acctgtgctagttttacagat

SEQ ID NO: 699284 - DNA, 19 bp, Homo sapiens
acctgtgcttcgggccctt

SEQ ID NO: 699285 - DNA, 22 bp, Homo sapiens
acctgtgcttcgggcccttccc

SEQ ID NO: 699286 - DNA, 23 bp, Homo sapiens
acctgtgcttcgggcccttccca

SEQ ID NO: 699287 - DNA, 14 bp, Homo sapiens
acctgtggatattt

SEQ ID NO: 699288 - DNA, 12 bp, Homo sapiens
acctgtgggtgt

SEQ ID NO: 699289 - DNA, 13 bp, Homo sapiens
acctgtgtacata

SEQ ID NO: 699290 - DNA, 18 bp, Homo sapiens
acctgtgtattttttaaa

SEQ ID NO: 699291 - DNA, 13 bp, Homo sapiens
acctgtgtgcttg

SEQ ID NO: 699292 - DNA, 19 bp, Homo sapiens
acctgttaaaatgtacact

SEQ ID NO: 699293 - DNA, 19 bp, Homo sapiens
acctgttatatatctcttt

SEQ ID NO: 699294 - DNA, 15 bp, Homo sapiens
acctgttattttatg

SEQ ID NO: 699295 - DNA, 18 bp, Homo sapiens
acctgttcagtgtcccgg

SEQ ID NO: 699296 - DNA, 21 bp, Homo sapiens
acctgttcttagagtgtagct

SEQ ID NO: 699297 - DNA, 22 bp, Homo sapiens
acctgttcttagagtgtagctg

SEQ ID NO: 699298 - DNA, 17 bp, Homo sapiens
acctgttgccagcagat

SEQ ID NO: 699299 - DNA, 14 bp, Homo sapiens
acctgttggcctgt

SEQ ID NO: 699300 - DNA, 22 bp, Homo sapiens
acctgttggcctgtgggcctca

SEQ ID NO: 699301 - DNA, 16 bp, Homo sapiens
acctgttggctacaca

SEQ ID NO: 699302 - DNA, 16 bp, Homo sapiens
acctgtttctctttgt

SEQ ID NO: 699303 - DNA, 18 bp, Homo sapiens
acctgtttctggaagact

SEQ ID NO: 699304 - DNA, 18 bp, Homo sapiens
acctgttttcgcacctac

SEQ ID NO: 699305 - DNA, 13 bp, Homo sapiens
acctgttttctga

SEQ ID NO: 699306 - DNA, 18 bp, Homo sapiens
acctgtttttaagctgtt

SEQ ID NO: 699307 - DNA, 21 bp, Homo sapiens
accttaaattaaacaatttat

SEQ ID NO: 699308 - DNA, 19 bp, Homo sapiens
accttaagacactgtgaga

SEQ ID NO: 699309 - DNA, 18 bp, Homo sapiens
accttaatgacaacactt

SEQ ID NO: 699310 - DNA, 14 bp, Homo sapiens
accttaatttatta

SEQ ID NO: 699311 - DNA, 15 bp, Homo sapiens
accttaatttattat

SEQ ID NO: 699312 - DNA, 20 bp, Homo sapiens
accttacaacgccgagtgca

SEQ ID NO: 699313 - DNA, 16 bp, Homo sapiens
accttaccaactttct

SEQ ID NO: 699314 - DNA, 13 bp, Homo sapiens
accttactaatta

SEQ ID NO: 699315 - DNA, 19 bp, Homo sapiens
accttactcaggggatgtt

SEQ ID NO: 699316 - DNA, 22 bp, Homo sapiens
accttagaaatcattgtagaaa

SEQ ID NO: 699317 - DNA, 13 bp, Homo sapiens
accttagcgttct

SEQ ID NO: 699318 - DNA, 21 bp, Homo sapiens
accttagctggcattacagct

SEQ ID NO: 699319 - DNA, 22 bp, Homo sapiens
accttagctggcattacagctg

SEQ ID NO: 699320 - DNA, 18 bp, Homo sapiens
accttaggccttcctctc

SEQ ID NO: 699321 - DNA, 20 bp, Homo sapiens
accttaggccttcctctctc

SEQ ID NO: 699322 - DNA, 16 bp, Homo sapiens
accttaggctttgtat

SEQ ID NO: 699323 - DNA, 19 bp, Homo sapiens
accttagtttcaagagtct

SEQ ID NO: 699324 - DNA, 14 bp, Homo sapiens
accttatagttact

SEQ ID NO: 699325 - DNA, 20 bp, Homo sapiens
accttatagttactgtgtaa

SEQ ID NO: 699326 - DNA, 17 bp, Homo sapiens
accttatatttctgtgt

SEQ ID NO: 699327 - DNA, 20 bp, Homo sapiens
accttatcaaggattttcat

SEQ ID NO: 699328 - DNA, 11 bp, Homo sapiens
accttatctgt

SEQ ID NO: 699329 - DNA, 22 bp, Homo sapiens
accttatctgtgcgtgaaacac

SEQ ID NO: 699330 - DNA, 16 bp, Homo sapiens
accttatttatttttg

SEQ ID NO: 699331 - DNA, 17 bp, Homo sapiens
accttatttatttttgt

SEQ ID NO: 699332 - DNA, 21 bp, Homo sapiens
accttcaaaatgttctattta

SEQ ID NO: 699333 - DNA, 16 bp, Homo sapiens
accttcaacccagtgg

SEQ ID NO: 699334 - DNA, 16 bp, Homo sapiens
accttcaagcgctcca

SEQ ID NO: 699335 - DNA, 18 bp, Homo sapiens
accttcaagcgctccagg

SEQ ID NO: 699336 - DNA, 20 bp, Homo sapiens
accttcaatgacttctaatt

SEQ ID NO: 699337 - DNA, 16 bp, Homo sapiens
accttcaattcctggg

SEQ ID NO: 699338 - DNA, 17 bp, Homo sapiens
accttcaattcctgggc

SEQ ID NO: 699339 - DNA, 17 bp, Homo sapiens
accttcagagccagccg

SEQ ID NO: 699340 - DNA, 12 bp, Homo sapiens
accttcagccct

SEQ ID NO: 699341 - DNA, 14 bp, Homo sapiens
accttcagccctgg

SEQ ID NO: 699342 - DNA, 21 bp, Homo sapiens
accttcagccctggccaagct

SEQ ID NO: 699343 - DNA, 19 bp, Homo sapiens
accttcagttatgattttt

SEQ ID NO: 699344 - DNA, 18 bp, Homo sapiens
accttcatttcaggaggg

SEQ ID NO: 699345 - DNA, 21 bp, Homo sapiens
accttcatttcaggagggatt

SEQ ID NO: 699346 - DNA, 14 bp, Homo sapiens
accttcatttcatg

SEQ ID NO: 699347 - DNA, 22 bp, Homo sapiens
accttcatttttaagactgtaa

SEQ ID NO: 699348 - DNA, 15 bp, Homo sapiens
accttccaagactga

SEQ ID NO: 699349 - DNA, 22 bp, Homo sapiens
accttcccaaacgcctcccctg

SEQ ID NO: 699350 - DNA, 13 bp, Homo sapiens
accttcccagctc

SEQ ID NO: 699351 - DNA, 15 bp, Homo sapiens
accttccccagactc

SEQ ID NO: 699352 - DNA, 17 bp, Homo sapiens
accttcccttctacaag

SEQ ID NO: 699353 - DNA, 14 bp, Homo sapiens
accttcccttgcca

SEQ ID NO: 699354 - DNA, 16 bp, Homo sapiens
accttcctcctccccg

SEQ ID NO: 699355 - DNA, 18 bp, Homo sapiens
accttcctcctccccgct

SEQ ID NO: 699356 - DNA, 14 bp, Homo sapiens
accttcctcctgca

SEQ ID NO: 699357 - DNA, 11 bp, Homo sapiens
accttcctgcc

SEQ ID NO: 699358 - DNA, 11 bp, Homo sapiens
accttcctggg

SEQ ID NO: 699359 - DNA, 24 bp, Homo sapiens
accttcctgtgggtgttctttcct

SEQ ID NO: 699360 - DNA, 11 bp, Homo sapiens
accttcgagta

SEQ ID NO: 699361 - DNA, 22 bp, Homo sapiens
accttcgggcagtcctgtgtga

SEQ ID NO: 699362 - DNA, 14 bp, Homo sapiens
accttcgggctgtg

SEQ ID NO: 699363 - DNA, 16 bp, Homo sapiens
accttcgggctgtgcc

SEQ ID NO: 699364 - DNA, 11 bp, Homo sapiens
accttctaaaa

SEQ ID NO: 699365 - DNA, 19 bp, Homo sapiens
accttctagtgagcctggg

SEQ ID NO: 699366 - DNA, 15 bp, Homo sapiens
accttctatgtatta

SEQ ID NO: 699367 - DNA, 20 bp, Homo sapiens
accttctatgtattagtgtc

SEQ ID NO: 699368 - DNA, 15 bp, Homo sapiens
accttctcccttctt

SEQ ID NO: 699369 - DNA, 22 bp, Homo sapiens
accttctcccttcttgggtctg

SEQ ID NO: 699370 - DNA, 15 bp, Homo sapiens
accttctctggagcc

SEQ ID NO: 699371 - DNA, 12 bp, Homo sapiens
accttctgcctt

SEQ ID NO: 699372 - DNA, 19 bp, Homo sapiens
accttctgcctttgatgtt

SEQ ID NO: 699373 - DNA, 18 bp, Homo sapiens
accttctggttgcttcag

SEQ ID NO: 699374 - DNA, 19 bp, Homo sapiens
accttctgtccccagccct

SEQ ID NO: 699375 - DNA, 20 bp, Homo sapiens
accttctgtccccagccctg

SEQ ID NO: 699376 - DNA, 12 bp, Homo sapiens
accttctgtggc

SEQ ID NO: 699377 - DNA, 13 bp, Homo sapiens
accttctgtggct

SEQ ID NO: 699378 - DNA, 15 bp, Homo sapiens
accttctgtggctca

SEQ ID NO: 699379 - DNA, 17 bp, Homo sapiens
accttcttggcgctgga

SEQ ID NO: 699380 - DNA, 17 bp, Homo sapiens
accttctttctggactg

SEQ ID NO: 699381 - DNA, 18 bp, Homo sapiens
accttctttctggactgg

SEQ ID NO: 699382 - DNA, 20 bp, Homo sapiens
accttctttctggactggcg

SEQ ID NO: 699383 - DNA, 18 bp, Homo sapiens
accttgaaaaaaaacagt

SEQ ID NO: 699384 - DNA, 22 bp, Homo sapiens
accttgaaaaaaaacagtggat

SEQ ID NO: 699385 - DNA, 18 bp, Homo sapiens
accttgaacactggggga

SEQ ID NO: 699386 - DNA, 21 bp, Homo sapiens
accttgaacactgggggaggg

SEQ ID NO: 699387 - DNA, 13 bp, Homo sapiens
accttgaatgctg

SEQ ID NO: 699388 - DNA, 16 bp, Homo sapiens
accttgaatgctgcca

SEQ ID NO: 699389 - DNA, 17 bp, Homo sapiens
accttgaatgctgccag

SEQ ID NO: 699390 - DNA, 16 bp, Homo sapiens
accttgacagagcagc

SEQ ID NO: 699391 - DNA, 22 bp, Homo sapiens
accttgaggaggggcaggtaaa

SEQ ID NO: 699392 - DNA, 22 bp, Homo sapiens
accttgagtcagaaaacagaga

SEQ ID NO: 699393 - DNA, 22 bp, Homo sapiens
accttgatcccaatccttatcc

SEQ ID NO: 699394 - DNA, 17 bp, Homo sapiens
accttgcaacacacaga

SEQ ID NO: 699395 - DNA, 21 bp, Homo sapiens
caactttaccataaagccttt

SEQ ID NO: 699396 - DNA, 22 bp, Homo sapiens
caactttaccataaagccttta

SEQ ID NO: 699397 - DNA, 24 bp, Homo sapiens
caactttagctagtatcttcaaac

SEQ ID NO: 699398 - DNA, 13 bp, Homo sapiens
caactttcacttc

SEQ ID NO: 699399 - DNA, 16 bp, Homo sapiens
caactttcacttcttc

SEQ ID NO: 699400 - DNA, 12 bp, Homo sapiens
caactttctgta

SEQ ID NO: 699401 - DNA, 12 bp, Homo sapiens
caactttgcaaa

SEQ ID NO: 699402 - DNA, 19 bp, Homo sapiens
caacttttcaatgtgattc

SEQ ID NO: 699403 - DNA, 22 bp, Homo sapiens
caacttttgacaatcaaagaaa

SEQ ID NO: 699404 - DNA, 19 bp, Homo sapiens
caacttttgactaagaatt

SEQ ID NO: 699405 - DNA, 21 bp, Homo sapiens
caacttttgtgtaatgaaaat

SEQ ID NO: 699406 - DNA, 18 bp, Homo sapiens
caacttttgttttctgat

SEQ ID NO: 699407 - DNA, 15 bp, Homo sapiens
caagaaaaggacaaa

SEQ ID NO: 699408 - DNA, 13 bp, Homo sapiens
caagaaaatcttt

SEQ ID NO: 699409 - DNA, 20 bp, Homo sapiens
caagaaaatctttgttgaag

SEQ ID NO: 699410 - DNA, 16 bp, Homo sapiens
caagaaacactgcctg

SEQ ID NO: 699411 - DNA, 18 bp, Homo sapiens
caagaaacactgcctgcc

SEQ ID NO: 699412 - DNA, 18 bp, Homo sapiens
caagaaacagccagcaag

SEQ ID NO: 699413 - DNA, 20 bp, Homo sapiens
caagaaaccaagtgggctgg

SEQ ID NO: 699414 - DNA, 15 bp, Homo sapiens
caagaaactgaatga

SEQ ID NO: 699415 - DNA, 14 bp, Homo sapiens
caagaaagatgtat

SEQ ID NO: 699416 - DNA, 19 bp, Homo sapiens
caagaaagcttcttcagag

SEQ ID NO: 699417 - DNA, 21 bp, Homo sapiens
caagaaagggccaggagatgg

SEQ ID NO: 699418 - DNA, 15 bp, Homo sapiens
caagaaaggggaccc

SEQ ID NO: 699419 - DNA, 13 bp, Homo sapiens
caagaaataaaag

SEQ ID NO: 699420 - DNA, 19 bp, Homo sapiens
caagaaataaaaggaagcc

SEQ ID NO: 699421 - DNA, 18 bp, Homo sapiens
caagaaataagtttttgt

SEQ ID NO: 699422 - DNA, 22 bp, Homo sapiens
caagaaatccagtttcccacca

SEQ ID NO: 699423 - DNA, 10 bp, Homo sapiens
caagaaatgg

SEQ ID NO: 699424 - DNA, 20 bp, Homo sapiens
caagaaatgtctctgctcct

SEQ ID NO: 699425 - DNA, 19 bp, Homo sapiens
caagaacccaagtgcctca

SEQ ID NO: 699426 - DNA, 10 bp, Homo sapiens
caagaacctg

SEQ ID NO: 699427 - DNA, 15 bp, Homo sapiens
caagaacctggaaaa

SEQ ID NO: 699428 - DNA, 13 bp, Homo sapiens
caagaactccacc

SEQ ID NO: 699429 - DNA, 21 bp, Homo sapiens
caagaactgcagatagcccag

SEQ ID NO: 699430 - DNA, 22 bp, Homo sapiens
caagaactgcagatagcccagg

SEQ ID NO: 699431 - DNA, 23 bp, Homo sapiens
caagaactgcagatagcccagga

SEQ ID NO: 699432 - DNA, 12 bp, Homo sapiens
caagaactgcat

SEQ ID NO: 699433 - DNA, 13 bp, Homo sapiens
caagaagaaaaag

SEQ ID NO: 699434 - DNA, 12 bp, Homo sapiens
caagaagaaata

SEQ ID NO: 699435 - DNA, 19 bp, Homo sapiens
caagaagaagggcacccta

SEQ ID NO: 699436 - DNA, 14 bp, Homo sapiens
caagaagaatgaac

SEQ ID NO: 699437 - DNA, 19 bp, Homo sapiens
caagaagcaattatttaaa

SEQ ID NO: 699438 - DNA, 22 bp, Homo sapiens
caagaagcaattatttaaagaa

SEQ ID NO: 699439 - DNA, 16 bp, Homo sapiens
caagaagcagcctgtt

SEQ ID NO: 699440 - DNA, 17 bp, Homo sapiens
caagaagcattttgtaa

SEQ ID NO: 699441 - DNA, 13 bp, Homo sapiens
caagaagcccagt

SEQ ID NO: 699442 - DNA, 15 bp, Homo sapiens
caagaagcctttcct

SEQ ID NO: 699443 - DNA, 20 bp, Homo sapiens
caagaagcgccgactccctg

SEQ ID NO: 699444 - DNA, 17 bp, Homo sapiens
caagaaggaaggaggca

SEQ ID NO: 699445 - DNA, 20 bp, Homo sapiens
caagaaggaaggaggcagac

SEQ ID NO: 699446 - DNA, 16 bp, Homo sapiens
caagaaggagaggaaa

SEQ ID NO: 699447 - DNA, 15 bp, Homo sapiens
caagaagggctgcat

SEQ ID NO: 699448 - DNA, 20 bp, Homo sapiens
caagaagggctgcatgatgt

SEQ ID NO: 699449 - DNA, 19 bp, Homo sapiens
caagaagtcaaagtaaaac

SEQ ID NO: 699450 - DNA, 18 bp, Homo sapiens
caagaagtgggtgccctt

SEQ ID NO: 699451 - DNA, 15 bp, Homo sapiens
caagaagtttaagga

SEQ ID NO: 699452 - DNA, 17 bp, Homo sapiens
caagaagtttattctca

SEQ ID NO: 699453 - DNA, 15 bp, Homo sapiens
caagaatattgcaaa

SEQ ID NO: 699454 - DNA, 15 bp, Homo sapiens
caagaatattgtatg

SEQ ID NO: 699455 - DNA, 23 bp, Homo sapiens
caagaatattgtatgttaaagca

SEQ ID NO: 699456 - DNA, 14 bp, Homo sapiens
caagaatctagaag

SEQ ID NO: 699457 - DNA, 21 bp, Homo sapiens
caagaatgaaaaatataatgt

SEQ ID NO: 699458 - DNA, 23 bp, Homo sapiens
caagaatgcattccctgaatctg

SEQ ID NO: 699459 - DNA, 15 bp, Homo sapiens
caagaatggaagcct

SEQ ID NO: 699460 - DNA, 22 bp, Homo sapiens
caagaatggatcacaagatgga

SEQ ID NO: 699461 - DNA, 13 bp, Homo sapiens
caagaattaaaac

SEQ ID NO: 699462 - DNA, 16 bp, Homo sapiens
caagaattaaaactga

SEQ ID NO: 699463 - DNA, 17 bp, Homo sapiens
caagaattaaaactgag

SEQ ID NO: 699464 - DNA, 22 bp, Homo sapiens
caagaatttcttggtaagaagc

SEQ ID NO: 699465 - DNA, 22 bp, Homo sapiens
caagaatttgatcgttccagtt

SEQ ID NO: 699466 - DNA, 12 bp, Homo sapiens
caagacaaatca

SEQ ID NO: 699467 - DNA, 15 bp, Homo sapiens
caagacaaatcaaca

SEQ ID NO: 699468 - DNA, 21 bp, Homo sapiens
caagacaaatcaacagaagca

SEQ ID NO: 699469 - DNA, 18 bp, Homo sapiens
caagacaaggctggcaaa

SEQ ID NO: 699470 - DNA, 14 bp, Homo sapiens
caagacacttcccc

SEQ ID NO: 699471 - DNA, 12 bp, Homo sapiens
caagacagcctt

SEQ ID NO: 699472 - DNA, 13 bp, Homo sapiens
caagacaggcaga

SEQ ID NO: 699473 - DNA, 22 bp, Homo sapiens
caagacagtgagacagtctgga

SEQ ID NO: 699474 - DNA, 16 bp, Homo sapiens
caagacatgtggaggg

SEQ ID NO: 699475 - DNA, 18 bp, Homo sapiens
caagaccaaaatgacaat

SEQ ID NO: 699476 - DNA, 19 bp, Homo sapiens
caagaccaccacttcgaaa

SEQ ID NO: 699477 - DNA, 13 bp, Homo sapiens
caagaccaccagg

SEQ ID NO: 699478 - DNA, 20 bp, Homo sapiens
caagaccaccagggtcccag

SEQ ID NO: 699479 - DNA, 22 bp, Homo sapiens
caagaccaccagggtcccagga

SEQ ID NO: 699480 - DNA, 22 bp, Homo sapiens
caagaccacggagggagcgaca

SEQ ID NO: 699481 - DNA, 18 bp, Homo sapiens
caagaccacgtttctaaa

SEQ ID NO: 699482 - DNA, 13 bp, Homo sapiens
caagaccctgccc

SEQ ID NO: 699483 - DNA, 16 bp, Homo sapiens
caagaccgatcggcgg

SEQ ID NO: 699484 - DNA, 17 bp, Homo sapiens
caagaccgccccagggc

SEQ ID NO: 699485 - DNA, 18 bp, Homo sapiens
caagaccgccccagggct

SEQ ID NO: 699486 - DNA, 22 bp, Homo sapiens
caagacctagtcccctttcctc

SEQ ID NO: 699487 - DNA, 22 bp, Homo sapiens
caagacctcatctgtggagctg

SEQ ID NO: 699488 - DNA, 22 bp, Homo sapiens
caagaccttggcctctccttgg

SEQ ID NO: 699489 - DNA, 11 bp, Homo sapiens
caagactcctc

SEQ ID NO: 699490 - DNA, 15 bp, Homo sapiens
caagactctgtctca

SEQ ID NO: 699491 - DNA, 23 bp, Homo sapiens
caagactgaagatggcttttcct

SEQ ID NO: 699492 - DNA, 14 bp, Homo sapiens
caagactgcaaact

SEQ ID NO: 699493 - DNA, 16 bp, Homo sapiens
caagactgcaaacttt

SEQ ID NO: 699494 - DNA, 12 bp, Homo sapiens
caagactgccag

SEQ ID NO: 699495 - DNA, 17 bp, Homo sapiens
caagactgcctccctct

SEQ ID NO: 699496 - DNA, 14 bp, Homo sapiens
caagactgttgctc

SEQ ID NO: 699497 - DNA, 15 bp, Homo sapiens
caagacttggcaaca

SEQ ID NO: 699498 - DNA, 22 bp, Homo sapiens
caagactttagttaccgagaca

SEQ ID NO: 699499 - DNA, 12 bp, Homo sapiens
caagactttgat

SEQ ID NO: 699500 - DNA, 19 bp, Homo sapiens
caagactttgatccttgga

SEQ ID NO: 699501 - DNA, 21 bp, Homo sapiens
caagactttgatccttggaaa

SEQ ID NO: 699502 - DNA, 18 bp, Homo sapiens
caagagaaaattcctaga

SEQ ID NO: 699503 - DNA, 20 bp, Homo sapiens
caagagaaaattcctagaaa

SEQ ID NO: 699504 - DNA, 12 bp, Homo sapiens
caagagaaactt

SEQ ID NO: 699505 - DNA, 24 bp, Homo sapiens
caagagaactcgcgctcagtaaac

SEQ ID NO: 699506 - DNA, 19 bp, Homo sapiens
caagagaaggggaagcact

SEQ ID NO: 699507 - DNA, 11 bp, Homo sapiens
caagagaatca

SEQ ID NO: 699508 - DNA, 12 bp, Homo sapiens
caagagactgag

SEQ ID NO: 699509 - DNA, 13 bp, Homo sapiens
caagagactgagt

SEQ ID NO: 699510 - DNA, 21 bp, Homo sapiens
caagagatctttctttccaaa

SEQ ID NO: 699511 - DNA, 23 bp, Homo sapiens
caagagatgaagagtgagagggc

SEQ ID NO: 699512 - DNA, 16 bp, Homo sapiens
caagagcagcctgtgg

SEQ ID NO: 699513 - DNA, 17 bp, Homo sapiens
caagagcagcctgtggc

SEQ ID NO: 699514 - DNA, 17 bp, Homo sapiens
caagagcatgcacatgc

SEQ ID NO: 699515 - DNA, 19 bp, Homo sapiens
caagagcccagcagggcct

SEQ ID NO: 699516 - DNA, 12 bp, Homo sapiens
caagagccctgt

SEQ ID NO: 699517 - DNA, 16 bp, Homo sapiens
caagagccctgtggcc

SEQ ID NO: 699518 - DNA, 21 bp, Homo sapiens
caagagcctgatctcttcctg

SEQ ID NO: 699519 - DNA, 12 bp, Homo sapiens
caagagccttgg

SEQ ID NO: 699520 - DNA, 21 bp, Homo sapiens
accttgcaacctcaccttcct

SEQ ID NO: 699521 - DNA, 16 bp, Homo sapiens
accttgcagattttct

SEQ ID NO: 699522 - DNA, 20 bp, Homo sapiens
accttgcagattttcttaag

SEQ ID NO: 699523 - DNA, 13 bp, Homo sapiens
accttgcagtatt

SEQ ID NO: 699524 - DNA, 19 bp, Homo sapiens
accttgccacccattcttc

SEQ ID NO: 699525 - DNA, 22 bp, Homo sapiens
accttgccacccattcttcccg

SEQ ID NO: 699526 - DNA, 23 bp, Homo sapiens
accttgcctgaacatccttcctt

SEQ ID NO: 699527 - DNA, 24 bp, Homo sapiens
accttgcctgaacatccttccttc

SEQ ID NO: 699528 - DNA, 15 bp, Homo sapiens
accttgcctggtaca

SEQ ID NO: 699529 - DNA, 18 bp, Homo sapiens
accttgcctggtacagta

SEQ ID NO: 699530 - DNA, 23 bp, Homo sapiens
accttgctgcaagcacagccctt

SEQ ID NO: 699531 - DNA, 23 bp, Homo sapiens
accttgctgggacttggatccca

SEQ ID NO: 699532 - DNA, 11 bp, Homo sapiens
accttgctgtc

SEQ ID NO: 699533 - DNA, 17 bp, Homo sapiens
accttgctgtcctgatc

SEQ ID NO: 699534 - DNA, 19 bp, Homo sapiens
accttgctgtcctgatctg

SEQ ID NO: 699535 - DNA, 14 bp, Homo sapiens
accttgctgtgtga

SEQ ID NO: 699536 - DNA, 13 bp, Homo sapiens
accttgcttttgc

SEQ ID NO: 699537 - DNA, 11 bp, Homo sapiens
accttggaagg

SEQ ID NO: 699538 - DNA, 18 bp, Homo sapiens
accttggacatcctcctc

SEQ ID NO: 699539 - DNA, 19 bp, Homo sapiens
accttggacatcctcctcc

SEQ ID NO: 699540 - DNA, 18 bp, Homo sapiens
accttggaccactcctgt

SEQ ID NO: 699541 - DNA, 17 bp, Homo sapiens
accttggaccctggtga

SEQ ID NO: 699542 - DNA, 17 bp, Homo sapiens
accttggactcctccca

SEQ ID NO: 699543 - DNA, 16 bp, Homo sapiens
accttggagaggagag

SEQ ID NO: 699544 - DNA, 13 bp, Homo sapiens
accttggaggagg

SEQ ID NO: 699545 - DNA, 17 bp, Homo sapiens
accttggcccaggagct

SEQ ID NO: 699546 - DNA, 18 bp, Homo sapiens
accttggcccaggagctc

SEQ ID NO: 699547 - DNA, 19 bp, Homo sapiens
accttggcctctccttgga

SEQ ID NO: 699548 - DNA, 16 bp, Homo sapiens
accttgggtggcccct

SEQ ID NO: 699549 - DNA, 23 bp, Homo sapiens
accttgtaaaaaaagcaaaaatg

SEQ ID NO: 699550 - DNA, 17 bp, Homo sapiens
accttgtcccagccagt

SEQ ID NO: 699551 - DNA, 14 bp, Homo sapiens
accttgtgatgact

SEQ ID NO: 699552 - DNA, 12 bp, Homo sapiens
accttgtgttta

SEQ ID NO: 699553 - DNA, 14 bp, Homo sapiens
accttgttctattt

SEQ ID NO: 699554 - DNA, 16 bp, Homo sapiens
accttgttggagcctg

SEQ ID NO: 699555 - DNA, 17 bp, Homo sapiens
accttgttggagcctgc

SEQ ID NO: 699556 - DNA, 18 bp, Homo sapiens
accttgttggagcctgca

SEQ ID NO: 699557 - DNA, 20 bp, Homo sapiens
accttgtttattaaattgca

SEQ ID NO: 699558 - DNA, 21 bp, Homo sapiens
accttgtttttaatctcctgt

SEQ ID NO: 699559 - DNA, 22 bp, Homo sapiens
acctttaagaaaaatgaaaact

SEQ ID NO: 699560 - DNA, 16 bp, Homo sapiens
acctttagaatatctt

SEQ ID NO: 699561 - DNA, 21 bp, Homo sapiens
acctttagggcagcttgcccc

SEQ ID NO: 699562 - DNA, 21 bp, Homo sapiens
acctttaggtcaaactcccta

SEQ ID NO: 699563 - DNA, 21 bp, Homo sapiens
acctttatatctgtcttttat

SEQ ID NO: 699564 - DNA, 15 bp, Homo sapiens
acctttatggtttct

SEQ ID NO: 699565 - DNA, 17 bp, Homo sapiens
acctttattaaaatctt

SEQ ID NO: 699566 - DNA, 20 bp, Homo sapiens
acctttattaaaatcttaaa

SEQ ID NO: 699567 - DNA, 23 bp, Homo sapiens
acctttcagtgcagtttcttttc

SEQ ID NO: 699568 - DNA, 18 bp, Homo sapiens
acctttccaccacagcca

SEQ ID NO: 699569 - DNA, 13 bp, Homo sapiens
acctttcccatct

SEQ ID NO: 699570 - DNA, 18 bp, Homo sapiens
acctttcccatcttccaa

SEQ ID NO: 699571 - DNA, 14 bp, Homo sapiens
acctttccctcacc

SEQ ID NO: 699572 - DNA, 21 bp, Homo sapiens
acctttccgctgtcgccccag

SEQ ID NO: 699573 - DNA, 20 bp, Homo sapiens
acctttcctttttggggagt

SEQ ID NO: 699574 - DNA, 18 bp, Homo sapiens
acctttctaggttcaaaa

SEQ ID NO: 699575 - DNA, 11 bp, Homo sapiens
acctttctagt

SEQ ID NO: 699576 - DNA, 14 bp, Homo sapiens
acctttctctgaga

SEQ ID NO: 699577 - DNA, 14 bp, Homo sapiens
acctttctgggctt

SEQ ID NO: 699578 - DNA, 22 bp, Homo sapiens
acctttgaaatattaaaatcac

SEQ ID NO: 699579 - DNA, 20 bp, Homo sapiens
acctttgatgaattcttcct

SEQ ID NO: 699580 - DNA, 11 bp, Homo sapiens
acctttgctat

SEQ ID NO: 699581 - DNA, 21 bp, Homo sapiens
acctttgggatcagcctccgc

SEQ ID NO: 699582 - DNA, 15 bp, Homo sapiens
acctttggtgcagag

SEQ ID NO: 699583 - DNA, 16 bp, Homo sapiens
acctttggtgcagagg

SEQ ID NO: 699584 - DNA, 19 bp, Homo sapiens
acctttgtaagacatttgt

SEQ ID NO: 699585 - DNA, 22 bp, Homo sapiens
acctttgtcttctataatattt

SEQ ID NO: 699586 - DNA, 16 bp, Homo sapiens
acctttgtgtattttt

SEQ ID NO: 699587 - DNA, 14 bp, Homo sapiens
accttttaactcac

SEQ ID NO: 699588 - DNA, 13 bp, Homo sapiens
accttttatacca

SEQ ID NO: 699589 - DNA, 13 bp, Homo sapiens
accttttattata

SEQ ID NO: 699590 - DNA, 11 bp, Homo sapiens
accttttcagg

SEQ ID NO: 699591 - DNA, 16 bp, Homo sapiens
accttttcaggaaaat

SEQ ID NO: 699592 - DNA, 18 bp, Homo sapiens
accttttcatgtacagca

SEQ ID NO: 699593 - DNA, 23 bp, Homo sapiens
accttttccccaaccacagagaa

SEQ ID NO: 699594 - DNA, 22 bp, Homo sapiens
accttttccttatactgtatat

SEQ ID NO: 699595 - DNA, 14 bp, Homo sapiens
accttttctataag

SEQ ID NO: 699596 - DNA, 16 bp, Homo sapiens
accttttctataagtt

SEQ ID NO: 699597 - DNA, 20 bp, Homo sapiens
accttttctgtggctggctc

SEQ ID NO: 699598 - DNA, 21 bp, Homo sapiens
accttttctgtggctggctct

SEQ ID NO: 699599 - DNA, 17 bp, Homo sapiens
accttttcttgtatctg

SEQ ID NO: 699600 - DNA, 21 bp, Homo sapiens
accttttggtcttcagcctcc

SEQ ID NO: 699601 - DNA, 15 bp, Homo sapiens
acctttttatattta

SEQ ID NO: 699602 - DNA, 13 bp, Homo sapiens
acctttttgtaaa

SEQ ID NO: 699603 - DNA, 21 bp, Homo sapiens
accttttttatacataaacaa

SEQ ID NO: 699604 - DNA, 13 bp, Homo sapiens
accttttttgtct

SEQ ID NO: 699605 - DNA, 13 bp, Homo sapiens
acgaaaaaatggt

SEQ ID NO: 699606 - DNA, 19 bp, Homo sapiens
acgaaaaagagcatatact

SEQ ID NO: 699607 - DNA, 14 bp, Homo sapiens
acgaaagaaatgta

SEQ ID NO: 699608 - DNA, 21 bp, Homo sapiens
acgaaataattgttgttctgt

SEQ ID NO: 699609 - DNA, 17 bp, Homo sapiens
acgaaatatcaaagtca

SEQ ID NO: 699610 - DNA, 12 bp, Homo sapiens
acgaaatgttat

SEQ ID NO: 699611 - DNA, 11 bp, Homo sapiens
acgaagaaaaa

SEQ ID NO: 699612 - DNA, 19 bp, Homo sapiens
acgaagacaaagtcccaga

SEQ ID NO: 699613 - DNA, 13 bp, Homo sapiens
acgaagacgccaa

SEQ ID NO: 699614 - DNA, 14 bp, Homo sapiens
acgaatacttttgc

SEQ ID NO: 699615 - DNA, 22 bp, Homo sapiens
acgaatacttttgccctttgat

SEQ ID NO: 699616 - DNA, 15 bp, Homo sapiens
acgaatagacatcaa

SEQ ID NO: 699617 - DNA, 16 bp, Homo sapiens
acgaatagacatcaaa

SEQ ID NO: 699618 - DNA, 16 bp, Homo sapiens
acgacaatgttgagaa

SEQ ID NO: 699619 - DNA, 21 bp, Homo sapiens
acgacacctggagactgtccc

SEQ ID NO: 699620 - DNA, 14 bp, Homo sapiens
acgacccctgcctc

SEQ ID NO: 699621 - DNA, 14 bp, Homo sapiens
acgacgccctctcc

SEQ ID NO: 699622 - DNA, 19 bp, Homo sapiens
acgacgtgggaatttcaat

SEQ ID NO: 699623 - DNA, 15 bp, Homo sapiens
acgactcaaaatgac

SEQ ID NO: 699624 - DNA, 16 bp, Homo sapiens
acgactcaaaatgaca

SEQ ID NO: 699625 - DNA, 16 bp, Homo sapiens
acgactctaaacacac

SEQ ID NO: 699626 - DNA, 16 bp, Homo sapiens
acgactcttcctgcaa

SEQ ID NO: 699627 - DNA, 14 bp, Homo sapiens
acgacttcagggca

SEQ ID NO: 699628 - DNA, 19 bp, Homo sapiens
acgagaccctacaggagag

SEQ ID NO: 699629 - DNA, 14 bp, Homo sapiens
acgagactttccat

SEQ ID NO: 699630 - DNA, 19 bp, Homo sapiens
acgagatcaagagatcaag

SEQ ID NO: 699631 - DNA, 15 bp, Homo sapiens
acgagatcttccttc

SEQ ID NO: 699632 - DNA, 16 bp, Homo sapiens
acgagatcttccttcc

SEQ ID NO: 699633 - DNA, 23 bp, Homo sapiens
acgagatttcttttttatgtgat

SEQ ID NO: 699634 - DNA, 16 bp, Homo sapiens
acgagcactggccaga

SEQ ID NO: 699635 - DNA, 21 bp, Homo sapiens
acgagcatccccctcctctcc

SEQ ID NO: 699636 - DNA, 14 bp, Homo sapiens
acgagccacaagct

SEQ ID NO: 699637 - DNA, 17 bp, Homo sapiens
acgagccacaagctgca

SEQ ID NO: 699638 - DNA, 20 bp, Homo sapiens
acgagccacaagctgcactg

SEQ ID NO: 699639 - DNA, 19 bp, Homo sapiens
acgagcctcctcagggggt

SEQ ID NO: 699640 - DNA, 19 bp, Homo sapiens
acgagctgtttactaggga

SEQ ID NO: 699641 - DNA, 20 bp, Homo sapiens
acgaggaaaaggtccttgcc

SEQ ID NO: 699642 - DNA, 15 bp, Homo sapiens
acgaggaaccgaaaa

SEQ ID NO: 699643 - DNA, 13 bp, Homo sapiens
acgaggagcagca

SEQ ID NO: 699644 - DNA, 15 bp, Homo sapiens
acgaggctgccccca

SEQ ID NO: 699645 - DNA, 18 bp, Homo sapiens
caagagccttggtgtcca

SEQ ID NO: 699646 - DNA, 18 bp, Homo sapiens
caagagcgaaactccgtc

SEQ ID NO: 699647 - DNA, 13 bp, Homo sapiens
caagagctgctgt

SEQ ID NO: 699648 - DNA, 23 bp, Homo sapiens
caagaggaaaggcgcccccgccc

SEQ ID NO: 699649 - DNA, 15 bp, Homo sapiens
caagaggaatctgtt

SEQ ID NO: 699650 - DNA, 13 bp, Homo sapiens
caagaggacacaa

SEQ ID NO: 699651 - DNA, 16 bp, Homo sapiens
caagaggacacaatgg

SEQ ID NO: 699652 - DNA, 14 bp, Homo sapiens
caagaggagatcca

SEQ ID NO: 699653 - DNA, 15 bp, Homo sapiens
caagaggcaagctga

SEQ ID NO: 699654 - DNA, 14 bp, Homo sapiens
caagaggctggttt

SEQ ID NO: 699655 - DNA, 16 bp, Homo sapiens
caagagggaacaaaac

SEQ ID NO: 699656 - DNA, 12 bp, Homo sapiens
caagagggaggg

SEQ ID NO: 699657 - DNA, 15 bp, Homo sapiens
caagagggcactggt

SEQ ID NO: 699658 - DNA, 17 bp, Homo sapiens
caagagggcactggtgg

SEQ ID NO: 699659 - DNA, 20 bp, Homo sapiens
caagagggcactggtggccc

SEQ ID NO: 699660 - DNA, 23 bp, Homo sapiens
caagaggggcgggctcagagctt

SEQ ID NO: 699661 - DNA, 15 bp, Homo sapiens
caagagggggacctg

SEQ ID NO: 699662 - DNA, 21 bp, Homo sapiens
caagagggggtggaggggtgt

SEQ ID NO: 699663 - DNA, 21 bp, Homo sapiens
caagaggggtggagactgctt

SEQ ID NO: 699664 - DNA, 21 bp, Homo sapiens
caagagggtctctttgttcaa

SEQ ID NO: 699665 - DNA, 14 bp, Homo sapiens
caagaggtctgagc

SEQ ID NO: 699666 - DNA, 18 bp, Homo sapiens
caagaggtctgagccctg

SEQ ID NO: 699667 - DNA, 22 bp, Homo sapiens
caagagtagttatataattgtt

SEQ ID NO: 699668 - DNA, 22 bp, Homo sapiens
caagagtccctttgaagataat

SEQ ID NO: 699669 - DNA, 18 bp, Homo sapiens
caagagtccggatttcta

SEQ ID NO: 699670 - DNA, 19 bp, Homo sapiens
caagagtccggatttctaa

SEQ ID NO: 699671 - DNA, 22 bp, Homo sapiens
caagagtccggatttctaacag

SEQ ID NO: 699672 - DNA, 22 bp, Homo sapiens
caagagtcgctgtgccacaggc

SEQ ID NO: 699673 - DNA, 20 bp, Homo sapiens
caagagtctaatagtctttg

SEQ ID NO: 699674 - DNA, 22 bp, Homo sapiens
caagagtggactgaatgtgcct

SEQ ID NO: 699675 - DNA, 17 bp, Homo sapiens
caagagtggggggagga

SEQ ID NO: 699676 - DNA, 20 bp, Homo sapiens
caagagtggggggaggaagc

SEQ ID NO: 699677 - DNA, 17 bp, Homo sapiens
caagagttcagtgctca

SEQ ID NO: 699678 - DNA, 22 bp, Homo sapiens
caagagtttatttccaaataaa

SEQ ID NO: 699679 - DNA, 14 bp, Homo sapiens
caagagttttaaca

SEQ ID NO: 699680 - DNA, 17 bp, Homo sapiens
caagatagatttggaat

SEQ ID NO: 699681 - DNA, 17 bp, Homo sapiens
caagataggagttctct

SEQ ID NO: 699682 - DNA, 21 bp, Homo sapiens
caagatatatgtgtatacata

SEQ ID NO: 699683 - DNA, 17 bp, Homo sapiens
caagatattgtacataa

SEQ ID NO: 699684 - DNA, 16 bp, Homo sapiens
caagatatttatatat

SEQ ID NO: 699685 - DNA, 16 bp, Homo sapiens
caagatcgcgccactg

SEQ ID NO: 699686 - DNA, 15 bp, Homo sapiens
caagatgaaataatt

SEQ ID NO: 699687 - DNA, 19 bp, Homo sapiens
caagatgaaataatttttc

SEQ ID NO: 699688 - DNA, 18 bp, Homo sapiens
caagatgaaggagaggca

SEQ ID NO: 699689 - DNA, 23 bp, Homo sapiens
caagatgaatgcagattacactg

SEQ ID NO: 699690 - DNA, 23 bp, Homo sapiens
caagatgagattggcatggcttt

SEQ ID NO: 699691 - DNA, 21 bp, Homo sapiens
caagatgagctgcagcccccc

SEQ ID NO: 699692 - DNA, 13 bp, Homo sapiens
caagatgagctgt

SEQ ID NO: 699693 - DNA, 13 bp, Homo sapiens
caagatgccctca

SEQ ID NO: 699694 - DNA, 17 bp, Homo sapiens
caagatggaagtcacct

SEQ ID NO: 699695 - DNA, 19 bp, Homo sapiens
caagatggaatttatcaaa

SEQ ID NO: 699696 - DNA, 16 bp, Homo sapiens
caagatggattaaaga

SEQ ID NO: 699697 - DNA, 19 bp, Homo sapiens
caagatggattaaagactt

SEQ ID NO: 699698 - DNA, 19 bp, Homo sapiens
caagatggcgaccaccaaa

SEQ ID NO: 699699 - DNA, 21 bp, Homo sapiens
caagatggcgaccaccaaagt

SEQ ID NO: 699700 - DNA, 17 bp, Homo sapiens
caagatgggcatctttt

SEQ ID NO: 699701 - DNA, 19 bp, Homo sapiens
caagatgggggcagggctg

SEQ ID NO: 699702 - DNA, 14 bp, Homo sapiens
caagatggtccatt

SEQ ID NO: 699703 - DNA, 22 bp, Homo sapiens
caagatggtccatttgttcctg

SEQ ID NO: 699704 - DNA, 15 bp, Homo sapiens
caagatgtcagactg

SEQ ID NO: 699705 - DNA, 12 bp, Homo sapiens
caagatgtgaat

SEQ ID NO: 699706 - DNA, 13 bp, Homo sapiens
caagatgtgaatt

SEQ ID NO: 699707 - DNA, 13 bp, Homo sapiens
caagatgtttctt

SEQ ID NO: 699708 - DNA, 14 bp, Homo sapiens
caagatgtttctta

SEQ ID NO: 699709 - DNA, 15 bp, Homo sapiens
caagattatgtgact

SEQ ID NO: 699710 - DNA, 13 bp, Homo sapiens
caagattcccaga

SEQ ID NO: 699711 - DNA, 14 bp, Homo sapiens
caagattcccagag

SEQ ID NO: 699712 - DNA, 18 bp, Homo sapiens
caagattcccagagacag

SEQ ID NO: 699713 - DNA, 19 bp, Homo sapiens
caagattcccagagacagg

SEQ ID NO: 699714 - DNA, 14 bp, Homo sapiens
caagattctaaagc

SEQ ID NO: 699715 - DNA, 16 bp, Homo sapiens
caagattctaaagctc

SEQ ID NO: 699716 - DNA, 13 bp, Homo sapiens
caagattgcttaa

SEQ ID NO: 699717 - DNA, 14 bp, Homo sapiens
caagattgttgata

SEQ ID NO: 699718 - DNA, 21 bp, Homo sapiens
caagatttccttaaaatctct

SEQ ID NO: 699719 - DNA, 17 bp, Homo sapiens
caagatttgaccaaatc

SEQ ID NO: 699720 - DNA, 22 bp, Homo sapiens
caagattttagggcttttattt

SEQ ID NO: 699721 - DNA, 22 bp, Homo sapiens
caagattttgaatgcttcctga

SEQ ID NO: 699722 - DNA, 23 bp, Homo sapiens
caagattttttttttaagtgaca

SEQ ID NO: 699723 - DNA, 23 bp, Homo sapiens
caagcaaacatcaaataaatttc

SEQ ID NO: 699724 - DNA, 19 bp, Homo sapiens
caagcaaaggtgaagagac

SEQ ID NO: 699725 - DNA, 21 bp, Homo sapiens
caagcaaagtatcaaagaaaa

SEQ ID NO: 699726 - DNA, 22 bp, Homo sapiens
caagcaacatttgtatggattt

SEQ ID NO: 699727 - DNA, 16 bp, Homo sapiens
caagcaagatgagctg

SEQ ID NO: 699728 - DNA, 17 bp, Homo sapiens
caagcaaggatatcaga

SEQ ID NO: 699729 - DNA, 19 bp, Homo sapiens
caagcaaggatatcagagc

SEQ ID NO: 699730 - DNA, 14 bp, Homo sapiens
caagcaataattgt

SEQ ID NO: 699731 - DNA, 16 bp, Homo sapiens
caagcaataattgttt

SEQ ID NO: 699732 - DNA, 13 bp, Homo sapiens
caagcaatcctcc

SEQ ID NO: 699733 - DNA, 14 bp, Homo sapiens
caagcaatcctcct

SEQ ID NO: 699734 - DNA, 16 bp, Homo sapiens
caagcaatcctcctgc

SEQ ID NO: 699735 - DNA, 18 bp, Homo sapiens
caagcacagagcctggcc

SEQ ID NO: 699736 - DNA, 22 bp, Homo sapiens
caagcacagagcctggccccag

SEQ ID NO: 699737 - DNA, 13 bp, Homo sapiens
caagcacagcagc

SEQ ID NO: 699738 - DNA, 14 bp, Homo sapiens
caagcacagccctt

SEQ ID NO: 699739 - DNA, 13 bp, Homo sapiens
caagcacatgtaa

SEQ ID NO: 699740 - DNA, 22 bp, Homo sapiens
caagcaccaggaagtgtttatg

SEQ ID NO: 699741 - DNA, 15 bp, Homo sapiens
caagcactattttat

SEQ ID NO: 699742 - DNA, 18 bp, Homo sapiens
caagcactcgagaccatc

SEQ ID NO: 699743 - DNA, 20 bp, Homo sapiens
caagcagactccagcccctg

SEQ ID NO: 699744 - DNA, 18 bp, Homo sapiens
caagcagaggtggccaga

SEQ ID NO: 699745 - DNA, 17 bp, Homo sapiens
caagcagccagccagtc

SEQ ID NO: 699746 - DNA, 21 bp, Homo sapiens
caagcagcctgagcaactctt

SEQ ID NO: 699747 - DNA, 16 bp, Homo sapiens
caagcagcctggagac

SEQ ID NO: 699748 - DNA, 18 bp, Homo sapiens
caagcagcctggagactt

SEQ ID NO: 699749 - DNA, 17 bp, Homo sapiens
caagcagctttttattc

SEQ ID NO: 699750 - DNA, 17 bp, Homo sapiens
caagcaggaaatgaaaa

SEQ ID NO: 699751 - DNA, 16 bp, Homo sapiens
caagcagtcgtgcctg

SEQ ID NO: 699752 - DNA, 19 bp, Homo sapiens
caagcagtcgtgcctgtgt

SEQ ID NO: 699753 - DNA, 22 bp, Homo sapiens
caagcataacatggagctcttg

SEQ ID NO: 699754 - DNA, 16 bp, Homo sapiens
caagcatcactgcccg

SEQ ID NO: 699755 - DNA, 22 bp, Homo sapiens
caagcatgatcttgttactgtg

SEQ ID NO: 699756 - DNA, 13 bp, Homo sapiens
caagcatgcaata

SEQ ID NO: 699757 - DNA, 15 bp, Homo sapiens
caagcatgtattttt

SEQ ID NO: 699758 - DNA, 22 bp, Homo sapiens
caagcatgtctctctgccaaga

SEQ ID NO: 699759 - DNA, 17 bp, Homo sapiens
caagcattcagaagaaa

SEQ ID NO: 699760 - DNA, 12 bp, Homo sapiens
caagcatttcat

SEQ ID NO: 699761 - DNA, 13 bp, Homo sapiens
caagcatttcatg

SEQ ID NO: 699762 - DNA, 20 bp, Homo sapiens
caagcatttcatgaaaaagc

SEQ ID NO: 699763 - DNA, 20 bp, Homo sapiens
caagccaaagagcctcccac

SEQ ID NO: 699764 - DNA, 18 bp, Homo sapiens
caagccaacgacaaagcc

SEQ ID NO: 699765 - DNA, 19 bp, Homo sapiens
caagccaacgacaaagcca

SEQ ID NO: 699766 - DNA, 17 bp, Homo sapiens
caagccaagaaagatgt

SEQ ID NO: 699767 - DNA, 18 bp, Homo sapiens
caagccaagggaacctgt

SEQ ID NO: 699768 - DNA, 22 bp, Homo sapiens
caagccaagggaacctgtgtcc

SEQ ID NO: 699769 - DNA, 17 bp, Homo sapiens
acgaggctgcccccatc

SEQ ID NO: 699770 - DNA, 21 bp, Homo sapiens
acgagggctgatggaggaaaa

SEQ ID NO: 699771 - DNA, 11 bp, Homo sapiens
acgagggctgg

SEQ ID NO: 699772 - DNA, 12 bp, Homo sapiens
acgagggctggc

SEQ ID NO: 699773 - DNA, 20 bp, Homo sapiens
acgaggggcttcctctagag

SEQ ID NO: 699774 - DNA, 17 bp, Homo sapiens
acgagggtctcccctcc

SEQ ID NO: 699775 - DNA, 20 bp, Homo sapiens
acgagggtctcccctcctgc

SEQ ID NO: 699776 - DNA, 21 bp, Homo sapiens
acgaggttaaagaagctgcat

SEQ ID NO: 699777 - DNA, 17 bp, Homo sapiens
acgagtcaatcccctca

SEQ ID NO: 699778 - DNA, 23 bp, Homo sapiens
acgagtttggatgttgtaaataa

SEQ ID NO: 699779 - DNA, 19 bp, Homo sapiens
acgatcaagttgttgactg

SEQ ID NO: 699780 - DNA, 17 bp, Homo sapiens
acgatcccctcccccaa

SEQ ID NO: 699781 - DNA, 14 bp, Homo sapiens
acgatgacagtgtt

SEQ ID NO: 699782 - DNA, 19 bp, Homo sapiens
acgatgcatttaataaaga

SEQ ID NO: 699783 - DNA, 14 bp, Homo sapiens
acgatgtggccctg

SEQ ID NO: 699784 - DNA, 17 bp, Homo sapiens
acgatgtggccctggcc

SEQ ID NO: 699785 - DNA, 18 bp, Homo sapiens
acgatgtggccctggcct

SEQ ID NO: 699786 - DNA, 23 bp, Homo sapiens
acgatgtgtctgtatttcatgtg

SEQ ID NO: 699787 - DNA, 16 bp, Homo sapiens
acgattatacttgaga

SEQ ID NO: 699788 - DNA, 19 bp, Homo sapiens
acgattcatttttgaaact

SEQ ID NO: 699789 - DNA, 18 bp, Homo sapiens
acgatttagaaagaagcc

SEQ ID NO: 699790 - DNA, 12 bp, Homo sapiens
acgatttctgtt

SEQ ID NO: 699791 - DNA, 14 bp, Homo sapiens
acgatttctgttta

SEQ ID NO: 699792 - DNA, 20 bp, Homo sapiens
acgatttctgtttagataat

SEQ ID NO: 699793 - DNA, 11 bp, Homo sapiens
acgatttgtct

SEQ ID NO: 699794 - DNA, 14 bp, Homo sapiens
acgcaaggaaggac

SEQ ID NO: 699795 - DNA, 16 bp, Homo sapiens
acgcaattaaaaataa

SEQ ID NO: 699796 - DNA, 14 bp, Homo sapiens
acgcacacacacaa

SEQ ID NO: 699797 - DNA, 21 bp, Homo sapiens
acgcacacacacacacaggag

SEQ ID NO: 699798 - DNA, 16 bp, Homo sapiens
acgcacacacacatac

SEQ ID NO: 699799 - DNA, 13 bp, Homo sapiens
acgcacaccctgc

SEQ ID NO: 699800 - DNA, 15 bp, Homo sapiens
acgcacacgcacaca

SEQ ID NO: 699801 - DNA, 14 bp, Homo sapiens
acgcacagtgcagt

SEQ ID NO: 699802 - DNA, 15 bp, Homo sapiens
acgcacagtgcagtt

SEQ ID NO: 699803 - DNA, 15 bp, Homo sapiens
acgcaccactgccaa

SEQ ID NO: 699804 - DNA, 18 bp, Homo sapiens
acgcaccccactgggaga

SEQ ID NO: 699805 - DNA, 14 bp, Homo sapiens
acgcacctgcctca

SEQ ID NO: 699806 - DNA, 14 bp, Homo sapiens
acgcacctgtagtc

SEQ ID NO: 699807 - DNA, 19 bp, Homo sapiens
acgcacctgtagtcccagc

SEQ ID NO: 699808 - DNA, 14 bp, Homo sapiens
acgcacgcacacac

SEQ ID NO: 699809 - DNA, 16 bp, Homo sapiens
acgcacgcacacacac

SEQ ID NO: 699810 - DNA, 16 bp, Homo sapiens
acgcacgctcgctgcc

SEQ ID NO: 699811 - DNA, 17 bp, Homo sapiens
acgcacgctcgctgcca

SEQ ID NO: 699812 - DNA, 17 bp, Homo sapiens
acgcactccatgagcac

SEQ ID NO: 699813 - DNA, 21 bp, Homo sapiens
acgcactccatgagcacccca

SEQ ID NO: 699814 - DNA, 13 bp, Homo sapiens
acgcagcaccctt

SEQ ID NO: 699815 - DNA, 22 bp, Homo sapiens
acgcagccctgctttgggctgc

SEQ ID NO: 699816 - DNA, 19 bp, Homo sapiens
acgcagccggagggaggca

SEQ ID NO: 699817 - DNA, 11 bp, Homo sapiens
acgcagcctcc

SEQ ID NO: 699818 - DNA, 16 bp, Homo sapiens
acgcaggaactcccag

SEQ ID NO: 699819 - DNA, 23 bp, Homo sapiens
acgcaggccacccgggctgcctg

SEQ ID NO: 699820 - DNA, 16 bp, Homo sapiens
acgcaggccctgtcca

SEQ ID NO: 699821 - DNA, 18 bp, Homo sapiens
acgcaggcggccagggcg

SEQ ID NO: 699822 - DNA, 16 bp, Homo sapiens
acgcaggctgagtcca

SEQ ID NO: 699823 - DNA, 18 bp, Homo sapiens
acgcaggctgagtccaga

SEQ ID NO: 699824 - DNA, 18 bp, Homo sapiens
acgcaggggccctgagcc

SEQ ID NO: 699825 - DNA, 19 bp, Homo sapiens
acgcaggggccctgagcca

SEQ ID NO: 699826 - DNA, 14 bp, Homo sapiens
acgcaggggctctg

SEQ ID NO: 699827 - DNA, 17 bp, Homo sapiens
acgcaggggttgcagtg

SEQ ID NO: 699828 - DNA, 18 bp, Homo sapiens
acgcatacacacatgccc

SEQ ID NO: 699829 - DNA, 22 bp, Homo sapiens
acgcatagactgaggtataaag

SEQ ID NO: 699830 - DNA, 22 bp, Homo sapiens
acgcatctcaaaacagagggct

SEQ ID NO: 699831 - DNA, 22 bp, Homo sapiens
acgcatggagtgtgtattgttc

SEQ ID NO: 699832 - DNA, 14 bp, Homo sapiens
acgcatgggcattg

SEQ ID NO: 699833 - DNA, 21 bp, Homo sapiens
acgcatgggcattgcagcctt

SEQ ID NO: 699834 - DNA, 16 bp, Homo sapiens
acgcattaagaggttt

SEQ ID NO: 699835 - DNA, 22 bp, Homo sapiens
acgccaaagtgcagcccttcct

SEQ ID NO: 699836 - DNA, 20 bp, Homo sapiens
acgccacccccgcccccacc

SEQ ID NO: 699837 - DNA, 12 bp, Homo sapiens
acgccactcatt

SEQ ID NO: 699838 - DNA, 16 bp, Homo sapiens
acgccactcatttcat

SEQ ID NO: 699839 - DNA, 20 bp, Homo sapiens
acgccactgcactccagcct

SEQ ID NO: 699840 - DNA, 15 bp, Homo sapiens
acgccagataaaatg

SEQ ID NO: 699841 - DNA, 14 bp, Homo sapiens
acgccagctcctct

SEQ ID NO: 699842 - DNA, 15 bp, Homo sapiens
acgccagctcctctc

SEQ ID NO: 699843 - DNA, 22 bp, Homo sapiens
acgccagtctcccaggccccct

SEQ ID NO: 699844 - DNA, 15 bp, Homo sapiens
acgccattggttgga

SEQ ID NO: 699845 - DNA, 15 bp, Homo sapiens
acgcccagctccgcc

SEQ ID NO: 699846 - DNA, 14 bp, Homo sapiens
acgcccaggacagc

SEQ ID NO: 699847 - DNA, 14 bp, Homo sapiens
acgcccatgtgtga

SEQ ID NO: 699848 - DNA, 21 bp, Homo sapiens
acgccccagataccagcccct

SEQ ID NO: 699849 - DNA, 13 bp, Homo sapiens
acgccccagcccg

SEQ ID NO: 699850 - DNA, 14 bp, Homo sapiens
acgcccccccccac

SEQ ID NO: 699851 - DNA, 16 bp, Homo sapiens
acgcccccccccaccc

SEQ ID NO: 699852 - DNA, 23 bp, Homo sapiens
acgcccccccccacccctggggg

SEQ ID NO: 699853 - DNA, 22 bp, Homo sapiens
acgccccgaacctcacctgacc

SEQ ID NO: 699854 - DNA, 16 bp, Homo sapiens
acgccccgctgtgtcc

SEQ ID NO: 699855 - DNA, 12 bp, Homo sapiens
acgcccctccaa

SEQ ID NO: 699856 - DNA, 16 bp, Homo sapiens
acgcccctccaaacct

SEQ ID NO: 699857 - DNA, 19 bp, Homo sapiens
acgcccctccaaacctcca

SEQ ID NO: 699858 - DNA, 21 bp, Homo sapiens
acgcccctccaaacctccagc

SEQ ID NO: 699859 - DNA, 22 bp, Homo sapiens
acgcccctccaaacctccagcc

SEQ ID NO: 699860 - DNA, 15 bp, Homo sapiens
acgcccctcccaagc

SEQ ID NO: 699861 - DNA, 19 bp, Homo sapiens
acgcccgtcctgcctgtgg

SEQ ID NO: 699862 - DNA, 16 bp, Homo sapiens
acgccctactccactg

SEQ ID NO: 699863 - DNA, 13 bp, Homo sapiens
acgccctatttct

SEQ ID NO: 699864 - DNA, 22 bp, Homo sapiens
acgccctatttctatgtcattt

SEQ ID NO: 699865 - DNA, 15 bp, Homo sapiens
acgccctctcctccc

SEQ ID NO: 699866 - DNA, 12 bp, Homo sapiens
acgccgagtgca

SEQ ID NO: 699867 - DNA, 13 bp, Homo sapiens
acgccgccctcca

SEQ ID NO: 699868 - DNA, 15 bp, Homo sapiens
acgccgccctccatc

SEQ ID NO: 699869 - DNA, 20 bp, Homo sapiens
acgccggcctctgctgcccc

SEQ ID NO: 699870 - DNA, 21 bp, Homo sapiens
acgccgtcccaccagcttcac

SEQ ID NO: 699871 - DNA, 14 bp, Homo sapiens
acgcctatgccctg

SEQ ID NO: 699872 - DNA, 12 bp, Homo sapiens
acgcctcctggc

SEQ ID NO: 699873 - DNA, 13 bp, Homo sapiens
acgcctcctggcc

SEQ ID NO: 699874 - DNA, 19 bp, Homo sapiens
acgcctctcctcaatgctg

SEQ ID NO: 699875 - DNA, 16 bp, Homo sapiens
acgcctcttgaccagg

SEQ ID NO: 699876 - DNA, 20 bp, Homo sapiens
acgcctcttttccctctcta

SEQ ID NO: 699877 - DNA, 14 bp, Homo sapiens
acgcctgagacagc

SEQ ID NO: 699878 - DNA, 15 bp, Homo sapiens
acgcctgagacagca

SEQ ID NO: 699879 - DNA, 22 bp, Homo sapiens
acgcctgcaggagagagcagca

SEQ ID NO: 699880 - DNA, 18 bp, Homo sapiens
acgcctgcaggctggaga

SEQ ID NO: 699881 - DNA, 16 bp, Homo sapiens
acgcctgtaatcccag

SEQ ID NO: 699882 - DNA, 17 bp, Homo sapiens
acgcctgtaatcccagc

SEQ ID NO: 699883 - DNA, 19 bp, Homo sapiens
acgcctgtaatcccagcac

SEQ ID NO: 699884 - DNA, 20 bp, Homo sapiens
acgcctgtaatcccagcact

SEQ ID NO: 699885 - DNA, 20 bp, Homo sapiens
acgcctgtcctcctggaagg

SEQ ID NO: 699886 - DNA, 16 bp, Homo sapiens
acgcctgtctgtgtgc

SEQ ID NO: 699887 - DNA, 17 bp, Homo sapiens
acgccttcctctctgga

SEQ ID NO: 699888 - DNA, 18 bp, Homo sapiens
acgcctttaaaggttttt

SEQ ID NO: 699889 - DNA, 22 bp, Homo sapiens
acgcctttaaaggtttttaaat

SEQ ID NO: 699890 - DNA, 22 bp, Homo sapiens
acgccttttcttggttcttttt

SEQ ID NO: 699891 - DNA, 22 bp, Homo sapiens
acgcgacttccacaaacctgga

SEQ ID NO: 699892 - DNA, 18 bp, Homo sapiens
acgcggaggaggaagagg

SEQ ID NO: 699893 - DNA, 18 bp, Homo sapiens
acgcgggcttctggagct

SEQ ID NO: 699894 - DNA, 23 bp, Homo sapiens
caagccaagggaacctgtgtccg

SEQ ID NO: 699895 - DNA, 14 bp, Homo sapiens
caagccaatcccct

SEQ ID NO: 699896 - DNA, 20 bp, Homo sapiens
caagccacaagtcttccaga

SEQ ID NO: 699897 - DNA, 22 bp, Homo sapiens
caagccacagaagccaggagca

SEQ ID NO: 699898 - DNA, 16 bp, Homo sapiens
caagccacaggaagga

SEQ ID NO: 699899 - DNA, 14 bp, Homo sapiens
caagccagacctag

SEQ ID NO: 699900 - DNA, 12 bp, Homo sapiens
caagccagcccc

SEQ ID NO: 699901 - DNA, 14 bp, Homo sapiens
caagccagccccct

SEQ ID NO: 699902 - DNA, 13 bp, Homo sapiens
caagccagggccc

SEQ ID NO: 699903 - DNA, 20 bp, Homo sapiens
caagccagggcccagagccc

SEQ ID NO: 699904 - DNA, 23 bp, Homo sapiens
caagccagggcccagagcccttg

SEQ ID NO: 699905 - DNA, 20 bp, Homo sapiens
caagccagttctccttccct

SEQ ID NO: 699906 - DNA, 10 bp, Homo sapiens
caagccataa

SEQ ID NO: 699907 - DNA, 20 bp, Homo sapiens
caagccataacgtgccccca

SEQ ID NO: 699908 - DNA, 15 bp, Homo sapiens
caagccccagggcct

SEQ ID NO: 699909 - DNA, 18 bp, Homo sapiens
caagccccagggcctggg

SEQ ID NO: 699910 - DNA, 19 bp, Homo sapiens
caagccccagggcctgggg

SEQ ID NO: 699911 - DNA, 21 bp, Homo sapiens
caagccccagggcctgggggc

SEQ ID NO: 699912 - DNA, 20 bp, Homo sapiens
caagccccatctcatcctgg

SEQ ID NO: 699913 - DNA, 16 bp, Homo sapiens
caagccccccacacct

SEQ ID NO: 699914 - DNA, 13 bp, Homo sapiens
caagccccctggc

SEQ ID NO: 699915 - DNA, 22 bp, Homo sapiens
caagccccctggcagctgcccc

SEQ ID NO: 699916 - DNA, 20 bp, Homo sapiens
caagcccctgccctggggag

SEQ ID NO: 699917 - DNA, 20 bp, Homo sapiens
caagcccgcctccagcacca

SEQ ID NO: 699918 - DNA, 17 bp, Homo sapiens
caagccctaagcctgtc

SEQ ID NO: 699919 - DNA, 18 bp, Homo sapiens
caagccctaagcctgtcc

SEQ ID NO: 699920 - DNA, 11 bp, Homo sapiens
caagccctggc

SEQ ID NO: 699921 - DNA, 16 bp, Homo sapiens
caagcccttggggagg

SEQ ID NO: 699922 - DNA, 16 bp, Homo sapiens
caagccgaccttccct

SEQ ID NO: 699923 - DNA, 14 bp, Homo sapiens
caagccgtggcttc

SEQ ID NO: 699924 - DNA, 17 bp, Homo sapiens
caagccgtggcttcccg

SEQ ID NO: 699925 - DNA, 13 bp, Homo sapiens
caagcctcaaagt

SEQ ID NO: 699926 - DNA, 18 bp, Homo sapiens
caagcctcttattccagg

SEQ ID NO: 699927 - DNA, 10 bp, Homo sapiens
caagcctggc

SEQ ID NO: 699928 - DNA, 12 bp, Homo sapiens
caagcctggcac

SEQ ID NO: 699929 - DNA, 14 bp, Homo sapiens
caagcctggcaccc

SEQ ID NO: 699930 - DNA, 20 bp, Homo sapiens
caagcctggcacccaccgtc

SEQ ID NO: 699931 - DNA, 18 bp, Homo sapiens
caagcctgtaatcccagc

SEQ ID NO: 699932 - DNA, 14 bp, Homo sapiens
caagcctgtccatt

SEQ ID NO: 699933 - DNA, 18 bp, Homo sapiens
caagcctttatggctgct

SEQ ID NO: 699934 - DNA, 17 bp, Homo sapiens
caagcgaggtcaacaga

SEQ ID NO: 699935 - DNA, 12 bp, Homo sapiens
caagcgctcatg

SEQ ID NO: 699936 - DNA, 13 bp, Homo sapiens
caagcgctccagg

SEQ ID NO: 699937 - DNA, 16 bp, Homo sapiens
caagcgctccagggcc

SEQ ID NO: 699938 - DNA, 18 bp, Homo sapiens
caagcggctcaagaataa

SEQ ID NO: 699939 - DNA, 16 bp, Homo sapiens
caagcgggggcgtggc

SEQ ID NO: 699940 - DNA, 15 bp, Homo sapiens
caagcgggtggctct

SEQ ID NO: 699941 - DNA, 22 bp, Homo sapiens
caagcgtcacttctcctgctgc

SEQ ID NO: 699942 - DNA, 19 bp, Homo sapiens
caagcgttcctggccttct

SEQ ID NO: 699943 - DNA, 17 bp, Homo sapiens
caagctagaaggccaca

SEQ ID NO: 699944 - DNA, 16 bp, Homo sapiens
caagctatctaaagtt

SEQ ID NO: 699945 - DNA, 20 bp, Homo sapiens
caagctattcctttcccttc

SEQ ID NO: 699946 - DNA, 15 bp, Homo sapiens
caagctatttaatat

SEQ ID NO: 699947 - DNA, 16 bp, Homo sapiens
caagctcacagttcct

SEQ ID NO: 699948 - DNA, 21 bp, Homo sapiens
caagctcacagttcctcgccc

SEQ ID NO: 699949 - DNA, 17 bp, Homo sapiens
caagctccatctccact

SEQ ID NO: 699950 - DNA, 18 bp, Homo sapiens
caagctccctggagccct

SEQ ID NO: 699951 - DNA, 19 bp, Homo sapiens
caagctccctggagccctg

SEQ ID NO: 699952 - DNA, 16 bp, Homo sapiens
caagctctcgggacta

SEQ ID NO: 699953 - DNA, 23 bp, Homo sapiens
caagctctcgggactagctgcct

SEQ ID NO: 699954 - DNA, 15 bp, Homo sapiens
caagctctctgttgc

SEQ ID NO: 699955 - DNA, 13 bp, Homo sapiens
caagctctgggga

SEQ ID NO: 699956 - DNA, 17 bp, Homo sapiens
caagctctggggatggg

SEQ ID NO: 699957 - DNA, 18 bp, Homo sapiens
caagctcttgccccactc

SEQ ID NO: 699958 - DNA, 13 bp, Homo sapiens
caagctgaaattt

SEQ ID NO: 699959 - DNA, 15 bp, Homo sapiens
caagctgaagctaca

SEQ ID NO: 699960 - DNA, 21 bp, Homo sapiens
caagctgagaaaagtattctc

SEQ ID NO: 699961 - DNA, 22 bp, Homo sapiens
caagctgagtttcctatgggaa

SEQ ID NO: 699962 - DNA, 23 bp, Homo sapiens
caagctgagtttcctatgggaac

SEQ ID NO: 699963 - DNA, 10 bp, Homo sapiens
caagctgcac

SEQ ID NO: 699964 - DNA, 20 bp, Homo sapiens
caagctgcaccctcaggcag

SEQ ID NO: 699965 - DNA, 21 bp, Homo sapiens
caagctgccatcccctccccg

SEQ ID NO: 699966 - DNA, 12 bp, Homo sapiens
caagctgcctct

SEQ ID NO: 699967 - DNA, 14 bp, Homo sapiens
caagctgcctctgg

SEQ ID NO: 699968 - DNA, 17 bp, Homo sapiens
caagctgcctctgggcc

SEQ ID NO: 699969 - DNA, 18 bp, Homo sapiens
caagctgcctctgggcca

SEQ ID NO: 699970 - DNA, 22 bp, Homo sapiens
caagctgctctgagccacagtg

SEQ ID NO: 699971 - DNA, 23 bp, Homo sapiens
caagctgcttgtcctgggcctgc

SEQ ID NO: 699972 - DNA, 21 bp, Homo sapiens
caagctggccactatcacata

SEQ ID NO: 699973 - DNA, 13 bp, Homo sapiens
caagctggcttct

SEQ ID NO: 699974 - DNA, 15 bp, Homo sapiens
caagctggcttctgt

SEQ ID NO: 699975 - DNA, 20 bp, Homo sapiens
caagctgtacccttgagacc

SEQ ID NO: 699976 - DNA, 11 bp, Homo sapiens
caagctgtctc

SEQ ID NO: 699977 - DNA, 23 bp, Homo sapiens
caagctgtgagacagtgggaaat

SEQ ID NO: 699978 - DNA, 12 bp, Homo sapiens
caagctgtgcag

SEQ ID NO: 699979 - DNA, 14 bp, Homo sapiens
caagctgtgcaggc

SEQ ID NO: 699980 - DNA, 22 bp, Homo sapiens
caagctgtggcagccgtcccag

SEQ ID NO: 699981 - DNA, 16 bp, Homo sapiens
caagctgttttcttct

SEQ ID NO: 699982 - DNA, 12 bp, Homo sapiens
caagcttccctc

SEQ ID NO: 699983 - DNA, 24 bp, Homo sapiens
caagcttcctgtgccctcacccca

SEQ ID NO: 699984 - DNA, 13 bp, Homo sapiens
caagcttggcagc

SEQ ID NO: 699985 - DNA, 14 bp, Homo sapiens
caagcttggcagcc

SEQ ID NO: 699986 - DNA, 20 bp, Homo sapiens
caagcttggcagccgagctc

SEQ ID NO: 699987 - DNA, 16 bp, Homo sapiens
caagcttggtcaaact

SEQ ID NO: 699988 - DNA, 17 bp, Homo sapiens
caagcttggtcaaactt

SEQ ID NO: 699989 - DNA, 13 bp, Homo sapiens
caagcttgtgtac

SEQ ID NO: 699990 - DNA, 15 bp, Homo sapiens
caagcttttgcttga

SEQ ID NO: 699991 - DNA, 15 bp, Homo sapiens
caaggaaaaacaggt

SEQ ID NO: 699992 - DNA, 16 bp, Homo sapiens
caaggaaaatctatat

SEQ ID NO: 699993 - DNA, 22 bp, Homo sapiens
caaggaaaatctatatttgtct

SEQ ID NO: 699994 - DNA, 18 bp, Homo sapiens
caaggaaaattgaaagta

SEQ ID NO: 699995 - DNA, 22 bp, Homo sapiens
caaggaaaccgcctagtttact

SEQ ID NO: 699996 - DNA, 19 bp, Homo sapiens
caaggaaaggggagaaggg

SEQ ID NO: 699997 - DNA, 17 bp, Homo sapiens
caaggaaagtgaacctt

SEQ ID NO: 699998 - DNA, 20 bp, Homo sapiens
caaggaaatgtcctgcatgg

SEQ ID NO: 699999 - DNA, 19 bp, Homo sapiens
caaggaaccctcaggccac

SEQ ID NO: 700000 - DNA, 20 bp, Homo sapiens
caaggaaccctcaggccacc

SEQ ID NO: 700001 - DNA, 13 bp, Homo sapiens
caaggaagaaaac

SEQ ID NO: 700002 - DNA, 17 bp, Homo sapiens
caaggaagaagaaatct

SEQ ID NO: 700003 - DNA, 21 bp, Homo sapiens
caaggaagccaaagttttcaa

SEQ ID NO: 700004 - DNA, 10 bp, Homo sapiens
caaggaagct

SEQ ID NO: 700005 - DNA, 19 bp, Homo sapiens
caaggaagctccttcctgt

SEQ ID NO: 700006 - DNA, 15 bp, Homo sapiens
caaggaaggacttac

SEQ ID NO: 700007 - DNA, 11 bp, Homo sapiens
caaggaaggag

SEQ ID NO: 700008 - DNA, 14 bp, Homo sapiens
caaggaaggagccc

SEQ ID NO: 700009 - DNA, 16 bp, Homo sapiens
caaggaatcagcagga

SEQ ID NO: 700010 - DNA, 18 bp, Homo sapiens
caaggaatccatcctgca

SEQ ID NO: 700011 - DNA, 19 bp, Homo sapiens
caaggaatgcctgtgccaa

SEQ ID NO: 700012 - DNA, 21 bp, Homo sapiens
caaggaatgcctgtgccaata

SEQ ID NO: 700013 - DNA, 20 bp, Homo sapiens
caaggaatttccctgtgtgg

SEQ ID NO: 700014 - DNA, 22 bp, Homo sapiens
caaggaatttccctgtgtggat

SEQ ID NO: 700015 - DNA, 15 bp, Homo sapiens
caaggaatttcttaa

SEQ ID NO: 700016 - DNA, 14 bp, Homo sapiens
caaggacagacagc

SEQ ID NO: 700017 - DNA, 15 bp, Homo sapiens
caaggacagacagca

SEQ ID NO: 700018 - DNA, 18 bp, Homo sapiens
caaggacagacagcaggc

SEQ ID NO: 700019 - DNA, 20 bp, Homo sapiens
acgcgtatctaggctttggt

SEQ ID NO: 700020 - DNA, 14 bp, Homo sapiens
acgcgtctgcctgg

SEQ ID NO: 700021 - DNA, 15 bp, Homo sapiens
acgcgtcttcctgag

SEQ ID NO: 700022 - DNA, 15 bp, Homo sapiens
acgcgtgattgaccc

SEQ ID NO: 700023 - DNA, 23 bp, Homo sapiens
acgcgtgtgtacacgggactgac

SEQ ID NO: 700024 - DNA, 18 bp, Homo sapiens
acgctaaagagcccttgc

SEQ ID NO: 700025 - DNA, 20 bp, Homo sapiens
acgctaaagagcccttgcct

SEQ ID NO: 700026 - DNA, 20 bp, Homo sapiens
acgctacctctctgtccctt

SEQ ID NO: 700027 - DNA, 22 bp, Homo sapiens
acgctacggggaaaatgcattt

SEQ ID NO: 700028 - DNA, 19 bp, Homo sapiens
acgctactataaagagaag

SEQ ID NO: 700029 - DNA, 14 bp, Homo sapiens
acgctcagtgcccg

SEQ ID NO: 700030 - DNA, 14 bp, Homo sapiens
acgctccagctgcc

SEQ ID NO: 700031 - DNA, 21 bp, Homo sapiens
acgctcccccgcagtccccag

SEQ ID NO: 700032 - DNA, 19 bp, Homo sapiens
acgctcccctgagaggttt

SEQ ID NO: 700033 - DNA, 13 bp, Homo sapiens
acgctcctttgtg

SEQ ID NO: 700034 - DNA, 11 bp, Homo sapiens
acgctctcctc

SEQ ID NO: 700035 - DNA, 21 bp, Homo sapiens
acgctctcctcgagccctccc

SEQ ID NO: 700036 - DNA, 23 bp, Homo sapiens
acgctgaccatgcgtcaggggcc

SEQ ID NO: 700037 - DNA, 14 bp, Homo sapiens
acgctgcagagcac

SEQ ID NO: 700038 - DNA, 14 bp, Homo sapiens
acgctgcccagggg

SEQ ID NO: 700039 - DNA, 21 bp, Homo sapiens
acgctgcccaggggcttcaga

SEQ ID NO: 700040 - DNA, 22 bp, Homo sapiens
acgctgccgctgccgctgcacc

SEQ ID NO: 700041 - DNA, 19 bp, Homo sapiens
acgctgcctggtctgtctg

SEQ ID NO: 700042 - DNA, 20 bp, Homo sapiens
acgctgcctggtctgtctgg

SEQ ID NO: 700043 - DNA, 21 bp, Homo sapiens
acgctgctgtcacaaccaaga

SEQ ID NO: 700044 - DNA, 14 bp, Homo sapiens
acgctggagatgca

SEQ ID NO: 700045 - DNA, 23 bp, Homo sapiens
acgctggagatgcaaggtgctgg

SEQ ID NO: 700046 - DNA, 18 bp, Homo sapiens
acgctggcaacacagagg

SEQ ID NO: 700047 - DNA, 22 bp, Homo sapiens
acgctggcgacacactccgtcc

SEQ ID NO: 700048 - DNA, 11 bp, Homo sapiens
acgctgtctcc

SEQ ID NO: 700049 - DNA, 12 bp, Homo sapiens
acgctgtctcca

SEQ ID NO: 700050 - DNA, 15 bp, Homo sapiens
acgctgtctccagac

SEQ ID NO: 700051 - DNA, 20 bp, Homo sapiens
acgctgtctccagaccccca

SEQ ID NO: 700052 - DNA, 23 bp, Homo sapiens
acgctgtctccagacccccaccc

SEQ ID NO: 700053 - DNA, 22 bp, Homo sapiens
acgctgtgatgctgtgtgccca

SEQ ID NO: 700054 - DNA, 20 bp, Homo sapiens
acgcttaacctttccgctgt

SEQ ID NO: 700055 - DNA, 22 bp, Homo sapiens
acgcttaagtcatcattacttg

SEQ ID NO: 700056 - DNA, 12 bp, Homo sapiens
acgcttctgaat

SEQ ID NO: 700057 - DNA, 15 bp, Homo sapiens
acgcttgcctggtca

SEQ ID NO: 700058 - DNA, 16 bp, Homo sapiens
acgcttgtgacagtgc

SEQ ID NO: 700059 - DNA, 18 bp, Homo sapiens
acgctttcctgaatccaa

SEQ ID NO: 700060 - DNA, 17 bp, Homo sapiens
acgctttctagctgttg

SEQ ID NO: 700061 - DNA, 14 bp, Homo sapiens
acgctttgattcat

SEQ ID NO: 700062 - DNA, 16 bp, Homo sapiens
acgctttgattcatag

SEQ ID NO: 700063 - DNA, 20 bp, Homo sapiens
acgcttttaatgaaaaggaa

SEQ ID NO: 700064 - DNA, 23 bp, Homo sapiens
acgcttttaattctcatttgttc

SEQ ID NO: 700065 - DNA, 15 bp, Homo sapiens
acgcttttgagtggg

SEQ ID NO: 700066 - DNA, 16 bp, Homo sapiens
acgcttttgagtgggc

SEQ ID NO: 700067 - DNA, 14 bp, Homo sapiens
acgcttttgtgatg

SEQ ID NO: 700068 - DNA, 15 bp, Homo sapiens
acggaaagtgctgtc

SEQ ID NO: 700069 - DNA, 20 bp, Homo sapiens
acggaagccccctcttcctc

SEQ ID NO: 700070 - DNA, 23 bp, Homo sapiens
acggaagctcatagaggtgagaa

SEQ ID NO: 700071 - DNA, 20 bp, Homo sapiens
acggaagttttcaatgatgg

SEQ ID NO: 700072 - DNA, 14 bp, Homo sapiens
acggaccactcgag

SEQ ID NO: 700073 - DNA, 19 bp, Homo sapiens
acggaccactcgaggcctg

SEQ ID NO: 700074 - DNA, 16 bp, Homo sapiens
acggacgtttccatca

SEQ ID NO: 700075 - DNA, 15 bp, Homo sapiens
acggactcccgggcc

SEQ ID NO: 700076 - DNA, 15 bp, Homo sapiens
acggactgaggtgcc

SEQ ID NO: 700077 - DNA, 14 bp, Homo sapiens
acggagagaaaaaa

SEQ ID NO: 700078 - DNA, 16 bp, Homo sapiens
acggagagtgcttggg

SEQ ID NO: 700079 - DNA, 14 bp, Homo sapiens
acggagatgtttca

SEQ ID NO: 700080 - DNA, 19 bp, Homo sapiens
acggagcagttcagagtgg

SEQ ID NO: 700081 - DNA, 18 bp, Homo sapiens
acggagccactcctctga

SEQ ID NO: 700082 - DNA, 20 bp, Homo sapiens
acggagccactcctctgact

SEQ ID NO: 700083 - DNA, 21 bp, Homo sapiens
acggagccactcctctgactc

SEQ ID NO: 700084 - DNA, 20 bp, Homo sapiens
acggagcccagccctcccca

SEQ ID NO: 700085 - DNA, 18 bp, Homo sapiens
acggagccccaggcctct

SEQ ID NO: 700086 - DNA, 21 bp, Homo sapiens
acggagccccaggcctctgtg

SEQ ID NO: 700087 - DNA, 22 bp, Homo sapiens
acggaggagttttggcagccag

SEQ ID NO: 700088 - DNA, 15 bp, Homo sapiens
acggagggaggcacc

SEQ ID NO: 700089 - DNA, 23 bp, Homo sapiens
acggagggagtggcacttctgcc

SEQ ID NO: 700090 - DNA, 12 bp, Homo sapiens
acggagtggggg

SEQ ID NO: 700091 - DNA, 19 bp, Homo sapiens
acggagtggggggacagag

SEQ ID NO: 700092 - DNA, 17 bp, Homo sapiens
acggatctgagaatctt

SEQ ID NO: 700093 - DNA, 16 bp, Homo sapiens
acggattctaaggact

SEQ ID NO: 700094 - DNA, 14 bp, Homo sapiens
acggcaaccacatg

SEQ ID NO: 700095 - DNA, 22 bp, Homo sapiens
acggcaaccacatgtcccagat

SEQ ID NO: 700096 - DNA, 17 bp, Homo sapiens
acggcaacgtagcctgg

SEQ ID NO: 700097 - DNA, 15 bp, Homo sapiens
acggcagccacagct

SEQ ID NO: 700098 - DNA, 11 bp, Homo sapiens
acggcagctgt

SEQ ID NO: 700099 - DNA, 13 bp, Homo sapiens
acggcaggcgtgt

SEQ ID NO: 700100 - DNA, 20 bp, Homo sapiens
acggcaggcgtgtggcagcc

SEQ ID NO: 700101 - DNA, 17 bp, Homo sapiens
acggcaggctcactgcc

SEQ ID NO: 700102 - DNA, 20 bp, Homo sapiens
acggcaggctcactgccagg

SEQ ID NO: 700103 - DNA, 22 bp, Homo sapiens
acggcaggctcactgccaggcc

SEQ ID NO: 700104 - DNA, 22 bp, Homo sapiens
acggcatcacacttatatttta

SEQ ID NO: 700105 - DNA, 20 bp, Homo sapiens
acggccaatggtgcttcccc

SEQ ID NO: 700106 - DNA, 13 bp, Homo sapiens
acggccacatcaa

SEQ ID NO: 700107 - DNA, 12 bp, Homo sapiens
acggccaccctc

SEQ ID NO: 700108 - DNA, 20 bp, Homo sapiens
acggccaggaaaagccctca

SEQ ID NO: 700109 - DNA, 18 bp, Homo sapiens
acggccctgcaggagcag

SEQ ID NO: 700110 - DNA, 21 bp, Homo sapiens
acggccctgcctgcctcttgg

SEQ ID NO: 700111 - DNA, 21 bp, Homo sapiens
acggccggccggacctctgag

SEQ ID NO: 700112 - DNA, 21 bp, Homo sapiens
acggcctaggggtggcgctca

SEQ ID NO: 700113 - DNA, 14 bp, Homo sapiens
acggcctccaggag

SEQ ID NO: 700114 - DNA, 15 bp, Homo sapiens
acggcctccaggagg

SEQ ID NO: 700115 - DNA, 18 bp, Homo sapiens
acggcctgatgctccctc

SEQ ID NO: 700116 - DNA, 20 bp, Homo sapiens
acggcctgatgctccctccc

SEQ ID NO: 700117 - DNA, 14 bp, Homo sapiens
acggcctttctagc

SEQ ID NO: 700118 - DNA, 21 bp, Homo sapiens
acggcctttctagcctggcta

SEQ ID NO: 700119 - DNA, 22 bp, Homo sapiens
acggcgaccaataaacagctcc

SEQ ID NO: 700120 - DNA, 17 bp, Homo sapiens
acggcgcccccagtgtg

SEQ ID NO: 700121 - DNA, 17 bp, Homo sapiens
acggcgctgcctcaggc

SEQ ID NO: 700122 - DNA, 15 bp, Homo sapiens
acggctccgagggcg

SEQ ID NO: 700123 - DNA, 21 bp, Homo sapiens
acggctccgagggcggccagg

SEQ ID NO: 700124 - DNA, 12 bp, Homo sapiens
acggctcctcag

SEQ ID NO: 700125 - DNA, 14 bp, Homo sapiens
acggctcctcagag

SEQ ID NO: 700126 - DNA, 15 bp, Homo sapiens
acggctcctcagagc

SEQ ID NO: 700127 - DNA, 22 bp, Homo sapiens
acggctgcctgacactgagccc

SEQ ID NO: 700128 - DNA, 16 bp, Homo sapiens
acggctggtcactctg

SEQ ID NO: 700129 - DNA, 17 bp, Homo sapiens
acgggaagtttagagag

SEQ ID NO: 700130 - DNA, 19 bp, Homo sapiens
acgggagcattggcccctg

SEQ ID NO: 700131 - DNA, 20 bp, Homo sapiens
acgggagcattggcccctga

SEQ ID NO: 700132 - DNA, 18 bp, Homo sapiens
acgggcaagtgagagggg

SEQ ID NO: 700133 - DNA, 15 bp, Homo sapiens
acgggcagccacagg

SEQ ID NO: 700134 - DNA, 23 bp, Homo sapiens
acgggcagccacaggactgagcc

SEQ ID NO: 700135 - DNA, 23 bp, Homo sapiens
acgggcatgggcctctctggggg

SEQ ID NO: 700136 - DNA, 16 bp, Homo sapiens
acgggcccgggttggg

SEQ ID NO: 700137 - DNA, 17 bp, Homo sapiens
acgggcccgggttgggt

SEQ ID NO: 700138 - DNA, 20 bp, Homo sapiens
acgggcccgggttgggtcac

SEQ ID NO: 700139 - DNA, 11 bp, Homo sapiens
acgggccctgc

SEQ ID NO: 700140 - DNA, 16 bp, Homo sapiens
acgggccctgccccag

SEQ ID NO: 700141 - DNA, 22 bp, Homo sapiens
acgggccctgccccagccccta

SEQ ID NO: 700142 - DNA, 15 bp, Homo sapiens
acggggaaaatgcat

SEQ ID NO: 700143 - DNA, 14 bp, Homo sapiens
caaggacaggagcc

SEQ ID NO: 700144 - DNA, 16 bp, Homo sapiens
caaggacaggagcctg

SEQ ID NO: 700145 - DNA, 17 bp, Homo sapiens
caaggacaggagcctgg

SEQ ID NO: 700146 - DNA, 14 bp, Homo sapiens
caaggacagggctg

SEQ ID NO: 700147 - DNA, 22 bp, Homo sapiens
caaggacagggctgagcgtgga

SEQ ID NO: 700148 - DNA, 18 bp, Homo sapiens
caaggacattcactgctg

SEQ ID NO: 700149 - DNA, 13 bp, Homo sapiens
caaggaccaggac

SEQ ID NO: 700150 - DNA, 18 bp, Homo sapiens
caaggaccaggactccct

SEQ ID NO: 700151 - DNA, 22 bp, Homo sapiens
caaggaccttttggaatgactg

SEQ ID NO: 700152 - DNA, 21 bp, Homo sapiens
caaggactacgttaagggaag

SEQ ID NO: 700153 - DNA, 14 bp, Homo sapiens
caaggactgagggc

SEQ ID NO: 700154 - DNA, 17 bp, Homo sapiens
caaggactgagggcagt

SEQ ID NO: 700155 - DNA, 18 bp, Homo sapiens
caaggactgtttcagtgt

SEQ ID NO: 700156 - DNA, 18 bp, Homo sapiens
caaggagaaacagagaca

SEQ ID NO: 700157 - DNA, 13 bp, Homo sapiens
caaggagagcgga

SEQ ID NO: 700158 - DNA, 21 bp, Homo sapiens
caaggagatttcttagttcat

SEQ ID NO: 700159 - DNA, 16 bp, Homo sapiens
caaggagcacaagcca

SEQ ID NO: 700160 - DNA, 12 bp, Homo sapiens
caaggagcagag

SEQ ID NO: 700161 - DNA, 13 bp, Homo sapiens
caaggagcagaga

SEQ ID NO: 700162 - DNA, 14 bp, Homo sapiens
caaggagccaaaca

SEQ ID NO: 700163 - DNA, 20 bp, Homo sapiens
caaggagctcaccctgcccg

SEQ ID NO: 700164 - DNA, 21 bp, Homo sapiens
caaggagctgatttccaggcc

SEQ ID NO: 700165 - DNA, 11 bp, Homo sapiens
caaggagctgc

SEQ ID NO: 700166 - DNA, 13 bp, Homo sapiens
caaggagctgcta

SEQ ID NO: 700167 - DNA, 15 bp, Homo sapiens
caaggagcttaccca

SEQ ID NO: 700168 - DNA, 21 bp, Homo sapiens
caaggagcttacccaagctgt

SEQ ID NO: 700169 - DNA, 20 bp, Homo sapiens
caaggaggaaaaacagacaa

SEQ ID NO: 700170 - DNA, 21 bp, Homo sapiens
caaggaggaaataactaagag

SEQ ID NO: 700171 - DNA, 12 bp, Homo sapiens
caaggaggcctg

SEQ ID NO: 700172 - DNA, 18 bp, Homo sapiens
caaggaggggctgtaaaa

SEQ ID NO: 700173 - DNA, 19 bp, Homo sapiens
caaggagggtgagtgcaag

SEQ ID NO: 700174 - DNA, 15 bp, Homo sapiens
caaggaggtagagag

SEQ ID NO: 700175 - DNA, 22 bp, Homo sapiens
caaggaggtggtgaatttttaa

SEQ ID NO: 700176 - DNA, 16 bp, Homo sapiens
caaggagtgcccgcct

SEQ ID NO: 700177 - DNA, 18 bp, Homo sapiens
caaggagtgcccgccttg

SEQ ID NO: 700178 - DNA, 15 bp, Homo sapiens
caaggagttctcttc

SEQ ID NO: 700179 - DNA, 15 bp, Homo sapiens
caaggagtttattac

SEQ ID NO: 700180 - DNA, 17 bp, Homo sapiens
caaggagtttattacaa

SEQ ID NO: 700181 - DNA, 24 bp, Homo sapiens
caaggagtttgagaccagcttagc

SEQ ID NO: 700182 - DNA, 18 bp, Homo sapiens
caaggatatactgcagct

SEQ ID NO: 700183 - DNA, 17 bp, Homo sapiens
caaggatatcagagctg

SEQ ID NO: 700184 - DNA, 18 bp, Homo sapiens
caaggatcaggctgctgg

SEQ ID NO: 700185 - DNA, 14 bp, Homo sapiens
caaggatcctctcc

SEQ ID NO: 700186 - DNA, 20 bp, Homo sapiens
caaggatcggactctgcccc

SEQ ID NO: 700187 - DNA, 16 bp, Homo sapiens
caaggattttcatgtt

SEQ ID NO: 700188 - DNA, 23 bp, Homo sapiens
caaggcaaacaatcccaatcttt

SEQ ID NO: 700189 - DNA, 15 bp, Homo sapiens
caaggcaaggcaggt

SEQ ID NO: 700190 - DNA, 17 bp, Homo sapiens
caaggcaccttcttaaa

SEQ ID NO: 700191 - DNA, 16 bp, Homo sapiens
caaggcagaggcctgg

SEQ ID NO: 700192 - DNA, 16 bp, Homo sapiens
caaggcagcctccaga

SEQ ID NO: 700193 - DNA, 17 bp, Homo sapiens
caaggcagcctccagag

SEQ ID NO: 700194 - DNA, 24 bp, Homo sapiens
caaggcagcctccagagccagcct

SEQ ID NO: 700195 - DNA, 20 bp, Homo sapiens
caaggcagcctgaacactca

SEQ ID NO: 700196 - DNA, 20 bp, Homo sapiens
caaggcagctcttctggagt

SEQ ID NO: 700197 - DNA, 23 bp, Homo sapiens
caaggcaggtagatcgcttgagc

SEQ ID NO: 700198 - DNA, 13 bp, Homo sapiens
caaggcaggtgcc

SEQ ID NO: 700199 - DNA, 20 bp, Homo sapiens
caaggcaggtgcctccaggt

SEQ ID NO: 700200 - DNA, 16 bp, Homo sapiens
caaggcagtgcatgca

SEQ ID NO: 700201 - DNA, 19 bp, Homo sapiens
caaggcagtgcatgcatgt

SEQ ID NO: 700202 - DNA, 23 bp, Homo sapiens
caaggccaccttggaggaggatg

SEQ ID NO: 700203 - DNA, 17 bp, Homo sapiens
caaggccagagtggcct

SEQ ID NO: 700204 - DNA, 17 bp, Homo sapiens
caaggccagtccccatt

SEQ ID NO: 700205 - DNA, 16 bp, Homo sapiens
caaggccccagagact

SEQ ID NO: 700206 - DNA, 18 bp, Homo sapiens
caaggccccagggacaga

SEQ ID NO: 700207 - DNA, 16 bp, Homo sapiens
caaggccctcggagct

SEQ ID NO: 700208 - DNA, 18 bp, Homo sapiens
caaggccctcggagctgg

SEQ ID NO: 700209 - DNA, 19 bp, Homo sapiens
caaggccctcggagctggc

SEQ ID NO: 700210 - DNA, 13 bp, Homo sapiens
caaggccctttcc

SEQ ID NO: 700211 - DNA, 17 bp, Homo sapiens
caaggccgaagctctgg

SEQ ID NO: 700212 - DNA, 19 bp, Homo sapiens
caaggccgaagctctggct

SEQ ID NO: 700213 - DNA, 16 bp, Homo sapiens
caaggccgagggccag

SEQ ID NO: 700214 - DNA, 20 bp, Homo sapiens
caaggccgagggccaggcag

SEQ ID NO: 700215 - DNA, 21 bp, Homo sapiens
caaggccgagggccaggcaga

SEQ ID NO: 700216 - DNA, 22 bp, Homo sapiens
caaggccgcggcccagacccac

SEQ ID NO: 700217 - DNA, 20 bp, Homo sapiens
caaggccgctgttcacccac

SEQ ID NO: 700218 - DNA, 16 bp, Homo sapiens
caaggcctcggcagaa

SEQ ID NO: 700219 - DNA, 14 bp, Homo sapiens
caaggcctctcaga

SEQ ID NO: 700220 - DNA, 19 bp, Homo sapiens
caaggcctctcagacccag

SEQ ID NO: 700221 - DNA, 23 bp, Homo sapiens
caaggccttggtggagcagccag

SEQ ID NO: 700222 - DNA, 20 bp, Homo sapiens
caaggctaacatcccactta

SEQ ID NO: 700223 - DNA, 20 bp, Homo sapiens
caaggctactatgcttcagg

SEQ ID NO: 700224 - DNA, 14 bp, Homo sapiens
caaggctatgtgat

SEQ ID NO: 700225 - DNA, 16 bp, Homo sapiens
caaggctcactgcagc

SEQ ID NO: 700226 - DNA, 15 bp, Homo sapiens
caaggctctgagcaa

SEQ ID NO: 700227 - DNA, 18 bp, Homo sapiens
caaggctgaccaagagag

SEQ ID NO: 700228 - DNA, 19 bp, Homo sapiens
caaggctgaccaagagaga

SEQ ID NO: 700229 - DNA, 18 bp, Homo sapiens
caaggctgcggtttgttg

SEQ ID NO: 700230 - DNA, 13 bp, Homo sapiens
caaggctgctgcc

SEQ ID NO: 700231 - DNA, 13 bp, Homo sapiens
caaggctggccag

SEQ ID NO: 700232 - DNA, 14 bp, Homo sapiens
caaggctggccagc

SEQ ID NO: 700233 - DNA, 14 bp, Homo sapiens
caaggctggggcat

SEQ ID NO: 700234 - DNA, 14 bp, Homo sapiens
caaggctgttgcat

SEQ ID NO: 700235 - DNA, 18 bp, Homo sapiens
caaggctgttgcatgggc

SEQ ID NO: 700236 - DNA, 15 bp, Homo sapiens
caaggctttctctac

SEQ ID NO: 700237 - DNA, 15 bp, Homo sapiens
caagggaaaagtctc

SEQ ID NO: 700238 - DNA, 12 bp, Homo sapiens
caagggaaaggg

SEQ ID NO: 700239 - DNA, 14 bp, Homo sapiens
caagggaaaggggt

SEQ ID NO: 700240 - DNA, 15 bp, Homo sapiens
caagggaacctgtgt

SEQ ID NO: 700241 - DNA, 20 bp, Homo sapiens
caagggaagaaacactctta

SEQ ID NO: 700242 - DNA, 14 bp, Homo sapiens
caagggaaggggcc

SEQ ID NO: 700243 - DNA, 23 bp, Homo sapiens
caagggaatttcttcaactccct

SEQ ID NO: 700244 - DNA, 13 bp, Homo sapiens
caagggacagcaa

SEQ ID NO: 700245 - DNA, 22 bp, Homo sapiens
caagggacagcaagtgagcaga

SEQ ID NO: 700246 - DNA, 21 bp, Homo sapiens
caagggacaggagaagagagg

SEQ ID NO: 700247 - DNA, 19 bp, Homo sapiens
caagggacaggtgggcctg

SEQ ID NO: 700248 - DNA, 15 bp, Homo sapiens
caagggagaaaagag

SEQ ID NO: 700249 - DNA, 17 bp, Homo sapiens
caagggagaaaagagaa

SEQ ID NO: 700250 - DNA, 19 bp, Homo sapiens
caagggagaaaagagaaac

SEQ ID NO: 700251 - DNA, 14 bp, Homo sapiens
caagggagagacct

SEQ ID NO: 700252 - DNA, 20 bp, Homo sapiens
caagggagagacctcatcag

SEQ ID NO: 700253 - DNA, 15 bp, Homo sapiens
caagggaggcagtgg

SEQ ID NO: 700254 - DNA, 22 bp, Homo sapiens
caagggagggaagggccaccct

SEQ ID NO: 700255 - DNA, 13 bp, Homo sapiens
caagggagggtgc

SEQ ID NO: 700256 - DNA, 21 bp, Homo sapiens
caagggagggtgcagccctct

SEQ ID NO: 700257 - DNA, 18 bp, Homo sapiens
caagggcaagaacccaag

SEQ ID NO: 700258 - DNA, 21 bp, Homo sapiens
caagggcagaatgaatctatg

SEQ ID NO: 700259 - DNA, 16 bp, Homo sapiens
caagggcataaagtaa

SEQ ID NO: 700260 - DNA, 20 bp, Homo sapiens
caagggccatgctgaaggga

SEQ ID NO: 700261 - DNA, 21 bp, Homo sapiens
caagggccatgctgaagggac

SEQ ID NO: 700262 - DNA, 14 bp, Homo sapiens
caagggcccagagt

SEQ ID NO: 700263 - DNA, 23 bp, Homo sapiens
caagggccccaggggcagcaagg

SEQ ID NO: 700264 - DNA, 13 bp, Homo sapiens
caagggctccagc

SEQ ID NO: 700265 - DNA, 22 bp, Homo sapiens
caagggctcctatctttcctcc

SEQ ID NO: 700266 - DNA, 17 bp, Homo sapiens
caagggctggggcggag

SEQ ID NO: 700267 - DNA, 20 bp, Homo sapiens
caagggctttgttttgcaca

SEQ ID NO: 700268 - DNA, 13 bp, Homo sapiens
acggggacctgga

SEQ ID NO: 700269 - DNA, 14 bp, Homo sapiens
acggggactgggga

SEQ ID NO: 700270 - DNA, 12 bp, Homo sapiens
acggggagaaaa

SEQ ID NO: 700271 - DNA, 15 bp, Homo sapiens
acggggcaggcgctg

SEQ ID NO: 700272 - DNA, 22 bp, Homo sapiens
acggggccacgtgtgctgtggc

SEQ ID NO: 700273 - DNA, 18 bp, Homo sapiens
acggggcctccaacccat

SEQ ID NO: 700274 - DNA, 15 bp, Homo sapiens
acgggggctgtgact

SEQ ID NO: 700275 - DNA, 19 bp, Homo sapiens
acggggtctccctgtgtta

SEQ ID NO: 700276 - DNA, 12 bp, Homo sapiens
acggggtgggga

SEQ ID NO: 700277 - DNA, 17 bp, Homo sapiens
acggggtggggagggtg

SEQ ID NO: 700278 - DNA, 15 bp, Homo sapiens
acggggttccctcct

SEQ ID NO: 700279 - DNA, 21 bp, Homo sapiens
acggggttggctgttccagac

SEQ ID NO: 700280 - DNA, 13 bp, Homo sapiens
acggggtttcacc

SEQ ID NO: 700281 - DNA, 14 bp, Homo sapiens
acgggtggtccccg

SEQ ID NO: 700282 - DNA, 13 bp, Homo sapiens
acgggtttccctc

SEQ ID NO: 700283 - DNA, 17 bp, Homo sapiens
acggtatcctccctgcc

SEQ ID NO: 700284 - DNA, 23 bp, Homo sapiens
acggtcaggtttaacatttgcct

SEQ ID NO: 700285 - DNA, 18 bp, Homo sapiens
acggtcctttaggcagcc

SEQ ID NO: 700286 - DNA, 13 bp, Homo sapiens
acggtctgagcta

SEQ ID NO: 700287 - DNA, 20 bp, Homo sapiens
acggtctgttcttgaagcag

SEQ ID NO: 700288 - DNA, 14 bp, Homo sapiens
acggtgacacaggt

SEQ ID NO: 700289 - DNA, 18 bp, Homo sapiens
acggtgacacaggtcagg

SEQ ID NO: 700290 - DNA, 20 bp, Homo sapiens
acggtgccaagggccccagg

SEQ ID NO: 700291 - DNA, 21 bp, Homo sapiens
acggtgccttttttcacggaa

SEQ ID NO: 700292 - DNA, 18 bp, Homo sapiens
acggtgcgtggctgtggc

SEQ ID NO: 700293 - DNA, 13 bp, Homo sapiens
acggtgctaaaaa

SEQ ID NO: 700294 - DNA, 21 bp, Homo sapiens
acggtggcggctgcacaacag

SEQ ID NO: 700295 - DNA, 18 bp, Homo sapiens
acggtgggcatttgtgag

SEQ ID NO: 700296 - DNA, 17 bp, Homo sapiens
acggttaacttgtatat

SEQ ID NO: 700297 - DNA, 17 bp, Homo sapiens
acggttttactgcagct

SEQ ID NO: 700298 - DNA, 17 bp, Homo sapiens
acggttttggcagctga

SEQ ID NO: 700299 - DNA, 22 bp, Homo sapiens
acgtaaaacatttgtttccccc

SEQ ID NO: 700300 - DNA, 18 bp, Homo sapiens
acgtaaaatttacagtca

SEQ ID NO: 700301 - DNA, 21 bp, Homo sapiens
acgtaaaatttacagtcaatc

SEQ ID NO: 700302 - DNA, 13 bp, Homo sapiens
acgtaaagaattt

SEQ ID NO: 700303 - DNA, 20 bp, Homo sapiens
acgtacacaccacgtcctgg

SEQ ID NO: 700304 - DNA, 13 bp, Homo sapiens
acgtacatgttta

SEQ ID NO: 700305 - DNA, 19 bp, Homo sapiens
acgtactacggagaaactc

SEQ ID NO: 700306 - DNA, 21 bp, Homo sapiens
acgtagactgatggaacagaa

SEQ ID NO: 700307 - DNA, 16 bp, Homo sapiens
acgtataatgctttct

SEQ ID NO: 700308 - DNA, 19 bp, Homo sapiens
acgtatgtaacatgatgtt

SEQ ID NO: 700309 - DNA, 17 bp, Homo sapiens
acgtatgtgtgcaggag

SEQ ID NO: 700310 - DNA, 22 bp, Homo sapiens
acgtatgtgtgcaggagcctcc

SEQ ID NO: 700311 - DNA, 16 bp, Homo sapiens
acgtatttaatagcaa

SEQ ID NO: 700312 - DNA, 21 bp, Homo sapiens
acgtatttaatagcaaagaat

SEQ ID NO: 700313 - DNA, 13 bp, Homo sapiens
acgtatttctcca

SEQ ID NO: 700314 - DNA, 15 bp, Homo sapiens
acgtatttctccaga

SEQ ID NO: 700315 - DNA, 15 bp, Homo sapiens
acgtatttttctgac

SEQ ID NO: 700316 - DNA, 22 bp, Homo sapiens
acgtcaacccaagctctgggga

SEQ ID NO: 700317 - DNA, 18 bp, Homo sapiens
acgtcacgctccctgact

SEQ ID NO: 700318 - DNA, 19 bp, Homo sapiens
acgtcactttttggccatg

SEQ ID NO: 700319 - DNA, 15 bp, Homo sapiens
acgtcaggccctgac

SEQ ID NO: 700320 - DNA, 23 bp, Homo sapiens
acgtcaggccctgactcctctgg

SEQ ID NO: 700321 - DNA, 18 bp, Homo sapiens
acgtcatcggaggctggg

SEQ ID NO: 700322 - DNA, 12 bp, Homo sapiens
acgtcatgtatt

SEQ ID NO: 700323 - DNA, 16 bp, Homo sapiens
acgtcatgtattttat

SEQ ID NO: 700324 - DNA, 21 bp, Homo sapiens
acgtccaggttcaacccacag

SEQ ID NO: 700325 - DNA, 19 bp, Homo sapiens
acgtcccagcatccctgga

SEQ ID NO: 700326 - DNA, 19 bp, Homo sapiens
acgtcccagcggcctcagg

SEQ ID NO: 700327 - DNA, 20 bp, Homo sapiens
acgtcccagcggcctcaggg

SEQ ID NO: 700328 - DNA, 13 bp, Homo sapiens
acgtccccctggg

SEQ ID NO: 700329 - DNA, 14 bp, Homo sapiens
acgtcccctccgcc

SEQ ID NO: 700330 - DNA, 23 bp, Homo sapiens
acgtcccctccgccgtgccggcg

SEQ ID NO: 700331 - DNA, 19 bp, Homo sapiens
acgtcccgctgcctcctgc

SEQ ID NO: 700332 - DNA, 20 bp, Homo sapiens
acgtcccgctgcctcctgct

SEQ ID NO: 700333 - DNA, 18 bp, Homo sapiens
acgtccgtgtgtcccaga

SEQ ID NO: 700334 - DNA, 23 bp, Homo sapiens
acgtccgtgtgtcccagatgctg

SEQ ID NO: 700335 - DNA, 21 bp, Homo sapiens
acgtcctcgaattctcagacg

SEQ ID NO: 700336 - DNA, 14 bp, Homo sapiens
acgtccttccttga

SEQ ID NO: 700337 - DNA, 23 bp, Homo sapiens
acgtctagctatgctgtatctgt

SEQ ID NO: 700338 - DNA, 16 bp, Homo sapiens
acgtctctttttggta

SEQ ID NO: 700339 - DNA, 15 bp, Homo sapiens
acgtctgccaggccc

SEQ ID NO: 700340 - DNA, 16 bp, Homo sapiens
acgtctgccaggccca

SEQ ID NO: 700341 - DNA, 12 bp, Homo sapiens
acgtctggctcc

SEQ ID NO: 700342 - DNA, 16 bp, Homo sapiens
acgtctggctccctgc

SEQ ID NO: 700343 - DNA, 21 bp, Homo sapiens
acgtctggctccctgcccctt

SEQ ID NO: 700344 - DNA, 21 bp, Homo sapiens
acgtcttagagccttttatct

SEQ ID NO: 700345 - DNA, 12 bp, Homo sapiens
acgtcttctaaa

SEQ ID NO: 700346 - DNA, 16 bp, Homo sapiens
acgtcttggtgccttt

SEQ ID NO: 700347 - DNA, 21 bp, Homo sapiens
acgtcttggtgccttttgtgt

SEQ ID NO: 700348 - DNA, 15 bp, Homo sapiens
acgtctttcctgcta

SEQ ID NO: 700349 - DNA, 23 bp, Homo sapiens
acgtgacaccaccgaatatatta

SEQ ID NO: 700350 - DNA, 16 bp, Homo sapiens
acgtgacagtgcctgg

SEQ ID NO: 700351 - DNA, 17 bp, Homo sapiens
acgtgacagtgcctggg

SEQ ID NO: 700352 - DNA, 18 bp, Homo sapiens
acgtgactgccccaactc

SEQ ID NO: 700353 - DNA, 15 bp, Homo sapiens
acgtgagccaggtaa

SEQ ID NO: 700354 - DNA, 22 bp, Homo sapiens
acgtgagccaggtaatgaggga

SEQ ID NO: 700355 - DNA, 15 bp, Homo sapiens
acgtgatgtgccact

SEQ ID NO: 700356 - DNA, 21 bp, Homo sapiens
acgtgatgttttgaatgtgga

SEQ ID NO: 700357 - DNA, 18 bp, Homo sapiens
acgtgattgattcagtat

SEQ ID NO: 700358 - DNA, 18 bp, Homo sapiens
acgtgatttccagtgagt

SEQ ID NO: 700359 - DNA, 13 bp, Homo sapiens
acgtgcaaacaac

SEQ ID NO: 700360 - DNA, 20 bp, Homo sapiens
acgtgcacctgtactcagga

SEQ ID NO: 700361 - DNA, 14 bp, Homo sapiens
acgtgcactgacag

SEQ ID NO: 700362 - DNA, 23 bp, Homo sapiens
acgtgcactgtgaatcctggcaa

SEQ ID NO: 700363 - DNA, 15 bp, Homo sapiens
acgtgcaggacagct

SEQ ID NO: 700364 - DNA, 17 bp, Homo sapiens
acgtgcaggacagctct

SEQ ID NO: 700365 - DNA, 19 bp, Homo sapiens
acgtgcatttaaactctgc

SEQ ID NO: 700366 - DNA, 23 bp, Homo sapiens
acgtgccagatataactgtcttg

SEQ ID NO: 700367 - DNA, 16 bp, Homo sapiens
acgtgccagctctagt

SEQ ID NO: 700368 - DNA, 19 bp, Homo sapiens
acgtgccaggcccggggct

SEQ ID NO: 700369 - DNA, 21 bp, Homo sapiens
acgtgccaggcccggggctgg

SEQ ID NO: 700370 - DNA, 17 bp, Homo sapiens
acgtgccttttgcaccc

SEQ ID NO: 700371 - DNA, 19 bp, Homo sapiens
acgtgccttttgcacccct

SEQ ID NO: 700372 - DNA, 20 bp, Homo sapiens
acgtgccttttgcacccctc

SEQ ID NO: 700373 - DNA, 18 bp, Homo sapiens
acgtgctctgtgggtctc

SEQ ID NO: 700374 - DNA, 15 bp, Homo sapiens
acgtgctttgagaaa

SEQ ID NO: 700375 - DNA, 17 bp, Homo sapiens
acgtggaacctctgtct

SEQ ID NO: 700376 - DNA, 20 bp, Homo sapiens
acgtggaacctctgtctcat

SEQ ID NO: 700377 - DNA, 17 bp, Homo sapiens
acgtggacgtttttaat

SEQ ID NO: 700378 - DNA, 15 bp, Homo sapiens
acgtggagagctggt

SEQ ID NO: 700379 - DNA, 18 bp, Homo sapiens
acgtggatacagagccac

SEQ ID NO: 700380 - DNA, 19 bp, Homo sapiens
acgtggattttaaaaaatc

SEQ ID NO: 700381 - DNA, 21 bp, Homo sapiens
acgtggcctccgcagtgtctc

SEQ ID NO: 700382 - DNA, 22 bp, Homo sapiens
acgtggcctctctctctctcct

SEQ ID NO: 700383 - DNA, 22 bp, Homo sapiens
acgtggcttgtagaatttttaa

SEQ ID NO: 700384 - DNA, 12 bp, Homo sapiens
acgtgggaggct

SEQ ID NO: 700385 - DNA, 23 bp, Homo sapiens
acgtgggagttcagctgcttctc

SEQ ID NO: 700386 - DNA, 19 bp, Homo sapiens
acgtgggctcccctcttcc

SEQ ID NO: 700387 - DNA, 15 bp, Homo sapiens
acgtggtcaccttcg

SEQ ID NO: 700388 - DNA, 19 bp, Homo sapiens
acgtggtcaccttcgagta

SEQ ID NO: 700389 - DNA, 12 bp, Homo sapiens
acgtggtgggac

SEQ ID NO: 700390 - DNA, 15 bp, Homo sapiens
acgtgtacagcacag

SEQ ID NO: 700391 - DNA, 17 bp, Homo sapiens
acgtgtacagcacagaa

SEQ ID NO: 700392 - DNA, 16 bp, Homo sapiens
caaggggaaaatctca

SEQ ID NO: 700393 - DNA, 21 bp, Homo sapiens
caaggggatttttatgtctgg

SEQ ID NO: 700394 - DNA, 20 bp, Homo sapiens
caaggggctgcgctagcagc

SEQ ID NO: 700395 - DNA, 18 bp, Homo sapiens
caaggggcttcgttttca

SEQ ID NO: 700396 - DNA, 13 bp, Homo sapiens
caagggggcccaa

SEQ ID NO: 700397 - DNA, 18 bp, Homo sapiens
caagggggcggggactgc

SEQ ID NO: 700398 - DNA, 15 bp, Homo sapiens
caagggggtgactgg

SEQ ID NO: 700399 - DNA, 16 bp, Homo sapiens
caagggggtgactgga

SEQ ID NO: 700400 - DNA, 22 bp, Homo sapiens
caagggggtgtcatctgaggag

SEQ ID NO: 700401 - DNA, 23 bp, Homo sapiens
caaggggtctgtatatacatttc

SEQ ID NO: 700402 - DNA, 14 bp, Homo sapiens
caagggtccagaag

SEQ ID NO: 700403 - DNA, 15 bp, Homo sapiens
caagggtcctcaccc

SEQ ID NO: 700404 - DNA, 16 bp, Homo sapiens
caaggtagccatccca

SEQ ID NO: 700405 - DNA, 17 bp, Homo sapiens
caaggtcactcttggtc

SEQ ID NO: 700406 - DNA, 18 bp, Homo sapiens
caaggtccactccctgct

SEQ ID NO: 700407 - DNA, 19 bp, Homo sapiens
caaggtccactccctgctc

SEQ ID NO: 700408 - DNA, 14 bp, Homo sapiens
caaggtcccctcca

SEQ ID NO: 700409 - DNA, 21 bp, Homo sapiens
caaggtcctctgtcagtcaca

SEQ ID NO: 700410 - DNA, 10 bp, Homo sapiens
caaggtcctg

SEQ ID NO: 700411 - DNA, 12 bp, Homo sapiens
caaggtgaaacg

SEQ ID NO: 700412 - DNA, 22 bp, Homo sapiens
caaggtgaaacgactcaaaatg

SEQ ID NO: 700413 - DNA, 16 bp, Homo sapiens
caaggtgaatagcaca

SEQ ID NO: 700414 - DNA, 23 bp, Homo sapiens
caaggtgatatataatttcctca

SEQ ID NO: 700415 - DNA, 17 bp, Homo sapiens
caaggtgcatatagaaa

SEQ ID NO: 700416 - DNA, 22 bp, Homo sapiens
caaggtgcatatagaaaacaaa

SEQ ID NO: 700417 - DNA, 22 bp, Homo sapiens
caaggtggcagatgtcttccct

SEQ ID NO: 700418 - DNA, 18 bp, Homo sapiens
caaggtggcctctgcctg

SEQ ID NO: 700419 - DNA, 21 bp, Homo sapiens
caaggtggcctttgtgctgcg

SEQ ID NO: 700420 - DNA, 23 bp, Homo sapiens
caaggtgggaggattgcttgagc

SEQ ID NO: 700421 - DNA, 12 bp, Homo sapiens
caaggtgggcgg

SEQ ID NO: 700422 - DNA, 21 bp, Homo sapiens
caaggtgggctgagccctggc

SEQ ID NO: 700423 - DNA, 23 bp, Homo sapiens
caaggtgggctgagccctggcag

SEQ ID NO: 700424 - DNA, 24 bp, Homo sapiens
caaggtgggctgagccctggcagg

SEQ ID NO: 700425 - DNA, 17 bp, Homo sapiens
caaggtggtcagtaaat

SEQ ID NO: 700426 - DNA, 14 bp, Homo sapiens
caaggtgtccaggg

SEQ ID NO: 700427 - DNA, 21 bp, Homo sapiens
caaggttactcagcagcagag

SEQ ID NO: 700428 - DNA, 23 bp, Homo sapiens
caaggttactcagcagcagagag

SEQ ID NO: 700429 - DNA, 22 bp, Homo sapiens
caaggttataattttttttaaa

SEQ ID NO: 700430 - DNA, 17 bp, Homo sapiens
caaggttccctctgaga

SEQ ID NO: 700431 - DNA, 17 bp, Homo sapiens
caaggttggagcccagg

SEQ ID NO: 700432 - DNA, 22 bp, Homo sapiens
caaggttggcaccccagctacc

SEQ ID NO: 700433 - DNA, 16 bp, Homo sapiens
caaggttggttgctaa

SEQ ID NO: 700434 - DNA, 15 bp, Homo sapiens
caaggtttataaagc

SEQ ID NO: 700435 - DNA, 16 bp, Homo sapiens
caaggtttcgtggcag

SEQ ID NO: 700436 - DNA, 17 bp, Homo sapiens
caaggtttcgtggcagc

SEQ ID NO: 700437 - DNA, 18 bp, Homo sapiens
caaggtttcgtggcagca

SEQ ID NO: 700438 - DNA, 10 bp, Homo sapiens
caagtaaaaa

SEQ ID NO: 700439 - DNA, 14 bp, Homo sapiens
caagtaaaatgttt

SEQ ID NO: 700440 - DNA, 14 bp, Homo sapiens
caagtaacaaaaat

SEQ ID NO: 700441 - DNA, 23 bp, Homo sapiens
caagtaacactttaaaaccagtt

SEQ ID NO: 700442 - DNA, 22 bp, Homo sapiens
caagtaagaagacatgaaccaa

SEQ ID NO: 700443 - DNA, 23 bp, Homo sapiens
caagtaagactttctgaaaacac

SEQ ID NO: 700444 - DNA, 21 bp, Homo sapiens
caagtaagagtactgggagaa

SEQ ID NO: 700445 - DNA, 12 bp, Homo sapiens
caagtaatatta

SEQ ID NO: 700446 - DNA, 14 bp, Homo sapiens
caagtaatattatt

SEQ ID NO: 700447 - DNA, 14 bp, Homo sapiens
caagtaatttcagt

SEQ ID NO: 700448 - DNA, 23 bp, Homo sapiens
caagtaatttcagtgtaaagtgt

SEQ ID NO: 700449 - DNA, 18 bp, Homo sapiens
caagtaattttcatatta

SEQ ID NO: 700450 - DNA, 20 bp, Homo sapiens
caagtacatggctagctttt

SEQ ID NO: 700451 - DNA, 12 bp, Homo sapiens
caagtacccatt

SEQ ID NO: 700452 - DNA, 18 bp, Homo sapiens
caagtagataaatatttg

SEQ ID NO: 700453 - DNA, 22 bp, Homo sapiens
caagtagataggaagaaagaag

SEQ ID NO: 700454 - DNA, 18 bp, Homo sapiens
caagtagatgcctgaact

SEQ ID NO: 700455 - DNA, 20 bp, Homo sapiens
caagtagatgcctgaacttg

SEQ ID NO: 700456 - DNA, 20 bp, Homo sapiens
caagtagctgggattacagg

SEQ ID NO: 700457 - DNA, 15 bp, Homo sapiens
caagtagctttccac

SEQ ID NO: 700458 - DNA, 14 bp, Homo sapiens
caagtataaacttt

SEQ ID NO: 700459 - DNA, 14 bp, Homo sapiens
caagtatagaaaat

SEQ ID NO: 700460 - DNA, 15 bp, Homo sapiens
caagtatataattta

SEQ ID NO: 700461 - DNA, 22 bp, Homo sapiens
caagtatataatttactttgta

SEQ ID NO: 700462 - DNA, 22 bp, Homo sapiens
caagtatatgtgaaaaaaatga

SEQ ID NO: 700463 - DNA, 16 bp, Homo sapiens
caagtatcttctattt

SEQ ID NO: 700464 - DNA, 21 bp, Homo sapiens
caagtatgaagtataaatctg

SEQ ID NO: 700465 - DNA, 15 bp, Homo sapiens
caagtatgccttaag

SEQ ID NO: 700466 - DNA, 20 bp, Homo sapiens
caagtatgccttaagcagaa

SEQ ID NO: 700467 - DNA, 22 bp, Homo sapiens
caagtatgccttaagcagaaca

SEQ ID NO: 700468 - DNA, 20 bp, Homo sapiens
caagtatggtaggggagggc

SEQ ID NO: 700469 - DNA, 22 bp, Homo sapiens
caagtatttgggaagtgaagac

SEQ ID NO: 700470 - DNA, 15 bp, Homo sapiens
caagtatttttaatt

SEQ ID NO: 700471 - DNA, 19 bp, Homo sapiens
caagtcaaccaatgtagaa

SEQ ID NO: 700472 - DNA, 17 bp, Homo sapiens
caagtcaagtgaaaaag

SEQ ID NO: 700473 - DNA, 19 bp, Homo sapiens
caagtcacagctgcagctg

SEQ ID NO: 700474 - DNA, 23 bp, Homo sapiens
caagtcagtccaggatgctaaca

SEQ ID NO: 700475 - DNA, 20 bp, Homo sapiens
caagtcatagccataaatga

SEQ ID NO: 700476 - DNA, 14 bp, Homo sapiens
caagtccaacctgc

SEQ ID NO: 700477 - DNA, 13 bp, Homo sapiens
caagtccactgtc

SEQ ID NO: 700478 - DNA, 15 bp, Homo sapiens
caagtccactgtcct

SEQ ID NO: 700479 - DNA, 22 bp, Homo sapiens
caagtccagatttacactggga

SEQ ID NO: 700480 - DNA, 22 bp, Homo sapiens
caagtccatgttattctctcac

SEQ ID NO: 700481 - DNA, 20 bp, Homo sapiens
caagtccctgactctctgtg

SEQ ID NO: 700482 - DNA, 21 bp, Homo sapiens
caagtccctgttttctgagcc

SEQ ID NO: 700483 - DNA, 22 bp, Homo sapiens
caagtccctgttttctgagccc

SEQ ID NO: 700484 - DNA, 20 bp, Homo sapiens
caagtcctgaagaggcgggc

SEQ ID NO: 700485 - DNA, 15 bp, Homo sapiens
caagtcctggctaca

SEQ ID NO: 700486 - DNA, 22 bp, Homo sapiens
caagtcctggctacatcccagc

SEQ ID NO: 700487 - DNA, 22 bp, Homo sapiens
caagtccttacctcttccggag

SEQ ID NO: 700488 - DNA, 21 bp, Homo sapiens
caagtccttgacctctataaa

SEQ ID NO: 700489 - DNA, 13 bp, Homo sapiens
caagtcggggcct

SEQ ID NO: 700490 - DNA, 14 bp, Homo sapiens
caagtctccttccc

SEQ ID NO: 700491 - DNA, 15 bp, Homo sapiens
caagtctctctgtga

SEQ ID NO: 700492 - DNA, 16 bp, Homo sapiens
caagtctctctgtgaa

SEQ ID NO: 700493 - DNA, 19 bp, Homo sapiens
caagtctctgctggcccag

SEQ ID NO: 700494 - DNA, 23 bp, Homo sapiens
caagtctctgctggcccagccaa

SEQ ID NO: 700495 - DNA, 18 bp, Homo sapiens
caagtcttctcccgtcca

SEQ ID NO: 700496 - DNA, 22 bp, Homo sapiens
caagtgaagaacactactgcta

SEQ ID NO: 700497 - DNA, 12 bp, Homo sapiens
caagtgaaggtt

SEQ ID NO: 700498 - DNA, 21 bp, Homo sapiens
caagtgaaggttcccaaggac

SEQ ID NO: 700499 - DNA, 23 bp, Homo sapiens
caagtgaaggttcccaaggacat

SEQ ID NO: 700500 - DNA, 21 bp, Homo sapiens
caagtgaaggtttacaattta

SEQ ID NO: 700501 - DNA, 20 bp, Homo sapiens
caagtgaatctttctcctgg

SEQ ID NO: 700502 - DNA, 23 bp, Homo sapiens
caagtgaatctttctcctggtga

SEQ ID NO: 700503 - DNA, 13 bp, Homo sapiens
caagtgaccaggg

SEQ ID NO: 700504 - DNA, 23 bp, Homo sapiens
caagtgactctcctgcctcagcc

SEQ ID NO: 700505 - DNA, 16 bp, Homo sapiens
caagtgagaggggagg

SEQ ID NO: 700506 - DNA, 18 bp, Homo sapiens
caagtgagaggggaggga

SEQ ID NO: 700507 - DNA, 19 bp, Homo sapiens
caagtgaggtgtgtcacaa

SEQ ID NO: 700508 - DNA, 23 bp, Homo sapiens
caagtgagtctggtggaggagct

SEQ ID NO: 700509 - DNA, 23 bp, Homo sapiens
caagtgataattttatttataaa

SEQ ID NO: 700510 - DNA, 21 bp, Homo sapiens
caagtgatcctcacgccttgg

SEQ ID NO: 700511 - DNA, 15 bp, Homo sapiens
caagtgattgaaaat

SEQ ID NO: 700512 - DNA, 19 bp, Homo sapiens
caagtgattgaaaatagta

SEQ ID NO: 700513 - DNA, 16 bp, Homo sapiens
caagtgcaatagatta

SEQ ID NO: 700514 - DNA, 20 bp, Homo sapiens
caagtgcactttctaatgtt

SEQ ID NO: 700515 - DNA, 15 bp, Homo sapiens
acgtgtatgtttctt

SEQ ID NO: 700516 - DNA, 21 bp, Homo sapiens
acgtgtccgtccacccttcca

SEQ ID NO: 700517 - DNA, 14 bp, Homo sapiens
acgtgtggcctccg

SEQ ID NO: 700518 - DNA, 22 bp, Homo sapiens
acgtgtgtccaggctctgggca

SEQ ID NO: 700519 - DNA, 23 bp, Homo sapiens
acgtgtgtccaggctctgggcac

SEQ ID NO: 700520 - DNA, 16 bp, Homo sapiens
acgtgtgtgactcaga

SEQ ID NO: 700521 - DNA, 11 bp, Homo sapiens
acgtgttgcct

SEQ ID NO: 700522 - DNA, 14 bp, Homo sapiens
acgtgttgtatcta

SEQ ID NO: 700523 - DNA, 11 bp, Homo sapiens
acgtgtttaaa

SEQ ID NO: 700524 - DNA, 16 bp, Homo sapiens
acgtgtttgtgctgtg

SEQ ID NO: 700525 - DNA, 23 bp, Homo sapiens
acgttaaaagcaaaaagatgtat

SEQ ID NO: 700526 - DNA, 15 bp, Homo sapiens
acgttactcagggct

SEQ ID NO: 700527 - DNA, 15 bp, Homo sapiens
acgttagcagcccag

SEQ ID NO: 700528 - DNA, 14 bp, Homo sapiens
acgttcagggaggg

SEQ ID NO: 700529 - DNA, 16 bp, Homo sapiens
acgttcatcacctgct

SEQ ID NO: 700530 - DNA, 18 bp, Homo sapiens
acgttcctattgtcatta

SEQ ID NO: 700531 - DNA, 13 bp, Homo sapiens
acgttcctggccc

SEQ ID NO: 700532 - DNA, 18 bp, Homo sapiens
acgttctctttaaaagct

SEQ ID NO: 700533 - DNA, 21 bp, Homo sapiens
acgttgaaccacgtgaaactg

SEQ ID NO: 700534 - DNA, 13 bp, Homo sapiens
acgttgacgggcc

SEQ ID NO: 700535 - DNA, 22 bp, Homo sapiens
acgttgacgggccgcaggaggg

SEQ ID NO: 700536 - DNA, 22 bp, Homo sapiens
acgttgccacaccaatcagaga

SEQ ID NO: 700537 - DNA, 21 bp, Homo sapiens
acgttgccaggggcttgagaa

SEQ ID NO: 700538 - DNA, 12 bp, Homo sapiens
acgttggacttt

SEQ ID NO: 700539 - DNA, 12 bp, Homo sapiens
acgttgttgtca

SEQ ID NO: 700540 - DNA, 17 bp, Homo sapiens
acgtttaagccaaaaca

SEQ ID NO: 700541 - DNA, 19 bp, Homo sapiens
acgtttaagccaaaacaat

SEQ ID NO: 700542 - DNA, 12 bp, Homo sapiens
acgtttccatca

SEQ ID NO: 700543 - DNA, 18 bp, Homo sapiens
acgtttgcaccgcctgcc

SEQ ID NO: 700544 - DNA, 13 bp, Homo sapiens
acgtttgtatgtg

SEQ ID NO: 700545 - DNA, 15 bp, Homo sapiens
acgttttattgtgtt

SEQ ID NO: 700546 - DNA, 16 bp, Homo sapiens
acgttttattgtgttt

SEQ ID NO: 700547 - DNA, 20 bp, Homo sapiens
acgttttcttctttccctgg

SEQ ID NO: 700548 - DNA, 21 bp, Homo sapiens
acgttttcttctttccctgga

SEQ ID NO: 700549 - DNA, 22 bp, Homo sapiens
acgttttcttctttccctggac

SEQ ID NO: 700550 - DNA, 16 bp, Homo sapiens
acgttttctttacaca

SEQ ID NO: 700551 - DNA, 15 bp, Homo sapiens
acgttttgtgtatat

SEQ ID NO: 700552 - DNA, 17 bp, Homo sapiens
actaaaaagtataaaat

SEQ ID NO: 700553 - DNA, 20 bp, Homo sapiens
actaaaaagtataaaatagt

SEQ ID NO: 700554 - DNA, 16 bp, Homo sapiens
actaaaaataaattaa

SEQ ID NO: 700555 - DNA, 13 bp, Homo sapiens
actaaaaatatag

SEQ ID NO: 700556 - DNA, 13 bp, Homo sapiens
actaaaaatattg

SEQ ID NO: 700557 - DNA, 21 bp, Homo sapiens
actaaaaatattgtttctgca

SEQ ID NO: 700558 - DNA, 12 bp, Homo sapiens
actaaaaatgca

SEQ ID NO: 700559 - DNA, 15 bp, Homo sapiens
actaaaataattttg

SEQ ID NO: 700560 - DNA, 16 bp, Homo sapiens
actaaaataattttgt

SEQ ID NO: 700561 - DNA, 17 bp, Homo sapiens
actaaaataattttgta

SEQ ID NO: 700562 - DNA, 19 bp, Homo sapiens
actaaaataattttgtaat

SEQ ID NO: 700563 - DNA, 12 bp, Homo sapiens
actaaacagaaa

SEQ ID NO: 700564 - DNA, 14 bp, Homo sapiens
actaaacattttgt

SEQ ID NO: 700565 - DNA, 16 bp, Homo sapiens
actaaaccaagttatt

SEQ ID NO: 700566 - DNA, 15 bp, Homo sapiens
actaaactctctttg

SEQ ID NO: 700567 - DNA, 13 bp, Homo sapiens
actaaactctggg

SEQ ID NO: 700568 - DNA, 18 bp, Homo sapiens
actaaactctggggcttg

SEQ ID NO: 700569 - DNA, 19 bp, Homo sapiens
actaaacttggtgcttatt

SEQ ID NO: 700570 - DNA, 15 bp, Homo sapiens
actaaagaaagatta

SEQ ID NO: 700571 - DNA, 14 bp, Homo sapiens
actaaagagagaat

SEQ ID NO: 700572 - DNA, 21 bp, Homo sapiens
actaaagatatcagagctctt

SEQ ID NO: 700573 - DNA, 11 bp, Homo sapiens
actaaagcaaa

SEQ ID NO: 700574 - DNA, 20 bp, Homo sapiens
actaaagcagtggacaccag

SEQ ID NO: 700575 - DNA, 16 bp, Homo sapiens
actaaagccagcctga

SEQ ID NO: 700576 - DNA, 23 bp, Homo sapiens
actaaataatgaataaactgaat

SEQ ID NO: 700577 - DNA, 19 bp, Homo sapiens
actaaatatatattatgca

SEQ ID NO: 700578 - DNA, 17 bp, Homo sapiens
actaaatatatgtctgt

SEQ ID NO: 700579 - DNA, 15 bp, Homo sapiens
actaaatcagagaca

SEQ ID NO: 700580 - DNA, 21 bp, Homo sapiens
actaaatcagagacaaaatat

SEQ ID NO: 700581 - DNA, 14 bp, Homo sapiens
actaaatcccctca

SEQ ID NO: 700582 - DNA, 13 bp, Homo sapiens
actaaatctttta

SEQ ID NO: 700583 - DNA, 18 bp, Homo sapiens
actaaatggtgttacatt

SEQ ID NO: 700584 - DNA, 19 bp, Homo sapiens
actaaatggtgttacatta

SEQ ID NO: 700585 - DNA, 14 bp, Homo sapiens
actaaattactgtt

SEQ ID NO: 700586 - DNA, 13 bp, Homo sapiens
actaaattttctt

SEQ ID NO: 700587 - DNA, 17 bp, Homo sapiens
actaaattttcttttaa

SEQ ID NO: 700588 - DNA, 20 bp, Homo sapiens
actaaattttcttttaagca

SEQ ID NO: 700589 - DNA, 16 bp, Homo sapiens
actaaatttttcatag

SEQ ID NO: 700590 - DNA, 12 bp, Homo sapiens
actaacactggc

SEQ ID NO: 700591 - DNA, 16 bp, Homo sapiens
actaacagataagcaa

SEQ ID NO: 700592 - DNA, 16 bp, Homo sapiens
actaacagtcaagaaa

SEQ ID NO: 700593 - DNA, 17 bp, Homo sapiens
actaacatgtcctgcct

SEQ ID NO: 700594 - DNA, 15 bp, Homo sapiens
actaaccaagctgag

SEQ ID NO: 700595 - DNA, 18 bp, Homo sapiens
actaaccaagctgagttt

SEQ ID NO: 700596 - DNA, 21 bp, Homo sapiens
actaaccaagctgagtttcct

SEQ ID NO: 700597 - DNA, 22 bp, Homo sapiens
actaaccaagctgagtttccta

SEQ ID NO: 700598 - DNA, 23 bp, Homo sapiens
actaaccagggaagctgtccctc

SEQ ID NO: 700599 - DNA, 19 bp, Homo sapiens
actaaccagtacctctgta

SEQ ID NO: 700600 - DNA, 21 bp, Homo sapiens
actaaccatgtgttatgtttt

SEQ ID NO: 700601 - DNA, 17 bp, Homo sapiens
actaaccttgcctggta

SEQ ID NO: 700602 - DNA, 21 bp, Homo sapiens
actaaccttgcctggtacagt

SEQ ID NO: 700603 - DNA, 22 bp, Homo sapiens
actaacgaaatatcaaagtcat

SEQ ID NO: 700604 - DNA, 13 bp, Homo sapiens
actaactaaactc

SEQ ID NO: 700605 - DNA, 22 bp, Homo sapiens
actaactcaccagccccactgc

SEQ ID NO: 700606 - DNA, 20 bp, Homo sapiens
actaactgcttcatctcctt

SEQ ID NO: 700607 - DNA, 23 bp, Homo sapiens
actaacttatttatgttaaaaga

SEQ ID NO: 700608 - DNA, 13 bp, Homo sapiens
actaactttggtc

SEQ ID NO: 700609 - DNA, 14 bp, Homo sapiens
actaagaaaagata

SEQ ID NO: 700610 - DNA, 19 bp, Homo sapiens
actaagaacccctctgctt

SEQ ID NO: 700611 - DNA, 13 bp, Homo sapiens
actaagaagaaaa

SEQ ID NO: 700612 - DNA, 14 bp, Homo sapiens
actaagaagaaaat

SEQ ID NO: 700613 - DNA, 17 bp, Homo sapiens
actaagaaggaaaagaa

SEQ ID NO: 700614 - DNA, 23 bp, Homo sapiens
actaagaataacaagaagcccag

SEQ ID NO: 700615 - DNA, 16 bp, Homo sapiens
actaagaattcaaact

SEQ ID NO: 700616 - DNA, 20 bp, Homo sapiens
actaagaccctggtctgagg

SEQ ID NO: 700617 - DNA, 16 bp, Homo sapiens
actaagagaagttgta

SEQ ID NO: 700618 - DNA, 19 bp, Homo sapiens
actaagagacagttctctg

SEQ ID NO: 700619 - DNA, 22 bp, Homo sapiens
actaagatctgttaaaaaagaa

SEQ ID NO: 700620 - DNA, 18 bp, Homo sapiens
actaagatgaaattgcca

SEQ ID NO: 700621 - DNA, 19 bp, Homo sapiens
actaagatgaaattgccaa

SEQ ID NO: 700622 - DNA, 12 bp, Homo sapiens
actaagcagagg

SEQ ID NO: 700623 - DNA, 14 bp, Homo sapiens
actaagccaggagg

SEQ ID NO: 700624 - DNA, 15 bp, Homo sapiens
actaagccaggaggc

SEQ ID NO: 700625 - DNA, 16 bp, Homo sapiens
actaagccaggaggct

SEQ ID NO: 700626 - DNA, 22 bp, Homo sapiens
actaagccctgtcgagacactt

SEQ ID NO: 700627 - DNA, 21 bp, Homo sapiens
actaagctttgccagctgctg

SEQ ID NO: 700628 - DNA, 14 bp, Homo sapiens
actaaggacaaatt

SEQ ID NO: 700629 - DNA, 15 bp, Homo sapiens
actaaggacaaatta

SEQ ID NO: 700630 - DNA, 16 bp, Homo sapiens
actaaggcttttattt

SEQ ID NO: 700631 - DNA, 18 bp, Homo sapiens
actaaggcttttatttct

SEQ ID NO: 700632 - DNA, 12 bp, Homo sapiens
actaaggggccc

SEQ ID NO: 700633 - DNA, 21 bp, Homo sapiens
actaaggggcccggccagcca

SEQ ID NO: 700634 - DNA, 17 bp, Homo sapiens
actaagttatagtatat

SEQ ID NO: 700635 - DNA, 20 bp, Homo sapiens
actaagttttgtgtgtatat

SEQ ID NO: 700636 - DNA, 15 bp, Homo sapiens
actaataaatacata

SEQ ID NO: 700637 - DNA, 11 bp, Homo sapiens
actaataattg

SEQ ID NO: 700638 - DNA, 21 bp, Homo sapiens
actaatataacttgaaaattt

SEQ ID NO: 700639 - DNA, 20 bp, Homo sapiens
actaatccattatcctttat

SEQ ID NO: 700640 - DNA, 13 bp, Homo sapiens
caagtgcaggctg

SEQ ID NO: 700641 - DNA, 13 bp, Homo sapiens
caagtgccagagg

SEQ ID NO: 700642 - DNA, 16 bp, Homo sapiens
caagtgccagaggtgg

SEQ ID NO: 700643 - DNA, 20 bp, Homo sapiens
caagtgccagaggtgggcag

SEQ ID NO: 700644 - DNA, 11 bp, Homo sapiens
caagtgcctca

SEQ ID NO: 700645 - DNA, 13 bp, Homo sapiens
caagtgctggagt

SEQ ID NO: 700646 - DNA, 23 bp, Homo sapiens
caagtggactcagggcagcgcca

SEQ ID NO: 700647 - DNA, 16 bp, Homo sapiens
caagtggacttggagc

SEQ ID NO: 700648 - DNA, 21 bp, Homo sapiens
caagtggatgggaatttgtca

SEQ ID NO: 700649 - DNA, 22 bp, Homo sapiens
caagtggatgggaatttgtcag

SEQ ID NO: 700650 - DNA, 19 bp, Homo sapiens
caagtggcatgtgctgtga

SEQ ID NO: 700651 - DNA, 13 bp, Homo sapiens
caagtgggctggt

SEQ ID NO: 700652 - DNA, 13 bp, Homo sapiens
caagtgggggcag

SEQ ID NO: 700653 - DNA, 20 bp, Homo sapiens
caagtgggggcagagggcag

SEQ ID NO: 700654 - DNA, 17 bp, Homo sapiens
caagtggggtgctggga

SEQ ID NO: 700655 - DNA, 21 bp, Homo sapiens
caagtggggtgctgggaggag

SEQ ID NO: 700656 - DNA, 15 bp, Homo sapiens
caagtggtgaccaaa

SEQ ID NO: 700657 - DNA, 18 bp, Homo sapiens
caagtggtggtaaccctg

SEQ ID NO: 700658 - DNA, 15 bp, Homo sapiens
caagtgtaaaatatt

SEQ ID NO: 700659 - DNA, 21 bp, Homo sapiens
caagtgtaaaatattttgaat

SEQ ID NO: 700660 - DNA, 21 bp, Homo sapiens
caagtgtagatgtagcattgt

SEQ ID NO: 700661 - DNA, 14 bp, Homo sapiens
caagtgtatatcag

SEQ ID NO: 700662 - DNA, 14 bp, Homo sapiens
caagtgtcttccat

SEQ ID NO: 700663 - DNA, 19 bp, Homo sapiens
caagtgtgaacaaaagatg

SEQ ID NO: 700664 - DNA, 23 bp, Homo sapiens
caagtgtggagagggcagggtcc

SEQ ID NO: 700665 - DNA, 19 bp, Homo sapiens
caagtgtgggaacattatt

SEQ ID NO: 700666 - DNA, 22 bp, Homo sapiens
caagtgtggtagagtgtgcctg

SEQ ID NO: 700667 - DNA, 23 bp, Homo sapiens
caagtgtggtagggacttaaaaa

SEQ ID NO: 700668 - DNA, 12 bp, Homo sapiens
caagtgtgtgag

SEQ ID NO: 700669 - DNA, 21 bp, Homo sapiens
caagtgtgtgcacatgtgtgc

SEQ ID NO: 700670 - DNA, 22 bp, Homo sapiens
caagtgtgtgcacatgtgtgcg

SEQ ID NO: 700671 - DNA, 16 bp, Homo sapiens
caagtgttaaggcaac

SEQ ID NO: 700672 - DNA, 22 bp, Homo sapiens
caagtgttaaggcaacattcct

SEQ ID NO: 700673 - DNA, 17 bp, Homo sapiens
caagtgttttagatgtt

SEQ ID NO: 700674 - DNA, 17 bp, Homo sapiens
caagtgttttggagaaa

SEQ ID NO: 700675 - DNA, 18 bp, Homo sapiens
caagttaaagtgaataac

SEQ ID NO: 700676 - DNA, 16 bp, Homo sapiens
caagttaacaaggaat

SEQ ID NO: 700677 - DNA, 13 bp, Homo sapiens
caagttagctcag

SEQ ID NO: 700678 - DNA, 16 bp, Homo sapiens
caagttagctcaggag

SEQ ID NO: 700679 - DNA, 14 bp, Homo sapiens
caagttatattgaa

SEQ ID NO: 700680 - DNA, 19 bp, Homo sapiens
caagttatattgaatatat

SEQ ID NO: 700681 - DNA, 19 bp, Homo sapiens
caagttattcaaatttgta

SEQ ID NO: 700682 - DNA, 20 bp, Homo sapiens
caagttattcaaatttgtac

SEQ ID NO: 700683 - DNA, 20 bp, Homo sapiens
caagttattgtacagctgtt

SEQ ID NO: 700684 - DNA, 18 bp, Homo sapiens
caagttccaagttgctaa

SEQ ID NO: 700685 - DNA, 22 bp, Homo sapiens
caagttccccatccctgtcatt

SEQ ID NO: 700686 - DNA, 21 bp, Homo sapiens
caagttcctctagtgccctcc

SEQ ID NO: 700687 - DNA, 21 bp, Homo sapiens
caagttctagagaagaggctg

SEQ ID NO: 700688 - DNA, 16 bp, Homo sapiens
caagttctaggccccc

SEQ ID NO: 700689 - DNA, 18 bp, Homo sapiens
caagttctatttcttgaa

SEQ ID NO: 700690 - DNA, 14 bp, Homo sapiens
caagttcttcacct

SEQ ID NO: 700691 - DNA, 16 bp, Homo sapiens
caagttcttcacctct

SEQ ID NO: 700692 - DNA, 17 bp, Homo sapiens
caagttcttcacctcta

SEQ ID NO: 700693 - DNA, 15 bp, Homo sapiens
caagttcttggacca

SEQ ID NO: 700694 - DNA, 22 bp, Homo sapiens
caagttcttggaccagtttgca

SEQ ID NO: 700695 - DNA, 19 bp, Homo sapiens
caagttgaagactttgttt

SEQ ID NO: 700696 - DNA, 15 bp, Homo sapiens
caagttgaattgagg

SEQ ID NO: 700697 - DNA, 13 bp, Homo sapiens
caagttgagattt

SEQ ID NO: 700698 - DNA, 19 bp, Homo sapiens
caagttgagatttttaaga

SEQ ID NO: 700699 - DNA, 20 bp, Homo sapiens
caagttgagatttttaagaa

SEQ ID NO: 700700 - DNA, 12 bp, Homo sapiens
caagttgcagtg

SEQ ID NO: 700701 - DNA, 18 bp, Homo sapiens
caagttgcagtgagcagg

SEQ ID NO: 700702 - DNA, 23 bp, Homo sapiens
caagttgcagtgagcagggtggg

SEQ ID NO: 700703 - DNA, 15 bp, Homo sapiens
caagttgcgacggag

SEQ ID NO: 700704 - DNA, 20 bp, Homo sapiens
caagttgcgacggagagaaa

SEQ ID NO: 700705 - DNA, 15 bp, Homo sapiens
caagttgctaataca

SEQ ID NO: 700706 - DNA, 12 bp, Homo sapiens
caagttgtaaat

SEQ ID NO: 700707 - DNA, 17 bp, Homo sapiens
caagttgtgcttgttta

SEQ ID NO: 700708 - DNA, 20 bp, Homo sapiens
caagttgttattgttgaaca

SEQ ID NO: 700709 - DNA, 21 bp, Homo sapiens
caagttgttccttaagtcaga

SEQ ID NO: 700710 - DNA, 16 bp, Homo sapiens
caagttgtttcattga

SEQ ID NO: 700711 - DNA, 16 bp, Homo sapiens
caagtttaaaagccat

SEQ ID NO: 700712 - DNA, 20 bp, Homo sapiens
caagtttatcagtaaataac

SEQ ID NO: 700713 - DNA, 22 bp, Homo sapiens
caagtttatcagtaaataactg

SEQ ID NO: 700714 - DNA, 14 bp, Homo sapiens
caagtttcagacag

SEQ ID NO: 700715 - DNA, 22 bp, Homo sapiens
caagtttctagctagaaatatg

SEQ ID NO: 700716 - DNA, 23 bp, Homo sapiens
caagtttctagctagaaatatga

SEQ ID NO: 700717 - DNA, 17 bp, Homo sapiens
caagtttgaccagtgca

SEQ ID NO: 700718 - DNA, 19 bp, Homo sapiens
caagtttgaccagtgcagt

SEQ ID NO: 700719 - DNA, 22 bp, Homo sapiens
caagttttaggacaaacagctc

SEQ ID NO: 700720 - DNA, 21 bp, Homo sapiens
caagttttcttccatgatttt

SEQ ID NO: 700721 - DNA, 14 bp, Homo sapiens
caagttttgtataa

SEQ ID NO: 700722 - DNA, 19 bp, Homo sapiens
caagttttgtataaataat

SEQ ID NO: 700723 - DNA, 16 bp, Homo sapiens
caataaaaaaaagaaa

SEQ ID NO: 700724 - DNA, 19 bp, Homo sapiens
caataaaaaaaagaaatga

SEQ ID NO: 700725 - DNA, 20 bp, Homo sapiens
caataaaaacattttgaagt

SEQ ID NO: 700726 - DNA, 19 bp, Homo sapiens
caataaaaagttcagagtt

SEQ ID NO: 700727 - DNA, 20 bp, Homo sapiens
caataaaaagttcagagttc

SEQ ID NO: 700728 - DNA, 13 bp, Homo sapiens
caataaaaatgtt

SEQ ID NO: 700729 - DNA, 19 bp, Homo sapiens
caataaaagagctgtctga

SEQ ID NO: 700730 - DNA, 22 bp, Homo sapiens
caataaaagagctgtctgactg

SEQ ID NO: 700731 - DNA, 14 bp, Homo sapiens
caataaaagagctt

SEQ ID NO: 700732 - DNA, 18 bp, Homo sapiens
caataaaagtgactctca

SEQ ID NO: 700733 - DNA, 14 bp, Homo sapiens
caataaaatattat

SEQ ID NO: 700734 - DNA, 21 bp, Homo sapiens
caataaaatattattgaacta

SEQ ID NO: 700735 - DNA, 18 bp, Homo sapiens
caataaaatttctaagag

SEQ ID NO: 700736 - DNA, 18 bp, Homo sapiens
caataaaatttttttaaa

SEQ ID NO: 700737 - DNA, 12 bp, Homo sapiens
caataaacagga

SEQ ID NO: 700738 - DNA, 15 bp, Homo sapiens
caataaacaggaatt

SEQ ID NO: 700739 - DNA, 16 bp, Homo sapiens
caataaacaggaattt

SEQ ID NO: 700740 - DNA, 17 bp, Homo sapiens
caataaacaggaatttt

SEQ ID NO: 700741 - DNA, 20 bp, Homo sapiens
caataaaccaaacccagcca

SEQ ID NO: 700742 - DNA, 13 bp, Homo sapiens
caataaaccaggt

SEQ ID NO: 700743 - DNA, 17 bp, Homo sapiens
caataaaccttgaacag

SEQ ID NO: 700744 - DNA, 13 bp, Homo sapiens
caataaagaagag

SEQ ID NO: 700745 - DNA, 12 bp, Homo sapiens
caataaagaatt

SEQ ID NO: 700746 - DNA, 17 bp, Homo sapiens
caataaagcactgagca

SEQ ID NO: 700747 - DNA, 23 bp, Homo sapiens
caataaagcagagccaaggccac

SEQ ID NO: 700748 - DNA, 19 bp, Homo sapiens
caataaagcagcgtttcta

SEQ ID NO: 700749 - DNA, 15 bp, Homo sapiens
caataaagcatttat

SEQ ID NO: 700750 - DNA, 13 bp, Homo sapiens
caataaaggcagc

SEQ ID NO: 700751 - DNA, 16 bp, Homo sapiens
caataaaggcagctgc

SEQ ID NO: 700752 - DNA, 19 bp, Homo sapiens
caataaaggcagctgcctc

SEQ ID NO: 700753 - DNA, 24 bp, Homo sapiens
caataaaggcagctgcctctgctc

SEQ ID NO: 700754 - DNA, 13 bp, Homo sapiens
caataaagggaga

SEQ ID NO: 700755 - DNA, 22 bp, Homo sapiens
caataaagggagaatggtgctg

SEQ ID NO: 700756 - DNA, 19 bp, Homo sapiens
caataaagtgatctgtgtt

SEQ ID NO: 700757 - DNA, 17 bp, Homo sapiens
caataaagtgccttctg

SEQ ID NO: 700758 - DNA, 18 bp, Homo sapiens
caataaagtgccttctgg

SEQ ID NO: 700759 - DNA, 14 bp, Homo sapiens
caataaatggccag

SEQ ID NO: 700760 - DNA, 22 bp, Homo sapiens
caataaatggccagtgctgctt

SEQ ID NO: 700761 - DNA, 22 bp, Homo sapiens
caataaatgtttgttatttaca

SEQ ID NO: 700762 - DNA, 16 bp, Homo sapiens
caataacaaagcacat

SEQ ID NO: 700763 - DNA, 14 bp, Homo sapiens
caataacactaaaa

SEQ ID NO: 700764 - DNA, 18 bp, Homo sapiens
actaatctattgggttca

SEQ ID NO: 700765 - DNA, 20 bp, Homo sapiens
actaatctattgggttcatt

SEQ ID NO: 700766 - DNA, 19 bp, Homo sapiens
actaatgaacaaatatgct

SEQ ID NO: 700767 - DNA, 20 bp, Homo sapiens
actaatgagtatgaacttga

SEQ ID NO: 700768 - DNA, 22 bp, Homo sapiens
actaatgagtatgaacttgaga

SEQ ID NO: 700769 - DNA, 18 bp, Homo sapiens
actaatgatgagcattta

SEQ ID NO: 700770 - DNA, 15 bp, Homo sapiens
actaatgatgctttt

SEQ ID NO: 700771 - DNA, 19 bp, Homo sapiens
actaatgccttactcttct

SEQ ID NO: 700772 - DNA, 24 bp, Homo sapiens
actaatgccttactcttcttgaaa

SEQ ID NO: 700773 - DNA, 18 bp, Homo sapiens
actaatgcttacaacttt

SEQ ID NO: 700774 - DNA, 22 bp, Homo sapiens
actaatgcttacaactttctaa

SEQ ID NO: 700775 - DNA, 13 bp, Homo sapiens
actaatgtactgt

SEQ ID NO: 700776 - DNA, 12 bp, Homo sapiens
actaatgtgatg

SEQ ID NO: 700777 - DNA, 15 bp, Homo sapiens
actaattaaaatctg

SEQ ID NO: 700778 - DNA, 17 bp, Homo sapiens
actaattatactacttt

SEQ ID NO: 700779 - DNA, 17 bp, Homo sapiens
actaattctatttctct

SEQ ID NO: 700780 - DNA, 18 bp, Homo sapiens
actaattctatttctcta

SEQ ID NO: 700781 - DNA, 20 bp, Homo sapiens
actaattggcctctttaaga

SEQ ID NO: 700782 - DNA, 15 bp, Homo sapiens
actaatttaaaaaat

SEQ ID NO: 700783 - DNA, 15 bp, Homo sapiens
actaatttatacttt

SEQ ID NO: 700784 - DNA, 17 bp, Homo sapiens
actaatttatactttaa

SEQ ID NO: 700785 - DNA, 23 bp, Homo sapiens
actaattttacacattagatttt

SEQ ID NO: 700786 - DNA, 15 bp, Homo sapiens
actaattttacatgt

SEQ ID NO: 700787 - DNA, 21 bp, Homo sapiens
actaattttacatgtttataa

SEQ ID NO: 700788 - DNA, 18 bp, Homo sapiens
actaattttgttgaaaat

SEQ ID NO: 700789 - DNA, 18 bp, Homo sapiens
actaatttttgtattatt

SEQ ID NO: 700790 - DNA, 11 bp, Homo sapiens
actacaaaaac

SEQ ID NO: 700791 - DNA, 14 bp, Homo sapiens
actacaaaatacaa

SEQ ID NO: 700792 - DNA, 15 bp, Homo sapiens
actacaaaatacaat

SEQ ID NO: 700793 - DNA, 20 bp, Homo sapiens
actacaaaatacaatcctgt

SEQ ID NO: 700794 - DNA, 13 bp, Homo sapiens
actacaaaatttg

SEQ ID NO: 700795 - DNA, 16 bp, Homo sapiens
actacaaaatttgaaa

SEQ ID NO: 700796 - DNA, 23 bp, Homo sapiens
actacaaagcttctatcccagga

SEQ ID NO: 700797 - DNA, 16 bp, Homo sapiens
actacaaagctttgct

SEQ ID NO: 700798 - DNA, 17 bp, Homo sapiens
actacaaagctttgcta

SEQ ID NO: 700799 - DNA, 18 bp, Homo sapiens
actacaaagctttgctac

SEQ ID NO: 700800 - DNA, 11 bp, Homo sapiens
actacaaatca

SEQ ID NO: 700801 - DNA, 19 bp, Homo sapiens
actacaaccaagctctctg

SEQ ID NO: 700802 - DNA, 20 bp, Homo sapiens
actacaacttttgttttctg

SEQ ID NO: 700803 - DNA, 13 bp, Homo sapiens
actacaagtcagc

SEQ ID NO: 700804 - DNA, 13 bp, Homo sapiens
actacaatgatgg

SEQ ID NO: 700805 - DNA, 18 bp, Homo sapiens
actacaatgatggtaaag

SEQ ID NO: 700806 - DNA, 22 bp, Homo sapiens
actacacactgtgtactgcagt

SEQ ID NO: 700807 - DNA, 17 bp, Homo sapiens
actacacccaagcctga

SEQ ID NO: 700808 - DNA, 15 bp, Homo sapiens
actacacccagcaat

SEQ ID NO: 700809 - DNA, 21 bp, Homo sapiens
actacaccttgccttgctgtt

SEQ ID NO: 700810 - DNA, 15 bp, Homo sapiens
actacactccagcct

SEQ ID NO: 700811 - DNA, 17 bp, Homo sapiens
actacactccagcctga

SEQ ID NO: 700812 - DNA, 20 bp, Homo sapiens
actacactccagcctgagca

SEQ ID NO: 700813 - DNA, 17 bp, Homo sapiens
actacagaataatgtgt

SEQ ID NO: 700814 - DNA, 18 bp, Homo sapiens
actacagacattaaataa

SEQ ID NO: 700815 - DNA, 17 bp, Homo sapiens
actacagtctaaagctg

SEQ ID NO: 700816 - DNA, 13 bp, Homo sapiens
actacagtttgtt

SEQ ID NO: 700817 - DNA, 17 bp, Homo sapiens
actacataaactgactt

SEQ ID NO: 700818 - DNA, 18 bp, Homo sapiens
actacatctttaaacagt

SEQ ID NO: 700819 - DNA, 20 bp, Homo sapiens
actacatgcagcccatgccc

SEQ ID NO: 700820 - DNA, 12 bp, Homo sapiens
actacattctgt

SEQ ID NO: 700821 - DNA, 13 bp, Homo sapiens
actacattctgtt

SEQ ID NO: 700822 - DNA, 20 bp, Homo sapiens
actacccatcggtgtccatt

SEQ ID NO: 700823 - DNA, 19 bp, Homo sapiens
actaccccacaacacgcct

SEQ ID NO: 700824 - DNA, 16 bp, Homo sapiens
actacccgagcccagc

SEQ ID NO: 700825 - DNA, 13 bp, Homo sapiens
actaccctccaga

SEQ ID NO: 700826 - DNA, 16 bp, Homo sapiens
actaccctgattcttg

SEQ ID NO: 700827 - DNA, 21 bp, Homo sapiens
actaccctttgctggaagaaa

SEQ ID NO: 700828 - DNA, 18 bp, Homo sapiens
actaccgaatgtgtcttt

SEQ ID NO: 700829 - DNA, 19 bp, Homo sapiens
actaccgtggaccacctag

SEQ ID NO: 700830 - DNA, 14 bp, Homo sapiens
actacctataggaa

SEQ ID NO: 700831 - DNA, 14 bp, Homo sapiens
actacctcagaaca

SEQ ID NO: 700832 - DNA, 15 bp, Homo sapiens
actacctctggacag

SEQ ID NO: 700833 - DNA, 15 bp, Homo sapiens
actacggagaaactc

SEQ ID NO: 700834 - DNA, 16 bp, Homo sapiens
actactaacaaatgta

SEQ ID NO: 700835 - DNA, 19 bp, Homo sapiens
actactaatagaataaagg

SEQ ID NO: 700836 - DNA, 14 bp, Homo sapiens
actactcctctgca

SEQ ID NO: 700837 - DNA, 14 bp, Homo sapiens
actactctctgttt

SEQ ID NO: 700838 - DNA, 13 bp, Homo sapiens
actactctgccaa

SEQ ID NO: 700839 - DNA, 15 bp, Homo sapiens
actactgacagggag

SEQ ID NO: 700840 - DNA, 13 bp, Homo sapiens
actactgcagcac

SEQ ID NO: 700841 - DNA, 21 bp, Homo sapiens
actactgctaatgttgatcag

SEQ ID NO: 700842 - DNA, 23 bp, Homo sapiens
actactgctcctgtggcaggagg

SEQ ID NO: 700843 - DNA, 16 bp, Homo sapiens
actactgggtgtcatt

SEQ ID NO: 700844 - DNA, 23 bp, Homo sapiens
actactgggtgtcatttcattcc

SEQ ID NO: 700845 - DNA, 13 bp, Homo sapiens
actactgtacatt

SEQ ID NO: 700846 - DNA, 15 bp, Homo sapiens
actactgtgttcctg

SEQ ID NO: 700847 - DNA, 18 bp, Homo sapiens
actactgtgttcctggca

SEQ ID NO: 700848 - DNA, 21 bp, Homo sapiens
actactgtgttcctggcaata

SEQ ID NO: 700849 - DNA, 17 bp, Homo sapiens
actacttgggagcaccg

SEQ ID NO: 700850 - DNA, 20 bp, Homo sapiens
actactttaataaagaatta

SEQ ID NO: 700851 - DNA, 21 bp, Homo sapiens
actactttgccttcttttgta

SEQ ID NO: 700852 - DNA, 17 bp, Homo sapiens
actacttttctaaaatc

SEQ ID NO: 700853 - DNA, 17 bp, Homo sapiens
actactttttatactcc

SEQ ID NO: 700854 - DNA, 22 bp, Homo sapiens
actactttttatactccataca

SEQ ID NO: 700855 - DNA, 18 bp, Homo sapiens
actagaaagaaggaccca

SEQ ID NO: 700856 - DNA, 15 bp, Homo sapiens
actagaaatctgcca

SEQ ID NO: 700857 - DNA, 14 bp, Homo sapiens
actagaagaaaagc

SEQ ID NO: 700858 - DNA, 15 bp, Homo sapiens
actagaagaaaagcc

SEQ ID NO: 700859 - DNA, 19 bp, Homo sapiens
actagaagaaaagcccatt

SEQ ID NO: 700860 - DNA, 17 bp, Homo sapiens
actagaaggcttctctc

SEQ ID NO: 700861 - DNA, 21 bp, Homo sapiens
actagaaggcttctctccaca

SEQ ID NO: 700862 - DNA, 17 bp, Homo sapiens
actagaattctagtgct

SEQ ID NO: 700863 - DNA, 22 bp, Homo sapiens
actagaattctagtgctgctga

SEQ ID NO: 700864 - DNA, 22 bp, Homo sapiens
actagactggtggcaggggctt

SEQ ID NO: 700865 - DNA, 21 bp, Homo sapiens
actagaggaaaccagtttggt

SEQ ID NO: 700866 - DNA, 19 bp, Homo sapiens
actagagggacctctccca

SEQ ID NO: 700867 - DNA, 21 bp, Homo sapiens
actagagggacctctcccagg

SEQ ID NO: 700868 - DNA, 12 bp, Homo sapiens
actagagggccc

SEQ ID NO: 700869 - DNA, 21 bp, Homo sapiens
actagaggtgttacagaggac

SEQ ID NO: 700870 - DNA, 15 bp, Homo sapiens
actagagtctgaaca

SEQ ID NO: 700871 - DNA, 21 bp, Homo sapiens
actagagtctgaacagctgta

SEQ ID NO: 700872 - DNA, 19 bp, Homo sapiens
actagatactcgtgtgtgg

SEQ ID NO: 700873 - DNA, 15 bp, Homo sapiens
actagatggcgagca

SEQ ID NO: 700874 - DNA, 13 bp, Homo sapiens
actagattacatt

SEQ ID NO: 700875 - DNA, 15 bp, Homo sapiens
actagatttgtcctt

SEQ ID NO: 700876 - DNA, 19 bp, Homo sapiens
actagatttgtccttttat

SEQ ID NO: 700877 - DNA, 19 bp, Homo sapiens
actagcaaaataaaacata

SEQ ID NO: 700878 - DNA, 23 bp, Homo sapiens
actagcaatctcttcattattct

SEQ ID NO: 700879 - DNA, 21 bp, Homo sapiens
actagcaggctactgggacct

SEQ ID NO: 700880 - DNA, 10 bp, Homo sapiens
actagcatta

SEQ ID NO: 700881 - DNA, 14 bp, Homo sapiens
actagccaaaccag

SEQ ID NO: 700882 - DNA, 16 bp, Homo sapiens
actagccaaggctagt

SEQ ID NO: 700883 - DNA, 22 bp, Homo sapiens
actagccagacactctgctctg

SEQ ID NO: 700884 - DNA, 15 bp, Homo sapiens
actaggaatcccaga

SEQ ID NO: 700885 - DNA, 18 bp, Homo sapiens
actaggactcagaaacga

SEQ ID NO: 700886 - DNA, 18 bp, Homo sapiens
actaggagaaccaaatct

SEQ ID NO: 700887 - DNA, 15 bp, Homo sapiens
actaggatatgtata

SEQ ID NO: 700888 - DNA, 18 bp, Homo sapiens
actaggcccccacttgcc

SEQ ID NO: 700889 - DNA, 17 bp, Homo sapiens
caataacactaaaattt

SEQ ID NO: 700890 - DNA, 13 bp, Homo sapiens
caataacactgtc

SEQ ID NO: 700891 - DNA, 15 bp, Homo sapiens
caataacccagttac

SEQ ID NO: 700892 - DNA, 19 bp, Homo sapiens
caataacccagttactttt

SEQ ID NO: 700893 - DNA, 15 bp, Homo sapiens
caataacgtttaagc

SEQ ID NO: 700894 - DNA, 15 bp, Homo sapiens
caataactactgtgt

SEQ ID NO: 700895 - DNA, 16 bp, Homo sapiens
caataactactgtgtt

SEQ ID NO: 700896 - DNA, 16 bp, Homo sapiens
caataactccaagcag

SEQ ID NO: 700897 - DNA, 17 bp, Homo sapiens
caataactctgggaggg

SEQ ID NO: 700898 - DNA, 12 bp, Homo sapiens
caataacttcta

SEQ ID NO: 700899 - DNA, 13 bp, Homo sapiens
caataacttctat

SEQ ID NO: 700900 - DNA, 12 bp, Homo sapiens
caataagaaatg

SEQ ID NO: 700901 - DNA, 15 bp, Homo sapiens
caataagaaatgaac

SEQ ID NO: 700902 - DNA, 16 bp, Homo sapiens
caataagaaatgaaca

SEQ ID NO: 700903 - DNA, 21 bp, Homo sapiens
caataagaaatgaacaaaaga

SEQ ID NO: 700904 - DNA, 22 bp, Homo sapiens
caataagctggactagtgtcct

SEQ ID NO: 700905 - DNA, 14 bp, Homo sapiens
caataaggagcatc

SEQ ID NO: 700906 - DNA, 23 bp, Homo sapiens
caataagtgtgtggtagaaacaa

SEQ ID NO: 700907 - DNA, 21 bp, Homo sapiens
caataagtttgaacctttttt

SEQ ID NO: 700908 - DNA, 14 bp, Homo sapiens
caataataaagaca

SEQ ID NO: 700909 - DNA, 18 bp, Homo sapiens
caataataataaattaaa

SEQ ID NO: 700910 - DNA, 16 bp, Homo sapiens
caataatatattttct

SEQ ID NO: 700911 - DNA, 17 bp, Homo sapiens
caataatatattttctg

SEQ ID NO: 700912 - DNA, 17 bp, Homo sapiens
caataatatcaaaacaa

SEQ ID NO: 700913 - DNA, 15 bp, Homo sapiens
caataatcagaaaag

SEQ ID NO: 700914 - DNA, 18 bp, Homo sapiens
caataatcagaaaagtaa

SEQ ID NO: 700915 - DNA, 22 bp, Homo sapiens
caataatcagaaaagtaatttt

SEQ ID NO: 700916 - DNA, 17 bp, Homo sapiens
caataatgtgcaaattt

SEQ ID NO: 700917 - DNA, 20 bp, Homo sapiens
caataatgtgcaaattttgc

SEQ ID NO: 700918 - DNA, 12 bp, Homo sapiens
caataattgttt

SEQ ID NO: 700919 - DNA, 14 bp, Homo sapiens
caataatttcaggt

SEQ ID NO: 700920 - DNA, 16 bp, Homo sapiens
caataatttgtacaat

SEQ ID NO: 700921 - DNA, 17 bp, Homo sapiens
caataatttgtacaatg

SEQ ID NO: 700922 - DNA, 15 bp, Homo sapiens
caatacaaatggatt

SEQ ID NO: 700923 - DNA, 16 bp, Homo sapiens
caatacaactttacca

SEQ ID NO: 700924 - DNA, 12 bp, Homo sapiens
caatacaatgta

SEQ ID NO: 700925 - DNA, 17 bp, Homo sapiens
caatacagaattgactg

SEQ ID NO: 700926 - DNA, 20 bp, Homo sapiens
caatacatatatctacacat

SEQ ID NO: 700927 - DNA, 15 bp, Homo sapiens
caatacatgagaaag

SEQ ID NO: 700928 - DNA, 12 bp, Homo sapiens
caatacatttga

SEQ ID NO: 700929 - DNA, 20 bp, Homo sapiens
caataccagcaggaggttct

SEQ ID NO: 700930 - DNA, 15 bp, Homo sapiens
caataccctactgtg

SEQ ID NO: 700931 - DNA, 18 bp, Homo sapiens
caatactgtatgccttct

SEQ ID NO: 700932 - DNA, 20 bp, Homo sapiens
caatacttgaatatggaaca

SEQ ID NO: 700933 - DNA, 23 bp, Homo sapiens
caatagaaggatgtacatttcca

SEQ ID NO: 700934 - DNA, 15 bp, Homo sapiens
caatagagactgtag

SEQ ID NO: 700935 - DNA, 18 bp, Homo sapiens
caatagattactgatgtg

SEQ ID NO: 700936 - DNA, 19 bp, Homo sapiens
caatagcaacgtagcttct

SEQ ID NO: 700937 - DNA, 16 bp, Homo sapiens
caatagcacatatgga

SEQ ID NO: 700938 - DNA, 20 bp, Homo sapiens
caatagcacccctactcaca

SEQ ID NO: 700939 - DNA, 19 bp, Homo sapiens
caatagcagacagtgtttt

SEQ ID NO: 700940 - DNA, 18 bp, Homo sapiens
caatagccactaaccttg

SEQ ID NO: 700941 - DNA, 22 bp, Homo sapiens
caatagccactaaccttgcctg

SEQ ID NO: 700942 - DNA, 18 bp, Homo sapiens
caatagctttaccctcag

SEQ ID NO: 700943 - DNA, 18 bp, Homo sapiens
caataggaaagcatatgc

SEQ ID NO: 700944 - DNA, 15 bp, Homo sapiens
caataggcaaattaa

SEQ ID NO: 700945 - DNA, 15 bp, Homo sapiens
caataggctgttccc

SEQ ID NO: 700946 - DNA, 23 bp, Homo sapiens
caatagggctaaatgtttaaaga

SEQ ID NO: 700947 - DNA, 23 bp, Homo sapiens
caatagtgtgttctgattagaaa

SEQ ID NO: 700948 - DNA, 15 bp, Homo sapiens
caatagttgaattag

SEQ ID NO: 700949 - DNA, 21 bp, Homo sapiens
caatagttttttacttctctt

SEQ ID NO: 700950 - DNA, 18 bp, Homo sapiens
caatataaaactgtactt

SEQ ID NO: 700951 - DNA, 14 bp, Homo sapiens
caatataagaagca

SEQ ID NO: 700952 - DNA, 21 bp, Homo sapiens
caatatacaactgtaaagcaa

SEQ ID NO: 700953 - DNA, 14 bp, Homo sapiens
caatatacttcact

SEQ ID NO: 700954 - DNA, 20 bp, Homo sapiens
caatatagaaaaataaaaat

SEQ ID NO: 700955 - DNA, 22 bp, Homo sapiens
caatatagaaaaataaaaatct

SEQ ID NO: 700956 - DNA, 22 bp, Homo sapiens
caatatatagtgggtacatcaa

SEQ ID NO: 700957 - DNA, 19 bp, Homo sapiens
caatatcatgtcttgtgca

SEQ ID NO: 700958 - DNA, 13 bp, Homo sapiens
caatatcccaaca

SEQ ID NO: 700959 - DNA, 21 bp, Homo sapiens
caatatcccaacattctgcaa

SEQ ID NO: 700960 - DNA, 16 bp, Homo sapiens
caatatctaatatata

SEQ ID NO: 700961 - DNA, 13 bp, Homo sapiens
caatatctgcagc

SEQ ID NO: 700962 - DNA, 23 bp, Homo sapiens
caatatcttcgttagtaatctgt

SEQ ID NO: 700963 - DNA, 14 bp, Homo sapiens
caatatgaaaagga

SEQ ID NO: 700964 - DNA, 23 bp, Homo sapiens
caatatgaaaaggatattatcta

SEQ ID NO: 700965 - DNA, 19 bp, Homo sapiens
caatatgaatctataagta

SEQ ID NO: 700966 - DNA, 11 bp, Homo sapiens
caatatgcaag

SEQ ID NO: 700967 - DNA, 13 bp, Homo sapiens
caatatgcaagca

SEQ ID NO: 700968 - DNA, 18 bp, Homo sapiens
caatatgggggccttttg

SEQ ID NO: 700969 - DNA, 17 bp, Homo sapiens
caatatgtatgcttttt

SEQ ID NO: 700970 - DNA, 22 bp, Homo sapiens
caatatgtatgctttttaccta

SEQ ID NO: 700971 - DNA, 12 bp, Homo sapiens
caatatgtgcca

SEQ ID NO: 700972 - DNA, 19 bp, Homo sapiens
caatatgtgccaatcaata

SEQ ID NO: 700973 - DNA, 21 bp, Homo sapiens
caatattaaagggtctggaaa

SEQ ID NO: 700974 - DNA, 20 bp, Homo sapiens
caatattaaatacagacact

SEQ ID NO: 700975 - DNA, 21 bp, Homo sapiens
caatattaaatacagacacta

SEQ ID NO: 700976 - DNA, 20 bp, Homo sapiens
caatattaacacgctgcctg

SEQ ID NO: 700977 - DNA, 17 bp, Homo sapiens
caatattaatgccttta

SEQ ID NO: 700978 - DNA, 23 bp, Homo sapiens
caatattaatgcctttaaagtat

SEQ ID NO: 700979 - DNA, 13 bp, Homo sapiens
caatattataatt

SEQ ID NO: 700980 - DNA, 12 bp, Homo sapiens
caatattgaatt

SEQ ID NO: 700981 - DNA, 16 bp, Homo sapiens
caatattgcctgtgct

SEQ ID NO: 700982 - DNA, 17 bp, Homo sapiens
caatattgtacagtttt

SEQ ID NO: 700983 - DNA, 22 bp, Homo sapiens
caatattgtctcccttccagca

SEQ ID NO: 700984 - DNA, 14 bp, Homo sapiens
caatatttaaacat

SEQ ID NO: 700985 - DNA, 13 bp, Homo sapiens
caatatttagaaa

SEQ ID NO: 700986 - DNA, 15 bp, Homo sapiens
caatatttagaaaat

SEQ ID NO: 700987 - DNA, 19 bp, Homo sapiens
caatatttattattttcac

SEQ ID NO: 700988 - DNA, 23 bp, Homo sapiens
caatattttatggttatgttttt

SEQ ID NO: 700989 - DNA, 16 bp, Homo sapiens
caatattttctttaat

SEQ ID NO: 700990 - DNA, 20 bp, Homo sapiens
caatattttctttaatgctt

SEQ ID NO: 700991 - DNA, 22 bp, Homo sapiens
caatatttttatatcatgcaaa

SEQ ID NO: 700992 - DNA, 18 bp, Homo sapiens
caatcaaaggaaaatagt

SEQ ID NO: 700993 - DNA, 22 bp, Homo sapiens
caatcaaataagtatttataat

SEQ ID NO: 700994 - DNA, 20 bp, Homo sapiens
caatcaaatctcctgctgat

SEQ ID NO: 700995 - DNA, 17 bp, Homo sapiens
caatcaactttactgta

SEQ ID NO: 700996 - DNA, 13 bp, Homo sapiens
caatcaagttttt

SEQ ID NO: 700997 - DNA, 15 bp, Homo sapiens
caatcacagtctcag

SEQ ID NO: 700998 - DNA, 13 bp, Homo sapiens
caatcactattct

SEQ ID NO: 700999 - DNA, 14 bp, Homo sapiens
caatcactattctt

SEQ ID NO: 701000 - DNA, 22 bp, Homo sapiens
caatcactattcttaagcactt

SEQ ID NO: 701001 - DNA, 15 bp, Homo sapiens
caatcactgctcccc

SEQ ID NO: 701002 - DNA, 16 bp, Homo sapiens
caatcactttttggaa

SEQ ID NO: 701003 - DNA, 23 bp, Homo sapiens
caatcagagctccagtttgcatt

SEQ ID NO: 701004 - DNA, 21 bp, Homo sapiens
caatcagagtgtacaaattgt

SEQ ID NO: 701005 - DNA, 12 bp, Homo sapiens
caatcagccttt

SEQ ID NO: 701006 - DNA, 19 bp, Homo sapiens
caatcagcttttgttctag

SEQ ID NO: 701007 - DNA, 14 bp, Homo sapiens
caatcagtcccctc

SEQ ID NO: 701008 - DNA, 15 bp, Homo sapiens
caatcagtcccctcc

SEQ ID NO: 701009 - DNA, 16 bp, Homo sapiens
caatcagtcccctccc

SEQ ID NO: 701010 - DNA, 17 bp, Homo sapiens
caatcagtcccctccca

SEQ ID NO: 701011 - DNA, 20 bp, Homo sapiens
caatcagtcccctcccatct

SEQ ID NO: 701012 - DNA, 21 bp, Homo sapiens
caatcagtcccctcccatctg

SEQ ID NO: 701013 - DNA, 19 bp, Homo sapiens
caatcagtttatcctgaca

SEQ ID NO: 701014 - DNA, 22 bp, Homo sapiens
actaggcccccacttgcctctt

SEQ ID NO: 701015 - DNA, 16 bp, Homo sapiens
actaggctaaactcaa

SEQ ID NO: 701016 - DNA, 14 bp, Homo sapiens
actaggctgagcaa

SEQ ID NO: 701017 - DNA, 17 bp, Homo sapiens
actagggaagataatat

SEQ ID NO: 701018 - DNA, 19 bp, Homo sapiens
actagggatccctcatctg

SEQ ID NO: 701019 - DNA, 20 bp, Homo sapiens
actagggatccctcatctgt

SEQ ID NO: 701020 - DNA, 16 bp, Homo sapiens
actagggattcaggct

SEQ ID NO: 701021 - DNA, 12 bp, Homo sapiens
actagggctgag

SEQ ID NO: 701022 - DNA, 14 bp, Homo sapiens
actaggtaacttca

SEQ ID NO: 701023 - DNA, 15 bp, Homo sapiens
actaggtaacttcat

SEQ ID NO: 701024 - DNA, 21 bp, Homo sapiens
actaggtattgtctactctga

SEQ ID NO: 701025 - DNA, 19 bp, Homo sapiens
actaggtatttaagactga

SEQ ID NO: 701026 - DNA, 14 bp, Homo sapiens
actaggtgtcccca

SEQ ID NO: 701027 - DNA, 18 bp, Homo sapiens
actaggttggacagcccc

SEQ ID NO: 701028 - DNA, 22 bp, Homo sapiens
actaggtttatttatctgagca

SEQ ID NO: 701029 - DNA, 15 bp, Homo sapiens
actaggtttttgctt

SEQ ID NO: 701030 - DNA, 23 bp, Homo sapiens
actagtaataccaaagactattt

SEQ ID NO: 701031 - DNA, 12 bp, Homo sapiens
actagtatcaga

SEQ ID NO: 701032 - DNA, 16 bp, Homo sapiens
actagtatcattttag

SEQ ID NO: 701033 - DNA, 19 bp, Homo sapiens
actagtgaccccttccctg

SEQ ID NO: 701034 - DNA, 17 bp, Homo sapiens
actagtgagtcagcacc

SEQ ID NO: 701035 - DNA, 20 bp, Homo sapiens
actagtgagtcagcaccttg

SEQ ID NO: 701036 - DNA, 17 bp, Homo sapiens
actagtgccaatgatgt

SEQ ID NO: 701037 - DNA, 15 bp, Homo sapiens
actagttacacatct

SEQ ID NO: 701038 - DNA, 19 bp, Homo sapiens
actagtttgattattatgt

SEQ ID NO: 701039 - DNA, 14 bp, Homo sapiens
actagtttttatag

SEQ ID NO: 701040 - DNA, 21 bp, Homo sapiens
actagtttttcctatcatgtt

SEQ ID NO: 701041 - DNA, 13 bp, Homo sapiens
actataaaaaaga

SEQ ID NO: 701042 - DNA, 18 bp, Homo sapiens
actataaaggttgacaat

SEQ ID NO: 701043 - DNA, 16 bp, Homo sapiens
actataaggtgcctca

SEQ ID NO: 701044 - DNA, 13 bp, Homo sapiens
actataagtagtt

SEQ ID NO: 701045 - DNA, 22 bp, Homo sapiens
actataagtagttggtttgtat

SEQ ID NO: 701046 - DNA, 19 bp, Homo sapiens
actataatgtgaaatgtaa

SEQ ID NO: 701047 - DNA, 19 bp, Homo sapiens
actataattgtaaatattt

SEQ ID NO: 701048 - DNA, 21 bp, Homo sapiens
actataattgtaaatattttg

SEQ ID NO: 701049 - DNA, 14 bp, Homo sapiens
actatacagccata

SEQ ID NO: 701050 - DNA, 14 bp, Homo sapiens
actatagcccaggt

SEQ ID NO: 701051 - DNA, 20 bp, Homo sapiens
actatagcccaggtcctctg

SEQ ID NO: 701052 - DNA, 20 bp, Homo sapiens
actatagtgtaataatgtta

SEQ ID NO: 701053 - DNA, 17 bp, Homo sapiens
actatatagagatgttt

SEQ ID NO: 701054 - DNA, 17 bp, Homo sapiens
actatatcagtagtgta

SEQ ID NO: 701055 - DNA, 19 bp, Homo sapiens
actatatcagtagtgtaca

SEQ ID NO: 701056 - DNA, 20 bp, Homo sapiens
actatatcagtagtgtacat

SEQ ID NO: 701057 - DNA, 18 bp, Homo sapiens
actatatgtacagctctc

SEQ ID NO: 701058 - DNA, 14 bp, Homo sapiens
actatatgtttaca

SEQ ID NO: 701059 - DNA, 15 bp, Homo sapiens
actatatgtttacac

SEQ ID NO: 701060 - DNA, 16 bp, Homo sapiens
actatatgtttacaca

SEQ ID NO: 701061 - DNA, 18 bp, Homo sapiens
actatatgtttacacaat

SEQ ID NO: 701062 - DNA, 19 bp, Homo sapiens
actatatgtttacacaatt

SEQ ID NO: 701063 - DNA, 19 bp, Homo sapiens
actatattgattgtccttt

SEQ ID NO: 701064 - DNA, 16 bp, Homo sapiens
actatatttatttttg

SEQ ID NO: 701065 - DNA, 14 bp, Homo sapiens
actatcaaactgaa

SEQ ID NO: 701066 - DNA, 22 bp, Homo sapiens
actatcacacactttctcttca

SEQ ID NO: 701067 - DNA, 19 bp, Homo sapiens
actatcaggtaataaaagc

SEQ ID NO: 701068 - DNA, 13 bp, Homo sapiens
actatcattctca

SEQ ID NO: 701069 - DNA, 14 bp, Homo sapiens
actatccatgtaat

SEQ ID NO: 701070 - DNA, 16 bp, Homo sapiens
actatccatgtaataa

SEQ ID NO: 701071 - DNA, 21 bp, Homo sapiens
actatcccaatcaaagaatta

SEQ ID NO: 701072 - DNA, 17 bp, Homo sapiens
actatcctgattccaaa

SEQ ID NO: 701073 - DNA, 19 bp, Homo sapiens
actatcctgattccaaata

SEQ ID NO: 701074 - DNA, 19 bp, Homo sapiens
actatcctgtaaatatatc

SEQ ID NO: 701075 - DNA, 18 bp, Homo sapiens
actatctcacttccagat

SEQ ID NO: 701076 - DNA, 20 bp, Homo sapiens
actatctctactgaatgtca

SEQ ID NO: 701077 - DNA, 15 bp, Homo sapiens
actatctgcattatc

SEQ ID NO: 701078 - DNA, 19 bp, Homo sapiens
actatgaaaagctagaatt

SEQ ID NO: 701079 - DNA, 20 bp, Homo sapiens
actatgaaaagctagaattg

SEQ ID NO: 701080 - DNA, 16 bp, Homo sapiens
actatgaaataaaaaa

SEQ ID NO: 701081 - DNA, 14 bp, Homo sapiens
actatgaacactgt

SEQ ID NO: 701082 - DNA, 22 bp, Homo sapiens
actatgaactacaggtgtttga

SEQ ID NO: 701083 - DNA, 15 bp, Homo sapiens
actatgataaagttg

SEQ ID NO: 701084 - DNA, 22 bp, Homo sapiens
actatgatcagaagaacatgat

SEQ ID NO: 701085 - DNA, 15 bp, Homo sapiens
actatgatgggcttc

SEQ ID NO: 701086 - DNA, 19 bp, Homo sapiens
actatgatttaatttgaaa

SEQ ID NO: 701087 - DNA, 15 bp, Homo sapiens
actatgctttccttc

SEQ ID NO: 701088 - DNA, 23 bp, Homo sapiens
actatggagtgcaccaaagagaa

SEQ ID NO: 701089 - DNA, 22 bp, Homo sapiens
actatggccctggcctagcata

SEQ ID NO: 701090 - DNA, 21 bp, Homo sapiens
actatggctgatttatttcta

SEQ ID NO: 701091 - DNA, 18 bp, Homo sapiens
actatggtatgctggcca

SEQ ID NO: 701092 - DNA, 20 bp, Homo sapiens
actatggtatgctggccagc

SEQ ID NO: 701093 - DNA, 10 bp, Homo sapiens
actatggtgt

SEQ ID NO: 701094 - DNA, 19 bp, Homo sapiens
actatggtgtgttgtatct

SEQ ID NO: 701095 - DNA, 23 bp, Homo sapiens
actatggttcccaataaaagtga

SEQ ID NO: 701096 - DNA, 11 bp, Homo sapiens
actatgtaaac

SEQ ID NO: 701097 - DNA, 14 bp, Homo sapiens
actatgtaaactac

SEQ ID NO: 701098 - DNA, 16 bp, Homo sapiens
actatgtaaactactt

SEQ ID NO: 701099 - DNA, 15 bp, Homo sapiens
actatgtatatacat

SEQ ID NO: 701100 - DNA, 14 bp, Homo sapiens
actatgtccagatt

SEQ ID NO: 701101 - DNA, 13 bp, Homo sapiens
actatgttcctaa

SEQ ID NO: 701102 - DNA, 21 bp, Homo sapiens
actatgttcctaacaaaatga

SEQ ID NO: 701103 - DNA, 15 bp, Homo sapiens
actattaaaatattt

SEQ ID NO: 701104 - DNA, 17 bp, Homo sapiens
actattaaaatattttg

SEQ ID NO: 701105 - DNA, 14 bp, Homo sapiens
actattaacctttt

SEQ ID NO: 701106 - DNA, 16 bp, Homo sapiens
actattccctttgact

SEQ ID NO: 701107 - DNA, 18 bp, Homo sapiens
actattcttaagcacttt

SEQ ID NO: 701108 - DNA, 19 bp, Homo sapiens
actattcttggttcttatt

SEQ ID NO: 701109 - DNA, 14 bp, Homo sapiens
actattgaaaaata

SEQ ID NO: 701110 - DNA, 15 bp, Homo sapiens
actattgagccttgc

SEQ ID NO: 701111 - DNA, 22 bp, Homo sapiens
actattgagccttgcatgtact

SEQ ID NO: 701112 - DNA, 22 bp, Homo sapiens
actattgcagacctgtcaccct

SEQ ID NO: 701113 - DNA, 15 bp, Homo sapiens
actattgcatttata

SEQ ID NO: 701114 - DNA, 14 bp, Homo sapiens
actattggaaagta

SEQ ID NO: 701115 - DNA, 21 bp, Homo sapiens
actattgtgaatatttggaat

SEQ ID NO: 701116 - DNA, 16 bp, Homo sapiens
actatttaaaataaag

SEQ ID NO: 701117 - DNA, 15 bp, Homo sapiens
actatttaaaattgg

SEQ ID NO: 701118 - DNA, 16 bp, Homo sapiens
actatttaaaattggc

SEQ ID NO: 701119 - DNA, 19 bp, Homo sapiens
actatttaagttatcaact

SEQ ID NO: 701120 - DNA, 23 bp, Homo sapiens
actatttagtttttgtaatttat

SEQ ID NO: 701121 - DNA, 16 bp, Homo sapiens
actatttatttacaaa

SEQ ID NO: 701122 - DNA, 13 bp, Homo sapiens
actatttccttta

SEQ ID NO: 701123 - DNA, 12 bp, Homo sapiens
actatttcttca

SEQ ID NO: 701124 - DNA, 13 bp, Homo sapiens
actatttcttcag

SEQ ID NO: 701125 - DNA, 14 bp, Homo sapiens
actatttcttcaga

SEQ ID NO: 701126 - DNA, 16 bp, Homo sapiens
actatttcttcagagt

SEQ ID NO: 701127 - DNA, 15 bp, Homo sapiens
actattttcaaagaa

SEQ ID NO: 701128 - DNA, 15 bp, Homo sapiens
actattttcattttt

SEQ ID NO: 701129 - DNA, 13 bp, Homo sapiens
actattttctatt

SEQ ID NO: 701130 - DNA, 18 bp, Homo sapiens
actatttttatattaaag

SEQ ID NO: 701131 - DNA, 18 bp, Homo sapiens
actatttttatttatatt

SEQ ID NO: 701132 - DNA, 14 bp, Homo sapiens
actatttttcctca

SEQ ID NO: 701133 - DNA, 15 bp, Homo sapiens
actatttttctatga

SEQ ID NO: 701134 - DNA, 13 bp, Homo sapiens
actcaaaacctgg

SEQ ID NO: 701135 - DNA, 19 bp, Homo sapiens
actcaaaatatttgtacat

SEQ ID NO: 701136 - DNA, 12 bp, Homo sapiens
actcaaaatgac

SEQ ID NO: 701137 - DNA, 13 bp, Homo sapiens
actcaaaatgaca

SEQ ID NO: 701138 - DNA, 17 bp, Homo sapiens
actcaaactcttaaaac

SEQ ID NO: 701139 - DNA, 17 bp, Homo sapiens
caatcatcaaaaagtaa

SEQ ID NO: 701140 - DNA, 15 bp, Homo sapiens
caatcatctgtgtga

SEQ ID NO: 701141 - DNA, 17 bp, Homo sapiens
caatcatctgtgtgaaa

SEQ ID NO: 701142 - DNA, 23 bp, Homo sapiens
caatcatgaacagctctgagatc

SEQ ID NO: 701143 - DNA, 22 bp, Homo sapiens
caatcatggctcactgcagcct

SEQ ID NO: 701144 - DNA, 22 bp, Homo sapiens
caatcattgaagtatattctta

SEQ ID NO: 701145 - DNA, 12 bp, Homo sapiens
caatcattttat

SEQ ID NO: 701146 - DNA, 15 bp, Homo sapiens
caatccacctgcctt

SEQ ID NO: 701147 - DNA, 16 bp, Homo sapiens
caatccacctgccttg

SEQ ID NO: 701148 - DNA, 19 bp, Homo sapiens
caatccatgtgattaatgt

SEQ ID NO: 701149 - DNA, 17 bp, Homo sapiens
caatcccaatctttcta

SEQ ID NO: 701150 - DNA, 14 bp, Homo sapiens
caatcccaattctg

SEQ ID NO: 701151 - DNA, 16 bp, Homo sapiens
caatcccaccaaatca

SEQ ID NO: 701152 - DNA, 23 bp, Homo sapiens
caatcccaccaaatcatcctgaa

SEQ ID NO: 701153 - DNA, 12 bp, Homo sapiens
caatcccagcta

SEQ ID NO: 701154 - DNA, 15 bp, Homo sapiens
caatcccctcattca

SEQ ID NO: 701155 - DNA, 12 bp, Homo sapiens
caatcccctcct

SEQ ID NO: 701156 - DNA, 13 bp, Homo sapiens
caatccctctcca

SEQ ID NO: 701157 - DNA, 17 bp, Homo sapiens
caatccctgccactggg

SEQ ID NO: 701158 - DNA, 23 bp, Homo sapiens
caatccctgccactgggctctgg

SEQ ID NO: 701159 - DNA, 20 bp, Homo sapiens
caatccctttattaccccct

SEQ ID NO: 701160 - DNA, 15 bp, Homo sapiens
caatccgagcagtgg

SEQ ID NO: 701161 - DNA, 17 bp, Homo sapiens
caatcctaacacattat

SEQ ID NO: 701162 - DNA, 20 bp, Homo sapiens
caatcctaatttctcctccc

SEQ ID NO: 701163 - DNA, 21 bp, Homo sapiens
caatcctaatttctcctccct

SEQ ID NO: 701164 - DNA, 14 bp, Homo sapiens
caatcctatgtttt

SEQ ID NO: 701165 - DNA, 16 bp, Homo sapiens
caatcctcactgggtg

SEQ ID NO: 701166 - DNA, 17 bp, Homo sapiens
caatcctcactgggtgg

SEQ ID NO: 701167 - DNA, 13 bp, Homo sapiens
caatcctcctgcc

SEQ ID NO: 701168 - DNA, 20 bp, Homo sapiens
caatcctgggcaatcagaca

SEQ ID NO: 701169 - DNA, 17 bp, Homo sapiens
caatcctgtctttctga

SEQ ID NO: 701170 - DNA, 18 bp, Homo sapiens
caatcctgtgggtgaaga

SEQ ID NO: 701171 - DNA, 19 bp, Homo sapiens
caatccttccctgctcttg

SEQ ID NO: 701172 - DNA, 22 bp, Homo sapiens
caatccttccctgctcttgcag

SEQ ID NO: 701173 - DNA, 12 bp, Homo sapiens
caatcctttcca

SEQ ID NO: 701174 - DNA, 21 bp, Homo sapiens
caatcgagatttgggagctga

SEQ ID NO: 701175 - DNA, 17 bp, Homo sapiens
caatcggactgccaaat

SEQ ID NO: 701176 - DNA, 17 bp, Homo sapiens
caatctaaaacaattcc

SEQ ID NO: 701177 - DNA, 15 bp, Homo sapiens
caatctaaggccttc

SEQ ID NO: 701178 - DNA, 17 bp, Homo sapiens
caatctactcaaagcat

SEQ ID NO: 701179 - DNA, 11 bp, Homo sapiens
caatctactgg

SEQ ID NO: 701180 - DNA, 19 bp, Homo sapiens
caatctatggcttatttct

SEQ ID NO: 701181 - DNA, 21 bp, Homo sapiens
caatctatggcttatttctat

SEQ ID NO: 701182 - DNA, 17 bp, Homo sapiens
caatctccagggctcca

SEQ ID NO: 701183 - DNA, 20 bp, Homo sapiens
caatctcggctcactgcatc

SEQ ID NO: 701184 - DNA, 11 bp, Homo sapiens
caatctctgtt

SEQ ID NO: 701185 - DNA, 22 bp, Homo sapiens
caatctcttcattattctctgc

SEQ ID NO: 701186 - DNA, 13 bp, Homo sapiens
caatctgaaattc

SEQ ID NO: 701187 - DNA, 18 bp, Homo sapiens
caatctgaaattcaaaat

SEQ ID NO: 701188 - DNA, 12 bp, Homo sapiens
caatctgtaaac

SEQ ID NO: 701189 - DNA, 18 bp, Homo sapiens
caatctgtaaactgtgta

SEQ ID NO: 701190 - DNA, 16 bp, Homo sapiens
caatcttaagagcttg

SEQ ID NO: 701191 - DNA, 18 bp, Homo sapiens
caatcttaccagatgcta

SEQ ID NO: 701192 - DNA, 20 bp, Homo sapiens
caatcttaccagatgctact

SEQ ID NO: 701193 - DNA, 16 bp, Homo sapiens
caatcttattccgagc

SEQ ID NO: 701194 - DNA, 20 bp, Homo sapiens
caatcttgcccactggccgc

SEQ ID NO: 701195 - DNA, 14 bp, Homo sapiens
caatcttgccttct

SEQ ID NO: 701196 - DNA, 16 bp, Homo sapiens
caatctttcatgtctt

SEQ ID NO: 701197 - DNA, 12 bp, Homo sapiens
caatctttctat

SEQ ID NO: 701198 - DNA, 12 bp, Homo sapiens
caatctttgaaa

SEQ ID NO: 701199 - DNA, 20 bp, Homo sapiens
caatgaaacagatgataaat

SEQ ID NO: 701200 - DNA, 22 bp, Homo sapiens
caatgaaacagatgataaatat

SEQ ID NO: 701201 - DNA, 22 bp, Homo sapiens
caatgaaatactgagatgctgg

SEQ ID NO: 701202 - DNA, 21 bp, Homo sapiens
caatgaaatgaattaaagtgg

SEQ ID NO: 701203 - DNA, 17 bp, Homo sapiens
caatgaactgcttttcc

SEQ ID NO: 701204 - DNA, 17 bp, Homo sapiens
caatgaatatactcatt

SEQ ID NO: 701205 - DNA, 21 bp, Homo sapiens
caatgaatccccgacccccct

SEQ ID NO: 701206 - DNA, 21 bp, Homo sapiens
caatgaatgtatattttgtgt

SEQ ID NO: 701207 - DNA, 17 bp, Homo sapiens
caatgaattaattcaga

SEQ ID NO: 701208 - DNA, 23 bp, Homo sapiens
caatgaattttataatctgcagc

SEQ ID NO: 701209 - DNA, 14 bp, Homo sapiens
caatgacacagtct

SEQ ID NO: 701210 - DNA, 21 bp, Homo sapiens
caatgacacagtcttggctca

SEQ ID NO: 701211 - DNA, 23 bp, Homo sapiens
caatgacacccatgccagagagg

SEQ ID NO: 701212 - DNA, 17 bp, Homo sapiens
caatgacatctcagggg

SEQ ID NO: 701213 - DNA, 19 bp, Homo sapiens
caatgacatctcaggggcc

SEQ ID NO: 701214 - DNA, 22 bp, Homo sapiens
caatgacatctcaggggccaga

SEQ ID NO: 701215 - DNA, 15 bp, Homo sapiens
caatgacttactgta

SEQ ID NO: 701216 - DNA, 19 bp, Homo sapiens
caatgacttctaatttata

SEQ ID NO: 701217 - DNA, 11 bp, Homo sapiens
caatgactttt

SEQ ID NO: 701218 - DNA, 12 bp, Homo sapiens
caatgactttta

SEQ ID NO: 701219 - DNA, 21 bp, Homo sapiens
caatgagactctagggtccag

SEQ ID NO: 701220 - DNA, 13 bp, Homo sapiens
caatgagagcata

SEQ ID NO: 701221 - DNA, 17 bp, Homo sapiens
caatgaggtctgaaatg

SEQ ID NO: 701222 - DNA, 18 bp, Homo sapiens
caatgaggtctgaaatgg

SEQ ID NO: 701223 - DNA, 19 bp, Homo sapiens
caatgaggtctgaaatgga

SEQ ID NO: 701224 - DNA, 23 bp, Homo sapiens
caatgatacccaacagtttattt

SEQ ID NO: 701225 - DNA, 20 bp, Homo sapiens
caatgatagtaagaaaagtg

SEQ ID NO: 701226 - DNA, 21 bp, Homo sapiens
caatgatgaatgagaatctac

SEQ ID NO: 701227 - DNA, 24 bp, Homo sapiens
caatgatggcaattttgtaacgaa

SEQ ID NO: 701228 - DNA, 13 bp, Homo sapiens
caatgatggtaaa

SEQ ID NO: 701229 - DNA, 18 bp, Homo sapiens
caatgatggtaaagccat

SEQ ID NO: 701230 - DNA, 23 bp, Homo sapiens
caatgatgtgaccctcaatccca

SEQ ID NO: 701231 - DNA, 15 bp, Homo sapiens
caatgattgttaatt

SEQ ID NO: 701232 - DNA, 19 bp, Homo sapiens
caatgcaaccaactatcca

SEQ ID NO: 701233 - DNA, 20 bp, Homo sapiens
caatgcaaccaactatccaa

SEQ ID NO: 701234 - DNA, 18 bp, Homo sapiens
caatgcaagacgccctct

SEQ ID NO: 701235 - DNA, 21 bp, Homo sapiens
caatgcaagagtgattgcagc

SEQ ID NO: 701236 - DNA, 17 bp, Homo sapiens
caatgcacctaaagaaa

SEQ ID NO: 701237 - DNA, 21 bp, Homo sapiens
caatgcatacaataaaagagc

SEQ ID NO: 701238 - DNA, 22 bp, Homo sapiens
caatgcatacaataaaagagct

SEQ ID NO: 701239 - DNA, 17 bp, Homo sapiens
caatgccagaccgcaga

SEQ ID NO: 701240 - DNA, 15 bp, Homo sapiens
caatgccagggccca

SEQ ID NO: 701241 - DNA, 17 bp, Homo sapiens
caatgccatcagcccct

SEQ ID NO: 701242 - DNA, 18 bp, Homo sapiens
caatgccatcagcccctg

SEQ ID NO: 701243 - DNA, 20 bp, Homo sapiens
caatgccatcagcccctggg

SEQ ID NO: 701244 - DNA, 20 bp, Homo sapiens
caatgcccgtaatgcttaga

SEQ ID NO: 701245 - DNA, 17 bp, Homo sapiens
caatgccgcaacatata

SEQ ID NO: 701246 - DNA, 20 bp, Homo sapiens
caatgcctattgtaatatag

SEQ ID NO: 701247 - DNA, 17 bp, Homo sapiens
caatgccttgacaacag

SEQ ID NO: 701248 - DNA, 23 bp, Homo sapiens
caatgccttgacaacagactgaa

SEQ ID NO: 701249 - DNA, 15 bp, Homo sapiens
caatgcctttttaga

SEQ ID NO: 701250 - DNA, 16 bp, Homo sapiens
caatgctgatttggtg

SEQ ID NO: 701251 - DNA, 21 bp, Homo sapiens
caatgctgatttggtgaccaa

SEQ ID NO: 701252 - DNA, 22 bp, Homo sapiens
caatgctgcctgggagccaggg

SEQ ID NO: 701253 - DNA, 18 bp, Homo sapiens
caatgctgttgtaaacaa

SEQ ID NO: 701254 - DNA, 11 bp, Homo sapiens
caatgcttaaa

SEQ ID NO: 701255 - DNA, 13 bp, Homo sapiens
caatgcttaaact

SEQ ID NO: 701256 - DNA, 16 bp, Homo sapiens
caatgcttaaactaaa

SEQ ID NO: 701257 - DNA, 15 bp, Homo sapiens
caatgcttcattatt

SEQ ID NO: 701258 - DNA, 13 bp, Homo sapiens
caatgctttggga

SEQ ID NO: 701259 - DNA, 20 bp, Homo sapiens
caatgctttgggaggccaag

SEQ ID NO: 701260 - DNA, 17 bp, Homo sapiens
caatgcttttaatgaat

SEQ ID NO: 701261 - DNA, 20 bp, Homo sapiens
caatggagactgtctcaaga

SEQ ID NO: 701262 - DNA, 17 bp, Homo sapiens
caatggagttcagagat

SEQ ID NO: 701263 - DNA, 20 bp, Homo sapiens
actcaaagaggtaactgagg

SEQ ID NO: 701264 - DNA, 18 bp, Homo sapiens
actcaaagtctaacatat

SEQ ID NO: 701265 - DNA, 19 bp, Homo sapiens
actcaaatcgaatagggaa

SEQ ID NO: 701266 - DNA, 14 bp, Homo sapiens
actcaaattttggc

SEQ ID NO: 701267 - DNA, 17 bp, Homo sapiens
actcaacatgttactga

SEQ ID NO: 701268 - DNA, 20 bp, Homo sapiens
actcaacatgttactgacca

SEQ ID NO: 701269 - DNA, 21 bp, Homo sapiens
actcaacatgttactgaccag

SEQ ID NO: 701270 - DNA, 22 bp, Homo sapiens
actcaacatgttactgaccagc

SEQ ID NO: 701271 - DNA, 23 bp, Homo sapiens
actcaacatgttactgaccagca

SEQ ID NO: 701272 - DNA, 17 bp, Homo sapiens
actcaaccataacactt

SEQ ID NO: 701273 - DNA, 16 bp, Homo sapiens
actcaactctgagccc

SEQ ID NO: 701274 - DNA, 18 bp, Homo sapiens
actcaagaggctgaggca

SEQ ID NO: 701275 - DNA, 14 bp, Homo sapiens
actcaagcccgcgg

SEQ ID NO: 701276 - DNA, 17 bp, Homo sapiens
actcaagcgggtggctc

SEQ ID NO: 701277 - DNA, 21 bp, Homo sapiens
actcaagcgggtggctctggg

SEQ ID NO: 701278 - DNA, 15 bp, Homo sapiens
actcaagctgtctct

SEQ ID NO: 701279 - DNA, 20 bp, Homo sapiens
actcaaggacaggagcctgg

SEQ ID NO: 701280 - DNA, 21 bp, Homo sapiens
actcaaggataccttcttatt

SEQ ID NO: 701281 - DNA, 19 bp, Homo sapiens
actcaagtgttaaattatt

SEQ ID NO: 701282 - DNA, 19 bp, Homo sapiens
actcaataaattgcaacat

SEQ ID NO: 701283 - DNA, 12 bp, Homo sapiens
actcaatgcttt

SEQ ID NO: 701284 - DNA, 22 bp, Homo sapiens
actcaatgctttatttgtaaat

SEQ ID NO: 701285 - DNA, 23 bp, Homo sapiens
actcaatgctttatttgtaaatt

SEQ ID NO: 701286 - DNA, 14 bp, Homo sapiens
actcacaagaagac

SEQ ID NO: 701287 - DNA, 16 bp, Homo sapiens
actcacaagaagacca

SEQ ID NO: 701288 - DNA, 14 bp, Homo sapiens
actcacacaggacc

SEQ ID NO: 701289 - DNA, 17 bp, Homo sapiens
actcacactctctgcag

SEQ ID NO: 701290 - DNA, 14 bp, Homo sapiens
actcacagacctgg

SEQ ID NO: 701291 - DNA, 23 bp, Homo sapiens
actcacagacctggagcccctgg

SEQ ID NO: 701292 - DNA, 12 bp, Homo sapiens
actcacagagct

SEQ ID NO: 701293 - DNA, 16 bp, Homo sapiens
actcacagcttctcca

SEQ ID NO: 701294 - DNA, 17 bp, Homo sapiens
actcacagcttctccaa

SEQ ID NO: 701295 - DNA, 11 bp, Homo sapiens
actcacaggcc

SEQ ID NO: 701296 - DNA, 16 bp, Homo sapiens
actcaccaacttgcca

SEQ ID NO: 701297 - DNA, 18 bp, Homo sapiens
actcaccacaagctgagc

SEQ ID NO: 701298 - DNA, 19 bp, Homo sapiens
actcaccacaagctgagca

SEQ ID NO: 701299 - DNA, 23 bp, Homo sapiens
actcaccagccccactgccagca

SEQ ID NO: 701300 - DNA, 13 bp, Homo sapiens
actcaccagccct

SEQ ID NO: 701301 - DNA, 14 bp, Homo sapiens
actcaccagggtcc

SEQ ID NO: 701302 - DNA, 15 bp, Homo sapiens
actcaccagggtccg

SEQ ID NO: 701303 - DNA, 16 bp, Homo sapiens
actcaccagtggcctt

SEQ ID NO: 701304 - DNA, 14 bp, Homo sapiens
actcacccctcagc

SEQ ID NO: 701305 - DNA, 16 bp, Homo sapiens
actcaccctgggagcc

SEQ ID NO: 701306 - DNA, 18 bp, Homo sapiens
actcacccttcctggccc

SEQ ID NO: 701307 - DNA, 20 bp, Homo sapiens
actcacccttcctggcccag

SEQ ID NO: 701308 - DNA, 21 bp, Homo sapiens
actcacccttcctggcccagg

SEQ ID NO: 701309 - DNA, 22 bp, Homo sapiens
actcacccttcctggcccaggc

SEQ ID NO: 701310 - DNA, 20 bp, Homo sapiens
actcacctaatgtttatgag

SEQ ID NO: 701311 - DNA, 20 bp, Homo sapiens
actcacctcccccatctctt

SEQ ID NO: 701312 - DNA, 15 bp, Homo sapiens
actcacctctgcctc

SEQ ID NO: 701313 - DNA, 16 bp, Homo sapiens
actcacctctgcctca

SEQ ID NO: 701314 - DNA, 18 bp, Homo sapiens
actcacctgctggcccct

SEQ ID NO: 701315 - DNA, 19 bp, Homo sapiens
actcacctgctggcccctc

SEQ ID NO: 701316 - DNA, 15 bp, Homo sapiens
actcacctgttactt

SEQ ID NO: 701317 - DNA, 15 bp, Homo sapiens
actcactaggccccc

SEQ ID NO: 701318 - DNA, 17 bp, Homo sapiens
actcactcactccaaga

SEQ ID NO: 701319 - DNA, 17 bp, Homo sapiens
actcactcactccccac

SEQ ID NO: 701320 - DNA, 13 bp, Homo sapiens
actcactcattcc

SEQ ID NO: 701321 - DNA, 15 bp, Homo sapiens
actcactccaagacc

SEQ ID NO: 701322 - DNA, 14 bp, Homo sapiens
actcactccagccc

SEQ ID NO: 701323 - DNA, 16 bp, Homo sapiens
actcactccagcccaa

SEQ ID NO: 701324 - DNA, 12 bp, Homo sapiens
actcactcccca

SEQ ID NO: 701325 - DNA, 20 bp, Homo sapiens
actcactccccactccccca

SEQ ID NO: 701326 - DNA, 15 bp, Homo sapiens
actcactctgggctg

SEQ ID NO: 701327 - DNA, 16 bp, Homo sapiens
actcactctgggctgt

SEQ ID NO: 701328 - DNA, 13 bp, Homo sapiens
actcactgaggcc

SEQ ID NO: 701329 - DNA, 14 bp, Homo sapiens
actcactgaggcca

SEQ ID NO: 701330 - DNA, 17 bp, Homo sapiens
actcactgaggccatca

SEQ ID NO: 701331 - DNA, 18 bp, Homo sapiens
actcactgaggccatcag

SEQ ID NO: 701332 - DNA, 22 bp, Homo sapiens
actcactggggcctacagcttt

SEQ ID NO: 701333 - DNA, 23 bp, Homo sapiens
actcacttcaatgtgtcatttcc

SEQ ID NO: 701334 - DNA, 14 bp, Homo sapiens
actcacttttcact

SEQ ID NO: 701335 - DNA, 15 bp, Homo sapiens
actcactttttccaa

SEQ ID NO: 701336 - DNA, 15 bp, Homo sapiens
actcagaaacatcag

SEQ ID NO: 701337 - DNA, 14 bp, Homo sapiens
actcagaaagccaa

SEQ ID NO: 701338 - DNA, 21 bp, Homo sapiens
actcagaaatttaattcatgt

SEQ ID NO: 701339 - DNA, 14 bp, Homo sapiens
actcagaagcctga

SEQ ID NO: 701340 - DNA, 20 bp, Homo sapiens
actcagaatagctgttttgt

SEQ ID NO: 701341 - DNA, 16 bp, Homo sapiens
actcagaatgggggct

SEQ ID NO: 701342 - DNA, 17 bp, Homo sapiens
actcagaattattttta

SEQ ID NO: 701343 - DNA, 14 bp, Homo sapiens
actcagaattctct

SEQ ID NO: 701344 - DNA, 14 bp, Homo sapiens
actcagaccacttg

SEQ ID NO: 701345 - DNA, 14 bp, Homo sapiens
actcagagcagagc

SEQ ID NO: 701346 - DNA, 14 bp, Homo sapiens
actcagaggccccc

SEQ ID NO: 701347 - DNA, 16 bp, Homo sapiens
actcagaggcccccag

SEQ ID NO: 701348 - DNA, 19 bp, Homo sapiens
actcagaggcccccagtgg

SEQ ID NO: 701349 - DNA, 23 bp, Homo sapiens
actcagatatagatcctgagctc

SEQ ID NO: 701350 - DNA, 21 bp, Homo sapiens
actcagatgaccccagaaact

SEQ ID NO: 701351 - DNA, 15 bp, Homo sapiens
actcagcacaaggcc

SEQ ID NO: 701352 - DNA, 14 bp, Homo sapiens
actcagcagaggca

SEQ ID NO: 701353 - DNA, 15 bp, Homo sapiens
actcagcagcagaga

SEQ ID NO: 701354 - DNA, 21 bp, Homo sapiens
actcagcagcagagagccctg

SEQ ID NO: 701355 - DNA, 13 bp, Homo sapiens
actcagcagccct

SEQ ID NO: 701356 - DNA, 15 bp, Homo sapiens
actcagcagccctcc

SEQ ID NO: 701357 - DNA, 21 bp, Homo sapiens
actcagccatttccccctcct

SEQ ID NO: 701358 - DNA, 22 bp, Homo sapiens
actcagccatttccccctcctc

SEQ ID NO: 701359 - DNA, 13 bp, Homo sapiens
actcagcccctac

SEQ ID NO: 701360 - DNA, 15 bp, Homo sapiens
actcagcccctaccc

SEQ ID NO: 701361 - DNA, 20 bp, Homo sapiens
actcagcccctacccctgcc

SEQ ID NO: 701362 - DNA, 15 bp, Homo sapiens
actcagcccctagga

SEQ ID NO: 701363 - DNA, 20 bp, Homo sapiens
actcagcctcattcagcatg

SEQ ID NO: 701364 - DNA, 12 bp, Homo sapiens
actcagcctgct

SEQ ID NO: 701365 - DNA, 15 bp, Homo sapiens
actcagcctgctgcc

SEQ ID NO: 701366 - DNA, 16 bp, Homo sapiens
actcagcctgctgccc

SEQ ID NO: 701367 - DNA, 18 bp, Homo sapiens
actcagcctgctgcccag

SEQ ID NO: 701368 - DNA, 23 bp, Homo sapiens
actcagccttcagacagagagga

SEQ ID NO: 701369 - DNA, 22 bp, Homo sapiens
actcagcttaattctccttccc

SEQ ID NO: 701370 - DNA, 14 bp, Homo sapiens
actcaggaggctga

SEQ ID NO: 701371 - DNA, 17 bp, Homo sapiens
actcaggaggctgaggc

SEQ ID NO: 701372 - DNA, 18 bp, Homo sapiens
actcaggaggctgaggca

SEQ ID NO: 701373 - DNA, 20 bp, Homo sapiens
actcaggaggctgaggcaga

SEQ ID NO: 701374 - DNA, 21 bp, Homo sapiens
actcaggaggctgaggcagga

SEQ ID NO: 701375 - DNA, 18 bp, Homo sapiens
actcaggaggctgagggg

SEQ ID NO: 701376 - DNA, 16 bp, Homo sapiens
actcaggagtctgcca

SEQ ID NO: 701377 - DNA, 18 bp, Homo sapiens
actcaggagtctgccact

SEQ ID NO: 701378 - DNA, 12 bp, Homo sapiens
actcaggatcca

SEQ ID NO: 701379 - DNA, 17 bp, Homo sapiens
actcaggatttaaaaac

SEQ ID NO: 701380 - DNA, 21 bp, Homo sapiens
actcaggcctgtgtgactcca

SEQ ID NO: 701381 - DNA, 17 bp, Homo sapiens
actcagggacagagcca

SEQ ID NO: 701382 - DNA, 20 bp, Homo sapiens
actcagggcagcgccaggct

SEQ ID NO: 701383 - DNA, 15 bp, Homo sapiens
actcagggcagctgc

SEQ ID NO: 701384 - DNA, 16 bp, Homo sapiens
actcagggcagctgcc

SEQ ID NO: 701385 - DNA, 17 bp, Homo sapiens
actcagggcagctgcct

SEQ ID NO: 701386 - DNA, 21 bp, Homo sapiens
actcagggcagctgcctggcc

SEQ ID NO: 701387 - DNA, 22 bp, Homo sapiens
actcagggcagctgcctggcca

SEQ ID NO: 701388 - DNA, 14 bp, Homo sapiens
caatggataaatca

SEQ ID NO: 701389 - DNA, 22 bp, Homo sapiens
caatggatttgatgctgtttga

SEQ ID NO: 701390 - DNA, 21 bp, Homo sapiens
caatggcacctctgcccttcc

SEQ ID NO: 701391 - DNA, 14 bp, Homo sapiens
caatggcagctaga

SEQ ID NO: 701392 - DNA, 18 bp, Homo sapiens
caatggcagctagactgg

SEQ ID NO: 701393 - DNA, 19 bp, Homo sapiens
caatggcagctagactgga

SEQ ID NO: 701394 - DNA, 15 bp, Homo sapiens
caatggcccgacatt

SEQ ID NO: 701395 - DNA, 19 bp, Homo sapiens
caatggcccgacatttctt

SEQ ID NO: 701396 - DNA, 14 bp, Homo sapiens
caatggcgctgtgc

SEQ ID NO: 701397 - DNA, 15 bp, Homo sapiens
caatggctttttaaa

SEQ ID NO: 701398 - DNA, 13 bp, Homo sapiens
caatgggaagcag

SEQ ID NO: 701399 - DNA, 15 bp, Homo sapiens
caatgggcaatgaca

SEQ ID NO: 701400 - DNA, 15 bp, Homo sapiens
caatgggcactggga

SEQ ID NO: 701401 - DNA, 18 bp, Homo sapiens
caatgggcactgggatga

SEQ ID NO: 701402 - DNA, 16 bp, Homo sapiens
caatgggcagctatcc

SEQ ID NO: 701403 - DNA, 21 bp, Homo sapiens
caatgggccgtcccctctccc

SEQ ID NO: 701404 - DNA, 15 bp, Homo sapiens
caatggggccagtca

SEQ ID NO: 701405 - DNA, 17 bp, Homo sapiens
caatgggtcttagctct

SEQ ID NO: 701406 - DNA, 19 bp, Homo sapiens
caatggtgatcctctattt

SEQ ID NO: 701407 - DNA, 20 bp, Homo sapiens
caatggtgatcctctatttt

SEQ ID NO: 701408 - DNA, 14 bp, Homo sapiens
caatggtgcaaaaa

SEQ ID NO: 701409 - DNA, 15 bp, Homo sapiens
caatggtgcttcccc

SEQ ID NO: 701410 - DNA, 18 bp, Homo sapiens
caatggtttattcccaag

SEQ ID NO: 701411 - DNA, 18 bp, Homo sapiens
caatggtttttaaatttt

SEQ ID NO: 701412 - DNA, 17 bp, Homo sapiens
caatgtaagcatacttt

SEQ ID NO: 701413 - DNA, 14 bp, Homo sapiens
caatgtacaattat

SEQ ID NO: 701414 - DNA, 17 bp, Homo sapiens
caatgtacaattatgtc

SEQ ID NO: 701415 - DNA, 11 bp, Homo sapiens
caatgtataaa

SEQ ID NO: 701416 - DNA, 13 bp, Homo sapiens
caatgtataaaga

SEQ ID NO: 701417 - DNA, 19 bp, Homo sapiens
caatgtataaagattgtac

SEQ ID NO: 701418 - DNA, 21 bp, Homo sapiens
caatgtataaagattgtactt

SEQ ID NO: 701419 - DNA, 19 bp, Homo sapiens
caatgtatctttattaaaa

SEQ ID NO: 701420 - DNA, 15 bp, Homo sapiens
caatgtatgtacaat

SEQ ID NO: 701421 - DNA, 13 bp, Homo sapiens
caatgtcagcctt

SEQ ID NO: 701422 - DNA, 14 bp, Homo sapiens
caatgtcaggaaca

SEQ ID NO: 701423 - DNA, 17 bp, Homo sapiens
caatgtcatttttaaaa

SEQ ID NO: 701424 - DNA, 15 bp, Homo sapiens
caatgtcctgaaaca

SEQ ID NO: 701425 - DNA, 12 bp, Homo sapiens
caatgtctgtgc

SEQ ID NO: 701426 - DNA, 18 bp, Homo sapiens
caatgtcttaaataaaac

SEQ ID NO: 701427 - DNA, 19 bp, Homo sapiens
caatgtcttaaataaaact

SEQ ID NO: 701428 - DNA, 21 bp, Homo sapiens
caatgtcttaaataaaactat

SEQ ID NO: 701429 - DNA, 22 bp, Homo sapiens
caatgtcttttgacaggtgcct

SEQ ID NO: 701430 - DNA, 14 bp, Homo sapiens
caatgtgaaaaatc

SEQ ID NO: 701431 - DNA, 19 bp, Homo sapiens
caatgtgaaaagaaaaatg

SEQ ID NO: 701432 - DNA, 18 bp, Homo sapiens
caatgtgaaacacatgcc

SEQ ID NO: 701433 - DNA, 17 bp, Homo sapiens
caatgtgaccaggggtg

SEQ ID NO: 701434 - DNA, 17 bp, Homo sapiens
caatgtgataaaacccc

SEQ ID NO: 701435 - DNA, 13 bp, Homo sapiens
caatgtgcataat

SEQ ID NO: 701436 - DNA, 23 bp, Homo sapiens
caatgtgccttgattgattagat

SEQ ID NO: 701437 - DNA, 23 bp, Homo sapiens
caatgtgctactgattgtttcat

SEQ ID NO: 701438 - DNA, 21 bp, Homo sapiens
caatgtggacgtgcactgaca

SEQ ID NO: 701439 - DNA, 16 bp, Homo sapiens
caatgtggagcagcag

SEQ ID NO: 701440 - DNA, 17 bp, Homo sapiens
caatgtggatttgggga

SEQ ID NO: 701441 - DNA, 20 bp, Homo sapiens
caatgtggtgacacctcccc

SEQ ID NO: 701442 - DNA, 21 bp, Homo sapiens
caatgtggtgacacctccccc

SEQ ID NO: 701443 - DNA, 21 bp, Homo sapiens
caatgtggttgcaaggccgct

SEQ ID NO: 701444 - DNA, 15 bp, Homo sapiens
caatgtgttttctgt

SEQ ID NO: 701445 - DNA, 17 bp, Homo sapiens
caatgtgttttctgtag

SEQ ID NO: 701446 - DNA, 23 bp, Homo sapiens
caatgtgttttttcggacatgct

SEQ ID NO: 701447 - DNA, 15 bp, Homo sapiens
caatgttagcctcaa

SEQ ID NO: 701448 - DNA, 18 bp, Homo sapiens
caatgttcattgtaatgt

SEQ ID NO: 701449 - DNA, 23 bp, Homo sapiens
caatgttcattgtaatgttactg

SEQ ID NO: 701450 - DNA, 12 bp, Homo sapiens
caatgttccatt

SEQ ID NO: 701451 - DNA, 20 bp, Homo sapiens
caatgttgctagttttttgc

SEQ ID NO: 701452 - DNA, 18 bp, Homo sapiens
caatgttgtccaacaata

SEQ ID NO: 701453 - DNA, 12 bp, Homo sapiens
caatgtttcaag

SEQ ID NO: 701454 - DNA, 17 bp, Homo sapiens
caatgtttcttctaggt

SEQ ID NO: 701455 - DNA, 15 bp, Homo sapiens
caatgtttgatgtcc

SEQ ID NO: 701456 - DNA, 19 bp, Homo sapiens
caatgtttgggggaaaaaa

SEQ ID NO: 701457 - DNA, 13 bp, Homo sapiens
caatgttttcctt

SEQ ID NO: 701458 - DNA, 18 bp, Homo sapiens
caatgtttttaaaaatct

SEQ ID NO: 701459 - DNA, 23 bp, Homo sapiens
caattaaaaaaaaagatctgttt

SEQ ID NO: 701460 - DNA, 12 bp, Homo sapiens
caattaaaaata

SEQ ID NO: 701461 - DNA, 14 bp, Homo sapiens
caattaaaaataaa

SEQ ID NO: 701462 - DNA, 20 bp, Homo sapiens
caattaaaggtcctgccctc

SEQ ID NO: 701463 - DNA, 19 bp, Homo sapiens
caattaacatatgtcacga

SEQ ID NO: 701464 - DNA, 22 bp, Homo sapiens
caattaatagtttgtctatttt

SEQ ID NO: 701465 - DNA, 17 bp, Homo sapiens
caattaattcatccctt

SEQ ID NO: 701466 - DNA, 18 bp, Homo sapiens
caattaattgtcttgcac

SEQ ID NO: 701467 - DNA, 22 bp, Homo sapiens
caattacagggtgactcacagc

SEQ ID NO: 701468 - DNA, 17 bp, Homo sapiens
caattaccagaaagata

SEQ ID NO: 701469 - DNA, 15 bp, Homo sapiens
caattactttggtag

SEQ ID NO: 701470 - DNA, 20 bp, Homo sapiens
caattaggaagtgtaacagc

SEQ ID NO: 701471 - DNA, 23 bp, Homo sapiens
caattaggaagtgtaacagctga

SEQ ID NO: 701472 - DNA, 22 bp, Homo sapiens
caattagtgtgacagtttccaa

SEQ ID NO: 701473 - DNA, 23 bp, Homo sapiens
caattagtgtgacagtttccaaa

SEQ ID NO: 701474 - DNA, 13 bp, Homo sapiens
caattagtttcct

SEQ ID NO: 701475 - DNA, 14 bp, Homo sapiens
caattagtttcctt

SEQ ID NO: 701476 - DNA, 11 bp, Homo sapiens
caattatgaaa

SEQ ID NO: 701477 - DNA, 15 bp, Homo sapiens
caattatgtctcttg

SEQ ID NO: 701478 - DNA, 14 bp, Homo sapiens
caattatgtgcaaa

SEQ ID NO: 701479 - DNA, 23 bp, Homo sapiens
caattattgttacacattaagta

SEQ ID NO: 701480 - DNA, 14 bp, Homo sapiens
caattatttaaaga

SEQ ID NO: 701481 - DNA, 22 bp, Homo sapiens
caattcaaaaataaattagaaa

SEQ ID NO: 701482 - DNA, 18 bp, Homo sapiens
caattcaagctgagaaaa

SEQ ID NO: 701483 - DNA, 15 bp, Homo sapiens
caattcagtaacaaa

SEQ ID NO: 701484 - DNA, 13 bp, Homo sapiens
caattcagtggtc

SEQ ID NO: 701485 - DNA, 20 bp, Homo sapiens
caattcatgtaacagttgtg

SEQ ID NO: 701486 - DNA, 15 bp, Homo sapiens
caattccaaaggaat

SEQ ID NO: 701487 - DNA, 14 bp, Homo sapiens
caattccaagaaaa

SEQ ID NO: 701488 - DNA, 18 bp, Homo sapiens
caattccaccaagacagt

SEQ ID NO: 701489 - DNA, 18 bp, Homo sapiens
caattccatgctataaaa

SEQ ID NO: 701490 - DNA, 12 bp, Homo sapiens
caattcccctct

SEQ ID NO: 701491 - DNA, 16 bp, Homo sapiens
caattcctagataaaa

SEQ ID NO: 701492 - DNA, 14 bp, Homo sapiens
caattcctctgata

SEQ ID NO: 701493 - DNA, 16 bp, Homo sapiens
caattcctctgataat

SEQ ID NO: 701494 - DNA, 14 bp, Homo sapiens
caattcctctggga

SEQ ID NO: 701495 - DNA, 15 bp, Homo sapiens
caattcggggcctgc

SEQ ID NO: 701496 - DNA, 18 bp, Homo sapiens
caattcggggcctgctgg

SEQ ID NO: 701497 - DNA, 18 bp, Homo sapiens
caattctgaaatactttt

SEQ ID NO: 701498 - DNA, 16 bp, Homo sapiens
caattctgactgtcca

SEQ ID NO: 701499 - DNA, 12 bp, Homo sapiens
caattctgcatg

SEQ ID NO: 701500 - DNA, 13 bp, Homo sapiens
caattctgcctgc

SEQ ID NO: 701501 - DNA, 13 bp, Homo sapiens
caattctgggtgc

SEQ ID NO: 701502 - DNA, 13 bp, Homo sapiens
caattctgtaatt

SEQ ID NO: 701503 - DNA, 13 bp, Homo sapiens
caattctgtccca

SEQ ID NO: 701504 - DNA, 14 bp, Homo sapiens
caattctgtccctg

SEQ ID NO: 701505 - DNA, 15 bp, Homo sapiens
caattgacaaatgat

SEQ ID NO: 701506 - DNA, 23 bp, Homo sapiens
caattgagaaaaatatatactaa

SEQ ID NO: 701507 - DNA, 20 bp, Homo sapiens
caattgatacttcaggtgct

SEQ ID NO: 701508 - DNA, 13 bp, Homo sapiens
caattgatctttt

SEQ ID NO: 701509 - DNA, 23 bp, Homo sapiens
caattgatgtatatgtttatata

SEQ ID NO: 701510 - DNA, 22 bp, Homo sapiens
caattgatgttttacgtgcaaa

SEQ ID NO: 701511 - DNA, 23 bp, Homo sapiens
caattgatgttttacgtgcaaac

SEQ ID NO: 701512 - DNA, 23 bp, Homo sapiens
caattgcacgcggagtgagtttt

SEQ ID NO: 701513 - DNA, 18 bp, Homo sapiens
actcagggccatgcctgc

SEQ ID NO: 701514 - DNA, 13 bp, Homo sapiens
actcagggcccca

SEQ ID NO: 701515 - DNA, 14 bp, Homo sapiens
actcagggctcctc

SEQ ID NO: 701516 - DNA, 13 bp, Homo sapiens
actcaggtgggcc

SEQ ID NO: 701517 - DNA, 21 bp, Homo sapiens
actcaggttgtagtaaagaaa

SEQ ID NO: 701518 - DNA, 23 bp, Homo sapiens
actcaggtttgagaaaaaggaaa

SEQ ID NO: 701519 - DNA, 19 bp, Homo sapiens
actcagtccactgttgagc

SEQ ID NO: 701520 - DNA, 22 bp, Homo sapiens
actcagtcccccaccacactga

SEQ ID NO: 701521 - DNA, 17 bp, Homo sapiens
actcagtctctcttctc

SEQ ID NO: 701522 - DNA, 15 bp, Homo sapiens
actcagtctcttcca

SEQ ID NO: 701523 - DNA, 21 bp, Homo sapiens
actcagtgagcctcctgtgcc

SEQ ID NO: 701524 - DNA, 23 bp, Homo sapiens
actcagtgagcctcctgtgcctg

SEQ ID NO: 701525 - DNA, 23 bp, Homo sapiens
actcagtgagctggggccgtctg

SEQ ID NO: 701526 - DNA, 18 bp, Homo sapiens
actcagtgcctccacatg

SEQ ID NO: 701527 - DNA, 18 bp, Homo sapiens
actcagtgttagagaaat

SEQ ID NO: 701528 - DNA, 22 bp, Homo sapiens
actcagttccaggcctgatctt

SEQ ID NO: 701529 - DNA, 22 bp, Homo sapiens
actcagttttaactagaattta

SEQ ID NO: 701530 - DNA, 21 bp, Homo sapiens
actcatagattgcaaatattg

SEQ ID NO: 701531 - DNA, 17 bp, Homo sapiens
actcataggtccctgac

SEQ ID NO: 701532 - DNA, 22 bp, Homo sapiens
actcatatcccctatttaacag

SEQ ID NO: 701533 - DNA, 20 bp, Homo sapiens
actcatcaatcaaataagta

SEQ ID NO: 701534 - DNA, 20 bp, Homo sapiens
actcatcaatggggccagtc

SEQ ID NO: 701535 - DNA, 12 bp, Homo sapiens
actcatcagagc

SEQ ID NO: 701536 - DNA, 14 bp, Homo sapiens
actcatcctctttt

SEQ ID NO: 701537 - DNA, 16 bp, Homo sapiens
actcatcctcttttaa

SEQ ID NO: 701538 - DNA, 12 bp, Homo sapiens
actcatcttagg

SEQ ID NO: 701539 - DNA, 13 bp, Homo sapiens
actcatgaatgaa

SEQ ID NO: 701540 - DNA, 21 bp, Homo sapiens
actcatgatcttgtgacatat

SEQ ID NO: 701541 - DNA, 17 bp, Homo sapiens
actcatgcaaactgctt

SEQ ID NO: 701542 - DNA, 18 bp, Homo sapiens
actcatgcaaactgcttt

SEQ ID NO: 701543 - DNA, 16 bp, Homo sapiens
actcatgcacacagat

SEQ ID NO: 701544 - DNA, 13 bp, Homo sapiens
actcatggcagct

SEQ ID NO: 701545 - DNA, 19 bp, Homo sapiens
actcatggcagctgtttct

SEQ ID NO: 701546 - DNA, 21 bp, Homo sapiens
actcatggcagctgtttctca

SEQ ID NO: 701547 - DNA, 21 bp, Homo sapiens
actcattagactggaacttga

SEQ ID NO: 701548 - DNA, 15 bp, Homo sapiens
actcattgctgagcc

SEQ ID NO: 701549 - DNA, 13 bp, Homo sapiens
actccaaaaacag

SEQ ID NO: 701550 - DNA, 18 bp, Homo sapiens
actccaaaacccatgtgg

SEQ ID NO: 701551 - DNA, 19 bp, Homo sapiens
actccaaacagacccctgt

SEQ ID NO: 701552 - DNA, 18 bp, Homo sapiens
actccaacagaagaactg

SEQ ID NO: 701553 - DNA, 16 bp, Homo sapiens
actccaagatgccctc

SEQ ID NO: 701554 - DNA, 21 bp, Homo sapiens
actccaagcagactccagccc

SEQ ID NO: 701555 - DNA, 22 bp, Homo sapiens
actccaagcagactccagcccc

SEQ ID NO: 701556 - DNA, 21 bp, Homo sapiens
actccaagccccctggcagct

SEQ ID NO: 701557 - DNA, 18 bp, Homo sapiens
actccaaggagctactga

SEQ ID NO: 701558 - DNA, 19 bp, Homo sapiens
actccaaggtttataaagc

SEQ ID NO: 701559 - DNA, 20 bp, Homo sapiens
actccaatgtctgctgagga

SEQ ID NO: 701560 - DNA, 16 bp, Homo sapiens
actccacatctgcctt

SEQ ID NO: 701561 - DNA, 14 bp, Homo sapiens
actccaccacccaa

SEQ ID NO: 701562 - DNA, 23 bp, Homo sapiens
actccaccctgttagttttgtaa

SEQ ID NO: 701563 - DNA, 17 bp, Homo sapiens
actccaccgaccaactg

SEQ ID NO: 701564 - DNA, 22 bp, Homo sapiens
actccaccgaccaactgcccta

SEQ ID NO: 701565 - DNA, 13 bp, Homo sapiens
actccacctcaaa

SEQ ID NO: 701566 - DNA, 12 bp, Homo sapiens
actccactcagg

SEQ ID NO: 701567 - DNA, 13 bp, Homo sapiens
actccactctgat

SEQ ID NO: 701568 - DNA, 20 bp, Homo sapiens
actccactctgattcacctc

SEQ ID NO: 701569 - DNA, 14 bp, Homo sapiens
actccactgccctg

SEQ ID NO: 701570 - DNA, 15 bp, Homo sapiens
actccactgccctgg

SEQ ID NO: 701571 - DNA, 19 bp, Homo sapiens
actccactggtctgtcttt

SEQ ID NO: 701572 - DNA, 16 bp, Homo sapiens
actccagaatctgctg

SEQ ID NO: 701573 - DNA, 17 bp, Homo sapiens
actccagaatctgctgt

SEQ ID NO: 701574 - DNA, 13 bp, Homo sapiens
actccagacccct

SEQ ID NO: 701575 - DNA, 16 bp, Homo sapiens
actccagagggacagg

SEQ ID NO: 701576 - DNA, 16 bp, Homo sapiens
actccagatagagaaa

SEQ ID NO: 701577 - DNA, 15 bp, Homo sapiens
actccagcaacttct

SEQ ID NO: 701578 - DNA, 13 bp, Homo sapiens
actccagcacctg

SEQ ID NO: 701579 - DNA, 11 bp, Homo sapiens
actccagccag

SEQ ID NO: 701580 - DNA, 14 bp, Homo sapiens
actccagccagcgc

SEQ ID NO: 701581 - DNA, 21 bp, Homo sapiens
actccagccagcgcctccctc

SEQ ID NO: 701582 - DNA, 15 bp, Homo sapiens
actccagcctgagca

SEQ ID NO: 701583 - DNA, 13 bp, Homo sapiens
actccagcctggg

SEQ ID NO: 701584 - DNA, 23 bp, Homo sapiens
actccagcctgggcaacagagca

SEQ ID NO: 701585 - DNA, 15 bp, Homo sapiens
actccagcctgggcg

SEQ ID NO: 701586 - DNA, 14 bp, Homo sapiens
actccagcctgggt

SEQ ID NO: 701587 - DNA, 16 bp, Homo sapiens
actccagcctgggtga

SEQ ID NO: 701588 - DNA, 18 bp, Homo sapiens
actccaggaaagagcagt

SEQ ID NO: 701589 - DNA, 13 bp, Homo sapiens
actccaggcccaa

SEQ ID NO: 701590 - DNA, 14 bp, Homo sapiens
actccaggcccaag

SEQ ID NO: 701591 - DNA, 19 bp, Homo sapiens
actccagggacacacagcc

SEQ ID NO: 701592 - DNA, 21 bp, Homo sapiens
actccagggtcccctgccacc

SEQ ID NO: 701593 - DNA, 19 bp, Homo sapiens
actccagtgccagcaatga

SEQ ID NO: 701594 - DNA, 16 bp, Homo sapiens
actccagtggtgaaga

SEQ ID NO: 701595 - DNA, 18 bp, Homo sapiens
actccagttttctcctct

SEQ ID NO: 701596 - DNA, 14 bp, Homo sapiens
actccatacagcct

SEQ ID NO: 701597 - DNA, 15 bp, Homo sapiens
actccatacagcctc

SEQ ID NO: 701598 - DNA, 22 bp, Homo sapiens
actccatacagcctctacagcc

SEQ ID NO: 701599 - DNA, 21 bp, Homo sapiens
actccatacataacttgatat

SEQ ID NO: 701600 - DNA, 18 bp, Homo sapiens
actccatatttatttaaa

SEQ ID NO: 701601 - DNA, 20 bp, Homo sapiens
actccatcgccatcttcttc

SEQ ID NO: 701602 - DNA, 16 bp, Homo sapiens
actccatctctcatcc

SEQ ID NO: 701603 - DNA, 11 bp, Homo sapiens
actccatcttg

SEQ ID NO: 701604 - DNA, 17 bp, Homo sapiens
actccatgagaagccgt

SEQ ID NO: 701605 - DNA, 14 bp, Homo sapiens
actccatggccacc

SEQ ID NO: 701606 - DNA, 15 bp, Homo sapiens
actccatggccaccc

SEQ ID NO: 701607 - DNA, 16 bp, Homo sapiens
actccatggccacccc

SEQ ID NO: 701608 - DNA, 17 bp, Homo sapiens
actccatggccaccccg

SEQ ID NO: 701609 - DNA, 20 bp, Homo sapiens
actccatttggtcctttctc

SEQ ID NO: 701610 - DNA, 23 bp, Homo sapiens
actcccagcagagcccaccagcc

SEQ ID NO: 701611 - DNA, 22 bp, Homo sapiens
actcccagtccaaatgtcctcc

SEQ ID NO: 701612 - DNA, 13 bp, Homo sapiens
actcccatctcct

SEQ ID NO: 701613 - DNA, 17 bp, Homo sapiens
actccccactcccccac

SEQ ID NO: 701614 - DNA, 19 bp, Homo sapiens
actccccagagctgtgcca

SEQ ID NO: 701615 - DNA, 17 bp, Homo sapiens
actccccagccccagcc

SEQ ID NO: 701616 - DNA, 12 bp, Homo sapiens
actccccaggcc

SEQ ID NO: 701617 - DNA, 13 bp, Homo sapiens
actccccaggcca

SEQ ID NO: 701618 - DNA, 11 bp, Homo sapiens
actccccaggg

SEQ ID NO: 701619 - DNA, 19 bp, Homo sapiens
actcccccaaccaaggaag

SEQ ID NO: 701620 - DNA, 20 bp, Homo sapiens
actcccccaaccaaggaagg

SEQ ID NO: 701621 - DNA, 21 bp, Homo sapiens
actcccccacccatggggagg

SEQ ID NO: 701622 - DNA, 13 bp, Homo sapiens
actcccccacctg

SEQ ID NO: 701623 - DNA, 22 bp, Homo sapiens
actcccccttcccttggaggga

SEQ ID NO: 701624 - DNA, 14 bp, Homo sapiens
actccccgaagtct

SEQ ID NO: 701625 - DNA, 16 bp, Homo sapiens
actccccgaagtcttt

SEQ ID NO: 701626 - DNA, 17 bp, Homo sapiens
actccccgaagtctttt

SEQ ID NO: 701627 - DNA, 22 bp, Homo sapiens
actcccctcacacacacccccc

SEQ ID NO: 701628 - DNA, 12 bp, Homo sapiens
actccccttccc

SEQ ID NO: 701629 - DNA, 15 bp, Homo sapiens
actccccttccctgg

SEQ ID NO: 701630 - DNA, 18 bp, Homo sapiens
actccccttccctgggga

SEQ ID NO: 701631 - DNA, 20 bp, Homo sapiens
actcccgaaagcctttcctc

SEQ ID NO: 701632 - DNA, 18 bp, Homo sapiens
actcccgccccgggctgg

SEQ ID NO: 701633 - DNA, 17 bp, Homo sapiens
actcccgctgcacacag

SEQ ID NO: 701634 - DNA, 16 bp, Homo sapiens
actcccgggccaagac

SEQ ID NO: 701635 - DNA, 16 bp, Homo sapiens
actcccgggccacgcc

SEQ ID NO: 701636 - DNA, 18 bp, Homo sapiens
actcccgggccacgcccc

SEQ ID NO: 701637 - DNA, 19 bp, Homo sapiens
actcccgggccacgcccca

SEQ ID NO: 701638 - DNA, 13 bp, Homo sapiens
caattgcactgct

SEQ ID NO: 701639 - DNA, 14 bp, Homo sapiens
caattgcatctccc

SEQ ID NO: 701640 - DNA, 12 bp, Homo sapiens
caattgccctgt

SEQ ID NO: 701641 - DNA, 14 bp, Homo sapiens
caattggagggtct

SEQ ID NO: 701642 - DNA, 21 bp, Homo sapiens
caattggattggaatgcagag

SEQ ID NO: 701643 - DNA, 17 bp, Homo sapiens
caattggcagtgacttt

SEQ ID NO: 701644 - DNA, 18 bp, Homo sapiens
caattggcagtgactttg

SEQ ID NO: 701645 - DNA, 12 bp, Homo sapiens
caattggttgtt

SEQ ID NO: 701646 - DNA, 14 bp, Homo sapiens
caattgtattttat

SEQ ID NO: 701647 - DNA, 16 bp, Homo sapiens
caattgtcatttataa

SEQ ID NO: 701648 - DNA, 14 bp, Homo sapiens
caattgtgctgcca

SEQ ID NO: 701649 - DNA, 15 bp, Homo sapiens
caattgtgctgccat

SEQ ID NO: 701650 - DNA, 15 bp, Homo sapiens
caattgtgtagcctt

SEQ ID NO: 701651 - DNA, 22 bp, Homo sapiens
caattgtttggggttgaaaatt

SEQ ID NO: 701652 - DNA, 11 bp, Homo sapiens
caatttaaatg

SEQ ID NO: 701653 - DNA, 14 bp, Homo sapiens
caatttaaatgtta

SEQ ID NO: 701654 - DNA, 22 bp, Homo sapiens
caatttaaggaacacagagcag

SEQ ID NO: 701655 - DNA, 23 bp, Homo sapiens
caatttaagtgttggaaaaaatt

SEQ ID NO: 701656 - DNA, 13 bp, Homo sapiens
caatttacaaagt

SEQ ID NO: 701657 - DNA, 20 bp, Homo sapiens
caatttacaaagtgtgtatt

SEQ ID NO: 701658 - DNA, 17 bp, Homo sapiens
caatttagcaaactgat

SEQ ID NO: 701659 - DNA, 16 bp, Homo sapiens
caatttattactgaaa

SEQ ID NO: 701660 - DNA, 23 bp, Homo sapiens
caatttatttgaatgatttttct

SEQ ID NO: 701661 - DNA, 18 bp, Homo sapiens
caatttccatatagtcta

SEQ ID NO: 701662 - DNA, 13 bp, Homo sapiens
caatttcggattt

SEQ ID NO: 701663 - DNA, 17 bp, Homo sapiens
caatttcggattttttc

SEQ ID NO: 701664 - DNA, 19 bp, Homo sapiens
caatttctaatttttaaga

SEQ ID NO: 701665 - DNA, 16 bp, Homo sapiens
caatttctactttgaa

SEQ ID NO: 701666 - DNA, 20 bp, Homo sapiens
caatttctactttgaagtca

SEQ ID NO: 701667 - DNA, 14 bp, Homo sapiens
caatttcttccttc

SEQ ID NO: 701668 - DNA, 17 bp, Homo sapiens
caatttgagactgaaat

SEQ ID NO: 701669 - DNA, 19 bp, Homo sapiens
caatttgagactgaaattt

SEQ ID NO: 701670 - DNA, 16 bp, Homo sapiens
caatttgatacataat

SEQ ID NO: 701671 - DNA, 20 bp, Homo sapiens
caatttgcactaaatcagag

SEQ ID NO: 701672 - DNA, 16 bp, Homo sapiens
caatttgctgaaaaca

SEQ ID NO: 701673 - DNA, 23 bp, Homo sapiens
caatttgctgaaaacattacatg

SEQ ID NO: 701674 - DNA, 20 bp, Homo sapiens
caatttggagcattaactaa

SEQ ID NO: 701675 - DNA, 22 bp, Homo sapiens
caatttggagcattaactaaat

SEQ ID NO: 701676 - DNA, 23 bp, Homo sapiens
caatttggatttaaaagcctgct

SEQ ID NO: 701677 - DNA, 21 bp, Homo sapiens
caatttggtaaaaatgctgct

SEQ ID NO: 701678 - DNA, 19 bp, Homo sapiens
caatttgtaaaaacagcat

SEQ ID NO: 701679 - DNA, 16 bp, Homo sapiens
caatttgtataaaatg

SEQ ID NO: 701680 - DNA, 14 bp, Homo sapiens
caatttgtctccta

SEQ ID NO: 701681 - DNA, 18 bp, Homo sapiens
caatttgttaattcctat

SEQ ID NO: 701682 - DNA, 15 bp, Homo sapiens
caatttgtttttgca

SEQ ID NO: 701683 - DNA, 20 bp, Homo sapiens
caatttgtttttgcattttt

SEQ ID NO: 701684 - DNA, 15 bp, Homo sapiens
caattttaaacatat

SEQ ID NO: 701685 - DNA, 12 bp, Homo sapiens
caattttaaaga

SEQ ID NO: 701686 - DNA, 13 bp, Homo sapiens
caattttaaagac

SEQ ID NO: 701687 - DNA, 12 bp, Homo sapiens
caattttaaagt

SEQ ID NO: 701688 - DNA, 16 bp, Homo sapiens
caattttaaagttctt

SEQ ID NO: 701689 - DNA, 23 bp, Homo sapiens
caattttaatgatggtgttaaag

SEQ ID NO: 701690 - DNA, 17 bp, Homo sapiens
caattttaatgctattt

SEQ ID NO: 701691 - DNA, 18 bp, Homo sapiens
caattttaatttagtaaa

SEQ ID NO: 701692 - DNA, 19 bp, Homo sapiens
caattttaatttagtaaat

SEQ ID NO: 701693 - DNA, 23 bp, Homo sapiens
caattttaatttagtaaatgtta

SEQ ID NO: 701694 - DNA, 21 bp, Homo sapiens
caattttagtcactaagactt

SEQ ID NO: 701695 - DNA, 20 bp, Homo sapiens
caattttagtgtattaatca

SEQ ID NO: 701696 - DNA, 18 bp, Homo sapiens
caattttcattaaacttg

SEQ ID NO: 701697 - DNA, 20 bp, Homo sapiens
caattttcattaaacttgaa

SEQ ID NO: 701698 - DNA, 17 bp, Homo sapiens
caattttctcccaggaa

SEQ ID NO: 701699 - DNA, 19 bp, Homo sapiens
caattttctttaaccagtc

SEQ ID NO: 701700 - DNA, 15 bp, Homo sapiens
caattttctttgttt

SEQ ID NO: 701701 - DNA, 21 bp, Homo sapiens
caattttgatctttttatatt

SEQ ID NO: 701702 - DNA, 13 bp, Homo sapiens
caatttttatttc

SEQ ID NO: 701703 - DNA, 18 bp, Homo sapiens
caatttttatttctttta

SEQ ID NO: 701704 - DNA, 19 bp, Homo sapiens
caatttttgtctcagaagt

SEQ ID NO: 701705 - DNA, 21 bp, Homo sapiens
caattttttaagtgaaaatat

SEQ ID NO: 701706 - DNA, 12 bp, Homo sapiens
cacaaaaaagaa

SEQ ID NO: 701707 - DNA, 20 bp, Homo sapiens
cacaaaaaggcaaatattga

SEQ ID NO: 701708 - DNA, 20 bp, Homo sapiens
cacaaaaatttgaacactgg

SEQ ID NO: 701709 - DNA, 17 bp, Homo sapiens
cacaaaacattcatgta

SEQ ID NO: 701710 - DNA, 19 bp, Homo sapiens
cacaaaacattcatgtaac

SEQ ID NO: 701711 - DNA, 21 bp, Homo sapiens
cacaaaacattcatgtaactc

SEQ ID NO: 701712 - DNA, 17 bp, Homo sapiens
cacaaaattagaaagga

SEQ ID NO: 701713 - DNA, 13 bp, Homo sapiens
cacaaaattcaaa

SEQ ID NO: 701714 - DNA, 14 bp, Homo sapiens
cacaaacattgctg

SEQ ID NO: 701715 - DNA, 17 bp, Homo sapiens
cacaaaccctgctgaac

SEQ ID NO: 701716 - DNA, 17 bp, Homo sapiens
cacaaacctactgccca

SEQ ID NO: 701717 - DNA, 14 bp, Homo sapiens
cacaaacggagccc

SEQ ID NO: 701718 - DNA, 16 bp, Homo sapiens
cacaaacggagcccct

SEQ ID NO: 701719 - DNA, 23 bp, Homo sapiens
cacaaacgtttacttatcttatg

SEQ ID NO: 701720 - DNA, 16 bp, Homo sapiens
cacaaactacctctgg

SEQ ID NO: 701721 - DNA, 17 bp, Homo sapiens
cacaaactacctctgga

SEQ ID NO: 701722 - DNA, 16 bp, Homo sapiens
cacaaactgcagctgt

SEQ ID NO: 701723 - DNA, 17 bp, Homo sapiens
cacaaactgtgaaaata

SEQ ID NO: 701724 - DNA, 20 bp, Homo sapiens
cacaaagaaaattcctataa

SEQ ID NO: 701725 - DNA, 18 bp, Homo sapiens
cacaaagcccttccatgt

SEQ ID NO: 701726 - DNA, 18 bp, Homo sapiens
cacaaagcggggggaggg

SEQ ID NO: 701727 - DNA, 17 bp, Homo sapiens
cacaaagtcagcaggga

SEQ ID NO: 701728 - DNA, 12 bp, Homo sapiens
cacaacacagat

SEQ ID NO: 701729 - DNA, 23 bp, Homo sapiens
cacaacataaggagaatgtatct

SEQ ID NO: 701730 - DNA, 16 bp, Homo sapiens
cacaaccagccaggca

SEQ ID NO: 701731 - DNA, 15 bp, Homo sapiens
cacaacctcaccaaa

SEQ ID NO: 701732 - DNA, 18 bp, Homo sapiens
cacaacctcaccaaacta

SEQ ID NO: 701733 - DNA, 17 bp, Homo sapiens
cacaacctctctgatct

SEQ ID NO: 701734 - DNA, 19 bp, Homo sapiens
cacaaccttcggctccggg

SEQ ID NO: 701735 - DNA, 19 bp, Homo sapiens
cacaactcactccttttaa

SEQ ID NO: 701736 - DNA, 19 bp, Homo sapiens
cacaactgtgtgattaaaa

SEQ ID NO: 701737 - DNA, 22 bp, Homo sapiens
cacaactgtgtgattaaaaggt

SEQ ID NO: 701738 - DNA, 23 bp, Homo sapiens
cacaacttgtcacccaaagcctg

SEQ ID NO: 701739 - DNA, 20 bp, Homo sapiens
cacaacttgtttttggtttt

SEQ ID NO: 701740 - DNA, 21 bp, Homo sapiens
cacaactttattgattgaatt

SEQ ID NO: 701741 - DNA, 16 bp, Homo sapiens
cacaactttgcaaatt

SEQ ID NO: 701742 - DNA, 12 bp, Homo sapiens
cacaagaaattt

SEQ ID NO: 701743 - DNA, 13 bp, Homo sapiens
cacaagaatggat

SEQ ID NO: 701744 - DNA, 23 bp, Homo sapiens
cacaagaatggatcacaagatgg

SEQ ID NO: 701745 - DNA, 18 bp, Homo sapiens
cacaagagcatcaggctc

SEQ ID NO: 701746 - DNA, 20 bp, Homo sapiens
cacaagagcccagcagggcc

SEQ ID NO: 701747 - DNA, 14 bp, Homo sapiens
cacaagagtgaatt

SEQ ID NO: 701748 - DNA, 12 bp, Homo sapiens
cacaagccacag

SEQ ID NO: 701749 - DNA, 23 bp, Homo sapiens
cacaagccattttttgaggagag

SEQ ID NO: 701750 - DNA, 21 bp, Homo sapiens
cacaagcccgtgacagatgcc

SEQ ID NO: 701751 - DNA, 22 bp, Homo sapiens
cacaagcccgtgacagatgcca

SEQ ID NO: 701752 - DNA, 18 bp, Homo sapiens
cacaagcctcttctgaag

SEQ ID NO: 701753 - DNA, 15 bp, Homo sapiens
cacaagctgagcagg

SEQ ID NO: 701754 - DNA, 11 bp, Homo sapiens
cacaagctgca

SEQ ID NO: 701755 - DNA, 12 bp, Homo sapiens
cacaagctgcac

SEQ ID NO: 701756 - DNA, 13 bp, Homo sapiens
cacaagctgcctc

SEQ ID NO: 701757 - DNA, 15 bp, Homo sapiens
cacaagctgcctctg

SEQ ID NO: 701758 - DNA, 13 bp, Homo sapiens
cacaagctggaag

SEQ ID NO: 701759 - DNA, 14 bp, Homo sapiens
cacaagctggaagc

SEQ ID NO: 701760 - DNA, 20 bp, Homo sapiens
cacaaggaaccctcaggcca

SEQ ID NO: 701761 - DNA, 12 bp, Homo sapiens
cacaaggctggc

SEQ ID NO: 701762 - DNA, 15 bp, Homo sapiens
cacaaggctggccag

SEQ ID NO: 701763 - DNA, 23 bp, Homo sapiens
actcccgggccacgccccagccc

SEQ ID NO: 701764 - DNA, 19 bp, Homo sapiens
actccctaatttatgtgct

SEQ ID NO: 701765 - DNA, 22 bp, Homo sapiens
actccctacccaatgtctccca

SEQ ID NO: 701766 - DNA, 14 bp, Homo sapiens
actccctccaccag

SEQ ID NO: 701767 - DNA, 22 bp, Homo sapiens
actccctccaccagcctgctga

SEQ ID NO: 701768 - DNA, 14 bp, Homo sapiens
actccctccccacc

SEQ ID NO: 701769 - DNA, 15 bp, Homo sapiens
actccctccccaccc

SEQ ID NO: 701770 - DNA, 16 bp, Homo sapiens
actccctcctcacctc

SEQ ID NO: 701771 - DNA, 19 bp, Homo sapiens
actccctcctcacctctgg

SEQ ID NO: 701772 - DNA, 16 bp, Homo sapiens
actccctcctggagct

SEQ ID NO: 701773 - DNA, 22 bp, Homo sapiens
actccctctgcagaatcccttt

SEQ ID NO: 701774 - DNA, 15 bp, Homo sapiens
actccctctgccttc

SEQ ID NO: 701775 - DNA, 23 bp, Homo sapiens
actccctctgccttcaggcttct

SEQ ID NO: 701776 - DNA, 14 bp, Homo sapiens
actccctgcagatg

SEQ ID NO: 701777 - DNA, 18 bp, Homo sapiens
actccctgcccttccccc

SEQ ID NO: 701778 - DNA, 13 bp, Homo sapiens
actccctggcctt

SEQ ID NO: 701779 - DNA, 17 bp, Homo sapiens
actccctggctctcaga

SEQ ID NO: 701780 - DNA, 22 bp, Homo sapiens
actccctgtgggggtggccatc

SEQ ID NO: 701781 - DNA, 19 bp, Homo sapiens
actcccttaggcattattt

SEQ ID NO: 701782 - DNA, 16 bp, Homo sapiens
actcccttgctggccc

SEQ ID NO: 701783 - DNA, 23 bp, Homo sapiens
actcccttgctggccccagccct

SEQ ID NO: 701784 - DNA, 21 bp, Homo sapiens
actcccttggtggcaagagcc

SEQ ID NO: 701785 - DNA, 22 bp, Homo sapiens
actcccttggtggcaagagccc

SEQ ID NO: 701786 - DNA, 23 bp, Homo sapiens
actccgagaggtgggccagtctg

SEQ ID NO: 701787 - DNA, 13 bp, Homo sapiens
actccgcccccag

SEQ ID NO: 701788 - DNA, 17 bp, Homo sapiens
actccgcccccagccta

SEQ ID NO: 701789 - DNA, 18 bp, Homo sapiens
actccgcgccgatgccac

SEQ ID NO: 701790 - DNA, 19 bp, Homo sapiens
actccgcgccgatgccacc

SEQ ID NO: 701791 - DNA, 21 bp, Homo sapiens
actccgcgccgatgccaccgg

SEQ ID NO: 701792 - DNA, 15 bp, Homo sapiens
actccggagacaggg

SEQ ID NO: 701793 - DNA, 20 bp, Homo sapiens
actccggaggactgagcccc

SEQ ID NO: 701794 - DNA, 16 bp, Homo sapiens
actccggtgtgcctgc

SEQ ID NO: 701795 - DNA, 19 bp, Homo sapiens
actccggtgtgcctgcagc

SEQ ID NO: 701796 - DNA, 23 bp, Homo sapiens
actccgtccatccgactgcccct

SEQ ID NO: 701797 - DNA, 18 bp, Homo sapiens
actccgtgtgcctggggt

SEQ ID NO: 701798 - DNA, 21 bp, Homo sapiens
actccgttggccactccgaga

SEQ ID NO: 701799 - DNA, 22 bp, Homo sapiens
actcctaattttaaataatttc

SEQ ID NO: 701800 - DNA, 22 bp, Homo sapiens
actcctacaagatttagaaaaa

SEQ ID NO: 701801 - DNA, 15 bp, Homo sapiens
actcctacctcagcc

SEQ ID NO: 701802 - DNA, 16 bp, Homo sapiens
actcctacctcagcct

SEQ ID NO: 701803 - DNA, 23 bp, Homo sapiens
actcctagaagaaccaaatacct

SEQ ID NO: 701804 - DNA, 20 bp, Homo sapiens
actcctcaaaccacttgcct

SEQ ID NO: 701805 - DNA, 16 bp, Homo sapiens
actcctcaagactttg

SEQ ID NO: 701806 - DNA, 18 bp, Homo sapiens
actcctcagatctgaaca

SEQ ID NO: 701807 - DNA, 19 bp, Homo sapiens
actcctcagatctgaacac

SEQ ID NO: 701808 - DNA, 12 bp, Homo sapiens
actcctcccagg

SEQ ID NO: 701809 - DNA, 13 bp, Homo sapiens
actcctccctccg

SEQ ID NO: 701810 - DNA, 13 bp, Homo sapiens
actcctcctcttt

SEQ ID NO: 701811 - DNA, 16 bp, Homo sapiens
actcctcctctttctc

SEQ ID NO: 701812 - DNA, 18 bp, Homo sapiens
actcctcctctttctctc

SEQ ID NO: 701813 - DNA, 22 bp, Homo sapiens
actcctcctgggggctggctcc

SEQ ID NO: 701814 - DNA, 22 bp, Homo sapiens
actcctctcaactgcctcagcg

SEQ ID NO: 701815 - DNA, 19 bp, Homo sapiens
actcctctcccttgaggga

SEQ ID NO: 701816 - DNA, 20 bp, Homo sapiens
actcctctgcagtgccttgg

SEQ ID NO: 701817 - DNA, 11 bp, Homo sapiens
actcctctggg

SEQ ID NO: 701818 - DNA, 12 bp, Homo sapiens
actcctctgggc

SEQ ID NO: 701819 - DNA, 21 bp, Homo sapiens
actcctctgggcctggggtgc

SEQ ID NO: 701820 - DNA, 22 bp, Homo sapiens
actcctgaaatgccaagtgcct

SEQ ID NO: 701821 - DNA, 23 bp, Homo sapiens
actcctgaagggaaggcaaaggc

SEQ ID NO: 701822 - DNA, 22 bp, Homo sapiens
actcctgaattcagttgctttg

SEQ ID NO: 701823 - DNA, 18 bp, Homo sapiens
actcctgacccctctcct

SEQ ID NO: 701824 - DNA, 20 bp, Homo sapiens
actcctgacccctctcctca

SEQ ID NO: 701825 - DNA, 17 bp, Homo sapiens
actcctgaggacagctg

SEQ ID NO: 701826 - DNA, 19 bp, Homo sapiens
actcctgaggacagctgtc

SEQ ID NO: 701827 - DNA, 17 bp, Homo sapiens
actcctgagtggggcca

SEQ ID NO: 701828 - DNA, 15 bp, Homo sapiens
actcctgcaaaattt

SEQ ID NO: 701829 - DNA, 18 bp, Homo sapiens
actcctgccagttgaaaa

SEQ ID NO: 701830 - DNA, 23 bp, Homo sapiens
actcctgccagttgaaaatggat

SEQ ID NO: 701831 - DNA, 12 bp, Homo sapiens
actcctgcttct

SEQ ID NO: 701832 - DNA, 19 bp, Homo sapiens
actcctggactccggagga

SEQ ID NO: 701833 - DNA, 15 bp, Homo sapiens
actcctggcctcaag

SEQ ID NO: 701834 - DNA, 10 bp, Homo sapiens
actcctggct

SEQ ID NO: 701835 - DNA, 12 bp, Homo sapiens
actcctggctcc

SEQ ID NO: 701836 - DNA, 16 bp, Homo sapiens
actcctggctccgcag

SEQ ID NO: 701837 - DNA, 20 bp, Homo sapiens
actcctggctccgcaggggt

SEQ ID NO: 701838 - DNA, 16 bp, Homo sapiens
actcctgggctctgaa

SEQ ID NO: 701839 - DNA, 19 bp, Homo sapiens
actcctgggctctgaacac

SEQ ID NO: 701840 - DNA, 21 bp, Homo sapiens
actcctggggcctcttgggtc

SEQ ID NO: 701841 - DNA, 23 bp, Homo sapiens
actcctgggttgagctgttgcct

SEQ ID NO: 701842 - DNA, 15 bp, Homo sapiens
actcctgtaattcct

SEQ ID NO: 701843 - DNA, 13 bp, Homo sapiens
actcctgtacact

SEQ ID NO: 701844 - DNA, 15 bp, Homo sapiens
actcctgtacactga

SEQ ID NO: 701845 - DNA, 20 bp, Homo sapiens
actcctgtcccgccttcctc

SEQ ID NO: 701846 - DNA, 10 bp, Homo sapiens
actcctgtgt

SEQ ID NO: 701847 - DNA, 17 bp, Homo sapiens
actcctgttacttacct

SEQ ID NO: 701848 - DNA, 20 bp, Homo sapiens
actcctgttacttacctaaa

SEQ ID NO: 701849 - DNA, 14 bp, Homo sapiens
actcctgtttctcc

SEQ ID NO: 701850 - DNA, 15 bp, Homo sapiens
actccttatttggcg

SEQ ID NO: 701851 - DNA, 22 bp, Homo sapiens
actcctttactgcagcctgggc

SEQ ID NO: 701852 - DNA, 15 bp, Homo sapiens
actcctttatctgta

SEQ ID NO: 701853 - DNA, 13 bp, Homo sapiens
actcctttccaat

SEQ ID NO: 701854 - DNA, 15 bp, Homo sapiens
actcgaatctgtgtg

SEQ ID NO: 701855 - DNA, 19 bp, Homo sapiens
actcgacaaaggccacagg

SEQ ID NO: 701856 - DNA, 17 bp, Homo sapiens
actcgactctgctgctc

SEQ ID NO: 701857 - DNA, 21 bp, Homo sapiens
actcgagaccatcctggcccc

SEQ ID NO: 701858 - DNA, 14 bp, Homo sapiens
actcgatgcactga

SEQ ID NO: 701859 - DNA, 12 bp, Homo sapiens
actcgcccccag

SEQ ID NO: 701860 - DNA, 14 bp, Homo sapiens
actcgcccgcccac

SEQ ID NO: 701861 - DNA, 19 bp, Homo sapiens
actcgcccgcccactgtcc

SEQ ID NO: 701862 - DNA, 22 bp, Homo sapiens
actcgcccgcccactgtcctgg

SEQ ID NO: 701863 - DNA, 15 bp, Homo sapiens
actcgcgctcagtaa

SEQ ID NO: 701864 - DNA, 16 bp, Homo sapiens
actcgcgctcagtaaa

SEQ ID NO: 701865 - DNA, 16 bp, Homo sapiens
actcggcaccctgcaa

SEQ ID NO: 701866 - DNA, 15 bp, Homo sapiens
actcggctctgcagt

SEQ ID NO: 701867 - DNA, 14 bp, Homo sapiens
actcgggagctgca

SEQ ID NO: 701868 - DNA, 17 bp, Homo sapiens
actcgggggcgcctgga

SEQ ID NO: 701869 - DNA, 14 bp, Homo sapiens
actcgtatatgtct

SEQ ID NO: 701870 - DNA, 15 bp, Homo sapiens
actcgtgtgtttcta

SEQ ID NO: 701871 - DNA, 23 bp, Homo sapiens
actcgtgtgtttctattttttga

SEQ ID NO: 701872 - DNA, 22 bp, Homo sapiens
actcgttcacctccaagcattt

SEQ ID NO: 701873 - DNA, 16 bp, Homo sapiens
actcgttggatgtctg

SEQ ID NO: 701874 - DNA, 21 bp, Homo sapiens
actctaaaagatcctttttaa

SEQ ID NO: 701875 - DNA, 19 bp, Homo sapiens
actctaaaatggacatttt

SEQ ID NO: 701876 - DNA, 20 bp, Homo sapiens
actctaaaatggacattttc

SEQ ID NO: 701877 - DNA, 21 bp, Homo sapiens
actctaaacaatagttcactc

SEQ ID NO: 701878 - DNA, 13 bp, Homo sapiens
actctaaactgca

SEQ ID NO: 701879 - DNA, 13 bp, Homo sapiens
actctaaatgcag

SEQ ID NO: 701880 - DNA, 18 bp, Homo sapiens
actctaaccctgtggaag

SEQ ID NO: 701881 - DNA, 15 bp, Homo sapiens
actctaactgtatat

SEQ ID NO: 701882 - DNA, 18 bp, Homo sapiens
actctaactgtatatttg

SEQ ID NO: 701883 - DNA, 18 bp, Homo sapiens
actctaagtcatgtatgt

SEQ ID NO: 701884 - DNA, 23 bp, Homo sapiens
actctaagtcatgtatgtttctc

SEQ ID NO: 701885 - DNA, 14 bp, Homo sapiens
actctaatagtgct

SEQ ID NO: 701886 - DNA, 21 bp, Homo sapiens
actctaattagagaactggag

SEQ ID NO: 701887 - DNA, 16 bp, Homo sapiens
cacaaggctggccagc

SEQ ID NO: 701888 - DNA, 17 bp, Homo sapiens
cacaaggctggccagca

SEQ ID NO: 701889 - DNA, 16 bp, Homo sapiens
cacaaggctgttgcat

SEQ ID NO: 701890 - DNA, 20 bp, Homo sapiens
cacaaggtccactccctgct

SEQ ID NO: 701891 - DNA, 21 bp, Homo sapiens
cacaagtggtggtaaccctgg

SEQ ID NO: 701892 - DNA, 16 bp, Homo sapiens
cacaataaatggccag

SEQ ID NO: 701893 - DNA, 20 bp, Homo sapiens
cacaataaatggccagtgct

SEQ ID NO: 701894 - DNA, 19 bp, Homo sapiens
cacaataaatgtattcaaa

SEQ ID NO: 701895 - DNA, 20 bp, Homo sapiens
cacaatagccgatatcagaa

SEQ ID NO: 701896 - DNA, 20 bp, Homo sapiens
cacaataggtctttctctca

SEQ ID NO: 701897 - DNA, 12 bp, Homo sapiens
cacaatatgaat

SEQ ID NO: 701898 - DNA, 14 bp, Homo sapiens
cacaatatgtatgc

SEQ ID NO: 701899 - DNA, 13 bp, Homo sapiens
cacaatgaatgta

SEQ ID NO: 701900 - DNA, 19 bp, Homo sapiens
cacaatgagatgcatgatt

SEQ ID NO: 701901 - DNA, 22 bp, Homo sapiens
cacaatgcatgtgctgtctcca

SEQ ID NO: 701902 - DNA, 13 bp, Homo sapiens
cacaatggcacct

SEQ ID NO: 701903 - DNA, 20 bp, Homo sapiens
cacaatggctaattcccaga

SEQ ID NO: 701904 - DNA, 22 bp, Homo sapiens
cacaatggtttttaaattttgt

SEQ ID NO: 701905 - DNA, 22 bp, Homo sapiens
cacaatgttgctagttttttgc

SEQ ID NO: 701906 - DNA, 23 bp, Homo sapiens
cacaatgtttcttcatttctctg

SEQ ID NO: 701907 - DNA, 15 bp, Homo sapiens
cacaattctgtccct

SEQ ID NO: 701908 - DNA, 17 bp, Homo sapiens
cacaattctgtccctgt

SEQ ID NO: 701909 - DNA, 18 bp, Homo sapiens
cacaattgatacttcagg

SEQ ID NO: 701910 - DNA, 23 bp, Homo sapiens
cacaattgatacttcaggtgctt

SEQ ID NO: 701911 - DNA, 16 bp, Homo sapiens
cacaattgttttacct

SEQ ID NO: 701912 - DNA, 17 bp, Homo sapiens
cacaattgttttacctg

SEQ ID NO: 701913 - DNA, 17 bp, Homo sapiens
cacaatttaaaatattt

SEQ ID NO: 701914 - DNA, 15 bp, Homo sapiens
cacacaaacaaggcc

SEQ ID NO: 701915 - DNA, 18 bp, Homo sapiens
cacacaaaccttctgcct

SEQ ID NO: 701916 - DNA, 15 bp, Homo sapiens
cacacaaagactcct

SEQ ID NO: 701917 - DNA, 13 bp, Homo sapiens
cacacaaaggtat

SEQ ID NO: 701918 - DNA, 18 bp, Homo sapiens
cacacaagaagaagggca

SEQ ID NO: 701919 - DNA, 21 bp, Homo sapiens
cacacaagtttgtgctatcta

SEQ ID NO: 701920 - DNA, 15 bp, Homo sapiens
cacacaataaagaac

SEQ ID NO: 701921 - DNA, 23 bp, Homo sapiens
cacacaatgtggacgtgcactga

SEQ ID NO: 701922 - DNA, 16 bp, Homo sapiens
cacacaattagatttc

SEQ ID NO: 701923 - DNA, 15 bp, Homo sapiens
cacacaattttttct

SEQ ID NO: 701924 - DNA, 15 bp, Homo sapiens
cacacacaaaccatt

SEQ ID NO: 701925 - DNA, 16 bp, Homo sapiens
cacacacaataaagaa

SEQ ID NO: 701926 - DNA, 11 bp, Homo sapiens
cacacacacac

SEQ ID NO: 701927 - DNA, 13 bp, Homo sapiens
cacacacacacaa

SEQ ID NO: 701928 - DNA, 14 bp, Homo sapiens
cacacacacacaaa

SEQ ID NO: 701929 - DNA, 15 bp, Homo sapiens
cacacacacacacac

SEQ ID NO: 701930 - DNA, 13 bp, Homo sapiens
cacacacacgcac

SEQ ID NO: 701931 - DNA, 12 bp, Homo sapiens
cacacacagagg

SEQ ID NO: 701932 - DNA, 16 bp, Homo sapiens
cacacacagctgggca

SEQ ID NO: 701933 - DNA, 12 bp, Homo sapiens
cacacacaggag

SEQ ID NO: 701934 - DNA, 13 bp, Homo sapiens
cacacacaggcaa

SEQ ID NO: 701935 - DNA, 21 bp, Homo sapiens
cacacacaggcaactgaggca

SEQ ID NO: 701936 - DNA, 15 bp, Homo sapiens
cacacacaggccttc

SEQ ID NO: 701937 - DNA, 13 bp, Homo sapiens
cacacacatctgg

SEQ ID NO: 701938 - DNA, 18 bp, Homo sapiens
cacacacatgctaggatg

SEQ ID NO: 701939 - DNA, 14 bp, Homo sapiens
cacacacctagcca

SEQ ID NO: 701940 - DNA, 13 bp, Homo sapiens
cacacacgatgca

SEQ ID NO: 701941 - DNA, 19 bp, Homo sapiens
cacacacgcacgcacacac

SEQ ID NO: 701942 - DNA, 23 bp, Homo sapiens
cacacacgcacgcacacacacaa

SEQ ID NO: 701943 - DNA, 12 bp, Homo sapiens
cacacacgccag

SEQ ID NO: 701944 - DNA, 15 bp, Homo sapiens
cacacacgccagctc

SEQ ID NO: 701945 - DNA, 19 bp, Homo sapiens
cacacacgctttcttatgc

SEQ ID NO: 701946 - DNA, 13 bp, Homo sapiens
cacacactcacca

SEQ ID NO: 701947 - DNA, 17 bp, Homo sapiens
cacacactggaccccac

SEQ ID NO: 701948 - DNA, 20 bp, Homo sapiens
cacacactggaccccactgg

SEQ ID NO: 701949 - DNA, 23 bp, Homo sapiens
cacacacttagccattgaaatgt

SEQ ID NO: 701950 - DNA, 18 bp, Homo sapiens
cacacagagattctggat

SEQ ID NO: 701951 - DNA, 12 bp, Homo sapiens
cacacagaggaa

SEQ ID NO: 701952 - DNA, 22 bp, Homo sapiens
cacacagaggaagagcaggcac

SEQ ID NO: 701953 - DNA, 21 bp, Homo sapiens
cacacagaggctgcctctccc

SEQ ID NO: 701954 - DNA, 16 bp, Homo sapiens
cacacagatacacaca

SEQ ID NO: 701955 - DNA, 17 bp, Homo sapiens
cacacagatgacaaatt

SEQ ID NO: 701956 - DNA, 13 bp, Homo sapiens
cacacagcctcta

SEQ ID NO: 701957 - DNA, 14 bp, Homo sapiens
cacacagctgagca

SEQ ID NO: 701958 - DNA, 13 bp, Homo sapiens
cacacagctgccc

SEQ ID NO: 701959 - DNA, 16 bp, Homo sapiens
cacacagctgccctag

SEQ ID NO: 701960 - DNA, 13 bp, Homo sapiens
cacacagctgggc

SEQ ID NO: 701961 - DNA, 14 bp, Homo sapiens
cacacaggacagcg

SEQ ID NO: 701962 - DNA, 20 bp, Homo sapiens
cacacaggcaactgaggcag

SEQ ID NO: 701963 - DNA, 10 bp, Homo sapiens
cacacaggcc

SEQ ID NO: 701964 - DNA, 14 bp, Homo sapiens
cacacaggccttct

SEQ ID NO: 701965 - DNA, 12 bp, Homo sapiens
cacacagggcac

SEQ ID NO: 701966 - DNA, 17 bp, Homo sapiens
cacacagggcactgact

SEQ ID NO: 701967 - DNA, 12 bp, Homo sapiens
cacacagggctc

SEQ ID NO: 701968 - DNA, 20 bp, Homo sapiens
cacacagggctcacagggca

SEQ ID NO: 701969 - DNA, 22 bp, Homo sapiens
cacacaggggaggtgatagcat

SEQ ID NO: 701970 - DNA, 18 bp, Homo sapiens
cacacagtttaaaaaatc

SEQ ID NO: 701971 - DNA, 21 bp, Homo sapiens
cacacatataaacatcacaca

SEQ ID NO: 701972 - DNA, 13 bp, Homo sapiens
cacacatatacat

SEQ ID NO: 701973 - DNA, 17 bp, Homo sapiens
cacacatatacatatat

SEQ ID NO: 701974 - DNA, 18 bp, Homo sapiens
cacacatatacatatata

SEQ ID NO: 701975 - DNA, 23 bp, Homo sapiens
cacacatatatataacaaataat

SEQ ID NO: 701976 - DNA, 15 bp, Homo sapiens
cacacatccagctgc

SEQ ID NO: 701977 - DNA, 23 bp, Homo sapiens
cacacatccagctgcccctccct

SEQ ID NO: 701978 - DNA, 17 bp, Homo sapiens
cacacatccccagccag

SEQ ID NO: 701979 - DNA, 18 bp, Homo sapiens
cacacatcgttgccgcag

SEQ ID NO: 701980 - DNA, 16 bp, Homo sapiens
cacacatctggccctg

SEQ ID NO: 701981 - DNA, 22 bp, Homo sapiens
cacacatctgggtgccctgaaa

SEQ ID NO: 701982 - DNA, 13 bp, Homo sapiens
cacacatggctta

SEQ ID NO: 701983 - DNA, 16 bp, Homo sapiens
cacacattccagccag

SEQ ID NO: 701984 - DNA, 19 bp, Homo sapiens
cacacattccagccaggcc

SEQ ID NO: 701985 - DNA, 21 bp, Homo sapiens
cacacattccagccaggccca

SEQ ID NO: 701986 - DNA, 17 bp, Homo sapiens
cacacattccagggctg

SEQ ID NO: 701987 - DNA, 14 bp, Homo sapiens
cacacattttatga

SEQ ID NO: 701988 - DNA, 18 bp, Homo sapiens
cacaccaatcagagagcc

SEQ ID NO: 701989 - DNA, 19 bp, Homo sapiens
cacaccaatcagagagcct

SEQ ID NO: 701990 - DNA, 23 bp, Homo sapiens
cacaccactaaccatccccaact

SEQ ID NO: 701991 - DNA, 16 bp, Homo sapiens
cacaccactgccctgc

SEQ ID NO: 701992 - DNA, 19 bp, Homo sapiens
cacaccagccgctgcaggg

SEQ ID NO: 701993 - DNA, 22 bp, Homo sapiens
cacaccaggccgtcctcccggg

SEQ ID NO: 701994 - DNA, 14 bp, Homo sapiens
cacaccaggctgtg

SEQ ID NO: 701995 - DNA, 17 bp, Homo sapiens
cacaccaggctgtgggc

SEQ ID NO: 701996 - DNA, 18 bp, Homo sapiens
cacaccagggcaactctt

SEQ ID NO: 701997 - DNA, 15 bp, Homo sapiens
cacaccagtgcaagc

SEQ ID NO: 701998 - DNA, 15 bp, Homo sapiens
cacaccagttttgag

SEQ ID NO: 701999 - DNA, 14 bp, Homo sapiens
cacacccaccgtcc

SEQ ID NO: 702000 - DNA, 13 bp, Homo sapiens
cacacccactgcc

SEQ ID NO: 702001 - DNA, 15 bp, Homo sapiens
cacacccaggaaggg

SEQ ID NO: 702002 - DNA, 17 bp, Homo sapiens
cacacccaggtctcttc

SEQ ID NO: 702003 - DNA, 13 bp, Homo sapiens
cacaccccacacc

SEQ ID NO: 702004 - DNA, 19 bp, Homo sapiens
cacaccccacaccccagcc

SEQ ID NO: 702005 - DNA, 17 bp, Homo sapiens
cacaccccactcccaca

SEQ ID NO: 702006 - DNA, 14 bp, Homo sapiens
cacaccccagccca

SEQ ID NO: 702007 - DNA, 21 bp, Homo sapiens
cacaccccagcccaccctgct

SEQ ID NO: 702008 - DNA, 13 bp, Homo sapiens
cacacccccagag

SEQ ID NO: 702009 - DNA, 23 bp, Homo sapiens
cacacccgccctgtgtgtgtccc

SEQ ID NO: 702010 - DNA, 15 bp, Homo sapiens
cacaccgtcttcctt

SEQ ID NO: 702011 - DNA, 14 bp, Homo sapiens
cacacctcacgctc

SEQ ID NO: 702012 - DNA, 17 bp, Homo sapiens
cacacctcacgctctgg

SEQ ID NO: 702013 - DNA, 20 bp, Homo sapiens
actctaattcccattttgca

SEQ ID NO: 702014 - DNA, 22 bp, Homo sapiens
actctaattcccattttgcaaa

SEQ ID NO: 702015 - DNA, 14 bp, Homo sapiens
actctacactgaaa

SEQ ID NO: 702016 - DNA, 15 bp, Homo sapiens
actctacactgaaac

SEQ ID NO: 702017 - DNA, 14 bp, Homo sapiens
actctacagactcc

SEQ ID NO: 702018 - DNA, 18 bp, Homo sapiens
actctacatgtaactatt

SEQ ID NO: 702019 - DNA, 19 bp, Homo sapiens
actctacccatattacaga

SEQ ID NO: 702020 - DNA, 15 bp, Homo sapiens
actctacccctgctc

SEQ ID NO: 702021 - DNA, 18 bp, Homo sapiens
actctacccctgctccca

SEQ ID NO: 702022 - DNA, 19 bp, Homo sapiens
actctacccctgctcccat

SEQ ID NO: 702023 - DNA, 19 bp, Homo sapiens
actctaccctcccaccccc

SEQ ID NO: 702024 - DNA, 22 bp, Homo sapiens
actctacctcatatcagtttgc

SEQ ID NO: 702025 - DNA, 17 bp, Homo sapiens
actctacgccaaagtgc

SEQ ID NO: 702026 - DNA, 22 bp, Homo sapiens
actctacgccaaagtgcagccc

SEQ ID NO: 702027 - DNA, 19 bp, Homo sapiens
actctacttaatccaatgg

SEQ ID NO: 702028 - DNA, 20 bp, Homo sapiens
actctacttagcatgtccct

SEQ ID NO: 702029 - DNA, 23 bp, Homo sapiens
actctagcctggcaacagagcga

SEQ ID NO: 702030 - DNA, 20 bp, Homo sapiens
actctagctgggggtgggcc

SEQ ID NO: 702031 - DNA, 15 bp, Homo sapiens
actctagggaaaaac

SEQ ID NO: 702032 - DNA, 16 bp, Homo sapiens
actctagggatataaa

SEQ ID NO: 702033 - DNA, 12 bp, Homo sapiens
actctaggttat

SEQ ID NO: 702034 - DNA, 15 bp, Homo sapiens
actctaggttataca

SEQ ID NO: 702035 - DNA, 16 bp, Homo sapiens
actctaggttatacaa

SEQ ID NO: 702036 - DNA, 17 bp, Homo sapiens
actctaggttatacaat

SEQ ID NO: 702037 - DNA, 19 bp, Homo sapiens
actctaggttatacaataa

SEQ ID NO: 702038 - DNA, 20 bp, Homo sapiens
actctaggttatacaataac

SEQ ID NO: 702039 - DNA, 16 bp, Homo sapiens
actctagtgacttcct

SEQ ID NO: 702040 - DNA, 22 bp, Homo sapiens
actctagtgacttcctggtgag

SEQ ID NO: 702041 - DNA, 14 bp, Homo sapiens
actctagttctaga

SEQ ID NO: 702042 - DNA, 13 bp, Homo sapiens
actctagttctgt

SEQ ID NO: 702043 - DNA, 20 bp, Homo sapiens
actctagttctgttgttttg

SEQ ID NO: 702044 - DNA, 17 bp, Homo sapiens
actctagtttattctaa

SEQ ID NO: 702045 - DNA, 22 bp, Homo sapiens
actctataagcaaattgctttt

SEQ ID NO: 702046 - DNA, 20 bp, Homo sapiens
actctatatgtagtgcattt

SEQ ID NO: 702047 - DNA, 15 bp, Homo sapiens
actctattctttaac

SEQ ID NO: 702048 - DNA, 15 bp, Homo sapiens
actctatttacagtc

SEQ ID NO: 702049 - DNA, 20 bp, Homo sapiens
actctatttttacatttaaa

SEQ ID NO: 702050 - DNA, 16 bp, Homo sapiens
actctcaaaagtctat

SEQ ID NO: 702051 - DNA, 19 bp, Homo sapiens
actctcaaaagtctatttt

SEQ ID NO: 702052 - DNA, 19 bp, Homo sapiens
actctcacactgaatcagc

SEQ ID NO: 702053 - DNA, 21 bp, Homo sapiens
actctcactcctgaattcagt

SEQ ID NO: 702054 - DNA, 22 bp, Homo sapiens
actctcaggaccaaagctttca

SEQ ID NO: 702055 - DNA, 18 bp, Homo sapiens
actctcaggatcaagaaa

SEQ ID NO: 702056 - DNA, 11 bp, Homo sapiens
actctcaggga

SEQ ID NO: 702057 - DNA, 16 bp, Homo sapiens
actctcatgtcccctt

SEQ ID NO: 702058 - DNA, 21 bp, Homo sapiens
actctcatgtccccttcctgt

SEQ ID NO: 702059 - DNA, 23 bp, Homo sapiens
actctccagagaacctttagaat

SEQ ID NO: 702060 - DNA, 19 bp, Homo sapiens
actctccagccattgtaat

SEQ ID NO: 702061 - DNA, 10 bp, Homo sapiens
actctcccca

SEQ ID NO: 702062 - DNA, 15 bp, Homo sapiens
actctccccacacta

SEQ ID NO: 702063 - DNA, 21 bp, Homo sapiens
actctccccacgagggctggc

SEQ ID NO: 702064 - DNA, 22 bp, Homo sapiens
actctccccacgagggctggct

SEQ ID NO: 702065 - DNA, 11 bp, Homo sapiens
actctccccag

SEQ ID NO: 702066 - DNA, 16 bp, Homo sapiens
actctccccagtgcct

SEQ ID NO: 702067 - DNA, 18 bp, Homo sapiens
actctccccagtgcctgc

SEQ ID NO: 702068 - DNA, 14 bp, Homo sapiens
actctccccctttc

SEQ ID NO: 702069 - DNA, 17 bp, Homo sapiens
actctcccctccctctt

SEQ ID NO: 702070 - DNA, 20 bp, Homo sapiens
actctcccctccctcttcct

SEQ ID NO: 702071 - DNA, 12 bp, Homo sapiens
actctcctcctc

SEQ ID NO: 702072 - DNA, 18 bp, Homo sapiens
actctcctcctcccctcc

SEQ ID NO: 702073 - DNA, 19 bp, Homo sapiens
actctcctcctcccctcct

SEQ ID NO: 702074 - DNA, 22 bp, Homo sapiens
actctcctcggccccctccatc

SEQ ID NO: 702075 - DNA, 12 bp, Homo sapiens
actctcctgcct

SEQ ID NO: 702076 - DNA, 18 bp, Homo sapiens
actctcctggaaatatta

SEQ ID NO: 702077 - DNA, 19 bp, Homo sapiens
actctcggggcccttgggg

SEQ ID NO: 702078 - DNA, 23 bp, Homo sapiens
actctcggggcccttggggcctg

SEQ ID NO: 702079 - DNA, 15 bp, Homo sapiens
actctctaaactggt

SEQ ID NO: 702080 - DNA, 13 bp, Homo sapiens
actctctcaccca

SEQ ID NO: 702081 - DNA, 16 bp, Homo sapiens
actctctcacccacca

SEQ ID NO: 702082 - DNA, 21 bp, Homo sapiens
actctctcacccaccagctcc

SEQ ID NO: 702083 - DNA, 13 bp, Homo sapiens
actctctccaccc

SEQ ID NO: 702084 - DNA, 20 bp, Homo sapiens
actctctccaccctatatgt

SEQ ID NO: 702085 - DNA, 21 bp, Homo sapiens
actctctccaccctatatgta

SEQ ID NO: 702086 - DNA, 16 bp, Homo sapiens
actctctccctggtct

SEQ ID NO: 702087 - DNA, 18 bp, Homo sapiens
actctctgaacccctccc

SEQ ID NO: 702088 - DNA, 13 bp, Homo sapiens
actctctgcagcc

SEQ ID NO: 702089 - DNA, 14 bp, Homo sapiens
actctctgcagccc

SEQ ID NO: 702090 - DNA, 16 bp, Homo sapiens
actctctgcagcccag

SEQ ID NO: 702091 - DNA, 14 bp, Homo sapiens
actctctgctctag

SEQ ID NO: 702092 - DNA, 16 bp, Homo sapiens
actctctgctctagcc

SEQ ID NO: 702093 - DNA, 17 bp, Homo sapiens
actctctgctctagcca

SEQ ID NO: 702094 - DNA, 19 bp, Homo sapiens
actctctgctctagccagg

SEQ ID NO: 702095 - DNA, 24 bp, Homo sapiens
actctctgctctagccaggagtct

SEQ ID NO: 702096 - DNA, 18 bp, Homo sapiens
actctctgggactctcct

SEQ ID NO: 702097 - DNA, 14 bp, Homo sapiens
actctctgtcttct

SEQ ID NO: 702098 - DNA, 15 bp, Homo sapiens
actctctgtcttctc

SEQ ID NO: 702099 - DNA, 16 bp, Homo sapiens
actctctgtcttctct

SEQ ID NO: 702100 - DNA, 17 bp, Homo sapiens
actctctgtcttctctc

SEQ ID NO: 702101 - DNA, 19 bp, Homo sapiens
actctctgtcttctctcca

SEQ ID NO: 702102 - DNA, 23 bp, Homo sapiens
actctctgttttagtgtttatgt

SEQ ID NO: 702103 - DNA, 12 bp, Homo sapiens
actctctttcct

SEQ ID NO: 702104 - DNA, 21 bp, Homo sapiens
actctctttccttgagctgtt

SEQ ID NO: 702105 - DNA, 10 bp, Homo sapiens
actctgaaaa

SEQ ID NO: 702106 - DNA, 13 bp, Homo sapiens
actctgaaaaaca

SEQ ID NO: 702107 - DNA, 22 bp, Homo sapiens
actctgaaaagcaattgccctg

SEQ ID NO: 702108 - DNA, 17 bp, Homo sapiens
actctgaaatctgaaga

SEQ ID NO: 702109 - DNA, 22 bp, Homo sapiens
actctgaagctaattgtactaa

SEQ ID NO: 702110 - DNA, 17 bp, Homo sapiens
actctgaaggagaggag

SEQ ID NO: 702111 - DNA, 20 bp, Homo sapiens
actctgaagggcatcatgca

SEQ ID NO: 702112 - DNA, 21 bp, Homo sapiens
actctgaagggcatcatgcat

SEQ ID NO: 702113 - DNA, 14 bp, Homo sapiens
actctgagccaagg

SEQ ID NO: 702114 - DNA, 21 bp, Homo sapiens
actctgagccaagggagggaa

SEQ ID NO: 702115 - DNA, 13 bp, Homo sapiens
actctgagcccag

SEQ ID NO: 702116 - DNA, 14 bp, Homo sapiens
actctgagcccagg

SEQ ID NO: 702117 - DNA, 18 bp, Homo sapiens
actctgagcccaggccgt

SEQ ID NO: 702118 - DNA, 18 bp, Homo sapiens
actctgagcgggaggcag

SEQ ID NO: 702119 - DNA, 23 bp, Homo sapiens
actctgaggctctttctgggcca

SEQ ID NO: 702120 - DNA, 18 bp, Homo sapiens
actctgagtcacaggtgt

SEQ ID NO: 702121 - DNA, 23 bp, Homo sapiens
actctgatggttcttcacctcct

SEQ ID NO: 702122 - DNA, 17 bp, Homo sapiens
actctgattcacctctt

SEQ ID NO: 702123 - DNA, 21 bp, Homo sapiens
actctgattcacctcttcctc

SEQ ID NO: 702124 - DNA, 23 bp, Homo sapiens
actctgattcacctcttcctctg

SEQ ID NO: 702125 - DNA, 19 bp, Homo sapiens
actctgcactactcctctg

SEQ ID NO: 702126 - DNA, 14 bp, Homo sapiens
actctgcactccat

SEQ ID NO: 702127 - DNA, 18 bp, Homo sapiens
actctgcactccatggcc

SEQ ID NO: 702128 - DNA, 22 bp, Homo sapiens
actctgcactccatggccaccc

SEQ ID NO: 702129 - DNA, 13 bp, Homo sapiens
actctgcagccct

SEQ ID NO: 702130 - DNA, 20 bp, Homo sapiens
actctgcatccagagattca

SEQ ID NO: 702131 - DNA, 11 bp, Homo sapiens
actctgccaat

SEQ ID NO: 702132 - DNA, 12 bp, Homo sapiens
actctgccagaa

SEQ ID NO: 702133 - DNA, 14 bp, Homo sapiens
actctgcccaccct

SEQ ID NO: 702134 - DNA, 19 bp, Homo sapiens
actctgcccagccggaggg

SEQ ID NO: 702135 - DNA, 24 bp, Homo sapiens
actctgccccacgctgtggccctg

SEQ ID NO: 702136 - DNA, 21 bp, Homo sapiens
actctgcccccatttccccga

SEQ ID NO: 702137 - DNA, 15 bp, Homo sapiens
cacacctcagaggct

SEQ ID NO: 702138 - DNA, 17 bp, Homo sapiens
cacacctcagtgggaag

SEQ ID NO: 702139 - DNA, 13 bp, Homo sapiens
cacacctcagttc

SEQ ID NO: 702140 - DNA, 17 bp, Homo sapiens
cacacctcagttccctt

SEQ ID NO: 702141 - DNA, 20 bp, Homo sapiens
cacacctcagttcccttggc

SEQ ID NO: 702142 - DNA, 11 bp, Homo sapiens
cacacctctgg

SEQ ID NO: 702143 - DNA, 12 bp, Homo sapiens
cacacctctggg

SEQ ID NO: 702144 - DNA, 17 bp, Homo sapiens
cacacctgaacttgcct

SEQ ID NO: 702145 - DNA, 13 bp, Homo sapiens
cacacctgagcgc

SEQ ID NO: 702146 - DNA, 15 bp, Homo sapiens
cacacctgccctaaa

SEQ ID NO: 702147 - DNA, 12 bp, Homo sapiens
cacacctggcct

SEQ ID NO: 702148 - DNA, 20 bp, Homo sapiens
cacacctggccttaaagagg

SEQ ID NO: 702149 - DNA, 22 bp, Homo sapiens
cacacctgggcccgggcaggcc

SEQ ID NO: 702150 - DNA, 16 bp, Homo sapiens
cacacctgtagcactt

SEQ ID NO: 702151 - DNA, 14 bp, Homo sapiens
cacaccttggcctt

SEQ ID NO: 702152 - DNA, 22 bp, Homo sapiens
cacaccttttattgacacagaa

SEQ ID NO: 702153 - DNA, 13 bp, Homo sapiens
cacacgatgcatt

SEQ ID NO: 702154 - DNA, 18 bp, Homo sapiens
cacacgatgcatttaata

SEQ ID NO: 702155 - DNA, 21 bp, Homo sapiens
cacacgatgcatttaataaag

SEQ ID NO: 702156 - DNA, 24 bp, Homo sapiens
cacacgatgcatttaataaagatg

SEQ ID NO: 702157 - DNA, 15 bp, Homo sapiens
cacacgcacacacac

SEQ ID NO: 702158 - DNA, 16 bp, Homo sapiens
cacacgcaggcggcca

SEQ ID NO: 702159 - DNA, 17 bp, Homo sapiens
cacacgcaggcggccag

SEQ ID NO: 702160 - DNA, 14 bp, Homo sapiens
cacacgcatgggca

SEQ ID NO: 702161 - DNA, 22 bp, Homo sapiens
cacacgcatgggcattgcagcc

SEQ ID NO: 702162 - DNA, 13 bp, Homo sapiens
cacacgccagctc

SEQ ID NO: 702163 - DNA, 14 bp, Homo sapiens
cacacgccagctcc

SEQ ID NO: 702164 - DNA, 20 bp, Homo sapiens
cacacgcctcccactggggt

SEQ ID NO: 702165 - DNA, 14 bp, Homo sapiens
cacacgctgcacct

SEQ ID NO: 702166 - DNA, 22 bp, Homo sapiens
cacacggacactcaaaagctgg

SEQ ID NO: 702167 - DNA, 20 bp, Homo sapiens
cacacggactcccgggccac

SEQ ID NO: 702168 - DNA, 23 bp, Homo sapiens
cacacggactcccgggccacgcc

SEQ ID NO: 702169 - DNA, 17 bp, Homo sapiens
cacacggagaggccact

SEQ ID NO: 702170 - DNA, 18 bp, Homo sapiens
cacacggaggcatctgca

SEQ ID NO: 702171 - DNA, 20 bp, Homo sapiens
cacacggcagcccccccctc

SEQ ID NO: 702172 - DNA, 22 bp, Homo sapiens
cacacggctggtcactctgccc

SEQ ID NO: 702173 - DNA, 17 bp, Homo sapiens
cacacgtaccttcatgt

SEQ ID NO: 702174 - DNA, 15 bp, Homo sapiens
cacacgtagactgat

SEQ ID NO: 702175 - DNA, 14 bp, Homo sapiens
cacacgtgtgtatg

SEQ ID NO: 702176 - DNA, 18 bp, Homo sapiens
cacacgttgacgggccgc

SEQ ID NO: 702177 - DNA, 16 bp, Homo sapiens
cacactaaactctggg

SEQ ID NO: 702178 - DNA, 19 bp, Homo sapiens
cacactaaccaagctgagt

SEQ ID NO: 702179 - DNA, 16 bp, Homo sapiens
cacactaccgaatgtg

SEQ ID NO: 702180 - DNA, 18 bp, Homo sapiens
cacactagcctctccagg

SEQ ID NO: 702181 - DNA, 19 bp, Homo sapiens
cacactagggactatcagg

SEQ ID NO: 702182 - DNA, 18 bp, Homo sapiens
cacactattaccatgaga

SEQ ID NO: 702183 - DNA, 17 bp, Homo sapiens
cacactcaaggacagga

SEQ ID NO: 702184 - DNA, 21 bp, Homo sapiens
cacactcaaggacaggagcct

SEQ ID NO: 702185 - DNA, 19 bp, Homo sapiens
cacactcacaatttaaaat

SEQ ID NO: 702186 - DNA, 18 bp, Homo sapiens
cacactcaccccagcctc

SEQ ID NO: 702187 - DNA, 19 bp, Homo sapiens
cacactcaccccagcctca

SEQ ID NO: 702188 - DNA, 20 bp, Homo sapiens
cacactcagtcccccaccac

SEQ ID NO: 702189 - DNA, 22 bp, Homo sapiens
cacactccaagatatggacaca

SEQ ID NO: 702190 - DNA, 13 bp, Homo sapiens
cacactccactct

SEQ ID NO: 702191 - DNA, 14 bp, Homo sapiens
cacactccactctg

SEQ ID NO: 702192 - DNA, 22 bp, Homo sapiens
cacactctccatcaccctcttc

SEQ ID NO: 702193 - DNA, 13 bp, Homo sapiens
cacactctctgca

SEQ ID NO: 702194 - DNA, 21 bp, Homo sapiens
cacactctctgcagcccagcc

SEQ ID NO: 702195 - DNA, 18 bp, Homo sapiens
cacactgaaaccaaaaca

SEQ ID NO: 702196 - DNA, 19 bp, Homo sapiens
cacactgaaaccaaaacat

SEQ ID NO: 702197 - DNA, 16 bp, Homo sapiens
cacactgatacataaa

SEQ ID NO: 702198 - DNA, 21 bp, Homo sapiens
cacactgatacataaaaatta

SEQ ID NO: 702199 - DNA, 18 bp, Homo sapiens
cacactgatgcttagatg

SEQ ID NO: 702200 - DNA, 16 bp, Homo sapiens
cacactgcaagagcct

SEQ ID NO: 702201 - DNA, 19 bp, Homo sapiens
cacactgctcttaagaaac

SEQ ID NO: 702202 - DNA, 14 bp, Homo sapiens
cacactgctgtcct

SEQ ID NO: 702203 - DNA, 17 bp, Homo sapiens
cacactgctgtcctctc

SEQ ID NO: 702204 - DNA, 22 bp, Homo sapiens
cacactgctgtcctctccccct

SEQ ID NO: 702205 - DNA, 17 bp, Homo sapiens
cacactggaccccactg

SEQ ID NO: 702206 - DNA, 19 bp, Homo sapiens
cacactggaccccactggc

SEQ ID NO: 702207 - DNA, 20 bp, Homo sapiens
cacactgggtgcgtctccag

SEQ ID NO: 702208 - DNA, 16 bp, Homo sapiens
cacactggtcacaggc

SEQ ID NO: 702209 - DNA, 15 bp, Homo sapiens
cacactggtgactgc

SEQ ID NO: 702210 - DNA, 18 bp, Homo sapiens
cacactggttctcaatga

SEQ ID NO: 702211 - DNA, 19 bp, Homo sapiens
cacactggttctcaatgaa

SEQ ID NO: 702212 - DNA, 22 bp, Homo sapiens
cacactgtcatgcttcatcatt

SEQ ID NO: 702213 - DNA, 14 bp, Homo sapiens
cacactgtcttccc

SEQ ID NO: 702214 - DNA, 19 bp, Homo sapiens
cacactgtgattttgccct

SEQ ID NO: 702215 - DNA, 17 bp, Homo sapiens
cacactgtgcagaccca

SEQ ID NO: 702216 - DNA, 20 bp, Homo sapiens
cacactgtgtcctggtgctc

SEQ ID NO: 702217 - DNA, 24 bp, Homo sapiens
cacactgtgtcctggtgctctctg

SEQ ID NO: 702218 - DNA, 23 bp, Homo sapiens
cacactgtgtgaggctgtgtctc

SEQ ID NO: 702219 - DNA, 18 bp, Homo sapiens
cacacttatattttatga

SEQ ID NO: 702220 - DNA, 19 bp, Homo sapiens
cacacttatattttatgaa

SEQ ID NO: 702221 - DNA, 21 bp, Homo sapiens
cacacttatattttatgaaca

SEQ ID NO: 702222 - DNA, 23 bp, Homo sapiens
cacacttatattttatgaacatt

SEQ ID NO: 702223 - DNA, 22 bp, Homo sapiens
cacacttcaggctcttctcctt

SEQ ID NO: 702224 - DNA, 14 bp, Homo sapiens
cacacttccccatc

SEQ ID NO: 702225 - DNA, 12 bp, Homo sapiens
cacacttccctg

SEQ ID NO: 702226 - DNA, 13 bp, Homo sapiens
cacacttccctgg

SEQ ID NO: 702227 - DNA, 14 bp, Homo sapiens
cacacttccctggc

SEQ ID NO: 702228 - DNA, 15 bp, Homo sapiens
cacacttctgtgaga

SEQ ID NO: 702229 - DNA, 21 bp, Homo sapiens
cacacttcttgaaacagcctg

SEQ ID NO: 702230 - DNA, 13 bp, Homo sapiens
cacacttgtgcca

SEQ ID NO: 702231 - DNA, 14 bp, Homo sapiens
cacacttgtgccag

SEQ ID NO: 702232 - DNA, 18 bp, Homo sapiens
cacacttgtgccagcccg

SEQ ID NO: 702233 - DNA, 14 bp, Homo sapiens
cacagaaaaagcat

SEQ ID NO: 702234 - DNA, 14 bp, Homo sapiens
cacagaaaaccgag

SEQ ID NO: 702235 - DNA, 14 bp, Homo sapiens
cacagaaaataagg

SEQ ID NO: 702236 - DNA, 12 bp, Homo sapiens
cacagaaaattt

SEQ ID NO: 702237 - DNA, 13 bp, Homo sapiens
cacagaaacacaa

SEQ ID NO: 702238 - DNA, 18 bp, Homo sapiens
cacagaaacacaatattt

SEQ ID NO: 702239 - DNA, 21 bp, Homo sapiens
cacagaaacacaatattttgt

SEQ ID NO: 702240 - DNA, 19 bp, Homo sapiens
cacagaaacctctactaaa

SEQ ID NO: 702241 - DNA, 18 bp, Homo sapiens
cacagaaagctagatatg

SEQ ID NO: 702242 - DNA, 21 bp, Homo sapiens
cacagaaagctccttccagac

SEQ ID NO: 702243 - DNA, 17 bp, Homo sapiens
cacagaaatcacagtca

SEQ ID NO: 702244 - DNA, 21 bp, Homo sapiens
cacagaaatcacagtcaatgg

SEQ ID NO: 702245 - DNA, 17 bp, Homo sapiens
cacagaaatcagaggag

SEQ ID NO: 702246 - DNA, 16 bp, Homo sapiens
cacagaaatgctgctg

SEQ ID NO: 702247 - DNA, 17 bp, Homo sapiens
cacagaaatgctgctgg

SEQ ID NO: 702248 - DNA, 22 bp, Homo sapiens
cacagaacctactgttcctttc

SEQ ID NO: 702249 - DNA, 21 bp, Homo sapiens
cacagaaccttcaacccagtg

SEQ ID NO: 702250 - DNA, 16 bp, Homo sapiens
cacagaagggctcttt

SEQ ID NO: 702251 - DNA, 20 bp, Homo sapiens
cacagacacaatatgtatgc

SEQ ID NO: 702252 - DNA, 14 bp, Homo sapiens
cacagacacacaca

SEQ ID NO: 702253 - DNA, 17 bp, Homo sapiens
cacagacacacacacgc

SEQ ID NO: 702254 - DNA, 18 bp, Homo sapiens
cacagacacacacacgca

SEQ ID NO: 702255 - DNA, 19 bp, Homo sapiens
cacagacagggtcaaagtg

SEQ ID NO: 702256 - DNA, 14 bp, Homo sapiens
cacagaccaggcct

SEQ ID NO: 702257 - DNA, 18 bp, Homo sapiens
cacagacctctgcttgga

SEQ ID NO: 702258 - DNA, 19 bp, Homo sapiens
cacagacgccttactggca

SEQ ID NO: 702259 - DNA, 21 bp, Homo sapiens
cacagacgggcacacagactg

SEQ ID NO: 702260 - DNA, 14 bp, Homo sapiens
cacagactattttt

SEQ ID NO: 702261 - DNA, 20 bp, Homo sapiens
actctgcccctggacctggg

SEQ ID NO: 702262 - DNA, 18 bp, Homo sapiens
actctgccctactcactc

SEQ ID NO: 702263 - DNA, 11 bp, Homo sapiens
actctgccctc

SEQ ID NO: 702264 - DNA, 13 bp, Homo sapiens
actctgccgctgt

SEQ ID NO: 702265 - DNA, 20 bp, Homo sapiens
actctgccgctgtgtaggga

SEQ ID NO: 702266 - DNA, 22 bp, Homo sapiens
actctgcctcctggtttccttt

SEQ ID NO: 702267 - DNA, 14 bp, Homo sapiens
actctgcctgcctg

SEQ ID NO: 702268 - DNA, 21 bp, Homo sapiens
actctgccttttttcacagcc

SEQ ID NO: 702269 - DNA, 18 bp, Homo sapiens
actctgcggcccgggccg

SEQ ID NO: 702270 - DNA, 21 bp, Homo sapiens
actctgcggcccgggccgacc

SEQ ID NO: 702271 - DNA, 18 bp, Homo sapiens
actctgctccaaagtaga

SEQ ID NO: 702272 - DNA, 23 bp, Homo sapiens
actctgctgctcatgggaagaac

SEQ ID NO: 702273 - DNA, 14 bp, Homo sapiens
actctgctgcttag

SEQ ID NO: 702274 - DNA, 22 bp, Homo sapiens
actctgctgtctaacctgtgac

SEQ ID NO: 702275 - DNA, 21 bp, Homo sapiens
actctgcttaaacaaagcagt

SEQ ID NO: 702276 - DNA, 14 bp, Homo sapiens
actctgcttctctg

SEQ ID NO: 702277 - DNA, 21 bp, Homo sapiens
actctgcttctctgacttctg

SEQ ID NO: 702278 - DNA, 22 bp, Homo sapiens
actctgcttctctgacttctgc

SEQ ID NO: 702279 - DNA, 13 bp, Homo sapiens
actctgcttgtta

SEQ ID NO: 702280 - DNA, 14 bp, Homo sapiens
actctggactttct

SEQ ID NO: 702281 - DNA, 22 bp, Homo sapiens
actctggactttctctaataat

SEQ ID NO: 702282 - DNA, 20 bp, Homo sapiens
actctggattcagccttctt

SEQ ID NO: 702283 - DNA, 18 bp, Homo sapiens
actctggattttgaatta

SEQ ID NO: 702284 - DNA, 15 bp, Homo sapiens
actctggcaaagctt

SEQ ID NO: 702285 - DNA, 23 bp, Homo sapiens
actctggcaaagcttttagaaat

SEQ ID NO: 702286 - DNA, 17 bp, Homo sapiens
actctggcaaatgatga

SEQ ID NO: 702287 - DNA, 12 bp, Homo sapiens
actctggcacag

SEQ ID NO: 702288 - DNA, 12 bp, Homo sapiens
actctggccctg

SEQ ID NO: 702289 - DNA, 20 bp, Homo sapiens
actctggctcagcctgtctc

SEQ ID NO: 702290 - DNA, 21 bp, Homo sapiens
actctggctcagcctgtctcg

SEQ ID NO: 702291 - DNA, 17 bp, Homo sapiens
actctggcttttggaag

SEQ ID NO: 702292 - DNA, 19 bp, Homo sapiens
actctgggctatggacaca

SEQ ID NO: 702293 - DNA, 14 bp, Homo sapiens
actctgggctccag

SEQ ID NO: 702294 - DNA, 17 bp, Homo sapiens
actctgggctgctaccc

SEQ ID NO: 702295 - DNA, 21 bp, Homo sapiens
actctggggcttgtcctgtgc

SEQ ID NO: 702296 - DNA, 18 bp, Homo sapiens
actctgggtccctcggag

SEQ ID NO: 702297 - DNA, 19 bp, Homo sapiens
actctgggttcgttgggga

SEQ ID NO: 702298 - DNA, 20 bp, Homo sapiens
actctgggttcgttggggac

SEQ ID NO: 702299 - DNA, 18 bp, Homo sapiens
actctggtcttctttggg

SEQ ID NO: 702300 - DNA, 11 bp, Homo sapiens
actctggtggc

SEQ ID NO: 702301 - DNA, 19 bp, Homo sapiens
actctggtggcacaggagt

SEQ ID NO: 702302 - DNA, 15 bp, Homo sapiens
actctggttctttgt

SEQ ID NO: 702303 - DNA, 18 bp, Homo sapiens
actctgtaatagttcagt

SEQ ID NO: 702304 - DNA, 14 bp, Homo sapiens
actctgtcagatgg

SEQ ID NO: 702305 - DNA, 15 bp, Homo sapiens
actctgtcagccagc

SEQ ID NO: 702306 - DNA, 16 bp, Homo sapiens
actctgtcagccagcc

SEQ ID NO: 702307 - DNA, 11 bp, Homo sapiens
actctgtccag

SEQ ID NO: 702308 - DNA, 16 bp, Homo sapiens
actctgtccaggccac

SEQ ID NO: 702309 - DNA, 23 bp, Homo sapiens
actctgtccaggccactgtggcc

SEQ ID NO: 702310 - DNA, 17 bp, Homo sapiens
actctgtccctgtcctt

SEQ ID NO: 702311 - DNA, 21 bp, Homo sapiens
actctgtccctgtccttccct

SEQ ID NO: 702312 - DNA, 18 bp, Homo sapiens
actctgtcgctcaggctg

SEQ ID NO: 702313 - DNA, 22 bp, Homo sapiens
actctgtcgctcaggctggagt

SEQ ID NO: 702314 - DNA, 18 bp, Homo sapiens
actctgtctcccaggctg

SEQ ID NO: 702315 - DNA, 19 bp, Homo sapiens
actctgtctcccaggctgc

SEQ ID NO: 702316 - DNA, 13 bp, Homo sapiens
actctgtgtttaa

SEQ ID NO: 702317 - DNA, 15 bp, Homo sapiens
actctgttcccccac

SEQ ID NO: 702318 - DNA, 20 bp, Homo sapiens
actctgttccttcacatcct

SEQ ID NO: 702319 - DNA, 22 bp, Homo sapiens
actctgttccttcacatcctgt

SEQ ID NO: 702320 - DNA, 17 bp, Homo sapiens
actctgttgatctaccc

SEQ ID NO: 702321 - DNA, 17 bp, Homo sapiens
actctgttgtaagtaat

SEQ ID NO: 702322 - DNA, 21 bp, Homo sapiens
actcttaaaaatgttttttca

SEQ ID NO: 702323 - DNA, 18 bp, Homo sapiens
actcttaaaacccaagtg

SEQ ID NO: 702324 - DNA, 15 bp, Homo sapiens
actcttaaatacttt

SEQ ID NO: 702325 - DNA, 16 bp, Homo sapiens
actcttaaatcatttg

SEQ ID NO: 702326 - DNA, 17 bp, Homo sapiens
actcttaaatcatttgg

SEQ ID NO: 702327 - DNA, 17 bp, Homo sapiens
actcttaaatgatctgc

SEQ ID NO: 702328 - DNA, 13 bp, Homo sapiens
actcttaatttta

SEQ ID NO: 702329 - DNA, 15 bp, Homo sapiens
actcttacagagcct

SEQ ID NO: 702330 - DNA, 18 bp, Homo sapiens
actcttacagagccttga

SEQ ID NO: 702331 - DNA, 22 bp, Homo sapiens
actcttaccatatgtttggtaa

SEQ ID NO: 702332 - DNA, 14 bp, Homo sapiens
actcttagaaatga

SEQ ID NO: 702333 - DNA, 15 bp, Homo sapiens
actcttcaaatggga

SEQ ID NO: 702334 - DNA, 21 bp, Homo sapiens
actcttcacttgagttggctg

SEQ ID NO: 702335 - DNA, 22 bp, Homo sapiens
actcttcacttgagttggctgt

SEQ ID NO: 702336 - DNA, 23 bp, Homo sapiens
actcttcacttgagttggctgtg

SEQ ID NO: 702337 - DNA, 13 bp, Homo sapiens
actcttcagaaca

SEQ ID NO: 702338 - DNA, 10 bp, Homo sapiens
actcttcagt

SEQ ID NO: 702339 - DNA, 20 bp, Homo sapiens
actcttcagtgcaaattgta

SEQ ID NO: 702340 - DNA, 17 bp, Homo sapiens
actcttccagaatccca

SEQ ID NO: 702341 - DNA, 23 bp, Homo sapiens
actcttcccctccctcccacact

SEQ ID NO: 702342 - DNA, 19 bp, Homo sapiens
actcttcctctaacatttt

SEQ ID NO: 702343 - DNA, 12 bp, Homo sapiens
actcttcctttc

SEQ ID NO: 702344 - DNA, 13 bp, Homo sapiens
actcttcctttct

SEQ ID NO: 702345 - DNA, 13 bp, Homo sapiens
actcttctctcct

SEQ ID NO: 702346 - DNA, 21 bp, Homo sapiens
actcttctctcctttctccct

SEQ ID NO: 702347 - DNA, 21 bp, Homo sapiens
actcttctttaagccatagac

SEQ ID NO: 702348 - DNA, 14 bp, Homo sapiens
actcttgatgtgaa

SEQ ID NO: 702349 - DNA, 16 bp, Homo sapiens
actcttgatgtgaaga

SEQ ID NO: 702350 - DNA, 14 bp, Homo sapiens
actcttgctctttc

SEQ ID NO: 702351 - DNA, 16 bp, Homo sapiens
actcttgctgatggct

SEQ ID NO: 702352 - DNA, 15 bp, Homo sapiens
actcttggagcctct

SEQ ID NO: 702353 - DNA, 23 bp, Homo sapiens
actcttggagcctctttttcctt

SEQ ID NO: 702354 - DNA, 18 bp, Homo sapiens
actctttaacacattctt

SEQ ID NO: 702355 - DNA, 19 bp, Homo sapiens
actctttaacacattcttt

SEQ ID NO: 702356 - DNA, 18 bp, Homo sapiens
actctttatgatctggcc

SEQ ID NO: 702357 - DNA, 22 bp, Homo sapiens
actctttatttctagcagagtg

SEQ ID NO: 702358 - DNA, 22 bp, Homo sapiens
actctttatttttctctttctc

SEQ ID NO: 702359 - DNA, 15 bp, Homo sapiens
actctttcaaagaaa

SEQ ID NO: 702360 - DNA, 21 bp, Homo sapiens
actctttcaataaatgtatca

SEQ ID NO: 702361 - DNA, 22 bp, Homo sapiens
actctttcaataaatgtatcat

SEQ ID NO: 702362 - DNA, 16 bp, Homo sapiens
actctttcctaaagcc

SEQ ID NO: 702363 - DNA, 18 bp, Homo sapiens
actctttcctaaagccaa

SEQ ID NO: 702364 - DNA, 22 bp, Homo sapiens
actctttctgaaggaagagaag

SEQ ID NO: 702365 - DNA, 14 bp, Homo sapiens
actctttctgtata

SEQ ID NO: 702366 - DNA, 18 bp, Homo sapiens
actctttgagaaacaaca

SEQ ID NO: 702367 - DNA, 12 bp, Homo sapiens
actctttgagag

SEQ ID NO: 702368 - DNA, 14 bp, Homo sapiens
actctttgagcctt

SEQ ID NO: 702369 - DNA, 15 bp, Homo sapiens
actctttgctgctgc

SEQ ID NO: 702370 - DNA, 24 bp, Homo sapiens
actctttgggtccattcagatgaa

SEQ ID NO: 702371 - DNA, 15 bp, Homo sapiens
actcttttgctgtgc

SEQ ID NO: 702372 - DNA, 19 bp, Homo sapiens
actctttttagggccaggc

SEQ ID NO: 702373 - DNA, 17 bp, Homo sapiens
actctttttcaataaat

SEQ ID NO: 702374 - DNA, 14 bp, Homo sapiens
actctttttctaaa

SEQ ID NO: 702375 - DNA, 18 bp, Homo sapiens
actctttttctaaagtgt

SEQ ID NO: 702376 - DNA, 20 bp, Homo sapiens
actctttttctaaagtgttg

SEQ ID NO: 702377 - DNA, 18 bp, Homo sapiens
actctttttgttttttgt

SEQ ID NO: 702378 - DNA, 15 bp, Homo sapiens
actgaaaaaatacta

SEQ ID NO: 702379 - DNA, 14 bp, Homo sapiens
actgaaaaaatata

SEQ ID NO: 702380 - DNA, 15 bp, Homo sapiens
actgaaaaaatatat

SEQ ID NO: 702381 - DNA, 16 bp, Homo sapiens
actgaaaaattatact

SEQ ID NO: 702382 - DNA, 18 bp, Homo sapiens
actgaaaacatctggaag

SEQ ID NO: 702383 - DNA, 15 bp, Homo sapiens
actgaaaacctctcc

SEQ ID NO: 702384 - DNA, 17 bp, Homo sapiens
actgaaaacctctcctc

SEQ ID NO: 702385 - DNA, 18 bp, Homo sapiens
cacagactcaaatgctca

SEQ ID NO: 702386 - DNA, 13 bp, Homo sapiens
cacagactgcccc

SEQ ID NO: 702387 - DNA, 13 bp, Homo sapiens
cacagactggcaa

SEQ ID NO: 702388 - DNA, 15 bp, Homo sapiens
cacagactggcaata

SEQ ID NO: 702389 - DNA, 16 bp, Homo sapiens
cacagacttctggaag

SEQ ID NO: 702390 - DNA, 16 bp, Homo sapiens
cacagactttctgtga

SEQ ID NO: 702391 - DNA, 20 bp, Homo sapiens
cacagagaagctggggagga

SEQ ID NO: 702392 - DNA, 11 bp, Homo sapiens
cacagagaagg

SEQ ID NO: 702393 - DNA, 21 bp, Homo sapiens
cacagagaagtttgtagccag

SEQ ID NO: 702394 - DNA, 13 bp, Homo sapiens
cacagagaggagg

SEQ ID NO: 702395 - DNA, 12 bp, Homo sapiens
cacagagaggga

SEQ ID NO: 702396 - DNA, 22 bp, Homo sapiens
cacagagagggacacatgcccc

SEQ ID NO: 702397 - DNA, 18 bp, Homo sapiens
cacagagagggagagcag

SEQ ID NO: 702398 - DNA, 18 bp, Homo sapiens
cacagagattctggatct

SEQ ID NO: 702399 - DNA, 16 bp, Homo sapiens
cacagagcaaaagagg

SEQ ID NO: 702400 - DNA, 20 bp, Homo sapiens
cacagagcacacttatttat

SEQ ID NO: 702401 - DNA, 17 bp, Homo sapiens
cacagagcacgcctgcc

SEQ ID NO: 702402 - DNA, 18 bp, Homo sapiens
cacagagcacgcctgcca

SEQ ID NO: 702403 - DNA, 20 bp, Homo sapiens
cacagagcacgcctgccatc

SEQ ID NO: 702404 - DNA, 23 bp, Homo sapiens
cacagagccctgaggggctgggc

SEQ ID NO: 702405 - DNA, 15 bp, Homo sapiens
cacagagcctggccc

SEQ ID NO: 702406 - DNA, 15 bp, Homo sapiens
cacagaggacacaga

SEQ ID NO: 702407 - DNA, 19 bp, Homo sapiens
cacagaggacacagagaag

SEQ ID NO: 702408 - DNA, 17 bp, Homo sapiens
cacagaggagtgcagcc

SEQ ID NO: 702409 - DNA, 15 bp, Homo sapiens
cacagaggctggcac

SEQ ID NO: 702410 - DNA, 16 bp, Homo sapiens
cacagagggcgtgtgc

SEQ ID NO: 702411 - DNA, 16 bp, Homo sapiens
cacagagttgttacat

SEQ ID NO: 702412 - DNA, 17 bp, Homo sapiens
cacagatacctcatcat

SEQ ID NO: 702413 - DNA, 21 bp, Homo sapiens
cacagatacctcatcatccac

SEQ ID NO: 702414 - DNA, 18 bp, Homo sapiens
cacagatagacctttttt

SEQ ID NO: 702415 - DNA, 23 bp, Homo sapiens
cacagatatatacacacagtgga

SEQ ID NO: 702416 - DNA, 21 bp, Homo sapiens
cacagatattgttataaataa

SEQ ID NO: 702417 - DNA, 19 bp, Homo sapiens
cacagatcccactggaaga

SEQ ID NO: 702418 - DNA, 17 bp, Homo sapiens
cacagatgacaaattat

SEQ ID NO: 702419 - DNA, 16 bp, Homo sapiens
cacagatgaggagcag

SEQ ID NO: 702420 - DNA, 22 bp, Homo sapiens
cacagatgaggagcagctgggg

SEQ ID NO: 702421 - DNA, 15 bp, Homo sapiens
cacagatgctccagg

SEQ ID NO: 702422 - DNA, 19 bp, Homo sapiens
cacagatgtctctggggca

SEQ ID NO: 702423 - DNA, 15 bp, Homo sapiens
cacagatgtgtctgg

SEQ ID NO: 702424 - DNA, 23 bp, Homo sapiens
cacagatgtgtctgggagagcct

SEQ ID NO: 702425 - DNA, 16 bp, Homo sapiens
cacagattgaagaatc

SEQ ID NO: 702426 - DNA, 14 bp, Homo sapiens
cacagattttgaat

SEQ ID NO: 702427 - DNA, 16 bp, Homo sapiens
cacagattttgaatct

SEQ ID NO: 702428 - DNA, 14 bp, Homo sapiens
cacagatttttaca

SEQ ID NO: 702429 - DNA, 16 bp, Homo sapiens
cacagatttttacact

SEQ ID NO: 702430 - DNA, 17 bp, Homo sapiens
cacagatttttacacta

SEQ ID NO: 702431 - DNA, 21 bp, Homo sapiens
cacagatttttatgttttctt

SEQ ID NO: 702432 - DNA, 15 bp, Homo sapiens
cacagcaactgacct

SEQ ID NO: 702433 - DNA, 22 bp, Homo sapiens
cacagcaaggaaatgtcctgca

SEQ ID NO: 702434 - DNA, 23 bp, Homo sapiens
cacagcaaggaaatgtcctgcat

SEQ ID NO: 702435 - DNA, 15 bp, Homo sapiens
cacagcaagtacagc

SEQ ID NO: 702436 - DNA, 19 bp, Homo sapiens
cacagcaagtacagcggct

SEQ ID NO: 702437 - DNA, 18 bp, Homo sapiens
cacagcaattcctcaggc

SEQ ID NO: 702438 - DNA, 14 bp, Homo sapiens
cacagcacaaatta

SEQ ID NO: 702439 - DNA, 18 bp, Homo sapiens
cacagcacaaccggtccc

SEQ ID NO: 702440 - DNA, 16 bp, Homo sapiens
cacagcacaccagccg

SEQ ID NO: 702441 - DNA, 21 bp, Homo sapiens
cacagcacaccagccgctgca

SEQ ID NO: 702442 - DNA, 12 bp, Homo sapiens
cacagcacagcc

SEQ ID NO: 702443 - DNA, 16 bp, Homo sapiens
cacagcaccgtgccaa

SEQ ID NO: 702444 - DNA, 12 bp, Homo sapiens
cacagcagcctg

SEQ ID NO: 702445 - DNA, 14 bp, Homo sapiens
cacagcagcctggg

SEQ ID NO: 702446 - DNA, 16 bp, Homo sapiens
cacagcagctgaacag

SEQ ID NO: 702447 - DNA, 18 bp, Homo sapiens
cacagcagcttcaccaga

SEQ ID NO: 702448 - DNA, 12 bp, Homo sapiens
cacagcaggacc

SEQ ID NO: 702449 - DNA, 12 bp, Homo sapiens
cacagcaggatc

SEQ ID NO: 702450 - DNA, 16 bp, Homo sapiens
cacagcagtgagactg

SEQ ID NO: 702451 - DNA, 22 bp, Homo sapiens
cacagcagtgtgaatagcctgg

SEQ ID NO: 702452 - DNA, 20 bp, Homo sapiens
cacagcatcattttgcattc

SEQ ID NO: 702453 - DNA, 15 bp, Homo sapiens
cacagcatcgggagc

SEQ ID NO: 702454 - DNA, 23 bp, Homo sapiens
cacagcatcgtgatcactgagcc

SEQ ID NO: 702455 - DNA, 21 bp, Homo sapiens
cacagcatgaggcaaaaatgt

SEQ ID NO: 702456 - DNA, 16 bp, Homo sapiens
cacagcatggaggagg

SEQ ID NO: 702457 - DNA, 16 bp, Homo sapiens
cacagcatgtgccaag

SEQ ID NO: 702458 - DNA, 16 bp, Homo sapiens
cacagccaaatttaaa

SEQ ID NO: 702459 - DNA, 22 bp, Homo sapiens
cacagccaacacgcacctgcct

SEQ ID NO: 702460 - DNA, 16 bp, Homo sapiens
cacagccaacgagaca

SEQ ID NO: 702461 - DNA, 18 bp, Homo sapiens
cacagccaacgagacaca

SEQ ID NO: 702462 - DNA, 16 bp, Homo sapiens
cacagccacacctgga

SEQ ID NO: 702463 - DNA, 15 bp, Homo sapiens
cacagccacccgtgg

SEQ ID NO: 702464 - DNA, 21 bp, Homo sapiens
cacagccacctccgccagacc

SEQ ID NO: 702465 - DNA, 23 bp, Homo sapiens
cacagccacctccgccagacccc

SEQ ID NO: 702466 - DNA, 12 bp, Homo sapiens
cacagccagagg

SEQ ID NO: 702467 - DNA, 16 bp, Homo sapiens
cacagccagcacctgg

SEQ ID NO: 702468 - DNA, 12 bp, Homo sapiens
cacagccagccc

SEQ ID NO: 702469 - DNA, 22 bp, Homo sapiens
cacagccagggggatgccactc

SEQ ID NO: 702470 - DNA, 23 bp, Homo sapiens
cacagcccaagaggactgagact

SEQ ID NO: 702471 - DNA, 15 bp, Homo sapiens
cacagcccagaacca

SEQ ID NO: 702472 - DNA, 17 bp, Homo sapiens
cacagcccagaaccaca

SEQ ID NO: 702473 - DNA, 14 bp, Homo sapiens
cacagcccagggcc

SEQ ID NO: 702474 - DNA, 17 bp, Homo sapiens
cacagcccagggcctgc

SEQ ID NO: 702475 - DNA, 14 bp, Homo sapiens
cacagcccccttgc

SEQ ID NO: 702476 - DNA, 19 bp, Homo sapiens
cacagcccccttgccctcc

SEQ ID NO: 702477 - DNA, 12 bp, Homo sapiens
cacagccccgat

SEQ ID NO: 702478 - DNA, 22 bp, Homo sapiens
cacagcccctatagcactgagc

SEQ ID NO: 702479 - DNA, 17 bp, Homo sapiens
cacagcccgggtgtgcc

SEQ ID NO: 702480 - DNA, 15 bp, Homo sapiens
cacagccctgggagg

SEQ ID NO: 702481 - DNA, 16 bp, Homo sapiens
cacagccctgggaggg

SEQ ID NO: 702482 - DNA, 17 bp, Homo sapiens
cacagccctgggagggg

SEQ ID NO: 702483 - DNA, 11 bp, Homo sapiens
cacagccctgt

SEQ ID NO: 702484 - DNA, 21 bp, Homo sapiens
cacagccctgtcagtgcagcc

SEQ ID NO: 702485 - DNA, 14 bp, Homo sapiens
cacagccgcagcct

SEQ ID NO: 702486 - DNA, 20 bp, Homo sapiens
cacagcctcccctgccaggg

SEQ ID NO: 702487 - DNA, 13 bp, Homo sapiens
cacagcctccctg

SEQ ID NO: 702488 - DNA, 16 bp, Homo sapiens
cacagcctccctgagc

SEQ ID NO: 702489 - DNA, 17 bp, Homo sapiens
cacagcctccctgagcc

SEQ ID NO: 702490 - DNA, 21 bp, Homo sapiens
cacagcctccctgagcctgca

SEQ ID NO: 702491 - DNA, 12 bp, Homo sapiens
cacagcctcggg

SEQ ID NO: 702492 - DNA, 12 bp, Homo sapiens
cacagcctgctg

SEQ ID NO: 702493 - DNA, 13 bp, Homo sapiens
cacagcctgctgg

SEQ ID NO: 702494 - DNA, 12 bp, Homo sapiens
cacagccttcct

SEQ ID NO: 702495 - DNA, 19 bp, Homo sapiens
cacagccttccttctgctc

SEQ ID NO: 702496 - DNA, 23 bp, Homo sapiens
cacagcctttcgttctgctgacc

SEQ ID NO: 702497 - DNA, 13 bp, Homo sapiens
cacagcgagcctg

SEQ ID NO: 702498 - DNA, 16 bp, Homo sapiens
cacagcgagcctgtgc

SEQ ID NO: 702499 - DNA, 15 bp, Homo sapiens
cacagcgagggcagc

SEQ ID NO: 702500 - DNA, 19 bp, Homo sapiens
cacagcgagggcagctgct

SEQ ID NO: 702501 - DNA, 14 bp, Homo sapiens
cacagcgccagcct

SEQ ID NO: 702502 - DNA, 21 bp, Homo sapiens
cacagcggaggtgtggagccg

SEQ ID NO: 702503 - DNA, 14 bp, Homo sapiens
cacagcggcccctg

SEQ ID NO: 702504 - DNA, 14 bp, Homo sapiens
cacagcgtccctgg

SEQ ID NO: 702505 - DNA, 19 bp, Homo sapiens
cacagcgtccctggcgcag

SEQ ID NO: 702506 - DNA, 13 bp, Homo sapiens
cacagcgtgctgg

SEQ ID NO: 702507 - DNA, 17 bp, Homo sapiens
cacagcgtgctggcgac

SEQ ID NO: 702508 - DNA, 15 bp, Homo sapiens
cacagctacctgaga

SEQ ID NO: 702509 - DNA, 12 bp, Homo sapiens
cacagctccagg

SEQ ID NO: 702510 - DNA, 17 bp, Homo sapiens
cacagctcccaccccac

SEQ ID NO: 702511 - DNA, 14 bp, Homo sapiens
actgaaaagaagga

SEQ ID NO: 702512 - DNA, 19 bp, Homo sapiens
actgaaaagaaggaaagat

SEQ ID NO: 702513 - DNA, 18 bp, Homo sapiens
actgaaaatattgtttta

SEQ ID NO: 702514 - DNA, 15 bp, Homo sapiens
actgaaaatgtgcta

SEQ ID NO: 702515 - DNA, 19 bp, Homo sapiens
actgaaaatgtgctatact

SEQ ID NO: 702516 - DNA, 12 bp, Homo sapiens
actgaaaccaaa

SEQ ID NO: 702517 - DNA, 17 bp, Homo sapiens
actgaaacttttctaaa

SEQ ID NO: 702518 - DNA, 16 bp, Homo sapiens
actgaaagatctctgt

SEQ ID NO: 702519 - DNA, 14 bp, Homo sapiens
actgaaagcagcag

SEQ ID NO: 702520 - DNA, 16 bp, Homo sapiens
actgaaagttttgtaa

SEQ ID NO: 702521 - DNA, 18 bp, Homo sapiens
actgaaagttttgtaaaa

SEQ ID NO: 702522 - DNA, 20 bp, Homo sapiens
actgaaataaacctgcactg

SEQ ID NO: 702523 - DNA, 17 bp, Homo sapiens
actgaaatctgtcaaga

SEQ ID NO: 702524 - DNA, 22 bp, Homo sapiens
actgaaattgttttaccagctc

SEQ ID NO: 702525 - DNA, 23 bp, Homo sapiens
actgaaattgttttaccagctcc

SEQ ID NO: 702526 - DNA, 23 bp, Homo sapiens
actgaaatttgttatacttcaaa

SEQ ID NO: 702527 - DNA, 20 bp, Homo sapiens
actgaacaccattgaaggct

SEQ ID NO: 702528 - DNA, 22 bp, Homo sapiens
actgaacaccattgaaggctta

SEQ ID NO: 702529 - DNA, 10 bp, Homo sapiens
actgaacagg

SEQ ID NO: 702530 - DNA, 20 bp, Homo sapiens
actgaacatctgagtcctgg

SEQ ID NO: 702531 - DNA, 13 bp, Homo sapiens
actgaacatgcct

SEQ ID NO: 702532 - DNA, 13 bp, Homo sapiens
actgaacattcca

SEQ ID NO: 702533 - DNA, 14 bp, Homo sapiens
actgaaccagccac

SEQ ID NO: 702534 - DNA, 21 bp, Homo sapiens
actgaactgtgtgtaattgtt

SEQ ID NO: 702535 - DNA, 14 bp, Homo sapiens
actgaactgtttgg

SEQ ID NO: 702536 - DNA, 23 bp, Homo sapiens
actgaactgtttggtcgagtctt

SEQ ID NO: 702537 - DNA, 23 bp, Homo sapiens
actgaagactagccccttttctg

SEQ ID NO: 702538 - DNA, 18 bp, Homo sapiens
actgaagccttcttctgc

SEQ ID NO: 702539 - DNA, 20 bp, Homo sapiens
actgaagcttcaaaaagcca

SEQ ID NO: 702540 - DNA, 23 bp, Homo sapiens
actgaaggaaaagcaagaaacag

SEQ ID NO: 702541 - DNA, 13 bp, Homo sapiens
actgaaggggcac

SEQ ID NO: 702542 - DNA, 15 bp, Homo sapiens
actgaaggggtgcac

SEQ ID NO: 702543 - DNA, 16 bp, Homo sapiens
actgaaggtgattcac

SEQ ID NO: 702544 - DNA, 22 bp, Homo sapiens
actgaagtccaaattgtttgta

SEQ ID NO: 702545 - DNA, 20 bp, Homo sapiens
actgaagtgcttgcagatca

SEQ ID NO: 702546 - DNA, 16 bp, Homo sapiens
actgaagtggccctcc

SEQ ID NO: 702547 - DNA, 19 bp, Homo sapiens
actgaagtggccctccctc

SEQ ID NO: 702548 - DNA, 20 bp, Homo sapiens
actgaataaactcaaaactc

SEQ ID NO: 702549 - DNA, 21 bp, Homo sapiens
actgaataaactcaaaactct

SEQ ID NO: 702550 - DNA, 18 bp, Homo sapiens
actgaataatatcaaata

SEQ ID NO: 702551 - DNA, 22 bp, Homo sapiens
actgaataatatcaaataaaat

SEQ ID NO: 702552 - DNA, 16 bp, Homo sapiens
actgaataatgctacc

SEQ ID NO: 702553 - DNA, 19 bp, Homo sapiens
actgaataatgctaccagg

SEQ ID NO: 702554 - DNA, 20 bp, Homo sapiens
actgaataccactctgtaat

SEQ ID NO: 702555 - DNA, 15 bp, Homo sapiens
actgaatatttatat

SEQ ID NO: 702556 - DNA, 19 bp, Homo sapiens
actgaatattttggaaact

SEQ ID NO: 702557 - DNA, 21 bp, Homo sapiens
actgaatgcctcaatgtgacc

SEQ ID NO: 702558 - DNA, 16 bp, Homo sapiens
actgaatgctctgtgc

SEQ ID NO: 702559 - DNA, 13 bp, Homo sapiens
actgaatgtttta

SEQ ID NO: 702560 - DNA, 12 bp, Homo sapiens
actgaatttctt

SEQ ID NO: 702561 - DNA, 13 bp, Homo sapiens
actgaatttggag

SEQ ID NO: 702562 - DNA, 17 bp, Homo sapiens
actgacaaagtcatccc

SEQ ID NO: 702563 - DNA, 18 bp, Homo sapiens
actgacaagccatcttga

SEQ ID NO: 702564 - DNA, 23 bp, Homo sapiens
actgacacaaaaagtagattaag

SEQ ID NO: 702565 - DNA, 14 bp, Homo sapiens
actgacacagtaaa

SEQ ID NO: 702566 - DNA, 21 bp, Homo sapiens
actgacacttcctgtccttgt

SEQ ID NO: 702567 - DNA, 13 bp, Homo sapiens
actgacagcatgt

SEQ ID NO: 702568 - DNA, 15 bp, Homo sapiens
actgacagccttgcc

SEQ ID NO: 702569 - DNA, 18 bp, Homo sapiens
actgacagccttgcccac

SEQ ID NO: 702570 - DNA, 16 bp, Homo sapiens
actgacagcctttgat

SEQ ID NO: 702571 - DNA, 20 bp, Homo sapiens
actgacagggagcagccccc

SEQ ID NO: 702572 - DNA, 17 bp, Homo sapiens
actgacatgccctccct

SEQ ID NO: 702573 - DNA, 18 bp, Homo sapiens
actgacatgtggggccag

SEQ ID NO: 702574 - DNA, 21 bp, Homo sapiens
actgaccaatattgtacagtt

SEQ ID NO: 702575 - DNA, 13 bp, Homo sapiens
actgaccagcctc

SEQ ID NO: 702576 - DNA, 17 bp, Homo sapiens
actgaccccctcccctg

SEQ ID NO: 702577 - DNA, 14 bp, Homo sapiens
actgacctacctca

SEQ ID NO: 702578 - DNA, 20 bp, Homo sapiens
actgacctgctccgccagga

SEQ ID NO: 702579 - DNA, 16 bp, Homo sapiens
actgacgctggagatg

SEQ ID NO: 702580 - DNA, 15 bp, Homo sapiens
actgacgtcctccct

SEQ ID NO: 702581 - DNA, 15 bp, Homo sapiens
actgactctgttatt

SEQ ID NO: 702582 - DNA, 18 bp, Homo sapiens
actgacttcatttgtgcc

SEQ ID NO: 702583 - DNA, 14 bp, Homo sapiens
actgactttatcct

SEQ ID NO: 702584 - DNA, 18 bp, Homo sapiens
actgactttctgattact

SEQ ID NO: 702585 - DNA, 23 bp, Homo sapiens
actgactttgcttgctttgaagt

SEQ ID NO: 702586 - DNA, 19 bp, Homo sapiens
actgagaacattaaaaaag

SEQ ID NO: 702587 - DNA, 23 bp, Homo sapiens
actgagaaggctcacgaagggca

SEQ ID NO: 702588 - DNA, 22 bp, Homo sapiens
actgagacagccacttggtttt

SEQ ID NO: 702589 - DNA, 16 bp, Homo sapiens
actgagacttgttctt

SEQ ID NO: 702590 - DNA, 14 bp, Homo sapiens
actgagagaaagat

SEQ ID NO: 702591 - DNA, 14 bp, Homo sapiens
actgagagctgcct

SEQ ID NO: 702592 - DNA, 18 bp, Homo sapiens
actgagagctgcctcctg

SEQ ID NO: 702593 - DNA, 21 bp, Homo sapiens
actgagagggcaaggaagtgg

SEQ ID NO: 702594 - DNA, 19 bp, Homo sapiens
actgagataccagcgagga

SEQ ID NO: 702595 - DNA, 17 bp, Homo sapiens
actgagatgcaaatgtc

SEQ ID NO: 702596 - DNA, 11 bp, Homo sapiens
actgagatgct

SEQ ID NO: 702597 - DNA, 18 bp, Homo sapiens
actgagatgttttaccat

SEQ ID NO: 702598 - DNA, 14 bp, Homo sapiens
actgagcaccctct

SEQ ID NO: 702599 - DNA, 18 bp, Homo sapiens
actgagcagccgccagct

SEQ ID NO: 702600 - DNA, 20 bp, Homo sapiens
actgagccaaggaggcctgg

SEQ ID NO: 702601 - DNA, 21 bp, Homo sapiens
actgagccagcttagcaactg

SEQ ID NO: 702602 - DNA, 14 bp, Homo sapiens
actgagccatcatt

SEQ ID NO: 702603 - DNA, 16 bp, Homo sapiens
actgagccatcatttc

SEQ ID NO: 702604 - DNA, 13 bp, Homo sapiens
actgagccccacc

SEQ ID NO: 702605 - DNA, 20 bp, Homo sapiens
actgagccctctcactccag

SEQ ID NO: 702606 - DNA, 22 bp, Homo sapiens
actgagccctctcactccagcc

SEQ ID NO: 702607 - DNA, 17 bp, Homo sapiens
actgagctcacatggga

SEQ ID NO: 702608 - DNA, 22 bp, Homo sapiens
actgagctcacatgggactggg

SEQ ID NO: 702609 - DNA, 20 bp, Homo sapiens
actgagctccccagatctcc

SEQ ID NO: 702610 - DNA, 16 bp, Homo sapiens
actgagctcgcagccc

SEQ ID NO: 702611 - DNA, 19 bp, Homo sapiens
actgagctctccaggccag

SEQ ID NO: 702612 - DNA, 15 bp, Homo sapiens
actgagctgggggaa

SEQ ID NO: 702613 - DNA, 16 bp, Homo sapiens
actgagcttagagtat

SEQ ID NO: 702614 - DNA, 18 bp, Homo sapiens
actgagcttctctgtgaa

SEQ ID NO: 702615 - DNA, 17 bp, Homo sapiens
actgaggaatttcacct

SEQ ID NO: 702616 - DNA, 15 bp, Homo sapiens
actgaggcagacagc

SEQ ID NO: 702617 - DNA, 22 bp, Homo sapiens
actgaggcagacagcagctcag

SEQ ID NO: 702618 - DNA, 21 bp, Homo sapiens
actgaggccatcagggccctg

SEQ ID NO: 702619 - DNA, 15 bp, Homo sapiens
actgaggccctgtga

SEQ ID NO: 702620 - DNA, 15 bp, Homo sapiens
actgaggccttgtgt

SEQ ID NO: 702621 - DNA, 22 bp, Homo sapiens
actgaggccttgtgtgtcaggc

SEQ ID NO: 702622 - DNA, 13 bp, Homo sapiens
actgaggcttaga

SEQ ID NO: 702623 - DNA, 21 bp, Homo sapiens
actgagggaccaactgggccc

SEQ ID NO: 702624 - DNA, 23 bp, Homo sapiens
actgagggattttagcctcttcc

SEQ ID NO: 702625 - DNA, 14 bp, Homo sapiens
actgagggcagtgc

SEQ ID NO: 702626 - DNA, 15 bp, Homo sapiens
actgagggcagtgcc

SEQ ID NO: 702627 - DNA, 12 bp, Homo sapiens
actgagggccac

SEQ ID NO: 702628 - DNA, 17 bp, Homo sapiens
actgagggctctgtttg

SEQ ID NO: 702629 - DNA, 19 bp, Homo sapiens
actgaggtataaagacaag

SEQ ID NO: 702630 - DNA, 18 bp, Homo sapiens
actgaggtgcctgctcag

SEQ ID NO: 702631 - DNA, 21 bp, Homo sapiens
actgaggtgcctgctcaggtg

SEQ ID NO: 702632 - DNA, 22 bp, Homo sapiens
actgaggtgcctgctcaggtgc

SEQ ID NO: 702633 - DNA, 20 bp, Homo sapiens
actgagtcatcttgtgagtg

SEQ ID NO: 702634 - DNA, 22 bp, Homo sapiens
actgagtcatcttgtgagtgga

SEQ ID NO: 702635 - DNA, 13 bp, Homo sapiens
cacagctcctgcc

SEQ ID NO: 702636 - DNA, 14 bp, Homo sapiens
cacagctcctgcca

SEQ ID NO: 702637 - DNA, 20 bp, Homo sapiens
cacagctctccggtctctct

SEQ ID NO: 702638 - DNA, 16 bp, Homo sapiens
cacagctctgggcctc

SEQ ID NO: 702639 - DNA, 18 bp, Homo sapiens
cacagctctgggcctctt

SEQ ID NO: 702640 - DNA, 17 bp, Homo sapiens
cacagctcttccagggc

SEQ ID NO: 702641 - DNA, 19 bp, Homo sapiens
cacagctgagagactttta

SEQ ID NO: 702642 - DNA, 16 bp, Homo sapiens
cacagctgagcactta

SEQ ID NO: 702643 - DNA, 14 bp, Homo sapiens
cacagctgcagctg

SEQ ID NO: 702644 - DNA, 13 bp, Homo sapiens
cacagctgccctg

SEQ ID NO: 702645 - DNA, 18 bp, Homo sapiens
cacagctgccctgctgcc

SEQ ID NO: 702646 - DNA, 20 bp, Homo sapiens
cacagctgccctgctgccac

SEQ ID NO: 702647 - DNA, 22 bp, Homo sapiens
cacagctgctcaataaagtaca

SEQ ID NO: 702648 - DNA, 16 bp, Homo sapiens
cacagctgctggagaa

SEQ ID NO: 702649 - DNA, 16 bp, Homo sapiens
cacagctgctgttctc

SEQ ID NO: 702650 - DNA, 24 bp, Homo sapiens
cacagctgctgttctcaggacagc

SEQ ID NO: 702651 - DNA, 14 bp, Homo sapiens
cacagctgctttct

SEQ ID NO: 702652 - DNA, 13 bp, Homo sapiens
cacagctggctct

SEQ ID NO: 702653 - DNA, 13 bp, Homo sapiens
cacagctgggagc

SEQ ID NO: 702654 - DNA, 17 bp, Homo sapiens
cacagctgggagcctgg

SEQ ID NO: 702655 - DNA, 13 bp, Homo sapiens
cacagctgggcag

SEQ ID NO: 702656 - DNA, 14 bp, Homo sapiens
cacagctgggcagg

SEQ ID NO: 702657 - DNA, 13 bp, Homo sapiens
cacagctgtctgc

SEQ ID NO: 702658 - DNA, 17 bp, Homo sapiens
cacagcttagatttcat

SEQ ID NO: 702659 - DNA, 16 bp, Homo sapiens
cacagcttcttctgcc

SEQ ID NO: 702660 - DNA, 18 bp, Homo sapiens
cacagcttcttctgcccc

SEQ ID NO: 702661 - DNA, 23 bp, Homo sapiens
cacagcttgggtcaggttcttgc

SEQ ID NO: 702662 - DNA, 12 bp, Homo sapiens
cacagcttttgc

SEQ ID NO: 702663 - DNA, 13 bp, Homo sapiens
cacaggaaaaata

SEQ ID NO: 702664 - DNA, 22 bp, Homo sapiens
cacaggaaaaataaacgtggat

SEQ ID NO: 702665 - DNA, 23 bp, Homo sapiens
cacaggaaaatgtatccagagga

SEQ ID NO: 702666 - DNA, 15 bp, Homo sapiens
cacaggaaccctaaa

SEQ ID NO: 702667 - DNA, 22 bp, Homo sapiens
cacaggaagcctgcagtcctgg

SEQ ID NO: 702668 - DNA, 19 bp, Homo sapiens
cacaggacacgaaggctgc

SEQ ID NO: 702669 - DNA, 22 bp, Homo sapiens
cacaggacatgcggtagccagc

SEQ ID NO: 702670 - DNA, 17 bp, Homo sapiens
cacaggacatttctcta

SEQ ID NO: 702671 - DNA, 16 bp, Homo sapiens
cacaggactctgcctc

SEQ ID NO: 702672 - DNA, 14 bp, Homo sapiens
cacaggactgagcc

SEQ ID NO: 702673 - DNA, 20 bp, Homo sapiens
cacaggactgagccctctca

SEQ ID NO: 702674 - DNA, 22 bp, Homo sapiens
cacaggactttgatgaagacca

SEQ ID NO: 702675 - DNA, 22 bp, Homo sapiens
cacaggagcaatcacaggaaaa

SEQ ID NO: 702676 - DNA, 14 bp, Homo sapiens
cacaggagggccag

SEQ ID NO: 702677 - DNA, 15 bp, Homo sapiens
cacaggagggccagc

SEQ ID NO: 702678 - DNA, 19 bp, Homo sapiens
cacaggagtcttcagaccc

SEQ ID NO: 702679 - DNA, 20 bp, Homo sapiens
cacaggagtcttcagaccca

SEQ ID NO: 702680 - DNA, 22 bp, Homo sapiens
cacaggagtcttcagacccaga

SEQ ID NO: 702681 - DNA, 19 bp, Homo sapiens
cacaggataggactccatt

SEQ ID NO: 702682 - DNA, 16 bp, Homo sapiens
cacaggatgctgtgtt

SEQ ID NO: 702683 - DNA, 20 bp, Homo sapiens
cacaggcaaaatccttgctt

SEQ ID NO: 702684 - DNA, 13 bp, Homo sapiens
cacaggcaactga

SEQ ID NO: 702685 - DNA, 17 bp, Homo sapiens
cacaggcaactgaggca

SEQ ID NO: 702686 - DNA, 23 bp, Homo sapiens
cacaggcaactgaggcagacagc

SEQ ID NO: 702687 - DNA, 18 bp, Homo sapiens
cacaggcacacagggccc

SEQ ID NO: 702688 - DNA, 12 bp, Homo sapiens
cacaggcactga

SEQ ID NO: 702689 - DNA, 21 bp, Homo sapiens
cacaggcactgaacaggctgg

SEQ ID NO: 702690 - DNA, 22 bp, Homo sapiens
cacaggcaggtcacagaaaggc

SEQ ID NO: 702691 - DNA, 21 bp, Homo sapiens
cacaggcccccttgagtgggg

SEQ ID NO: 702692 - DNA, 20 bp, Homo sapiens
cacaggcccgccctctgcct

SEQ ID NO: 702693 - DNA, 16 bp, Homo sapiens
cacaggcccttcctct

SEQ ID NO: 702694 - DNA, 19 bp, Homo sapiens
cacaggcccttcctctcca

SEQ ID NO: 702695 - DNA, 21 bp, Homo sapiens
cacaggcccttcctctccact

SEQ ID NO: 702696 - DNA, 21 bp, Homo sapiens
cacagggacttgaagttgtta

SEQ ID NO: 702697 - DNA, 14 bp, Homo sapiens
cacagggatgctgg

SEQ ID NO: 702698 - DNA, 23 bp, Homo sapiens
cacagggcaaaatcgccataggc

SEQ ID NO: 702699 - DNA, 17 bp, Homo sapiens
cacagggcaaggacaca

SEQ ID NO: 702700 - DNA, 17 bp, Homo sapiens
cacagggcactgactga

SEQ ID NO: 702701 - DNA, 14 bp, Homo sapiens
cacagggccccaga

SEQ ID NO: 702702 - DNA, 22 bp, Homo sapiens
cacagggccccagaaggcaggg

SEQ ID NO: 702703 - DNA, 23 bp, Homo sapiens
cacagggcggtaccttgtgccca

SEQ ID NO: 702704 - DNA, 14 bp, Homo sapiens
cacagggctcacag

SEQ ID NO: 702705 - DNA, 16 bp, Homo sapiens
cacagggctctttgat

SEQ ID NO: 702706 - DNA, 22 bp, Homo sapiens
cacaggggaaggaaataacatt

SEQ ID NO: 702707 - DNA, 13 bp, Homo sapiens
cacaggggcaggc

SEQ ID NO: 702708 - DNA, 18 bp, Homo sapiens
cacaggggcaggcctggg

SEQ ID NO: 702709 - DNA, 19 bp, Homo sapiens
cacaggggcaggcctggga

SEQ ID NO: 702710 - DNA, 16 bp, Homo sapiens
cacaggggccaccacc

SEQ ID NO: 702711 - DNA, 13 bp, Homo sapiens
cacaggggcccca

SEQ ID NO: 702712 - DNA, 23 bp, Homo sapiens
cacaggggccccagatctgcctg

SEQ ID NO: 702713 - DNA, 13 bp, Homo sapiens
cacaggggccctg

SEQ ID NO: 702714 - DNA, 16 bp, Homo sapiens
cacaggggcggggcag

SEQ ID NO: 702715 - DNA, 17 bp, Homo sapiens
cacagggtctgctcttt

SEQ ID NO: 702716 - DNA, 23 bp, Homo sapiens
cacagggtctgctctttctctgc

SEQ ID NO: 702717 - DNA, 14 bp, Homo sapiens
cacagggttgggcc

SEQ ID NO: 702718 - DNA, 22 bp, Homo sapiens
cacagggttgggcccagatctg

SEQ ID NO: 702719 - DNA, 18 bp, Homo sapiens
cacaggtcagggctcaga

SEQ ID NO: 702720 - DNA, 15 bp, Homo sapiens
cacaggtcccacctc

SEQ ID NO: 702721 - DNA, 14 bp, Homo sapiens
cacaggtctttcct

SEQ ID NO: 702722 - DNA, 15 bp, Homo sapiens
cacaggtgtctgcct

SEQ ID NO: 702723 - DNA, 19 bp, Homo sapiens
cacaggtgtgggatggaga

SEQ ID NO: 702724 - DNA, 14 bp, Homo sapiens
cacaggtgttgatt

SEQ ID NO: 702725 - DNA, 15 bp, Homo sapiens
cacagtaaaaataaa

SEQ ID NO: 702726 - DNA, 17 bp, Homo sapiens
cacagtaaaaataaaat

SEQ ID NO: 702727 - DNA, 19 bp, Homo sapiens
cacagtaatgcaagcaaag

SEQ ID NO: 702728 - DNA, 18 bp, Homo sapiens
cacagtacagcatgtgcc

SEQ ID NO: 702729 - DNA, 19 bp, Homo sapiens
cacagtacagcatgtgcct

SEQ ID NO: 702730 - DNA, 17 bp, Homo sapiens
cacagtaccggattctc

SEQ ID NO: 702731 - DNA, 22 bp, Homo sapiens
cacagtactcactttttccaaa

SEQ ID NO: 702732 - DNA, 13 bp, Homo sapiens
cacagtactttat

SEQ ID NO: 702733 - DNA, 15 bp, Homo sapiens
cacagtagagccagc

SEQ ID NO: 702734 - DNA, 17 bp, Homo sapiens
cacagtagagccagctt

SEQ ID NO: 702735 - DNA, 16 bp, Homo sapiens
cacagtatattttatt

SEQ ID NO: 702736 - DNA, 19 bp, Homo sapiens
cacagtatattttatttca

SEQ ID NO: 702737 - DNA, 14 bp, Homo sapiens
cacagtatttgtaa

SEQ ID NO: 702738 - DNA, 15 bp, Homo sapiens
cacagtatttgtaat

SEQ ID NO: 702739 - DNA, 19 bp, Homo sapiens
cacagtcactgatgtacaa

SEQ ID NO: 702740 - DNA, 15 bp, Homo sapiens
cacagtcactgctct

SEQ ID NO: 702741 - DNA, 19 bp, Homo sapiens
cacagtcacttgggagctg

SEQ ID NO: 702742 - DNA, 20 bp, Homo sapiens
cacagtcacttgggagctgc

SEQ ID NO: 702743 - DNA, 19 bp, Homo sapiens
cacagtcaggggctgggca

SEQ ID NO: 702744 - DNA, 13 bp, Homo sapiens
cacagtcagtgac

SEQ ID NO: 702745 - DNA, 18 bp, Homo sapiens
cacagtccaaccagaaac

SEQ ID NO: 702746 - DNA, 14 bp, Homo sapiens
cacagtccagaccc

SEQ ID NO: 702747 - DNA, 15 bp, Homo sapiens
cacagtccagaccca

SEQ ID NO: 702748 - DNA, 18 bp, Homo sapiens
cacagtccagacccaagt

SEQ ID NO: 702749 - DNA, 19 bp, Homo sapiens
cacagtccagacccaagtc

SEQ ID NO: 702750 - DNA, 22 bp, Homo sapiens
cacagtccaggaacaagctaat

SEQ ID NO: 702751 - DNA, 21 bp, Homo sapiens
cacagtcccccacccacctcc

SEQ ID NO: 702752 - DNA, 23 bp, Homo sapiens
cacagtcccccacccacctcctg

SEQ ID NO: 702753 - DNA, 19 bp, Homo sapiens
cacagtctcagttctcttg

SEQ ID NO: 702754 - DNA, 16 bp, Homo sapiens
cacagtgagaggggag

SEQ ID NO: 702755 - DNA, 22 bp, Homo sapiens
cacagtgatatatttctatgtg

SEQ ID NO: 702756 - DNA, 14 bp, Homo sapiens
cacagtgatgccgg

SEQ ID NO: 702757 - DNA, 23 bp, Homo sapiens
cacagtgatgccgggcgccagga

SEQ ID NO: 702758 - DNA, 11 bp, Homo sapiens
cacagtgattt

SEQ ID NO: 702759 - DNA, 15 bp, Homo sapiens
actgagtccatgaaa

SEQ ID NO: 702760 - DNA, 12 bp, Homo sapiens
actgagtgactc

SEQ ID NO: 702761 - DNA, 13 bp, Homo sapiens
actgagtgggaag

SEQ ID NO: 702762 - DNA, 21 bp, Homo sapiens
actgagtgttcaaactactgt

SEQ ID NO: 702763 - DNA, 18 bp, Homo sapiens
actgagttatcaggtgca

SEQ ID NO: 702764 - DNA, 13 bp, Homo sapiens
actgataaagatg

SEQ ID NO: 702765 - DNA, 21 bp, Homo sapiens
actgataaagatgagtgagca

SEQ ID NO: 702766 - DNA, 22 bp, Homo sapiens
actgatagcttacactgaggac

SEQ ID NO: 702767 - DNA, 16 bp, Homo sapiens
actgatagtgtccaaa

SEQ ID NO: 702768 - DNA, 17 bp, Homo sapiens
actgatagtgtccaaat

SEQ ID NO: 702769 - DNA, 15 bp, Homo sapiens
actgatcacccaatg

SEQ ID NO: 702770 - DNA, 16 bp, Homo sapiens
actgatcatgcattgt

SEQ ID NO: 702771 - DNA, 17 bp, Homo sapiens
actgatcatgcattgtt

SEQ ID NO: 702772 - DNA, 18 bp, Homo sapiens
actgatccaaaaattata

SEQ ID NO: 702773 - DNA, 20 bp, Homo sapiens
actgatctttgtatattaca

SEQ ID NO: 702774 - DNA, 20 bp, Homo sapiens
actgatgagcacatctctct

SEQ ID NO: 702775 - DNA, 21 bp, Homo sapiens
actgatgagtttcactgtact

SEQ ID NO: 702776 - DNA, 22 bp, Homo sapiens
actgatgagtttcactgtactg

SEQ ID NO: 702777 - DNA, 16 bp, Homo sapiens
actgatggaaaatacc

SEQ ID NO: 702778 - DNA, 14 bp, Homo sapiens
actgatggaacaga

SEQ ID NO: 702779 - DNA, 20 bp, Homo sapiens
actgatggaccgggtgggcc

SEQ ID NO: 702780 - DNA, 22 bp, Homo sapiens
actgatggctaatgtactgcat

SEQ ID NO: 702781 - DNA, 20 bp, Homo sapiens
actgatggctcaagacaagg

SEQ ID NO: 702782 - DNA, 12 bp, Homo sapiens
actgatgggctg

SEQ ID NO: 702783 - DNA, 21 bp, Homo sapiens
actgatgttacatcacagtgt

SEQ ID NO: 702784 - DNA, 22 bp, Homo sapiens
actgatgttacatcacagtgtt

SEQ ID NO: 702785 - DNA, 13 bp, Homo sapiens
actgatgttgtgt

SEQ ID NO: 702786 - DNA, 18 bp, Homo sapiens
actgatgttgtgttttta

SEQ ID NO: 702787 - DNA, 19 bp, Homo sapiens
actgattaaatatttgaag

SEQ ID NO: 702788 - DNA, 17 bp, Homo sapiens
actgattagtattcagg

SEQ ID NO: 702789 - DNA, 18 bp, Homo sapiens
actgattattacttctgt

SEQ ID NO: 702790 - DNA, 15 bp, Homo sapiens
actgattattttctt

SEQ ID NO: 702791 - DNA, 20 bp, Homo sapiens
actgatttcacaacagatca

SEQ ID NO: 702792 - DNA, 15 bp, Homo sapiens
actgatttcagagtg

SEQ ID NO: 702793 - DNA, 16 bp, Homo sapiens
actgatttggagatat

SEQ ID NO: 702794 - DNA, 17 bp, Homo sapiens
actgattttaaaatgaa

SEQ ID NO: 702795 - DNA, 13 bp, Homo sapiens
actgcaaactttt

SEQ ID NO: 702796 - DNA, 18 bp, Homo sapiens
actgcaaacttttttata

SEQ ID NO: 702797 - DNA, 15 bp, Homo sapiens
actgcaaaggcgcag

SEQ ID NO: 702798 - DNA, 17 bp, Homo sapiens
actgcaaataaagcctt

SEQ ID NO: 702799 - DNA, 15 bp, Homo sapiens
actgcaaatggcagt

SEQ ID NO: 702800 - DNA, 12 bp, Homo sapiens
actgcaacactg

SEQ ID NO: 702801 - DNA, 19 bp, Homo sapiens
actgcaacctccgccttcc

SEQ ID NO: 702802 - DNA, 17 bp, Homo sapiens
actgcaaccttgtttat

SEQ ID NO: 702803 - DNA, 14 bp, Homo sapiens
actgcaacttctgc

SEQ ID NO: 702804 - DNA, 16 bp, Homo sapiens
actgcaacttctgcct

SEQ ID NO: 702805 - DNA, 17 bp, Homo sapiens
actgcaagagccttggt

SEQ ID NO: 702806 - DNA, 18 bp, Homo sapiens
actgcaagagccttggtg

SEQ ID NO: 702807 - DNA, 17 bp, Homo sapiens
actgcaagcatttttcc

SEQ ID NO: 702808 - DNA, 17 bp, Homo sapiens
actgcaatagagactgt

SEQ ID NO: 702809 - DNA, 18 bp, Homo sapiens
actgcacacacagctcct

SEQ ID NO: 702810 - DNA, 20 bp, Homo sapiens
actgcacagcggcccctgca

SEQ ID NO: 702811 - DNA, 22 bp, Homo sapiens
actgcacagcggcccctgcatc

SEQ ID NO: 702812 - DNA, 18 bp, Homo sapiens
actgcacagcgtcctgtc

SEQ ID NO: 702813 - DNA, 16 bp, Homo sapiens
actgcacaggtgacaa

SEQ ID NO: 702814 - DNA, 23 bp, Homo sapiens
actgcacagtgcatctcagccca

SEQ ID NO: 702815 - DNA, 14 bp, Homo sapiens
actgcacagtgctg

SEQ ID NO: 702816 - DNA, 15 bp, Homo sapiens
actgcacagtgctgt

SEQ ID NO: 702817 - DNA, 20 bp, Homo sapiens
actgcacagtgctgttggtg

SEQ ID NO: 702818 - DNA, 17 bp, Homo sapiens
actgcacccagctccag

SEQ ID NO: 702819 - DNA, 18 bp, Homo sapiens
actgcacctgggcagctc

SEQ ID NO: 702820 - DNA, 16 bp, Homo sapiens
actgcactccagcctg

SEQ ID NO: 702821 - DNA, 17 bp, Homo sapiens
actgcactccagcctgg

SEQ ID NO: 702822 - DNA, 18 bp, Homo sapiens
actgcactccagcctggg

SEQ ID NO: 702823 - DNA, 19 bp, Homo sapiens
actgcactccagcctgggc

SEQ ID NO: 702824 - DNA, 21 bp, Homo sapiens
actgcactccagcctgggcga

SEQ ID NO: 702825 - DNA, 20 bp, Homo sapiens
actgcactccagcctggggg

SEQ ID NO: 702826 - DNA, 17 bp, Homo sapiens
actgcactccagcttgg

SEQ ID NO: 702827 - DNA, 12 bp, Homo sapiens
actgcactgagt

SEQ ID NO: 702828 - DNA, 14 bp, Homo sapiens
actgcactttcccc

SEQ ID NO: 702829 - DNA, 16 bp, Homo sapiens
actgcactttccccct

SEQ ID NO: 702830 - DNA, 15 bp, Homo sapiens
actgcactttgttta

SEQ ID NO: 702831 - DNA, 18 bp, Homo sapiens
actgcactttgtttagaa

SEQ ID NO: 702832 - DNA, 19 bp, Homo sapiens
actgcactttgtttagaaa

SEQ ID NO: 702833 - DNA, 19 bp, Homo sapiens
actgcactttttttacttc

SEQ ID NO: 702834 - DNA, 21 bp, Homo sapiens
actgcagaatacagtaagctg

SEQ ID NO: 702835 - DNA, 20 bp, Homo sapiens
actgcagattgagacctaca

SEQ ID NO: 702836 - DNA, 23 bp, Homo sapiens
actgcagattgagacctacaggc

SEQ ID NO: 702837 - DNA, 12 bp, Homo sapiens
actgcagcacct

SEQ ID NO: 702838 - DNA, 22 bp, Homo sapiens
actgcagcacctccaggcctgt

SEQ ID NO: 702839 - DNA, 13 bp, Homo sapiens
actgcagcctcat

SEQ ID NO: 702840 - DNA, 17 bp, Homo sapiens
actgcagcctctctggc

SEQ ID NO: 702841 - DNA, 18 bp, Homo sapiens
actgcagcctctctggct

SEQ ID NO: 702842 - DNA, 19 bp, Homo sapiens
actgcagcctctctggctg

SEQ ID NO: 702843 - DNA, 13 bp, Homo sapiens
actgcagctgctg

SEQ ID NO: 702844 - DNA, 12 bp, Homo sapiens
actgcagctgtg

SEQ ID NO: 702845 - DNA, 13 bp, Homo sapiens
actgcagctgtga

SEQ ID NO: 702846 - DNA, 15 bp, Homo sapiens
actgcagctttacat

SEQ ID NO: 702847 - DNA, 12 bp, Homo sapiens
actgcaggcccc

SEQ ID NO: 702848 - DNA, 15 bp, Homo sapiens
actgcaggccccgct

SEQ ID NO: 702849 - DNA, 18 bp, Homo sapiens
actgcaggccctggcctc

SEQ ID NO: 702850 - DNA, 23 bp, Homo sapiens
actgcagggaaaattatttgcat

SEQ ID NO: 702851 - DNA, 16 bp, Homo sapiens
actgcagggactgcca

SEQ ID NO: 702852 - DNA, 12 bp, Homo sapiens
actgcagggcct

SEQ ID NO: 702853 - DNA, 22 bp, Homo sapiens
actgcagggcctatatgccagc

SEQ ID NO: 702854 - DNA, 23 bp, Homo sapiens
actgcaggtgggctgggcccacc

SEQ ID NO: 702855 - DNA, 13 bp, Homo sapiens
actgcagtcagat

SEQ ID NO: 702856 - DNA, 21 bp, Homo sapiens
actgcagtcggcatgccagga

SEQ ID NO: 702857 - DNA, 13 bp, Homo sapiens
actgcagtttcct

SEQ ID NO: 702858 - DNA, 15 bp, Homo sapiens
actgcagtttcctgg

SEQ ID NO: 702859 - DNA, 13 bp, Homo sapiens
actgcatactttt

SEQ ID NO: 702860 - DNA, 18 bp, Homo sapiens
actgcatactttttaaat

SEQ ID NO: 702861 - DNA, 15 bp, Homo sapiens
actgcatccagcctg

SEQ ID NO: 702862 - DNA, 14 bp, Homo sapiens
actgcatctggatt

SEQ ID NO: 702863 - DNA, 21 bp, Homo sapiens
actgcatcttggttatttctg

SEQ ID NO: 702864 - DNA, 14 bp, Homo sapiens
actgcatggaccta

SEQ ID NO: 702865 - DNA, 20 bp, Homo sapiens
actgcatggacctaacattc

SEQ ID NO: 702866 - DNA, 21 bp, Homo sapiens
actgcatggacctaacattcg

SEQ ID NO: 702867 - DNA, 20 bp, Homo sapiens
actgcattaccgcgttgtaa

SEQ ID NO: 702868 - DNA, 17 bp, Homo sapiens
actgcattcctgtgccc

SEQ ID NO: 702869 - DNA, 20 bp, Homo sapiens
actgcattcgtatctgagca

SEQ ID NO: 702870 - DNA, 17 bp, Homo sapiens
actgcattctctcccat

SEQ ID NO: 702871 - DNA, 20 bp, Homo sapiens
actgcattctctcccatcct

SEQ ID NO: 702872 - DNA, 15 bp, Homo sapiens
actgcattgagaact

SEQ ID NO: 702873 - DNA, 10 bp, Homo sapiens
actgcatttt

SEQ ID NO: 702874 - DNA, 20 bp, Homo sapiens
actgccaaataaatcatcct

SEQ ID NO: 702875 - DNA, 23 bp, Homo sapiens
actgccaccttgtggccgcctga

SEQ ID NO: 702876 - DNA, 16 bp, Homo sapiens
actgccagatgctgca

SEQ ID NO: 702877 - DNA, 17 bp, Homo sapiens
actgccaggaccccagg

SEQ ID NO: 702878 - DNA, 21 bp, Homo sapiens
actgccaggaccccaggtcag

SEQ ID NO: 702879 - DNA, 15 bp, Homo sapiens
actgccaggcacctg

SEQ ID NO: 702880 - DNA, 16 bp, Homo sapiens
actgccaggcacctgg

SEQ ID NO: 702881 - DNA, 17 bp, Homo sapiens
actgccaggcacctggc

SEQ ID NO: 702882 - DNA, 20 bp, Homo sapiens
actgccaggcacctggcctg

SEQ ID NO: 702883 - DNA, 23 bp, Homo sapiens
actgccaggccagcctccgagag

SEQ ID NO: 702884 - DNA, 16 bp, Homo sapiens
cacagtgcagcttgca

SEQ ID NO: 702885 - DNA, 14 bp, Homo sapiens
cacagtgcatctca

SEQ ID NO: 702886 - DNA, 17 bp, Homo sapiens
cacagtgcatctcagcc

SEQ ID NO: 702887 - DNA, 18 bp, Homo sapiens
cacagtgcatctcagccc

SEQ ID NO: 702888 - DNA, 16 bp, Homo sapiens
cacagtgctgcccctt

SEQ ID NO: 702889 - DNA, 13 bp, Homo sapiens
cacagtgctgctt

SEQ ID NO: 702890 - DNA, 13 bp, Homo sapiens
cacagtgctgttg

SEQ ID NO: 702891 - DNA, 19 bp, Homo sapiens
cacagtggacggaggtccc

SEQ ID NO: 702892 - DNA, 20 bp, Homo sapiens
cacagtggacggaggtcccc

SEQ ID NO: 702893 - DNA, 20 bp, Homo sapiens
cacagtggactcagcagtga

SEQ ID NO: 702894 - DNA, 21 bp, Homo sapiens
cacagtggactcagcagtgac

SEQ ID NO: 702895 - DNA, 22 bp, Homo sapiens
cacagtggatggacggacaaga

SEQ ID NO: 702896 - DNA, 13 bp, Homo sapiens
cacagtggcttct

SEQ ID NO: 702897 - DNA, 20 bp, Homo sapiens
cacagtggggctgcaggcag

SEQ ID NO: 702898 - DNA, 18 bp, Homo sapiens
cacagtggtgaccccctt

SEQ ID NO: 702899 - DNA, 21 bp, Homo sapiens
cacagtgtaatccaggggtgt

SEQ ID NO: 702900 - DNA, 18 bp, Homo sapiens
cacagtgtcactggtcag

SEQ ID NO: 702901 - DNA, 12 bp, Homo sapiens
cacagtgtctgt

SEQ ID NO: 702902 - DNA, 12 bp, Homo sapiens
cacagtgtgtga

SEQ ID NO: 702903 - DNA, 15 bp, Homo sapiens
cacagtgtgtgaact

SEQ ID NO: 702904 - DNA, 21 bp, Homo sapiens
cacagtgtgtgacttacagaa

SEQ ID NO: 702905 - DNA, 13 bp, Homo sapiens
cacagtgtttata

SEQ ID NO: 702906 - DNA, 14 bp, Homo sapiens
cacagtgtttcaat

SEQ ID NO: 702907 - DNA, 20 bp, Homo sapiens
cacagtgtttcaattctgta

SEQ ID NO: 702908 - DNA, 21 bp, Homo sapiens
cacagtgtttttattgctcgc

SEQ ID NO: 702909 - DNA, 21 bp, Homo sapiens
cacagttagttgtgaaagaaa

SEQ ID NO: 702910 - DNA, 22 bp, Homo sapiens
cacagttcctcgccctgggtct

SEQ ID NO: 702911 - DNA, 22 bp, Homo sapiens
cacagttcttggtgactgtccc

SEQ ID NO: 702912 - DNA, 14 bp, Homo sapiens
cacagttgccacca

SEQ ID NO: 702913 - DNA, 20 bp, Homo sapiens
cacagttgccaccacctctg

SEQ ID NO: 702914 - DNA, 12 bp, Homo sapiens
cacagttggcct

SEQ ID NO: 702915 - DNA, 17 bp, Homo sapiens
cacagttggctggatga

SEQ ID NO: 702916 - DNA, 22 bp, Homo sapiens
cacagttggctggatgaaattt

SEQ ID NO: 702917 - DNA, 22 bp, Homo sapiens
cacagttgggacccaaaacaca

SEQ ID NO: 702918 - DNA, 24 bp, Homo sapiens
cacagttgtctattctgagccttg

SEQ ID NO: 702919 - DNA, 13 bp, Homo sapiens
cacagtttagaac

SEQ ID NO: 702920 - DNA, 16 bp, Homo sapiens
cacagtttagaacaga

SEQ ID NO: 702921 - DNA, 22 bp, Homo sapiens
cacagttttaataagaacagat

SEQ ID NO: 702922 - DNA, 20 bp, Homo sapiens
cacataaaaaagaagcactt

SEQ ID NO: 702923 - DNA, 14 bp, Homo sapiens
cacataactggatt

SEQ ID NO: 702924 - DNA, 19 bp, Homo sapiens
cacataagcccagttcatc

SEQ ID NO: 702925 - DNA, 19 bp, Homo sapiens
cacataagctcagaatcca

SEQ ID NO: 702926 - DNA, 18 bp, Homo sapiens
cacataattccagtcaca

SEQ ID NO: 702927 - DNA, 16 bp, Homo sapiens
cacataatttttgtac

SEQ ID NO: 702928 - DNA, 13 bp, Homo sapiens
cacatacaacaca

SEQ ID NO: 702929 - DNA, 22 bp, Homo sapiens
cacatacaacacaaagagaaaa

SEQ ID NO: 702930 - DNA, 20 bp, Homo sapiens
cacatacacccaaacactta

SEQ ID NO: 702931 - DNA, 21 bp, Homo sapiens
cacatacagagctctctgagg

SEQ ID NO: 702932 - DNA, 13 bp, Homo sapiens
cacatacatacac

SEQ ID NO: 702933 - DNA, 13 bp, Homo sapiens
cacatacatacat

SEQ ID NO: 702934 - DNA, 14 bp, Homo sapiens
cacatacatacata

SEQ ID NO: 702935 - DNA, 17 bp, Homo sapiens
cacatacatacatacat

SEQ ID NO: 702936 - DNA, 17 bp, Homo sapiens
cacatacatagatcttc

SEQ ID NO: 702937 - DNA, 17 bp, Homo sapiens
cacatactgtgttccaa

SEQ ID NO: 702938 - DNA, 13 bp, Homo sapiens
cacatagagcttt

SEQ ID NO: 702939 - DNA, 19 bp, Homo sapiens
cacatagagctttttaata

SEQ ID NO: 702940 - DNA, 23 bp, Homo sapiens
cacatagagctttttaatagcac

SEQ ID NO: 702941 - DNA, 14 bp, Homo sapiens
cacatagattcacc

SEQ ID NO: 702942 - DNA, 17 bp, Homo sapiens
cacatagattcacctgt

SEQ ID NO: 702943 - DNA, 17 bp, Homo sapiens
cacatagcatgcttcct

SEQ ID NO: 702944 - DNA, 21 bp, Homo sapiens
cacataggaagggatctgaga

SEQ ID NO: 702945 - DNA, 20 bp, Homo sapiens
cacataggctggtggccttg

SEQ ID NO: 702946 - DNA, 16 bp, Homo sapiens
cacatagtcctcaggg

SEQ ID NO: 702947 - DNA, 16 bp, Homo sapiens
cacatagtgtcctgcc

SEQ ID NO: 702948 - DNA, 14 bp, Homo sapiens
cacatataacactt

SEQ ID NO: 702949 - DNA, 13 bp, Homo sapiens
cacatatacacga

SEQ ID NO: 702950 - DNA, 15 bp, Homo sapiens
cacatatacatatat

SEQ ID NO: 702951 - DNA, 16 bp, Homo sapiens
cacatatacatatata

SEQ ID NO: 702952 - DNA, 18 bp, Homo sapiens
cacatatgaacacagaca

SEQ ID NO: 702953 - DNA, 14 bp, Homo sapiens
cacatattttaaaa

SEQ ID NO: 702954 - DNA, 20 bp, Homo sapiens
cacatcacaagactatgcca

SEQ ID NO: 702955 - DNA, 16 bp, Homo sapiens
cacatcaccaggtgca

SEQ ID NO: 702956 - DNA, 22 bp, Homo sapiens
cacatcacctctttgcccccga

SEQ ID NO: 702957 - DNA, 13 bp, Homo sapiens
cacatcagcaatt

SEQ ID NO: 702958 - DNA, 18 bp, Homo sapiens
cacatcagcacgatttct

SEQ ID NO: 702959 - DNA, 19 bp, Homo sapiens
cacatcagcacgatttctg

SEQ ID NO: 702960 - DNA, 17 bp, Homo sapiens
cacatcagccccacagg

SEQ ID NO: 702961 - DNA, 21 bp, Homo sapiens
cacatcataaggttttattca

SEQ ID NO: 702962 - DNA, 20 bp, Homo sapiens
cacatcatattctattgttt

SEQ ID NO: 702963 - DNA, 18 bp, Homo sapiens
cacatccaactccagcaa

SEQ ID NO: 702964 - DNA, 19 bp, Homo sapiens
cacatccaactccagcaac

SEQ ID NO: 702965 - DNA, 16 bp, Homo sapiens
cacatccagccttgga

SEQ ID NO: 702966 - DNA, 19 bp, Homo sapiens
cacatccagcttgttgtcc

SEQ ID NO: 702967 - DNA, 15 bp, Homo sapiens
cacatcccagcagcc

SEQ ID NO: 702968 - DNA, 16 bp, Homo sapiens
cacatcccagcagccc

SEQ ID NO: 702969 - DNA, 18 bp, Homo sapiens
cacatcccagcagcccaa

SEQ ID NO: 702970 - DNA, 22 bp, Homo sapiens
cacatcccaggcttcaccctga

SEQ ID NO: 702971 - DNA, 21 bp, Homo sapiens
cacatccccagaatccataaa

SEQ ID NO: 702972 - DNA, 22 bp, Homo sapiens
cacatccccagagcccagctct

SEQ ID NO: 702973 - DNA, 23 bp, Homo sapiens
cacatccccagagcccagctctt

SEQ ID NO: 702974 - DNA, 18 bp, Homo sapiens
cacatccccttagaggac

SEQ ID NO: 702975 - DNA, 17 bp, Homo sapiens
cacatcccttcatatca

SEQ ID NO: 702976 - DNA, 14 bp, Homo sapiens
cacatcctcctgcc

SEQ ID NO: 702977 - DNA, 13 bp, Homo sapiens
cacatcctctcca

SEQ ID NO: 702978 - DNA, 14 bp, Homo sapiens
cacatcctctccag

SEQ ID NO: 702979 - DNA, 17 bp, Homo sapiens
cacatcctgtgtttcta

SEQ ID NO: 702980 - DNA, 17 bp, Homo sapiens
cacatcgttgccgcagc

SEQ ID NO: 702981 - DNA, 19 bp, Homo sapiens
cacatcgttgccgcagcgg

SEQ ID NO: 702982 - DNA, 23 bp, Homo sapiens
cacatctaaagctttatctttgt

SEQ ID NO: 702983 - DNA, 11 bp, Homo sapiens
cacatctccag

SEQ ID NO: 702984 - DNA, 12 bp, Homo sapiens
cacatctccaga

SEQ ID NO: 702985 - DNA, 17 bp, Homo sapiens
cacatctccagaaaaat

SEQ ID NO: 702986 - DNA, 22 bp, Homo sapiens
cacatctcctccatactcagga

SEQ ID NO: 702987 - DNA, 16 bp, Homo sapiens
cacatctctctgccct

SEQ ID NO: 702988 - DNA, 23 bp, Homo sapiens
cacatctctctgccctctccctg

SEQ ID NO: 702989 - DNA, 13 bp, Homo sapiens
cacatctgcattt

SEQ ID NO: 702990 - DNA, 19 bp, Homo sapiens
cacatctgcctcctctcct

SEQ ID NO: 702991 - DNA, 13 bp, Homo sapiens
cacatctgcctta

SEQ ID NO: 702992 - DNA, 15 bp, Homo sapiens
cacatctgctctagg

SEQ ID NO: 702993 - DNA, 13 bp, Homo sapiens
cacatctggccct

SEQ ID NO: 702994 - DNA, 15 bp, Homo sapiens
cacatctggccctga

SEQ ID NO: 702995 - DNA, 16 bp, Homo sapiens
cacatctggccctgac

SEQ ID NO: 702996 - DNA, 12 bp, Homo sapiens
cacatctggctg

SEQ ID NO: 702997 - DNA, 13 bp, Homo sapiens
cacatctggctgc

SEQ ID NO: 702998 - DNA, 20 bp, Homo sapiens
cacatctggctgcacaggct

SEQ ID NO: 702999 - DNA, 15 bp, Homo sapiens
cacatctgggtgccc

SEQ ID NO: 703000 - DNA, 17 bp, Homo sapiens
cacatctgggtgccctg

SEQ ID NO: 703001 - DNA, 18 bp, Homo sapiens
cacatctgtcctcaccct

SEQ ID NO: 703002 - DNA, 23 bp, Homo sapiens
cacatctgtcctcaccctgtggg

SEQ ID NO: 703003 - DNA, 16 bp, Homo sapiens
cacatctgtgtcttgt

SEQ ID NO: 703004 - DNA, 16 bp, Homo sapiens
cacatcttacctctca

SEQ ID NO: 703005 - DNA, 18 bp, Homo sapiens
cacatcttttggtgatcg

SEQ ID NO: 703006 - DNA, 13 bp, Homo sapiens
cacatgaaagttt

SEQ ID NO: 703007 - DNA, 18 bp, Homo sapiens
cacatgaattattacagt

SEQ ID NO: 703008 - DNA, 13 bp, Homo sapiens
cacatgacctcca

SEQ ID NO: 703009 - DNA, 20 bp, Homo sapiens
actgccaggtggttgggttc

SEQ ID NO: 703010 - DNA, 13 bp, Homo sapiens
actgccataaaac

SEQ ID NO: 703011 - DNA, 15 bp, Homo sapiens
actgccataaaacat

SEQ ID NO: 703012 - DNA, 21 bp, Homo sapiens
actgccatattaaattttttg

SEQ ID NO: 703013 - DNA, 17 bp, Homo sapiens
actgccattattttctg

SEQ ID NO: 703014 - DNA, 21 bp, Homo sapiens
actgcccaaggataggtattt

SEQ ID NO: 703015 - DNA, 18 bp, Homo sapiens
actgcccacatttgggct

SEQ ID NO: 703016 - DNA, 22 bp, Homo sapiens
actgcccacatttgggctcagg

SEQ ID NO: 703017 - DNA, 15 bp, Homo sapiens
actgcccagccactc

SEQ ID NO: 703018 - DNA, 22 bp, Homo sapiens
actgcccagccactccaagccc

SEQ ID NO: 703019 - DNA, 13 bp, Homo sapiens
actgcccagcccc

SEQ ID NO: 703020 - DNA, 14 bp, Homo sapiens
actgcccagcccct

SEQ ID NO: 703021 - DNA, 19 bp, Homo sapiens
actgcccaggcctgcctgt

SEQ ID NO: 703022 - DNA, 16 bp, Homo sapiens
actgcccatcagtgac

SEQ ID NO: 703023 - DNA, 23 bp, Homo sapiens
actgcccatcagtgacagactgg

SEQ ID NO: 703024 - DNA, 17 bp, Homo sapiens
actgccccacttctggc

SEQ ID NO: 703025 - DNA, 16 bp, Homo sapiens
actgcccccagaaagc

SEQ ID NO: 703026 - DNA, 21 bp, Homo sapiens
actgcccccagaaagcctcct

SEQ ID NO: 703027 - DNA, 20 bp, Homo sapiens
actgccccccgaggctgcta

SEQ ID NO: 703028 - DNA, 22 bp, Homo sapiens
actgcccctgctgtgctgctca

SEQ ID NO: 703029 - DNA, 19 bp, Homo sapiens
actgcccgagctggtgcat

SEQ ID NO: 703030 - DNA, 22 bp, Homo sapiens
actgcccgagctggtgcattac

SEQ ID NO: 703031 - DNA, 16 bp, Homo sapiens
actgcccgctcctcgg

SEQ ID NO: 703032 - DNA, 20 bp, Homo sapiens
actgccctaagcccccaggg

SEQ ID NO: 703033 - DNA, 22 bp, Homo sapiens
actgccctaagcccccagggcc

SEQ ID NO: 703034 - DNA, 13 bp, Homo sapiens
actgccctgcctg

SEQ ID NO: 703035 - DNA, 16 bp, Homo sapiens
actgccctgcctgccc

SEQ ID NO: 703036 - DNA, 14 bp, Homo sapiens
actgccctggcagc

SEQ ID NO: 703037 - DNA, 15 bp, Homo sapiens
actgcccttgctgcc

SEQ ID NO: 703038 - DNA, 17 bp, Homo sapiens
actgcccttgctgcccg

SEQ ID NO: 703039 - DNA, 17 bp, Homo sapiens
actgccgacatccctcc

SEQ ID NO: 703040 - DNA, 18 bp, Homo sapiens
actgccgaccgaggctgg

SEQ ID NO: 703041 - DNA, 19 bp, Homo sapiens
actgccgcctactggacgc

SEQ ID NO: 703042 - DNA, 19 bp, Homo sapiens
actgcctagaaaatgcaaa

SEQ ID NO: 703043 - DNA, 22 bp, Homo sapiens
actgcctaggaggctggccaag

SEQ ID NO: 703044 - DNA, 20 bp, Homo sapiens
actgcctataatcttataca

SEQ ID NO: 703045 - DNA, 21 bp, Homo sapiens
actgcctataatcttatacaa

SEQ ID NO: 703046 - DNA, 12 bp, Homo sapiens
actgcctcagcg

SEQ ID NO: 703047 - DNA, 15 bp, Homo sapiens
actgcctcctgcctg

SEQ ID NO: 703048 - DNA, 23 bp, Homo sapiens
actgcctctatgccctgcagagc

SEQ ID NO: 703049 - DNA, 12 bp, Homo sapiens
actgcctctccc

SEQ ID NO: 703050 - DNA, 15 bp, Homo sapiens
actgcctcttcctcc

SEQ ID NO: 703051 - DNA, 14 bp, Homo sapiens
actgcctgaataaa

SEQ ID NO: 703052 - DNA, 15 bp, Homo sapiens
actgcctgaataaag

SEQ ID NO: 703053 - DNA, 17 bp, Homo sapiens
actgcctgaataaagag

SEQ ID NO: 703054 - DNA, 19 bp, Homo sapiens
actgcctgaataaagagcc

SEQ ID NO: 703055 - DNA, 23 bp, Homo sapiens
actgcctgcagaggtctgtgctg

SEQ ID NO: 703056 - DNA, 12 bp, Homo sapiens
actgcctgccca

SEQ ID NO: 703057 - DNA, 13 bp, Homo sapiens
actgcctgcccac

SEQ ID NO: 703058 - DNA, 14 bp, Homo sapiens
actgcctgcccacc

SEQ ID NO: 703059 - DNA, 20 bp, Homo sapiens
actgcctgtagcaatggcca

SEQ ID NO: 703060 - DNA, 21 bp, Homo sapiens
actgcctgtagcaatggccag

SEQ ID NO: 703061 - DNA, 16 bp, Homo sapiens
actgcctgtctccatg

SEQ ID NO: 703062 - DNA, 11 bp, Homo sapiens
actgccttaat

SEQ ID NO: 703063 - DNA, 15 bp, Homo sapiens
actgccttcgcttct

SEQ ID NO: 703064 - DNA, 22 bp, Homo sapiens
actgccttcgcttcttgcctct

SEQ ID NO: 703065 - DNA, 20 bp, Homo sapiens
actgccttctcctctctggg

SEQ ID NO: 703066 - DNA, 21 bp, Homo sapiens
actgccttctcctctctgggc

SEQ ID NO: 703067 - DNA, 14 bp, Homo sapiens
actgccttggcccc

SEQ ID NO: 703068 - DNA, 15 bp, Homo sapiens
actgccttggcccct

SEQ ID NO: 703069 - DNA, 16 bp, Homo sapiens
actgccttggcccctc

SEQ ID NO: 703070 - DNA, 15 bp, Homo sapiens
actgcgactttctgc

SEQ ID NO: 703071 - DNA, 17 bp, Homo sapiens
actgcgactttctgcct

SEQ ID NO: 703072 - DNA, 19 bp, Homo sapiens
actgcgactttctgcctgg

SEQ ID NO: 703073 - DNA, 19 bp, Homo sapiens
actgcgaggacatcaaagt

SEQ ID NO: 703074 - DNA, 22 bp, Homo sapiens
actgcgggatggtcctggggct

SEQ ID NO: 703075 - DNA, 16 bp, Homo sapiens
actgcgtcaagcaatc

SEQ ID NO: 703076 - DNA, 15 bp, Homo sapiens
actgctaaattctat

SEQ ID NO: 703077 - DNA, 16 bp, Homo sapiens
actgctaaattctatg

SEQ ID NO: 703078 - DNA, 21 bp, Homo sapiens
actgctaaattctatgttaaa

SEQ ID NO: 703079 - DNA, 16 bp, Homo sapiens
actgctaaggctgctg

SEQ ID NO: 703080 - DNA, 18 bp, Homo sapiens
actgctaaggctgctggc

SEQ ID NO: 703081 - DNA, 18 bp, Homo sapiens
actgctaagtatttccca

SEQ ID NO: 703082 - DNA, 15 bp, Homo sapiens
actgctaatgcaaat

SEQ ID NO: 703083 - DNA, 23 bp, Homo sapiens
actgctacaaatactcttaggaa

SEQ ID NO: 703084 - DNA, 18 bp, Homo sapiens
actgctactgtaatttta

SEQ ID NO: 703085 - DNA, 20 bp, Homo sapiens
actgctaggcgagtgccagg

SEQ ID NO: 703086 - DNA, 23 bp, Homo sapiens
actgctaggtgggccagcccctc

SEQ ID NO: 703087 - DNA, 17 bp, Homo sapiens
actgctataaataggtt

SEQ ID NO: 703088 - DNA, 19 bp, Homo sapiens
actgctatgccatttcttc

SEQ ID NO: 703089 - DNA, 13 bp, Homo sapiens
actgctcagagct

SEQ ID NO: 703090 - DNA, 15 bp, Homo sapiens
actgctcaggctgca

SEQ ID NO: 703091 - DNA, 18 bp, Homo sapiens
actgctcaggctgcagct

SEQ ID NO: 703092 - DNA, 21 bp, Homo sapiens
actgctcaggctgcagctgga

SEQ ID NO: 703093 - DNA, 19 bp, Homo sapiens
actgctcccatcattcctt

SEQ ID NO: 703094 - DNA, 19 bp, Homo sapiens
actgctccccagccctggc

SEQ ID NO: 703095 - DNA, 20 bp, Homo sapiens
actgctccccagccctggct

SEQ ID NO: 703096 - DNA, 23 bp, Homo sapiens
actgctccctaagccagcctggt

SEQ ID NO: 703097 - DNA, 17 bp, Homo sapiens
actgctccgtggaggag

SEQ ID NO: 703098 - DNA, 15 bp, Homo sapiens
actgctctagaaagt

SEQ ID NO: 703099 - DNA, 14 bp, Homo sapiens
actgctgagccact

SEQ ID NO: 703100 - DNA, 16 bp, Homo sapiens
actgctgagccactcg

SEQ ID NO: 703101 - DNA, 17 bp, Homo sapiens
actgctgagctggccct

SEQ ID NO: 703102 - DNA, 19 bp, Homo sapiens
actgctgaggagtctgagg

SEQ ID NO: 703103 - DNA, 22 bp, Homo sapiens
actgctgaggagtctgaggact

SEQ ID NO: 703104 - DNA, 15 bp, Homo sapiens
actgctgaggtcccg

SEQ ID NO: 703105 - DNA, 20 bp, Homo sapiens
actgctgatcgtagaaaatt

SEQ ID NO: 703106 - DNA, 22 bp, Homo sapiens
actgctgcaaggtggcctctgc

SEQ ID NO: 703107 - DNA, 18 bp, Homo sapiens
actgctgcccagcctcca

SEQ ID NO: 703108 - DNA, 21 bp, Homo sapiens
actgctgcccagcctccaagc

SEQ ID NO: 703109 - DNA, 15 bp, Homo sapiens
actgctgccttaccc

SEQ ID NO: 703110 - DNA, 19 bp, Homo sapiens
actgctgctactgcccctc

SEQ ID NO: 703111 - DNA, 18 bp, Homo sapiens
actgctgctcctctttcc

SEQ ID NO: 703112 - DNA, 19 bp, Homo sapiens
actgctgctcctctttccc

SEQ ID NO: 703113 - DNA, 13 bp, Homo sapiens
actgctgctgcct

SEQ ID NO: 703114 - DNA, 14 bp, Homo sapiens
actgctgctgcctg

SEQ ID NO: 703115 - DNA, 14 bp, Homo sapiens
actgctggacatga

SEQ ID NO: 703116 - DNA, 19 bp, Homo sapiens
actgctggagtccagtgct

SEQ ID NO: 703117 - DNA, 11 bp, Homo sapiens
actgctggctc

SEQ ID NO: 703118 - DNA, 12 bp, Homo sapiens
actgctggctgc

SEQ ID NO: 703119 - DNA, 14 bp, Homo sapiens
actgctggctgcct

SEQ ID NO: 703120 - DNA, 19 bp, Homo sapiens
actgctgggactggccagg

SEQ ID NO: 703121 - DNA, 22 bp, Homo sapiens
actgctgtaaataaatgcttta

SEQ ID NO: 703122 - DNA, 19 bp, Homo sapiens
actgctgtcaataaatgac

SEQ ID NO: 703123 - DNA, 20 bp, Homo sapiens
actgctgtcaataaatgaca

SEQ ID NO: 703124 - DNA, 23 bp, Homo sapiens
actgctgtccacatgacctccat

SEQ ID NO: 703125 - DNA, 15 bp, Homo sapiens
actgctgtcctctcc

SEQ ID NO: 703126 - DNA, 23 bp, Homo sapiens
actgctgtcctctcccccttcag

SEQ ID NO: 703127 - DNA, 15 bp, Homo sapiens
actgctgtcttccaa

SEQ ID NO: 703128 - DNA, 22 bp, Homo sapiens
actgctgtgaaccctggggcct

SEQ ID NO: 703129 - DNA, 14 bp, Homo sapiens
actgctgtggcccc

SEQ ID NO: 703130 - DNA, 19 bp, Homo sapiens
actgctgtggccccctgtc

SEQ ID NO: 703131 - DNA, 12 bp, Homo sapiens
actgctgttaaa

SEQ ID NO: 703132 - DNA, 20 bp, Homo sapiens
actgctgttcctgctccatg

SEQ ID NO: 703133 - DNA, 21 bp, Homo sapiens
cacatgacgccagataaaatg

SEQ ID NO: 703134 - DNA, 20 bp, Homo sapiens
cacatgacttattatgcata

SEQ ID NO: 703135 - DNA, 18 bp, Homo sapiens
cacatgagctatttccat

SEQ ID NO: 703136 - DNA, 21 bp, Homo sapiens
cacatgaggccatctcaggag

SEQ ID NO: 703137 - DNA, 23 bp, Homo sapiens
cacatgaggccatctcaggagat

SEQ ID NO: 703138 - DNA, 12 bp, Homo sapiens
cacatgatcatg

SEQ ID NO: 703139 - DNA, 20 bp, Homo sapiens
cacatgcaaggtcatttttt

SEQ ID NO: 703140 - DNA, 19 bp, Homo sapiens
cacatgcacttttgggcct

SEQ ID NO: 703141 - DNA, 20 bp, Homo sapiens
cacatgcacttttgggcctt

SEQ ID NO: 703142 - DNA, 12 bp, Homo sapiens
cacatgcccctc

SEQ ID NO: 703143 - DNA, 17 bp, Homo sapiens
cacatgcccctccccca

SEQ ID NO: 703144 - DNA, 19 bp, Homo sapiens
cacatgcccctcccccagc

SEQ ID NO: 703145 - DNA, 22 bp, Homo sapiens
cacatgcccctcccccagctgc

SEQ ID NO: 703146 - DNA, 14 bp, Homo sapiens
cacatgccctcctg

SEQ ID NO: 703147 - DNA, 21 bp, Homo sapiens
cacatgctaggatgcggaaat

SEQ ID NO: 703148 - DNA, 21 bp, Homo sapiens
cacatgctatgttctgtcttc

SEQ ID NO: 703149 - DNA, 21 bp, Homo sapiens
cacatgctgaggttttgaata

SEQ ID NO: 703150 - DNA, 21 bp, Homo sapiens
cacatggattttggcagggcg

SEQ ID NO: 703151 - DNA, 15 bp, Homo sapiens
cacatggccatagag

SEQ ID NO: 703152 - DNA, 22 bp, Homo sapiens
cacatggccatagaggcccagg

SEQ ID NO: 703153 - DNA, 23 bp, Homo sapiens
cacatggccatagaggcccaggc

SEQ ID NO: 703154 - DNA, 23 bp, Homo sapiens
cacatggcccctccccctgccag

SEQ ID NO: 703155 - DNA, 16 bp, Homo sapiens
cacatgggctgggggc

SEQ ID NO: 703156 - DNA, 15 bp, Homo sapiens
cacatggtgtctccc

SEQ ID NO: 703157 - DNA, 16 bp, Homo sapiens
cacatggtgtctccca

SEQ ID NO: 703158 - DNA, 16 bp, Homo sapiens
cacatggtgtggccat

SEQ ID NO: 703159 - DNA, 18 bp, Homo sapiens
cacatggttcaccatgca

SEQ ID NO: 703160 - DNA, 23 bp, Homo sapiens
cacatgtacataaactgtcactc

SEQ ID NO: 703161 - DNA, 12 bp, Homo sapiens
cacatgtcaccg

SEQ ID NO: 703162 - DNA, 19 bp, Homo sapiens
cacatgtcaccgtggacct

SEQ ID NO: 703163 - DNA, 21 bp, Homo sapiens
cacatgtcccagatcgtctcc

SEQ ID NO: 703164 - DNA, 16 bp, Homo sapiens
cacatgtctgtcctca

SEQ ID NO: 703165 - DNA, 22 bp, Homo sapiens
cacatgtgagcatgtcacttcc

SEQ ID NO: 703166 - DNA, 14 bp, Homo sapiens
cacatgtgctgccc

SEQ ID NO: 703167 - DNA, 17 bp, Homo sapiens
cacatgtggccatggcc

SEQ ID NO: 703168 - DNA, 12 bp, Homo sapiens
cacatgttactg

SEQ ID NO: 703169 - DNA, 14 bp, Homo sapiens
cacatgtttcctct

SEQ ID NO: 703170 - DNA, 22 bp, Homo sapiens
cacattaaaaaatgaaatattt

SEQ ID NO: 703171 - DNA, 12 bp, Homo sapiens
cacattaaagaa

SEQ ID NO: 703172 - DNA, 16 bp, Homo sapiens
cacattaaagaagacc

SEQ ID NO: 703173 - DNA, 14 bp, Homo sapiens
cacattaactccct

SEQ ID NO: 703174 - DNA, 15 bp, Homo sapiens
cacattaactccctc

SEQ ID NO: 703175 - DNA, 23 bp, Homo sapiens
cacattaactccctccaccagcc

SEQ ID NO: 703176 - DNA, 22 bp, Homo sapiens
cacattaagtaatcaataaaga

SEQ ID NO: 703177 - DNA, 17 bp, Homo sapiens
cacattaatctcaaaga

SEQ ID NO: 703178 - DNA, 20 bp, Homo sapiens
cacattagattttattttac

SEQ ID NO: 703179 - DNA, 16 bp, Homo sapiens
cacattccagccaggc

SEQ ID NO: 703180 - DNA, 17 bp, Homo sapiens
cacattccagccaggcc

SEQ ID NO: 703181 - DNA, 19 bp, Homo sapiens
cacattccagccaggccca

SEQ ID NO: 703182 - DNA, 15 bp, Homo sapiens
cacattccagggctg

SEQ ID NO: 703183 - DNA, 14 bp, Homo sapiens
cacattcctggccc

SEQ ID NO: 703184 - DNA, 15 bp, Homo sapiens
cacattcctggcccc

SEQ ID NO: 703185 - DNA, 21 bp, Homo sapiens
cacattcctggccccgggctc

SEQ ID NO: 703186 - DNA, 16 bp, Homo sapiens
cacattctttataaaa

SEQ ID NO: 703187 - DNA, 19 bp, Homo sapiens
cacattgagactttcttct

SEQ ID NO: 703188 - DNA, 18 bp, Homo sapiens
cacattgatgtaaggact

SEQ ID NO: 703189 - DNA, 23 bp, Homo sapiens
cacattgatgtaaggactgtaaa

SEQ ID NO: 703190 - DNA, 14 bp, Homo sapiens
cacattgcctcatt

SEQ ID NO: 703191 - DNA, 15 bp, Homo sapiens
cacatttaaaacatt

SEQ ID NO: 703192 - DNA, 16 bp, Homo sapiens
cacatttaaaacattt

SEQ ID NO: 703193 - DNA, 14 bp, Homo sapiens
cacatttatatata

SEQ ID NO: 703194 - DNA, 21 bp, Homo sapiens
cacatttatatatatatgtat

SEQ ID NO: 703195 - DNA, 14 bp, Homo sapiens
cacatttgaattct

SEQ ID NO: 703196 - DNA, 13 bp, Homo sapiens
cacatttgatgta

SEQ ID NO: 703197 - DNA, 14 bp, Homo sapiens
cacatttgatgtac

SEQ ID NO: 703198 - DNA, 16 bp, Homo sapiens
cacatttgatgtacat

SEQ ID NO: 703199 - DNA, 17 bp, Homo sapiens
cacatttgatgtacatg

SEQ ID NO: 703200 - DNA, 18 bp, Homo sapiens
cacatttgatgtacatgt

SEQ ID NO: 703201 - DNA, 17 bp, Homo sapiens
cacatttgattctgtgt

SEQ ID NO: 703202 - DNA, 22 bp, Homo sapiens
cacatttgggatgttccttttt

SEQ ID NO: 703203 - DNA, 20 bp, Homo sapiens
cacatttgggctcagggttg

SEQ ID NO: 703204 - DNA, 22 bp, Homo sapiens
cacatttggttctaagaaaccc

SEQ ID NO: 703205 - DNA, 20 bp, Homo sapiens
cacatttgtatgtgtgtaga

SEQ ID NO: 703206 - DNA, 19 bp, Homo sapiens
cacatttgtcagtattttt

SEQ ID NO: 703207 - DNA, 22 bp, Homo sapiens
cacatttgtcagtatttttgcc

SEQ ID NO: 703208 - DNA, 15 bp, Homo sapiens
cacattttaaaagtg

SEQ ID NO: 703209 - DNA, 14 bp, Homo sapiens
cacatttttcttag

SEQ ID NO: 703210 - DNA, 21 bp, Homo sapiens
cacattttttaaatgcacctg

SEQ ID NO: 703211 - DNA, 13 bp, Homo sapiens
caccaaaacatgc

SEQ ID NO: 703212 - DNA, 23 bp, Homo sapiens
caccaaaaccaaacttgttcatt

SEQ ID NO: 703213 - DNA, 19 bp, Homo sapiens
caccaaaactatcctgatt

SEQ ID NO: 703214 - DNA, 16 bp, Homo sapiens
caccaaactgcacaca

SEQ ID NO: 703215 - DNA, 14 bp, Homo sapiens
caccaaagacatca

SEQ ID NO: 703216 - DNA, 18 bp, Homo sapiens
caccaaagctgcccactg

SEQ ID NO: 703217 - DNA, 14 bp, Homo sapiens
caccaaatcatcct

SEQ ID NO: 703218 - DNA, 17 bp, Homo sapiens
caccaacataaaacaaa

SEQ ID NO: 703219 - DNA, 20 bp, Homo sapiens
caccaaccccgcggcccaga

SEQ ID NO: 703220 - DNA, 16 bp, Homo sapiens
caccaacctcactgcc

SEQ ID NO: 703221 - DNA, 17 bp, Homo sapiens
caccaacctcactgccc

SEQ ID NO: 703222 - DNA, 14 bp, Homo sapiens
caccaacctccagt

SEQ ID NO: 703223 - DNA, 22 bp, Homo sapiens
caccaactctgcactccatggc

SEQ ID NO: 703224 - DNA, 15 bp, Homo sapiens
caccaagagggtgga

SEQ ID NO: 703225 - DNA, 19 bp, Homo sapiens
caccaagcacagcagcctg

SEQ ID NO: 703226 - DNA, 23 bp, Homo sapiens
caccaagcagtggcctttttctg

SEQ ID NO: 703227 - DNA, 14 bp, Homo sapiens
caccaagccaaggg

SEQ ID NO: 703228 - DNA, 15 bp, Homo sapiens
caccaagctcacagt

SEQ ID NO: 703229 - DNA, 12 bp, Homo sapiens
caccaaggaaac

SEQ ID NO: 703230 - DNA, 20 bp, Homo sapiens
caccaaggaaacgctacctc

SEQ ID NO: 703231 - DNA, 15 bp, Homo sapiens
caccaaggcagtgca

SEQ ID NO: 703232 - DNA, 18 bp, Homo sapiens
caccaaggcagtgcatgc

SEQ ID NO: 703233 - DNA, 19 bp, Homo sapiens
caccaaggcagtgcatgca

SEQ ID NO: 703234 - DNA, 20 bp, Homo sapiens
caccaagggacaggagaaga

SEQ ID NO: 703235 - DNA, 21 bp, Homo sapiens
caccaagtctaaaaagacctg

SEQ ID NO: 703236 - DNA, 22 bp, Homo sapiens
caccaagtctaaaaagacctgg

SEQ ID NO: 703237 - DNA, 13 bp, Homo sapiens
caccaagtggctg

SEQ ID NO: 703238 - DNA, 21 bp, Homo sapiens
caccaagtggctgggtgccct

SEQ ID NO: 703239 - DNA, 22 bp, Homo sapiens
caccaagtggctgggtgccctc

SEQ ID NO: 703240 - DNA, 23 bp, Homo sapiens
caccaagtgtctagagtcatgtg

SEQ ID NO: 703241 - DNA, 22 bp, Homo sapiens
caccaagttggaacatccttgg

SEQ ID NO: 703242 - DNA, 20 bp, Homo sapiens
caccaataaatcagaccatg

SEQ ID NO: 703243 - DNA, 14 bp, Homo sapiens
caccaatcagagag

SEQ ID NO: 703244 - DNA, 15 bp, Homo sapiens
caccaatcagagagc

SEQ ID NO: 703245 - DNA, 14 bp, Homo sapiens
caccaatctgccct

SEQ ID NO: 703246 - DNA, 12 bp, Homo sapiens
caccacacagtc

SEQ ID NO: 703247 - DNA, 20 bp, Homo sapiens
caccacacagtcacccctcc

SEQ ID NO: 703248 - DNA, 15 bp, Homo sapiens
caccacagacacaca

SEQ ID NO: 703249 - DNA, 21 bp, Homo sapiens
caccacagacacacacacgca

SEQ ID NO: 703250 - DNA, 19 bp, Homo sapiens
caccacagccagcacctgg

SEQ ID NO: 703251 - DNA, 22 bp, Homo sapiens
caccacatagcatgcttccttt

SEQ ID NO: 703252 - DNA, 18 bp, Homo sapiens
caccacatcctccgtcca

SEQ ID NO: 703253 - DNA, 13 bp, Homo sapiens
caccaccacctga

SEQ ID NO: 703254 - DNA, 16 bp, Homo sapiens
caccaccactggccac

SEQ ID NO: 703255 - DNA, 13 bp, Homo sapiens
caccaccaggagc

SEQ ID NO: 703256 - DNA, 20 bp, Homo sapiens
caccaccaggagcagcagcc

SEQ ID NO: 703257 - DNA, 17 bp, Homo sapiens
actgcttaaattccaag

SEQ ID NO: 703258 - DNA, 18 bp, Homo sapiens
actgcttaacttcacata

SEQ ID NO: 703259 - DNA, 15 bp, Homo sapiens
actgcttcccatcct

SEQ ID NO: 703260 - DNA, 16 bp, Homo sapiens
actgcttcccatccta

SEQ ID NO: 703261 - DNA, 19 bp, Homo sapiens
actgcttcccatcctaccc

SEQ ID NO: 703262 - DNA, 20 bp, Homo sapiens
actgcttcccatcctaccct

SEQ ID NO: 703263 - DNA, 19 bp, Homo sapiens
actgcttctaagatgccag

SEQ ID NO: 703264 - DNA, 15 bp, Homo sapiens
actgcttctcggcca

SEQ ID NO: 703265 - DNA, 13 bp, Homo sapiens
actgcttctcttt

SEQ ID NO: 703266 - DNA, 15 bp, Homo sapiens
actgcttctctttgt

SEQ ID NO: 703267 - DNA, 17 bp, Homo sapiens
actgcttctctttgtgc

SEQ ID NO: 703268 - DNA, 16 bp, Homo sapiens
actgcttcttggagct

SEQ ID NO: 703269 - DNA, 12 bp, Homo sapiens
actgctttcaag

SEQ ID NO: 703270 - DNA, 13 bp, Homo sapiens
actgctttcaagt

SEQ ID NO: 703271 - DNA, 14 bp, Homo sapiens
actgctttctgttc

SEQ ID NO: 703272 - DNA, 23 bp, Homo sapiens
actgctttctttcgtttgtttgt

SEQ ID NO: 703273 - DNA, 16 bp, Homo sapiens
actgctttgcaaagac

SEQ ID NO: 703274 - DNA, 17 bp, Homo sapiens
actggaaaacagaacac

SEQ ID NO: 703275 - DNA, 18 bp, Homo sapiens
actggaaaaggtgaaaat

SEQ ID NO: 703276 - DNA, 15 bp, Homo sapiens
actggaaaggggaga

SEQ ID NO: 703277 - DNA, 23 bp, Homo sapiens
actggaaaggggagagcctgctg

SEQ ID NO: 703278 - DNA, 10 bp, Homo sapiens
actggaagat

SEQ ID NO: 703279 - DNA, 20 bp, Homo sapiens
actggaagcacagcctcggg

SEQ ID NO: 703280 - DNA, 19 bp, Homo sapiens
actggaagcatgtaggaga

SEQ ID NO: 703281 - DNA, 20 bp, Homo sapiens
actggaagcatgtaggagaa

SEQ ID NO: 703282 - DNA, 16 bp, Homo sapiens
actggaagctaatttg

SEQ ID NO: 703283 - DNA, 20 bp, Homo sapiens
actggaagctaatttgcatt

SEQ ID NO: 703284 - DNA, 18 bp, Homo sapiens
actggaaggggaagggac

SEQ ID NO: 703285 - DNA, 18 bp, Homo sapiens
actggaataatttgtaaa

SEQ ID NO: 703286 - DNA, 21 bp, Homo sapiens
actggaataatttgtaaatga

SEQ ID NO: 703287 - DNA, 19 bp, Homo sapiens
actggaatataaaacagtc

SEQ ID NO: 703288 - DNA, 16 bp, Homo sapiens
actggacaacactgat

SEQ ID NO: 703289 - DNA, 13 bp, Homo sapiens
actggacagcttg

SEQ ID NO: 703290 - DNA, 14 bp, Homo sapiens
actggacagcttgt

SEQ ID NO: 703291 - DNA, 15 bp, Homo sapiens
actggaccccactgg

SEQ ID NO: 703292 - DNA, 23 bp, Homo sapiens
actggacccccagcccccagggc

SEQ ID NO: 703293 - DNA, 16 bp, Homo sapiens
actggaccgctgactg

SEQ ID NO: 703294 - DNA, 15 bp, Homo sapiens
actggacctgggggt

SEQ ID NO: 703295 - DNA, 16 bp, Homo sapiens
actggactcaggaact

SEQ ID NO: 703296 - DNA, 16 bp, Homo sapiens
actggactccggggcc

SEQ ID NO: 703297 - DNA, 15 bp, Homo sapiens
actggactgcatggg

SEQ ID NO: 703298 - DNA, 21 bp, Homo sapiens
actggacttcccaagataaat

SEQ ID NO: 703299 - DNA, 22 bp, Homo sapiens
actggagatgcatcgggaaaga

SEQ ID NO: 703300 - DNA, 23 bp, Homo sapiens
actggagatgcatcgggaaagaa

SEQ ID NO: 703301 - DNA, 15 bp, Homo sapiens
actggagcaccaggc

SEQ ID NO: 703302 - DNA, 19 bp, Homo sapiens
actggagcaccaggcacga

SEQ ID NO: 703303 - DNA, 16 bp, Homo sapiens
actggaggagagaaga

SEQ ID NO: 703304 - DNA, 18 bp, Homo sapiens
actggaggagagaagaat

SEQ ID NO: 703305 - DNA, 14 bp, Homo sapiens
actggaggagcagc

SEQ ID NO: 703306 - DNA, 19 bp, Homo sapiens
actggaggagcagcttcct

SEQ ID NO: 703307 - DNA, 18 bp, Homo sapiens
actggaggcccctggagc

SEQ ID NO: 703308 - DNA, 21 bp, Homo sapiens
actggaggcccctggagccag

SEQ ID NO: 703309 - DNA, 14 bp, Homo sapiens
actggaggtcacat

SEQ ID NO: 703310 - DNA, 21 bp, Homo sapiens
actggaggtcacattcaggaa

SEQ ID NO: 703311 - DNA, 23 bp, Homo sapiens
actggaggtcacattcaggaaga

SEQ ID NO: 703312 - DNA, 23 bp, Homo sapiens
actggaggtgggcatgccaccct

SEQ ID NO: 703313 - DNA, 16 bp, Homo sapiens
actggaggttgaagcc

SEQ ID NO: 703314 - DNA, 17 bp, Homo sapiens
actggagtctatgctta

SEQ ID NO: 703315 - DNA, 20 bp, Homo sapiens
actggagtgaggcttccagg

SEQ ID NO: 703316 - DNA, 17 bp, Homo sapiens
actggagtgcagggagg

SEQ ID NO: 703317 - DNA, 16 bp, Homo sapiens
actggagttacattaa

SEQ ID NO: 703318 - DNA, 17 bp, Homo sapiens
actggagttacattaat

SEQ ID NO: 703319 - DNA, 15 bp, Homo sapiens
actggagttctatgc

SEQ ID NO: 703320 - DNA, 18 bp, Homo sapiens
actggataaattgtttag

SEQ ID NO: 703321 - DNA, 15 bp, Homo sapiens
actggatgctcgcca

SEQ ID NO: 703322 - DNA, 14 bp, Homo sapiens
actggattcttatt

SEQ ID NO: 703323 - DNA, 22 bp, Homo sapiens
actggcaaaaggatctttgtgg

SEQ ID NO: 703324 - DNA, 13 bp, Homo sapiens
actggcaaacttc

SEQ ID NO: 703325 - DNA, 21 bp, Homo sapiens
actggcaaacttcagactgaa

SEQ ID NO: 703326 - DNA, 15 bp, Homo sapiens
actggcaataaactc

SEQ ID NO: 703327 - DNA, 23 bp, Homo sapiens
actggcactggtggtttttgctc

SEQ ID NO: 703328 - DNA, 15 bp, Homo sapiens
actggcagagcacag

SEQ ID NO: 703329 - DNA, 16 bp, Homo sapiens
actggcagagcacagc

SEQ ID NO: 703330 - DNA, 11 bp, Homo sapiens
actggcagctc

SEQ ID NO: 703331 - DNA, 13 bp, Homo sapiens
actggcagctcct

SEQ ID NO: 703332 - DNA, 21 bp, Homo sapiens
actggcaggggagacaggagc

SEQ ID NO: 703333 - DNA, 13 bp, Homo sapiens
actggcaggtgca

SEQ ID NO: 703334 - DNA, 14 bp, Homo sapiens
actggcaggtgcag

SEQ ID NO: 703335 - DNA, 22 bp, Homo sapiens
actggcaggtgcagatgggctg

SEQ ID NO: 703336 - DNA, 12 bp, Homo sapiens
actggcatggat

SEQ ID NO: 703337 - DNA, 20 bp, Homo sapiens
actggcatggattaatagag

SEQ ID NO: 703338 - DNA, 17 bp, Homo sapiens
actggcattgtccctgt

SEQ ID NO: 703339 - DNA, 18 bp, Homo sapiens
actggccaccaggctggc

SEQ ID NO: 703340 - DNA, 19 bp, Homo sapiens
actggccaccaggctggcg

SEQ ID NO: 703341 - DNA, 21 bp, Homo sapiens
actggccaccaggctggcgca

SEQ ID NO: 703342 - DNA, 18 bp, Homo sapiens
actggccacccctcccca

SEQ ID NO: 703343 - DNA, 17 bp, Homo sapiens
actggccagagagggcc

SEQ ID NO: 703344 - DNA, 23 bp, Homo sapiens
actggccagagagggcccagctg

SEQ ID NO: 703345 - DNA, 17 bp, Homo sapiens
actggccatttttctgg

SEQ ID NO: 703346 - DNA, 14 bp, Homo sapiens
actggccccacagg

SEQ ID NO: 703347 - DNA, 16 bp, Homo sapiens
actggccccacaggag

SEQ ID NO: 703348 - DNA, 17 bp, Homo sapiens
actggccccacaggagt

SEQ ID NO: 703349 - DNA, 18 bp, Homo sapiens
actggccgctgagcgccc

SEQ ID NO: 703350 - DNA, 22 bp, Homo sapiens
actggcctcaaagcaagcattc

SEQ ID NO: 703351 - DNA, 15 bp, Homo sapiens
actggcctctgtgat

SEQ ID NO: 703352 - DNA, 23 bp, Homo sapiens
actggccttctgatgaaatgtta

SEQ ID NO: 703353 - DNA, 18 bp, Homo sapiens
actggcctttttcattta

SEQ ID NO: 703354 - DNA, 12 bp, Homo sapiens
actggctctcca

SEQ ID NO: 703355 - DNA, 17 bp, Homo sapiens
actggctctccaagtgc

SEQ ID NO: 703356 - DNA, 22 bp, Homo sapiens
actggctctccaagtgccagag

SEQ ID NO: 703357 - DNA, 15 bp, Homo sapiens
actggctctcctggc

SEQ ID NO: 703358 - DNA, 17 bp, Homo sapiens
actggctctctccagga

SEQ ID NO: 703359 - DNA, 21 bp, Homo sapiens
actggctggccagtctgggtc

SEQ ID NO: 703360 - DNA, 18 bp, Homo sapiens
actggctggcctgagcaa

SEQ ID NO: 703361 - DNA, 17 bp, Homo sapiens
actggctggctgcagtg

SEQ ID NO: 703362 - DNA, 20 bp, Homo sapiens
actggctgggagtccttacc

SEQ ID NO: 703363 - DNA, 23 bp, Homo sapiens
actggctgggagtccttacctcg

SEQ ID NO: 703364 - DNA, 17 bp, Homo sapiens
actggctgggcccctgg

SEQ ID NO: 703365 - DNA, 20 bp, Homo sapiens
actggctgggcccctgggga

SEQ ID NO: 703366 - DNA, 14 bp, Homo sapiens
actggctggggcag

SEQ ID NO: 703367 - DNA, 14 bp, Homo sapiens
actggctgtctgcc

SEQ ID NO: 703368 - DNA, 17 bp, Homo sapiens
actggctgtctgcctgt

SEQ ID NO: 703369 - DNA, 24 bp, Homo sapiens
actggctgtgcccctgatgcagcc

SEQ ID NO: 703370 - DNA, 15 bp, Homo sapiens
actggcttctgtgca

SEQ ID NO: 703371 - DNA, 22 bp, Homo sapiens
actggcttctgtgcactagcct

SEQ ID NO: 703372 - DNA, 23 bp, Homo sapiens
actggcttctgtgcactagcctg

SEQ ID NO: 703373 - DNA, 14 bp, Homo sapiens
actggcttttatta

SEQ ID NO: 703374 - DNA, 21 bp, Homo sapiens
actggcttttattaatgcact

SEQ ID NO: 703375 - DNA, 22 bp, Homo sapiens
actgggaaagttaggattcaga

SEQ ID NO: 703376 - DNA, 13 bp, Homo sapiens
actgggaagctgg

SEQ ID NO: 703377 - DNA, 16 bp, Homo sapiens
actgggaagctggagt

SEQ ID NO: 703378 - DNA, 20 bp, Homo sapiens
actgggaagctggagtgctg

SEQ ID NO: 703379 - DNA, 12 bp, Homo sapiens
actgggaaggaa

SEQ ID NO: 703380 - DNA, 14 bp, Homo sapiens
actgggaaggaaac

SEQ ID NO: 703381 - DNA, 11 bp, Homo sapiens
caccaccaggg

SEQ ID NO: 703382 - DNA, 24 bp, Homo sapiens
caccaccagggtggaccaggcctg

SEQ ID NO: 703383 - DNA, 23 bp, Homo sapiens
caccacccagcccttccttgggc

SEQ ID NO: 703384 - DNA, 18 bp, Homo sapiens
caccaccccaacaaacca

SEQ ID NO: 703385 - DNA, 14 bp, Homo sapiens
caccacccccactg

SEQ ID NO: 703386 - DNA, 23 bp, Homo sapiens
caccacccgctttcttgctggtt

SEQ ID NO: 703387 - DNA, 15 bp, Homo sapiens
caccaccctcaggtg

SEQ ID NO: 703388 - DNA, 23 bp, Homo sapiens
caccaccgaatatattactgatt

SEQ ID NO: 703389 - DNA, 14 bp, Homo sapiens
caccaccgcctctg

SEQ ID NO: 703390 - DNA, 22 bp, Homo sapiens
caccaccgcctctggccgccac

SEQ ID NO: 703391 - DNA, 23 bp, Homo sapiens
caccacctaggccactcctccaa

SEQ ID NO: 703392 - DNA, 18 bp, Homo sapiens
caccacctcactcctgtt

SEQ ID NO: 703393 - DNA, 21 bp, Homo sapiens
caccacctgacggctggggac

SEQ ID NO: 703394 - DNA, 13 bp, Homo sapiens
caccacctggagt

SEQ ID NO: 703395 - DNA, 20 bp, Homo sapiens
caccaccttggactcctccc

SEQ ID NO: 703396 - DNA, 23 bp, Homo sapiens
caccaccttggactcctcccaca

SEQ ID NO: 703397 - DNA, 15 bp, Homo sapiens
caccacgatgtggcc

SEQ ID NO: 703398 - DNA, 21 bp, Homo sapiens
caccacgatgtggccctggcc

SEQ ID NO: 703399 - DNA, 22 bp, Homo sapiens
caccacggcgttgtacctgtag

SEQ ID NO: 703400 - DNA, 20 bp, Homo sapiens
caccacggcgtttttttaca

SEQ ID NO: 703401 - DNA, 19 bp, Homo sapiens
caccacgtctggctccctg

SEQ ID NO: 703402 - DNA, 18 bp, Homo sapiens
caccactaaccatcccca

SEQ ID NO: 703403 - DNA, 21 bp, Homo sapiens
caccactaaccatccccaact

SEQ ID NO: 703404 - DNA, 18 bp, Homo sapiens
caccactacattctgtta

SEQ ID NO: 703405 - DNA, 20 bp, Homo sapiens
caccactacattctgttaat

SEQ ID NO: 703406 - DNA, 16 bp, Homo sapiens
caccactaccagccag

SEQ ID NO: 703407 - DNA, 19 bp, Homo sapiens
caccactaggaatcccaga

SEQ ID NO: 703408 - DNA, 13 bp, Homo sapiens
caccactcaggcc

SEQ ID NO: 703409 - DNA, 16 bp, Homo sapiens
caccactcctctccct

SEQ ID NO: 703410 - DNA, 16 bp, Homo sapiens
caccactgatatcatg

SEQ ID NO: 703411 - DNA, 21 bp, Homo sapiens
caccactgatatcatggggag

SEQ ID NO: 703412 - DNA, 12 bp, Homo sapiens
caccactgcagc

SEQ ID NO: 703413 - DNA, 14 bp, Homo sapiens
caccactgccctgc

SEQ ID NO: 703414 - DNA, 21 bp, Homo sapiens
caccactgccctgcctgccca

SEQ ID NO: 703415 - DNA, 16 bp, Homo sapiens
caccactgctgaggag

SEQ ID NO: 703416 - DNA, 20 bp, Homo sapiens
caccactgctgaggagtctg

SEQ ID NO: 703417 - DNA, 15 bp, Homo sapiens
caccactggccacca

SEQ ID NO: 703418 - DNA, 16 bp, Homo sapiens
caccactggccaccag

SEQ ID NO: 703419 - DNA, 19 bp, Homo sapiens
caccactggccaccaggct

SEQ ID NO: 703420 - DNA, 21 bp, Homo sapiens
caccactggccaccaggctgg

SEQ ID NO: 703421 - DNA, 19 bp, Homo sapiens
caccactgtactccagccc

SEQ ID NO: 703422 - DNA, 21 bp, Homo sapiens
caccacttatttattgttgcc

SEQ ID NO: 703423 - DNA, 23 bp, Homo sapiens
caccacttatttattgttgcctt

SEQ ID NO: 703424 - DNA, 18 bp, Homo sapiens
caccagaacgcaccccac

SEQ ID NO: 703425 - DNA, 21 bp, Homo sapiens
caccagaacgcaccccactgg

SEQ ID NO: 703426 - DNA, 13 bp, Homo sapiens
caccagaagttac

SEQ ID NO: 703427 - DNA, 20 bp, Homo sapiens
caccagacccacctggagcc

SEQ ID NO: 703428 - DNA, 21 bp, Homo sapiens
caccagacccacctggagccc

SEQ ID NO: 703429 - DNA, 23 bp, Homo sapiens
caccagacccacctggagcccgc

SEQ ID NO: 703430 - DNA, 17 bp, Homo sapiens
caccagacggggctgga

SEQ ID NO: 703431 - DNA, 17 bp, Homo sapiens
caccagacgtcaggccc

SEQ ID NO: 703432 - DNA, 19 bp, Homo sapiens
caccagacgtcaggccctg

SEQ ID NO: 703433 - DNA, 22 bp, Homo sapiens
caccagactgaagtaaacagct

SEQ ID NO: 703434 - DNA, 18 bp, Homo sapiens
caccagacttggcctcca

SEQ ID NO: 703435 - DNA, 21 bp, Homo sapiens
caccagagcatttccaacacc

SEQ ID NO: 703436 - DNA, 16 bp, Homo sapiens
caccagaggctgcaga

SEQ ID NO: 703437 - DNA, 21 bp, Homo sapiens
caccagaggctgcagaaggcc

SEQ ID NO: 703438 - DNA, 23 bp, Homo sapiens
caccagaggctgcagaaggccaa

SEQ ID NO: 703439 - DNA, 20 bp, Homo sapiens
caccagatgcttttgtgaga

SEQ ID NO: 703440 - DNA, 17 bp, Homo sapiens
caccagcaacatctcga

SEQ ID NO: 703441 - DNA, 12 bp, Homo sapiens
caccagcagcac

SEQ ID NO: 703442 - DNA, 14 bp, Homo sapiens
caccagcattcctt

SEQ ID NO: 703443 - DNA, 20 bp, Homo sapiens
caccagccagccctggccca

SEQ ID NO: 703444 - DNA, 13 bp, Homo sapiens
caccagccatcct

SEQ ID NO: 703445 - DNA, 20 bp, Homo sapiens
caccagccccctggatgggc

SEQ ID NO: 703446 - DNA, 18 bp, Homo sapiens
caccagcccggcctgctc

SEQ ID NO: 703447 - DNA, 15 bp, Homo sapiens
caccagccgccccag

SEQ ID NO: 703448 - DNA, 17 bp, Homo sapiens
caccagccgccccagcc

SEQ ID NO: 703449 - DNA, 18 bp, Homo sapiens
caccagccgccccagccc

SEQ ID NO: 703450 - DNA, 13 bp, Homo sapiens
caccagccgctgc

SEQ ID NO: 703451 - DNA, 13 bp, Homo sapiens
caccagcctgctg

SEQ ID NO: 703452 - DNA, 14 bp, Homo sapiens
caccagcctgctga

SEQ ID NO: 703453 - DNA, 21 bp, Homo sapiens
caccagcctgctgacagacac

SEQ ID NO: 703454 - DNA, 23 bp, Homo sapiens
caccagcctgctgacagacacta

SEQ ID NO: 703455 - DNA, 16 bp, Homo sapiens
caccagcgcccccaga

SEQ ID NO: 703456 - DNA, 19 bp, Homo sapiens
caccagcgttcccttctcc

SEQ ID NO: 703457 - DNA, 14 bp, Homo sapiens
caccagctatctgt

SEQ ID NO: 703458 - DNA, 15 bp, Homo sapiens
caccagctccacaca

SEQ ID NO: 703459 - DNA, 21 bp, Homo sapiens
caccagctccacacattccag

SEQ ID NO: 703460 - DNA, 23 bp, Homo sapiens
caccagctccacacattccagcc

SEQ ID NO: 703461 - DNA, 12 bp, Homo sapiens
caccagctcctc

SEQ ID NO: 703462 - DNA, 15 bp, Homo sapiens
caccagctcctccct

SEQ ID NO: 703463 - DNA, 22 bp, Homo sapiens
caccagctcgtttttcagcacc

SEQ ID NO: 703464 - DNA, 22 bp, Homo sapiens
caccagctctgccgtctctgga

SEQ ID NO: 703465 - DNA, 14 bp, Homo sapiens
caccagctctgtgg

SEQ ID NO: 703466 - DNA, 15 bp, Homo sapiens
caccagctctgtggc

SEQ ID NO: 703467 - DNA, 16 bp, Homo sapiens
caccagctctgtggcc

SEQ ID NO: 703468 - DNA, 19 bp, Homo sapiens
caccagctctgtggcctgt

SEQ ID NO: 703469 - DNA, 22 bp, Homo sapiens
caccagctctgtggcctgtgtc

SEQ ID NO: 703470 - DNA, 13 bp, Homo sapiens
caccagctgctct

SEQ ID NO: 703471 - DNA, 16 bp, Homo sapiens
caccagctgctctgcc

SEQ ID NO: 703472 - DNA, 18 bp, Homo sapiens
caccagctgctctgcccc

SEQ ID NO: 703473 - DNA, 13 bp, Homo sapiens
caccagctggggt

SEQ ID NO: 703474 - DNA, 20 bp, Homo sapiens
caccagcttcactctctccg

SEQ ID NO: 703475 - DNA, 17 bp, Homo sapiens
caccagcttctccaggc

SEQ ID NO: 703476 - DNA, 19 bp, Homo sapiens
caccagcttctccaggctc

SEQ ID NO: 703477 - DNA, 11 bp, Homo sapiens
caccaggaagg

SEQ ID NO: 703478 - DNA, 17 bp, Homo sapiens
caccaggaagtgtttat

SEQ ID NO: 703479 - DNA, 16 bp, Homo sapiens
caccaggactagggct

SEQ ID NO: 703480 - DNA, 19 bp, Homo sapiens
caccaggagaaccactaca

SEQ ID NO: 703481 - DNA, 13 bp, Homo sapiens
caccaggagcagc

SEQ ID NO: 703482 - DNA, 22 bp, Homo sapiens
caccaggagcagcagccagcac

SEQ ID NO: 703483 - DNA, 13 bp, Homo sapiens
caccaggatggcc

SEQ ID NO: 703484 - DNA, 15 bp, Homo sapiens
caccaggatggccct

SEQ ID NO: 703485 - DNA, 21 bp, Homo sapiens
caccaggatggcccttcccac

SEQ ID NO: 703486 - DNA, 19 bp, Homo sapiens
caccaggcacgaacccacc

SEQ ID NO: 703487 - DNA, 20 bp, Homo sapiens
caccaggcacgaacccacct

SEQ ID NO: 703488 - DNA, 21 bp, Homo sapiens
caccaggcacgaacccacctg

SEQ ID NO: 703489 - DNA, 15 bp, Homo sapiens
caccaggccacctcc

SEQ ID NO: 703490 - DNA, 18 bp, Homo sapiens
caccaggccgtgccttgt

SEQ ID NO: 703491 - DNA, 18 bp, Homo sapiens
caccaggcctcactggct

SEQ ID NO: 703492 - DNA, 19 bp, Homo sapiens
caccaggctggagtgcagt

SEQ ID NO: 703493 - DNA, 16 bp, Homo sapiens
caccaggctggcgcag

SEQ ID NO: 703494 - DNA, 18 bp, Homo sapiens
caccaggctggcgcagcc

SEQ ID NO: 703495 - DNA, 19 bp, Homo sapiens
caccaggctggcgcagcca

SEQ ID NO: 703496 - DNA, 23 bp, Homo sapiens
caccaggctggcgcagccaaggc

SEQ ID NO: 703497 - DNA, 15 bp, Homo sapiens
caccaggctgtgggc

SEQ ID NO: 703498 - DNA, 17 bp, Homo sapiens
caccaggctgtgggcct

SEQ ID NO: 703499 - DNA, 13 bp, Homo sapiens
caccagggaagaa

SEQ ID NO: 703500 - DNA, 15 bp, Homo sapiens
caccagggaagaaga

SEQ ID NO: 703501 - DNA, 15 bp, Homo sapiens
caccagggactgcag

SEQ ID NO: 703502 - DNA, 18 bp, Homo sapiens
caccagggagcttcctgg

SEQ ID NO: 703503 - DNA, 19 bp, Homo sapiens
caccagggagcttcctggc

SEQ ID NO: 703504 - DNA, 23 bp, Homo sapiens
caccagggagcttcctggctctg

SEQ ID NO: 703505 - DNA, 20 bp, Homo sapiens
actgggaaggcttgggattt

SEQ ID NO: 703506 - DNA, 19 bp, Homo sapiens
actgggaccgtgcgagctg

SEQ ID NO: 703507 - DNA, 21 bp, Homo sapiens
actgggaccgtgcgagctgcc

SEQ ID NO: 703508 - DNA, 17 bp, Homo sapiens
actgggagtcagagccc

SEQ ID NO: 703509 - DNA, 18 bp, Homo sapiens
actgggagtcagagccct

SEQ ID NO: 703510 - DNA, 21 bp, Homo sapiens
actgggagtcagagccctggc

SEQ ID NO: 703511 - DNA, 16 bp, Homo sapiens
actgggatgagccgct

SEQ ID NO: 703512 - DNA, 22 bp, Homo sapiens
actgggatgggaacactggtgg

SEQ ID NO: 703513 - DNA, 21 bp, Homo sapiens
actgggcaacactgcaggaca

SEQ ID NO: 703514 - DNA, 21 bp, Homo sapiens
actgggcacagattgaagaat

SEQ ID NO: 703515 - DNA, 17 bp, Homo sapiens
actgggcaggttcctgg

SEQ ID NO: 703516 - DNA, 21 bp, Homo sapiens
actgggcaggttcctggggcc

SEQ ID NO: 703517 - DNA, 20 bp, Homo sapiens
actgggccagccctgcagcc

SEQ ID NO: 703518 - DNA, 14 bp, Homo sapiens
actgggcccaggca

SEQ ID NO: 703519 - DNA, 16 bp, Homo sapiens
actgggctctggacct

SEQ ID NO: 703520 - DNA, 19 bp, Homo sapiens
actgggctctggacctcag

SEQ ID NO: 703521 - DNA, 21 bp, Homo sapiens
actgggctggcgcttggatct

SEQ ID NO: 703522 - DNA, 15 bp, Homo sapiens
actggggaaacataa

SEQ ID NO: 703523 - DNA, 21 bp, Homo sapiens
actggggagcccgtctcagtg

SEQ ID NO: 703524 - DNA, 16 bp, Homo sapiens
actggggagggctgca

SEQ ID NO: 703525 - DNA, 19 bp, Homo sapiens
actggggatggtggcacag

SEQ ID NO: 703526 - DNA, 12 bp, Homo sapiens
actggggcctcc

SEQ ID NO: 703527 - DNA, 13 bp, Homo sapiens
actggggcctcca

SEQ ID NO: 703528 - DNA, 17 bp, Homo sapiens
actggggcctccagaac

SEQ ID NO: 703529 - DNA, 15 bp, Homo sapiens
actgggggaaaagat

SEQ ID NO: 703530 - DNA, 19 bp, Homo sapiens
actgggggactgggagtca

SEQ ID NO: 703531 - DNA, 13 bp, Homo sapiens
actggggggccac

SEQ ID NO: 703532 - DNA, 14 bp, Homo sapiens
actggggggccacc

SEQ ID NO: 703533 - DNA, 18 bp, Homo sapiens
actggggtcctggggcct

SEQ ID NO: 703534 - DNA, 21 bp, Homo sapiens
actggggttgcgtctgaggcc

SEQ ID NO: 703535 - DNA, 23 bp, Homo sapiens
actggggttgcgtctgaggcctg

SEQ ID NO: 703536 - DNA, 22 bp, Homo sapiens
actgggtaatttataaagaaaa

SEQ ID NO: 703537 - DNA, 16 bp, Homo sapiens
actgggtgcgtctcca

SEQ ID NO: 703538 - DNA, 18 bp, Homo sapiens
actgggtggggtgaggac

SEQ ID NO: 703539 - DNA, 20 bp, Homo sapiens
actgggtggggtgaggacca

SEQ ID NO: 703540 - DNA, 17 bp, Homo sapiens
actgggtgtaaacacat

SEQ ID NO: 703541 - DNA, 14 bp, Homo sapiens
actgggtgtcattt

SEQ ID NO: 703542 - DNA, 21 bp, Homo sapiens
actgggtgtcatttcattcca

SEQ ID NO: 703543 - DNA, 14 bp, Homo sapiens
actgggtgttgatc

SEQ ID NO: 703544 - DNA, 16 bp, Homo sapiens
actgggttcccatgct

SEQ ID NO: 703545 - DNA, 21 bp, Homo sapiens
actgggttcttgttttatata

SEQ ID NO: 703546 - DNA, 20 bp, Homo sapiens
actgggttctttggaagcag

SEQ ID NO: 703547 - DNA, 20 bp, Homo sapiens
actgggtttctctgtatagt

SEQ ID NO: 703548 - DNA, 21 bp, Homo sapiens
actgggtttggaccccagctg

SEQ ID NO: 703549 - DNA, 22 bp, Homo sapiens
actgggtttggaccccagctgg

SEQ ID NO: 703550 - DNA, 23 bp, Homo sapiens
actgggtttggaccccagctggg

SEQ ID NO: 703551 - DNA, 17 bp, Homo sapiens
actggtaagattgttat

SEQ ID NO: 703552 - DNA, 18 bp, Homo sapiens
actggtaagattgttatt

SEQ ID NO: 703553 - DNA, 23 bp, Homo sapiens
actggtacttagagtttctgttt

SEQ ID NO: 703554 - DNA, 15 bp, Homo sapiens
actggtaggaccaag

SEQ ID NO: 703555 - DNA, 18 bp, Homo sapiens
actggtaggttgggacac

SEQ ID NO: 703556 - DNA, 23 bp, Homo sapiens
actggtattagttaaaacacata

SEQ ID NO: 703557 - DNA, 14 bp, Homo sapiens
actggtatttatat

SEQ ID NO: 703558 - DNA, 15 bp, Homo sapiens
actggtatttatatt

SEQ ID NO: 703559 - DNA, 14 bp, Homo sapiens
actggtcagggcag

SEQ ID NO: 703560 - DNA, 22 bp, Homo sapiens
actggtcagggcagtggccaag

SEQ ID NO: 703561 - DNA, 16 bp, Homo sapiens
actggtccagctctga

SEQ ID NO: 703562 - DNA, 18 bp, Homo sapiens
actggtccagctctgaca

SEQ ID NO: 703563 - DNA, 22 bp, Homo sapiens
actggtccaggtcttcagtttc

SEQ ID NO: 703564 - DNA, 15 bp, Homo sapiens
actggtcctgtgtgc

SEQ ID NO: 703565 - DNA, 22 bp, Homo sapiens
actggtgaactgagctgggcag

SEQ ID NO: 703566 - DNA, 21 bp, Homo sapiens
actggtgactgcgatcttcag

SEQ ID NO: 703567 - DNA, 22 bp, Homo sapiens
actggtgatgttgaaatatgca

SEQ ID NO: 703568 - DNA, 23 bp, Homo sapiens
actggtgctataggctggagaag

SEQ ID NO: 703569 - DNA, 16 bp, Homo sapiens
actggtgctgagtgac

SEQ ID NO: 703570 - DNA, 12 bp, Homo sapiens
actggtggcccg

SEQ ID NO: 703571 - DNA, 17 bp, Homo sapiens
actggtgggcagctgag

SEQ ID NO: 703572 - DNA, 21 bp, Homo sapiens
actggtgggggttctggcagg

SEQ ID NO: 703573 - DNA, 23 bp, Homo sapiens
actggtgggtctttaataaaaca

SEQ ID NO: 703574 - DNA, 18 bp, Homo sapiens
actggttagtgatgcagt

SEQ ID NO: 703575 - DNA, 14 bp, Homo sapiens
actggttcacctga

SEQ ID NO: 703576 - DNA, 17 bp, Homo sapiens
actggttctcaatgaaa

SEQ ID NO: 703577 - DNA, 14 bp, Homo sapiens
actggttgcatgga

SEQ ID NO: 703578 - DNA, 15 bp, Homo sapiens
actggttgcatggaa

SEQ ID NO: 703579 - DNA, 13 bp, Homo sapiens
actggttgctgtg

SEQ ID NO: 703580 - DNA, 14 bp, Homo sapiens
actggttgctgtgt

SEQ ID NO: 703581 - DNA, 15 bp, Homo sapiens
actggttgtcagaat

SEQ ID NO: 703582 - DNA, 16 bp, Homo sapiens
actggttgtcagaatg

SEQ ID NO: 703583 - DNA, 21 bp, Homo sapiens
actggttgtcagaatggaatc

SEQ ID NO: 703584 - DNA, 22 bp, Homo sapiens
actggtttacaggccctgctcc

SEQ ID NO: 703585 - DNA, 13 bp, Homo sapiens
actggtttcaaga

SEQ ID NO: 703586 - DNA, 18 bp, Homo sapiens
actggtttcaagaatatg

SEQ ID NO: 703587 - DNA, 12 bp, Homo sapiens
actggtttgttt

SEQ ID NO: 703588 - DNA, 16 bp, Homo sapiens
actggtttgtttgctt

SEQ ID NO: 703589 - DNA, 18 bp, Homo sapiens
actggtttgtttgcttaa

SEQ ID NO: 703590 - DNA, 19 bp, Homo sapiens
actggttttacacagagaa

SEQ ID NO: 703591 - DNA, 19 bp, Homo sapiens
actggttttctgccaatga

SEQ ID NO: 703592 - DNA, 16 bp, Homo sapiens
actgtaaaatgaaatt

SEQ ID NO: 703593 - DNA, 13 bp, Homo sapiens
actgtaaaatgat

SEQ ID NO: 703594 - DNA, 23 bp, Homo sapiens
actgtaaactctatcagcattgt

SEQ ID NO: 703595 - DNA, 20 bp, Homo sapiens
actgtaaagatttgttgaca

SEQ ID NO: 703596 - DNA, 17 bp, Homo sapiens
actgtaaataaaatgtg

SEQ ID NO: 703597 - DNA, 13 bp, Homo sapiens
actgtaaatatcc

SEQ ID NO: 703598 - DNA, 12 bp, Homo sapiens
actgtaaatcat

SEQ ID NO: 703599 - DNA, 12 bp, Homo sapiens
actgtaactttt

SEQ ID NO: 703600 - DNA, 18 bp, Homo sapiens
actgtaactttttttcag

SEQ ID NO: 703601 - DNA, 17 bp, Homo sapiens
actgtaagaagagccat

SEQ ID NO: 703602 - DNA, 20 bp, Homo sapiens
actgtaagacgtatgtaaca

SEQ ID NO: 703603 - DNA, 14 bp, Homo sapiens
actgtaagatgttg

SEQ ID NO: 703604 - DNA, 21 bp, Homo sapiens
actgtaagcttttaagaaaaa

SEQ ID NO: 703605 - DNA, 17 bp, Homo sapiens
actgtaattttatatga

SEQ ID NO: 703606 - DNA, 15 bp, Homo sapiens
actgtacaaagtaga

SEQ ID NO: 703607 - DNA, 16 bp, Homo sapiens
actgtacaaagtagaa

SEQ ID NO: 703608 - DNA, 22 bp, Homo sapiens
actgtacaaagtagaagtctta

SEQ ID NO: 703609 - DNA, 14 bp, Homo sapiens
actgtacagagact

SEQ ID NO: 703610 - DNA, 22 bp, Homo sapiens
actgtacagattgctgcttctg

SEQ ID NO: 703611 - DNA, 14 bp, Homo sapiens
actgtacatgaaaa

SEQ ID NO: 703612 - DNA, 21 bp, Homo sapiens
actgtacatgaaaacacattt

SEQ ID NO: 703613 - DNA, 14 bp, Homo sapiens
actgtacatgctat

SEQ ID NO: 703614 - DNA, 12 bp, Homo sapiens
actgtacatgtg

SEQ ID NO: 703615 - DNA, 14 bp, Homo sapiens
actgtacattgtga

SEQ ID NO: 703616 - DNA, 17 bp, Homo sapiens
actgtacattgtgagct

SEQ ID NO: 703617 - DNA, 20 bp, Homo sapiens
actgtactatcctgtaaata

SEQ ID NO: 703618 - DNA, 14 bp, Homo sapiens
actgtactgcatgt

SEQ ID NO: 703619 - DNA, 15 bp, Homo sapiens
actgtactgcatgtg

SEQ ID NO: 703620 - DNA, 12 bp, Homo sapiens
actgtactggcc

SEQ ID NO: 703621 - DNA, 13 bp, Homo sapiens
actgtacttcact

SEQ ID NO: 703622 - DNA, 16 bp, Homo sapiens
actgtactttgccatt

SEQ ID NO: 703623 - DNA, 23 bp, Homo sapiens
actgtagaaaagggaactgaaca

SEQ ID NO: 703624 - DNA, 19 bp, Homo sapiens
actgtagaatgatttcatg

SEQ ID NO: 703625 - DNA, 18 bp, Homo sapiens
actgtagccacagctgct

SEQ ID NO: 703626 - DNA, 17 bp, Homo sapiens
actgtagcctggatatt

SEQ ID NO: 703627 - DNA, 18 bp, Homo sapiens
actgtagcgaccccagac

SEQ ID NO: 703628 - DNA, 23 bp, Homo sapiens
actgtagctattagcggctcctc

SEQ ID NO: 703629 - DNA, 21 bp, Homo sapiens
caccagggccagctaattttt

SEQ ID NO: 703630 - DNA, 15 bp, Homo sapiens
caccaggggtttctc

SEQ ID NO: 703631 - DNA, 19 bp, Homo sapiens
caccagggtccgcaccagc

SEQ ID NO: 703632 - DNA, 23 bp, Homo sapiens
caccagggtccgcaccagctgct

SEQ ID NO: 703633 - DNA, 13 bp, Homo sapiens
caccagggtggac

SEQ ID NO: 703634 - DNA, 15 bp, Homo sapiens
caccagggtggacca

SEQ ID NO: 703635 - DNA, 22 bp, Homo sapiens
caccagggttgaccccagagga

SEQ ID NO: 703636 - DNA, 22 bp, Homo sapiens
caccaggtgcctttcaaattta

SEQ ID NO: 703637 - DNA, 15 bp, Homo sapiens
caccaggttaaaatt

SEQ ID NO: 703638 - DNA, 13 bp, Homo sapiens
caccagtctgtct

SEQ ID NO: 703639 - DNA, 15 bp, Homo sapiens
caccagtggacctag

SEQ ID NO: 703640 - DNA, 21 bp, Homo sapiens
caccagtggacctagcctgga

SEQ ID NO: 703641 - DNA, 22 bp, Homo sapiens
caccagtggacctagcctggat

SEQ ID NO: 703642 - DNA, 21 bp, Homo sapiens
caccagtggcctttcagtgta

SEQ ID NO: 703643 - DNA, 22 bp, Homo sapiens
caccagtgtagcatcttcctct

SEQ ID NO: 703644 - DNA, 18 bp, Homo sapiens
caccagtgtcccctccac

SEQ ID NO: 703645 - DNA, 19 bp, Homo sapiens
caccagtgttcctgaagct

SEQ ID NO: 703646 - DNA, 21 bp, Homo sapiens
caccagtgttcctgaagctgc

SEQ ID NO: 703647 - DNA, 21 bp, Homo sapiens
caccagtttatacagaactca

SEQ ID NO: 703648 - DNA, 23 bp, Homo sapiens
caccatacgagcacctccagcct

SEQ ID NO: 703649 - DNA, 18 bp, Homo sapiens
caccatagttttgtttaa

SEQ ID NO: 703650 - DNA, 21 bp, Homo sapiens
caccatattaccacagacata

SEQ ID NO: 703651 - DNA, 15 bp, Homo sapiens
caccatcaccaccgc

SEQ ID NO: 703652 - DNA, 20 bp, Homo sapiens
caccatccaccttcccttct

SEQ ID NO: 703653 - DNA, 15 bp, Homo sapiens
caccatccctttttg

SEQ ID NO: 703654 - DNA, 24 bp, Homo sapiens
caccatcctcagaggctgagccct

SEQ ID NO: 703655 - DNA, 15 bp, Homo sapiens
caccatcgtgtttgc

SEQ ID NO: 703656 - DNA, 18 bp, Homo sapiens
caccatctgattaaaaca

SEQ ID NO: 703657 - DNA, 11 bp, Homo sapiens
caccatgaaac

SEQ ID NO: 703658 - DNA, 20 bp, Homo sapiens
caccatgaccccttctctct

SEQ ID NO: 703659 - DNA, 21 bp, Homo sapiens
caccatgcaaatgtcttccag

SEQ ID NO: 703660 - DNA, 18 bp, Homo sapiens
caccatgcactgtaaata

SEQ ID NO: 703661 - DNA, 19 bp, Homo sapiens
caccatgcactgtaaatat

SEQ ID NO: 703662 - DNA, 17 bp, Homo sapiens
caccatgcagcccctgg

SEQ ID NO: 703663 - DNA, 19 bp, Homo sapiens
caccatggaccagcccatt

SEQ ID NO: 703664 - DNA, 22 bp, Homo sapiens
caccatggcatgcgccaccatg

SEQ ID NO: 703665 - DNA, 23 bp, Homo sapiens
caccatggcatgcgccaccatgc

SEQ ID NO: 703666 - DNA, 19 bp, Homo sapiens
caccatgggaaactgttgt

SEQ ID NO: 703667 - DNA, 19 bp, Homo sapiens
caccatggtgactgccaca

SEQ ID NO: 703668 - DNA, 20 bp, Homo sapiens
caccatggtgactgccacat

SEQ ID NO: 703669 - DNA, 23 bp, Homo sapiens
caccatggtgactgccacataat

SEQ ID NO: 703670 - DNA, 14 bp, Homo sapiens
caccatgtgggcac

SEQ ID NO: 703671 - DNA, 15 bp, Homo sapiens
caccatgttagcctt

SEQ ID NO: 703672 - DNA, 16 bp, Homo sapiens
caccatgttagcctta

SEQ ID NO: 703673 - DNA, 20 bp, Homo sapiens
caccatgttggccaggctgg

SEQ ID NO: 703674 - DNA, 20 bp, Homo sapiens
caccatgttggtcaggctgg

SEQ ID NO: 703675 - DNA, 22 bp, Homo sapiens
caccatgttggtcaggctggtc

SEQ ID NO: 703676 - DNA, 23 bp, Homo sapiens
caccatgtttgagctcagacccc

SEQ ID NO: 703677 - DNA, 23 bp, Homo sapiens
caccattcacatttgatgtacat

SEQ ID NO: 703678 - DNA, 20 bp, Homo sapiens
caccattccaagtctccacc

SEQ ID NO: 703679 - DNA, 11 bp, Homo sapiens
caccattcctg

SEQ ID NO: 703680 - DNA, 22 bp, Homo sapiens
caccattcctgcctttaagcca

SEQ ID NO: 703681 - DNA, 23 bp, Homo sapiens
caccattcctgcctttaagccaa

SEQ ID NO: 703682 - DNA, 13 bp, Homo sapiens
caccattctacct

SEQ ID NO: 703683 - DNA, 22 bp, Homo sapiens
caccattggacagtctccctga

SEQ ID NO: 703684 - DNA, 13 bp, Homo sapiens
caccattgttcat

SEQ ID NO: 703685 - DNA, 17 bp, Homo sapiens
caccatttggcaatgcc

SEQ ID NO: 703686 - DNA, 18 bp, Homo sapiens
cacccaaaaatatctcct

SEQ ID NO: 703687 - DNA, 12 bp, Homo sapiens
cacccaaaacac

SEQ ID NO: 703688 - DNA, 13 bp, Homo sapiens
cacccaaaacacg

SEQ ID NO: 703689 - DNA, 14 bp, Homo sapiens
cacccaaaagtcaa

SEQ ID NO: 703690 - DNA, 14 bp, Homo sapiens
cacccaaacacttc

SEQ ID NO: 703691 - DNA, 15 bp, Homo sapiens
cacccaaaccccttc

SEQ ID NO: 703692 - DNA, 16 bp, Homo sapiens
cacccaaaccccttcc

SEQ ID NO: 703693 - DNA, 17 bp, Homo sapiens
cacccaaaccccttccc

SEQ ID NO: 703694 - DNA, 18 bp, Homo sapiens
cacccaaaccccttccca

SEQ ID NO: 703695 - DNA, 19 bp, Homo sapiens
cacccaaaccccttcccac

SEQ ID NO: 703696 - DNA, 22 bp, Homo sapiens
cacccaaagaggtatttatctt

SEQ ID NO: 703697 - DNA, 12 bp, Homo sapiens
cacccaacactt

SEQ ID NO: 703698 - DNA, 19 bp, Homo sapiens
cacccaagagattgttgtt

SEQ ID NO: 703699 - DNA, 16 bp, Homo sapiens
cacccaagatgaatta

SEQ ID NO: 703700 - DNA, 15 bp, Homo sapiens
cacccaagccctcct

SEQ ID NO: 703701 - DNA, 13 bp, Homo sapiens
cacccaagcctga

SEQ ID NO: 703702 - DNA, 17 bp, Homo sapiens
cacccaagcctgctggc

SEQ ID NO: 703703 - DNA, 14 bp, Homo sapiens
cacccaagcttggc

SEQ ID NO: 703704 - DNA, 19 bp, Homo sapiens
cacccaagcttggcagccg

SEQ ID NO: 703705 - DNA, 14 bp, Homo sapiens
cacccacacagctg

SEQ ID NO: 703706 - DNA, 17 bp, Homo sapiens
cacccacacagctgccc

SEQ ID NO: 703707 - DNA, 15 bp, Homo sapiens
cacccaccagctcca

SEQ ID NO: 703708 - DNA, 14 bp, Homo sapiens
cacccaccctggga

SEQ ID NO: 703709 - DNA, 20 bp, Homo sapiens
cacccaccgtctcggccctg

SEQ ID NO: 703710 - DNA, 21 bp, Homo sapiens
cacccaccgtctcggccctga

SEQ ID NO: 703711 - DNA, 13 bp, Homo sapiens
cacccaccgtgga

SEQ ID NO: 703712 - DNA, 16 bp, Homo sapiens
cacccaccgtggagga

SEQ ID NO: 703713 - DNA, 14 bp, Homo sapiens
cacccacctccacc

SEQ ID NO: 703714 - DNA, 15 bp, Homo sapiens
cacccacctccaccc

SEQ ID NO: 703715 - DNA, 16 bp, Homo sapiens
cacccacctccaccca

SEQ ID NO: 703716 - DNA, 17 bp, Homo sapiens
cacccacctccacccag

SEQ ID NO: 703717 - DNA, 18 bp, Homo sapiens
cacccacctccacccagc

SEQ ID NO: 703718 - DNA, 14 bp, Homo sapiens
cacccacctccctg

SEQ ID NO: 703719 - DNA, 21 bp, Homo sapiens
cacccacctccctgcctccag

SEQ ID NO: 703720 - DNA, 12 bp, Homo sapiens
cacccacctcct

SEQ ID NO: 703721 - DNA, 13 bp, Homo sapiens
cacccacctcctg

SEQ ID NO: 703722 - DNA, 18 bp, Homo sapiens
cacccacctctgggtcct

SEQ ID NO: 703723 - DNA, 16 bp, Homo sapiens
cacccacgtgagagaa

SEQ ID NO: 703724 - DNA, 23 bp, Homo sapiens
cacccacgtgagagaatctgcct

SEQ ID NO: 703725 - DNA, 13 bp, Homo sapiens
cacccactcagga

SEQ ID NO: 703726 - DNA, 14 bp, Homo sapiens
cacccactcaggat

SEQ ID NO: 703727 - DNA, 18 bp, Homo sapiens
cacccactctggtggcca

SEQ ID NO: 703728 - DNA, 14 bp, Homo sapiens
cacccactgtccgc

SEQ ID NO: 703729 - DNA, 19 bp, Homo sapiens
cacccactgtccgcctctg

SEQ ID NO: 703730 - DNA, 21 bp, Homo sapiens
cacccagagcaccccctgctc

SEQ ID NO: 703731 - DNA, 17 bp, Homo sapiens
cacccagatcaggaacc

SEQ ID NO: 703732 - DNA, 23 bp, Homo sapiens
cacccagcaccttgcagattttc

SEQ ID NO: 703733 - DNA, 12 bp, Homo sapiens
cacccagcaggc

SEQ ID NO: 703734 - DNA, 13 bp, Homo sapiens
cacccagcaggca

SEQ ID NO: 703735 - DNA, 11 bp, Homo sapiens
cacccagccca

SEQ ID NO: 703736 - DNA, 13 bp, Homo sapiens
cacccagcccatt

SEQ ID NO: 703737 - DNA, 14 bp, Homo sapiens
cacccagcccctgg

SEQ ID NO: 703738 - DNA, 16 bp, Homo sapiens
cacccagcccttcctt

SEQ ID NO: 703739 - DNA, 19 bp, Homo sapiens
cacccagcccttccttggg

SEQ ID NO: 703740 - DNA, 17 bp, Homo sapiens
cacccagctccaggccc

SEQ ID NO: 703741 - DNA, 15 bp, Homo sapiens
cacccagctccaggg

SEQ ID NO: 703742 - DNA, 15 bp, Homo sapiens
cacccagctggtcct

SEQ ID NO: 703743 - DNA, 16 bp, Homo sapiens
cacccagctggtcctg

SEQ ID NO: 703744 - DNA, 21 bp, Homo sapiens
cacccagctggtcctgtggat

SEQ ID NO: 703745 - DNA, 19 bp, Homo sapiens
cacccagcttcaaagctta

SEQ ID NO: 703746 - DNA, 11 bp, Homo sapiens
cacccaggaag

SEQ ID NO: 703747 - DNA, 13 bp, Homo sapiens
cacccaggctgca

SEQ ID NO: 703748 - DNA, 17 bp, Homo sapiens
cacccaggctgcactgc

SEQ ID NO: 703749 - DNA, 19 bp, Homo sapiens
cacccaggctgcactgcag

SEQ ID NO: 703750 - DNA, 21 bp, Homo sapiens
cacccaggctgcactgcagtg

SEQ ID NO: 703751 - DNA, 20 bp, Homo sapiens
cacccaggctggagtgcggt

SEQ ID NO: 703752 - DNA, 20 bp, Homo sapiens
cacccagggagctgatgccc

SEQ ID NO: 703753 - DNA, 21 bp, Homo sapiens
actgtaggcagggaaccttaa

SEQ ID NO: 703754 - DNA, 18 bp, Homo sapiens
actgtaggttatttaaaa

SEQ ID NO: 703755 - DNA, 17 bp, Homo sapiens
actgtagtttagttctg

SEQ ID NO: 703756 - DNA, 19 bp, Homo sapiens
actgtagtttagttctgtt

SEQ ID NO: 703757 - DNA, 14 bp, Homo sapiens
actgtagttttgag

SEQ ID NO: 703758 - DNA, 18 bp, Homo sapiens
actgtagtttttcttcaa

SEQ ID NO: 703759 - DNA, 20 bp, Homo sapiens
actgtagtttttcttcaaca

SEQ ID NO: 703760 - DNA, 22 bp, Homo sapiens
actgtagtttttgaaaattatg

SEQ ID NO: 703761 - DNA, 22 bp, Homo sapiens
actgtataagtactagatgcat

SEQ ID NO: 703762 - DNA, 14 bp, Homo sapiens
actgtatataaact

SEQ ID NO: 703763 - DNA, 14 bp, Homo sapiens
actgtatattcagg

SEQ ID NO: 703764 - DNA, 17 bp, Homo sapiens
actgtatattttttaat

SEQ ID NO: 703765 - DNA, 14 bp, Homo sapiens
actgtatcatgaca

SEQ ID NO: 703766 - DNA, 20 bp, Homo sapiens
actgtatctaggcatttcat

SEQ ID NO: 703767 - DNA, 13 bp, Homo sapiens
actgtatctgtgt

SEQ ID NO: 703768 - DNA, 14 bp, Homo sapiens
actgtatctgtgta

SEQ ID NO: 703769 - DNA, 13 bp, Homo sapiens
actgtatgctgga

SEQ ID NO: 703770 - DNA, 23 bp, Homo sapiens
actgtatgtaatatttacataaa

SEQ ID NO: 703771 - DNA, 17 bp, Homo sapiens
actgtatgtgtgtaggt

SEQ ID NO: 703772 - DNA, 20 bp, Homo sapiens
actgtattaaatcttaaaca

SEQ ID NO: 703773 - DNA, 18 bp, Homo sapiens
actgtattctagtggctg

SEQ ID NO: 703774 - DNA, 14 bp, Homo sapiens
actgtattgctcct

SEQ ID NO: 703775 - DNA, 15 bp, Homo sapiens
actgtatttaaggaa

SEQ ID NO: 703776 - DNA, 17 bp, Homo sapiens
actgtatttcagtattt

SEQ ID NO: 703777 - DNA, 21 bp, Homo sapiens
actgtatttctaagaagttgt

SEQ ID NO: 703778 - DNA, 23 bp, Homo sapiens
actgtatttgaaataagaattca

SEQ ID NO: 703779 - DNA, 13 bp, Homo sapiens
actgtatttttac

SEQ ID NO: 703780 - DNA, 20 bp, Homo sapiens
actgtatttttactattgaa

SEQ ID NO: 703781 - DNA, 20 bp, Homo sapiens
actgtatttttgaagactat

SEQ ID NO: 703782 - DNA, 16 bp, Homo sapiens
actgtatttttttaac

SEQ ID NO: 703783 - DNA, 17 bp, Homo sapiens
actgtatttttttaact

SEQ ID NO: 703784 - DNA, 16 bp, Homo sapiens
actgtcaaatgaactt

SEQ ID NO: 703785 - DNA, 21 bp, Homo sapiens
actgtcaaatgaacttttaca

SEQ ID NO: 703786 - DNA, 20 bp, Homo sapiens
actgtcaaatgatgtgcaaa

SEQ ID NO: 703787 - DNA, 13 bp, Homo sapiens
actgtcacactgg

SEQ ID NO: 703788 - DNA, 13 bp, Homo sapiens
actgtcactgccg

SEQ ID NO: 703789 - DNA, 15 bp, Homo sapiens
actgtcactgtttct

SEQ ID NO: 703790 - DNA, 16 bp, Homo sapiens
actgtcactgtttctc

SEQ ID NO: 703791 - DNA, 20 bp, Homo sapiens
actgtcactgtttctctgct

SEQ ID NO: 703792 - DNA, 15 bp, Homo sapiens
actgtcactttgctc

SEQ ID NO: 703793 - DNA, 18 bp, Homo sapiens
actgtcactttgctctgg

SEQ ID NO: 703794 - DNA, 19 bp, Homo sapiens
actgtcactttgctctggg

SEQ ID NO: 703795 - DNA, 22 bp, Homo sapiens
actgtcagcagggactgtaaac

SEQ ID NO: 703796 - DNA, 12 bp, Homo sapiens
actgtcaggaag

SEQ ID NO: 703797 - DNA, 16 bp, Homo sapiens
actgtcaggaagaaat

SEQ ID NO: 703798 - DNA, 13 bp, Homo sapiens
actgtcaggaagt

SEQ ID NO: 703799 - DNA, 15 bp, Homo sapiens
actgtcagggagggc

SEQ ID NO: 703800 - DNA, 18 bp, Homo sapiens
actgtcagttctctggga

SEQ ID NO: 703801 - DNA, 23 bp, Homo sapiens
actgtcagttctctgggaagtgg

SEQ ID NO: 703802 - DNA, 15 bp, Homo sapiens
actgtcatcaatgtt

SEQ ID NO: 703803 - DNA, 22 bp, Homo sapiens
actgtcatcctcaaagaaagtg

SEQ ID NO: 703804 - DNA, 15 bp, Homo sapiens
actgtcatgcttcat

SEQ ID NO: 703805 - DNA, 16 bp, Homo sapiens
actgtccacatctgcc

SEQ ID NO: 703806 - DNA, 13 bp, Homo sapiens
actgtccagagag

SEQ ID NO: 703807 - DNA, 14 bp, Homo sapiens
actgtccagagagc

SEQ ID NO: 703808 - DNA, 15 bp, Homo sapiens
actgtccagagagca

SEQ ID NO: 703809 - DNA, 14 bp, Homo sapiens
actgtccctcaaat

SEQ ID NO: 703810 - DNA, 23 bp, Homo sapiens
actgtccctcaaatgacccaaag

SEQ ID NO: 703811 - DNA, 20 bp, Homo sapiens
actgtccgcctctgcccgca

SEQ ID NO: 703812 - DNA, 15 bp, Homo sapiens
actgtcctaacatgg

SEQ ID NO: 703813 - DNA, 15 bp, Homo sapiens
actgtcctcaaataa

SEQ ID NO: 703814 - DNA, 13 bp, Homo sapiens
actgtcctcccac

SEQ ID NO: 703815 - DNA, 21 bp, Homo sapiens
actgtcctcccacagacctgc

SEQ ID NO: 703816 - DNA, 22 bp, Homo sapiens
actgtcctcccacagacctgca

SEQ ID NO: 703817 - DNA, 13 bp, Homo sapiens
actgtcctctaca

SEQ ID NO: 703818 - DNA, 10 bp, Homo sapiens
actgtcctgg

SEQ ID NO: 703819 - DNA, 19 bp, Homo sapiens
actgtcctgggcgccctgg

SEQ ID NO: 703820 - DNA, 22 bp, Homo sapiens
actgtcctgggcgccctggaag

SEQ ID NO: 703821 - DNA, 23 bp, Homo sapiens
actgtcctgggcgccctggaagc

SEQ ID NO: 703822 - DNA, 22 bp, Homo sapiens
actgtccttgaacccaacagtc

SEQ ID NO: 703823 - DNA, 16 bp, Homo sapiens
actgtctagccactcc

SEQ ID NO: 703824 - DNA, 18 bp, Homo sapiens
actgtctagccactccct

SEQ ID NO: 703825 - DNA, 20 bp, Homo sapiens
actgtctagccactccctcc

SEQ ID NO: 703826 - DNA, 19 bp, Homo sapiens
actgtctatttaagtgcaa

SEQ ID NO: 703827 - DNA, 23 bp, Homo sapiens
actgtctcaagagggcactggtg

SEQ ID NO: 703828 - DNA, 20 bp, Homo sapiens
actgtctcctccctgggcta

SEQ ID NO: 703829 - DNA, 14 bp, Homo sapiens
actgtctctggagt

SEQ ID NO: 703830 - DNA, 16 bp, Homo sapiens
actgtctggggcccca

SEQ ID NO: 703831 - DNA, 17 bp, Homo sapiens
actgtctgtctccatcg

SEQ ID NO: 703832 - DNA, 12 bp, Homo sapiens
actgtcttcagt

SEQ ID NO: 703833 - DNA, 11 bp, Homo sapiens
actgtcttccc

SEQ ID NO: 703834 - DNA, 13 bp, Homo sapiens
actgtcttcctca

SEQ ID NO: 703835 - DNA, 16 bp, Homo sapiens
actgtcttgtttcagt

SEQ ID NO: 703836 - DNA, 18 bp, Homo sapiens
actgtctttaaaagagag

SEQ ID NO: 703837 - DNA, 15 bp, Homo sapiens
actgtctttattctt

SEQ ID NO: 703838 - DNA, 14 bp, Homo sapiens
actgtctttgtgct

SEQ ID NO: 703839 - DNA, 16 bp, Homo sapiens
actgtctttgtgctga

SEQ ID NO: 703840 - DNA, 21 bp, Homo sapiens
actgtctttttttccctacca

SEQ ID NO: 703841 - DNA, 18 bp, Homo sapiens
actgtgaaaatagtgtaa

SEQ ID NO: 703842 - DNA, 21 bp, Homo sapiens
actgtgaaaatagtgtaagaa

SEQ ID NO: 703843 - DNA, 13 bp, Homo sapiens
actgtgaaattta

SEQ ID NO: 703844 - DNA, 23 bp, Homo sapiens
actgtgaaatttcatgattggct

SEQ ID NO: 703845 - DNA, 18 bp, Homo sapiens
actgtgaactgggcattt

SEQ ID NO: 703846 - DNA, 14 bp, Homo sapiens
actgtgaatttcaa

SEQ ID NO: 703847 - DNA, 16 bp, Homo sapiens
actgtgaccaagtata

SEQ ID NO: 703848 - DNA, 20 bp, Homo sapiens
actgtgactaggcatacact

SEQ ID NO: 703849 - DNA, 12 bp, Homo sapiens
actgtgagactg

SEQ ID NO: 703850 - DNA, 15 bp, Homo sapiens
actgtgagactgtat

SEQ ID NO: 703851 - DNA, 16 bp, Homo sapiens
actgtgagactgtatg

SEQ ID NO: 703852 - DNA, 22 bp, Homo sapiens
actgtgagagttgtctctgttg

SEQ ID NO: 703853 - DNA, 22 bp, Homo sapiens
actgtgattcagaaaatgttct

SEQ ID NO: 703854 - DNA, 15 bp, Homo sapiens
actgtgatttatctt

SEQ ID NO: 703855 - DNA, 14 bp, Homo sapiens
actgtgattttgcc

SEQ ID NO: 703856 - DNA, 19 bp, Homo sapiens
actgtgattttgccctcct

SEQ ID NO: 703857 - DNA, 20 bp, Homo sapiens
actgtgcaactttttaaagt

SEQ ID NO: 703858 - DNA, 21 bp, Homo sapiens
actgtgcacatctgtgtcttg

SEQ ID NO: 703859 - DNA, 12 bp, Homo sapiens
actgtgcagaat

SEQ ID NO: 703860 - DNA, 16 bp, Homo sapiens
actgtgcagaataatg

SEQ ID NO: 703861 - DNA, 15 bp, Homo sapiens
actgtgcagacccag

SEQ ID NO: 703862 - DNA, 17 bp, Homo sapiens
actgtgcagacccagtc

SEQ ID NO: 703863 - DNA, 16 bp, Homo sapiens
actgtgcatagtgctg

SEQ ID NO: 703864 - DNA, 17 bp, Homo sapiens
actgtgcatagtgctgg

SEQ ID NO: 703865 - DNA, 19 bp, Homo sapiens
actgtgcatagtgctggga

SEQ ID NO: 703866 - DNA, 12 bp, Homo sapiens
actgtgccacaa

SEQ ID NO: 703867 - DNA, 15 bp, Homo sapiens
actgtgcctcagaga

SEQ ID NO: 703868 - DNA, 18 bp, Homo sapiens
actgtgcctcagagacca

SEQ ID NO: 703869 - DNA, 20 bp, Homo sapiens
actgtgcctcagagaccagg

SEQ ID NO: 703870 - DNA, 23 bp, Homo sapiens
actgtgcctcagagaccagggct

SEQ ID NO: 703871 - DNA, 15 bp, Homo sapiens
actgtgcctcaggcc

SEQ ID NO: 703872 - DNA, 14 bp, Homo sapiens
actgtgcctttgca

SEQ ID NO: 703873 - DNA, 22 bp, Homo sapiens
actgtgcgtcttggtgtaattt

SEQ ID NO: 703874 - DNA, 18 bp, Homo sapiens
actgtgctccagcctggg

SEQ ID NO: 703875 - DNA, 20 bp, Homo sapiens
actgtgctccagcctgggca

SEQ ID NO: 703876 - DNA, 16 bp, Homo sapiens
actgtgctgtgcagct

SEQ ID NO: 703877 - DNA, 20 bp, Homo sapiens
actgtggaaggcctccctct

SEQ ID NO: 703878 - DNA, 21 bp, Homo sapiens
cacccaggggaaggccctgag

SEQ ID NO: 703879 - DNA, 22 bp, Homo sapiens
cacccaggtcccccgactgcct

SEQ ID NO: 703880 - DNA, 21 bp, Homo sapiens
cacccaggtctcttcctttgc

SEQ ID NO: 703881 - DNA, 15 bp, Homo sapiens
cacccagtgctgcca

SEQ ID NO: 703882 - DNA, 17 bp, Homo sapiens
cacccagtgctgccatg

SEQ ID NO: 703883 - DNA, 22 bp, Homo sapiens
cacccagtgctgccatgccact

SEQ ID NO: 703884 - DNA, 23 bp, Homo sapiens
cacccagttggtgactgggaaag

SEQ ID NO: 703885 - DNA, 22 bp, Homo sapiens
cacccatgaagacaggacagtg

SEQ ID NO: 703886 - DNA, 15 bp, Homo sapiens
cacccatggggagga

SEQ ID NO: 703887 - DNA, 18 bp, Homo sapiens
cacccatggggaggagac

SEQ ID NO: 703888 - DNA, 14 bp, Homo sapiens
cacccattcttccc

SEQ ID NO: 703889 - DNA, 17 bp, Homo sapiens
caccccaaaccccagcc

SEQ ID NO: 703890 - DNA, 19 bp, Homo sapiens
caccccaaagctttcctgc

SEQ ID NO: 703891 - DNA, 22 bp, Homo sapiens
caccccaactctccccagtgcc

SEQ ID NO: 703892 - DNA, 21 bp, Homo sapiens
caccccaacttggcagctttt

SEQ ID NO: 703893 - DNA, 23 bp, Homo sapiens
caccccaatccctgccactgggc

SEQ ID NO: 703894 - DNA, 12 bp, Homo sapiens
caccccacactt

SEQ ID NO: 703895 - DNA, 15 bp, Homo sapiens
caccccacagaacct

SEQ ID NO: 703896 - DNA, 16 bp, Homo sapiens
caccccacagaacctt

SEQ ID NO: 703897 - DNA, 16 bp, Homo sapiens
caccccaccccacccc

SEQ ID NO: 703898 - DNA, 14 bp, Homo sapiens
caccccacccttcc

SEQ ID NO: 703899 - DNA, 17 bp, Homo sapiens
caccccactgggagagc

SEQ ID NO: 703900 - DNA, 17 bp, Homo sapiens
caccccacttcccatct

SEQ ID NO: 703901 - DNA, 16 bp, Homo sapiens
caccccagaaatcact

SEQ ID NO: 703902 - DNA, 19 bp, Homo sapiens
caccccagaaatcactgtg

SEQ ID NO: 703903 - DNA, 13 bp, Homo sapiens
caccccagaggac

SEQ ID NO: 703904 - DNA, 19 bp, Homo sapiens
caccccagaggacacaggc

SEQ ID NO: 703905 - DNA, 22 bp, Homo sapiens
caccccagaggacacaggcagc

SEQ ID NO: 703906 - DNA, 15 bp, Homo sapiens
caccccagcacagcc

SEQ ID NO: 703907 - DNA, 17 bp, Homo sapiens
caccccagcacagccac

SEQ ID NO: 703908 - DNA, 13 bp, Homo sapiens
caccccagcattc

SEQ ID NO: 703909 - DNA, 20 bp, Homo sapiens
caccccagcattccagctct

SEQ ID NO: 703910 - DNA, 18 bp, Homo sapiens
caccccagcccaccctgc

SEQ ID NO: 703911 - DNA, 11 bp, Homo sapiens
caccccagcct

SEQ ID NO: 703912 - DNA, 19 bp, Homo sapiens
caccccagcgtcaggccta

SEQ ID NO: 703913 - DNA, 19 bp, Homo sapiens
caccccagctaccccttct

SEQ ID NO: 703914 - DNA, 24 bp, Homo sapiens
caccccagtgcggacccttcccag

SEQ ID NO: 703915 - DNA, 21 bp, Homo sapiens
caccccataataaccctgcca

SEQ ID NO: 703916 - DNA, 22 bp, Homo sapiens
caccccataataaccctgccag

SEQ ID NO: 703917 - DNA, 12 bp, Homo sapiens
caccccatccca

SEQ ID NO: 703918 - DNA, 17 bp, Homo sapiens
caccccattttctgtgg

SEQ ID NO: 703919 - DNA, 17 bp, Homo sapiens
cacccccaaacacaaaa

SEQ ID NO: 703920 - DNA, 16 bp, Homo sapiens
cacccccaacccccag

SEQ ID NO: 703921 - DNA, 17 bp, Homo sapiens
cacccccaccatgcagc

SEQ ID NO: 703922 - DNA, 11 bp, Homo sapiens
cacccccaccc

SEQ ID NO: 703923 - DNA, 13 bp, Homo sapiens
cacccccacttcc

SEQ ID NO: 703924 - DNA, 13 bp, Homo sapiens
cacccccagccag

SEQ ID NO: 703925 - DNA, 14 bp, Homo sapiens
cacccccagccagg

SEQ ID NO: 703926 - DNA, 13 bp, Homo sapiens
cacccccagctca

SEQ ID NO: 703927 - DNA, 11 bp, Homo sapiens
cacccccaggc

SEQ ID NO: 703928 - DNA, 12 bp, Homo sapiens
cacccccaggcc

SEQ ID NO: 703929 - DNA, 16 bp, Homo sapiens
cacccccaggcctcct

SEQ ID NO: 703930 - DNA, 19 bp, Homo sapiens
cacccccaggcctcctagg

SEQ ID NO: 703931 - DNA, 18 bp, Homo sapiens
cacccccaggtcttcctg

SEQ ID NO: 703932 - DNA, 13 bp, Homo sapiens
cacccccaggtgc

SEQ ID NO: 703933 - DNA, 14 bp, Homo sapiens
cacccccaggtgca

SEQ ID NO: 703934 - DNA, 22 bp, Homo sapiens
cacccccaggtgcagccccagg

SEQ ID NO: 703935 - DNA, 19 bp, Homo sapiens
cacccccagtctccaggga

SEQ ID NO: 703936 - DNA, 12 bp, Homo sapiens
cacccccagttc

SEQ ID NO: 703937 - DNA, 17 bp, Homo sapiens
cacccccatctctccct

SEQ ID NO: 703938 - DNA, 17 bp, Homo sapiens
cacccccatgctgcctt

SEQ ID NO: 703939 - DNA, 12 bp, Homo sapiens
caccccccactc

SEQ ID NO: 703940 - DNA, 13 bp, Homo sapiens
cacccccccaacc

SEQ ID NO: 703941 - DNA, 12 bp, Homo sapiens
cacccccctcat

SEQ ID NO: 703942 - DNA, 12 bp, Homo sapiens
cacccccctcct

SEQ ID NO: 703943 - DNA, 15 bp, Homo sapiens
cacccccctcctccc

SEQ ID NO: 703944 - DNA, 16 bp, Homo sapiens
cacccccctcctcccc

SEQ ID NO: 703945 - DNA, 18 bp, Homo sapiens
cacccccctctctttctc

SEQ ID NO: 703946 - DNA, 16 bp, Homo sapiens
cacccccgacggcctc

SEQ ID NO: 703947 - DNA, 23 bp, Homo sapiens
cacccccgacggcctccaggagg

SEQ ID NO: 703948 - DNA, 14 bp, Homo sapiens
cacccccgctggag

SEQ ID NO: 703949 - DNA, 23 bp, Homo sapiens
cacccccgctttggttcttcaga

SEQ ID NO: 703950 - DNA, 14 bp, Homo sapiens
cacccccgggatcc

SEQ ID NO: 703951 - DNA, 12 bp, Homo sapiens
caccccctcatt

SEQ ID NO: 703952 - DNA, 19 bp, Homo sapiens
caccccctcccacccccag

SEQ ID NO: 703953 - DNA, 14 bp, Homo sapiens
caccccctccccag

SEQ ID NO: 703954 - DNA, 18 bp, Homo sapiens
caccccctccccagggga

SEQ ID NO: 703955 - DNA, 13 bp, Homo sapiens
caccccctccctg

SEQ ID NO: 703956 - DNA, 18 bp, Homo sapiens
caccccctcctcccccag

SEQ ID NO: 703957 - DNA, 16 bp, Homo sapiens
caccccctcctggcaa

SEQ ID NO: 703958 - DNA, 20 bp, Homo sapiens
caccccctcctggcaatcaa

SEQ ID NO: 703959 - DNA, 16 bp, Homo sapiens
caccccctgttccctg

SEQ ID NO: 703960 - DNA, 17 bp, Homo sapiens
caccccctgttccctgt

SEQ ID NO: 703961 - DNA, 18 bp, Homo sapiens
caccccctgttccctgtt

SEQ ID NO: 703962 - DNA, 17 bp, Homo sapiens
cacccccttcagtgccc

SEQ ID NO: 703963 - DNA, 16 bp, Homo sapiens
cacccccttctctgct

SEQ ID NO: 703964 - DNA, 22 bp, Homo sapiens
cacccccttctctgctccacca

SEQ ID NO: 703965 - DNA, 23 bp, Homo sapiens
caccccgaaatcagcccccagcc

SEQ ID NO: 703966 - DNA, 21 bp, Homo sapiens
caccccgaagggagcatctgt

SEQ ID NO: 703967 - DNA, 18 bp, Homo sapiens
caccccgccgttccctgc

SEQ ID NO: 703968 - DNA, 19 bp, Homo sapiens
caccccgccgttccctgcg

SEQ ID NO: 703969 - DNA, 21 bp, Homo sapiens
caccccgccgttccctgcgct

SEQ ID NO: 703970 - DNA, 16 bp, Homo sapiens
caccccgcctgccctc

SEQ ID NO: 703971 - DNA, 22 bp, Homo sapiens
caccccgcttttgcagcagagg

SEQ ID NO: 703972 - DNA, 12 bp, Homo sapiens
caccccggcctc

SEQ ID NO: 703973 - DNA, 17 bp, Homo sapiens
cacccctaaactccagg

SEQ ID NO: 703974 - DNA, 12 bp, Homo sapiens
cacccctaccac

SEQ ID NO: 703975 - DNA, 17 bp, Homo sapiens
cacccctacccctggct

SEQ ID NO: 703976 - DNA, 24 bp, Homo sapiens
cacccctacccctggctgtactgc

SEQ ID NO: 703977 - DNA, 17 bp, Homo sapiens
cacccctcactccccag

SEQ ID NO: 703978 - DNA, 19 bp, Homo sapiens
cacccctcactccccaggg

SEQ ID NO: 703979 - DNA, 18 bp, Homo sapiens
cacccctccctgcttgca

SEQ ID NO: 703980 - DNA, 18 bp, Homo sapiens
cacccctcgccacctttc

SEQ ID NO: 703981 - DNA, 18 bp, Homo sapiens
cacccctcttctgctcct

SEQ ID NO: 703982 - DNA, 11 bp, Homo sapiens
cacccctgcac

SEQ ID NO: 703983 - DNA, 13 bp, Homo sapiens
cacccctgcacag

SEQ ID NO: 703984 - DNA, 15 bp, Homo sapiens
cacccctgccactca

SEQ ID NO: 703985 - DNA, 13 bp, Homo sapiens
cacccctgccccc

SEQ ID NO: 703986 - DNA, 22 bp, Homo sapiens
cacccctgcctcccatgcctgg

SEQ ID NO: 703987 - DNA, 15 bp, Homo sapiens
cacccctggaaccag

SEQ ID NO: 703988 - DNA, 19 bp, Homo sapiens
cacccctggaagagcccag

SEQ ID NO: 703989 - DNA, 13 bp, Homo sapiens
cacccctgggcag

SEQ ID NO: 703990 - DNA, 18 bp, Homo sapiens
cacccctgggcaggcggt

SEQ ID NO: 703991 - DNA, 12 bp, Homo sapiens
cacccctgggcc

SEQ ID NO: 703992 - DNA, 12 bp, Homo sapiens
cacccctggggg

SEQ ID NO: 703993 - DNA, 17 bp, Homo sapiens
cacccctgtcccaccca

SEQ ID NO: 703994 - DNA, 12 bp, Homo sapiens
cacccctgtgct

SEQ ID NO: 703995 - DNA, 17 bp, Homo sapiens
cacccctgtgctccgtg

SEQ ID NO: 703996 - DNA, 22 bp, Homo sapiens
cacccctgtgctccgtgcctcc

SEQ ID NO: 703997 - DNA, 17 bp, Homo sapiens
caccccttatccaggac

SEQ ID NO: 703998 - DNA, 18 bp, Homo sapiens
caccccttatccaggact

SEQ ID NO: 703999 - DNA, 19 bp, Homo sapiens
caccccttatccaggactc

SEQ ID NO: 704000 - DNA, 21 bp, Homo sapiens
caccccttcataccgcctcgt

SEQ ID NO: 704001 - DNA, 11 bp, Homo sapiens
caccccttccc

SEQ ID NO: 704002 - DNA, 18 bp, Homo sapiens
caccccttccccactgcc

SEQ ID NO: 704003 - DNA, 13 bp, Homo sapiens
caccccttcctgt

SEQ ID NO: 704004 - DNA, 17 bp, Homo sapiens
actgtggaatataaata

SEQ ID NO: 704005 - DNA, 18 bp, Homo sapiens
actgtggagatgctgtgg

SEQ ID NO: 704006 - DNA, 16 bp, Homo sapiens
actgtggcaactgaga

SEQ ID NO: 704007 - DNA, 17 bp, Homo sapiens
actgtggccacagcccc

SEQ ID NO: 704008 - DNA, 22 bp, Homo sapiens
actgtggccagagctggaaggc

SEQ ID NO: 704009 - DNA, 17 bp, Homo sapiens
actgtggccgttatctg

SEQ ID NO: 704010 - DNA, 20 bp, Homo sapiens
actgtggccgttatctggaa

SEQ ID NO: 704011 - DNA, 14 bp, Homo sapiens
actgtggggagaga

SEQ ID NO: 704012 - DNA, 16 bp, Homo sapiens
actgtggggagagatg

SEQ ID NO: 704013 - DNA, 14 bp, Homo sapiens
actgtgggtgggga

SEQ ID NO: 704014 - DNA, 22 bp, Homo sapiens
actgtgggtggggaggccctgc

SEQ ID NO: 704015 - DNA, 18 bp, Homo sapiens
actgtggtaggggcaggg

SEQ ID NO: 704016 - DNA, 19 bp, Homo sapiens
actgtggtaggggcaggga

SEQ ID NO: 704017 - DNA, 17 bp, Homo sapiens
actgtgtaaatatatgt

SEQ ID NO: 704018 - DNA, 19 bp, Homo sapiens
actgtgtatcattaaaata

SEQ ID NO: 704019 - DNA, 16 bp, Homo sapiens
actgtgtatgtacata

SEQ ID NO: 704020 - DNA, 23 bp, Homo sapiens
actgtgtcacagtttcaggcttt

SEQ ID NO: 704021 - DNA, 16 bp, Homo sapiens
actgtgtcctggtgct

SEQ ID NO: 704022 - DNA, 21 bp, Homo sapiens
actgtgtcctggtgctctctg

SEQ ID NO: 704023 - DNA, 22 bp, Homo sapiens
actgtgtgaggctgtgtctctg

SEQ ID NO: 704024 - DNA, 17 bp, Homo sapiens
actgtgtggactgtgat

SEQ ID NO: 704025 - DNA, 20 bp, Homo sapiens
actgtgtgggatacttagtg

SEQ ID NO: 704026 - DNA, 16 bp, Homo sapiens
actgtgtgtaattgtt

SEQ ID NO: 704027 - DNA, 17 bp, Homo sapiens
actgtgtgtaattgttc

SEQ ID NO: 704028 - DNA, 18 bp, Homo sapiens
actgtgtgttgacactgt

SEQ ID NO: 704029 - DNA, 21 bp, Homo sapiens
actgtgtgttgacactgtttt

SEQ ID NO: 704030 - DNA, 15 bp, Homo sapiens
actgtgttcctggca

SEQ ID NO: 704031 - DNA, 15 bp, Homo sapiens
actgtgttgtattaa

SEQ ID NO: 704032 - DNA, 21 bp, Homo sapiens
actgtgttgtattaacaaaag

SEQ ID NO: 704033 - DNA, 22 bp, Homo sapiens
actgtgtttcgcattaagcaca

SEQ ID NO: 704034 - DNA, 16 bp, Homo sapiens
actgttaacttattca

SEQ ID NO: 704035 - DNA, 22 bp, Homo sapiens
actgttaatacacagtacttta

SEQ ID NO: 704036 - DNA, 20 bp, Homo sapiens
actgttacagtaatgtcata

SEQ ID NO: 704037 - DNA, 17 bp, Homo sapiens
actgttagcactgttga

SEQ ID NO: 704038 - DNA, 18 bp, Homo sapiens
actgttagcactgttgat

SEQ ID NO: 704039 - DNA, 15 bp, Homo sapiens
actgttcacactgca

SEQ ID NO: 704040 - DNA, 15 bp, Homo sapiens
actgttccccctgtg

SEQ ID NO: 704041 - DNA, 16 bp, Homo sapiens
actgttccccctgtgc

SEQ ID NO: 704042 - DNA, 22 bp, Homo sapiens
actgttccctctgctcctggag

SEQ ID NO: 704043 - DNA, 21 bp, Homo sapiens
actgttccttatttctctctc

SEQ ID NO: 704044 - DNA, 24 bp, Homo sapiens
actgttccttatttctctctcctg

SEQ ID NO: 704045 - DNA, 16 bp, Homo sapiens
actgttcctttcagat

SEQ ID NO: 704046 - DNA, 23 bp, Homo sapiens
actgttcggaaggggttcctcaa

SEQ ID NO: 704047 - DNA, 23 bp, Homo sapiens
actgttctctttaaaatatttgt

SEQ ID NO: 704048 - DNA, 13 bp, Homo sapiens
actgttctgcaaa

SEQ ID NO: 704049 - DNA, 15 bp, Homo sapiens
actgttcttttgcaa

SEQ ID NO: 704050 - DNA, 14 bp, Homo sapiens
actgttgagttctg

SEQ ID NO: 704051 - DNA, 15 bp, Homo sapiens
actgttgataaaaac

SEQ ID NO: 704052 - DNA, 21 bp, Homo sapiens
actgttgatacaaaccactgt

SEQ ID NO: 704053 - DNA, 16 bp, Homo sapiens
actgttgatgaagtat

SEQ ID NO: 704054 - DNA, 13 bp, Homo sapiens
actgttgatgtat

SEQ ID NO: 704055 - DNA, 21 bp, Homo sapiens
actgttgcatttacttttaat

SEQ ID NO: 704056 - DNA, 14 bp, Homo sapiens
actgttgcccccca

SEQ ID NO: 704057 - DNA, 14 bp, Homo sapiens
actgttgcctttta

SEQ ID NO: 704058 - DNA, 19 bp, Homo sapiens
actgttgctgactactact

SEQ ID NO: 704059 - DNA, 15 bp, Homo sapiens
actgttgctttaata

SEQ ID NO: 704060 - DNA, 17 bp, Homo sapiens
actgttgctttaatatg

SEQ ID NO: 704061 - DNA, 14 bp, Homo sapiens
actgttggcactta

SEQ ID NO: 704062 - DNA, 16 bp, Homo sapiens
actgttggctctctga

SEQ ID NO: 704063 - DNA, 19 bp, Homo sapiens
actgttgtagaagacaaaa

SEQ ID NO: 704064 - DNA, 21 bp, Homo sapiens
actgttgtagcattttcctgt

SEQ ID NO: 704065 - DNA, 23 bp, Homo sapiens
actgttgtagcattttcctgttt

SEQ ID NO: 704066 - DNA, 24 bp, Homo sapiens
actgttgtagcattttcctgttta

SEQ ID NO: 704067 - DNA, 12 bp, Homo sapiens
actgttgtataa

SEQ ID NO: 704068 - DNA, 13 bp, Homo sapiens
actgttgtataaa

SEQ ID NO: 704069 - DNA, 19 bp, Homo sapiens
actgttgtataaatttatt

SEQ ID NO: 704070 - DNA, 18 bp, Homo sapiens
actgttgttttgtatgag

SEQ ID NO: 704071 - DNA, 13 bp, Homo sapiens
actgtttacagtt

SEQ ID NO: 704072 - DNA, 18 bp, Homo sapiens
actgtttatacactgtgt

SEQ ID NO: 704073 - DNA, 13 bp, Homo sapiens
actgtttcaaact

SEQ ID NO: 704074 - DNA, 15 bp, Homo sapiens
actgtttcactgaaa

SEQ ID NO: 704075 - DNA, 20 bp, Homo sapiens
actgtttcactgaaatgttt

SEQ ID NO: 704076 - DNA, 22 bp, Homo sapiens
actgtttcagtgtgagtcagaa

SEQ ID NO: 704077 - DNA, 19 bp, Homo sapiens
actgtttcattcactgtgc

SEQ ID NO: 704078 - DNA, 20 bp, Homo sapiens
actgtttcattcactgtgca

SEQ ID NO: 704079 - DNA, 17 bp, Homo sapiens
actgtttctcttgagct

SEQ ID NO: 704080 - DNA, 20 bp, Homo sapiens
actgtttctcttgagctggc

SEQ ID NO: 704081 - DNA, 21 bp, Homo sapiens
actgtttctcttgagctggcc

SEQ ID NO: 704082 - DNA, 15 bp, Homo sapiens
actgtttcttgcact

SEQ ID NO: 704083 - DNA, 16 bp, Homo sapiens
actgtttcttgcactg

SEQ ID NO: 704084 - DNA, 20 bp, Homo sapiens
actgtttcttgcactgaata

SEQ ID NO: 704085 - DNA, 17 bp, Homo sapiens
actgtttcttttgtaaa

SEQ ID NO: 704086 - DNA, 23 bp, Homo sapiens
actgtttgatataccaaattaaa

SEQ ID NO: 704087 - DNA, 22 bp, Homo sapiens
actgtttggtcgagtctttgtg

SEQ ID NO: 704088 - DNA, 18 bp, Homo sapiens
actgtttgttactatgta

SEQ ID NO: 704089 - DNA, 20 bp, Homo sapiens
actgtttgtttttaaaaagc

SEQ ID NO: 704090 - DNA, 20 bp, Homo sapiens
actgttttaataaaagattt

SEQ ID NO: 704091 - DNA, 16 bp, Homo sapiens
actgttttaattgtag

SEQ ID NO: 704092 - DNA, 14 bp, Homo sapiens
actgttttagaaat

SEQ ID NO: 704093 - DNA, 12 bp, Homo sapiens
actgttttcaat

SEQ ID NO: 704094 - DNA, 20 bp, Homo sapiens
actgttttctttatgtcttt

SEQ ID NO: 704095 - DNA, 15 bp, Homo sapiens
actgttttgggcctc

SEQ ID NO: 704096 - DNA, 18 bp, Homo sapiens
actgtttttaagtaactt

SEQ ID NO: 704097 - DNA, 18 bp, Homo sapiens
actgtttttcggacagtt

SEQ ID NO: 704098 - DNA, 15 bp, Homo sapiens
actgttttttaagtc

SEQ ID NO: 704099 - DNA, 18 bp, Homo sapiens
actgttttttcctgagct

SEQ ID NO: 704100 - DNA, 15 bp, Homo sapiens
acttaaaaaaatgac

SEQ ID NO: 704101 - DNA, 19 bp, Homo sapiens
acttaaaaatgtaaatatt

SEQ ID NO: 704102 - DNA, 12 bp, Homo sapiens
acttaaaagtat

SEQ ID NO: 704103 - DNA, 18 bp, Homo sapiens
acttaaaagtattcatac

SEQ ID NO: 704104 - DNA, 22 bp, Homo sapiens
acttaaaataggggatatttaa

SEQ ID NO: 704105 - DNA, 13 bp, Homo sapiens
acttaaaatgaca

SEQ ID NO: 704106 - DNA, 19 bp, Homo sapiens
acttaaaatgacaaagcca

SEQ ID NO: 704107 - DNA, 20 bp, Homo sapiens
acttaaaatgacaaagccat

SEQ ID NO: 704108 - DNA, 18 bp, Homo sapiens
acttaaagcaaaatagta

SEQ ID NO: 704109 - DNA, 20 bp, Homo sapiens
acttaaaggacaggaggagg

SEQ ID NO: 704110 - DNA, 17 bp, Homo sapiens
acttaaaggctgtggta

SEQ ID NO: 704111 - DNA, 19 bp, Homo sapiens
acttaaagggcccaatgaa

SEQ ID NO: 704112 - DNA, 22 bp, Homo sapiens
acttaaagttgattttgaactt

SEQ ID NO: 704113 - DNA, 11 bp, Homo sapiens
acttaaataaa

SEQ ID NO: 704114 - DNA, 16 bp, Homo sapiens
acttaaataatgtgaa

SEQ ID NO: 704115 - DNA, 23 bp, Homo sapiens
acttaaccctgacaaattttaat

SEQ ID NO: 704116 - DNA, 17 bp, Homo sapiens
acttaacggaccaaagc

SEQ ID NO: 704117 - DNA, 17 bp, Homo sapiens
acttaacggctccagga

SEQ ID NO: 704118 - DNA, 13 bp, Homo sapiens
acttaactgaaat

SEQ ID NO: 704119 - DNA, 13 bp, Homo sapiens
acttaactgaaga

SEQ ID NO: 704120 - DNA, 19 bp, Homo sapiens
acttaagagaatattttaa

SEQ ID NO: 704121 - DNA, 19 bp, Homo sapiens
acttaagcaaaagaaaaag

SEQ ID NO: 704122 - DNA, 21 bp, Homo sapiens
acttaagcatctggctctaat

SEQ ID NO: 704123 - DNA, 16 bp, Homo sapiens
acttaaggaagtttga

SEQ ID NO: 704124 - DNA, 14 bp, Homo sapiens
acttaaggaccttt

SEQ ID NO: 704125 - DNA, 19 bp, Homo sapiens
acttaaggggccaaggcag

SEQ ID NO: 704126 - DNA, 15 bp, Homo sapiens
acttaagtgcacttt

SEQ ID NO: 704127 - DNA, 21 bp, Homo sapiens
acttaagttctttgatttgta

SEQ ID NO: 704128 - DNA, 22 bp, Homo sapiens
caccccttcctgtcccacctct

SEQ ID NO: 704129 - DNA, 22 bp, Homo sapiens
caccccttcgacatgctgccag

SEQ ID NO: 704130 - DNA, 15 bp, Homo sapiens
cacccctttcctccc

SEQ ID NO: 704131 - DNA, 22 bp, Homo sapiens
cacccctttcctccccatacac

SEQ ID NO: 704132 - DNA, 23 bp, Homo sapiens
cacccctttcctccccatacaca

SEQ ID NO: 704133 - DNA, 12 bp, Homo sapiens
cacccctttcta

SEQ ID NO: 704134 - DNA, 21 bp, Homo sapiens
cacccgaagcgcttctgcacc

SEQ ID NO: 704135 - DNA, 16 bp, Homo sapiens
cacccgaagtcctgtc

SEQ ID NO: 704136 - DNA, 20 bp, Homo sapiens
cacccgaagtcctgtcactg

SEQ ID NO: 704137 - DNA, 23 bp, Homo sapiens
cacccgaagtcctgtcactgagc

SEQ ID NO: 704138 - DNA, 14 bp, Homo sapiens
cacccgacttcttt

SEQ ID NO: 704139 - DNA, 15 bp, Homo sapiens
cacccgagtacctcc

SEQ ID NO: 704140 - DNA, 17 bp, Homo sapiens
cacccgagtacctccag

SEQ ID NO: 704141 - DNA, 18 bp, Homo sapiens
cacccgagttcctctggg

SEQ ID NO: 704142 - DNA, 14 bp, Homo sapiens
cacccgatgctgct

SEQ ID NO: 704143 - DNA, 18 bp, Homo sapiens
cacccgcccctggacttc

SEQ ID NO: 704144 - DNA, 14 bp, Homo sapiens
cacccgcctctccc

SEQ ID NO: 704145 - DNA, 14 bp, Homo sapiens
cacccggccacagc

SEQ ID NO: 704146 - DNA, 16 bp, Homo sapiens
cacccggccacagctg

SEQ ID NO: 704147 - DNA, 18 bp, Homo sapiens
cacccgggggagcccagt

SEQ ID NO: 704148 - DNA, 19 bp, Homo sapiens
cacccgggggagcccagtg

SEQ ID NO: 704149 - DNA, 16 bp, Homo sapiens
cacccgtaggcagcct

SEQ ID NO: 704150 - DNA, 15 bp, Homo sapiens
cacccgtcctccctc

SEQ ID NO: 704151 - DNA, 17 bp, Homo sapiens
cacccgtcctccctcag

SEQ ID NO: 704152 - DNA, 20 bp, Homo sapiens
cacccgtcttcaatctctgt

SEQ ID NO: 704153 - DNA, 22 bp, Homo sapiens
cacccgtcttcaatctctgttc

SEQ ID NO: 704154 - DNA, 16 bp, Homo sapiens
cacccgtggagatggg

SEQ ID NO: 704155 - DNA, 17 bp, Homo sapiens
cacccgtggagatggga

SEQ ID NO: 704156 - DNA, 19 bp, Homo sapiens
cacccgtggggtgctgccc

SEQ ID NO: 704157 - DNA, 15 bp, Homo sapiens
caccctaagggcagc

SEQ ID NO: 704158 - DNA, 16 bp, Homo sapiens
caccctaagggcagcc

SEQ ID NO: 704159 - DNA, 18 bp, Homo sapiens
caccctaagggcagccct

SEQ ID NO: 704160 - DNA, 20 bp, Homo sapiens
caccctaagggcagccctcc

SEQ ID NO: 704161 - DNA, 16 bp, Homo sapiens
caccctacctgtgcct

SEQ ID NO: 704162 - DNA, 20 bp, Homo sapiens
caccctacgctcatctctgg

SEQ ID NO: 704163 - DNA, 18 bp, Homo sapiens
caccctagtcccttcccc

SEQ ID NO: 704164 - DNA, 16 bp, Homo sapiens
caccctagtttccctg

SEQ ID NO: 704165 - DNA, 17 bp, Homo sapiens
caccctagtttccctga

SEQ ID NO: 704166 - DNA, 18 bp, Homo sapiens
caccctcaacctcttctg

SEQ ID NO: 704167 - DNA, 20 bp, Homo sapiens
caccctcacacacacagctg

SEQ ID NO: 704168 - DNA, 23 bp, Homo sapiens
caccctcacacacacagctgggc

SEQ ID NO: 704169 - DNA, 19 bp, Homo sapiens
caccctcaccccctcctgg

SEQ ID NO: 704170 - DNA, 21 bp, Homo sapiens
caccctcaccccctcctggca

SEQ ID NO: 704171 - DNA, 17 bp, Homo sapiens
caccctcagcacccctt

SEQ ID NO: 704172 - DNA, 20 bp, Homo sapiens
caccctcagcaccccttcca

SEQ ID NO: 704173 - DNA, 21 bp, Homo sapiens
caccctcagcaccccttccat

SEQ ID NO: 704174 - DNA, 18 bp, Homo sapiens
caccctcagggagcctcc

SEQ ID NO: 704175 - DNA, 13 bp, Homo sapiens
caccctcaggtgc

SEQ ID NO: 704176 - DNA, 17 bp, Homo sapiens
caccctcaggtgcctcc

SEQ ID NO: 704177 - DNA, 22 bp, Homo sapiens
caccctccacaaagcaaaggca

SEQ ID NO: 704178 - DNA, 12 bp, Homo sapiens
caccctccaccc

SEQ ID NO: 704179 - DNA, 15 bp, Homo sapiens
caccctccacttccc

SEQ ID NO: 704180 - DNA, 22 bp, Homo sapiens
caccctccatgctcctcacctg

SEQ ID NO: 704181 - DNA, 15 bp, Homo sapiens
caccctcccctctct

SEQ ID NO: 704182 - DNA, 23 bp, Homo sapiens
caccctccctccgatccttcctc

SEQ ID NO: 704183 - DNA, 21 bp, Homo sapiens
caccctcctccctccaagcct

SEQ ID NO: 704184 - DNA, 12 bp, Homo sapiens
caccctcctcta

SEQ ID NO: 704185 - DNA, 14 bp, Homo sapiens
caccctcctcttgg

SEQ ID NO: 704186 - DNA, 14 bp, Homo sapiens
caccctctatccca

SEQ ID NO: 704187 - DNA, 16 bp, Homo sapiens
caccctctatcccaat

SEQ ID NO: 704188 - DNA, 11 bp, Homo sapiens
caccctctggg

SEQ ID NO: 704189 - DNA, 14 bp, Homo sapiens
caccctctgggagt

SEQ ID NO: 704190 - DNA, 12 bp, Homo sapiens
caccctctgggg

SEQ ID NO: 704191 - DNA, 11 bp, Homo sapiens
caccctctgtc

SEQ ID NO: 704192 - DNA, 15 bp, Homo sapiens
caccctcttcctgtg

SEQ ID NO: 704193 - DNA, 23 bp, Homo sapiens
caccctgaatggttccatgcctg

SEQ ID NO: 704194 - DNA, 17 bp, Homo sapiens
caccctgagccccttcc

SEQ ID NO: 704195 - DNA, 19 bp, Homo sapiens
caccctgaggcctctggaa

SEQ ID NO: 704196 - DNA, 15 bp, Homo sapiens
caccctgcacctgct

SEQ ID NO: 704197 - DNA, 18 bp, Homo sapiens
caccctgcacctgctgcg

SEQ ID NO: 704198 - DNA, 11 bp, Homo sapiens
caccctgcaga

SEQ ID NO: 704199 - DNA, 15 bp, Homo sapiens
caccctgcccacccc

SEQ ID NO: 704200 - DNA, 17 bp, Homo sapiens
caccctgcccacccccg

SEQ ID NO: 704201 - DNA, 17 bp, Homo sapiens
caccctgcccgctccca

SEQ ID NO: 704202 - DNA, 14 bp, Homo sapiens
caccctgcctgcac

SEQ ID NO: 704203 - DNA, 14 bp, Homo sapiens
caccctgcgcctcc

SEQ ID NO: 704204 - DNA, 15 bp, Homo sapiens
caccctgcgcctcca

SEQ ID NO: 704205 - DNA, 20 bp, Homo sapiens
caccctgcgcctccagaggt

SEQ ID NO: 704206 - DNA, 21 bp, Homo sapiens
caccctgctcctcctgccctg

SEQ ID NO: 704207 - DNA, 12 bp, Homo sapiens
caccctgctgca

SEQ ID NO: 704208 - DNA, 18 bp, Homo sapiens
caccctgctgcactagga

SEQ ID NO: 704209 - DNA, 12 bp, Homo sapiens
caccctgcttct

SEQ ID NO: 704210 - DNA, 18 bp, Homo sapiens
caccctgcttctcccggg

SEQ ID NO: 704211 - DNA, 11 bp, Homo sapiens
caccctggcct

SEQ ID NO: 704212 - DNA, 19 bp, Homo sapiens
caccctggcctagaccagc

SEQ ID NO: 704213 - DNA, 15 bp, Homo sapiens
caccctgggagccag

SEQ ID NO: 704214 - DNA, 22 bp, Homo sapiens
caccctgggcagtgagtgccat

SEQ ID NO: 704215 - DNA, 14 bp, Homo sapiens
caccctgggccctg

SEQ ID NO: 704216 - DNA, 19 bp, Homo sapiens
caccctggggcctggacct

SEQ ID NO: 704217 - DNA, 20 bp, Homo sapiens
caccctggggcctggacctg

SEQ ID NO: 704218 - DNA, 21 bp, Homo sapiens
caccctggggcctggacctgc

SEQ ID NO: 704219 - DNA, 14 bp, Homo sapiens
caccctgggtgcca

SEQ ID NO: 704220 - DNA, 17 bp, Homo sapiens
caccctgggtgccattc

SEQ ID NO: 704221 - DNA, 17 bp, Homo sapiens
caccctggtctgtggag

SEQ ID NO: 704222 - DNA, 15 bp, Homo sapiens
caccctgtcccccag

SEQ ID NO: 704223 - DNA, 19 bp, Homo sapiens
caccctgtcccccagctct

SEQ ID NO: 704224 - DNA, 20 bp, Homo sapiens
caccctgtcccccagctctg

SEQ ID NO: 704225 - DNA, 22 bp, Homo sapiens
caccctgtcccccagctctggt

SEQ ID NO: 704226 - DNA, 19 bp, Homo sapiens
caccctgtgaccctctcac

SEQ ID NO: 704227 - DNA, 19 bp, Homo sapiens
caccctgtgggaccgcctg

SEQ ID NO: 704228 - DNA, 21 bp, Homo sapiens
caccctgtgggaccgcctggc

SEQ ID NO: 704229 - DNA, 12 bp, Homo sapiens
caccctgtgggt

SEQ ID NO: 704230 - DNA, 14 bp, Homo sapiens
caccctgtgggtgt

SEQ ID NO: 704231 - DNA, 20 bp, Homo sapiens
caccctgtgggtgtctccct

SEQ ID NO: 704232 - DNA, 17 bp, Homo sapiens
cacccttaacccaagga

SEQ ID NO: 704233 - DNA, 14 bp, Homo sapiens
cacccttacttcct

SEQ ID NO: 704234 - DNA, 15 bp, Homo sapiens
cacccttagaaaatg

SEQ ID NO: 704235 - DNA, 19 bp, Homo sapiens
cacccttagaaaatgtgtc

SEQ ID NO: 704236 - DNA, 13 bp, Homo sapiens
cacccttccatca

SEQ ID NO: 704237 - DNA, 15 bp, Homo sapiens
cacccttccatcagc

SEQ ID NO: 704238 - DNA, 13 bp, Homo sapiens
cacccttcccctc

SEQ ID NO: 704239 - DNA, 14 bp, Homo sapiens
cacccttcccctcc

SEQ ID NO: 704240 - DNA, 23 bp, Homo sapiens
cacccttcccctccttctccctt

SEQ ID NO: 704241 - DNA, 15 bp, Homo sapiens
cacccttcctggccc

SEQ ID NO: 704242 - DNA, 19 bp, Homo sapiens
cacccttcctggcccaggc

SEQ ID NO: 704243 - DNA, 22 bp, Homo sapiens
cacccttcctggcccaggcctt

SEQ ID NO: 704244 - DNA, 12 bp, Homo sapiens
cacccttctggg

SEQ ID NO: 704245 - DNA, 21 bp, Homo sapiens
cacccttctttcctcttcccc

SEQ ID NO: 704246 - DNA, 16 bp, Homo sapiens
cacccttcttttctca

SEQ ID NO: 704247 - DNA, 14 bp, Homo sapiens
cacccttgcaccgt

SEQ ID NO: 704248 - DNA, 15 bp, Homo sapiens
cacccttggcctgtc

SEQ ID NO: 704249 - DNA, 19 bp, Homo sapiens
caccctttcatagagaggc

SEQ ID NO: 704250 - DNA, 15 bp, Homo sapiens
cacccttttccagct

SEQ ID NO: 704251 - DNA, 17 bp, Homo sapiens
caccgaccaactgccct

SEQ ID NO: 704252 - DNA, 19 bp, Homo sapiens
caccgacccgaggcccaga

SEQ ID NO: 704253 - DNA, 17 bp, Homo sapiens
acttaataaattcagat

SEQ ID NO: 704254 - DNA, 13 bp, Homo sapiens
acttaataactgt

SEQ ID NO: 704255 - DNA, 21 bp, Homo sapiens
acttaatactaccttgaaaat

SEQ ID NO: 704256 - DNA, 18 bp, Homo sapiens
acttaatcctttaactct

SEQ ID NO: 704257 - DNA, 13 bp, Homo sapiens
acttaatctaaat

SEQ ID NO: 704258 - DNA, 22 bp, Homo sapiens
acttaatctaaatggaaccact

SEQ ID NO: 704259 - DNA, 14 bp, Homo sapiens
acttaatgtaattc

SEQ ID NO: 704260 - DNA, 13 bp, Homo sapiens
acttaatgtatgt

SEQ ID NO: 704261 - DNA, 15 bp, Homo sapiens
acttaatgtatgtta

SEQ ID NO: 704262 - DNA, 16 bp, Homo sapiens
acttaatgtatgttac

SEQ ID NO: 704263 - DNA, 15 bp, Homo sapiens
acttaatgtttctta

SEQ ID NO: 704264 - DNA, 19 bp, Homo sapiens
acttaattgctacatctaa

SEQ ID NO: 704265 - DNA, 20 bp, Homo sapiens
acttaatttgtaaacttctg

SEQ ID NO: 704266 - DNA, 21 bp, Homo sapiens
acttaatttgtaaacttctga

SEQ ID NO: 704267 - DNA, 14 bp, Homo sapiens
acttacaaaatgcc

SEQ ID NO: 704268 - DNA, 16 bp, Homo sapiens
acttacaaaatgccaa

SEQ ID NO: 704269 - DNA, 20 bp, Homo sapiens
acttacaagtggtgaccaaa

SEQ ID NO: 704270 - DNA, 15 bp, Homo sapiens
acttacacttggagc

SEQ ID NO: 704271 - DNA, 16 bp, Homo sapiens
acttacactttatgca

SEQ ID NO: 704272 - DNA, 17 bp, Homo sapiens
acttacagctctggcca

SEQ ID NO: 704273 - DNA, 15 bp, Homo sapiens
acttacataaagctc

SEQ ID NO: 704274 - DNA, 14 bp, Homo sapiens
acttacatttgtac

SEQ ID NO: 704275 - DNA, 15 bp, Homo sapiens
acttacatttgtact

SEQ ID NO: 704276 - DNA, 23 bp, Homo sapiens
acttaccaattgatgttttacgt

SEQ ID NO: 704277 - DNA, 19 bp, Homo sapiens
acttacctaaacagatata

SEQ ID NO: 704278 - DNA, 14 bp, Homo sapiens
acttactgtacatg

SEQ ID NO: 704279 - DNA, 14 bp, Homo sapiens
acttactgtatatg

SEQ ID NO: 704280 - DNA, 15 bp, Homo sapiens
acttactgtatatgt

SEQ ID NO: 704281 - DNA, 16 bp, Homo sapiens
acttactgtatatgta

SEQ ID NO: 704282 - DNA, 16 bp, Homo sapiens
acttacttgcttattt

SEQ ID NO: 704283 - DNA, 15 bp, Homo sapiens
acttacttttgtaaa

SEQ ID NO: 704284 - DNA, 12 bp, Homo sapiens
acttagaaggat

SEQ ID NO: 704285 - DNA, 13 bp, Homo sapiens
acttagaatgcca

SEQ ID NO: 704286 - DNA, 14 bp, Homo sapiens
acttagaatgccat

SEQ ID NO: 704287 - DNA, 15 bp, Homo sapiens
acttagaatgccata

SEQ ID NO: 704288 - DNA, 21 bp, Homo sapiens
acttagaggaaataagaaaaa

SEQ ID NO: 704289 - DNA, 17 bp, Homo sapiens
acttagagtttctgttt

SEQ ID NO: 704290 - DNA, 20 bp, Homo sapiens
acttagagtttctgtttgat

SEQ ID NO: 704291 - DNA, 17 bp, Homo sapiens
acttagatgttaaatgt

SEQ ID NO: 704292 - DNA, 19 bp, Homo sapiens
acttagatgttaaatgtta

SEQ ID NO: 704293 - DNA, 16 bp, Homo sapiens
acttagcaagacctga

SEQ ID NO: 704294 - DNA, 22 bp, Homo sapiens
acttagcccaagaggtctgagc

SEQ ID NO: 704295 - DNA, 21 bp, Homo sapiens
acttagcgtcaagacatttgc

SEQ ID NO: 704296 - DNA, 23 bp, Homo sapiens
acttagcgtcaagacatttgctg

SEQ ID NO: 704297 - DNA, 16 bp, Homo sapiens
acttagctagttttat

SEQ ID NO: 704298 - DNA, 16 bp, Homo sapiens
acttagctatcagaag

SEQ ID NO: 704299 - DNA, 15 bp, Homo sapiens
acttagctgtactat

SEQ ID NO: 704300 - DNA, 16 bp, Homo sapiens
acttagctgtactata

SEQ ID NO: 704301 - DNA, 13 bp, Homo sapiens
acttagctttatt

SEQ ID NO: 704302 - DNA, 21 bp, Homo sapiens
acttaggcatgcacagctgta

SEQ ID NO: 704303 - DNA, 18 bp, Homo sapiens
acttaggccctagcggca

SEQ ID NO: 704304 - DNA, 23 bp, Homo sapiens
acttagggccaagtcttgggtct

SEQ ID NO: 704305 - DNA, 23 bp, Homo sapiens
acttaggtaaaataaaagactat

SEQ ID NO: 704306 - DNA, 22 bp, Homo sapiens
acttaggttattttgctttggt

SEQ ID NO: 704307 - DNA, 16 bp, Homo sapiens
acttagtagtttttac

SEQ ID NO: 704308 - DNA, 14 bp, Homo sapiens
acttagtatgcagt

SEQ ID NO: 704309 - DNA, 20 bp, Homo sapiens
acttagtgatcatttaaaaa

SEQ ID NO: 704310 - DNA, 20 bp, Homo sapiens
acttagtgcggacaagtttt

SEQ ID NO: 704311 - DNA, 19 bp, Homo sapiens
acttagtggtatgtctctt

SEQ ID NO: 704312 - DNA, 16 bp, Homo sapiens
acttagttaaaattga

SEQ ID NO: 704313 - DNA, 18 bp, Homo sapiens
acttataaagaaggttgg

SEQ ID NO: 704314 - DNA, 18 bp, Homo sapiens
acttataaagtagaaatg

SEQ ID NO: 704315 - DNA, 23 bp, Homo sapiens
acttataagtgaagtgatactat

SEQ ID NO: 704316 - DNA, 17 bp, Homo sapiens
acttataattttcctaa

SEQ ID NO: 704317 - DNA, 15 bp, Homo sapiens
acttatactcttgag

SEQ ID NO: 704318 - DNA, 15 bp, Homo sapiens
acttatatcaactta

SEQ ID NO: 704319 - DNA, 18 bp, Homo sapiens
acttatatggaaattctg

SEQ ID NO: 704320 - DNA, 13 bp, Homo sapiens
acttatattgaag

SEQ ID NO: 704321 - DNA, 16 bp, Homo sapiens
acttatattgaagaca

SEQ ID NO: 704322 - DNA, 20 bp, Homo sapiens
acttatattgaagacaattt

SEQ ID NO: 704323 - DNA, 17 bp, Homo sapiens
acttatattgtaagaaa

SEQ ID NO: 704324 - DNA, 19 bp, Homo sapiens
acttatattgtaagaaata

SEQ ID NO: 704325 - DNA, 18 bp, Homo sapiens
acttatattttatgaaca

SEQ ID NO: 704326 - DNA, 17 bp, Homo sapiens
acttatattttgatttt

SEQ ID NO: 704327 - DNA, 16 bp, Homo sapiens
acttatcatttttgta

SEQ ID NO: 704328 - DNA, 18 bp, Homo sapiens
acttatcatttttgtata

SEQ ID NO: 704329 - DNA, 20 bp, Homo sapiens
acttatcatttttgtataaa

SEQ ID NO: 704330 - DNA, 18 bp, Homo sapiens
acttatcctaaaacaaat

SEQ ID NO: 704331 - DNA, 18 bp, Homo sapiens
acttatctagaaagaaaa

SEQ ID NO: 704332 - DNA, 23 bp, Homo sapiens
acttatgacctcttcctttagga

SEQ ID NO: 704333 - DNA, 21 bp, Homo sapiens
acttatgcaagatatttttga

SEQ ID NO: 704334 - DNA, 16 bp, Homo sapiens
acttatgctagtttat

SEQ ID NO: 704335 - DNA, 19 bp, Homo sapiens
acttatgctagtttattgg

SEQ ID NO: 704336 - DNA, 17 bp, Homo sapiens
acttatggacactgcct

SEQ ID NO: 704337 - DNA, 16 bp, Homo sapiens
acttatgtttttaaat

SEQ ID NO: 704338 - DNA, 16 bp, Homo sapiens
acttattactgctaag

SEQ ID NO: 704339 - DNA, 19 bp, Homo sapiens
acttattactgctaagtat

SEQ ID NO: 704340 - DNA, 13 bp, Homo sapiens
acttattagaaac

SEQ ID NO: 704341 - DNA, 14 bp, Homo sapiens
acttattagaaacc

SEQ ID NO: 704342 - DNA, 12 bp, Homo sapiens
acttattattaa

SEQ ID NO: 704343 - DNA, 13 bp, Homo sapiens
acttattcaaaga

SEQ ID NO: 704344 - DNA, 18 bp, Homo sapiens
acttattcatagttttat

SEQ ID NO: 704345 - DNA, 15 bp, Homo sapiens
acttattgaatatat

SEQ ID NO: 704346 - DNA, 20 bp, Homo sapiens
acttattggaactctgcttg

SEQ ID NO: 704347 - DNA, 17 bp, Homo sapiens
acttattgtccaggtga

SEQ ID NO: 704348 - DNA, 18 bp, Homo sapiens
acttatttaaaaatattt

SEQ ID NO: 704349 - DNA, 13 bp, Homo sapiens
acttatttaatgc

SEQ ID NO: 704350 - DNA, 13 bp, Homo sapiens
acttatttatgaa

SEQ ID NO: 704351 - DNA, 14 bp, Homo sapiens
acttatttatgaat

SEQ ID NO: 704352 - DNA, 11 bp, Homo sapiens
acttatttctg

SEQ ID NO: 704353 - DNA, 13 bp, Homo sapiens
acttatttctgct

SEQ ID NO: 704354 - DNA, 15 bp, Homo sapiens
acttattttgtctta

SEQ ID NO: 704355 - DNA, 23 bp, Homo sapiens
acttattttgtcttattcttaag

SEQ ID NO: 704356 - DNA, 19 bp, Homo sapiens
acttatttttgacagtgtt

SEQ ID NO: 704357 - DNA, 18 bp, Homo sapiens
acttcaaagctgaatatt

SEQ ID NO: 704358 - DNA, 19 bp, Homo sapiens
acttcaaagctgaatattt

SEQ ID NO: 704359 - DNA, 19 bp, Homo sapiens
acttcaagcatggctattt

SEQ ID NO: 704360 - DNA, 13 bp, Homo sapiens
acttcaaggccca

SEQ ID NO: 704361 - DNA, 15 bp, Homo sapiens
acttcaatgatagta

SEQ ID NO: 704362 - DNA, 16 bp, Homo sapiens
acttcacacacaggca

SEQ ID NO: 704363 - DNA, 19 bp, Homo sapiens
acttcacacacaggcaact

SEQ ID NO: 704364 - DNA, 18 bp, Homo sapiens
acttcacagctggaccct

SEQ ID NO: 704365 - DNA, 21 bp, Homo sapiens
acttcacagctggaccctgct

SEQ ID NO: 704366 - DNA, 13 bp, Homo sapiens
acttcacaggtga

SEQ ID NO: 704367 - DNA, 17 bp, Homo sapiens
acttcacataggaaggg

SEQ ID NO: 704368 - DNA, 14 bp, Homo sapiens
acttcaccaccccc

SEQ ID NO: 704369 - DNA, 17 bp, Homo sapiens
acttcaccaccccctgt

SEQ ID NO: 704370 - DNA, 21 bp, Homo sapiens
acttcaccaccccctgtccca

SEQ ID NO: 704371 - DNA, 14 bp, Homo sapiens
acttcacccccaac

SEQ ID NO: 704372 - DNA, 15 bp, Homo sapiens
acttcactggtgtac

SEQ ID NO: 704373 - DNA, 14 bp, Homo sapiens
acttcactgtatat

SEQ ID NO: 704374 - DNA, 18 bp, Homo sapiens
acttcactgtatataaac

SEQ ID NO: 704375 - DNA, 23 bp, Homo sapiens
acttcactgtcaggaagaaatca

SEQ ID NO: 704376 - DNA, 17 bp, Homo sapiens
acttcactgtgagggga

SEQ ID NO: 704377 - DNA, 22 bp, Homo sapiens
acttcagaaacccggcttcctg

SEQ ID NO: 704378 - DNA, 19 bp, Homo sapiens
caccgacgcgtctcctgtt

SEQ ID NO: 704379 - DNA, 12 bp, Homo sapiens
caccgactgccc

SEQ ID NO: 704380 - DNA, 16 bp, Homo sapiens
caccgactgcccagcc

SEQ ID NO: 704381 - DNA, 13 bp, Homo sapiens
caccgagaatgtt

SEQ ID NO: 704382 - DNA, 16 bp, Homo sapiens
caccgaggttcccagg

SEQ ID NO: 704383 - DNA, 19 bp, Homo sapiens
caccgaggttcccagggct

SEQ ID NO: 704384 - DNA, 19 bp, Homo sapiens
caccgccacgtcccagcat

SEQ ID NO: 704385 - DNA, 12 bp, Homo sapiens
caccgccagctt

SEQ ID NO: 704386 - DNA, 14 bp, Homo sapiens
caccgcccatcagg

SEQ ID NO: 704387 - DNA, 12 bp, Homo sapiens
caccgcccccac

SEQ ID NO: 704388 - DNA, 14 bp, Homo sapiens
caccgcccctggcc

SEQ ID NO: 704389 - DNA, 15 bp, Homo sapiens
caccgcccctggccg

SEQ ID NO: 704390 - DNA, 21 bp, Homo sapiens
caccgccgagttaaagaggag

SEQ ID NO: 704391 - DNA, 15 bp, Homo sapiens
caccgccgcagaagc

SEQ ID NO: 704392 - DNA, 19 bp, Homo sapiens
caccgccgcagaagcagcc

SEQ ID NO: 704393 - DNA, 14 bp, Homo sapiens
caccgccgtggagt

SEQ ID NO: 704394 - DNA, 22 bp, Homo sapiens
caccgcctctggccgccacccc

SEQ ID NO: 704395 - DNA, 12 bp, Homo sapiens
caccgcctgccc

SEQ ID NO: 704396 - DNA, 12 bp, Homo sapiens
caccgctcagta

SEQ ID NO: 704397 - DNA, 20 bp, Homo sapiens
caccgctcagtgtcagcggg

SEQ ID NO: 704398 - DNA, 18 bp, Homo sapiens
caccgctccccagcccag

SEQ ID NO: 704399 - DNA, 20 bp, Homo sapiens
caccgctccccagcccaggg

SEQ ID NO: 704400 - DNA, 17 bp, Homo sapiens
caccgctgccagcacag

SEQ ID NO: 704401 - DNA, 18 bp, Homo sapiens
caccgcttctgccttttc

SEQ ID NO: 704402 - DNA, 19 bp, Homo sapiens
caccgcttttgttctcgca

SEQ ID NO: 704403 - DNA, 16 bp, Homo sapiens
caccggaactgggctg

SEQ ID NO: 704404 - DNA, 14 bp, Homo sapiens
caccggcccctggc

SEQ ID NO: 704405 - DNA, 13 bp, Homo sapiens
caccggcgctgca

SEQ ID NO: 704406 - DNA, 16 bp, Homo sapiens
caccggcgctgcaggt

SEQ ID NO: 704407 - DNA, 21 bp, Homo sapiens
caccggctctcacctggccct

SEQ ID NO: 704408 - DNA, 13 bp, Homo sapiens
caccgggagcctc

SEQ ID NO: 704409 - DNA, 17 bp, Homo sapiens
caccgggagcctccccc

SEQ ID NO: 704410 - DNA, 21 bp, Homo sapiens
caccgggctgcaggtgctgct

SEQ ID NO: 704411 - DNA, 16 bp, Homo sapiens
caccgggctggctgct

SEQ ID NO: 704412 - DNA, 17 bp, Homo sapiens
caccgggggtggctctg

SEQ ID NO: 704413 - DNA, 18 bp, Homo sapiens
caccggtcagtgcctttt

SEQ ID NO: 704414 - DNA, 17 bp, Homo sapiens
caccggtccagctggcc

SEQ ID NO: 704415 - DNA, 19 bp, Homo sapiens
caccgtacaaccccctcca

SEQ ID NO: 704416 - DNA, 22 bp, Homo sapiens
caccgtcccgccagtgcagatc

SEQ ID NO: 704417 - DNA, 14 bp, Homo sapiens
caccgtccctcagt

SEQ ID NO: 704418 - DNA, 15 bp, Homo sapiens
caccgtccgccctgc

SEQ ID NO: 704419 - DNA, 21 bp, Homo sapiens
caccgtctcggccctgaacca

SEQ ID NO: 704420 - DNA, 14 bp, Homo sapiens
caccgtctgtctca

SEQ ID NO: 704421 - DNA, 17 bp, Homo sapiens
caccgtgaaccagaggg

SEQ ID NO: 704422 - DNA, 15 bp, Homo sapiens
caccgtgcctggcca

SEQ ID NO: 704423 - DNA, 19 bp, Homo sapiens
caccgtgcctggccagatt

SEQ ID NO: 704424 - DNA, 14 bp, Homo sapiens
caccgtgcctggct

SEQ ID NO: 704425 - DNA, 16 bp, Homo sapiens
caccgtggaccttcct

SEQ ID NO: 704426 - DNA, 17 bp, Homo sapiens
caccgtggaccttcctg

SEQ ID NO: 704427 - DNA, 18 bp, Homo sapiens
caccgtggaccttcctgc

SEQ ID NO: 704428 - DNA, 19 bp, Homo sapiens
caccgtggaccttcctgcc

SEQ ID NO: 704429 - DNA, 15 bp, Homo sapiens
caccgtggcctgggc

SEQ ID NO: 704430 - DNA, 15 bp, Homo sapiens
caccgtgggcaggga

SEQ ID NO: 704431 - DNA, 17 bp, Homo sapiens
caccgtgggctccctga

SEQ ID NO: 704432 - DNA, 18 bp, Homo sapiens
caccgtgggctccctgac

SEQ ID NO: 704433 - DNA, 16 bp, Homo sapiens
caccgtgtaaaccaaa

SEQ ID NO: 704434 - DNA, 17 bp, Homo sapiens
caccgtgtcctcctctg

SEQ ID NO: 704435 - DNA, 18 bp, Homo sapiens
caccgttcgtacgcccag

SEQ ID NO: 704436 - DNA, 22 bp, Homo sapiens
caccgttcgtacgcccaggaca

SEQ ID NO: 704437 - DNA, 12 bp, Homo sapiens
cacctaaagaaa

SEQ ID NO: 704438 - DNA, 19 bp, Homo sapiens
cacctaagcacttctagaa

SEQ ID NO: 704439 - DNA, 17 bp, Homo sapiens
cacctaagtctctgtga

SEQ ID NO: 704440 - DNA, 21 bp, Homo sapiens
cacctaattcgatgaaggctg

SEQ ID NO: 704441 - DNA, 14 bp, Homo sapiens
cacctacacccctg

SEQ ID NO: 704442 - DNA, 20 bp, Homo sapiens
cacctacagtgtacagtctt

SEQ ID NO: 704443 - DNA, 22 bp, Homo sapiens
cacctaccatcagggacaggat

SEQ ID NO: 704444 - DNA, 16 bp, Homo sapiens
cacctaccatgctgct

SEQ ID NO: 704445 - DNA, 17 bp, Homo sapiens
cacctaccatgctgctt

SEQ ID NO: 704446 - DNA, 20 bp, Homo sapiens
cacctactatgtgctgggtg

SEQ ID NO: 704447 - DNA, 21 bp, Homo sapiens
cacctactgcactttccccct

SEQ ID NO: 704448 - DNA, 23 bp, Homo sapiens
cacctactgcactttcccccttc

SEQ ID NO: 704449 - DNA, 23 bp, Homo sapiens
cacctagaacactaactcaccag

SEQ ID NO: 704450 - DNA, 15 bp, Homo sapiens
cacctagacaaacaa

SEQ ID NO: 704451 - DNA, 16 bp, Homo sapiens
cacctagagccagacc

SEQ ID NO: 704452 - DNA, 17 bp, Homo sapiens
cacctagagccagacca

SEQ ID NO: 704453 - DNA, 14 bp, Homo sapiens
cacctagcagcctc

SEQ ID NO: 704454 - DNA, 17 bp, Homo sapiens
cacctaggccactcctc

SEQ ID NO: 704455 - DNA, 13 bp, Homo sapiens
cacctagtgcccc

SEQ ID NO: 704456 - DNA, 15 bp, Homo sapiens
cacctatctcagcca

SEQ ID NO: 704457 - DNA, 16 bp, Homo sapiens
cacctatctcagccat

SEQ ID NO: 704458 - DNA, 17 bp, Homo sapiens
cacctatctcagccata

SEQ ID NO: 704459 - DNA, 18 bp, Homo sapiens
cacctatgcctgtggtga

SEQ ID NO: 704460 - DNA, 17 bp, Homo sapiens
cacctatgttattttgt

SEQ ID NO: 704461 - DNA, 22 bp, Homo sapiens
cacctatgttattttgtgtaca

SEQ ID NO: 704462 - DNA, 15 bp, Homo sapiens
cacctattgaattac

SEQ ID NO: 704463 - DNA, 18 bp, Homo sapiens
cacctcaaggtcatcaaa

SEQ ID NO: 704464 - DNA, 21 bp, Homo sapiens
cacctcactgaaaacatctgg

SEQ ID NO: 704465 - DNA, 20 bp, Homo sapiens
cacctcagagtggagttgaa

SEQ ID NO: 704466 - DNA, 12 bp, Homo sapiens
cacctcagcctg

SEQ ID NO: 704467 - DNA, 16 bp, Homo sapiens
cacctcagcctggaga

SEQ ID NO: 704468 - DNA, 12 bp, Homo sapiens
cacctcagctga

SEQ ID NO: 704469 - DNA, 23 bp, Homo sapiens
cacctcaggccaggtgcagtggc

SEQ ID NO: 704470 - DNA, 13 bp, Homo sapiens
cacctcagggcca

SEQ ID NO: 704471 - DNA, 15 bp, Homo sapiens
cacctcagtgggaag

SEQ ID NO: 704472 - DNA, 16 bp, Homo sapiens
cacctcagtgggaaga

SEQ ID NO: 704473 - DNA, 11 bp, Homo sapiens
cacctcagttc

SEQ ID NO: 704474 - DNA, 18 bp, Homo sapiens
cacctcagttcccttggc

SEQ ID NO: 704475 - DNA, 20 bp, Homo sapiens
cacctcagttcccttggcct

SEQ ID NO: 704476 - DNA, 23 bp, Homo sapiens
cacctcagttcccttggcctcag

SEQ ID NO: 704477 - DNA, 15 bp, Homo sapiens
cacctcatcactgga

SEQ ID NO: 704478 - DNA, 18 bp, Homo sapiens
cacctcatcactggactg

SEQ ID NO: 704479 - DNA, 23 bp, Homo sapiens
cacctcatcactggactgcatgg

SEQ ID NO: 704480 - DNA, 14 bp, Homo sapiens
cacctcatgcccac

SEQ ID NO: 704481 - DNA, 16 bp, Homo sapiens
cacctcatgcccaccc

SEQ ID NO: 704482 - DNA, 19 bp, Homo sapiens
cacctcatgcccaccccct

SEQ ID NO: 704483 - DNA, 22 bp, Homo sapiens
cacctcatgcccaccccctgcc

SEQ ID NO: 704484 - DNA, 19 bp, Homo sapiens
cacctcatggattgccaca

SEQ ID NO: 704485 - DNA, 23 bp, Homo sapiens
cacctcatggattgccacagctc

SEQ ID NO: 704486 - DNA, 19 bp, Homo sapiens
cacctcattctgaaccctt

SEQ ID NO: 704487 - DNA, 18 bp, Homo sapiens
cacctccaatgctgcctg

SEQ ID NO: 704488 - DNA, 18 bp, Homo sapiens
cacctccaccacatctgc

SEQ ID NO: 704489 - DNA, 20 bp, Homo sapiens
cacctccaccacatctgcca

SEQ ID NO: 704490 - DNA, 14 bp, Homo sapiens
cacctccacccagc

SEQ ID NO: 704491 - DNA, 22 bp, Homo sapiens
cacctccacccccgccacggcc

SEQ ID NO: 704492 - DNA, 23 bp, Homo sapiens
cacctccacccccgccacggcca

SEQ ID NO: 704493 - DNA, 17 bp, Homo sapiens
cacctccacgccactgc

SEQ ID NO: 704494 - DNA, 16 bp, Homo sapiens
cacctccagcccggga

SEQ ID NO: 704495 - DNA, 20 bp, Homo sapiens
cacctccagcccgggagcct

SEQ ID NO: 704496 - DNA, 21 bp, Homo sapiens
cacctccagcccgggagccta

SEQ ID NO: 704497 - DNA, 22 bp, Homo sapiens
cacctccagcccgggagcctag

SEQ ID NO: 704498 - DNA, 14 bp, Homo sapiens
cacctccagcctga

SEQ ID NO: 704499 - DNA, 22 bp, Homo sapiens
cacctccaggcaggccaggctg

SEQ ID NO: 704500 - DNA, 23 bp, Homo sapiens
cacctccaggcaggccaggctgc

SEQ ID NO: 704501 - DNA, 14 bp, Homo sapiens
cacctccaggcctg

SEQ ID NO: 704502 - DNA, 21 bp, Homo sapiens
cacctccattaaagtctgaat

SEQ ID NO: 704503 - DNA, 18 bp, Homo sapiens
acttcagaagcaaacaat

SEQ ID NO: 704504 - DNA, 18 bp, Homo sapiens
acttcagagagctggtag

SEQ ID NO: 704505 - DNA, 20 bp, Homo sapiens
acttcagagagctggtagtt

SEQ ID NO: 704506 - DNA, 20 bp, Homo sapiens
acttcagagtcctcattata

SEQ ID NO: 704507 - DNA, 16 bp, Homo sapiens
acttcaggaacaagta

SEQ ID NO: 704508 - DNA, 17 bp, Homo sapiens
acttcaggctcttctcc

SEQ ID NO: 704509 - DNA, 18 bp, Homo sapiens
acttcaggctcttctcct

SEQ ID NO: 704510 - DNA, 16 bp, Homo sapiens
acttcaggtccgtggg

SEQ ID NO: 704511 - DNA, 21 bp, Homo sapiens
acttcagtaggatttatgtat

SEQ ID NO: 704512 - DNA, 17 bp, Homo sapiens
acttcagtatgttgtca

SEQ ID NO: 704513 - DNA, 19 bp, Homo sapiens
acttcagtatgttgtcaaa

SEQ ID NO: 704514 - DNA, 19 bp, Homo sapiens
acttcagtcctgctccaga

SEQ ID NO: 704515 - DNA, 13 bp, Homo sapiens
acttcagttttat

SEQ ID NO: 704516 - DNA, 17 bp, Homo sapiens
acttcatactggcagga

SEQ ID NO: 704517 - DNA, 22 bp, Homo sapiens
acttcatagaaacctctctatt

SEQ ID NO: 704518 - DNA, 14 bp, Homo sapiens
acttcatatagcat

SEQ ID NO: 704519 - DNA, 19 bp, Homo sapiens
acttcatatagcattgata

SEQ ID NO: 704520 - DNA, 22 bp, Homo sapiens
acttcatattgctgagagaaat

SEQ ID NO: 704521 - DNA, 24 bp, Homo sapiens
acttcatattgctgagagaaatat

SEQ ID NO: 704522 - DNA, 19 bp, Homo sapiens
acttcatgacaagcatttt

SEQ ID NO: 704523 - DNA, 15 bp, Homo sapiens
acttcatggaatgga

SEQ ID NO: 704524 - DNA, 21 bp, Homo sapiens
acttcattccagcagctgcac

SEQ ID NO: 704525 - DNA, 20 bp, Homo sapiens
acttcattctaaaccaaaac

SEQ ID NO: 704526 - DNA, 23 bp, Homo sapiens
acttcattctaaaccaaaacaga

SEQ ID NO: 704527 - DNA, 14 bp, Homo sapiens
acttcattcttgaa

SEQ ID NO: 704528 - DNA, 15 bp, Homo sapiens
acttcattcttgaaa

SEQ ID NO: 704529 - DNA, 20 bp, Homo sapiens
acttcatttaaaaaaatcac

SEQ ID NO: 704530 - DNA, 18 bp, Homo sapiens
acttcatttgtgccacac

SEQ ID NO: 704531 - DNA, 17 bp, Homo sapiens
acttccaaacagtgtgt

SEQ ID NO: 704532 - DNA, 17 bp, Homo sapiens
acttccaaactaatttt

SEQ ID NO: 704533 - DNA, 19 bp, Homo sapiens
acttccaaactaattttta

SEQ ID NO: 704534 - DNA, 18 bp, Homo sapiens
acttccaaagaaagttct

SEQ ID NO: 704535 - DNA, 19 bp, Homo sapiens
acttccaaatcccctaagc

SEQ ID NO: 704536 - DNA, 11 bp, Homo sapiens
acttccaacaa

SEQ ID NO: 704537 - DNA, 17 bp, Homo sapiens
acttccaacaagcctca

SEQ ID NO: 704538 - DNA, 15 bp, Homo sapiens
acttccaagaaaaat

SEQ ID NO: 704539 - DNA, 22 bp, Homo sapiens
acttccaaggccctgctttttt

SEQ ID NO: 704540 - DNA, 22 bp, Homo sapiens
acttccacaagagtgaatttga

SEQ ID NO: 704541 - DNA, 18 bp, Homo sapiens
acttccacagcagcagaa

SEQ ID NO: 704542 - DNA, 18 bp, Homo sapiens
acttccactaatccatta

SEQ ID NO: 704543 - DNA, 16 bp, Homo sapiens
acttccagagccagaa

SEQ ID NO: 704544 - DNA, 22 bp, Homo sapiens
acttccagaggacagctctggg

SEQ ID NO: 704545 - DNA, 16 bp, Homo sapiens
acttccaggggaacct

SEQ ID NO: 704546 - DNA, 21 bp, Homo sapiens
acttccaggggaacctgccat

SEQ ID NO: 704547 - DNA, 21 bp, Homo sapiens
acttccaggtgttactgtaat

SEQ ID NO: 704548 - DNA, 17 bp, Homo sapiens
acttccataatctggac

SEQ ID NO: 704549 - DNA, 17 bp, Homo sapiens
acttccatacagctcta

SEQ ID NO: 704550 - DNA, 22 bp, Homo sapiens
acttccataggacatactgcat

SEQ ID NO: 704551 - DNA, 17 bp, Homo sapiens
acttccatgaggccaaa

SEQ ID NO: 704552 - DNA, 20 bp, Homo sapiens
acttccatgccttaaaccta

SEQ ID NO: 704553 - DNA, 12 bp, Homo sapiens
acttcccacccc

SEQ ID NO: 704554 - DNA, 14 bp, Homo sapiens
acttcccaccccca

SEQ ID NO: 704555 - DNA, 11 bp, Homo sapiens
acttcccagct

SEQ ID NO: 704556 - DNA, 23 bp, Homo sapiens
acttcccagctaggaagagcagg

SEQ ID NO: 704557 - DNA, 23 bp, Homo sapiens
acttcccagttcaggagtcccaa

SEQ ID NO: 704558 - DNA, 19 bp, Homo sapiens
acttcccatctccagggaa

SEQ ID NO: 704559 - DNA, 22 bp, Homo sapiens
acttcccatctccagggaagcg

SEQ ID NO: 704560 - DNA, 15 bp, Homo sapiens
acttcccatctggct

SEQ ID NO: 704561 - DNA, 13 bp, Homo sapiens
acttcccctggga

SEQ ID NO: 704562 - DNA, 24 bp, Homo sapiens
acttcccctgggatgctgacccag

SEQ ID NO: 704563 - DNA, 15 bp, Homo sapiens
acttcccctgggcaa

SEQ ID NO: 704564 - DNA, 15 bp, Homo sapiens
acttccccttcttgc

SEQ ID NO: 704565 - DNA, 20 bp, Homo sapiens
acttcccgggccagggctgc

SEQ ID NO: 704566 - DNA, 20 bp, Homo sapiens
acttcccgtcccatatcctg

SEQ ID NO: 704567 - DNA, 22 bp, Homo sapiens
acttcccgtcccatatcctgcc

SEQ ID NO: 704568 - DNA, 23 bp, Homo sapiens
acttcccgtcccatatcctgcct

SEQ ID NO: 704569 - DNA, 16 bp, Homo sapiens
acttcccgtctcagaa

SEQ ID NO: 704570 - DNA, 19 bp, Homo sapiens
acttcccgtctcagaatct

SEQ ID NO: 704571 - DNA, 10 bp, Homo sapiens
acttccctgg

SEQ ID NO: 704572 - DNA, 13 bp, Homo sapiens
acttccctgggcc

SEQ ID NO: 704573 - DNA, 16 bp, Homo sapiens
acttccctgggcctca

SEQ ID NO: 704574 - DNA, 22 bp, Homo sapiens
acttccgctgaggggtctcgga

SEQ ID NO: 704575 - DNA, 13 bp, Homo sapiens
acttcctccacag

SEQ ID NO: 704576 - DNA, 15 bp, Homo sapiens
acttcctcctacctg

SEQ ID NO: 704577 - DNA, 23 bp, Homo sapiens
acttcctcctgatggccaagagc

SEQ ID NO: 704578 - DNA, 20 bp, Homo sapiens
acttcctctctaccccccac

SEQ ID NO: 704579 - DNA, 21 bp, Homo sapiens
acttcctctctaccccccacc

SEQ ID NO: 704580 - DNA, 11 bp, Homo sapiens
acttcctgctg

SEQ ID NO: 704581 - DNA, 15 bp, Homo sapiens
acttcctgctgcacc

SEQ ID NO: 704582 - DNA, 18 bp, Homo sapiens
acttcctggggccccgct

SEQ ID NO: 704583 - DNA, 22 bp, Homo sapiens
acttcctggtgaggcccagcct

SEQ ID NO: 704584 - DNA, 12 bp, Homo sapiens
acttcctgtact

SEQ ID NO: 704585 - DNA, 15 bp, Homo sapiens
acttcctgtgacttc

SEQ ID NO: 704586 - DNA, 21 bp, Homo sapiens
acttcctgtgcctttcctatc

SEQ ID NO: 704587 - DNA, 12 bp, Homo sapiens
acttcctgtgta

SEQ ID NO: 704588 - DNA, 17 bp, Homo sapiens
acttcctgtttgggccc

SEQ ID NO: 704589 - DNA, 21 bp, Homo sapiens
acttcctgtttgggcccctct

SEQ ID NO: 704590 - DNA, 22 bp, Homo sapiens
acttccttactaagcatagcaa

SEQ ID NO: 704591 - DNA, 15 bp, Homo sapiens
acttccttactttta

SEQ ID NO: 704592 - DNA, 22 bp, Homo sapiens
acttccttgagacacggagccc

SEQ ID NO: 704593 - DNA, 16 bp, Homo sapiens
acttccttgctctccc

SEQ ID NO: 704594 - DNA, 19 bp, Homo sapiens
acttccttgctctccctct

SEQ ID NO: 704595 - DNA, 23 bp, Homo sapiens
acttcctttcctactgtcctgga

SEQ ID NO: 704596 - DNA, 15 bp, Homo sapiens
acttcgactcaggat

SEQ ID NO: 704597 - DNA, 17 bp, Homo sapiens
acttcgggctgtgtaaa

SEQ ID NO: 704598 - DNA, 20 bp, Homo sapiens
acttcgtcttctaatttcaa

SEQ ID NO: 704599 - DNA, 15 bp, Homo sapiens
acttctaatatattt

SEQ ID NO: 704600 - DNA, 14 bp, Homo sapiens
acttctaatttata

SEQ ID NO: 704601 - DNA, 16 bp, Homo sapiens
acttctacctgccctc

SEQ ID NO: 704602 - DNA, 12 bp, Homo sapiens
acttctatattt

SEQ ID NO: 704603 - DNA, 14 bp, Homo sapiens
acttctatcctttc

SEQ ID NO: 704604 - DNA, 23 bp, Homo sapiens
acttctcaagtcccttgttttgt

SEQ ID NO: 704605 - DNA, 19 bp, Homo sapiens
acttctcattttttaaaaa

SEQ ID NO: 704606 - DNA, 14 bp, Homo sapiens
acttctccatgctg

SEQ ID NO: 704607 - DNA, 13 bp, Homo sapiens
acttctcccaccc

SEQ ID NO: 704608 - DNA, 14 bp, Homo sapiens
acttctcccacccc

SEQ ID NO: 704609 - DNA, 20 bp, Homo sapiens
acttctcccaccccttggcc

SEQ ID NO: 704610 - DNA, 12 bp, Homo sapiens
acttctcccccg

SEQ ID NO: 704611 - DNA, 20 bp, Homo sapiens
acttctcccccgccctgccc

SEQ ID NO: 704612 - DNA, 14 bp, Homo sapiens
acttctcctgctgc

SEQ ID NO: 704613 - DNA, 14 bp, Homo sapiens
acttctctaagcct

SEQ ID NO: 704614 - DNA, 17 bp, Homo sapiens
acttctctgaatcagaa

SEQ ID NO: 704615 - DNA, 23 bp, Homo sapiens
acttctctgaatcagaaaagcta

SEQ ID NO: 704616 - DNA, 13 bp, Homo sapiens
acttctctgctgc

SEQ ID NO: 704617 - DNA, 16 bp, Homo sapiens
acttctctgctgcctc

SEQ ID NO: 704618 - DNA, 22 bp, Homo sapiens
acttctctgtgtgcacacccat

SEQ ID NO: 704619 - DNA, 17 bp, Homo sapiens
acttctcttacattttc

SEQ ID NO: 704620 - DNA, 17 bp, Homo sapiens
acttctcttgaaaagtt

SEQ ID NO: 704621 - DNA, 14 bp, Homo sapiens
acttctcttgcttt

SEQ ID NO: 704622 - DNA, 20 bp, Homo sapiens
acttctgaagactgagaact

SEQ ID NO: 704623 - DNA, 21 bp, Homo sapiens
acttctgaccttgctgccaca

SEQ ID NO: 704624 - DNA, 13 bp, Homo sapiens
acttctgcctctt

SEQ ID NO: 704625 - DNA, 12 bp, Homo sapiens
acttctgcctgg

SEQ ID NO: 704626 - DNA, 17 bp, Homo sapiens
acttctggaaggctggc

SEQ ID NO: 704627 - DNA, 15 bp, Homo sapiens
cacctcccaggggac

SEQ ID NO: 704628 - DNA, 21 bp, Homo sapiens
cacctcccaggggactgttcc

SEQ ID NO: 704629 - DNA, 18 bp, Homo sapiens
cacctcccatttctgttg

SEQ ID NO: 704630 - DNA, 15 bp, Homo sapiens
cacctccccccactg

SEQ ID NO: 704631 - DNA, 23 bp, Homo sapiens
cacctccccccactgcaggcccc

SEQ ID NO: 704632 - DNA, 16 bp, Homo sapiens
cacctccccctaccca

SEQ ID NO: 704633 - DNA, 18 bp, Homo sapiens
cacctccccctacccata

SEQ ID NO: 704634 - DNA, 20 bp, Homo sapiens
cacctccccctcccccttct

SEQ ID NO: 704635 - DNA, 24 bp, Homo sapiens
cacctccccctgctgctgctgccc

SEQ ID NO: 704636 - DNA, 14 bp, Homo sapiens
cacctcccctatcc

SEQ ID NO: 704637 - DNA, 20 bp, Homo sapiens
cacctcccctatccacccag

SEQ ID NO: 704638 - DNA, 14 bp, Homo sapiens
cacctcccctcctt

SEQ ID NO: 704639 - DNA, 23 bp, Homo sapiens
cacctcccgccctcacctgcaga

SEQ ID NO: 704640 - DNA, 10 bp, Homo sapiens
cacctccctg

SEQ ID NO: 704641 - DNA, 19 bp, Homo sapiens
cacctccctgaaccatccc

SEQ ID NO: 704642 - DNA, 14 bp, Homo sapiens
cacctccctgaccc

SEQ ID NO: 704643 - DNA, 11 bp, Homo sapiens
cacctccctgc

SEQ ID NO: 704644 - DNA, 15 bp, Homo sapiens
cacctccctgcctcc

SEQ ID NO: 704645 - DNA, 17 bp, Homo sapiens
cacctccctgcctccag

SEQ ID NO: 704646 - DNA, 14 bp, Homo sapiens
cacctccctgcgcc

SEQ ID NO: 704647 - DNA, 22 bp, Homo sapiens
cacctccctgctcagtgcttgg

SEQ ID NO: 704648 - DNA, 16 bp, Homo sapiens
cacctcccttcccacc

SEQ ID NO: 704649 - DNA, 20 bp, Homo sapiens
cacctccgagaggcagccag

SEQ ID NO: 704650 - DNA, 21 bp, Homo sapiens
cacctccgagaggcagccaga

SEQ ID NO: 704651 - DNA, 12 bp, Homo sapiens
cacctccgccag

SEQ ID NO: 704652 - DNA, 15 bp, Homo sapiens
cacctccgccagacc

SEQ ID NO: 704653 - DNA, 23 bp, Homo sapiens
cacctccgccagaccccgtggct

SEQ ID NO: 704654 - DNA, 13 bp, Homo sapiens
cacctccggctgc

SEQ ID NO: 704655 - DNA, 17 bp, Homo sapiens
cacctccggctgcctag

SEQ ID NO: 704656 - DNA, 16 bp, Homo sapiens
cacctcctaaaacaac

SEQ ID NO: 704657 - DNA, 12 bp, Homo sapiens
cacctcctaccc

SEQ ID NO: 704658 - DNA, 14 bp, Homo sapiens
cacctcctccactc

SEQ ID NO: 704659 - DNA, 23 bp, Homo sapiens
cacctcctccactcactccagcc

SEQ ID NO: 704660 - DNA, 20 bp, Homo sapiens
cacctcctcccgaaaaatgt

SEQ ID NO: 704661 - DNA, 14 bp, Homo sapiens
cacctcctgagaag

SEQ ID NO: 704662 - DNA, 23 bp, Homo sapiens
cacctcctgagaaggcgaggaga

SEQ ID NO: 704663 - DNA, 11 bp, Homo sapiens
cacctcctgcg

SEQ ID NO: 704664 - DNA, 16 bp, Homo sapiens
cacctcctgcggctca

SEQ ID NO: 704665 - DNA, 17 bp, Homo sapiens
cacctccttccagcact

SEQ ID NO: 704666 - DNA, 15 bp, Homo sapiens
cacctcgctcccctc

SEQ ID NO: 704667 - DNA, 13 bp, Homo sapiens
cacctcggcacac

SEQ ID NO: 704668 - DNA, 16 bp, Homo sapiens
cacctcggcacacact

SEQ ID NO: 704669 - DNA, 15 bp, Homo sapiens
cacctcggcctccca

SEQ ID NO: 704670 - DNA, 14 bp, Homo sapiens
cacctcgtctccct

SEQ ID NO: 704671 - DNA, 19 bp, Homo sapiens
cacctcgtctccctggtgc

SEQ ID NO: 704672 - DNA, 20 bp, Homo sapiens
cacctctaatagaggcagtg

SEQ ID NO: 704673 - DNA, 18 bp, Homo sapiens
cacctctacccaaaccct

SEQ ID NO: 704674 - DNA, 21 bp, Homo sapiens
cacctctacccaaaccctagg

SEQ ID NO: 704675 - DNA, 18 bp, Homo sapiens
cacctctcacgggccctg

SEQ ID NO: 704676 - DNA, 22 bp, Homo sapiens
cacctctcaggattgctaggag

SEQ ID NO: 704677 - DNA, 12 bp, Homo sapiens
cacctctccaag

SEQ ID NO: 704678 - DNA, 18 bp, Homo sapiens
cacctctccaagtctctc

SEQ ID NO: 704679 - DNA, 23 bp, Homo sapiens
cacctctccaagtctctctgtga

SEQ ID NO: 704680 - DNA, 14 bp, Homo sapiens
cacctctccctcaa

SEQ ID NO: 704681 - DNA, 16 bp, Homo sapiens
cacctctctcctttgc

SEQ ID NO: 704682 - DNA, 12 bp, Homo sapiens
cacctctgagga

SEQ ID NO: 704683 - DNA, 16 bp, Homo sapiens
cacctctgaggacaga

SEQ ID NO: 704684 - DNA, 16 bp, Homo sapiens
cacctctgcccttccc

SEQ ID NO: 704685 - DNA, 18 bp, Homo sapiens
cacctctggactggctag

SEQ ID NO: 704686 - DNA, 13 bp, Homo sapiens
cacctctgggctt

SEQ ID NO: 704687 - DNA, 12 bp, Homo sapiens
cacctctggggg

SEQ ID NO: 704688 - DNA, 17 bp, Homo sapiens
cacctctggtggctcct

SEQ ID NO: 704689 - DNA, 13 bp, Homo sapiens
cacctctgtggca

SEQ ID NO: 704690 - DNA, 20 bp, Homo sapiens
cacctctgtggcattgaaat

SEQ ID NO: 704691 - DNA, 23 bp, Homo sapiens
cacctctgtgggcactggtgggc

SEQ ID NO: 704692 - DNA, 14 bp, Homo sapiens
cacctcttcacccc

SEQ ID NO: 704693 - DNA, 11 bp, Homo sapiens
cacctcttcca

SEQ ID NO: 704694 - DNA, 14 bp, Homo sapiens
cacctcttcctctg

SEQ ID NO: 704695 - DNA, 16 bp, Homo sapiens
cacctcttcctctggt

SEQ ID NO: 704696 - DNA, 22 bp, Homo sapiens
cacctcttctcttcctgtaaca

SEQ ID NO: 704697 - DNA, 22 bp, Homo sapiens
cacctctttaaaaactcactta

SEQ ID NO: 704698 - DNA, 16 bp, Homo sapiens
cacctgaaacactgga

SEQ ID NO: 704699 - DNA, 18 bp, Homo sapiens
cacctgaaacactggacc

SEQ ID NO: 704700 - DNA, 21 bp, Homo sapiens
cacctgaaacactggacctgg

SEQ ID NO: 704701 - DNA, 18 bp, Homo sapiens
cacctgaaattaatttgt

SEQ ID NO: 704702 - DNA, 22 bp, Homo sapiens
cacctgaaattaatttgtgaat

SEQ ID NO: 704703 - DNA, 19 bp, Homo sapiens
cacctgaaccccatgggct

SEQ ID NO: 704704 - DNA, 22 bp, Homo sapiens
cacctgaaccccatgggcttgg

SEQ ID NO: 704705 - DNA, 17 bp, Homo sapiens
cacctgaactgaacacc

SEQ ID NO: 704706 - DNA, 16 bp, Homo sapiens
cacctgaatcagctgg

SEQ ID NO: 704707 - DNA, 18 bp, Homo sapiens
cacctgaatcagctggac

SEQ ID NO: 704708 - DNA, 20 bp, Homo sapiens
cacctgaatcagctggacat

SEQ ID NO: 704709 - DNA, 16 bp, Homo sapiens
cacctgacacaccagg

SEQ ID NO: 704710 - DNA, 20 bp, Homo sapiens
cacctgacacaccaggcgct

SEQ ID NO: 704711 - DNA, 17 bp, Homo sapiens
cacctgacctcttgctg

SEQ ID NO: 704712 - DNA, 16 bp, Homo sapiens
cacctgacctgctgaa

SEQ ID NO: 704713 - DNA, 16 bp, Homo sapiens
cacctgacggctgggg

SEQ ID NO: 704714 - DNA, 21 bp, Homo sapiens
cacctgacttggctggggagg

SEQ ID NO: 704715 - DNA, 14 bp, Homo sapiens
cacctgagacccta

SEQ ID NO: 704716 - DNA, 16 bp, Homo sapiens
cacctgagaccctact

SEQ ID NO: 704717 - DNA, 17 bp, Homo sapiens
cacctgaggtgggccca

SEQ ID NO: 704718 - DNA, 18 bp, Homo sapiens
cacctgaggtgggcccag

SEQ ID NO: 704719 - DNA, 21 bp, Homo sapiens
cacctgaggtgggcccaggac

SEQ ID NO: 704720 - DNA, 17 bp, Homo sapiens
cacctgatattcaggct

SEQ ID NO: 704721 - DNA, 11 bp, Homo sapiens
cacctgcacct

SEQ ID NO: 704722 - DNA, 14 bp, Homo sapiens
cacctgcacctccc

SEQ ID NO: 704723 - DNA, 14 bp, Homo sapiens
cacctgcagagaaa

SEQ ID NO: 704724 - DNA, 15 bp, Homo sapiens
cacctgcaggaccct

SEQ ID NO: 704725 - DNA, 11 bp, Homo sapiens
cacctgccaca

SEQ ID NO: 704726 - DNA, 13 bp, Homo sapiens
cacctgccagcct

SEQ ID NO: 704727 - DNA, 16 bp, Homo sapiens
cacctgccagcctggc

SEQ ID NO: 704728 - DNA, 20 bp, Homo sapiens
cacctgccagcctggcttct

SEQ ID NO: 704729 - DNA, 22 bp, Homo sapiens
cacctgccatttgcaccctccg

SEQ ID NO: 704730 - DNA, 18 bp, Homo sapiens
cacctgcccaacctgctc

SEQ ID NO: 704731 - DNA, 18 bp, Homo sapiens
cacctgcccatcacaggg

SEQ ID NO: 704732 - DNA, 22 bp, Homo sapiens
cacctgcccatcacagggttgg

SEQ ID NO: 704733 - DNA, 14 bp, Homo sapiens
cacctgccccctgg

SEQ ID NO: 704734 - DNA, 17 bp, Homo sapiens
cacctgcccccttctcc

SEQ ID NO: 704735 - DNA, 18 bp, Homo sapiens
cacctgccccgtagagaa

SEQ ID NO: 704736 - DNA, 14 bp, Homo sapiens
cacctgcccctctg

SEQ ID NO: 704737 - DNA, 13 bp, Homo sapiens
cacctgccctgcc

SEQ ID NO: 704738 - DNA, 20 bp, Homo sapiens
cacctgccgcatgctccctc

SEQ ID NO: 704739 - DNA, 12 bp, Homo sapiens
cacctgcctcag

SEQ ID NO: 704740 - DNA, 18 bp, Homo sapiens
cacctgcctcagctacct

SEQ ID NO: 704741 - DNA, 14 bp, Homo sapiens
cacctgcctcctcg

SEQ ID NO: 704742 - DNA, 19 bp, Homo sapiens
cacctgcctgccccacacg

SEQ ID NO: 704743 - DNA, 15 bp, Homo sapiens
cacctgcctgcgtct

SEQ ID NO: 704744 - DNA, 20 bp, Homo sapiens
cacctgcctgcgtcttccgc

SEQ ID NO: 704745 - DNA, 16 bp, Homo sapiens
cacctgccttctaccc

SEQ ID NO: 704746 - DNA, 18 bp, Homo sapiens
cacctgccttggcctccc

SEQ ID NO: 704747 - DNA, 20 bp, Homo sapiens
cacctgcgcacaggtgggag

SEQ ID NO: 704748 - DNA, 22 bp, Homo sapiens
cacctgcgcacaggtgggagga

SEQ ID NO: 704749 - DNA, 23 bp, Homo sapiens
cacctgcgcttctgctggaggag

SEQ ID NO: 704750 - DNA, 15 bp, Homo sapiens
cacctgctcacaggg

SEQ ID NO: 704751 - DNA, 11 bp, Homo sapiens
cacctgctcca

SEQ ID NO: 704752 - DNA, 19 bp, Homo sapiens
acttctggaaggctggctg

SEQ ID NO: 704753 - DNA, 21 bp, Homo sapiens
acttctggaaggctggctgag

SEQ ID NO: 704754 - DNA, 22 bp, Homo sapiens
acttctggaaggctggctgagt

SEQ ID NO: 704755 - DNA, 14 bp, Homo sapiens
acttctggccacat

SEQ ID NO: 704756 - DNA, 16 bp, Homo sapiens
acttctggcctccagc

SEQ ID NO: 704757 - DNA, 19 bp, Homo sapiens
acttctggcctccagcctt

SEQ ID NO: 704758 - DNA, 17 bp, Homo sapiens
acttctggctcacagga

SEQ ID NO: 704759 - DNA, 16 bp, Homo sapiens
acttctggctcctcaa

SEQ ID NO: 704760 - DNA, 22 bp, Homo sapiens
acttctgggcttcatctggcaa

SEQ ID NO: 704761 - DNA, 23 bp, Homo sapiens
acttctgggtcatgcactgaggt

SEQ ID NO: 704762 - DNA, 20 bp, Homo sapiens
acttctggtcccctgtggtg

SEQ ID NO: 704763 - DNA, 23 bp, Homo sapiens
acttctggttgtatttctatatt

SEQ ID NO: 704764 - DNA, 19 bp, Homo sapiens
acttctgtgagacccccac

SEQ ID NO: 704765 - DNA, 20 bp, Homo sapiens
acttctgtgagacccccaca

SEQ ID NO: 704766 - DNA, 23 bp, Homo sapiens
acttctgtgagacccccacacct

SEQ ID NO: 704767 - DNA, 12 bp, Homo sapiens
acttctgtgggc

SEQ ID NO: 704768 - DNA, 16 bp, Homo sapiens
acttcttaaaagttgt

SEQ ID NO: 704769 - DNA, 13 bp, Homo sapiens
acttcttaaaatt

SEQ ID NO: 704770 - DNA, 16 bp, Homo sapiens
acttcttaaaggcctg

SEQ ID NO: 704771 - DNA, 20 bp, Homo sapiens
acttcttaaaggcctggaac

SEQ ID NO: 704772 - DNA, 21 bp, Homo sapiens
acttcttaaaggcctggaacc

SEQ ID NO: 704773 - DNA, 14 bp, Homo sapiens
acttcttacccaaa

SEQ ID NO: 704774 - DNA, 17 bp, Homo sapiens
acttcttatacatttga

SEQ ID NO: 704775 - DNA, 18 bp, Homo sapiens
acttcttatacatttgat

SEQ ID NO: 704776 - DNA, 16 bp, Homo sapiens
acttcttatggaattg

SEQ ID NO: 704777 - DNA, 20 bp, Homo sapiens
acttcttatggaattgattt

SEQ ID NO: 704778 - DNA, 21 bp, Homo sapiens
acttcttatggaattgatttg

SEQ ID NO: 704779 - DNA, 23 bp, Homo sapiens
acttcttatggaattgatttgca

SEQ ID NO: 704780 - DNA, 13 bp, Homo sapiens
acttcttcacctc

SEQ ID NO: 704781 - DNA, 14 bp, Homo sapiens
acttcttccactgt

SEQ ID NO: 704782 - DNA, 13 bp, Homo sapiens
acttcttctgtaa

SEQ ID NO: 704783 - DNA, 14 bp, Homo sapiens
acttcttctgtaat

SEQ ID NO: 704784 - DNA, 13 bp, Homo sapiens
acttcttgaatat

SEQ ID NO: 704785 - DNA, 11 bp, Homo sapiens
acttcttgctt

SEQ ID NO: 704786 - DNA, 18 bp, Homo sapiens
acttcttgcttctttcta

SEQ ID NO: 704787 - DNA, 22 bp, Homo sapiens
acttctttagcatttttatgca

SEQ ID NO: 704788 - DNA, 12 bp, Homo sapiens
acttctttctat

SEQ ID NO: 704789 - DNA, 22 bp, Homo sapiens
acttcttttttcaaaagaaagt

SEQ ID NO: 704790 - DNA, 14 bp, Homo sapiens
acttgaaaacagaa

SEQ ID NO: 704791 - DNA, 18 bp, Homo sapiens
acttgaaaattttttata

SEQ ID NO: 704792 - DNA, 15 bp, Homo sapiens
acttgaaaccagaag

SEQ ID NO: 704793 - DNA, 12 bp, Homo sapiens
acttgaaagatt

SEQ ID NO: 704794 - DNA, 14 bp, Homo sapiens
acttgaaagatttt

SEQ ID NO: 704795 - DNA, 19 bp, Homo sapiens
acttgaaagattttattgt

SEQ ID NO: 704796 - DNA, 16 bp, Homo sapiens
acttgaaagttttcca

SEQ ID NO: 704797 - DNA, 21 bp, Homo sapiens
acttgaaagttttccagtatt

SEQ ID NO: 704798 - DNA, 23 bp, Homo sapiens
acttgaaagttttccagtattga

SEQ ID NO: 704799 - DNA, 16 bp, Homo sapiens
acttgaaagttttcta

SEQ ID NO: 704800 - DNA, 20 bp, Homo sapiens
acttgaaatatataatattc

SEQ ID NO: 704801 - DNA, 20 bp, Homo sapiens
acttgaacctatgaagcaat

SEQ ID NO: 704802 - DNA, 13 bp, Homo sapiens
acttgaaggattg

SEQ ID NO: 704803 - DNA, 21 bp, Homo sapiens
acttgaaggattgcatcctgc

SEQ ID NO: 704804 - DNA, 20 bp, Homo sapiens
acttgaatattcctggactt

SEQ ID NO: 704805 - DNA, 16 bp, Homo sapiens
acttgaatgtgtcact

SEQ ID NO: 704806 - DNA, 11 bp, Homo sapiens
acttgaatttt

SEQ ID NO: 704807 - DNA, 22 bp, Homo sapiens
acttgacaacatcccacagtgg

SEQ ID NO: 704808 - DNA, 18 bp, Homo sapiens
acttgactccatttcatc

SEQ ID NO: 704809 - DNA, 21 bp, Homo sapiens
acttgagacaatgttttcttc

SEQ ID NO: 704810 - DNA, 21 bp, Homo sapiens
acttgagaccaacttttcaat

SEQ ID NO: 704811 - DNA, 14 bp, Homo sapiens
acttgagacctaat

SEQ ID NO: 704812 - DNA, 21 bp, Homo sapiens
acttgagacctaatctctgta

SEQ ID NO: 704813 - DNA, 16 bp, Homo sapiens
acttgagaggatgaat

SEQ ID NO: 704814 - DNA, 20 bp, Homo sapiens
acttgagatctgtataaata

SEQ ID NO: 704815 - DNA, 15 bp, Homo sapiens
acttgagcccactcc

SEQ ID NO: 704816 - DNA, 20 bp, Homo sapiens
acttgagggcccagagcagg

SEQ ID NO: 704817 - DNA, 20 bp, Homo sapiens
acttgagtgttcctttttaa

SEQ ID NO: 704818 - DNA, 18 bp, Homo sapiens
acttgagttacaccagac

SEQ ID NO: 704819 - DNA, 15 bp, Homo sapiens
acttgagttttattt

SEQ ID NO: 704820 - DNA, 21 bp, Homo sapiens
acttgagttttatttatttta

SEQ ID NO: 704821 - DNA, 23 bp, Homo sapiens
acttgataatattagtgattctg

SEQ ID NO: 704822 - DNA, 20 bp, Homo sapiens
acttgatggaaggatctctc

SEQ ID NO: 704823 - DNA, 20 bp, Homo sapiens
acttgatgtgccattttaaa

SEQ ID NO: 704824 - DNA, 22 bp, Homo sapiens
acttgatgttccacctgccaca

SEQ ID NO: 704825 - DNA, 17 bp, Homo sapiens
acttgattcatctctgg

SEQ ID NO: 704826 - DNA, 15 bp, Homo sapiens
acttgatttgatgtg

SEQ ID NO: 704827 - DNA, 16 bp, Homo sapiens
acttgatttgatgtga

SEQ ID NO: 704828 - DNA, 15 bp, Homo sapiens
acttgattttttcaa

SEQ ID NO: 704829 - DNA, 23 bp, Homo sapiens
acttgcaactaaggacaaattag

SEQ ID NO: 704830 - DNA, 20 bp, Homo sapiens
acttgcagaggagcccagtg

SEQ ID NO: 704831 - DNA, 20 bp, Homo sapiens
acttgcagcgccaagtggcc

SEQ ID NO: 704832 - DNA, 23 bp, Homo sapiens
acttgcagctgatgttggaagag

SEQ ID NO: 704833 - DNA, 18 bp, Homo sapiens
acttgcaggggtccctgc

SEQ ID NO: 704834 - DNA, 21 bp, Homo sapiens
acttgcagtcttgtagctaga

SEQ ID NO: 704835 - DNA, 17 bp, Homo sapiens
acttgcagttgtgatat

SEQ ID NO: 704836 - DNA, 14 bp, Homo sapiens
acttgcatgaatta

SEQ ID NO: 704837 - DNA, 21 bp, Homo sapiens
acttgcatgaattactgtata

SEQ ID NO: 704838 - DNA, 19 bp, Homo sapiens
acttgcattgaatatatta

SEQ ID NO: 704839 - DNA, 14 bp, Homo sapiens
acttgcatttttgc

SEQ ID NO: 704840 - DNA, 18 bp, Homo sapiens
acttgcatttttgcagga

SEQ ID NO: 704841 - DNA, 11 bp, Homo sapiens
acttgccaaaa

SEQ ID NO: 704842 - DNA, 23 bp, Homo sapiens
acttgccacatggtgtctcccaa

SEQ ID NO: 704843 - DNA, 21 bp, Homo sapiens
acttgccctgaccatgcattt

SEQ ID NO: 704844 - DNA, 18 bp, Homo sapiens
acttgccctgttctcttc

SEQ ID NO: 704845 - DNA, 23 bp, Homo sapiens
acttgccgcgtcgccctcccagg

SEQ ID NO: 704846 - DNA, 22 bp, Homo sapiens
acttgcctaactaactggcagg

SEQ ID NO: 704847 - DNA, 12 bp, Homo sapiens
acttgcctcttc

SEQ ID NO: 704848 - DNA, 17 bp, Homo sapiens
acttgcctcttccttga

SEQ ID NO: 704849 - DNA, 15 bp, Homo sapiens
acttgcctggaataa

SEQ ID NO: 704850 - DNA, 14 bp, Homo sapiens
acttgctaaagcac

SEQ ID NO: 704851 - DNA, 16 bp, Homo sapiens
acttgctaaagcactt

SEQ ID NO: 704852 - DNA, 15 bp, Homo sapiens
acttgctctttgact

SEQ ID NO: 704853 - DNA, 17 bp, Homo sapiens
acttgctgcctgaagaa

SEQ ID NO: 704854 - DNA, 12 bp, Homo sapiens
acttgctgctgt

SEQ ID NO: 704855 - DNA, 13 bp, Homo sapiens
acttgctgctgtc

SEQ ID NO: 704856 - DNA, 23 bp, Homo sapiens
acttgctggggctcacggggcct

SEQ ID NO: 704857 - DNA, 13 bp, Homo sapiens
acttgctgtccag

SEQ ID NO: 704858 - DNA, 14 bp, Homo sapiens
acttgctgtccagg

SEQ ID NO: 704859 - DNA, 22 bp, Homo sapiens
acttgctgtgtgaccctgggca

SEQ ID NO: 704860 - DNA, 18 bp, Homo sapiens
acttgctgttttgttctg

SEQ ID NO: 704861 - DNA, 19 bp, Homo sapiens
acttgcttagtatggttct

SEQ ID NO: 704862 - DNA, 22 bp, Homo sapiens
acttgctttatgccttcttatt

SEQ ID NO: 704863 - DNA, 21 bp, Homo sapiens
acttgctttcaattgacaaat

SEQ ID NO: 704864 - DNA, 22 bp, Homo sapiens
acttggaaaattctcttaatca

SEQ ID NO: 704865 - DNA, 16 bp, Homo sapiens
acttggaagaggagga

SEQ ID NO: 704866 - DNA, 17 bp, Homo sapiens
acttggaagaggaggag

SEQ ID NO: 704867 - DNA, 23 bp, Homo sapiens
acttggaatcaaggtaagctcag

SEQ ID NO: 704868 - DNA, 18 bp, Homo sapiens
acttggaatttgtaacct

SEQ ID NO: 704869 - DNA, 22 bp, Homo sapiens
acttggaatttgtaacctcagc

SEQ ID NO: 704870 - DNA, 23 bp, Homo sapiens
acttggaatttgtaacctcagct

SEQ ID NO: 704871 - DNA, 19 bp, Homo sapiens
acttggacatctctctggc

SEQ ID NO: 704872 - DNA, 22 bp, Homo sapiens
acttggacatctctctggcttc

SEQ ID NO: 704873 - DNA, 18 bp, Homo sapiens
acttggacccttggaaaa

SEQ ID NO: 704874 - DNA, 19 bp, Homo sapiens
acttggagactcctggtct

SEQ ID NO: 704875 - DNA, 14 bp, Homo sapiens
cacctgctccagaa

SEQ ID NO: 704876 - DNA, 14 bp, Homo sapiens
cacctgctcttcta

SEQ ID NO: 704877 - DNA, 22 bp, Homo sapiens
cacctgctgagagacccaagga

SEQ ID NO: 704878 - DNA, 13 bp, Homo sapiens
cacctgctgcgct

SEQ ID NO: 704879 - DNA, 21 bp, Homo sapiens
cacctgctgcgtccccactcc

SEQ ID NO: 704880 - DNA, 11 bp, Homo sapiens
cacctgctgga

SEQ ID NO: 704881 - DNA, 13 bp, Homo sapiens
cacctgctggaaa

SEQ ID NO: 704882 - DNA, 15 bp, Homo sapiens
cacctgctggagtga

SEQ ID NO: 704883 - DNA, 15 bp, Homo sapiens
cacctgctggcccct

SEQ ID NO: 704884 - DNA, 16 bp, Homo sapiens
cacctgctggcccctc

SEQ ID NO: 704885 - DNA, 18 bp, Homo sapiens
cacctgctggcccctcac

SEQ ID NO: 704886 - DNA, 20 bp, Homo sapiens
cacctgctggcccctcacct

SEQ ID NO: 704887 - DNA, 22 bp, Homo sapiens
cacctgctggcccctcacctgg

SEQ ID NO: 704888 - DNA, 14 bp, Homo sapiens
cacctggagcccgc

SEQ ID NO: 704889 - DNA, 18 bp, Homo sapiens
cacctggcagggctcaca

SEQ ID NO: 704890 - DNA, 21 bp, Homo sapiens
cacctggcagggctcacactc

SEQ ID NO: 704891 - DNA, 12 bp, Homo sapiens
cacctggccacc

SEQ ID NO: 704892 - DNA, 16 bp, Homo sapiens
cacctggccccatgtc

SEQ ID NO: 704893 - DNA, 22 bp, Homo sapiens
cacctggccctgcttcctgctt

SEQ ID NO: 704894 - DNA, 23 bp, Homo sapiens
cacctggccgggtcaccctgtga

SEQ ID NO: 704895 - DNA, 12 bp, Homo sapiens
cacctggcctgc

SEQ ID NO: 704896 - DNA, 13 bp, Homo sapiens
cacctggcctgct

SEQ ID NO: 704897 - DNA, 14 bp, Homo sapiens
cacctggcctgggc

SEQ ID NO: 704898 - DNA, 17 bp, Homo sapiens
cacctggcctgggccac

SEQ ID NO: 704899 - DNA, 23 bp, Homo sapiens
cacctggccttaaagagggacag

SEQ ID NO: 704900 - DNA, 23 bp, Homo sapiens
cacctggctgaggttcctctgcc

SEQ ID NO: 704901 - DNA, 19 bp, Homo sapiens
cacctggctgctaggccag

SEQ ID NO: 704902 - DNA, 14 bp, Homo sapiens
cacctgggaacaca

SEQ ID NO: 704903 - DNA, 20 bp, Homo sapiens
cacctgggaacacagttctg

SEQ ID NO: 704904 - DNA, 11 bp, Homo sapiens
cacctgggcac

SEQ ID NO: 704905 - DNA, 13 bp, Homo sapiens
cacctgggcagct

SEQ ID NO: 704906 - DNA, 20 bp, Homo sapiens
cacctgggcagctcctccct

SEQ ID NO: 704907 - DNA, 15 bp, Homo sapiens
cacctgggccccact

SEQ ID NO: 704908 - DNA, 19 bp, Homo sapiens
cacctgggccccactggac

SEQ ID NO: 704909 - DNA, 15 bp, Homo sapiens
cacctgggccctgga

SEQ ID NO: 704910 - DNA, 12 bp, Homo sapiens
cacctgggcctt

SEQ ID NO: 704911 - DNA, 14 bp, Homo sapiens
cacctggggagtgg

SEQ ID NO: 704912 - DNA, 17 bp, Homo sapiens
cacctggggagtgggac

SEQ ID NO: 704913 - DNA, 22 bp, Homo sapiens
cacctggggagtgggacagagt

SEQ ID NO: 704914 - DNA, 16 bp, Homo sapiens
cacctgggggcctggc

SEQ ID NO: 704915 - DNA, 21 bp, Homo sapiens
cacctggggtctctctcccta

SEQ ID NO: 704916 - DNA, 22 bp, Homo sapiens
cacctggttgacccaaaaatgt

SEQ ID NO: 704917 - DNA, 13 bp, Homo sapiens
cacctgtaaaact

SEQ ID NO: 704918 - DNA, 17 bp, Homo sapiens
cacctgtaaaactttat

SEQ ID NO: 704919 - DNA, 23 bp, Homo sapiens
cacctgtaaaactttattttata

SEQ ID NO: 704920 - DNA, 15 bp, Homo sapiens
cacctgtaaacctga

SEQ ID NO: 704921 - DNA, 16 bp, Homo sapiens
cacctgtaaacctgag

SEQ ID NO: 704922 - DNA, 21 bp, Homo sapiens
cacctgtaatcccagctactt

SEQ ID NO: 704923 - DNA, 15 bp, Homo sapiens
cacctgtacattctt

SEQ ID NO: 704924 - DNA, 17 bp, Homo sapiens
cacctgtagctgaagca

SEQ ID NO: 704925 - DNA, 18 bp, Homo sapiens
cacctgtagtcccagcta

SEQ ID NO: 704926 - DNA, 22 bp, Homo sapiens
cacctgtagtcccagctacttg

SEQ ID NO: 704927 - DNA, 21 bp, Homo sapiens
cacctgtccccaccctccact

SEQ ID NO: 704928 - DNA, 14 bp, Homo sapiens
cacctgtccggccc

SEQ ID NO: 704929 - DNA, 18 bp, Homo sapiens
cacctgtccggcccagtg

SEQ ID NO: 704930 - DNA, 18 bp, Homo sapiens
cacctgtcggtggctgcc

SEQ ID NO: 704931 - DNA, 20 bp, Homo sapiens
cacctgtcggtggctgcctt

SEQ ID NO: 704932 - DNA, 23 bp, Homo sapiens
cacctgtcggtggctgcctttga

SEQ ID NO: 704933 - DNA, 15 bp, Homo sapiens
cacctgtctcagcct

SEQ ID NO: 704934 - DNA, 19 bp, Homo sapiens
cacctgtctcagcctccca

SEQ ID NO: 704935 - DNA, 11 bp, Homo sapiens
cacctgtctgg

SEQ ID NO: 704936 - DNA, 19 bp, Homo sapiens
cacctgtgcttcgggccct

SEQ ID NO: 704937 - DNA, 10 bp, Homo sapiens
cacctgtggg

SEQ ID NO: 704938 - DNA, 22 bp, Homo sapiens
cacctgtgggtgtagccaggta

SEQ ID NO: 704939 - DNA, 23 bp, Homo sapiens
cacctgttactaagtcaggagtg

SEQ ID NO: 704940 - DNA, 15 bp, Homo sapiens
cacctgttatgtatg

SEQ ID NO: 704941 - DNA, 23 bp, Homo sapiens
cacctgttcacagaaaaagcatg

SEQ ID NO: 704942 - DNA, 17 bp, Homo sapiens
cacctgtttctggaaga

SEQ ID NO: 704943 - DNA, 21 bp, Homo sapiens
cacctgtttctggaagactgc

SEQ ID NO: 704944 - DNA, 23 bp, Homo sapiens
cacctgtttctggaagactgctc

SEQ ID NO: 704945 - DNA, 14 bp, Homo sapiens
caccttaatatgct

SEQ ID NO: 704946 - DNA, 23 bp, Homo sapiens
caccttaatatgctgcaacaaaa

SEQ ID NO: 704947 - DNA, 13 bp, Homo sapiens
caccttagagaag

SEQ ID NO: 704948 - DNA, 16 bp, Homo sapiens
caccttagagaagcta

SEQ ID NO: 704949 - DNA, 21 bp, Homo sapiens
caccttagagaagctacccct

SEQ ID NO: 704950 - DNA, 23 bp, Homo sapiens
caccttagagaagctacccctca

SEQ ID NO: 704951 - DNA, 18 bp, Homo sapiens
caccttagggtggcttta

SEQ ID NO: 704952 - DNA, 23 bp, Homo sapiens
caccttagggtggctttaattgt

SEQ ID NO: 704953 - DNA, 18 bp, Homo sapiens
caccttatatttctgtgt

SEQ ID NO: 704954 - DNA, 14 bp, Homo sapiens
caccttcaaaatgt

SEQ ID NO: 704955 - DNA, 16 bp, Homo sapiens
caccttcaaaatgttc

SEQ ID NO: 704956 - DNA, 17 bp, Homo sapiens
caccttcaagcgctcca

SEQ ID NO: 704957 - DNA, 22 bp, Homo sapiens
caccttcaagcgctccagggcc

SEQ ID NO: 704958 - DNA, 19 bp, Homo sapiens
caccttcaattcctgggcc

SEQ ID NO: 704959 - DNA, 14 bp, Homo sapiens
caccttcagggctg

SEQ ID NO: 704960 - DNA, 16 bp, Homo sapiens
caccttcatgattata

SEQ ID NO: 704961 - DNA, 14 bp, Homo sapiens
caccttccagctcc

SEQ ID NO: 704962 - DNA, 13 bp, Homo sapiens
caccttcccagct

SEQ ID NO: 704963 - DNA, 19 bp, Homo sapiens
caccttcccagctctccct

SEQ ID NO: 704964 - DNA, 13 bp, Homo sapiens
caccttcccatgc

SEQ ID NO: 704965 - DNA, 15 bp, Homo sapiens
caccttccccagact

SEQ ID NO: 704966 - DNA, 16 bp, Homo sapiens
caccttccccagactc

SEQ ID NO: 704967 - DNA, 20 bp, Homo sapiens
caccttccccagactcagct

SEQ ID NO: 704968 - DNA, 13 bp, Homo sapiens
caccttccccctt

SEQ ID NO: 704969 - DNA, 14 bp, Homo sapiens
caccttcccccttt

SEQ ID NO: 704970 - DNA, 16 bp, Homo sapiens
caccttccctcgactt

SEQ ID NO: 704971 - DNA, 14 bp, Homo sapiens
caccttcccttgcc

SEQ ID NO: 704972 - DNA, 13 bp, Homo sapiens
caccttcctcact

SEQ ID NO: 704973 - DNA, 14 bp, Homo sapiens
caccttcgggcagt

SEQ ID NO: 704974 - DNA, 18 bp, Homo sapiens
caccttcgggcagtcctg

SEQ ID NO: 704975 - DNA, 23 bp, Homo sapiens
caccttcgggcagtcctgtgtga

SEQ ID NO: 704976 - DNA, 22 bp, Homo sapiens
caccttctgggcaagggctcct

SEQ ID NO: 704977 - DNA, 21 bp, Homo sapiens
caccttcttggcttctgggac

SEQ ID NO: 704978 - DNA, 22 bp, Homo sapiens
caccttcttggcttctgggacc

SEQ ID NO: 704979 - DNA, 17 bp, Homo sapiens
caccttgaatctgcctg

SEQ ID NO: 704980 - DNA, 23 bp, Homo sapiens
caccttgacgtttcttctttcta

SEQ ID NO: 704981 - DNA, 23 bp, Homo sapiens
caccttgatcccaatccttatcc

SEQ ID NO: 704982 - DNA, 17 bp, Homo sapiens
caccttgcaacacacag

SEQ ID NO: 704983 - DNA, 21 bp, Homo sapiens
caccttgcaacacacagacac

SEQ ID NO: 704984 - DNA, 14 bp, Homo sapiens
caccttgcactcct

SEQ ID NO: 704985 - DNA, 23 bp, Homo sapiens
caccttgccacccattcttcccg

SEQ ID NO: 704986 - DNA, 14 bp, Homo sapiens
caccttgccagggc

SEQ ID NO: 704987 - DNA, 18 bp, Homo sapiens
caccttgccgagagaggc

SEQ ID NO: 704988 - DNA, 13 bp, Homo sapiens
caccttgccttgc

SEQ ID NO: 704989 - DNA, 13 bp, Homo sapiens
caccttgctgtgt

SEQ ID NO: 704990 - DNA, 14 bp, Homo sapiens
caccttgctgtgtg

SEQ ID NO: 704991 - DNA, 15 bp, Homo sapiens
caccttgctgtgtga

SEQ ID NO: 704992 - DNA, 16 bp, Homo sapiens
caccttggacatcctc

SEQ ID NO: 704993 - DNA, 18 bp, Homo sapiens
caccttggacatcctcct

SEQ ID NO: 704994 - DNA, 14 bp, Homo sapiens
caccttggaccctg

SEQ ID NO: 704995 - DNA, 18 bp, Homo sapiens
caccttggactcctccca

SEQ ID NO: 704996 - DNA, 21 bp, Homo sapiens
caccttggactcctcccacaa

SEQ ID NO: 704997 - DNA, 15 bp, Homo sapiens
caccttggaggagga

SEQ ID NO: 704998 - DNA, 16 bp, Homo sapiens
caccttggaggaggat

SEQ ID NO: 704999 - DNA, 14 bp, Homo sapiens
caccttggcccagg

SEQ ID NO: 705000 - DNA, 16 bp, Homo sapiens
acttggagagcaaagg

SEQ ID NO: 705001 - DNA, 21 bp, Homo sapiens
acttggagagcaaaggcccat

SEQ ID NO: 705002 - DNA, 14 bp, Homo sapiens
acttggagaggggg

SEQ ID NO: 705003 - DNA, 14 bp, Homo sapiens
acttggagccaagg

SEQ ID NO: 705004 - DNA, 19 bp, Homo sapiens
acttggagccaagggttca

SEQ ID NO: 705005 - DNA, 15 bp, Homo sapiens
acttggagcccgtgc

SEQ ID NO: 705006 - DNA, 19 bp, Homo sapiens
acttggagggtctgggggc

SEQ ID NO: 705007 - DNA, 23 bp, Homo sapiens
acttggatggacttgtatagtga

SEQ ID NO: 705008 - DNA, 16 bp, Homo sapiens
acttggcaacagaagc

SEQ ID NO: 705009 - DNA, 16 bp, Homo sapiens
acttggcacttaagtg

SEQ ID NO: 705010 - DNA, 18 bp, Homo sapiens
acttggcagctttttctg

SEQ ID NO: 705011 - DNA, 19 bp, Homo sapiens
acttggcatacaaaatatt

SEQ ID NO: 705012 - DNA, 13 bp, Homo sapiens
acttggcatttct

SEQ ID NO: 705013 - DNA, 18 bp, Homo sapiens
acttggcccagaaagctg

SEQ ID NO: 705014 - DNA, 16 bp, Homo sapiens
acttggcctcatgctg

SEQ ID NO: 705015 - DNA, 19 bp, Homo sapiens
acttggctcgaatctctgt

SEQ ID NO: 705016 - DNA, 20 bp, Homo sapiens
acttggctcgaatctctgtg

SEQ ID NO: 705017 - DNA, 14 bp, Homo sapiens
acttggctggaatt

SEQ ID NO: 705018 - DNA, 23 bp, Homo sapiens
acttggctgtccttccccttccc

SEQ ID NO: 705019 - DNA, 14 bp, Homo sapiens
acttgggagcctga

SEQ ID NO: 705020 - DNA, 19 bp, Homo sapiens
acttgggagctgctgggct

SEQ ID NO: 705021 - DNA, 14 bp, Homo sapiens
acttgggccactgt

SEQ ID NO: 705022 - DNA, 23 bp, Homo sapiens
acttggggccttcccccttgtgg

SEQ ID NO: 705023 - DNA, 19 bp, Homo sapiens
acttgggggttcaggcccg

SEQ ID NO: 705024 - DNA, 20 bp, Homo sapiens
acttgggggttcaggcccgg

SEQ ID NO: 705025 - DNA, 14 bp, Homo sapiens
acttggtcaccagc

SEQ ID NO: 705026 - DNA, 14 bp, Homo sapiens
acttggtctgcaga

SEQ ID NO: 705027 - DNA, 19 bp, Homo sapiens
acttggtggcttttccttg

SEQ ID NO: 705028 - DNA, 14 bp, Homo sapiens
acttggtgtactgg

SEQ ID NO: 705029 - DNA, 16 bp, Homo sapiens
acttggtgtactgggt

SEQ ID NO: 705030 - DNA, 15 bp, Homo sapiens
acttggttctgaagc

SEQ ID NO: 705031 - DNA, 15 bp, Homo sapiens
acttggttctgcttc

SEQ ID NO: 705032 - DNA, 20 bp, Homo sapiens
acttggttggtagggtggga

SEQ ID NO: 705033 - DNA, 14 bp, Homo sapiens
acttggtttagggt

SEQ ID NO: 705034 - DNA, 16 bp, Homo sapiens
acttggtttcctattt

SEQ ID NO: 705035 - DNA, 17 bp, Homo sapiens
acttggttttatggtta

SEQ ID NO: 705036 - DNA, 14 bp, Homo sapiens
acttggttttgcta

SEQ ID NO: 705037 - DNA, 12 bp, Homo sapiens
acttgtaaaatg

SEQ ID NO: 705038 - DNA, 13 bp, Homo sapiens
acttgtaaaatgc

SEQ ID NO: 705039 - DNA, 16 bp, Homo sapiens
acttgtaatatgtata

SEQ ID NO: 705040 - DNA, 20 bp, Homo sapiens
acttgtacaaaataaacaaa

SEQ ID NO: 705041 - DNA, 18 bp, Homo sapiens
acttgtactatgttaata

SEQ ID NO: 705042 - DNA, 22 bp, Homo sapiens
acttgtaggaatctgccttcca

SEQ ID NO: 705043 - DNA, 14 bp, Homo sapiens
acttgtaggataag

SEQ ID NO: 705044 - DNA, 17 bp, Homo sapiens
acttgtagggatgcctt

SEQ ID NO: 705045 - DNA, 14 bp, Homo sapiens
acttgtatatatgg

SEQ ID NO: 705046 - DNA, 23 bp, Homo sapiens
acttgtatatatggatcagagga

SEQ ID NO: 705047 - DNA, 20 bp, Homo sapiens
acttgtatattccaccattc

SEQ ID NO: 705048 - DNA, 15 bp, Homo sapiens
acttgtatatttgta

SEQ ID NO: 705049 - DNA, 17 bp, Homo sapiens
acttgtatatttgtaca

SEQ ID NO: 705050 - DNA, 14 bp, Homo sapiens
acttgtatgaaaga

SEQ ID NO: 705051 - DNA, 14 bp, Homo sapiens
acttgtattccctt

SEQ ID NO: 705052 - DNA, 17 bp, Homo sapiens
acttgtattgactttat

SEQ ID NO: 705053 - DNA, 22 bp, Homo sapiens
acttgtattgactttatgttgt

SEQ ID NO: 705054 - DNA, 18 bp, Homo sapiens
acttgtcaaagaaggttt

SEQ ID NO: 705055 - DNA, 14 bp, Homo sapiens
acttgtcacgaatt

SEQ ID NO: 705056 - DNA, 16 bp, Homo sapiens
acttgtcaggcatggc

SEQ ID NO: 705057 - DNA, 17 bp, Homo sapiens
acttgtcatatcactaa

SEQ ID NO: 705058 - DNA, 20 bp, Homo sapiens
acttgtctcttcatctaata

SEQ ID NO: 705059 - DNA, 14 bp, Homo sapiens
acttgtctgaggcc

SEQ ID NO: 705060 - DNA, 15 bp, Homo sapiens
acttgtctgaggcct

SEQ ID NO: 705061 - DNA, 17 bp, Homo sapiens
acttgtctgaggcctca

SEQ ID NO: 705062 - DNA, 20 bp, Homo sapiens
acttgtctgaggcctcatcc

SEQ ID NO: 705063 - DNA, 12 bp, Homo sapiens
acttgtctgtca

SEQ ID NO: 705064 - DNA, 15 bp, Homo sapiens
acttgtctttttctg

SEQ ID NO: 705065 - DNA, 14 bp, Homo sapiens
acttgtgccagccc

SEQ ID NO: 705066 - DNA, 15 bp, Homo sapiens
acttgtgctatagtg

SEQ ID NO: 705067 - DNA, 15 bp, Homo sapiens
acttgtggcctcaag

SEQ ID NO: 705068 - DNA, 15 bp, Homo sapiens
acttgtggtgtgacc

SEQ ID NO: 705069 - DNA, 17 bp, Homo sapiens
acttgtggtgtgaccat

SEQ ID NO: 705070 - DNA, 18 bp, Homo sapiens
acttgtggtgtgaccatg

SEQ ID NO: 705071 - DNA, 22 bp, Homo sapiens
acttgtggtgtgaccatgttca

SEQ ID NO: 705072 - DNA, 16 bp, Homo sapiens
acttgtggttgaatta

SEQ ID NO: 705073 - DNA, 22 bp, Homo sapiens
acttgtgtatattttaatgaat

SEQ ID NO: 705074 - DNA, 20 bp, Homo sapiens
acttgtgtgtgggctgtgag

SEQ ID NO: 705075 - DNA, 14 bp, Homo sapiens
acttgtgtttgctt

SEQ ID NO: 705076 - DNA, 15 bp, Homo sapiens
acttgtgtttgctta

SEQ ID NO: 705077 - DNA, 22 bp, Homo sapiens
acttgtgtttgcttaaacaaag

SEQ ID NO: 705078 - DNA, 21 bp, Homo sapiens
acttgttcaaaatatgttctt

SEQ ID NO: 705079 - DNA, 11 bp, Homo sapiens
acttgttcatt

SEQ ID NO: 705080 - DNA, 13 bp, Homo sapiens
acttgttcattta

SEQ ID NO: 705081 - DNA, 14 bp, Homo sapiens
acttgttccagatg

SEQ ID NO: 705082 - DNA, 15 bp, Homo sapiens
acttgttccagctct

SEQ ID NO: 705083 - DNA, 17 bp, Homo sapiens
acttgttccagctcttt

SEQ ID NO: 705084 - DNA, 23 bp, Homo sapiens
acttgttctgagtaagtgtgttc

SEQ ID NO: 705085 - DNA, 17 bp, Homo sapiens
acttgttcttggttcct

SEQ ID NO: 705086 - DNA, 22 bp, Homo sapiens
acttgtttactcattgaagcag

SEQ ID NO: 705087 - DNA, 19 bp, Homo sapiens
acttgtttctctgttgtaa

SEQ ID NO: 705088 - DNA, 20 bp, Homo sapiens
acttgtttgaatatttgttt

SEQ ID NO: 705089 - DNA, 22 bp, Homo sapiens
acttgtttgaatatttgtttta

SEQ ID NO: 705090 - DNA, 18 bp, Homo sapiens
acttgtttggtctcttac

SEQ ID NO: 705091 - DNA, 15 bp, Homo sapiens
acttgttttaaaatg

SEQ ID NO: 705092 - DNA, 12 bp, Homo sapiens
acttgttttaac

SEQ ID NO: 705093 - DNA, 15 bp, Homo sapiens
actttaaaaaaacaa

SEQ ID NO: 705094 - DNA, 15 bp, Homo sapiens
actttaaaaaggaaa

SEQ ID NO: 705095 - DNA, 16 bp, Homo sapiens
actttaaaactgtatt

SEQ ID NO: 705096 - DNA, 17 bp, Homo sapiens
actttaaaagaaaatag

SEQ ID NO: 705097 - DNA, 12 bp, Homo sapiens
actttaaaagca

SEQ ID NO: 705098 - DNA, 20 bp, Homo sapiens
actttaaaatgcgaaattat

SEQ ID NO: 705099 - DNA, 20 bp, Homo sapiens
actttaaacatctagcagta

SEQ ID NO: 705100 - DNA, 19 bp, Homo sapiens
actttaaagctcaggaggg

SEQ ID NO: 705101 - DNA, 15 bp, Homo sapiens
actttaaccctctct

SEQ ID NO: 705102 - DNA, 19 bp, Homo sapiens
actttaaccctctcttccc

SEQ ID NO: 705103 - DNA, 14 bp, Homo sapiens
actttaagaggaca

SEQ ID NO: 705104 - DNA, 16 bp, Homo sapiens
actttaagcactacat

SEQ ID NO: 705105 - DNA, 12 bp, Homo sapiens
actttaagtttt

SEQ ID NO: 705106 - DNA, 15 bp, Homo sapiens
actttaatggcctgg

SEQ ID NO: 705107 - DNA, 19 bp, Homo sapiens
actttaattaccaacctgt

SEQ ID NO: 705108 - DNA, 19 bp, Homo sapiens
actttaattgaagaactgc

SEQ ID NO: 705109 - DNA, 21 bp, Homo sapiens
actttacaaaccattacctgt

SEQ ID NO: 705110 - DNA, 22 bp, Homo sapiens
actttacaaaccattacctgta

SEQ ID NO: 705111 - DNA, 16 bp, Homo sapiens
actttacacaagaatc

SEQ ID NO: 705112 - DNA, 19 bp, Homo sapiens
actttacagaaatggactg

SEQ ID NO: 705113 - DNA, 17 bp, Homo sapiens
actttacccacctagaa

SEQ ID NO: 705114 - DNA, 18 bp, Homo sapiens
actttacccacctagaac

SEQ ID NO: 705115 - DNA, 22 bp, Homo sapiens
actttacctctctgtcatgtgc

SEQ ID NO: 705116 - DNA, 19 bp, Homo sapiens
actttaccttttttataca

SEQ ID NO: 705117 - DNA, 15 bp, Homo sapiens
actttactctgtgtt

SEQ ID NO: 705118 - DNA, 15 bp, Homo sapiens
actttagaagcctgc

SEQ ID NO: 705119 - DNA, 15 bp, Homo sapiens
actttagaatgagag

SEQ ID NO: 705120 - DNA, 14 bp, Homo sapiens
actttagacatttt

SEQ ID NO: 705121 - DNA, 15 bp, Homo sapiens
actttagatgctgat

SEQ ID NO: 705122 - DNA, 16 bp, Homo sapiens
actttagctagtatct

SEQ ID NO: 705123 - DNA, 19 bp, Homo sapiens
actttagggggtgggaggg

SEQ ID NO: 705124 - DNA, 17 bp, Homo sapiens
actttagtatttttact

SEQ ID NO: 705125 - DNA, 11 bp, Homo sapiens
caccttggcct

SEQ ID NO: 705126 - DNA, 14 bp, Homo sapiens
caccttggccttct

SEQ ID NO: 705127 - DNA, 20 bp, Homo sapiens
caccttgtcatgtaccatca

SEQ ID NO: 705128 - DNA, 23 bp, Homo sapiens
caccttgtcatgtaccatcaata

SEQ ID NO: 705129 - DNA, 15 bp, Homo sapiens
caccttgtcctggct

SEQ ID NO: 705130 - DNA, 12 bp, Homo sapiens
caccttgtgttt

SEQ ID NO: 705131 - DNA, 12 bp, Homo sapiens
cacctttactgt

SEQ ID NO: 705132 - DNA, 13 bp, Homo sapiens
cacctttactgtg

SEQ ID NO: 705133 - DNA, 22 bp, Homo sapiens
cacctttactgtgcttattttt

SEQ ID NO: 705134 - DNA, 14 bp, Homo sapiens
cacctttattaaaa

SEQ ID NO: 705135 - DNA, 10 bp, Homo sapiens
cacctttcct

SEQ ID NO: 705136 - DNA, 18 bp, Homo sapiens
cacctttcctctccctca

SEQ ID NO: 705137 - DNA, 23 bp, Homo sapiens
cacctttcctctccctcaggggc

SEQ ID NO: 705138 - DNA, 12 bp, Homo sapiens
cacctttctagt

SEQ ID NO: 705139 - DNA, 16 bp, Homo sapiens
cacctttctctgagaa

SEQ ID NO: 705140 - DNA, 14 bp, Homo sapiens
cacctttgggatca

SEQ ID NO: 705141 - DNA, 16 bp, Homo sapiens
cacctttggtgcagag

SEQ ID NO: 705142 - DNA, 21 bp, Homo sapiens
cacctttgtaagacatttgta

SEQ ID NO: 705143 - DNA, 16 bp, Homo sapiens
cacctttgtctggatg

SEQ ID NO: 705144 - DNA, 17 bp, Homo sapiens
cacctttgtctggatgc

SEQ ID NO: 705145 - DNA, 23 bp, Homo sapiens
cacctttgtggggtttttggaga

SEQ ID NO: 705146 - DNA, 13 bp, Homo sapiens
cacctttgtgtat

SEQ ID NO: 705147 - DNA, 14 bp, Homo sapiens
cacctttgtgtatt

SEQ ID NO: 705148 - DNA, 21 bp, Homo sapiens
caccttttctgtggctggctc

SEQ ID NO: 705149 - DNA, 12 bp, Homo sapiens
cacgaaacttgt

SEQ ID NO: 705150 - DNA, 21 bp, Homo sapiens
cacgaaacttgttattgtgaa

SEQ ID NO: 705151 - DNA, 22 bp, Homo sapiens
cacgaaacttgttattgtgaat

SEQ ID NO: 705152 - DNA, 17 bp, Homo sapiens
cacgaaatgttattttt

SEQ ID NO: 705153 - DNA, 18 bp, Homo sapiens
cacgaacccacctgctga

SEQ ID NO: 705154 - DNA, 16 bp, Homo sapiens
cacgaactgttcacac

SEQ ID NO: 705155 - DNA, 12 bp, Homo sapiens
cacgaagcaatt

SEQ ID NO: 705156 - DNA, 19 bp, Homo sapiens
cacgaagccttaagccata

SEQ ID NO: 705157 - DNA, 18 bp, Homo sapiens
cacgaagtgttgcatgga

SEQ ID NO: 705158 - DNA, 16 bp, Homo sapiens
cacgaatagacatcaa

SEQ ID NO: 705159 - DNA, 14 bp, Homo sapiens
cacgacccctgcct

SEQ ID NO: 705160 - DNA, 20 bp, Homo sapiens
cacgacccctgcctcgaggg

SEQ ID NO: 705161 - DNA, 15 bp, Homo sapiens
cacgaccgccccagt

SEQ ID NO: 705162 - DNA, 17 bp, Homo sapiens
cacgactcttcctgcaa

SEQ ID NO: 705163 - DNA, 19 bp, Homo sapiens
cacgactcttcctgcaaag

SEQ ID NO: 705164 - DNA, 17 bp, Homo sapiens
cacgactggtcaccttg

SEQ ID NO: 705165 - DNA, 13 bp, Homo sapiens
cacgactgtctcc

SEQ ID NO: 705166 - DNA, 17 bp, Homo sapiens
cacgagatcttccttcc

SEQ ID NO: 705167 - DNA, 14 bp, Homo sapiens
cacgagatttcttt

SEQ ID NO: 705168 - DNA, 21 bp, Homo sapiens
cacgagcaaacccagaggtgg

SEQ ID NO: 705169 - DNA, 12 bp, Homo sapiens
cacgagccacaa

SEQ ID NO: 705170 - DNA, 23 bp, Homo sapiens
cacgaggaatctgtgggtctggg

SEQ ID NO: 705171 - DNA, 16 bp, Homo sapiens
cacgaggctgccccca

SEQ ID NO: 705172 - DNA, 12 bp, Homo sapiens
cacgagggctgg

SEQ ID NO: 705173 - DNA, 13 bp, Homo sapiens
cacgagggctggc

SEQ ID NO: 705174 - DNA, 16 bp, Homo sapiens
cacgaggggacccatg

SEQ ID NO: 705175 - DNA, 21 bp, Homo sapiens
cacgagggtctcccctcctgc

SEQ ID NO: 705176 - DNA, 23 bp, Homo sapiens
cacgagggtctcccctcctgcac

SEQ ID NO: 705177 - DNA, 22 bp, Homo sapiens
cacgaggttaaagaagctgcat

SEQ ID NO: 705178 - DNA, 15 bp, Homo sapiens
cacgagtcacctgca

SEQ ID NO: 705179 - DNA, 17 bp, Homo sapiens
cacgagtcacctgcaag

SEQ ID NO: 705180 - DNA, 23 bp, Homo sapiens
cacgagtcacctgcaagccccag

SEQ ID NO: 705181 - DNA, 12 bp, Homo sapiens
cacgatgaaaaa

SEQ ID NO: 705182 - DNA, 15 bp, Homo sapiens
cacgatgcatttaat

SEQ ID NO: 705183 - DNA, 19 bp, Homo sapiens
cacgatgcatttaataaag

SEQ ID NO: 705184 - DNA, 22 bp, Homo sapiens
cacgatgtggccctggcctgct

SEQ ID NO: 705185 - DNA, 14 bp, Homo sapiens
cacgattggagaat

SEQ ID NO: 705186 - DNA, 16 bp, Homo sapiens
cacgattggagaatac

SEQ ID NO: 705187 - DNA, 14 bp, Homo sapiens
cacgatttctgttt

SEQ ID NO: 705188 - DNA, 16 bp, Homo sapiens
cacgattttcaagatt

SEQ ID NO: 705189 - DNA, 21 bp, Homo sapiens
cacgattttctccagctcaga

SEQ ID NO: 705190 - DNA, 23 bp, Homo sapiens
cacgcaagggcatcaggcactgg

SEQ ID NO: 705191 - DNA, 12 bp, Homo sapiens
cacgcacacaca

SEQ ID NO: 705192 - DNA, 15 bp, Homo sapiens
cacgcacacacacaa

SEQ ID NO: 705193 - DNA, 22 bp, Homo sapiens
cacgcacacacacacacaggag

SEQ ID NO: 705194 - DNA, 20 bp, Homo sapiens
cacgcacacacacatacaga

SEQ ID NO: 705195 - DNA, 19 bp, Homo sapiens
cacgcacacatcttacctc

SEQ ID NO: 705196 - DNA, 16 bp, Homo sapiens
cacgcacctccacgcc

SEQ ID NO: 705197 - DNA, 17 bp, Homo sapiens
cacgcacctccacgcca

SEQ ID NO: 705198 - DNA, 15 bp, Homo sapiens
cacgcacctgcctca

SEQ ID NO: 705199 - DNA, 16 bp, Homo sapiens
cacgcacctgcctcag

SEQ ID NO: 705200 - DNA, 19 bp, Homo sapiens
cacgcacctgtagtcccag

SEQ ID NO: 705201 - DNA, 21 bp, Homo sapiens
cacgcacctgtagtcccagct

SEQ ID NO: 705202 - DNA, 17 bp, Homo sapiens
cacgcacgcacacgcac

SEQ ID NO: 705203 - DNA, 17 bp, Homo sapiens
cacgcacttcgggaggt

SEQ ID NO: 705204 - DNA, 20 bp, Homo sapiens
cacgcagaggacgcacgctc

SEQ ID NO: 705205 - DNA, 21 bp, Homo sapiens
cacgcagaggacgcacgctcg

SEQ ID NO: 705206 - DNA, 14 bp, Homo sapiens
cacgcagcaccctt

SEQ ID NO: 705207 - DNA, 15 bp, Homo sapiens
cacgcagccgccgcc

SEQ ID NO: 705208 - DNA, 16 bp, Homo sapiens
cacgcagcctgctctg

SEQ ID NO: 705209 - DNA, 16 bp, Homo sapiens
cacgcaggcggccagg

SEQ ID NO: 705210 - DNA, 18 bp, Homo sapiens
cacgcaggggccctgagc

SEQ ID NO: 705211 - DNA, 19 bp, Homo sapiens
cacgcaggggccctgagcc

SEQ ID NO: 705212 - DNA, 15 bp, Homo sapiens
cacgcatgcagtgtt

SEQ ID NO: 705213 - DNA, 16 bp, Homo sapiens
cacgcatgggcattgc

SEQ ID NO: 705214 - DNA, 15 bp, Homo sapiens
cacgccacccccgcc

SEQ ID NO: 705215 - DNA, 22 bp, Homo sapiens
cacgccacccccgcccccaccg

SEQ ID NO: 705216 - DNA, 14 bp, Homo sapiens
cacgccactgcact

SEQ ID NO: 705217 - DNA, 15 bp, Homo sapiens
cacgccactgcctcc

SEQ ID NO: 705218 - DNA, 15 bp, Homo sapiens
cacgccagctcctct

SEQ ID NO: 705219 - DNA, 13 bp, Homo sapiens
cacgccccagccc

SEQ ID NO: 705220 - DNA, 14 bp, Homo sapiens
cacgcccccaggaa

SEQ ID NO: 705221 - DNA, 15 bp, Homo sapiens
cacgcccccaggaat

SEQ ID NO: 705222 - DNA, 16 bp, Homo sapiens
cacgcccgactagcag

SEQ ID NO: 705223 - DNA, 14 bp, Homo sapiens
cacgccgccctcca

SEQ ID NO: 705224 - DNA, 17 bp, Homo sapiens
cacgccgccctccatcc

SEQ ID NO: 705225 - DNA, 15 bp, Homo sapiens
cacgccggcctctgc

SEQ ID NO: 705226 - DNA, 21 bp, Homo sapiens
cacgccgggagaagccacctt

SEQ ID NO: 705227 - DNA, 13 bp, Homo sapiens
cacgcctcccact

SEQ ID NO: 705228 - DNA, 15 bp, Homo sapiens
cacgcctcccactgg

SEQ ID NO: 705229 - DNA, 13 bp, Homo sapiens
cacgcctcctggc

SEQ ID NO: 705230 - DNA, 13 bp, Homo sapiens
cacgcctgagcgt

SEQ ID NO: 705231 - DNA, 16 bp, Homo sapiens
cacgcctgcaggctgg

SEQ ID NO: 705232 - DNA, 16 bp, Homo sapiens
cacgcctgtaatccca

SEQ ID NO: 705233 - DNA, 17 bp, Homo sapiens
cacgcctgtaatcccag

SEQ ID NO: 705234 - DNA, 18 bp, Homo sapiens
cacgcctgtaatcccagc

SEQ ID NO: 705235 - DNA, 21 bp, Homo sapiens
cacgcctgtaatcccagcact

SEQ ID NO: 705236 - DNA, 23 bp, Homo sapiens
cacgcctgtaatcccagcacttt

SEQ ID NO: 705237 - DNA, 17 bp, Homo sapiens
cacgcgcgagtgtgctg

SEQ ID NO: 705238 - DNA, 13 bp, Homo sapiens
cacgcgcttccct

SEQ ID NO: 705239 - DNA, 15 bp, Homo sapiens
cacgcgcttccctgg

SEQ ID NO: 705240 - DNA, 15 bp, Homo sapiens
cacgcgggggccttg

SEQ ID NO: 705241 - DNA, 19 bp, Homo sapiens
cacgctccagctgccccgg

SEQ ID NO: 705242 - DNA, 12 bp, Homo sapiens
cacgctcccctc

SEQ ID NO: 705243 - DNA, 19 bp, Homo sapiens
cacgctcccctccatcccc

SEQ ID NO: 705244 - DNA, 21 bp, Homo sapiens
cacgctccctgacttctcccc

SEQ ID NO: 705245 - DNA, 15 bp, Homo sapiens
cacgctcgctgccat

SEQ ID NO: 705246 - DNA, 16 bp, Homo sapiens
cacgctcgctgccatc

SEQ ID NO: 705247 - DNA, 17 bp, Homo sapiens
cacgctcgctgccatca

SEQ ID NO: 705248 - DNA, 19 bp, Homo sapiens
cacgctcgctgccatcacc

SEQ ID NO: 705249 - DNA, 21 bp, Homo sapiens
cacgctcttgaggaagcccag

SEQ ID NO: 705250 - DNA, 22 bp, Homo sapiens
cacgctgcctgccaaagtagtc

SEQ ID NO: 705251 - DNA, 15 bp, Homo sapiens
actttagtctgcaaa

SEQ ID NO: 705252 - DNA, 19 bp, Homo sapiens
actttagttatattcactg

SEQ ID NO: 705253 - DNA, 12 bp, Homo sapiens
actttataaatt

SEQ ID NO: 705254 - DNA, 13 bp, Homo sapiens
actttataaattt

SEQ ID NO: 705255 - DNA, 14 bp, Homo sapiens
actttataaatttc

SEQ ID NO: 705256 - DNA, 16 bp, Homo sapiens
actttataactaacat

SEQ ID NO: 705257 - DNA, 19 bp, Homo sapiens
actttatagttgttttata

SEQ ID NO: 705258 - DNA, 14 bp, Homo sapiens
actttatatcttgt

SEQ ID NO: 705259 - DNA, 23 bp, Homo sapiens
actttatatcttgtttacaataa

SEQ ID NO: 705260 - DNA, 13 bp, Homo sapiens
actttatcacatt

SEQ ID NO: 705261 - DNA, 13 bp, Homo sapiens
actttatcactta

SEQ ID NO: 705262 - DNA, 21 bp, Homo sapiens
actttatgtgtaaatacataa

SEQ ID NO: 705263 - DNA, 19 bp, Homo sapiens
actttatgttgtatgattc

SEQ ID NO: 705264 - DNA, 18 bp, Homo sapiens
actttatgtttgtctttt

SEQ ID NO: 705265 - DNA, 12 bp, Homo sapiens
actttattaaat

SEQ ID NO: 705266 - DNA, 16 bp, Homo sapiens
actttattaacttacg

SEQ ID NO: 705267 - DNA, 14 bp, Homo sapiens
actttattaatatg

SEQ ID NO: 705268 - DNA, 15 bp, Homo sapiens
actttattcttgctg

SEQ ID NO: 705269 - DNA, 16 bp, Homo sapiens
actttattcttgctgg

SEQ ID NO: 705270 - DNA, 22 bp, Homo sapiens
actttattgcaactcttttaag

SEQ ID NO: 705271 - DNA, 18 bp, Homo sapiens
actttattgcatatagat

SEQ ID NO: 705272 - DNA, 21 bp, Homo sapiens
actttattgcttaatttctgc

SEQ ID NO: 705273 - DNA, 13 bp, Homo sapiens
actttattgtaca

SEQ ID NO: 705274 - DNA, 20 bp, Homo sapiens
actttattgtacagactgtt

SEQ ID NO: 705275 - DNA, 21 bp, Homo sapiens
actttattgtacagactgttt

SEQ ID NO: 705276 - DNA, 14 bp, Homo sapiens
actttatttaaatg

SEQ ID NO: 705277 - DNA, 17 bp, Homo sapiens
actttatttatttctag

SEQ ID NO: 705278 - DNA, 12 bp, Homo sapiens
actttatttctg

SEQ ID NO: 705279 - DNA, 23 bp, Homo sapiens
actttatttgtaaaccattgtaa

SEQ ID NO: 705280 - DNA, 15 bp, Homo sapiens
actttatttttctaa

SEQ ID NO: 705281 - DNA, 20 bp, Homo sapiens
actttatttttctaagtgta

SEQ ID NO: 705282 - DNA, 15 bp, Homo sapiens
actttatttttctga

SEQ ID NO: 705283 - DNA, 17 bp, Homo sapiens
actttcacatagatgtc

SEQ ID NO: 705284 - DNA, 16 bp, Homo sapiens
actttcactataatgt

SEQ ID NO: 705285 - DNA, 20 bp, Homo sapiens
actttcactataatgtgaaa

SEQ ID NO: 705286 - DNA, 23 bp, Homo sapiens
actttcactataatgtgaaatgt

SEQ ID NO: 705287 - DNA, 16 bp, Homo sapiens
actttcacttcttcct

SEQ ID NO: 705288 - DNA, 17 bp, Homo sapiens
actttcacttcttccta

SEQ ID NO: 705289 - DNA, 19 bp, Homo sapiens
actttcacttcttcctatt

SEQ ID NO: 705290 - DNA, 13 bp, Homo sapiens
actttcactttga

SEQ ID NO: 705291 - DNA, 13 bp, Homo sapiens
actttcagagccc

SEQ ID NO: 705292 - DNA, 18 bp, Homo sapiens
actttcaggtactaaata

SEQ ID NO: 705293 - DNA, 22 bp, Homo sapiens
actttcatcttaaactaatacg

SEQ ID NO: 705294 - DNA, 19 bp, Homo sapiens
actttccaccccctccctg

SEQ ID NO: 705295 - DNA, 20 bp, Homo sapiens
actttccaccccctccctgg

SEQ ID NO: 705296 - DNA, 17 bp, Homo sapiens
actttccacttcttcct

SEQ ID NO: 705297 - DNA, 22 bp, Homo sapiens
actttccacttcttcctttctc

SEQ ID NO: 705298 - DNA, 14 bp, Homo sapiens
actttccattaaat

SEQ ID NO: 705299 - DNA, 16 bp, Homo sapiens
actttccattaaatca

SEQ ID NO: 705300 - DNA, 18 bp, Homo sapiens
actttcccaaatgtattg

SEQ ID NO: 705301 - DNA, 23 bp, Homo sapiens
actttccccagatcaaattctat

SEQ ID NO: 705302 - DNA, 14 bp, Homo sapiens
actttcccccttcc

SEQ ID NO: 705303 - DNA, 20 bp, Homo sapiens
actttcccccttcccgcctt

SEQ ID NO: 705304 - DNA, 21 bp, Homo sapiens
actttccctagaaagccatat

SEQ ID NO: 705305 - DNA, 22 bp, Homo sapiens
actttcccttgcttttccctct

SEQ ID NO: 705306 - DNA, 21 bp, Homo sapiens
actttcgaccgactttcccca

SEQ ID NO: 705307 - DNA, 15 bp, Homo sapiens
actttcgtacattgg

SEQ ID NO: 705308 - DNA, 22 bp, Homo sapiens
actttctatagcagattgtgta

SEQ ID NO: 705309 - DNA, 14 bp, Homo sapiens
actttctcagtttt

SEQ ID NO: 705310 - DNA, 16 bp, Homo sapiens
actttctccatttaag

SEQ ID NO: 705311 - DNA, 23 bp, Homo sapiens
actttctctaataataaatagtt

SEQ ID NO: 705312 - DNA, 19 bp, Homo sapiens
actttctcttcatactttt

SEQ ID NO: 705313 - DNA, 12 bp, Homo sapiens
actttctgattg

SEQ ID NO: 705314 - DNA, 14 bp, Homo sapiens
actttctgcctgga

SEQ ID NO: 705315 - DNA, 17 bp, Homo sapiens
actttctggtgctgtct

SEQ ID NO: 705316 - DNA, 14 bp, Homo sapiens
actttctgtaaact

SEQ ID NO: 705317 - DNA, 18 bp, Homo sapiens
actttctgtaaactcaaa

SEQ ID NO: 705318 - DNA, 19 bp, Homo sapiens
actttctgttgccacaacc

SEQ ID NO: 705319 - DNA, 20 bp, Homo sapiens
actttcttcaccaagtgcaa

SEQ ID NO: 705320 - DNA, 21 bp, Homo sapiens
actttcttctagctgagcttt

SEQ ID NO: 705321 - DNA, 13 bp, Homo sapiens
actttctttctca

SEQ ID NO: 705322 - DNA, 19 bp, Homo sapiens
actttcttttctggaatgt

SEQ ID NO: 705323 - DNA, 18 bp, Homo sapiens
actttgaaaacaattcag

SEQ ID NO: 705324 - DNA, 20 bp, Homo sapiens
actttgaaaggagatgtctt

SEQ ID NO: 705325 - DNA, 23 bp, Homo sapiens
actttgaaagttaactcttcaaa

SEQ ID NO: 705326 - DNA, 17 bp, Homo sapiens
actttgaaatgtgtttc

SEQ ID NO: 705327 - DNA, 23 bp, Homo sapiens
actttgaaatgtgtttctgtata

SEQ ID NO: 705328 - DNA, 23 bp, Homo sapiens
actttgaagggcaagaaatggcg

SEQ ID NO: 705329 - DNA, 16 bp, Homo sapiens
actttgacaattactc

SEQ ID NO: 705330 - DNA, 23 bp, Homo sapiens
actttgacacttttcatatcatt

SEQ ID NO: 705331 - DNA, 12 bp, Homo sapiens
actttgacctct

SEQ ID NO: 705332 - DNA, 16 bp, Homo sapiens
actttgacctctgcag

SEQ ID NO: 705333 - DNA, 15 bp, Homo sapiens
actttgatccttgga

SEQ ID NO: 705334 - DNA, 18 bp, Homo sapiens
actttgatccttggaaac

SEQ ID NO: 705335 - DNA, 15 bp, Homo sapiens
actttgatctctgct

SEQ ID NO: 705336 - DNA, 12 bp, Homo sapiens
actttgcaaatt

SEQ ID NO: 705337 - DNA, 18 bp, Homo sapiens
actttgcaaattatttat

SEQ ID NO: 705338 - DNA, 22 bp, Homo sapiens
actttgcaaattatttattact

SEQ ID NO: 705339 - DNA, 23 bp, Homo sapiens
actttgcaaattatttattactt

SEQ ID NO: 705340 - DNA, 20 bp, Homo sapiens
actttgcaggcggccctcag

SEQ ID NO: 705341 - DNA, 23 bp, Homo sapiens
actttgcaggcggccctcagtgc

SEQ ID NO: 705342 - DNA, 16 bp, Homo sapiens
actttgccatttttct

SEQ ID NO: 705343 - DNA, 19 bp, Homo sapiens
actttgccatttttctata

SEQ ID NO: 705344 - DNA, 22 bp, Homo sapiens
actttgcccagggtcctgtgcc

SEQ ID NO: 705345 - DNA, 23 bp, Homo sapiens
actttgcccagggtcctgtgcct

SEQ ID NO: 705346 - DNA, 16 bp, Homo sapiens
actttgccttctggtt

SEQ ID NO: 705347 - DNA, 18 bp, Homo sapiens
actttgccttctggttat

SEQ ID NO: 705348 - DNA, 14 bp, Homo sapiens
actttgctctcttc

SEQ ID NO: 705349 - DNA, 12 bp, Homo sapiens
actttgcttgag

SEQ ID NO: 705350 - DNA, 17 bp, Homo sapiens
actttgcttgagaatcc

SEQ ID NO: 705351 - DNA, 20 bp, Homo sapiens
actttgcttgctttgaagta

SEQ ID NO: 705352 - DNA, 23 bp, Homo sapiens
actttggaaccagactcttgcct

SEQ ID NO: 705353 - DNA, 17 bp, Homo sapiens
actttggaagtttgtgt

SEQ ID NO: 705354 - DNA, 18 bp, Homo sapiens
actttggacagtggcctc

SEQ ID NO: 705355 - DNA, 21 bp, Homo sapiens
actttggcatcttttggagga

SEQ ID NO: 705356 - DNA, 16 bp, Homo sapiens
actttggctacaaata

SEQ ID NO: 705357 - DNA, 17 bp, Homo sapiens
actttggcttctcctgt

SEQ ID NO: 705358 - DNA, 18 bp, Homo sapiens
actttggcttctcctgtg

SEQ ID NO: 705359 - DNA, 16 bp, Homo sapiens
actttgggaggccaag

SEQ ID NO: 705360 - DNA, 14 bp, Homo sapiens
actttgggaggctg

SEQ ID NO: 705361 - DNA, 19 bp, Homo sapiens
actttgggaggctgaggcg

SEQ ID NO: 705362 - DNA, 14 bp, Homo sapiens
actttgggggagga

SEQ ID NO: 705363 - DNA, 22 bp, Homo sapiens
actttggtagctgggaaagcat

SEQ ID NO: 705364 - DNA, 20 bp, Homo sapiens
actttggtctcagcgggagc

SEQ ID NO: 705365 - DNA, 23 bp, Homo sapiens
actttgtaaataggatttttaga

SEQ ID NO: 705366 - DNA, 12 bp, Homo sapiens
actttgtaaatt

SEQ ID NO: 705367 - DNA, 17 bp, Homo sapiens
actttgtacatttggga

SEQ ID NO: 705368 - DNA, 15 bp, Homo sapiens
actttgtattactta

SEQ ID NO: 705369 - DNA, 20 bp, Homo sapiens
actttgtcgcccaggctgga

SEQ ID NO: 705370 - DNA, 17 bp, Homo sapiens
actttgtctgtacatac

SEQ ID NO: 705371 - DNA, 11 bp, Homo sapiens
actttgtgaat

SEQ ID NO: 705372 - DNA, 13 bp, Homo sapiens
actttgtgaatta

SEQ ID NO: 705373 - DNA, 18 bp, Homo sapiens
actttgtgcattctggat

SEQ ID NO: 705374 - DNA, 23 bp, Homo sapiens
actttgtggagagaatgtgtgtg

SEQ ID NO: 705375 - DNA, 18 bp, Homo sapiens
cacgctgggtcctaatta

SEQ ID NO: 705376 - DNA, 13 bp, Homo sapiens
cacgctgtcctct

SEQ ID NO: 705377 - DNA, 23 bp, Homo sapiens
cacgctgtcctctcgagcccaga

SEQ ID NO: 705378 - DNA, 15 bp, Homo sapiens
cacgctgtctccaga

SEQ ID NO: 705379 - DNA, 17 bp, Homo sapiens
cacgctgtctccagacc

SEQ ID NO: 705380 - DNA, 18 bp, Homo sapiens
cacgctgtctccagaccc

SEQ ID NO: 705381 - DNA, 23 bp, Homo sapiens
cacgctgttgacatcagcctgct

SEQ ID NO: 705382 - DNA, 17 bp, Homo sapiens
cacgcttgcctggtcac

SEQ ID NO: 705383 - DNA, 14 bp, Homo sapiens
cacgctttctagct

SEQ ID NO: 705384 - DNA, 15 bp, Homo sapiens
cacgctttgctgcta

SEQ ID NO: 705385 - DNA, 13 bp, Homo sapiens
cacgcttttgtga

SEQ ID NO: 705386 - DNA, 16 bp, Homo sapiens
cacggaagagccttgc

SEQ ID NO: 705387 - DNA, 22 bp, Homo sapiens
cacggaccactcgaggcctgca

SEQ ID NO: 705388 - DNA, 14 bp, Homo sapiens
cacggacccccaga

SEQ ID NO: 705389 - DNA, 13 bp, Homo sapiens
cacggagacagag

SEQ ID NO: 705390 - DNA, 17 bp, Homo sapiens
cacggagacagaggaaa

SEQ ID NO: 705391 - DNA, 19 bp, Homo sapiens
cacggagacagaggaaagg

SEQ ID NO: 705392 - DNA, 14 bp, Homo sapiens
cacggagagaaggc

SEQ ID NO: 705393 - DNA, 15 bp, Homo sapiens
cacggagaggccact

SEQ ID NO: 705394 - DNA, 19 bp, Homo sapiens
cacggagccactcctctga

SEQ ID NO: 705395 - DNA, 23 bp, Homo sapiens
cacggagccactcctctgactca

SEQ ID NO: 705396 - DNA, 22 bp, Homo sapiens
cacggagccgcgggacagccaa

SEQ ID NO: 705397 - DNA, 23 bp, Homo sapiens
cacggaggagttttggcagccag

SEQ ID NO: 705398 - DNA, 15 bp, Homo sapiens
cacggagggaggcac

SEQ ID NO: 705399 - DNA, 16 bp, Homo sapiens
cacggagggaggcacc

SEQ ID NO: 705400 - DNA, 13 bp, Homo sapiens
cacggataccgcc

SEQ ID NO: 705401 - DNA, 13 bp, Homo sapiens
cacggatctgaga

SEQ ID NO: 705402 - DNA, 14 bp, Homo sapiens
cacggatctgagaa

SEQ ID NO: 705403 - DNA, 18 bp, Homo sapiens
cacggatctgagaatctt

SEQ ID NO: 705404 - DNA, 12 bp, Homo sapiens
cacggcagcccc

SEQ ID NO: 705405 - DNA, 12 bp, Homo sapiens
cacggcagctgt

SEQ ID NO: 705406 - DNA, 21 bp, Homo sapiens
cacggcatcgcatccgtcctg

SEQ ID NO: 705407 - DNA, 13 bp, Homo sapiens
cacggccacatca

SEQ ID NO: 705408 - DNA, 14 bp, Homo sapiens
cacggccacgtcat

SEQ ID NO: 705409 - DNA, 18 bp, Homo sapiens
cacggcccggcccctcac

SEQ ID NO: 705410 - DNA, 19 bp, Homo sapiens
cacggcgggatcctccaca

SEQ ID NO: 705411 - DNA, 20 bp, Homo sapiens
cacggctgcctgacactgag

SEQ ID NO: 705412 - DNA, 14 bp, Homo sapiens
cacggctgctcggc

SEQ ID NO: 705413 - DNA, 12 bp, Homo sapiens
cacggctggtca

SEQ ID NO: 705414 - DNA, 19 bp, Homo sapiens
cacggctggtcactctgcc

SEQ ID NO: 705415 - DNA, 21 bp, Homo sapiens
cacggctggtcactctgccct

SEQ ID NO: 705416 - DNA, 22 bp, Homo sapiens
cacggctggtcactctgccctc

SEQ ID NO: 705417 - DNA, 22 bp, Homo sapiens
cacgggatgcgtgggaggcaga

SEQ ID NO: 705418 - DNA, 15 bp, Homo sapiens
cacgggccctccctc

SEQ ID NO: 705419 - DNA, 16 bp, Homo sapiens
cacgggctgtctgggt

SEQ ID NO: 705420 - DNA, 12 bp, Homo sapiens
cacggggacctg

SEQ ID NO: 705421 - DNA, 14 bp, Homo sapiens
cacggggacctgga

SEQ ID NO: 705422 - DNA, 19 bp, Homo sapiens
cacggggcagttagagcag

SEQ ID NO: 705423 - DNA, 15 bp, Homo sapiens
cacgggggcagtgtg

SEQ ID NO: 705424 - DNA, 21 bp, Homo sapiens
cacggggttccctcctagctc

SEQ ID NO: 705425 - DNA, 22 bp, Homo sapiens
cacggggttccctcctagctct

SEQ ID NO: 705426 - DNA, 13 bp, Homo sapiens
cacgggtggtccc

SEQ ID NO: 705427 - DNA, 21 bp, Homo sapiens
cacggtcgccacctggcattc

SEQ ID NO: 705428 - DNA, 18 bp, Homo sapiens
cacggtgacacaggtcag

SEQ ID NO: 705429 - DNA, 17 bp, Homo sapiens
cacggtgcgtggctgtg

SEQ ID NO: 705430 - DNA, 15 bp, Homo sapiens
cacggtgtccaccat

SEQ ID NO: 705431 - DNA, 15 bp, Homo sapiens
cacggtttgtgagag

SEQ ID NO: 705432 - DNA, 16 bp, Homo sapiens
cacgtacttaaatgaa

SEQ ID NO: 705433 - DNA, 23 bp, Homo sapiens
cacgtagcccccaggctgctgga

SEQ ID NO: 705434 - DNA, 16 bp, Homo sapiens
cacgtagggggctctg

SEQ ID NO: 705435 - DNA, 18 bp, Homo sapiens
cacgtagggggctctggg

SEQ ID NO: 705436 - DNA, 19 bp, Homo sapiens
cacgtaggttccccagaga

SEQ ID NO: 705437 - DNA, 18 bp, Homo sapiens
cacgtatttatatttgga

SEQ ID NO: 705438 - DNA, 16 bp, Homo sapiens
cacgtccccctggggc

SEQ ID NO: 705439 - DNA, 17 bp, Homo sapiens
cacgtccccctggggct

SEQ ID NO: 705440 - DNA, 20 bp, Homo sapiens
cacgtccccctggggcttct

SEQ ID NO: 705441 - DNA, 17 bp, Homo sapiens
cacgtcccgctgcctcc

SEQ ID NO: 705442 - DNA, 21 bp, Homo sapiens
cacgtcccgctgcctcctgct

SEQ ID NO: 705443 - DNA, 19 bp, Homo sapiens
cacgtcctgagaaagctca

SEQ ID NO: 705444 - DNA, 12 bp, Homo sapiens
cacgtctgccag

SEQ ID NO: 705445 - DNA, 21 bp, Homo sapiens
cacgtctgccaggcccatctc

SEQ ID NO: 705446 - DNA, 15 bp, Homo sapiens
cacgtctggaccccg

SEQ ID NO: 705447 - DNA, 17 bp, Homo sapiens
cacgtcttggtgccttt

SEQ ID NO: 705448 - DNA, 14 bp, Homo sapiens
cacgtgaaactgct

SEQ ID NO: 705449 - DNA, 14 bp, Homo sapiens
cacgtgaaatattt

SEQ ID NO: 705450 - DNA, 20 bp, Homo sapiens
cacgtgaaatttgcctctgt

SEQ ID NO: 705451 - DNA, 19 bp, Homo sapiens
cacgtgcaggacagctctt

SEQ ID NO: 705452 - DNA, 21 bp, Homo sapiens
cacgtgcaggacagctcttga

SEQ ID NO: 705453 - DNA, 14 bp, Homo sapiens
cacgtgccaggccc

SEQ ID NO: 705454 - DNA, 20 bp, Homo sapiens
cacgtggcatgtggcctgtg

SEQ ID NO: 705455 - DNA, 13 bp, Homo sapiens
cacgtggcctctt

SEQ ID NO: 705456 - DNA, 23 bp, Homo sapiens
cacgtggcctcttgagcagtggc

SEQ ID NO: 705457 - DNA, 17 bp, Homo sapiens
cacgtgggctcccctct

SEQ ID NO: 705458 - DNA, 14 bp, Homo sapiens
cacgtggggcccac

SEQ ID NO: 705459 - DNA, 15 bp, Homo sapiens
cacgtggggcccact

SEQ ID NO: 705460 - DNA, 23 bp, Homo sapiens
cacgtggttggggccctgccctg

SEQ ID NO: 705461 - DNA, 15 bp, Homo sapiens
cacgtgtggcctccg

SEQ ID NO: 705462 - DNA, 12 bp, Homo sapiens
cacgtgtgtgac

SEQ ID NO: 705463 - DNA, 15 bp, Homo sapiens
cacgttcagggaggg

SEQ ID NO: 705464 - DNA, 19 bp, Homo sapiens
cacgttcagggaggggccg

SEQ ID NO: 705465 - DNA, 18 bp, Homo sapiens
cacgttccacagttgcca

SEQ ID NO: 705466 - DNA, 22 bp, Homo sapiens
cacgttgctggtggtttttcag

SEQ ID NO: 705467 - DNA, 14 bp, Homo sapiens
cacgttggccctca

SEQ ID NO: 705468 - DNA, 18 bp, Homo sapiens
cacgttggccggcggcta

SEQ ID NO: 705469 - DNA, 20 bp, Homo sapiens
cacgtttgttcgcttcctga

SEQ ID NO: 705470 - DNA, 14 bp, Homo sapiens
cactaaaattttag

SEQ ID NO: 705471 - DNA, 19 bp, Homo sapiens
cactaaaccacttctctgc

SEQ ID NO: 705472 - DNA, 14 bp, Homo sapiens
cactaaactctggg

SEQ ID NO: 705473 - DNA, 16 bp, Homo sapiens
cactaaactctggggc

SEQ ID NO: 705474 - DNA, 21 bp, Homo sapiens
cactaaacttggtgcttattg

SEQ ID NO: 705475 - DNA, 15 bp, Homo sapiens
cactaaactttattt

SEQ ID NO: 705476 - DNA, 18 bp, Homo sapiens
cactaaagccagcctgac

SEQ ID NO: 705477 - DNA, 16 bp, Homo sapiens
cactaacaaagaaccc

SEQ ID NO: 705478 - DNA, 19 bp, Homo sapiens
cactaacactttagttata

SEQ ID NO: 705479 - DNA, 22 bp, Homo sapiens
cactaaccaagctgagtttcct

SEQ ID NO: 705480 - DNA, 16 bp, Homo sapiens
cactaaccatccccaa

SEQ ID NO: 705481 - DNA, 17 bp, Homo sapiens
cactaaccatccccaac

SEQ ID NO: 705482 - DNA, 14 bp, Homo sapiens
cactaactcaccag

SEQ ID NO: 705483 - DNA, 15 bp, Homo sapiens
cactaactcaccagc

SEQ ID NO: 705484 - DNA, 18 bp, Homo sapiens
cactaactcaccagcccc

SEQ ID NO: 705485 - DNA, 21 bp, Homo sapiens
cactaagcagaggaggggccg

SEQ ID NO: 705486 - DNA, 16 bp, Homo sapiens
cactaatatatggacc

SEQ ID NO: 705487 - DNA, 21 bp, Homo sapiens
cactaatatatggacctagct

SEQ ID NO: 705488 - DNA, 17 bp, Homo sapiens
cactaatatatttaaaa

SEQ ID NO: 705489 - DNA, 19 bp, Homo sapiens
cactaatatatttaaaaat

SEQ ID NO: 705490 - DNA, 20 bp, Homo sapiens
cactaatccattatccttta

SEQ ID NO: 705491 - DNA, 21 bp, Homo sapiens
cactaatgtgttatgagaaat

SEQ ID NO: 705492 - DNA, 21 bp, Homo sapiens
cactaattttagtattcattc

SEQ ID NO: 705493 - DNA, 19 bp, Homo sapiens
cactaatttttgtattatt

SEQ ID NO: 705494 - DNA, 21 bp, Homo sapiens
cactacaagtcagctccagct

SEQ ID NO: 705495 - DNA, 12 bp, Homo sapiens
cactacaatcat

SEQ ID NO: 705496 - DNA, 15 bp, Homo sapiens
cactacacagcacac

SEQ ID NO: 705497 - DNA, 16 bp, Homo sapiens
cactacacccagcaat

SEQ ID NO: 705498 - DNA, 17 bp, Homo sapiens
cactacacccagcaata

SEQ ID NO: 705499 - DNA, 16 bp, Homo sapiens
cactacaccttgcctt

SEQ ID NO: 705500 - DNA, 16 bp, Homo sapiens
actttgtggatgtctt

SEQ ID NO: 705501 - DNA, 17 bp, Homo sapiens
actttgtggatgtcttc

SEQ ID NO: 705502 - DNA, 15 bp, Homo sapiens
actttgtggtctaaa

SEQ ID NO: 705503 - DNA, 20 bp, Homo sapiens
actttgtggtctaaagtgtt

SEQ ID NO: 705504 - DNA, 13 bp, Homo sapiens
actttgtgtatta

SEQ ID NO: 705505 - DNA, 19 bp, Homo sapiens
actttgttctttaggagat

SEQ ID NO: 705506 - DNA, 20 bp, Homo sapiens
actttgttgcaagatgtgaa

SEQ ID NO: 705507 - DNA, 17 bp, Homo sapiens
actttgttggcccttcc

SEQ ID NO: 705508 - DNA, 19 bp, Homo sapiens
actttgttggcccttccag

SEQ ID NO: 705509 - DNA, 15 bp, Homo sapiens
actttgtttatgcat

SEQ ID NO: 705510 - DNA, 22 bp, Homo sapiens
acttttaaaaaacaaaaaaaga

SEQ ID NO: 705511 - DNA, 12 bp, Homo sapiens
acttttaaacag

SEQ ID NO: 705512 - DNA, 13 bp, Homo sapiens
acttttaaactgt

SEQ ID NO: 705513 - DNA, 15 bp, Homo sapiens
acttttaaagaaaaa

SEQ ID NO: 705514 - DNA, 18 bp, Homo sapiens
acttttaaagaaaaatat

SEQ ID NO: 705515 - DNA, 13 bp, Homo sapiens
acttttaaagctc

SEQ ID NO: 705516 - DNA, 20 bp, Homo sapiens
acttttaaggataaatcata

SEQ ID NO: 705517 - DNA, 17 bp, Homo sapiens
acttttaataaactttt

SEQ ID NO: 705518 - DNA, 15 bp, Homo sapiens
acttttaatggtgat

SEQ ID NO: 705519 - DNA, 13 bp, Homo sapiens
acttttaattcat

SEQ ID NO: 705520 - DNA, 14 bp, Homo sapiens
acttttacaagtaa

SEQ ID NO: 705521 - DNA, 16 bp, Homo sapiens
acttttacagaatgca

SEQ ID NO: 705522 - DNA, 20 bp, Homo sapiens
acttttacagaatgcattaa

SEQ ID NO: 705523 - DNA, 14 bp, Homo sapiens
acttttacagatta

SEQ ID NO: 705524 - DNA, 15 bp, Homo sapiens
acttttactctgcct

SEQ ID NO: 705525 - DNA, 18 bp, Homo sapiens
acttttaggttgttacca

SEQ ID NO: 705526 - DNA, 15 bp, Homo sapiens
acttttataaattaa

SEQ ID NO: 705527 - DNA, 16 bp, Homo sapiens
acttttataaattaaa

SEQ ID NO: 705528 - DNA, 19 bp, Homo sapiens
acttttataataaaaggaa

SEQ ID NO: 705529 - DNA, 16 bp, Homo sapiens
acttttataatgaaaa

SEQ ID NO: 705530 - DNA, 19 bp, Homo sapiens
acttttatgatgtatattt

SEQ ID NO: 705531 - DNA, 16 bp, Homo sapiens
acttttatgtgagatt

SEQ ID NO: 705532 - DNA, 18 bp, Homo sapiens
acttttatgtgagatttc

SEQ ID NO: 705533 - DNA, 21 bp, Homo sapiens
acttttcaatcccaattctgt

SEQ ID NO: 705534 - DNA, 13 bp, Homo sapiens
acttttcacactg

SEQ ID NO: 705535 - DNA, 14 bp, Homo sapiens
acttttcacactgt

SEQ ID NO: 705536 - DNA, 20 bp, Homo sapiens
acttttcacactgtcttccc

SEQ ID NO: 705537 - DNA, 23 bp, Homo sapiens
acttttcacactgtcttcccgat

SEQ ID NO: 705538 - DNA, 20 bp, Homo sapiens
acttttcagaagatggtgaa

SEQ ID NO: 705539 - DNA, 18 bp, Homo sapiens
acttttcatccttcccca

SEQ ID NO: 705540 - DNA, 14 bp, Homo sapiens
acttttcattccct

SEQ ID NO: 705541 - DNA, 20 bp, Homo sapiens
acttttcattctcttttaat

SEQ ID NO: 705542 - DNA, 17 bp, Homo sapiens
acttttcccctgttaaa

SEQ ID NO: 705543 - DNA, 13 bp, Homo sapiens
acttttcctctta

SEQ ID NO: 705544 - DNA, 20 bp, Homo sapiens
acttttccttttcttaaaac

SEQ ID NO: 705545 - DNA, 12 bp, Homo sapiens
acttttctaaaa

SEQ ID NO: 705546 - DNA, 16 bp, Homo sapiens
acttttctaagaaaag

SEQ ID NO: 705547 - DNA, 15 bp, Homo sapiens
acttttctccatgag

SEQ ID NO: 705548 - DNA, 15 bp, Homo sapiens
acttttctggttcca

SEQ ID NO: 705549 - DNA, 17 bp, Homo sapiens
acttttctggttccaaa

SEQ ID NO: 705550 - DNA, 13 bp, Homo sapiens
acttttcttcttc

SEQ ID NO: 705551 - DNA, 18 bp, Homo sapiens
acttttcttcttcctggt

SEQ ID NO: 705552 - DNA, 22 bp, Homo sapiens
acttttgacaatcaaagaaaag

SEQ ID NO: 705553 - DNA, 21 bp, Homo sapiens
acttttgagtatggctatcta

SEQ ID NO: 705554 - DNA, 12 bp, Homo sapiens
acttttgagtgt

SEQ ID NO: 705555 - DNA, 13 bp, Homo sapiens
acttttgatgact

SEQ ID NO: 705556 - DNA, 17 bp, Homo sapiens
acttttgcttacctttt

SEQ ID NO: 705557 - DNA, 21 bp, Homo sapiens
acttttggaaccatgccttcc

SEQ ID NO: 705558 - DNA, 17 bp, Homo sapiens
acttttgtaaatattct

SEQ ID NO: 705559 - DNA, 19 bp, Homo sapiens
acttttgtaaatattcttg

SEQ ID NO: 705560 - DNA, 12 bp, Homo sapiens
acttttgtaaga

SEQ ID NO: 705561 - DNA, 12 bp, Homo sapiens
acttttgtaatt

SEQ ID NO: 705562 - DNA, 15 bp, Homo sapiens
acttttgtaatttga

SEQ ID NO: 705563 - DNA, 16 bp, Homo sapiens
acttttgtaatttgaa

SEQ ID NO: 705564 - DNA, 18 bp, Homo sapiens
acttttgtactgaatttt

SEQ ID NO: 705565 - DNA, 14 bp, Homo sapiens
acttttgttctgct

SEQ ID NO: 705566 - DNA, 12 bp, Homo sapiens
acttttgttctt

SEQ ID NO: 705567 - DNA, 13 bp, Homo sapiens
acttttgttcttg

SEQ ID NO: 705568 - DNA, 23 bp, Homo sapiens
acttttgttcttggtttgtaaat

SEQ ID NO: 705569 - DNA, 19 bp, Homo sapiens
acttttgttgcccaggctg

SEQ ID NO: 705570 - DNA, 12 bp, Homo sapiens
acttttgtttaa

SEQ ID NO: 705571 - DNA, 14 bp, Homo sapiens
actttttaaaaaac

SEQ ID NO: 705572 - DNA, 14 bp, Homo sapiens
actttttaaaatac

SEQ ID NO: 705573 - DNA, 16 bp, Homo sapiens
actttttaatttttaa

SEQ ID NO: 705574 - DNA, 15 bp, Homo sapiens
actttttagtaattt

SEQ ID NO: 705575 - DNA, 15 bp, Homo sapiens
actttttatatagca

SEQ ID NO: 705576 - DNA, 22 bp, Homo sapiens
actttttatttaattaaatgta

SEQ ID NO: 705577 - DNA, 12 bp, Homo sapiens
actttttcaatg

SEQ ID NO: 705578 - DNA, 21 bp, Homo sapiens
actttttcagagttgctttaa

SEQ ID NO: 705579 - DNA, 12 bp, Homo sapiens
actttttcagtg

SEQ ID NO: 705580 - DNA, 13 bp, Homo sapiens
actttttccagca

SEQ ID NO: 705581 - DNA, 14 bp, Homo sapiens
actttttccagcaa

SEQ ID NO: 705582 - DNA, 12 bp, Homo sapiens
actttttctgat

SEQ ID NO: 705583 - DNA, 13 bp, Homo sapiens
actttttcttatt

SEQ ID NO: 705584 - DNA, 17 bp, Homo sapiens
actttttcttgtattca

SEQ ID NO: 705585 - DNA, 11 bp, Homo sapiens
actttttgatg

SEQ ID NO: 705586 - DNA, 23 bp, Homo sapiens
actttttgatggaattaaatgtg

SEQ ID NO: 705587 - DNA, 14 bp, Homo sapiens
actttttggctgga

SEQ ID NO: 705588 - DNA, 15 bp, Homo sapiens
actttttgtatttag

SEQ ID NO: 705589 - DNA, 21 bp, Homo sapiens
actttttgtattttttcctta

SEQ ID NO: 705590 - DNA, 18 bp, Homo sapiens
actttttgttctggtcct

SEQ ID NO: 705591 - DNA, 22 bp, Homo sapiens
acttttttaaactaagatctgt

SEQ ID NO: 705592 - DNA, 19 bp, Homo sapiens
acttttttaaatattttct

SEQ ID NO: 705593 - DNA, 21 bp, Homo sapiens
acttttttaaattaagacaaa

SEQ ID NO: 705594 - DNA, 18 bp, Homo sapiens
acttttttacactgataa

SEQ ID NO: 705595 - DNA, 12 bp, Homo sapiens
acttttttataa

SEQ ID NO: 705596 - DNA, 21 bp, Homo sapiens
acttttttatccacctcccta

SEQ ID NO: 705597 - DNA, 18 bp, Homo sapiens
acttttttatgaagaaaa

SEQ ID NO: 705598 - DNA, 15 bp, Homo sapiens
acttttttatttaaa

SEQ ID NO: 705599 - DNA, 19 bp, Homo sapiens
acttttttcattttgaaaa

SEQ ID NO: 705600 - DNA, 11 bp, Homo sapiens
acttttttccc

SEQ ID NO: 705601 - DNA, 19 bp, Homo sapiens
acttttttgtgtatgtact

SEQ ID NO: 705602 - DNA, 14 bp, Homo sapiens
actttttttcagtt

SEQ ID NO: 705603 - DNA, 23 bp, Homo sapiens
actttttttctgtaccagttaat

SEQ ID NO: 705604 - DNA, 22 bp, Homo sapiens
actttttttctgtgacatttat

SEQ ID NO: 705605 - DNA, 18 bp, Homo sapiens
actttttttgtagatgaa

SEQ ID NO: 705606 - DNA, 21 bp, Homo sapiens
actttttttgtagatgaactt

SEQ ID NO: 705607 - DNA, 16 bp, Homo sapiens
actttttttgtatgtg

SEQ ID NO: 705608 - DNA, 20 bp, Homo sapiens
actttttttttatactgcac

SEQ ID NO: 705609 - DNA, 19 bp, Homo sapiens
acttttttttttttaacat

SEQ ID NO: 705610 - DNA, 21 bp, Homo sapiens
acttttttttttttaacatct

SEQ ID NO: 705611 - DNA, 20 bp, Homo sapiens
agaaaaaaaaaaacttacac

SEQ ID NO: 705612 - DNA, 19 bp, Homo sapiens
agaaaaaaaaagaaaaaaa

SEQ ID NO: 705613 - DNA, 20 bp, Homo sapiens
agaaaaaaaaagtgaaaaaa

SEQ ID NO: 705614 - DNA, 17 bp, Homo sapiens
agaaaaaaaaccttgta

SEQ ID NO: 705615 - DNA, 21 bp, Homo sapiens
agaaaaaaaaccttgtaaaaa

SEQ ID NO: 705616 - DNA, 23 bp, Homo sapiens
agaaaaaaaagtgtctcaaagga

SEQ ID NO: 705617 - DNA, 20 bp, Homo sapiens
agaaaaaaaataacacagag

SEQ ID NO: 705618 - DNA, 22 bp, Homo sapiens
agaaaaaaacatgaatttagaa

SEQ ID NO: 705619 - DNA, 18 bp, Homo sapiens
agaaaaaaacattctatc

SEQ ID NO: 705620 - DNA, 12 bp, Homo sapiens
agaaaaaaagaa

SEQ ID NO: 705621 - DNA, 20 bp, Homo sapiens
agaaaaaaagaaaagaaaaa

SEQ ID NO: 705622 - DNA, 17 bp, Homo sapiens
agaaaaaaagatttatt

SEQ ID NO: 705623 - DNA, 16 bp, Homo sapiens
agaaaaaaagggagaa

SEQ ID NO: 705624 - DNA, 14 bp, Homo sapiens
agaaaaaaataact

SEQ ID NO: 705625 - DNA, 16 bp, Homo sapiens
agaaaaaaatgtacat

SEQ ID NO: 705626 - DNA, 18 bp, Homo sapiens
cactacactccagcctga

SEQ ID NO: 705627 - DNA, 20 bp, Homo sapiens
cactacactccagcctgagc

SEQ ID NO: 705628 - DNA, 21 bp, Homo sapiens
cactacactccagcctgagca

SEQ ID NO: 705629 - DNA, 21 bp, Homo sapiens
cactacaggtgaaggctctca

SEQ ID NO: 705630 - DNA, 17 bp, Homo sapiens
cactacataaactgact

SEQ ID NO: 705631 - DNA, 15 bp, Homo sapiens
cactacattcattta

SEQ ID NO: 705632 - DNA, 14 bp, Homo sapiens
cactacattctgtt

SEQ ID NO: 705633 - DNA, 15 bp, Homo sapiens
cactacattctgtta

SEQ ID NO: 705634 - DNA, 15 bp, Homo sapiens
cactaccagccagcc

SEQ ID NO: 705635 - DNA, 20 bp, Homo sapiens
cactacgcatgactaatttt

SEQ ID NO: 705636 - DNA, 16 bp, Homo sapiens
cactactacagaaatt

SEQ ID NO: 705637 - DNA, 17 bp, Homo sapiens
cactactcacagtctct

SEQ ID NO: 705638 - DNA, 20 bp, Homo sapiens
cactactcctctgcagtgcc

SEQ ID NO: 705639 - DNA, 12 bp, Homo sapiens
cactactgcagc

SEQ ID NO: 705640 - DNA, 16 bp, Homo sapiens
cactactgcagcacct

SEQ ID NO: 705641 - DNA, 13 bp, Homo sapiens
cactactgggtgt

SEQ ID NO: 705642 - DNA, 22 bp, Homo sapiens
cactactgggtgtcatttcatt

SEQ ID NO: 705643 - DNA, 12 bp, Homo sapiens
cactactttgta

SEQ ID NO: 705644 - DNA, 12 bp, Homo sapiens
cactagaaaact

SEQ ID NO: 705645 - DNA, 15 bp, Homo sapiens
cactagaagaaaagc

SEQ ID NO: 705646 - DNA, 19 bp, Homo sapiens
cactagaagaaaagcccat

SEQ ID NO: 705647 - DNA, 14 bp, Homo sapiens
cactagacaaaact

SEQ ID NO: 705648 - DNA, 12 bp, Homo sapiens
cactagagacaa

SEQ ID NO: 705649 - DNA, 15 bp, Homo sapiens
cactagaggccaggg

SEQ ID NO: 705650 - DNA, 12 bp, Homo sapiens
cactagagggcc

SEQ ID NO: 705651 - DNA, 13 bp, Homo sapiens
cactagagggccc

SEQ ID NO: 705652 - DNA, 23 bp, Homo sapiens
cactagagggcccatcaggcagt

SEQ ID NO: 705653 - DNA, 14 bp, Homo sapiens
cactagagtgctct

SEQ ID NO: 705654 - DNA, 16 bp, Homo sapiens
cactagagtgctctga

SEQ ID NO: 705655 - DNA, 19 bp, Homo sapiens
cactagcccaatgaaatga

SEQ ID NO: 705656 - DNA, 23 bp, Homo sapiens
cactagcccaatgaaatgaatta

SEQ ID NO: 705657 - DNA, 17 bp, Homo sapiens
cactagcctctccagga

SEQ ID NO: 705658 - DNA, 20 bp, Homo sapiens
cactaggaatcccagaggtg

SEQ ID NO: 705659 - DNA, 17 bp, Homo sapiens
cactaggactctgaggc

SEQ ID NO: 705660 - DNA, 20 bp, Homo sapiens
cactaggcaggtaataataa

SEQ ID NO: 705661 - DNA, 20 bp, Homo sapiens
cactaggcccccacttgcct

SEQ ID NO: 705662 - DNA, 21 bp, Homo sapiens
cactagggctgaggggcctgc

SEQ ID NO: 705663 - DNA, 23 bp, Homo sapiens
cactagggctgaggggcctgcgc

SEQ ID NO: 705664 - DNA, 15 bp, Homo sapiens
cactaggtaacttat

SEQ ID NO: 705665 - DNA, 14 bp, Homo sapiens
cactaggtgtcccc

SEQ ID NO: 705666 - DNA, 15 bp, Homo sapiens
cactaggttcttttc

SEQ ID NO: 705667 - DNA, 13 bp, Homo sapiens
cactagtctgtgt

SEQ ID NO: 705668 - DNA, 14 bp, Homo sapiens
cactagtctgtgta

SEQ ID NO: 705669 - DNA, 21 bp, Homo sapiens
cactagtgaccccttccctgt

SEQ ID NO: 705670 - DNA, 15 bp, Homo sapiens
cactagtgcaaatca

SEQ ID NO: 705671 - DNA, 15 bp, Homo sapiens
cactagtttatgcta

SEQ ID NO: 705672 - DNA, 17 bp, Homo sapiens
cactagttttgtgccag

SEQ ID NO: 705673 - DNA, 15 bp, Homo sapiens
cactatacaaacaaa

SEQ ID NO: 705674 - DNA, 15 bp, Homo sapiens
cactatagtgtaata

SEQ ID NO: 705675 - DNA, 20 bp, Homo sapiens
cactatatgatcagtgttac

SEQ ID NO: 705676 - DNA, 14 bp, Homo sapiens
cactatatttgtat

SEQ ID NO: 705677 - DNA, 16 bp, Homo sapiens
cactatatttgtatat

SEQ ID NO: 705678 - DNA, 23 bp, Homo sapiens
cactatatttgtatatattttat

SEQ ID NO: 705679 - DNA, 14 bp, Homo sapiens
cactatgaagatgt

SEQ ID NO: 705680 - DNA, 17 bp, Homo sapiens
cactatgaagctacctc

SEQ ID NO: 705681 - DNA, 17 bp, Homo sapiens
cactatgataaagttgt

SEQ ID NO: 705682 - DNA, 22 bp, Homo sapiens
cactatggtatgctggccagca

SEQ ID NO: 705683 - DNA, 19 bp, Homo sapiens
cactattcttaagcacttt

SEQ ID NO: 705684 - DNA, 17 bp, Homo sapiens
cactattgtaatcattt

SEQ ID NO: 705685 - DNA, 23 bp, Homo sapiens
cactattgtgaatatttggaatt

SEQ ID NO: 705686 - DNA, 19 bp, Homo sapiens
cactatttatctgtgcaaa

SEQ ID NO: 705687 - DNA, 15 bp, Homo sapiens
cactatttccaaaag

SEQ ID NO: 705688 - DNA, 13 bp, Homo sapiens
cactatttccttt

SEQ ID NO: 705689 - DNA, 17 bp, Homo sapiens
cactatttcctttataa

SEQ ID NO: 705690 - DNA, 17 bp, Homo sapiens
cactatttttatttata

SEQ ID NO: 705691 - DNA, 22 bp, Homo sapiens
cactatttttatttatattttt

SEQ ID NO: 705692 - DNA, 23 bp, Homo sapiens
cactatttttatttatatttttg

SEQ ID NO: 705693 - DNA, 19 bp, Homo sapiens
cactcaaaagctgggcagg

SEQ ID NO: 705694 - DNA, 20 bp, Homo sapiens
cactcaaaagctgggcaggt

SEQ ID NO: 705695 - DNA, 14 bp, Homo sapiens
cactcaaaatatgt

SEQ ID NO: 705696 - DNA, 19 bp, Homo sapiens
cactcaaacctggagctga

SEQ ID NO: 705697 - DNA, 14 bp, Homo sapiens
cactcaactctgag

SEQ ID NO: 705698 - DNA, 17 bp, Homo sapiens
cactcaactctgagccc

SEQ ID NO: 705699 - DNA, 13 bp, Homo sapiens
cactcaaggacag

SEQ ID NO: 705700 - DNA, 19 bp, Homo sapiens
cactcacaatttaaaatat

SEQ ID NO: 705701 - DNA, 14 bp, Homo sapiens
cactcacacaggac

SEQ ID NO: 705702 - DNA, 16 bp, Homo sapiens
cactcacagacctgga

SEQ ID NO: 705703 - DNA, 20 bp, Homo sapiens
cactcaccacaagctgagca

SEQ ID NO: 705704 - DNA, 20 bp, Homo sapiens
cactcaccactaccagccag

SEQ ID NO: 705705 - DNA, 15 bp, Homo sapiens
cactcaccagggtcc

SEQ ID NO: 705706 - DNA, 17 bp, Homo sapiens
cactcaccagtggcctt

SEQ ID NO: 705707 - DNA, 15 bp, Homo sapiens
cactcacccttcctg

SEQ ID NO: 705708 - DNA, 21 bp, Homo sapiens
cactcacccttcctggcccag

SEQ ID NO: 705709 - DNA, 12 bp, Homo sapiens
cactcacctgca

SEQ ID NO: 705710 - DNA, 16 bp, Homo sapiens
cactcactaggccccc

SEQ ID NO: 705711 - DNA, 14 bp, Homo sapiens
cactcactcactcc

SEQ ID NO: 705712 - DNA, 19 bp, Homo sapiens
cactcactcactccaagac

SEQ ID NO: 705713 - DNA, 19 bp, Homo sapiens
cactcactcactccccact

SEQ ID NO: 705714 - DNA, 14 bp, Homo sapiens
cactcactccaaga

SEQ ID NO: 705715 - DNA, 13 bp, Homo sapiens
cactcactccagc

SEQ ID NO: 705716 - DNA, 23 bp, Homo sapiens
cactcactgaggccatcagggcc

SEQ ID NO: 705717 - DNA, 12 bp, Homo sapiens
cactcactgctg

SEQ ID NO: 705718 - DNA, 14 bp, Homo sapiens
cactcagaggcccc

SEQ ID NO: 705719 - DNA, 20 bp, Homo sapiens
cactcagaggcccccagtgg

SEQ ID NO: 705720 - DNA, 21 bp, Homo sapiens
cactcagaggcccccagtggg

SEQ ID NO: 705721 - DNA, 16 bp, Homo sapiens
cactcagccaccctga

SEQ ID NO: 705722 - DNA, 17 bp, Homo sapiens
cactcagccaccctgag

SEQ ID NO: 705723 - DNA, 18 bp, Homo sapiens
cactcagccaccctgagt

SEQ ID NO: 705724 - DNA, 19 bp, Homo sapiens
cactcagccatttccccct

SEQ ID NO: 705725 - DNA, 12 bp, Homo sapiens
cactcagcccct

SEQ ID NO: 705726 - DNA, 13 bp, Homo sapiens
cactcagccccta

SEQ ID NO: 705727 - DNA, 15 bp, Homo sapiens
cactcagcccctagg

SEQ ID NO: 705728 - DNA, 23 bp, Homo sapiens
cactcagccggcagccagatggc

SEQ ID NO: 705729 - DNA, 18 bp, Homo sapiens
cactcagctgtcctgcag

SEQ ID NO: 705730 - DNA, 19 bp, Homo sapiens
cactcaggaggctgaggca

SEQ ID NO: 705731 - DNA, 13 bp, Homo sapiens
cactcaggccaca

SEQ ID NO: 705732 - DNA, 17 bp, Homo sapiens
cactcaggccacagtgg

SEQ ID NO: 705733 - DNA, 18 bp, Homo sapiens
cactcagggcagctgcct

SEQ ID NO: 705734 - DNA, 21 bp, Homo sapiens
cactcagggcagctgcctggc

SEQ ID NO: 705735 - DNA, 15 bp, Homo sapiens
cactcaggggacccc

SEQ ID NO: 705736 - DNA, 20 bp, Homo sapiens
cactcaggggaccccactcc

SEQ ID NO: 705737 - DNA, 17 bp, Homo sapiens
cactcaggttcttcagg

SEQ ID NO: 705738 - DNA, 18 bp, Homo sapiens
cactcagtccactgttga

SEQ ID NO: 705739 - DNA, 17 bp, Homo sapiens
cactcagtcccccacca

SEQ ID NO: 705740 - DNA, 18 bp, Homo sapiens
cactcagtgagcctcctg

SEQ ID NO: 705741 - DNA, 13 bp, Homo sapiens
cactcagtgcctc

SEQ ID NO: 705742 - DNA, 15 bp, Homo sapiens
cactcagtgcctcca

SEQ ID NO: 705743 - DNA, 16 bp, Homo sapiens
cactcatagggtgctc

SEQ ID NO: 705744 - DNA, 19 bp, Homo sapiens
cactcatgcaaactgcttt

SEQ ID NO: 705745 - DNA, 13 bp, Homo sapiens
cactcattcctgt

SEQ ID NO: 705746 - DNA, 15 bp, Homo sapiens
cactcattcctgtag

SEQ ID NO: 705747 - DNA, 20 bp, Homo sapiens
cactcattccttcactcatc

SEQ ID NO: 705748 - DNA, 15 bp, Homo sapiens
cactcattgacatga

SEQ ID NO: 705749 - DNA, 21 bp, Homo sapiens
cactcattgctgagcctctgc

SEQ ID NO: 705750 - DNA, 16 bp, Homo sapiens
cactcatttcatctca

SEQ ID NO: 705751 - DNA, 15 bp, Homo sapiens
agaaaaaaattcatg

SEQ ID NO: 705752 - DNA, 14 bp, Homo sapiens
agaaaaaaattgaa

SEQ ID NO: 705753 - DNA, 14 bp, Homo sapiens
agaaaaaacaaaaa

SEQ ID NO: 705754 - DNA, 12 bp, Homo sapiens
agaaaaaagaag

SEQ ID NO: 705755 - DNA, 17 bp, Homo sapiens
agaaaaaagagaaaaga

SEQ ID NO: 705756 - DNA, 10 bp, Homo sapiens
agaaaaaagt

SEQ ID NO: 705757 - DNA, 14 bp, Homo sapiens
agaaaaaagttgta

SEQ ID NO: 705758 - DNA, 16 bp, Homo sapiens
agaaaaacaatcttat

SEQ ID NO: 705759 - DNA, 13 bp, Homo sapiens
agaaaaagaaatg

SEQ ID NO: 705760 - DNA, 14 bp, Homo sapiens
agaaaaagaagcaa

SEQ ID NO: 705761 - DNA, 21 bp, Homo sapiens
agaaaaagcttaatgattctg

SEQ ID NO: 705762 - DNA, 16 bp, Homo sapiens
agaaaaagtacaatga

SEQ ID NO: 705763 - DNA, 15 bp, Homo sapiens
agaaaaataaaatgt

SEQ ID NO: 705764 - DNA, 18 bp, Homo sapiens
agaaaaataaaatttcct

SEQ ID NO: 705765 - DNA, 14 bp, Homo sapiens
agaaaaatgtataa

SEQ ID NO: 705766 - DNA, 20 bp, Homo sapiens
agaaaaattcagcaaaccat

SEQ ID NO: 705767 - DNA, 12 bp, Homo sapiens
agaaaacaaaaa

SEQ ID NO: 705768 - DNA, 20 bp, Homo sapiens
agaaaacaaaaaaacctcta

SEQ ID NO: 705769 - DNA, 13 bp, Homo sapiens
agaaaacaaaatt

SEQ ID NO: 705770 - DNA, 18 bp, Homo sapiens
agaaaacaacttggcatt

SEQ ID NO: 705771 - DNA, 22 bp, Homo sapiens
agaaaacaagatgagattggca

SEQ ID NO: 705772 - DNA, 16 bp, Homo sapiens
agaaaacagaaaacaa

SEQ ID NO: 705773 - DNA, 17 bp, Homo sapiens
agaaaacatttaacata

SEQ ID NO: 705774 - DNA, 20 bp, Homo sapiens
agaaaacatttaacataatg

SEQ ID NO: 705775 - DNA, 17 bp, Homo sapiens
agaaaaccaaaatgata

SEQ ID NO: 705776 - DNA, 13 bp, Homo sapiens
agaaaacccctcc

SEQ ID NO: 705777 - DNA, 16 bp, Homo sapiens
agaaaacccctcccac

SEQ ID NO: 705778 - DNA, 16 bp, Homo sapiens
agaaaacccttttcta

SEQ ID NO: 705779 - DNA, 14 bp, Homo sapiens
agaaaaccgagaat

SEQ ID NO: 705780 - DNA, 16 bp, Homo sapiens
agaaaaccgagaatat

SEQ ID NO: 705781 - DNA, 16 bp, Homo sapiens
agaaaacctttcttca

SEQ ID NO: 705782 - DNA, 22 bp, Homo sapiens
agaaaacgaagtctttttcatt

SEQ ID NO: 705783 - DNA, 17 bp, Homo sapiens
agaaaacgccagtgtgt

SEQ ID NO: 705784 - DNA, 22 bp, Homo sapiens
agaaaactccagggtcccctgc

SEQ ID NO: 705785 - DNA, 19 bp, Homo sapiens
agaaaactcccaatacaaa

SEQ ID NO: 705786 - DNA, 11 bp, Homo sapiens
agaaaagaaaa

SEQ ID NO: 705787 - DNA, 14 bp, Homo sapiens
agaaaagacatttt

SEQ ID NO: 705788 - DNA, 16 bp, Homo sapiens
agaaaagaccctgaga

SEQ ID NO: 705789 - DNA, 19 bp, Homo sapiens
agaaaagagacttctctgt

SEQ ID NO: 705790 - DNA, 15 bp, Homo sapiens
agaaaagataaagat

SEQ ID NO: 705791 - DNA, 17 bp, Homo sapiens
agaaaagataaagatga

SEQ ID NO: 705792 - DNA, 12 bp, Homo sapiens
agaaaagcacac

SEQ ID NO: 705793 - DNA, 13 bp, Homo sapiens
agaaaagctatta

SEQ ID NO: 705794 - DNA, 18 bp, Homo sapiens
agaaaagctattaaagtt

SEQ ID NO: 705795 - DNA, 19 bp, Homo sapiens
agaaaagctgccatttccc

SEQ ID NO: 705796 - DNA, 14 bp, Homo sapiens
agaaaaggcaaaag

SEQ ID NO: 705797 - DNA, 17 bp, Homo sapiens
agaaaaggcaaaagact

SEQ ID NO: 705798 - DNA, 19 bp, Homo sapiens
agaaaagggaaaaaagaaa

SEQ ID NO: 705799 - DNA, 15 bp, Homo sapiens
agaaaagtatgttct

SEQ ID NO: 705800 - DNA, 14 bp, Homo sapiens
agaaaagtgaattg

SEQ ID NO: 705801 - DNA, 15 bp, Homo sapiens
agaaaagtgaattga

SEQ ID NO: 705802 - DNA, 19 bp, Homo sapiens
agaaaagtgaattgaagtt

SEQ ID NO: 705803 - DNA, 15 bp, Homo sapiens
agaaaagtgggctgc

SEQ ID NO: 705804 - DNA, 13 bp, Homo sapiens
agaaaagtgtgta

SEQ ID NO: 705805 - DNA, 13 bp, Homo sapiens
agaaaagttatta

SEQ ID NO: 705806 - DNA, 15 bp, Homo sapiens
agaaaagttgcagat

SEQ ID NO: 705807 - DNA, 19 bp, Homo sapiens
agaaaagttgcagatgtat

SEQ ID NO: 705808 - DNA, 20 bp, Homo sapiens
agaaaagttgcagatgtatt

SEQ ID NO: 705809 - DNA, 22 bp, Homo sapiens
agaaaataaaaaaaagaaaaaa

SEQ ID NO: 705810 - DNA, 14 bp, Homo sapiens
agaaaataaaacta

SEQ ID NO: 705811 - DNA, 21 bp, Homo sapiens
agaaaataaaactaagctctt

SEQ ID NO: 705812 - DNA, 22 bp, Homo sapiens
agaaaataatggagaatcactt

SEQ ID NO: 705813 - DNA, 11 bp, Homo sapiens
agaaaatataa

SEQ ID NO: 705814 - DNA, 12 bp, Homo sapiens
agaaaatataag

SEQ ID NO: 705815 - DNA, 18 bp, Homo sapiens
agaaaatataataaaaga

SEQ ID NO: 705816 - DNA, 15 bp, Homo sapiens
agaaaatatcactgt

SEQ ID NO: 705817 - DNA, 13 bp, Homo sapiens
agaaaatcactta

SEQ ID NO: 705818 - DNA, 19 bp, Homo sapiens
agaaaatcatcaagaaggg

SEQ ID NO: 705819 - DNA, 16 bp, Homo sapiens
agaaaatcatgttgaa

SEQ ID NO: 705820 - DNA, 15 bp, Homo sapiens
agaaaatctttataa

SEQ ID NO: 705821 - DNA, 12 bp, Homo sapiens
agaaaatctttg

SEQ ID NO: 705822 - DNA, 19 bp, Homo sapiens
agaaaatgaattttttcca

SEQ ID NO: 705823 - DNA, 19 bp, Homo sapiens
agaaaatgacttatttctg

SEQ ID NO: 705824 - DNA, 11 bp, Homo sapiens
agaaaatgtga

SEQ ID NO: 705825 - DNA, 19 bp, Homo sapiens
agaaaatgtgaccctccaa

SEQ ID NO: 705826 - DNA, 13 bp, Homo sapiens
agaaaatgttatt

SEQ ID NO: 705827 - DNA, 17 bp, Homo sapiens
agaaaatgttgagaatc

SEQ ID NO: 705828 - DNA, 12 bp, Homo sapiens
agaaaattcaat

SEQ ID NO: 705829 - DNA, 13 bp, Homo sapiens
agaaaattcaatt

SEQ ID NO: 705830 - DNA, 22 bp, Homo sapiens
agaaaattcctataaggaagat

SEQ ID NO: 705831 - DNA, 20 bp, Homo sapiens
agaaaattctaatgattggc

SEQ ID NO: 705832 - DNA, 14 bp, Homo sapiens
agaaaattgaaaca

SEQ ID NO: 705833 - DNA, 15 bp, Homo sapiens
agaaaattgcatgaa

SEQ ID NO: 705834 - DNA, 17 bp, Homo sapiens
agaaaattgcatgaaac

SEQ ID NO: 705835 - DNA, 18 bp, Homo sapiens
agaaaattgctgtgcctc

SEQ ID NO: 705836 - DNA, 15 bp, Homo sapiens
agaaaatttgcttta

SEQ ID NO: 705837 - DNA, 18 bp, Homo sapiens
agaaaatttgctttaatt

SEQ ID NO: 705838 - DNA, 16 bp, Homo sapiens
agaaaatttttgtagt

SEQ ID NO: 705839 - DNA, 13 bp, Homo sapiens
agaaacaaacatc

SEQ ID NO: 705840 - DNA, 12 bp, Homo sapiens
agaaacaaaccc

SEQ ID NO: 705841 - DNA, 17 bp, Homo sapiens
agaaacaaagatgttat

SEQ ID NO: 705842 - DNA, 15 bp, Homo sapiens
agaaacaaagtaatc

SEQ ID NO: 705843 - DNA, 15 bp, Homo sapiens
agaaacaagctgtgc

SEQ ID NO: 705844 - DNA, 16 bp, Homo sapiens
agaaacaagctgtgca

SEQ ID NO: 705845 - DNA, 20 bp, Homo sapiens
agaaacacccctctgtctag

SEQ ID NO: 705846 - DNA, 21 bp, Homo sapiens
agaaacacccctctgtctagg

SEQ ID NO: 705847 - DNA, 15 bp, Homo sapiens
agaaacagagacagg

SEQ ID NO: 705848 - DNA, 20 bp, Homo sapiens
agaaacagagtggcctccct

SEQ ID NO: 705849 - DNA, 23 bp, Homo sapiens
agaaacagagtggcctccctgct

SEQ ID NO: 705850 - DNA, 13 bp, Homo sapiens
agaaacagccagc

SEQ ID NO: 705851 - DNA, 15 bp, Homo sapiens
agaaacagccagcaa

SEQ ID NO: 705852 - DNA, 17 bp, Homo sapiens
agaaacagctgcttctc

SEQ ID NO: 705853 - DNA, 23 bp, Homo sapiens
agaaacagctgcttctcccccca

SEQ ID NO: 705854 - DNA, 19 bp, Homo sapiens
agaaacagctttcaagtgc

SEQ ID NO: 705855 - DNA, 20 bp, Homo sapiens
agaaacagctttcaagtgcc

SEQ ID NO: 705856 - DNA, 18 bp, Homo sapiens
agaaacagggacaaagaa

SEQ ID NO: 705857 - DNA, 12 bp, Homo sapiens
agaaacagggca

SEQ ID NO: 705858 - DNA, 13 bp, Homo sapiens
agaaacagggcag

SEQ ID NO: 705859 - DNA, 14 bp, Homo sapiens
agaaacagtgtgca

SEQ ID NO: 705860 - DNA, 18 bp, Homo sapiens
agaaacagttggtaactt

SEQ ID NO: 705861 - DNA, 19 bp, Homo sapiens
agaaacagtttcttgcttg

SEQ ID NO: 705862 - DNA, 23 bp, Homo sapiens
agaaacatcagttactctgaagg

SEQ ID NO: 705863 - DNA, 15 bp, Homo sapiens
agaaacatctctggc

SEQ ID NO: 705864 - DNA, 22 bp, Homo sapiens
agaaacatctctggcccagaaa

SEQ ID NO: 705865 - DNA, 11 bp, Homo sapiens
agaaacatgaa

SEQ ID NO: 705866 - DNA, 13 bp, Homo sapiens
agaaaccaaagtc

SEQ ID NO: 705867 - DNA, 16 bp, Homo sapiens
agaaaccaagtgggct

SEQ ID NO: 705868 - DNA, 17 bp, Homo sapiens
agaaaccaagtgggctg

SEQ ID NO: 705869 - DNA, 18 bp, Homo sapiens
agaaaccaagtgggctgg

SEQ ID NO: 705870 - DNA, 19 bp, Homo sapiens
agaaaccaagtgggctggt

SEQ ID NO: 705871 - DNA, 15 bp, Homo sapiens
agaaaccagaaaagc

SEQ ID NO: 705872 - DNA, 13 bp, Homo sapiens
agaaaccatgaca

SEQ ID NO: 705873 - DNA, 23 bp, Homo sapiens
agaaaccatgacaaacctagctt

SEQ ID NO: 705874 - DNA, 18 bp, Homo sapiens
agaaacccaagctcctcc

SEQ ID NO: 705875 - DNA, 21 bp, Homo sapiens
agaaacccggcttcctgtgct

SEQ ID NO: 705876 - DNA, 16 bp, Homo sapiens
agaaacctatctcagg

SEQ ID NO: 705877 - DNA, 21 bp, Homo sapiens
agaaacctatctcagggaggg

SEQ ID NO: 705878 - DNA, 22 bp, Homo sapiens
cactcatttttttttgaggaga

SEQ ID NO: 705879 - DNA, 14 bp, Homo sapiens
cactccaagccccc

SEQ ID NO: 705880 - DNA, 18 bp, Homo sapiens
cactccaagccccctggc

SEQ ID NO: 705881 - DNA, 22 bp, Homo sapiens
cactccacataaggggtttagt

SEQ ID NO: 705882 - DNA, 11 bp, Homo sapiens
cactccaccac

SEQ ID NO: 705883 - DNA, 19 bp, Homo sapiens
cactccaccacccaaaagt

SEQ ID NO: 705884 - DNA, 11 bp, Homo sapiens
cactccaccat

SEQ ID NO: 705885 - DNA, 15 bp, Homo sapiens
cactccaccatcact

SEQ ID NO: 705886 - DNA, 20 bp, Homo sapiens
cactccaccatcactcactc

SEQ ID NO: 705887 - DNA, 12 bp, Homo sapiens
cactccaccctc

SEQ ID NO: 705888 - DNA, 15 bp, Homo sapiens
cactccaccctccac

SEQ ID NO: 705889 - DNA, 17 bp, Homo sapiens
cactccaccctccacct

SEQ ID NO: 705890 - DNA, 18 bp, Homo sapiens
cactccaccctccacctt

SEQ ID NO: 705891 - DNA, 12 bp, Homo sapiens
cactccactctg

SEQ ID NO: 705892 - DNA, 16 bp, Homo sapiens
cactccactctgattc

SEQ ID NO: 705893 - DNA, 23 bp, Homo sapiens
cactccactctgattcacctctt

SEQ ID NO: 705894 - DNA, 17 bp, Homo sapiens
cactccagacccctggc

SEQ ID NO: 705895 - DNA, 14 bp, Homo sapiens
cactccagccaaag

SEQ ID NO: 705896 - DNA, 13 bp, Homo sapiens
cactccagcccaa

SEQ ID NO: 705897 - DNA, 15 bp, Homo sapiens
cactccagcctgagc

SEQ ID NO: 705898 - DNA, 16 bp, Homo sapiens
cactccagcctgggcg

SEQ ID NO: 705899 - DNA, 13 bp, Homo sapiens
cactccagctcct

SEQ ID NO: 705900 - DNA, 20 bp, Homo sapiens
cactccagggacacacagcc

SEQ ID NO: 705901 - DNA, 17 bp, Homo sapiens
cactccagtagctcctg

SEQ ID NO: 705902 - DNA, 17 bp, Homo sapiens
cactccagtgccagcaa

SEQ ID NO: 705903 - DNA, 21 bp, Homo sapiens
cactccatgcttagtcactgc

SEQ ID NO: 705904 - DNA, 23 bp, Homo sapiens
cactccatggccaccccgtgcca

SEQ ID NO: 705905 - DNA, 21 bp, Homo sapiens
cactccattggatcttttact

SEQ ID NO: 705906 - DNA, 20 bp, Homo sapiens
cactcccaaatgaaaacccc

SEQ ID NO: 705907 - DNA, 19 bp, Homo sapiens
cactcccaaggttggagcc

SEQ ID NO: 705908 - DNA, 12 bp, Homo sapiens
cactcccaccac

SEQ ID NO: 705909 - DNA, 14 bp, Homo sapiens
cactcccatctcct

SEQ ID NO: 705910 - DNA, 22 bp, Homo sapiens
cactcccatctccttacctctg

SEQ ID NO: 705911 - DNA, 14 bp, Homo sapiens
cactccccacatcc

SEQ ID NO: 705912 - DNA, 14 bp, Homo sapiens
cactccccaccttc

SEQ ID NO: 705913 - DNA, 16 bp, Homo sapiens
cactccccactccccc

SEQ ID NO: 705914 - DNA, 18 bp, Homo sapiens
cactccccagagctgtgc

SEQ ID NO: 705915 - DNA, 16 bp, Homo sapiens
cactccccagccccag

SEQ ID NO: 705916 - DNA, 15 bp, Homo sapiens
cactccccagcctgg

SEQ ID NO: 705917 - DNA, 19 bp, Homo sapiens
cactccccagcctgggccc

SEQ ID NO: 705918 - DNA, 19 bp, Homo sapiens
cactccccagggagctctg

SEQ ID NO: 705919 - DNA, 18 bp, Homo sapiens
cactccccatgccacgtt

SEQ ID NO: 705920 - DNA, 23 bp, Homo sapiens
cactcccccttcccttggaggga

SEQ ID NO: 705921 - DNA, 18 bp, Homo sapiens
cactccccgaagtctttt

SEQ ID NO: 705922 - DNA, 17 bp, Homo sapiens
cactcccctaaactcca

SEQ ID NO: 705923 - DNA, 12 bp, Homo sapiens
cactcccctcac

SEQ ID NO: 705924 - DNA, 14 bp, Homo sapiens
cactcccctcacac

SEQ ID NO: 705925 - DNA, 20 bp, Homo sapiens
cactcccgaaagcctttcct

SEQ ID NO: 705926 - DNA, 18 bp, Homo sapiens
cactcccgctgcacacag

SEQ ID NO: 705927 - DNA, 21 bp, Homo sapiens
cactcccgggccaagacagat

SEQ ID NO: 705928 - DNA, 22 bp, Homo sapiens
cactcccgggccaagacagatg

SEQ ID NO: 705929 - DNA, 22 bp, Homo sapiens
cactccctcctggagctctgtg

SEQ ID NO: 705930 - DNA, 17 bp, Homo sapiens
cactccctctgccttca

SEQ ID NO: 705931 - DNA, 12 bp, Homo sapiens
cactccctgagc

SEQ ID NO: 705932 - DNA, 13 bp, Homo sapiens
cactccctgagct

SEQ ID NO: 705933 - DNA, 13 bp, Homo sapiens
cactccctgctcc

SEQ ID NO: 705934 - DNA, 13 bp, Homo sapiens
cactccctggcct

SEQ ID NO: 705935 - DNA, 22 bp, Homo sapiens
cactccctgggacacagaccca

SEQ ID NO: 705936 - DNA, 17 bp, Homo sapiens
cactcccttgctggccc

SEQ ID NO: 705937 - DNA, 20 bp, Homo sapiens
cactcccttgctggccccag

SEQ ID NO: 705938 - DNA, 16 bp, Homo sapiens
cactcccttgggctcc

SEQ ID NO: 705939 - DNA, 21 bp, Homo sapiens
cactcccttggtggcaagagc

SEQ ID NO: 705940 - DNA, 21 bp, Homo sapiens
cactccgcgccgatgccaccg

SEQ ID NO: 705941 - DNA, 20 bp, Homo sapiens
cactccggtcagcccctggc

SEQ ID NO: 705942 - DNA, 17 bp, Homo sapiens
cactccggtgtgcctgc

SEQ ID NO: 705943 - DNA, 18 bp, Homo sapiens
cactcctaggagagccaa

SEQ ID NO: 705944 - DNA, 21 bp, Homo sapiens
cactcctaggagagccaacct

SEQ ID NO: 705945 - DNA, 13 bp, Homo sapiens
cactcctcacaca

SEQ ID NO: 705946 - DNA, 23 bp, Homo sapiens
cactcctctgactcagggctcct

SEQ ID NO: 705947 - DNA, 14 bp, Homo sapiens
cactcctctgctga

SEQ ID NO: 705948 - DNA, 16 bp, Homo sapiens
cactcctctgctgacc

SEQ ID NO: 705949 - DNA, 22 bp, Homo sapiens
cactcctctgctgacctgctga

SEQ ID NO: 705950 - DNA, 11 bp, Homo sapiens
cactcctggag

SEQ ID NO: 705951 - DNA, 13 bp, Homo sapiens
cactcctgggctc

SEQ ID NO: 705952 - DNA, 20 bp, Homo sapiens
cactcctgggctctgaacac

SEQ ID NO: 705953 - DNA, 13 bp, Homo sapiens
cactcctgtacac

SEQ ID NO: 705954 - DNA, 23 bp, Homo sapiens
cactcctgtccctgtagctcagt

SEQ ID NO: 705955 - DNA, 18 bp, Homo sapiens
cactcctgttacttacct

SEQ ID NO: 705956 - DNA, 20 bp, Homo sapiens
cactccttccttcaggactc

SEQ ID NO: 705957 - DNA, 18 bp, Homo sapiens
cactcctttatctgtaat

SEQ ID NO: 705958 - DNA, 19 bp, Homo sapiens
cactcctttatctgtaatt

SEQ ID NO: 705959 - DNA, 14 bp, Homo sapiens
cactcgacccagaa

SEQ ID NO: 705960 - DNA, 21 bp, Homo sapiens
cactcgagaccatcctggccc

SEQ ID NO: 705961 - DNA, 14 bp, Homo sapiens
cactcgaggcctgc

SEQ ID NO: 705962 - DNA, 17 bp, Homo sapiens
cactcgaggcctgcaaa

SEQ ID NO: 705963 - DNA, 13 bp, Homo sapiens
cactcgcaggacc

SEQ ID NO: 705964 - DNA, 15 bp, Homo sapiens
cactcgcagtcgcag

SEQ ID NO: 705965 - DNA, 17 bp, Homo sapiens
cactcgccatttcctca

SEQ ID NO: 705966 - DNA, 16 bp, Homo sapiens
cactcgcccgcccact

SEQ ID NO: 705967 - DNA, 22 bp, Homo sapiens
cactcgcccgcccactgtcctg

SEQ ID NO: 705968 - DNA, 22 bp, Homo sapiens
cactcggatggaccaacctgct

SEQ ID NO: 705969 - DNA, 22 bp, Homo sapiens
cactcgtgtgcaacagacaagt

SEQ ID NO: 705970 - DNA, 12 bp, Homo sapiens
cactctaaactg

SEQ ID NO: 705971 - DNA, 20 bp, Homo sapiens
cactctaaactgcaaacaga

SEQ ID NO: 705972 - DNA, 15 bp, Homo sapiens
cactctaagtcatgt

SEQ ID NO: 705973 - DNA, 22 bp, Homo sapiens
cactctaagtcatgtatgtttc

SEQ ID NO: 705974 - DNA, 23 bp, Homo sapiens
cactctacacggactgaggtgcc

SEQ ID NO: 705975 - DNA, 14 bp, Homo sapiens
cactctacagactc

SEQ ID NO: 705976 - DNA, 19 bp, Homo sapiens
cactctaccaaataatttc

SEQ ID NO: 705977 - DNA, 16 bp, Homo sapiens
cactctaccctcccac

SEQ ID NO: 705978 - DNA, 21 bp, Homo sapiens
cactctaccctcccaccccct

SEQ ID NO: 705979 - DNA, 11 bp, Homo sapiens
cactctaccta

SEQ ID NO: 705980 - DNA, 16 bp, Homo sapiens
cactctagcctggcaa

SEQ ID NO: 705981 - DNA, 22 bp, Homo sapiens
cactctaggggtcaggctccat

SEQ ID NO: 705982 - DNA, 21 bp, Homo sapiens
cactctagtgacttcctggtg

SEQ ID NO: 705983 - DNA, 15 bp, Homo sapiens
cactctagttctaga

SEQ ID NO: 705984 - DNA, 18 bp, Homo sapiens
cactctagttctagatga

SEQ ID NO: 705985 - DNA, 21 bp, Homo sapiens
cactctatatgtagtgcattt

SEQ ID NO: 705986 - DNA, 22 bp, Homo sapiens
cactctcaccccaagcggcctt

SEQ ID NO: 705987 - DNA, 14 bp, Homo sapiens
cactctcactccac

SEQ ID NO: 705988 - DNA, 23 bp, Homo sapiens
cactctcatcaccccagaggcct

SEQ ID NO: 705989 - DNA, 17 bp, Homo sapiens
cactctcatgtcccctt

SEQ ID NO: 705990 - DNA, 21 bp, Homo sapiens
cactctcatgtccccttcctg

SEQ ID NO: 705991 - DNA, 21 bp, Homo sapiens
cactctccccacactaacctg

SEQ ID NO: 705992 - DNA, 14 bp, Homo sapiens
cactctcccctccc

SEQ ID NO: 705993 - DNA, 20 bp, Homo sapiens
cactctcgtggtatgtatgg

SEQ ID NO: 705994 - DNA, 13 bp, Homo sapiens
cactctctcaccc

SEQ ID NO: 705995 - DNA, 23 bp, Homo sapiens
cactctctcacccaccagctcca

SEQ ID NO: 705996 - DNA, 14 bp, Homo sapiens
cactctctgaagat

SEQ ID NO: 705997 - DNA, 17 bp, Homo sapiens
cactctctgcagcccag

SEQ ID NO: 705998 - DNA, 19 bp, Homo sapiens
cactctctgcagcccagcc

SEQ ID NO: 705999 - DNA, 21 bp, Homo sapiens
cactctctgggactctcctcc

SEQ ID NO: 706000 - DNA, 20 bp, Homo sapiens
cactctgattcacctcttcc

SEQ ID NO: 706001 - DNA, 21 bp, Homo sapiens
cactctgattcacctcttcct

SEQ ID NO: 706002 - DNA, 21 bp, Homo sapiens
agaaacctggggtgaatactt

SEQ ID NO: 706003 - DNA, 15 bp, Homo sapiens
agaaacgaaaaggac

SEQ ID NO: 706004 - DNA, 15 bp, Homo sapiens
agaaacgcatccagc

SEQ ID NO: 706005 - DNA, 21 bp, Homo sapiens
agaaacgcgctccttggcgga

SEQ ID NO: 706006 - DNA, 21 bp, Homo sapiens
agaaacgtcttctaaacttcc

SEQ ID NO: 706007 - DNA, 18 bp, Homo sapiens
agaaacgtgttaaaggtt

SEQ ID NO: 706008 - DNA, 20 bp, Homo sapiens
agaaactaaaaatatagcaa

SEQ ID NO: 706009 - DNA, 16 bp, Homo sapiens
agaaactaaacagaaa

SEQ ID NO: 706010 - DNA, 15 bp, Homo sapiens
agaaactaacttggt

SEQ ID NO: 706011 - DNA, 12 bp, Homo sapiens
agaaactattgg

SEQ ID NO: 706012 - DNA, 19 bp, Homo sapiens
agaaactccgaagaaaaga

SEQ ID NO: 706013 - DNA, 16 bp, Homo sapiens
agaaactcctgtttct

SEQ ID NO: 706014 - DNA, 20 bp, Homo sapiens
agaaactccttttgctgtct

SEQ ID NO: 706015 - DNA, 14 bp, Homo sapiens
agaaactgaaagtg

SEQ ID NO: 706016 - DNA, 22 bp, Homo sapiens
agaaactgaaccaacagaagca

SEQ ID NO: 706017 - DNA, 14 bp, Homo sapiens
agaaactgatttct

SEQ ID NO: 706018 - DNA, 17 bp, Homo sapiens
agaaactggaagctgtt

SEQ ID NO: 706019 - DNA, 18 bp, Homo sapiens
agaaacttaaatgttatt

SEQ ID NO: 706020 - DNA, 17 bp, Homo sapiens
agaaacttagaggaaaa

SEQ ID NO: 706021 - DNA, 21 bp, Homo sapiens
agaaacttgaactccaggatg

SEQ ID NO: 706022 - DNA, 22 bp, Homo sapiens
agaaacttggctggaatttctg

SEQ ID NO: 706023 - DNA, 23 bp, Homo sapiens
agaaacttgtgaagtggaaatgt

SEQ ID NO: 706024 - DNA, 10 bp, Homo sapiens
agaaagaaaa

SEQ ID NO: 706025 - DNA, 11 bp, Homo sapiens
agaaagaaaaa

SEQ ID NO: 706026 - DNA, 19 bp, Homo sapiens
agaaagaaaagaccctgag

SEQ ID NO: 706027 - DNA, 12 bp, Homo sapiens
agaaagaaaagg

SEQ ID NO: 706028 - DNA, 20 bp, Homo sapiens
agaaagaaaaggcaaaagac

SEQ ID NO: 706029 - DNA, 23 bp, Homo sapiens
agaaagaaaaggcaaaagactgg

SEQ ID NO: 706030 - DNA, 18 bp, Homo sapiens
agaaagaaagggaaactg

SEQ ID NO: 706031 - DNA, 13 bp, Homo sapiens
agaaagaagagac

SEQ ID NO: 706032 - DNA, 11 bp, Homo sapiens
agaaagaatgc

SEQ ID NO: 706033 - DNA, 17 bp, Homo sapiens
agaaagagaaacagttg

SEQ ID NO: 706034 - DNA, 16 bp, Homo sapiens
agaaagagaatgaact

SEQ ID NO: 706035 - DNA, 22 bp, Homo sapiens
agaaagagaatgaactgtggaa

SEQ ID NO: 706036 - DNA, 18 bp, Homo sapiens
agaaagagctcaaaataa

SEQ ID NO: 706037 - DNA, 16 bp, Homo sapiens
agaaagaggagtgctt

SEQ ID NO: 706038 - DNA, 22 bp, Homo sapiens
agaaagaggcaccaggaagccg

SEQ ID NO: 706039 - DNA, 17 bp, Homo sapiens
agaaagatcattgaaat

SEQ ID NO: 706040 - DNA, 18 bp, Homo sapiens
agaaagatcattgaaatt

SEQ ID NO: 706041 - DNA, 19 bp, Homo sapiens
agaaagatggatgtgcttt

SEQ ID NO: 706042 - DNA, 12 bp, Homo sapiens
agaaagatgtat

SEQ ID NO: 706043 - DNA, 21 bp, Homo sapiens
agaaagatgttccagtgagga

SEQ ID NO: 706044 - DNA, 20 bp, Homo sapiens
agaaagattacttagaggaa

SEQ ID NO: 706045 - DNA, 11 bp, Homo sapiens
agaaagcaata

SEQ ID NO: 706046 - DNA, 13 bp, Homo sapiens
agaaagccagaca

SEQ ID NO: 706047 - DNA, 16 bp, Homo sapiens
agaaagccagacaact

SEQ ID NO: 706048 - DNA, 17 bp, Homo sapiens
agaaagccagacaactt

SEQ ID NO: 706049 - DNA, 16 bp, Homo sapiens
agaaagccatattcca

SEQ ID NO: 706050 - DNA, 24 bp, Homo sapiens
agaaagccatattccagcagtgaa

SEQ ID NO: 706051 - DNA, 17 bp, Homo sapiens
agaaagccgggggaggg

SEQ ID NO: 706052 - DNA, 18 bp, Homo sapiens
agaaagccgggggagggg

SEQ ID NO: 706053 - DNA, 19 bp, Homo sapiens
agaaagccgggggaggggc

SEQ ID NO: 706054 - DNA, 22 bp, Homo sapiens
agaaagccgggggaggggccct

SEQ ID NO: 706055 - DNA, 23 bp, Homo sapiens
agaaagccgggggaggggccctc

SEQ ID NO: 706056 - DNA, 14 bp, Homo sapiens
agaaagcctctctc

SEQ ID NO: 706057 - DNA, 19 bp, Homo sapiens
agaaagcctctctctccct

SEQ ID NO: 706058 - DNA, 18 bp, Homo sapiens
agaaagcctgggtgacat

SEQ ID NO: 706059 - DNA, 18 bp, Homo sapiens
agaaagcctgttgtttaa

SEQ ID NO: 706060 - DNA, 15 bp, Homo sapiens
agaaagctagatatg

SEQ ID NO: 706061 - DNA, 17 bp, Homo sapiens
agaaagctccttccaga

SEQ ID NO: 706062 - DNA, 20 bp, Homo sapiens
agaaagctgccagagccggc

SEQ ID NO: 706063 - DNA, 20 bp, Homo sapiens
agaaaggaaaacctgaagac

SEQ ID NO: 706064 - DNA, 15 bp, Homo sapiens
agaaaggaagcattg

SEQ ID NO: 706065 - DNA, 17 bp, Homo sapiens
agaaaggaagcattgta

SEQ ID NO: 706066 - DNA, 22 bp, Homo sapiens
agaaaggaagcattgtaaaata

SEQ ID NO: 706067 - DNA, 20 bp, Homo sapiens
agaaaggaagccttgctcat

SEQ ID NO: 706068 - DNA, 19 bp, Homo sapiens
agaaaggagaaattttggt

SEQ ID NO: 706069 - DNA, 11 bp, Homo sapiens
agaaaggagac

SEQ ID NO: 706070 - DNA, 12 bp, Homo sapiens
agaaaggagggg

SEQ ID NO: 706071 - DNA, 17 bp, Homo sapiens
agaaaggatataaaagg

SEQ ID NO: 706072 - DNA, 21 bp, Homo sapiens
agaaaggatatttaagaaaat

SEQ ID NO: 706073 - DNA, 22 bp, Homo sapiens
agaaaggcagccctcacctctg

SEQ ID NO: 706074 - DNA, 16 bp, Homo sapiens
agaaaggctgttaaat

SEQ ID NO: 706075 - DNA, 17 bp, Homo sapiens
agaaagggagaggaaga

SEQ ID NO: 706076 - DNA, 16 bp, Homo sapiens
agaaagggaggcccag

SEQ ID NO: 706077 - DNA, 23 bp, Homo sapiens
agaaagggaggcccagccgcagg

SEQ ID NO: 706078 - DNA, 18 bp, Homo sapiens
agaaagggcagaggaaga

SEQ ID NO: 706079 - DNA, 16 bp, Homo sapiens
agaaaggggacccaag

SEQ ID NO: 706080 - DNA, 17 bp, Homo sapiens
agaaaggggctcttctg

SEQ ID NO: 706081 - DNA, 14 bp, Homo sapiens
agaaagggtgtttt

SEQ ID NO: 706082 - DNA, 16 bp, Homo sapiens
agaaaggttagtatca

SEQ ID NO: 706083 - DNA, 16 bp, Homo sapiens
agaaagtaagcatttc

SEQ ID NO: 706084 - DNA, 22 bp, Homo sapiens
agaaagtaaggtgcttggagtt

SEQ ID NO: 706085 - DNA, 22 bp, Homo sapiens
agaaagtaccctcttttaccaa

SEQ ID NO: 706086 - DNA, 21 bp, Homo sapiens
agaaagtcattcgcgtggctc

SEQ ID NO: 706087 - DNA, 14 bp, Homo sapiens
agaaagtgacattt

SEQ ID NO: 706088 - DNA, 17 bp, Homo sapiens
agaaagtgataagtgca

SEQ ID NO: 706089 - DNA, 18 bp, Homo sapiens
agaaagtgggaggtcagg

SEQ ID NO: 706090 - DNA, 22 bp, Homo sapiens
agaaagtgggaggtcaggaaac

SEQ ID NO: 706091 - DNA, 17 bp, Homo sapiens
agaaagtgtatttggaa

SEQ ID NO: 706092 - DNA, 22 bp, Homo sapiens
agaaagttagggggttcttatt

SEQ ID NO: 706093 - DNA, 15 bp, Homo sapiens
agaaagtttagatct

SEQ ID NO: 706094 - DNA, 12 bp, Homo sapiens
agaaataaaaat

SEQ ID NO: 706095 - DNA, 19 bp, Homo sapiens
agaaataaaacaactctga

SEQ ID NO: 706096 - DNA, 14 bp, Homo sapiens
agaaataaaccaaa

SEQ ID NO: 706097 - DNA, 19 bp, Homo sapiens
agaaataaagttggtgaca

SEQ ID NO: 706098 - DNA, 15 bp, Homo sapiens
agaaataaatagcta

SEQ ID NO: 706099 - DNA, 12 bp, Homo sapiens
agaaataaatga

SEQ ID NO: 706100 - DNA, 14 bp, Homo sapiens
agaaataaatgaaa

SEQ ID NO: 706101 - DNA, 22 bp, Homo sapiens
agaaataaattttgtttcagaa

SEQ ID NO: 706102 - DNA, 17 bp, Homo sapiens
agaaataagtggttatt

SEQ ID NO: 706103 - DNA, 22 bp, Homo sapiens
agaaataagtggttatttctca

SEQ ID NO: 706104 - DNA, 16 bp, Homo sapiens
agaaataagtttttgt

SEQ ID NO: 706105 - DNA, 15 bp, Homo sapiens
agaaataatatgcat

SEQ ID NO: 706106 - DNA, 16 bp, Homo sapiens
agaaataatatgcatt

SEQ ID NO: 706107 - DNA, 16 bp, Homo sapiens
agaaataattgttgat

SEQ ID NO: 706108 - DNA, 20 bp, Homo sapiens
agaaatacagctggctatct

SEQ ID NO: 706109 - DNA, 16 bp, Homo sapiens
agaaatactcatgtgc

SEQ ID NO: 706110 - DNA, 18 bp, Homo sapiens
agaaatactgctctgaat

SEQ ID NO: 706111 - DNA, 13 bp, Homo sapiens
agaaatactgtac

SEQ ID NO: 706112 - DNA, 16 bp, Homo sapiens
agaaatagaattataa

SEQ ID NO: 706113 - DNA, 18 bp, Homo sapiens
agaaatagacaaaaagta

SEQ ID NO: 706114 - DNA, 21 bp, Homo sapiens
agaaatagacaaaaagtatat

SEQ ID NO: 706115 - DNA, 22 bp, Homo sapiens
agaaatagacaaaaagtatatt

SEQ ID NO: 706116 - DNA, 18 bp, Homo sapiens
agaaatagacagtatatt

SEQ ID NO: 706117 - DNA, 17 bp, Homo sapiens
agaaatagacttaataa

SEQ ID NO: 706118 - DNA, 15 bp, Homo sapiens
agaaatagagccaac

SEQ ID NO: 706119 - DNA, 11 bp, Homo sapiens
agaaatagcag

SEQ ID NO: 706120 - DNA, 23 bp, Homo sapiens
agaaatagctgaaaagggcactc

SEQ ID NO: 706121 - DNA, 14 bp, Homo sapiens
agaaatatacagtt

SEQ ID NO: 706122 - DNA, 15 bp, Homo sapiens
agaaatatacagttt

SEQ ID NO: 706123 - DNA, 16 bp, Homo sapiens
agaaatatacagtttg

SEQ ID NO: 706124 - DNA, 22 bp, Homo sapiens
agaaatataggatagacactgg

SEQ ID NO: 706125 - DNA, 18 bp, Homo sapiens
agaaatatagtgcaatag

SEQ ID NO: 706126 - DNA, 17 bp, Homo sapiens
cactctgccctctgctg

SEQ ID NO: 706127 - DNA, 19 bp, Homo sapiens
cactctgccctctgctgct

SEQ ID NO: 706128 - DNA, 20 bp, Homo sapiens
cactctgccctctgctgctg

SEQ ID NO: 706129 - DNA, 18 bp, Homo sapiens
cactctgcggcccgggcc

SEQ ID NO: 706130 - DNA, 19 bp, Homo sapiens
cactctgcggcccgggccg

SEQ ID NO: 706131 - DNA, 12 bp, Homo sapiens
cactctgctctg

SEQ ID NO: 706132 - DNA, 12 bp, Homo sapiens
cactctgctgtt

SEQ ID NO: 706133 - DNA, 15 bp, Homo sapiens
cactctgcttctctg

SEQ ID NO: 706134 - DNA, 21 bp, Homo sapiens
cactctgcttctctgacttct

SEQ ID NO: 706135 - DNA, 18 bp, Homo sapiens
cactctggattcagcctt

SEQ ID NO: 706136 - DNA, 16 bp, Homo sapiens
cactctgggctccaga

SEQ ID NO: 706137 - DNA, 15 bp, Homo sapiens
cactctggtggccac

SEQ ID NO: 706138 - DNA, 13 bp, Homo sapiens
cactctgtaattg

SEQ ID NO: 706139 - DNA, 20 bp, Homo sapiens
cactctgtaattgcaaaaaa

SEQ ID NO: 706140 - DNA, 19 bp, Homo sapiens
cactctgtagtcaaaaaag

SEQ ID NO: 706141 - DNA, 17 bp, Homo sapiens
cactctgtcagccagcc

SEQ ID NO: 706142 - DNA, 21 bp, Homo sapiens
cactctgtcagccagccgccc

SEQ ID NO: 706143 - DNA, 22 bp, Homo sapiens
cactctgtcagccagccgccct

SEQ ID NO: 706144 - DNA, 20 bp, Homo sapiens
cactctgtccctgtccttcc

SEQ ID NO: 706145 - DNA, 20 bp, Homo sapiens
cactctgttgcccaggctgg

SEQ ID NO: 706146 - DNA, 18 bp, Homo sapiens
cactcttaggtatgtatg

SEQ ID NO: 706147 - DNA, 14 bp, Homo sapiens
cactcttcacttga

SEQ ID NO: 706148 - DNA, 17 bp, Homo sapiens
cactcttcctgcaagga

SEQ ID NO: 706149 - DNA, 13 bp, Homo sapiens
cactcttctctcc

SEQ ID NO: 706150 - DNA, 14 bp, Homo sapiens
cactcttctctcct

SEQ ID NO: 706151 - DNA, 21 bp, Homo sapiens
cactcttctctcctttctccc

SEQ ID NO: 706152 - DNA, 19 bp, Homo sapiens
cactctttaacacattctt

SEQ ID NO: 706153 - DNA, 20 bp, Homo sapiens
cactctttaacacattcttt

SEQ ID NO: 706154 - DNA, 12 bp, Homo sapiens
cactgaaaaaat

SEQ ID NO: 706155 - DNA, 13 bp, Homo sapiens
cactgaaaaaata

SEQ ID NO: 706156 - DNA, 14 bp, Homo sapiens
cactgaaaaacaac

SEQ ID NO: 706157 - DNA, 18 bp, Homo sapiens
cactgaaaacatctggaa

SEQ ID NO: 706158 - DNA, 22 bp, Homo sapiens
cactgaaaacatttcaaagctg

SEQ ID NO: 706159 - DNA, 19 bp, Homo sapiens
cactgaaaacttagccaga

SEQ ID NO: 706160 - DNA, 18 bp, Homo sapiens
cactgaaaatagtgttcc

SEQ ID NO: 706161 - DNA, 14 bp, Homo sapiens
cactgaaaccaaaa

SEQ ID NO: 706162 - DNA, 16 bp, Homo sapiens
cactgaaaccaaaaca

SEQ ID NO: 706163 - DNA, 12 bp, Homo sapiens
cactgaaacctg

SEQ ID NO: 706164 - DNA, 14 bp, Homo sapiens
cactgaaacctgag

SEQ ID NO: 706165 - DNA, 18 bp, Homo sapiens
cactgaaagttttgtaaa

SEQ ID NO: 706166 - DNA, 19 bp, Homo sapiens
cactgaaagttttgtaaaa

SEQ ID NO: 706167 - DNA, 21 bp, Homo sapiens
cactgaaagttttgtaaaaga

SEQ ID NO: 706168 - DNA, 17 bp, Homo sapiens
cactgaaatctgtcaag

SEQ ID NO: 706169 - DNA, 16 bp, Homo sapiens
cactgaaatgtttgga

SEQ ID NO: 706170 - DNA, 13 bp, Homo sapiens
cactgaacaaaac

SEQ ID NO: 706171 - DNA, 15 bp, Homo sapiens
cactgaacaaactaa

SEQ ID NO: 706172 - DNA, 14 bp, Homo sapiens
cactgaacagaatt

SEQ ID NO: 706173 - DNA, 16 bp, Homo sapiens
cactgaacaggctggg

SEQ ID NO: 706174 - DNA, 21 bp, Homo sapiens
cactgaacaggctggggcctt

SEQ ID NO: 706175 - DNA, 21 bp, Homo sapiens
cactgaacatgcctagtccaa

SEQ ID NO: 706176 - DNA, 16 bp, Homo sapiens
cactgaaccactgctt

SEQ ID NO: 706177 - DNA, 22 bp, Homo sapiens
cactgaaccttaggctttgtat

SEQ ID NO: 706178 - DNA, 17 bp, Homo sapiens
cactgaagtggccctcc

SEQ ID NO: 706179 - DNA, 19 bp, Homo sapiens
cactgaagttaacagagac

SEQ ID NO: 706180 - DNA, 19 bp, Homo sapiens
cactgaatatataaacact

SEQ ID NO: 706181 - DNA, 14 bp, Homo sapiens
cactgaatatttat

SEQ ID NO: 706182 - DNA, 15 bp, Homo sapiens
cactgaatcttcacg

SEQ ID NO: 706183 - DNA, 21 bp, Homo sapiens
cactgaatgcctcaatgtgac

SEQ ID NO: 706184 - DNA, 13 bp, Homo sapiens
cactgaattgaat

SEQ ID NO: 706185 - DNA, 20 bp, Homo sapiens
cactgaattgacatgaccct

SEQ ID NO: 706186 - DNA, 13 bp, Homo sapiens
cactgaatttata

SEQ ID NO: 706187 - DNA, 19 bp, Homo sapiens
cactgacacaaaaagtaga

SEQ ID NO: 706188 - DNA, 13 bp, Homo sapiens
cactgacagcctc

SEQ ID NO: 706189 - DNA, 20 bp, Homo sapiens
cactgacagcctcccacccc

SEQ ID NO: 706190 - DNA, 13 bp, Homo sapiens
cactgacagcctt

SEQ ID NO: 706191 - DNA, 17 bp, Homo sapiens
cactgacagccttgccc

SEQ ID NO: 706192 - DNA, 16 bp, Homo sapiens
cactgaccatccactc

SEQ ID NO: 706193 - DNA, 23 bp, Homo sapiens
cactgaccatccactctaccctc

SEQ ID NO: 706194 - DNA, 13 bp, Homo sapiens
cactgacccacct

SEQ ID NO: 706195 - DNA, 16 bp, Homo sapiens
cactgacccacctgcg

SEQ ID NO: 706196 - DNA, 18 bp, Homo sapiens
cactgacccacctgcgct

SEQ ID NO: 706197 - DNA, 19 bp, Homo sapiens
cactgaccctaactgcaga

SEQ ID NO: 706198 - DNA, 15 bp, Homo sapiens
cactgacctgtaggt

SEQ ID NO: 706199 - DNA, 19 bp, Homo sapiens
cactgactactggctctca

SEQ ID NO: 706200 - DNA, 16 bp, Homo sapiens
cactgactgtatggca

SEQ ID NO: 706201 - DNA, 16 bp, Homo sapiens
cactgacttgctgtgt

SEQ ID NO: 706202 - DNA, 17 bp, Homo sapiens
cactgagaagattgtga

SEQ ID NO: 706203 - DNA, 15 bp, Homo sapiens
cactgagaccaaggc

SEQ ID NO: 706204 - DNA, 17 bp, Homo sapiens
cactgagaccaaggctt

SEQ ID NO: 706205 - DNA, 19 bp, Homo sapiens
cactgagagctgcctcctg

SEQ ID NO: 706206 - DNA, 14 bp, Homo sapiens
cactgagaggcctg

SEQ ID NO: 706207 - DNA, 16 bp, Homo sapiens
cactgagaggcctgga

SEQ ID NO: 706208 - DNA, 18 bp, Homo sapiens
cactgagataccagcgag

SEQ ID NO: 706209 - DNA, 23 bp, Homo sapiens
cactgagataccagcgaggaggc

SEQ ID NO: 706210 - DNA, 19 bp, Homo sapiens
cactgagatttaaatgcaa

SEQ ID NO: 706211 - DNA, 18 bp, Homo sapiens
cactgagcacagtcaggg

SEQ ID NO: 706212 - DNA, 15 bp, Homo sapiens
cactgagccatcatt

SEQ ID NO: 706213 - DNA, 14 bp, Homo sapiens
cactgagccccacc

SEQ ID NO: 706214 - DNA, 21 bp, Homo sapiens
cactgagctcacatgggactg

SEQ ID NO: 706215 - DNA, 12 bp, Homo sapiens
cactgagctcca

SEQ ID NO: 706216 - DNA, 16 bp, Homo sapiens
cactgagctccccaga

SEQ ID NO: 706217 - DNA, 15 bp, Homo sapiens
cactgagcttctgag

SEQ ID NO: 706218 - DNA, 12 bp, Homo sapiens
cactgaggactg

SEQ ID NO: 706219 - DNA, 12 bp, Homo sapiens
cactgaggccat

SEQ ID NO: 706220 - DNA, 19 bp, Homo sapiens
cactgaggccatcagggcc

SEQ ID NO: 706221 - DNA, 22 bp, Homo sapiens
cactgaggccatcagggccctg

SEQ ID NO: 706222 - DNA, 23 bp, Homo sapiens
cactgaggccatcagggccctgc

SEQ ID NO: 706223 - DNA, 21 bp, Homo sapiens
cactgaggcttaggcctctct

SEQ ID NO: 706224 - DNA, 19 bp, Homo sapiens
cactgaggtccacagacct

SEQ ID NO: 706225 - DNA, 12 bp, Homo sapiens
cactgagttcta

SEQ ID NO: 706226 - DNA, 18 bp, Homo sapiens
cactgataaaagttttga

SEQ ID NO: 706227 - DNA, 19 bp, Homo sapiens
cactgatacataaaaatta

SEQ ID NO: 706228 - DNA, 20 bp, Homo sapiens
cactgatacataaaaattaa

SEQ ID NO: 706229 - DNA, 14 bp, Homo sapiens
cactgatagtcctt

SEQ ID NO: 706230 - DNA, 22 bp, Homo sapiens
cactgatgggctggggcagggg

SEQ ID NO: 706231 - DNA, 16 bp, Homo sapiens
cactgatttggagata

SEQ ID NO: 706232 - DNA, 15 bp, Homo sapiens
cactgcaaaatgtct

SEQ ID NO: 706233 - DNA, 19 bp, Homo sapiens
cactgcaaataaagccttt

SEQ ID NO: 706234 - DNA, 15 bp, Homo sapiens
cactgcaaatctccg

SEQ ID NO: 706235 - DNA, 19 bp, Homo sapiens
cactgcaacctccgcctct

SEQ ID NO: 706236 - DNA, 14 bp, Homo sapiens
cactgcaacctctg

SEQ ID NO: 706237 - DNA, 17 bp, Homo sapiens
cactgcaacttctgcct

SEQ ID NO: 706238 - DNA, 15 bp, Homo sapiens
cactgcaacttgtga

SEQ ID NO: 706239 - DNA, 17 bp, Homo sapiens
cactgcaacttgtgaac

SEQ ID NO: 706240 - DNA, 15 bp, Homo sapiens
cactgcaagagcctt

SEQ ID NO: 706241 - DNA, 13 bp, Homo sapiens
cactgcaagtctg

SEQ ID NO: 706242 - DNA, 15 bp, Homo sapiens
cactgcaatatcttc

SEQ ID NO: 706243 - DNA, 16 bp, Homo sapiens
cactgcaatcctgtct

SEQ ID NO: 706244 - DNA, 19 bp, Homo sapiens
cactgcacacacctcagag

SEQ ID NO: 706245 - DNA, 18 bp, Homo sapiens
cactgcacagtgcatctc

SEQ ID NO: 706246 - DNA, 19 bp, Homo sapiens
cactgcacagtgcatctca

SEQ ID NO: 706247 - DNA, 16 bp, Homo sapiens
cactgcacctgcccag

SEQ ID NO: 706248 - DNA, 17 bp, Homo sapiens
cactgcactccagcctg

SEQ ID NO: 706249 - DNA, 20 bp, Homo sapiens
cactgcactccagcctgggc

SEQ ID NO: 706250 - DNA, 20 bp, Homo sapiens
cactgcactccagcctgggt

SEQ ID NO: 706251 - DNA, 19 bp, Homo sapiens
agaaatatagtgcaatagt

SEQ ID NO: 706252 - DNA, 14 bp, Homo sapiens
agaaatatattttt

SEQ ID NO: 706253 - DNA, 14 bp, Homo sapiens
agaaatatctgtga

SEQ ID NO: 706254 - DNA, 17 bp, Homo sapiens
agaaatatctgtgaaat

SEQ ID NO: 706255 - DNA, 15 bp, Homo sapiens
agaaatatctttctc

SEQ ID NO: 706256 - DNA, 15 bp, Homo sapiens
agaaatatgaaattc

SEQ ID NO: 706257 - DNA, 13 bp, Homo sapiens
agaaatatgattt

SEQ ID NO: 706258 - DNA, 15 bp, Homo sapiens
agaaatatgatttta

SEQ ID NO: 706259 - DNA, 16 bp, Homo sapiens
agaaatatggaactta

SEQ ID NO: 706260 - DNA, 17 bp, Homo sapiens
agaaatatggaacttac

SEQ ID NO: 706261 - DNA, 20 bp, Homo sapiens
agaaatatggaacttacatt

SEQ ID NO: 706262 - DNA, 15 bp, Homo sapiens
agaaatatgtggttt

SEQ ID NO: 706263 - DNA, 15 bp, Homo sapiens
agaaatatttaccta

SEQ ID NO: 706264 - DNA, 19 bp, Homo sapiens
agaaatcacaggggcgggg

SEQ ID NO: 706265 - DNA, 22 bp, Homo sapiens
agaaatcacaggggcggggcag

SEQ ID NO: 706266 - DNA, 12 bp, Homo sapiens
agaaatcactgt

SEQ ID NO: 706267 - DNA, 13 bp, Homo sapiens
agaaatcactgtg

SEQ ID NO: 706268 - DNA, 17 bp, Homo sapiens
agaaatcactgtgaaat

SEQ ID NO: 706269 - DNA, 23 bp, Homo sapiens
agaaatcaggtgttttaagactg

SEQ ID NO: 706270 - DNA, 24 bp, Homo sapiens
agaaatcaggtgttttaagactga

SEQ ID NO: 706271 - DNA, 14 bp, Homo sapiens
agaaatcatagctg

SEQ ID NO: 706272 - DNA, 16 bp, Homo sapiens
agaaatcatgtccata

SEQ ID NO: 706273 - DNA, 16 bp, Homo sapiens
agaaatcattgtagaa

SEQ ID NO: 706274 - DNA, 17 bp, Homo sapiens
agaaatcattttgcaat

SEQ ID NO: 706275 - DNA, 16 bp, Homo sapiens
agaaatccaaatttct

SEQ ID NO: 706276 - DNA, 23 bp, Homo sapiens
agaaatccagtttgtgtttttct

SEQ ID NO: 706277 - DNA, 16 bp, Homo sapiens
agaaatccatatctta

SEQ ID NO: 706278 - DNA, 21 bp, Homo sapiens
agaaatccatatcttaaagaa

SEQ ID NO: 706279 - DNA, 18 bp, Homo sapiens
agaaatcctgcaatgaaa

SEQ ID NO: 706280 - DNA, 22 bp, Homo sapiens
agaaatcttgcttcagaccatc

SEQ ID NO: 706281 - DNA, 16 bp, Homo sapiens
agaaatctttctccct

SEQ ID NO: 706282 - DNA, 19 bp, Homo sapiens
agaaatgaataatttccca

SEQ ID NO: 706283 - DNA, 16 bp, Homo sapiens
agaaatgcaaaaatct

SEQ ID NO: 706284 - DNA, 15 bp, Homo sapiens
agaaatgcaataact

SEQ ID NO: 706285 - DNA, 19 bp, Homo sapiens
agaaatgcaataactctgg

SEQ ID NO: 706286 - DNA, 12 bp, Homo sapiens
agaaatgcagaa

SEQ ID NO: 706287 - DNA, 13 bp, Homo sapiens
agaaatgcatatt

SEQ ID NO: 706288 - DNA, 18 bp, Homo sapiens
agaaatgccagaaacagt

SEQ ID NO: 706289 - DNA, 14 bp, Homo sapiens
agaaatgctgcctg

SEQ ID NO: 706290 - DNA, 14 bp, Homo sapiens
agaaatgctgctgg

SEQ ID NO: 706291 - DNA, 20 bp, Homo sapiens
agaaatgctggtttttcagt

SEQ ID NO: 706292 - DNA, 20 bp, Homo sapiens
agaaatggacaaagaaaacg

SEQ ID NO: 706293 - DNA, 23 bp, Homo sapiens
agaaatggcgtctgctctggtgg

SEQ ID NO: 706294 - DNA, 12 bp, Homo sapiens
agaaatgggcag

SEQ ID NO: 706295 - DNA, 13 bp, Homo sapiens
agaaatgggcagt

SEQ ID NO: 706296 - DNA, 16 bp, Homo sapiens
agaaatgggcctgcct

SEQ ID NO: 706297 - DNA, 17 bp, Homo sapiens
agaaatgggcctgcctg

SEQ ID NO: 706298 - DNA, 17 bp, Homo sapiens
agaaatggtttcctctg

SEQ ID NO: 706299 - DNA, 19 bp, Homo sapiens
agaaatggtttcctctgga

SEQ ID NO: 706300 - DNA, 16 bp, Homo sapiens
agaaatgtaaactgcc

SEQ ID NO: 706301 - DNA, 18 bp, Homo sapiens
agaaatgtaaactgccat

SEQ ID NO: 706302 - DNA, 14 bp, Homo sapiens
agaaatgtacagca

SEQ ID NO: 706303 - DNA, 17 bp, Homo sapiens
agaaatgtacagcaagg

SEQ ID NO: 706304 - DNA, 11 bp, Homo sapiens
agaaatgtgtt

SEQ ID NO: 706305 - DNA, 14 bp, Homo sapiens
agaaattatttaat

SEQ ID NO: 706306 - DNA, 23 bp, Homo sapiens
agaaattcctgtagcatcttctg

SEQ ID NO: 706307 - DNA, 21 bp, Homo sapiens
agaaattctgcaagtttctgt

SEQ ID NO: 706308 - DNA, 12 bp, Homo sapiens
agaaattcttgt

SEQ ID NO: 706309 - DNA, 19 bp, Homo sapiens
agaaattgggctggattgt

SEQ ID NO: 706310 - DNA, 17 bp, Homo sapiens
agaaattgtatattgta

SEQ ID NO: 706311 - DNA, 24 bp, Homo sapiens
agaaatttaaactataagcaagaa

SEQ ID NO: 706312 - DNA, 22 bp, Homo sapiens
agaaatttaattcatgtttctt

SEQ ID NO: 706313 - DNA, 18 bp, Homo sapiens
agaaatttagagtcaatt

SEQ ID NO: 706314 - DNA, 19 bp, Homo sapiens
agaaatttatgaagcagat

SEQ ID NO: 706315 - DNA, 20 bp, Homo sapiens
agaaatttatgaagcagatt

SEQ ID NO: 706316 - DNA, 22 bp, Homo sapiens
agaaatttatgaagcagattta

SEQ ID NO: 706317 - DNA, 14 bp, Homo sapiens
agaaatttcacata

SEQ ID NO: 706318 - DNA, 13 bp, Homo sapiens
agaaatttctagt

SEQ ID NO: 706319 - DNA, 15 bp, Homo sapiens
agaaatttgatttct

SEQ ID NO: 706320 - DNA, 16 bp, Homo sapiens
agaaatttgatttcta

SEQ ID NO: 706321 - DNA, 13 bp, Homo sapiens
agaaatttgcaac

SEQ ID NO: 706322 - DNA, 15 bp, Homo sapiens
agaaatttggtaccc

SEQ ID NO: 706323 - DNA, 19 bp, Homo sapiens
agaaatttttatttttgaa

SEQ ID NO: 706324 - DNA, 17 bp, Homo sapiens
agaaatttttcagatgc

SEQ ID NO: 706325 - DNA, 23 bp, Homo sapiens
agaacaaaaaaatctgcagaagg

SEQ ID NO: 706326 - DNA, 20 bp, Homo sapiens
agaacaaaaagaaatcttgt

SEQ ID NO: 706327 - DNA, 21 bp, Homo sapiens
agaacaaaccccgaaacagta

SEQ ID NO: 706328 - DNA, 22 bp, Homo sapiens
agaacaaaccccgaaacagtaa

SEQ ID NO: 706329 - DNA, 21 bp, Homo sapiens
agaacaaagctgttaaactgt

SEQ ID NO: 706330 - DNA, 17 bp, Homo sapiens
agaacaaatgtgttttt

SEQ ID NO: 706331 - DNA, 18 bp, Homo sapiens
agaacaaatgtgtttttc

SEQ ID NO: 706332 - DNA, 15 bp, Homo sapiens
agaacaacaggcagg

SEQ ID NO: 706333 - DNA, 10 bp, Homo sapiens
agaacaaggc

SEQ ID NO: 706334 - DNA, 17 bp, Homo sapiens
agaacaaggtagttttt

SEQ ID NO: 706335 - DNA, 17 bp, Homo sapiens
agaacaagtcacagctg

SEQ ID NO: 706336 - DNA, 19 bp, Homo sapiens
agaacaagtcacagctgca

SEQ ID NO: 706337 - DNA, 21 bp, Homo sapiens
agaacaagtcacagctgcagc

SEQ ID NO: 706338 - DNA, 14 bp, Homo sapiens
agaacaatcactat

SEQ ID NO: 706339 - DNA, 22 bp, Homo sapiens
agaacacacacatatacacgaa

SEQ ID NO: 706340 - DNA, 13 bp, Homo sapiens
agaacacagcatg

SEQ ID NO: 706341 - DNA, 11 bp, Homo sapiens
agaacacctgg

SEQ ID NO: 706342 - DNA, 20 bp, Homo sapiens
agaacacgttgccaggggct

SEQ ID NO: 706343 - DNA, 18 bp, Homo sapiens
agaacactaactcaccag

SEQ ID NO: 706344 - DNA, 23 bp, Homo sapiens
agaacactgcctctgagttttga

SEQ ID NO: 706345 - DNA, 13 bp, Homo sapiens
agaacacttcaga

SEQ ID NO: 706346 - DNA, 16 bp, Homo sapiens
agaacagaaaacaaca

SEQ ID NO: 706347 - DNA, 14 bp, Homo sapiens
agaacagaggcatt

SEQ ID NO: 706348 - DNA, 22 bp, Homo sapiens
agaacagcatcatgtcataaac

SEQ ID NO: 706349 - DNA, 18 bp, Homo sapiens
agaacagccctcggcctc

SEQ ID NO: 706350 - DNA, 19 bp, Homo sapiens
agaacagccgctcctgtct

SEQ ID NO: 706351 - DNA, 20 bp, Homo sapiens
agaacagggaaaataggcag

SEQ ID NO: 706352 - DNA, 17 bp, Homo sapiens
agaacagtatgaatttg

SEQ ID NO: 706353 - DNA, 20 bp, Homo sapiens
agaacagtatgaatttgagc

SEQ ID NO: 706354 - DNA, 21 bp, Homo sapiens
agaacagtcatgtatgcaagt

SEQ ID NO: 706355 - DNA, 23 bp, Homo sapiens
agaacagtgagaaagggcataca

SEQ ID NO: 706356 - DNA, 18 bp, Homo sapiens
agaacagtggaaactatg

SEQ ID NO: 706357 - DNA, 12 bp, Homo sapiens
agaacagtgggc

SEQ ID NO: 706358 - DNA, 17 bp, Homo sapiens
agaacataaagcaaata

SEQ ID NO: 706359 - DNA, 13 bp, Homo sapiens
agaacatacactg

SEQ ID NO: 706360 - DNA, 17 bp, Homo sapiens
agaacatacatgataca

SEQ ID NO: 706361 - DNA, 19 bp, Homo sapiens
agaacatagacagaagaaa

SEQ ID NO: 706362 - DNA, 13 bp, Homo sapiens
agaacatcaagat

SEQ ID NO: 706363 - DNA, 14 bp, Homo sapiens
agaacatcattaga

SEQ ID NO: 706364 - DNA, 19 bp, Homo sapiens
agaacatccctgggcaagt

SEQ ID NO: 706365 - DNA, 20 bp, Homo sapiens
agaacatctgtataccctct

SEQ ID NO: 706366 - DNA, 20 bp, Homo sapiens
agaacatgcacatttatata

SEQ ID NO: 706367 - DNA, 16 bp, Homo sapiens
agaacatggacttgta

SEQ ID NO: 706368 - DNA, 12 bp, Homo sapiens
agaacatgttaa

SEQ ID NO: 706369 - DNA, 13 bp, Homo sapiens
agaacatgttaag

SEQ ID NO: 706370 - DNA, 13 bp, Homo sapiens
agaacattattca

SEQ ID NO: 706371 - DNA, 19 bp, Homo sapiens
agaaccaaagaagaaagtc

SEQ ID NO: 706372 - DNA, 17 bp, Homo sapiens
agaaccaaagctcaaat

SEQ ID NO: 706373 - DNA, 19 bp, Homo sapiens
agaaccaccactgcctgac

SEQ ID NO: 706374 - DNA, 13 bp, Homo sapiens
agaaccactatga

SEQ ID NO: 706375 - DNA, 21 bp, Homo sapiens
agaaccagccgtattttacat

SEQ ID NO: 706376 - DNA, 13 bp, Homo sapiens
cactgcactccgg

SEQ ID NO: 706377 - DNA, 18 bp, Homo sapiens
cactgcagacgggaatgc

SEQ ID NO: 706378 - DNA, 19 bp, Homo sapiens
cactgcagacgggaatgcc

SEQ ID NO: 706379 - DNA, 22 bp, Homo sapiens
cactgcagacgggaatgcctag

SEQ ID NO: 706380 - DNA, 23 bp, Homo sapiens
cactgcagacgggaatgcctagg

SEQ ID NO: 706381 - DNA, 17 bp, Homo sapiens
cactgcagacttgtcca

SEQ ID NO: 706382 - DNA, 19 bp, Homo sapiens
cactgcagcctcaacctcc

SEQ ID NO: 706383 - DNA, 19 bp, Homo sapiens
cactgcagcctcatactcc

SEQ ID NO: 706384 - DNA, 22 bp, Homo sapiens
cactgcagccttgtcctcccag

SEQ ID NO: 706385 - DNA, 12 bp, Homo sapiens
cactgcaggaca

SEQ ID NO: 706386 - DNA, 13 bp, Homo sapiens
cactgcaggcccc

SEQ ID NO: 706387 - DNA, 16 bp, Homo sapiens
cactgcagtcttattt

SEQ ID NO: 706388 - DNA, 18 bp, Homo sapiens
cactgcagtcttatttcc

SEQ ID NO: 706389 - DNA, 13 bp, Homo sapiens
cactgcagtgatg

SEQ ID NO: 706390 - DNA, 16 bp, Homo sapiens
cactgcatgtttgtga

SEQ ID NO: 706391 - DNA, 18 bp, Homo sapiens
cactgcattcctgtgccc

SEQ ID NO: 706392 - DNA, 22 bp, Homo sapiens
cactgcattcctgtgccctaga

SEQ ID NO: 706393 - DNA, 21 bp, Homo sapiens
cactgcatttggtcagggggg

SEQ ID NO: 706394 - DNA, 21 bp, Homo sapiens
cactgccaagagccgacaatg

SEQ ID NO: 706395 - DNA, 15 bp, Homo sapiens
cactgccaagcttcc

SEQ ID NO: 706396 - DNA, 17 bp, Homo sapiens
cactgccaagcttcctg

SEQ ID NO: 706397 - DNA, 16 bp, Homo sapiens
cactgccaatgctgta

SEQ ID NO: 706398 - DNA, 21 bp, Homo sapiens
cactgccagaagagaattcag

SEQ ID NO: 706399 - DNA, 22 bp, Homo sapiens
cactgccagcagcagcaggtga

SEQ ID NO: 706400 - DNA, 13 bp, Homo sapiens
cactgccaggcac

SEQ ID NO: 706401 - DNA, 15 bp, Homo sapiens
cactgccaggcacct

SEQ ID NO: 706402 - DNA, 17 bp, Homo sapiens
cactgccaggcacctgg

SEQ ID NO: 706403 - DNA, 18 bp, Homo sapiens
cactgccaggcacctggc

SEQ ID NO: 706404 - DNA, 16 bp, Homo sapiens
cactgccaggccagcc

SEQ ID NO: 706405 - DNA, 20 bp, Homo sapiens
cactgccaggccagcctccg

SEQ ID NO: 706406 - DNA, 20 bp, Homo sapiens
cactgccatcttagtttgga

SEQ ID NO: 706407 - DNA, 13 bp, Homo sapiens
cactgcccaccaa

SEQ ID NO: 706408 - DNA, 14 bp, Homo sapiens
cactgcccaccaaa

SEQ ID NO: 706409 - DNA, 14 bp, Homo sapiens
cactgcccaccccc

SEQ ID NO: 706410 - DNA, 17 bp, Homo sapiens
cactgcccatggacagg

SEQ ID NO: 706411 - DNA, 18 bp, Homo sapiens
cactgccccacttctggc

SEQ ID NO: 706412 - DNA, 20 bp, Homo sapiens
cactgccccacttctggcat

SEQ ID NO: 706413 - DNA, 18 bp, Homo sapiens
cactgcccgagctggtgc

SEQ ID NO: 706414 - DNA, 19 bp, Homo sapiens
cactgcccgagctggtgca

SEQ ID NO: 706415 - DNA, 21 bp, Homo sapiens
cactgcccgagctggtgcatt

SEQ ID NO: 706416 - DNA, 13 bp, Homo sapiens
cactgccctgcct

SEQ ID NO: 706417 - DNA, 16 bp, Homo sapiens
cactgccctgcctgcc

SEQ ID NO: 706418 - DNA, 18 bp, Homo sapiens
cactgccctgcctgccca

SEQ ID NO: 706419 - DNA, 13 bp, Homo sapiens
cactgccctggca

SEQ ID NO: 706420 - DNA, 15 bp, Homo sapiens
cactgccctggcagc

SEQ ID NO: 706421 - DNA, 23 bp, Homo sapiens
cactgcctaggaggctggccaag

SEQ ID NO: 706422 - DNA, 23 bp, Homo sapiens
cactgcctcctgttttctccctc

SEQ ID NO: 706423 - DNA, 10 bp, Homo sapiens
cactgcctct

SEQ ID NO: 706424 - DNA, 20 bp, Homo sapiens
cactgcctctatgccctgca

SEQ ID NO: 706425 - DNA, 22 bp, Homo sapiens
cactgcctctatgccctgcaga

SEQ ID NO: 706426 - DNA, 13 bp, Homo sapiens
cactgcctctccc

SEQ ID NO: 706427 - DNA, 14 bp, Homo sapiens
cactgcctctccct

SEQ ID NO: 706428 - DNA, 10 bp, Homo sapiens
cactgcctgc

SEQ ID NO: 706429 - DNA, 13 bp, Homo sapiens
cactgcctgcaga

SEQ ID NO: 706430 - DNA, 20 bp, Homo sapiens
cactgccttctcctctctgg

SEQ ID NO: 706431 - DNA, 14 bp, Homo sapiens
cactgccttggccc

SEQ ID NO: 706432 - DNA, 18 bp, Homo sapiens
cactgcgccactgccatc

SEQ ID NO: 706433 - DNA, 15 bp, Homo sapiens
cactgcgccactgct

SEQ ID NO: 706434 - DNA, 15 bp, Homo sapiens
cactgcgcccagcct

SEQ ID NO: 706435 - DNA, 15 bp, Homo sapiens
cactgctaaggctgc

SEQ ID NO: 706436 - DNA, 17 bp, Homo sapiens
cactgctaaggctgctg

SEQ ID NO: 706437 - DNA, 20 bp, Homo sapiens
cactgctaaggctgctggct

SEQ ID NO: 706438 - DNA, 21 bp, Homo sapiens
cactgctaaggctgctggctt

SEQ ID NO: 706439 - DNA, 22 bp, Homo sapiens
cactgctaaggctgctggcttc

SEQ ID NO: 706440 - DNA, 20 bp, Homo sapiens
cactgctaggcgagtgccag

SEQ ID NO: 706441 - DNA, 15 bp, Homo sapiens
cactgctatgccatt

SEQ ID NO: 706442 - DNA, 17 bp, Homo sapiens
cactgctatgccatttc

SEQ ID NO: 706443 - DNA, 17 bp, Homo sapiens
cactgctcacggacccc

SEQ ID NO: 706444 - DNA, 21 bp, Homo sapiens
cactgctccctaagccagcct

SEQ ID NO: 706445 - DNA, 15 bp, Homo sapiens
cactgctctaacagc

SEQ ID NO: 706446 - DNA, 20 bp, Homo sapiens
cactgctgaagatgcccctg

SEQ ID NO: 706447 - DNA, 23 bp, Homo sapiens
cactgctgaagatgcccctgctc

SEQ ID NO: 706448 - DNA, 13 bp, Homo sapiens
cactgctgagctg

SEQ ID NO: 706449 - DNA, 18 bp, Homo sapiens
cactgctgaggagtctga

SEQ ID NO: 706450 - DNA, 23 bp, Homo sapiens
cactgctgaggagtctgaggact

SEQ ID NO: 706451 - DNA, 13 bp, Homo sapiens
cactgctgcagta

SEQ ID NO: 706452 - DNA, 18 bp, Homo sapiens
cactgctgctactgcccc

SEQ ID NO: 706453 - DNA, 22 bp, Homo sapiens
cactgctgctcctctttcccct

SEQ ID NO: 706454 - DNA, 14 bp, Homo sapiens
cactgctggctgcc

SEQ ID NO: 706455 - DNA, 16 bp, Homo sapiens
cactgctgtcctctcc

SEQ ID NO: 706456 - DNA, 17 bp, Homo sapiens
cactgctgtcctctccc

SEQ ID NO: 706457 - DNA, 19 bp, Homo sapiens
cactgctgtcctctccccc

SEQ ID NO: 706458 - DNA, 20 bp, Homo sapiens
cactgctgtcctctccccct

SEQ ID NO: 706459 - DNA, 19 bp, Homo sapiens
cactgctgtgagtgcgcct

SEQ ID NO: 706460 - DNA, 20 bp, Homo sapiens
cactgctgtgagtgcgcctc

SEQ ID NO: 706461 - DNA, 22 bp, Homo sapiens
cactgctgttcctgctccatga

SEQ ID NO: 706462 - DNA, 13 bp, Homo sapiens
cactgcttaactt

SEQ ID NO: 706463 - DNA, 16 bp, Homo sapiens
cactgcttctcggcca

SEQ ID NO: 706464 - DNA, 20 bp, Homo sapiens
cactgcttctcggccagccc

SEQ ID NO: 706465 - DNA, 19 bp, Homo sapiens
cactgcttctcttttgaaa

SEQ ID NO: 706466 - DNA, 19 bp, Homo sapiens
cactgcttgatgaagcaag

SEQ ID NO: 706467 - DNA, 23 bp, Homo sapiens
cactgcttgatgaagcaaggaag

SEQ ID NO: 706468 - DNA, 12 bp, Homo sapiens
cactggaaaggg

SEQ ID NO: 706469 - DNA, 18 bp, Homo sapiens
cactggaaaggggagagc

SEQ ID NO: 706470 - DNA, 19 bp, Homo sapiens
cactggaaaggggagagcc

SEQ ID NO: 706471 - DNA, 23 bp, Homo sapiens
cactggaaaggggagagcctgct

SEQ ID NO: 706472 - DNA, 15 bp, Homo sapiens
cactggacaacactg

SEQ ID NO: 706473 - DNA, 17 bp, Homo sapiens
cactggacaacactgat

SEQ ID NO: 706474 - DNA, 14 bp, Homo sapiens
cactggacctgggg

SEQ ID NO: 706475 - DNA, 15 bp, Homo sapiens
cactggacctggggg

SEQ ID NO: 706476 - DNA, 17 bp, Homo sapiens
cactggacctgggggta

SEQ ID NO: 706477 - DNA, 15 bp, Homo sapiens
cactggactcacctc

SEQ ID NO: 706478 - DNA, 23 bp, Homo sapiens
cactggactccggggccccactg

SEQ ID NO: 706479 - DNA, 14 bp, Homo sapiens
cactggagccacag

SEQ ID NO: 706480 - DNA, 20 bp, Homo sapiens
cactggagccacaggcaggg

SEQ ID NO: 706481 - DNA, 20 bp, Homo sapiens
cactggagccatctcttcct

SEQ ID NO: 706482 - DNA, 12 bp, Homo sapiens
cactggagccca

SEQ ID NO: 706483 - DNA, 19 bp, Homo sapiens
cactggaggagagaagaat

SEQ ID NO: 706484 - DNA, 14 bp, Homo sapiens
cactggaggagcag

SEQ ID NO: 706485 - DNA, 19 bp, Homo sapiens
cactggatgcaaagaaaat

SEQ ID NO: 706486 - DNA, 22 bp, Homo sapiens
cactggcatcgcagcttcctgt

SEQ ID NO: 706487 - DNA, 18 bp, Homo sapiens
cactggcattgtccctgt

SEQ ID NO: 706488 - DNA, 22 bp, Homo sapiens
cactggcattgtccctgtgcct

SEQ ID NO: 706489 - DNA, 10 bp, Homo sapiens
cactggccac

SEQ ID NO: 706490 - DNA, 20 bp, Homo sapiens
cactggccaccaggctggcg

SEQ ID NO: 706491 - DNA, 14 bp, Homo sapiens
cactggccagagag

SEQ ID NO: 706492 - DNA, 23 bp, Homo sapiens
cactggccagagagggcccagct

SEQ ID NO: 706493 - DNA, 12 bp, Homo sapiens
cactggccccac

SEQ ID NO: 706494 - DNA, 13 bp, Homo sapiens
cactggcccctca

SEQ ID NO: 706495 - DNA, 24 bp, Homo sapiens
cactggcccctcaaatcgtccagc

SEQ ID NO: 706496 - DNA, 18 bp, Homo sapiens
cactggcccctggcctgc

SEQ ID NO: 706497 - DNA, 15 bp, Homo sapiens
cactggccgctgagc

SEQ ID NO: 706498 - DNA, 16 bp, Homo sapiens
cactggccgctgagcg

SEQ ID NO: 706499 - DNA, 23 bp, Homo sapiens
cactggccttctgatgaaatgtt

SEQ ID NO: 706500 - DNA, 22 bp, Homo sapiens
agaaccagccgtattttacatg

SEQ ID NO: 706501 - DNA, 18 bp, Homo sapiens
agaaccagtttcaggtgt

SEQ ID NO: 706502 - DNA, 20 bp, Homo sapiens
agaaccatttacatgcacct

SEQ ID NO: 706503 - DNA, 17 bp, Homo sapiens
agaacccaagtgcctca

SEQ ID NO: 706504 - DNA, 14 bp, Homo sapiens
agaacccacagtga

SEQ ID NO: 706505 - DNA, 17 bp, Homo sapiens
agaacccctacatgaaa

SEQ ID NO: 706506 - DNA, 16 bp, Homo sapiens
agaacccctctgcttt

SEQ ID NO: 706507 - DNA, 15 bp, Homo sapiens
agaaccctttgggag

SEQ ID NO: 706508 - DNA, 22 bp, Homo sapiens
agaaccgagcaaagatcaaaat

SEQ ID NO: 706509 - DNA, 14 bp, Homo sapiens
agaacctaattcaa

SEQ ID NO: 706510 - DNA, 15 bp, Homo sapiens
agaacctaattcaat

SEQ ID NO: 706511 - DNA, 20 bp, Homo sapiens
agaacctactgttcctttca

SEQ ID NO: 706512 - DNA, 22 bp, Homo sapiens
agaacctactgttcctttcaga

SEQ ID NO: 706513 - DNA, 13 bp, Homo sapiens
agaacctcttccc

SEQ ID NO: 706514 - DNA, 15 bp, Homo sapiens
agaacctcttcccca

SEQ ID NO: 706515 - DNA, 20 bp, Homo sapiens
agaacctgagctattttcct

SEQ ID NO: 706516 - DNA, 23 bp, Homo sapiens
agaacctgagctattttcctctg

SEQ ID NO: 706517 - DNA, 17 bp, Homo sapiens
agaacctgcacacagga

SEQ ID NO: 706518 - DNA, 20 bp, Homo sapiens
agaaccttaatgacaacact

SEQ ID NO: 706519 - DNA, 19 bp, Homo sapiens
agaaccttgcctgaacatc

SEQ ID NO: 706520 - DNA, 20 bp, Homo sapiens
agaaccttggaccactcctg

SEQ ID NO: 706521 - DNA, 20 bp, Homo sapiens
agaaccttgtcccagccagt

SEQ ID NO: 706522 - DNA, 22 bp, Homo sapiens
agaaccttgtcccagccagtga

SEQ ID NO: 706523 - DNA, 23 bp, Homo sapiens
agaaccttgtcccagccagtgag

SEQ ID NO: 706524 - DNA, 15 bp, Homo sapiens
agaacgcaccccact

SEQ ID NO: 706525 - DNA, 21 bp, Homo sapiens
agaacggagccccaggcctct

SEQ ID NO: 706526 - DNA, 22 bp, Homo sapiens
agaacgtattggtccagcttgc

SEQ ID NO: 706527 - DNA, 18 bp, Homo sapiens
agaacgtggctctgctgg

SEQ ID NO: 706528 - DNA, 19 bp, Homo sapiens
agaacgtggctctgctggc

SEQ ID NO: 706529 - DNA, 18 bp, Homo sapiens
agaactaaatttttcata

SEQ ID NO: 706530 - DNA, 16 bp, Homo sapiens
agaactactaaggaaa

SEQ ID NO: 706531 - DNA, 17 bp, Homo sapiens
agaactagccaaaccag

SEQ ID NO: 706532 - DNA, 14 bp, Homo sapiens
agaactatcatttt

SEQ ID NO: 706533 - DNA, 22 bp, Homo sapiens
agaactattctgggggcccgac

SEQ ID NO: 706534 - DNA, 15 bp, Homo sapiens
agaactcactctggg

SEQ ID NO: 706535 - DNA, 14 bp, Homo sapiens
agaactcactgggg

SEQ ID NO: 706536 - DNA, 16 bp, Homo sapiens
agaactcactggggcc

SEQ ID NO: 706537 - DNA, 17 bp, Homo sapiens
agaactcattcatagga

SEQ ID NO: 706538 - DNA, 19 bp, Homo sapiens
agaactccttattttgtat

SEQ ID NO: 706539 - DNA, 16 bp, Homo sapiens
agaactcgatgcactg

SEQ ID NO: 706540 - DNA, 18 bp, Homo sapiens
agaactcgatgcactgac

SEQ ID NO: 706541 - DNA, 19 bp, Homo sapiens
agaactcgatgcactgacc

SEQ ID NO: 706542 - DNA, 21 bp, Homo sapiens
agaactcgcgctcagtaaacg

SEQ ID NO: 706543 - DNA, 13 bp, Homo sapiens
agaactctctgga

SEQ ID NO: 706544 - DNA, 21 bp, Homo sapiens
agaactctctggaagcccctg

SEQ ID NO: 706545 - DNA, 13 bp, Homo sapiens
agaactctctgtc

SEQ ID NO: 706546 - DNA, 20 bp, Homo sapiens
agaactctctgtcttctctc

SEQ ID NO: 706547 - DNA, 20 bp, Homo sapiens
agaactctggcttttggaag

SEQ ID NO: 706548 - DNA, 19 bp, Homo sapiens
agaactcttaaatactttt

SEQ ID NO: 706549 - DNA, 18 bp, Homo sapiens
agaactgaagccacttgg

SEQ ID NO: 706550 - DNA, 21 bp, Homo sapiens
agaactgacaaaggagccttg

SEQ ID NO: 706551 - DNA, 15 bp, Homo sapiens
agaactgcaactgaa

SEQ ID NO: 706552 - DNA, 20 bp, Homo sapiens
agaactgcactttttttact

SEQ ID NO: 706553 - DNA, 19 bp, Homo sapiens
agaactgcagatagcccag

SEQ ID NO: 706554 - DNA, 20 bp, Homo sapiens
agaactgcagatagcccagg

SEQ ID NO: 706555 - DNA, 16 bp, Homo sapiens
agaactgcaggccctg

SEQ ID NO: 706556 - DNA, 19 bp, Homo sapiens
agaactgcatatgtttcgc

SEQ ID NO: 706557 - DNA, 20 bp, Homo sapiens
agaactgcatggacctaaca

SEQ ID NO: 706558 - DNA, 23 bp, Homo sapiens
agaactgcatggacctaacattc

SEQ ID NO: 706559 - DNA, 23 bp, Homo sapiens
agaactgccattattttctgtca

SEQ ID NO: 706560 - DNA, 16 bp, Homo sapiens
agaactgcccccactg

SEQ ID NO: 706561 - DNA, 21 bp, Homo sapiens
agaactgcccttgctgcccgc

SEQ ID NO: 706562 - DNA, 19 bp, Homo sapiens
agaactgcttcatgtgaac

SEQ ID NO: 706563 - DNA, 20 bp, Homo sapiens
agaactgcttcatgtgaaca

SEQ ID NO: 706564 - DNA, 23 bp, Homo sapiens
agaactgctttctttcgtttgtt

SEQ ID NO: 706565 - DNA, 12 bp, Homo sapiens
agaactgtacat

SEQ ID NO: 706566 - DNA, 13 bp, Homo sapiens
agaactgtcccat

SEQ ID NO: 706567 - DNA, 13 bp, Homo sapiens
agaactgtgccac

SEQ ID NO: 706568 - DNA, 20 bp, Homo sapiens
agaactgtgtttcaagttca

SEQ ID NO: 706569 - DNA, 21 bp, Homo sapiens
agaactgtgtttcaagttcaa

SEQ ID NO: 706570 - DNA, 21 bp, Homo sapiens
agaacttactgattattttct

SEQ ID NO: 706571 - DNA, 22 bp, Homo sapiens
agaacttagcctttacctgtga

SEQ ID NO: 706572 - DNA, 14 bp, Homo sapiens
agaacttcatggat

SEQ ID NO: 706573 - DNA, 17 bp, Homo sapiens
agaacttcatttttaat

SEQ ID NO: 706574 - DNA, 20 bp, Homo sapiens
agaacttccaacaagcctca

SEQ ID NO: 706575 - DNA, 21 bp, Homo sapiens
agaacttccctgattgacctg

SEQ ID NO: 706576 - DNA, 17 bp, Homo sapiens
agaacttctctaagcct

SEQ ID NO: 706577 - DNA, 17 bp, Homo sapiens
agaacttgatttgcatg

SEQ ID NO: 706578 - DNA, 16 bp, Homo sapiens
agaacttgctgctgtc

SEQ ID NO: 706579 - DNA, 19 bp, Homo sapiens
agaactttaaagctcagga

SEQ ID NO: 706580 - DNA, 15 bp, Homo sapiens
agaagaaaaagaagc

SEQ ID NO: 706581 - DNA, 13 bp, Homo sapiens
agaagaaaacccg

SEQ ID NO: 706582 - DNA, 11 bp, Homo sapiens
agaagaaaagc

SEQ ID NO: 706583 - DNA, 16 bp, Homo sapiens
agaagaaaattgctgt

SEQ ID NO: 706584 - DNA, 21 bp, Homo sapiens
agaagaaacaaggttttcagt

SEQ ID NO: 706585 - DNA, 18 bp, Homo sapiens
agaagaaacgtctatgtg

SEQ ID NO: 706586 - DNA, 13 bp, Homo sapiens
agaagaaactagg

SEQ ID NO: 706587 - DNA, 15 bp, Homo sapiens
agaagaaagtgtaga

SEQ ID NO: 706588 - DNA, 15 bp, Homo sapiens
agaagaaatagcaga

SEQ ID NO: 706589 - DNA, 19 bp, Homo sapiens
agaagaaatagcagagcct

SEQ ID NO: 706590 - DNA, 18 bp, Homo sapiens
agaagaaattctgtcata

SEQ ID NO: 706591 - DNA, 22 bp, Homo sapiens
agaagaaattctgtcatagaaa

SEQ ID NO: 706592 - DNA, 16 bp, Homo sapiens
agaagaaccagcccag

SEQ ID NO: 706593 - DNA, 23 bp, Homo sapiens
agaagaaccagcccagcctgccc

SEQ ID NO: 706594 - DNA, 21 bp, Homo sapiens
agaagaaccatttacatgcac

SEQ ID NO: 706595 - DNA, 20 bp, Homo sapiens
agaagaagagaagctgctga

SEQ ID NO: 706596 - DNA, 11 bp, Homo sapiens
agaagaagagg

SEQ ID NO: 706597 - DNA, 15 bp, Homo sapiens
agaagaagaggaaga

SEQ ID NO: 706598 - DNA, 17 bp, Homo sapiens
agaagaagtcagagagg

SEQ ID NO: 706599 - DNA, 22 bp, Homo sapiens
agaagaagtgggagcagcttct

SEQ ID NO: 706600 - DNA, 24 bp, Homo sapiens
agaagaagtgggagcagcttcttg

SEQ ID NO: 706601 - DNA, 18 bp, Homo sapiens
agaagaatatcaaataat

SEQ ID NO: 706602 - DNA, 22 bp, Homo sapiens
agaagaatatcgatataaattg

SEQ ID NO: 706603 - DNA, 14 bp, Homo sapiens
agaagaatattcag

SEQ ID NO: 706604 - DNA, 19 bp, Homo sapiens
agaagaatattcaggactt

SEQ ID NO: 706605 - DNA, 13 bp, Homo sapiens
agaagaatgaaaa

SEQ ID NO: 706606 - DNA, 19 bp, Homo sapiens
agaagaatgcttaatcaga

SEQ ID NO: 706607 - DNA, 19 bp, Homo sapiens
agaagaatggctttcaata

SEQ ID NO: 706608 - DNA, 22 bp, Homo sapiens
agaagaattttcagaccccagc

SEQ ID NO: 706609 - DNA, 15 bp, Homo sapiens
agaagacaaatgaca

SEQ ID NO: 706610 - DNA, 15 bp, Homo sapiens
agaagacatgaacca

SEQ ID NO: 706611 - DNA, 16 bp, Homo sapiens
agaagacatggagact

SEQ ID NO: 706612 - DNA, 20 bp, Homo sapiens
agaagacatggagactcctg

SEQ ID NO: 706613 - DNA, 15 bp, Homo sapiens
agaagacattctggt

SEQ ID NO: 706614 - DNA, 19 bp, Homo sapiens
agaagacccacgtgctagg

SEQ ID NO: 706615 - DNA, 18 bp, Homo sapiens
agaagacctagctatgtt

SEQ ID NO: 706616 - DNA, 18 bp, Homo sapiens
agaagactttaattatat

SEQ ID NO: 706617 - DNA, 15 bp, Homo sapiens
agaagagaagctgct

SEQ ID NO: 706618 - DNA, 15 bp, Homo sapiens
agaagagaggggaag

SEQ ID NO: 706619 - DNA, 18 bp, Homo sapiens
agaagagaggggaagaat

SEQ ID NO: 706620 - DNA, 19 bp, Homo sapiens
agaagagaggggaagaatt

SEQ ID NO: 706621 - DNA, 19 bp, Homo sapiens
agaagagatgagaaatgat

SEQ ID NO: 706622 - DNA, 21 bp, Homo sapiens
agaagagccaagagtccagga

SEQ ID NO: 706623 - DNA, 13 bp, Homo sapiens
cactggcgaggag

SEQ ID NO: 706624 - DNA, 23 bp, Homo sapiens
cactggcgcatcatatgcagtga

SEQ ID NO: 706625 - DNA, 14 bp, Homo sapiens
cactggctctccaa

SEQ ID NO: 706626 - DNA, 17 bp, Homo sapiens
cactggctctccaagtg

SEQ ID NO: 706627 - DNA, 16 bp, Homo sapiens
cactggctctctccag

SEQ ID NO: 706628 - DNA, 17 bp, Homo sapiens
cactggctctctccagg

SEQ ID NO: 706629 - DNA, 18 bp, Homo sapiens
cactggctctctccagga

SEQ ID NO: 706630 - DNA, 18 bp, Homo sapiens
cactggctggggcagagg

SEQ ID NO: 706631 - DNA, 22 bp, Homo sapiens
cactggcttggaacaccttggg

SEQ ID NO: 706632 - DNA, 13 bp, Homo sapiens
cactgggaaacag

SEQ ID NO: 706633 - DNA, 19 bp, Homo sapiens
cactgggaagaagcaaggg

SEQ ID NO: 706634 - DNA, 23 bp, Homo sapiens
cactgggaagctcccaccccact

SEQ ID NO: 706635 - DNA, 17 bp, Homo sapiens
cactgggaaggaaacaa

SEQ ID NO: 706636 - DNA, 14 bp, Homo sapiens
cactgggagagctg

SEQ ID NO: 706637 - DNA, 23 bp, Homo sapiens
cactgggatgagccgctgtgagc

SEQ ID NO: 706638 - DNA, 22 bp, Homo sapiens
cactgggcagcaaggctgctgc

SEQ ID NO: 706639 - DNA, 18 bp, Homo sapiens
cactgggcaggttcctgg

SEQ ID NO: 706640 - DNA, 19 bp, Homo sapiens
cactgggcaggttcctggg

SEQ ID NO: 706641 - DNA, 22 bp, Homo sapiens
cactgggcaggttcctggggcc

SEQ ID NO: 706642 - DNA, 21 bp, Homo sapiens
cactgggccagccctgcagcc

SEQ ID NO: 706643 - DNA, 19 bp, Homo sapiens
cactgggcccctgtcccca

SEQ ID NO: 706644 - DNA, 15 bp, Homo sapiens
cactgggcctggagc

SEQ ID NO: 706645 - DNA, 20 bp, Homo sapiens
cactgggcctggagccctgg

SEQ ID NO: 706646 - DNA, 18 bp, Homo sapiens
cactgggcgtctgactcc

SEQ ID NO: 706647 - DNA, 12 bp, Homo sapiens
cactgggctctg

SEQ ID NO: 706648 - DNA, 14 bp, Homo sapiens
cactgggctctgga

SEQ ID NO: 706649 - DNA, 20 bp, Homo sapiens
cactgggctctggacctcag

SEQ ID NO: 706650 - DNA, 16 bp, Homo sapiens
cactggggaatgctcc

SEQ ID NO: 706651 - DNA, 20 bp, Homo sapiens
cactggggaatgctcccagc

SEQ ID NO: 706652 - DNA, 23 bp, Homo sapiens
cactggggactttatttatttct

SEQ ID NO: 706653 - DNA, 21 bp, Homo sapiens
cactggggagcccgtctcagt

SEQ ID NO: 706654 - DNA, 16 bp, Homo sapiens
cactggggatggtggc

SEQ ID NO: 706655 - DNA, 16 bp, Homo sapiens
cactggggcctacagc

SEQ ID NO: 706656 - DNA, 17 bp, Homo sapiens
cactgggtctcactcct

SEQ ID NO: 706657 - DNA, 19 bp, Homo sapiens
cactgggtctcactcctga

SEQ ID NO: 706658 - DNA, 21 bp, Homo sapiens
cactgggtctcactcctgagt

SEQ ID NO: 706659 - DNA, 13 bp, Homo sapiens
cactgggtgagag

SEQ ID NO: 706660 - DNA, 14 bp, Homo sapiens
cactgggtggtggc

SEQ ID NO: 706661 - DNA, 15 bp, Homo sapiens
cactgggtggtggcc

SEQ ID NO: 706662 - DNA, 22 bp, Homo sapiens
cactgggtggtggcctggtccc

SEQ ID NO: 706663 - DNA, 18 bp, Homo sapiens
cactgggtgttgatctta

SEQ ID NO: 706664 - DNA, 21 bp, Homo sapiens
cactgggttgcgggacagagt

SEQ ID NO: 706665 - DNA, 14 bp, Homo sapiens
cactggtaaatgtt

SEQ ID NO: 706666 - DNA, 15 bp, Homo sapiens
cactggtaaatgtta

SEQ ID NO: 706667 - DNA, 21 bp, Homo sapiens
cactggtacttagagtttctg

SEQ ID NO: 706668 - DNA, 19 bp, Homo sapiens
cactggtaggttgggacac

SEQ ID NO: 706669 - DNA, 14 bp, Homo sapiens
cactggtatttata

SEQ ID NO: 706670 - DNA, 16 bp, Homo sapiens
cactggtatttatatt

SEQ ID NO: 706671 - DNA, 17 bp, Homo sapiens
cactggtcagggcagtg

SEQ ID NO: 706672 - DNA, 22 bp, Homo sapiens
cactggtgactgcgatcttcag

SEQ ID NO: 706673 - DNA, 14 bp, Homo sapiens
cactggtgagacag

SEQ ID NO: 706674 - DNA, 13 bp, Homo sapiens
cactggtggcccg

SEQ ID NO: 706675 - DNA, 15 bp, Homo sapiens
cactggtgggcagct

SEQ ID NO: 706676 - DNA, 19 bp, Homo sapiens
cactggtggtttttgctct

SEQ ID NO: 706677 - DNA, 20 bp, Homo sapiens
cactggtgtgaactcaccct

SEQ ID NO: 706678 - DNA, 21 bp, Homo sapiens
cactggttaaaataaagccta

SEQ ID NO: 706679 - DNA, 12 bp, Homo sapiens
cactggttctca

SEQ ID NO: 706680 - DNA, 15 bp, Homo sapiens
cactgtaaatatccc

SEQ ID NO: 706681 - DNA, 20 bp, Homo sapiens
cactgtaacctcaaactctg

SEQ ID NO: 706682 - DNA, 22 bp, Homo sapiens
cactgtaagcttttaagaaaaa

SEQ ID NO: 706683 - DNA, 18 bp, Homo sapiens
cactgtacacacccgcct

SEQ ID NO: 706684 - DNA, 13 bp, Homo sapiens
cactgtactgcat

SEQ ID NO: 706685 - DNA, 14 bp, Homo sapiens
cactgtactgcatg

SEQ ID NO: 706686 - DNA, 11 bp, Homo sapiens
cactgtagcta

SEQ ID NO: 706687 - DNA, 22 bp, Homo sapiens
cactgtagtaaatggcaattct

SEQ ID NO: 706688 - DNA, 15 bp, Homo sapiens
cactgtagttttgag

SEQ ID NO: 706689 - DNA, 16 bp, Homo sapiens
cactgtatataaacat

SEQ ID NO: 706690 - DNA, 17 bp, Homo sapiens
cactgtatgttatagaa

SEQ ID NO: 706691 - DNA, 20 bp, Homo sapiens
cactgtatgttatagaactt

SEQ ID NO: 706692 - DNA, 14 bp, Homo sapiens
cactgtatttgtat

SEQ ID NO: 706693 - DNA, 16 bp, Homo sapiens
cactgtcaccctccac

SEQ ID NO: 706694 - DNA, 13 bp, Homo sapiens
cactgtcactttg

SEQ ID NO: 706695 - DNA, 16 bp, Homo sapiens
cactgtcactttgctc

SEQ ID NO: 706696 - DNA, 20 bp, Homo sapiens
cactgtcactttgctctggg

SEQ ID NO: 706697 - DNA, 22 bp, Homo sapiens
cactgtcagcagggactgtaaa

SEQ ID NO: 706698 - DNA, 15 bp, Homo sapiens
cactgtcaggaagaa

SEQ ID NO: 706699 - DNA, 15 bp, Homo sapiens
cactgtcaggaatgg

SEQ ID NO: 706700 - DNA, 16 bp, Homo sapiens
cactgtccctcaaatg

SEQ ID NO: 706701 - DNA, 23 bp, Homo sapiens
cactgtccctcaaatgacccaaa

SEQ ID NO: 706702 - DNA, 16 bp, Homo sapiens
cactgtccctgtcctt

SEQ ID NO: 706703 - DNA, 18 bp, Homo sapiens
cactgtccgcctctgccc

SEQ ID NO: 706704 - DNA, 19 bp, Homo sapiens
cactgtcctgggcgccctg

SEQ ID NO: 706705 - DNA, 21 bp, Homo sapiens
cactgtcctgggcgccctgga

SEQ ID NO: 706706 - DNA, 23 bp, Homo sapiens
cactgtcctgggcgccctggaag

SEQ ID NO: 706707 - DNA, 16 bp, Homo sapiens
cactgtgaaatttcat

SEQ ID NO: 706708 - DNA, 22 bp, Homo sapiens
cactgtgaactcaatctccagg

SEQ ID NO: 706709 - DNA, 19 bp, Homo sapiens
cactgtgaatcctggcaag

SEQ ID NO: 706710 - DNA, 14 bp, Homo sapiens
cactgtgaccccca

SEQ ID NO: 706711 - DNA, 23 bp, Homo sapiens
cactgtgacccccagctccggcc

SEQ ID NO: 706712 - DNA, 16 bp, Homo sapiens
cactgtgaccttgact

SEQ ID NO: 706713 - DNA, 19 bp, Homo sapiens
cactgtgagagttgtctct

SEQ ID NO: 706714 - DNA, 20 bp, Homo sapiens
cactgtgaggggaaggcctt

SEQ ID NO: 706715 - DNA, 19 bp, Homo sapiens
cactgtgatcaatattttt

SEQ ID NO: 706716 - DNA, 22 bp, Homo sapiens
cactgtgcacatctgtgtcttg

SEQ ID NO: 706717 - DNA, 17 bp, Homo sapiens
cactgtgcagacccagt

SEQ ID NO: 706718 - DNA, 22 bp, Homo sapiens
cactgtgcagacccagtcccac

SEQ ID NO: 706719 - DNA, 13 bp, Homo sapiens
cactgtgccccac

SEQ ID NO: 706720 - DNA, 12 bp, Homo sapiens
cactgtgccctg

SEQ ID NO: 706721 - DNA, 15 bp, Homo sapiens
cactgtgccctggtg

SEQ ID NO: 706722 - DNA, 17 bp, Homo sapiens
cactgtgcctcagagac

SEQ ID NO: 706723 - DNA, 22 bp, Homo sapiens
cactgtgcctcagagaccaggg

SEQ ID NO: 706724 - DNA, 16 bp, Homo sapiens
cactgtgccttttccc

SEQ ID NO: 706725 - DNA, 19 bp, Homo sapiens
cactgtgcgtcttggtgta

SEQ ID NO: 706726 - DNA, 23 bp, Homo sapiens
cactgtggaactaataaatacat

SEQ ID NO: 706727 - DNA, 13 bp, Homo sapiens
cactgtggccaga

SEQ ID NO: 706728 - DNA, 15 bp, Homo sapiens
cactgtggccagagc

SEQ ID NO: 706729 - DNA, 16 bp, Homo sapiens
cactgtggccagagct

SEQ ID NO: 706730 - DNA, 19 bp, Homo sapiens
cactgtggccagagctgga

SEQ ID NO: 706731 - DNA, 20 bp, Homo sapiens
cactgtggccagagctggaa

SEQ ID NO: 706732 - DNA, 21 bp, Homo sapiens
cactgtgggaaggccagctgc

SEQ ID NO: 706733 - DNA, 14 bp, Homo sapiens
cactgtgtctctgt

SEQ ID NO: 706734 - DNA, 21 bp, Homo sapiens
cactgtgtctctgtttcctga

SEQ ID NO: 706735 - DNA, 16 bp, Homo sapiens
cactgtgtgccttctg

SEQ ID NO: 706736 - DNA, 21 bp, Homo sapiens
cactgttaatacacagtactt

SEQ ID NO: 706737 - DNA, 15 bp, Homo sapiens
cactgttatcaaaac

SEQ ID NO: 706738 - DNA, 14 bp, Homo sapiens
cactgttcaatact

SEQ ID NO: 706739 - DNA, 13 bp, Homo sapiens
cactgttccctct

SEQ ID NO: 706740 - DNA, 17 bp, Homo sapiens
cactgttccctctgctc

SEQ ID NO: 706741 - DNA, 18 bp, Homo sapiens
cactgttccctctggctt

SEQ ID NO: 706742 - DNA, 20 bp, Homo sapiens
cactgttccctctggcttcc

SEQ ID NO: 706743 - DNA, 21 bp, Homo sapiens
cactgttctgaaaggagacat

SEQ ID NO: 706744 - DNA, 16 bp, Homo sapiens
cactgttgaaaattat

SEQ ID NO: 706745 - DNA, 17 bp, Homo sapiens
cactgttgaattttctc

SEQ ID NO: 706746 - DNA, 20 bp, Homo sapiens
cactgttgagccccagtgct

SEQ ID NO: 706747 - DNA, 12 bp, Homo sapiens
agaagagcgcag

SEQ ID NO: 706748 - DNA, 18 bp, Homo sapiens
agaagagggcccagccca

SEQ ID NO: 706749 - DNA, 16 bp, Homo sapiens
agaagagtggtgagat

SEQ ID NO: 706750 - DNA, 23 bp, Homo sapiens
agaagagttttagagaaaataaa

SEQ ID NO: 706751 - DNA, 18 bp, Homo sapiens
agaagatccacatcctct

SEQ ID NO: 706752 - DNA, 17 bp, Homo sapiens
agaagatgatcagacct

SEQ ID NO: 706753 - DNA, 23 bp, Homo sapiens
agaagatgccagcttctctctcc

SEQ ID NO: 706754 - DNA, 15 bp, Homo sapiens
agaagatgccctcca

SEQ ID NO: 706755 - DNA, 13 bp, Homo sapiens
agaagattcaaga

SEQ ID NO: 706756 - DNA, 22 bp, Homo sapiens
agaagattgttggtgaattttc

SEQ ID NO: 706757 - DNA, 19 bp, Homo sapiens
agaagatttcagagctgag

SEQ ID NO: 706758 - DNA, 23 bp, Homo sapiens
agaagatttgatgctggagaggt

SEQ ID NO: 706759 - DNA, 19 bp, Homo sapiens
agaagcaaagatttcagta

SEQ ID NO: 706760 - DNA, 21 bp, Homo sapiens
agaagcaacctcagtaattta

SEQ ID NO: 706761 - DNA, 12 bp, Homo sapiens
agaagcaatggg

SEQ ID NO: 706762 - DNA, 22 bp, Homo sapiens
agaagcaattatttaaagaaag

SEQ ID NO: 706763 - DNA, 21 bp, Homo sapiens
agaagcacagaatatttttat

SEQ ID NO: 706764 - DNA, 13 bp, Homo sapiens
agaagcagagaga

SEQ ID NO: 706765 - DNA, 12 bp, Homo sapiens
agaagcagcttc

SEQ ID NO: 706766 - DNA, 13 bp, Homo sapiens
agaagcaggttct

SEQ ID NO: 706767 - DNA, 15 bp, Homo sapiens
agaagcagtggcctt

SEQ ID NO: 706768 - DNA, 13 bp, Homo sapiens
agaagcagttctc

SEQ ID NO: 706769 - DNA, 19 bp, Homo sapiens
agaagcatattttgctggt

SEQ ID NO: 706770 - DNA, 15 bp, Homo sapiens
agaagcatttgtatt

SEQ ID NO: 706771 - DNA, 19 bp, Homo sapiens
agaagcattttgtaagttg

SEQ ID NO: 706772 - DNA, 11 bp, Homo sapiens
agaagccaagc

SEQ ID NO: 706773 - DNA, 22 bp, Homo sapiens
agaagccaagctccctggagcc

SEQ ID NO: 706774 - DNA, 19 bp, Homo sapiens
agaagccaagggaaagggg

SEQ ID NO: 706775 - DNA, 21 bp, Homo sapiens
agaagccaagggaaaggggtg

SEQ ID NO: 706776 - DNA, 12 bp, Homo sapiens
agaagccacatc

SEQ ID NO: 706777 - DNA, 14 bp, Homo sapiens
agaagccaccttcc

SEQ ID NO: 706778 - DNA, 16 bp, Homo sapiens
agaagccatctgacag

SEQ ID NO: 706779 - DNA, 21 bp, Homo sapiens
agaagccatgggacctcctcc

SEQ ID NO: 706780 - DNA, 18 bp, Homo sapiens
agaagcccaatattataa

SEQ ID NO: 706781 - DNA, 22 bp, Homo sapiens
agaagcccagctctgggaactg

SEQ ID NO: 706782 - DNA, 16 bp, Homo sapiens
agaagcccatgtcttc

SEQ ID NO: 706783 - DNA, 17 bp, Homo sapiens
agaagcccatgtcttct

SEQ ID NO: 706784 - DNA, 22 bp, Homo sapiens
agaagcccatgtcttctgctgt

SEQ ID NO: 706785 - DNA, 15 bp, Homo sapiens
agaagccccgacaca

SEQ ID NO: 706786 - DNA, 20 bp, Homo sapiens
agaagcccctgtcgcccacc

SEQ ID NO: 706787 - DNA, 13 bp, Homo sapiens
agaagccctgatg

SEQ ID NO: 706788 - DNA, 14 bp, Homo sapiens
agaagccgtgggtg

SEQ ID NO: 706789 - DNA, 23 bp, Homo sapiens
agaagcctccaagcacagagcct

SEQ ID NO: 706790 - DNA, 21 bp, Homo sapiens
agaagcctccaagcctgcctc

SEQ ID NO: 706791 - DNA, 12 bp, Homo sapiens
agaagcctctgg

SEQ ID NO: 706792 - DNA, 12 bp, Homo sapiens
agaagcctgagg

SEQ ID NO: 706793 - DNA, 17 bp, Homo sapiens
agaagcctgatgctgac

SEQ ID NO: 706794 - DNA, 21 bp, Homo sapiens
agaagcctgatgctgacattc

SEQ ID NO: 706795 - DNA, 10 bp, Homo sapiens
agaagcctgc

SEQ ID NO: 706796 - DNA, 17 bp, Homo sapiens
agaagcctgcaggagaa

SEQ ID NO: 706797 - DNA, 21 bp, Homo sapiens
agaagcctgcataatgtttct

SEQ ID NO: 706798 - DNA, 22 bp, Homo sapiens
agaagcctggactctgccccac

SEQ ID NO: 706799 - DNA, 16 bp, Homo sapiens
agaagcctgttttgtt

SEQ ID NO: 706800 - DNA, 17 bp, Homo sapiens
agaagccttcagctcca

SEQ ID NO: 706801 - DNA, 18 bp, Homo sapiens
agaagccttcagctccag

SEQ ID NO: 706802 - DNA, 22 bp, Homo sapiens
agaagccttggaaccagcccca

SEQ ID NO: 706803 - DNA, 23 bp, Homo sapiens
agaagccttggaaccagccccat

SEQ ID NO: 706804 - DNA, 24 bp, Homo sapiens
agaagccttggaaccagccccatc

SEQ ID NO: 706805 - DNA, 14 bp, Homo sapiens
agaagcgagcactg

SEQ ID NO: 706806 - DNA, 22 bp, Homo sapiens
agaagcgattatgaaagcaaca

SEQ ID NO: 706807 - DNA, 15 bp, Homo sapiens
agaagcggctggcag

SEQ ID NO: 706808 - DNA, 23 bp, Homo sapiens
agaagcgggctgggggtagcctg

SEQ ID NO: 706809 - DNA, 16 bp, Homo sapiens
agaagcgtttttaacc

SEQ ID NO: 706810 - DNA, 22 bp, Homo sapiens
agaagctaatgtaggactgtat

SEQ ID NO: 706811 - DNA, 23 bp, Homo sapiens
agaagctatattagctgaaacaa

SEQ ID NO: 706812 - DNA, 18 bp, Homo sapiens
agaagctcagctgcattc

SEQ ID NO: 706813 - DNA, 16 bp, Homo sapiens
agaagctcccaggaac

SEQ ID NO: 706814 - DNA, 19 bp, Homo sapiens
agaagctctgaagaactct

SEQ ID NO: 706815 - DNA, 21 bp, Homo sapiens
agaagctgaagtgcatccaaa

SEQ ID NO: 706816 - DNA, 21 bp, Homo sapiens
agaagctgccaggtgagaaac

SEQ ID NO: 706817 - DNA, 22 bp, Homo sapiens
agaagctgccaggtgagaaact

SEQ ID NO: 706818 - DNA, 23 bp, Homo sapiens
agaagctgccaggtgagaaactg

SEQ ID NO: 706819 - DNA, 11 bp, Homo sapiens
agaagctgctc

SEQ ID NO: 706820 - DNA, 20 bp, Homo sapiens
agaagctgctccaggcctgc

SEQ ID NO: 706821 - DNA, 14 bp, Homo sapiens
agaagctgctgacc

SEQ ID NO: 706822 - DNA, 23 bp, Homo sapiens
agaagctgggaacgtgtgtccag

SEQ ID NO: 706823 - DNA, 13 bp, Homo sapiens
agaagctgtagta

SEQ ID NO: 706824 - DNA, 15 bp, Homo sapiens
agaagctttatttct

SEQ ID NO: 706825 - DNA, 14 bp, Homo sapiens
agaaggaaaaagaa

SEQ ID NO: 706826 - DNA, 17 bp, Homo sapiens
agaaggaaaaatgtgta

SEQ ID NO: 706827 - DNA, 23 bp, Homo sapiens
agaaggaaaacatgctgctctgg

SEQ ID NO: 706828 - DNA, 21 bp, Homo sapiens
agaaggaaaattttagcgtgc

SEQ ID NO: 706829 - DNA, 11 bp, Homo sapiens
agaaggaaatg

SEQ ID NO: 706830 - DNA, 17 bp, Homo sapiens
agaaggaaattgagatt

SEQ ID NO: 706831 - DNA, 19 bp, Homo sapiens
agaaggaaggaggcagact

SEQ ID NO: 706832 - DNA, 14 bp, Homo sapiens
agaaggaatcttct

SEQ ID NO: 706833 - DNA, 14 bp, Homo sapiens
agaaggaatttgta

SEQ ID NO: 706834 - DNA, 16 bp, Homo sapiens
agaaggaatttgtact

SEQ ID NO: 706835 - DNA, 15 bp, Homo sapiens
agaaggacggtgcca

SEQ ID NO: 706836 - DNA, 21 bp, Homo sapiens
agaaggacggtgccaagggcc

SEQ ID NO: 706837 - DNA, 15 bp, Homo sapiens
agaaggactgaactc

SEQ ID NO: 706838 - DNA, 17 bp, Homo sapiens
agaaggagggcagagcc

SEQ ID NO: 706839 - DNA, 18 bp, Homo sapiens
agaaggagggcagagcca

SEQ ID NO: 706840 - DNA, 12 bp, Homo sapiens
agaaggaggggg

SEQ ID NO: 706841 - DNA, 14 bp, Homo sapiens
agaaggcaatatta

SEQ ID NO: 706842 - DNA, 19 bp, Homo sapiens
agaaggcagcaaagagggg

SEQ ID NO: 706843 - DNA, 12 bp, Homo sapiens
agaaggcaggga

SEQ ID NO: 706844 - DNA, 16 bp, Homo sapiens
agaaggcagggaatgc

SEQ ID NO: 706845 - DNA, 21 bp, Homo sapiens
agaaggcagggaatgcctgga

SEQ ID NO: 706846 - DNA, 23 bp, Homo sapiens
agaaggcagggaatgcctggagg

SEQ ID NO: 706847 - DNA, 15 bp, Homo sapiens
agaaggcatgagaaa

SEQ ID NO: 706848 - DNA, 18 bp, Homo sapiens
agaaggcatttgcagggt

SEQ ID NO: 706849 - DNA, 13 bp, Homo sapiens
agaaggccaagaa

SEQ ID NO: 706850 - DNA, 20 bp, Homo sapiens
agaaggcccataccttctgg

SEQ ID NO: 706851 - DNA, 23 bp, Homo sapiens
agaaggcccataccttctggttg

SEQ ID NO: 706852 - DNA, 17 bp, Homo sapiens
agaaggccccagagaga

SEQ ID NO: 706853 - DNA, 23 bp, Homo sapiens
agaaggccttcatggccccagca

SEQ ID NO: 706854 - DNA, 18 bp, Homo sapiens
agaaggcgcttcccaact

SEQ ID NO: 706855 - DNA, 16 bp, Homo sapiens
agaagggaatcctcct

SEQ ID NO: 706856 - DNA, 15 bp, Homo sapiens
agaagggagaagaaa

SEQ ID NO: 706857 - DNA, 13 bp, Homo sapiens
agaagggagaagg

SEQ ID NO: 706858 - DNA, 16 bp, Homo sapiens
agaagggataatagac

SEQ ID NO: 706859 - DNA, 14 bp, Homo sapiens
agaaggggagcttt

SEQ ID NO: 706860 - DNA, 18 bp, Homo sapiens
agaaggggctgttcttcc

SEQ ID NO: 706861 - DNA, 20 bp, Homo sapiens
agaagggggagtgaaacaga

SEQ ID NO: 706862 - DNA, 17 bp, Homo sapiens
agaagggggccatgagg

SEQ ID NO: 706863 - DNA, 19 bp, Homo sapiens
agaagggggctctgcccca

SEQ ID NO: 706864 - DNA, 20 bp, Homo sapiens
agaagggggctctgccccag

SEQ ID NO: 706865 - DNA, 16 bp, Homo sapiens
agaagggggtctctgt

SEQ ID NO: 706866 - DNA, 23 bp, Homo sapiens
agaagggttctgccctgcctgag

SEQ ID NO: 706867 - DNA, 21 bp, Homo sapiens
agaaggtatcagttatatgat

SEQ ID NO: 706868 - DNA, 19 bp, Homo sapiens
agaaggtcagcgagaagga

SEQ ID NO: 706869 - DNA, 16 bp, Homo sapiens
agaaggtgagaggcga

SEQ ID NO: 706870 - DNA, 15 bp, Homo sapiens
agaaggtgccacttt

SEQ ID NO: 706871 - DNA, 23 bp, Homo sapiens
cactgttgagccccagtgctgga

SEQ ID NO: 706872 - DNA, 14 bp, Homo sapiens
cactgttgatgtat

SEQ ID NO: 706873 - DNA, 15 bp, Homo sapiens
cactgttgatgtatc

SEQ ID NO: 706874 - DNA, 13 bp, Homo sapiens
cactgttgccttt

SEQ ID NO: 706875 - DNA, 16 bp, Homo sapiens
cactgttgccttttaa

SEQ ID NO: 706876 - DNA, 23 bp, Homo sapiens
cactgttgccttttaaaacctct

SEQ ID NO: 706877 - DNA, 21 bp, Homo sapiens
cactgttgctgactactactc

SEQ ID NO: 706878 - DNA, 18 bp, Homo sapiens
cactgttggcacttatag

SEQ ID NO: 706879 - DNA, 22 bp, Homo sapiens
cactgttggcacttataggtaa

SEQ ID NO: 706880 - DNA, 16 bp, Homo sapiens
cactgttgggtgggtg

SEQ ID NO: 706881 - DNA, 17 bp, Homo sapiens
cactgttgggtgggtgg

SEQ ID NO: 706882 - DNA, 11 bp, Homo sapiens
cactgtttaag

SEQ ID NO: 706883 - DNA, 18 bp, Homo sapiens
cactgtttacaagaaaaa

SEQ ID NO: 706884 - DNA, 21 bp, Homo sapiens
cactgtttatacactgtgtaa

SEQ ID NO: 706885 - DNA, 12 bp, Homo sapiens
cactgtttctct

SEQ ID NO: 706886 - DNA, 22 bp, Homo sapiens
cactgtttctcttgagctggcc

SEQ ID NO: 706887 - DNA, 15 bp, Homo sapiens
cactgtttgttttta

SEQ ID NO: 706888 - DNA, 14 bp, Homo sapiens
cactgtttttaatc

SEQ ID NO: 706889 - DNA, 19 bp, Homo sapiens
cactgtttttattccttcc

SEQ ID NO: 706890 - DNA, 15 bp, Homo sapiens
cacttaaacttgcat

SEQ ID NO: 706891 - DNA, 18 bp, Homo sapiens
cacttaaagaagtatttt

SEQ ID NO: 706892 - DNA, 16 bp, Homo sapiens
cacttaaattcttttg

SEQ ID NO: 706893 - DNA, 20 bp, Homo sapiens
cacttaactataaggtgcct

SEQ ID NO: 706894 - DNA, 21 bp, Homo sapiens
cacttaagactgtgtattcta

SEQ ID NO: 706895 - DNA, 22 bp, Homo sapiens
cacttaagagaatattttaagt

SEQ ID NO: 706896 - DNA, 19 bp, Homo sapiens
cacttaagtgcactttttt

SEQ ID NO: 706897 - DNA, 13 bp, Homo sapiens
cacttaagttctt

SEQ ID NO: 706898 - DNA, 13 bp, Homo sapiens
cacttaatagcaa

SEQ ID NO: 706899 - DNA, 16 bp, Homo sapiens
cacttaatagcaacag

SEQ ID NO: 706900 - DNA, 14 bp, Homo sapiens
cacttaatgtttct

SEQ ID NO: 706901 - DNA, 14 bp, Homo sapiens
cacttaatttgtaa

SEQ ID NO: 706902 - DNA, 18 bp, Homo sapiens
cacttaatttgtaaactt

SEQ ID NO: 706903 - DNA, 17 bp, Homo sapiens
cacttacaagaaaggcc

SEQ ID NO: 706904 - DNA, 12 bp, Homo sapiens
cacttacaagtg

SEQ ID NO: 706905 - DNA, 15 bp, Homo sapiens
cacttacaagtggtg

SEQ ID NO: 706906 - DNA, 18 bp, Homo sapiens
cacttacactttatgcac

SEQ ID NO: 706907 - DNA, 14 bp, Homo sapiens
cacttacatttaca

SEQ ID NO: 706908 - DNA, 14 bp, Homo sapiens
cacttaccccgaga

SEQ ID NO: 706909 - DNA, 23 bp, Homo sapiens
cacttaccgccctgcgggccaca

SEQ ID NO: 706910 - DNA, 15 bp, Homo sapiens
cacttacgtaaaaca

SEQ ID NO: 706911 - DNA, 21 bp, Homo sapiens
cacttactggtaggaccaagc

SEQ ID NO: 706912 - DNA, 16 bp, Homo sapiens
cacttacttgcttatt

SEQ ID NO: 706913 - DNA, 21 bp, Homo sapiens
cacttactttttctggtctct

SEQ ID NO: 706914 - DNA, 21 bp, Homo sapiens
cacttagcaggcaccgccacg

SEQ ID NO: 706915 - DNA, 23 bp, Homo sapiens
cacttagcaggcaccgccacgtc

SEQ ID NO: 706916 - DNA, 23 bp, Homo sapiens
cacttagcccaagaggtctgagc

SEQ ID NO: 706917 - DNA, 19 bp, Homo sapiens
cacttagccgcaccctgca

SEQ ID NO: 706918 - DNA, 15 bp, Homo sapiens
cacttagctatcaga

SEQ ID NO: 706919 - DNA, 19 bp, Homo sapiens
cacttagtagtttttacaa

SEQ ID NO: 706920 - DNA, 23 bp, Homo sapiens
cacttatattttatgaacattgt

SEQ ID NO: 706921 - DNA, 14 bp, Homo sapiens
cacttatgctgctg

SEQ ID NO: 706922 - DNA, 15 bp, Homo sapiens
cacttatgctgctgt

SEQ ID NO: 706923 - DNA, 23 bp, Homo sapiens
cacttatgttactggtgtccagc

SEQ ID NO: 706924 - DNA, 12 bp, Homo sapiens
cacttattatta

SEQ ID NO: 706925 - DNA, 20 bp, Homo sapiens
cacttattgtccaggtgagg

SEQ ID NO: 706926 - DNA, 14 bp, Homo sapiens
cacttcaaagctaa

SEQ ID NO: 706927 - DNA, 18 bp, Homo sapiens
cacttcaaattcaaataa

SEQ ID NO: 706928 - DNA, 22 bp, Homo sapiens
cacttcaatgtgtcatttccgg

SEQ ID NO: 706929 - DNA, 21 bp, Homo sapiens
cacttcagacacaggaaaaat

SEQ ID NO: 706930 - DNA, 22 bp, Homo sapiens
cacttcagacacaggaaaaata

SEQ ID NO: 706931 - DNA, 15 bp, Homo sapiens
cacttcagagagctg

SEQ ID NO: 706932 - DNA, 13 bp, Homo sapiens
cacttcagatctc

SEQ ID NO: 706933 - DNA, 16 bp, Homo sapiens
cacttcagatctctaa

SEQ ID NO: 706934 - DNA, 12 bp, Homo sapiens
cacttcagctga

SEQ ID NO: 706935 - DNA, 21 bp, Homo sapiens
cacttcagctgacttttctgt

SEQ ID NO: 706936 - DNA, 14 bp, Homo sapiens
cacttcaggctctt

SEQ ID NO: 706937 - DNA, 15 bp, Homo sapiens
cacttcataatccag

SEQ ID NO: 706938 - DNA, 19 bp, Homo sapiens
cacttcattccagcagctg

SEQ ID NO: 706939 - DNA, 22 bp, Homo sapiens
cacttcattcttgaaagctgtg

SEQ ID NO: 706940 - DNA, 12 bp, Homo sapiens
cacttccagggg

SEQ ID NO: 706941 - DNA, 14 bp, Homo sapiens
cacttccagtgttg

SEQ ID NO: 706942 - DNA, 18 bp, Homo sapiens
cacttccatacagctcta

SEQ ID NO: 706943 - DNA, 13 bp, Homo sapiens
cacttccatggga

SEQ ID NO: 706944 - DNA, 15 bp, Homo sapiens
cacttcccaccccca

SEQ ID NO: 706945 - DNA, 12 bp, Homo sapiens
cacttcccatct

SEQ ID NO: 706946 - DNA, 14 bp, Homo sapiens
cacttcccatctcc

SEQ ID NO: 706947 - DNA, 17 bp, Homo sapiens
cacttcccatctccagg

SEQ ID NO: 706948 - DNA, 19 bp, Homo sapiens
cacttcccatctccaggga

SEQ ID NO: 706949 - DNA, 14 bp, Homo sapiens
cacttccccatctt

SEQ ID NO: 706950 - DNA, 15 bp, Homo sapiens
cacttccccttgtct

SEQ ID NO: 706951 - DNA, 22 bp, Homo sapiens
cacttccccttgtctccctggt

SEQ ID NO: 706952 - DNA, 18 bp, Homo sapiens
cacttcccgtctcagaat

SEQ ID NO: 706953 - DNA, 19 bp, Homo sapiens
cacttccctcatctctcct

SEQ ID NO: 706954 - DNA, 18 bp, Homo sapiens
cacttccctctgtttctc

SEQ ID NO: 706955 - DNA, 10 bp, Homo sapiens
cacttccctg

SEQ ID NO: 706956 - DNA, 19 bp, Homo sapiens
cacttccctggcggcccca

SEQ ID NO: 706957 - DNA, 17 bp, Homo sapiens
cacttccctgggcctca

SEQ ID NO: 706958 - DNA, 17 bp, Homo sapiens
cacttcctacaagagca

SEQ ID NO: 706959 - DNA, 16 bp, Homo sapiens
cacttcctccacagtc

SEQ ID NO: 706960 - DNA, 14 bp, Homo sapiens
cacttcctcctacc

SEQ ID NO: 706961 - DNA, 20 bp, Homo sapiens
cacttcctcctacctgggga

SEQ ID NO: 706962 - DNA, 21 bp, Homo sapiens
cacttcctctcgcggccctca

SEQ ID NO: 706963 - DNA, 13 bp, Homo sapiens
cacttcctgccta

SEQ ID NO: 706964 - DNA, 14 bp, Homo sapiens
cacttcctgcctaa

SEQ ID NO: 706965 - DNA, 14 bp, Homo sapiens
cacttcctgtccag

SEQ ID NO: 706966 - DNA, 20 bp, Homo sapiens
cacttcctttcctactgtcc

SEQ ID NO: 706967 - DNA, 21 bp, Homo sapiens
cacttcgcgtgccctcgctgc

SEQ ID NO: 706968 - DNA, 12 bp, Homo sapiens
cacttctccccg

SEQ ID NO: 706969 - DNA, 14 bp, Homo sapiens
cacttctccccgca

SEQ ID NO: 706970 - DNA, 14 bp, Homo sapiens
cacttctctgctgc

SEQ ID NO: 706971 - DNA, 17 bp, Homo sapiens
cacttctctgctgcctc

SEQ ID NO: 706972 - DNA, 20 bp, Homo sapiens
cacttctctgctgcctctgt

SEQ ID NO: 706973 - DNA, 19 bp, Homo sapiens
cacttctgaccacacttcc

SEQ ID NO: 706974 - DNA, 21 bp, Homo sapiens
cacttctgcgggctccctcct

SEQ ID NO: 706975 - DNA, 13 bp, Homo sapiens
cacttctgctttc

SEQ ID NO: 706976 - DNA, 14 bp, Homo sapiens
cacttctgctttca

SEQ ID NO: 706977 - DNA, 15 bp, Homo sapiens
cacttctgctttcac

SEQ ID NO: 706978 - DNA, 23 bp, Homo sapiens
cacttctggcttcagcccccacc

SEQ ID NO: 706979 - DNA, 13 bp, Homo sapiens
cacttctggtccc

SEQ ID NO: 706980 - DNA, 18 bp, Homo sapiens
cacttctggtcccctgtg

SEQ ID NO: 706981 - DNA, 22 bp, Homo sapiens
cacttctgtgagacccccacac

SEQ ID NO: 706982 - DNA, 20 bp, Homo sapiens
cacttctgtgggcatggccg

SEQ ID NO: 706983 - DNA, 12 bp, Homo sapiens
cacttcttcacc

SEQ ID NO: 706984 - DNA, 19 bp, Homo sapiens
cacttcttcctttctcttt

SEQ ID NO: 706985 - DNA, 15 bp, Homo sapiens
cacttcttgaaacag

SEQ ID NO: 706986 - DNA, 18 bp, Homo sapiens
cacttcttgaaacagcct

SEQ ID NO: 706987 - DNA, 19 bp, Homo sapiens
cacttcttgaaacagcctg

SEQ ID NO: 706988 - DNA, 21 bp, Homo sapiens
cacttcttgaaacagcctggg

SEQ ID NO: 706989 - DNA, 15 bp, Homo sapiens
cacttcttggttcct

SEQ ID NO: 706990 - DNA, 18 bp, Homo sapiens
cacttctttgcagagcct

SEQ ID NO: 706991 - DNA, 16 bp, Homo sapiens
cacttcttttgaacat

SEQ ID NO: 706992 - DNA, 12 bp, Homo sapiens
cacttgaaagat

SEQ ID NO: 706993 - DNA, 15 bp, Homo sapiens
cacttgaaagatttt

SEQ ID NO: 706994 - DNA, 20 bp, Homo sapiens
cacttgagaaccagtctcct

SEQ ID NO: 706995 - DNA, 13 bp, Homo sapiens
cacttgagaggat

SEQ ID NO: 706996 - DNA, 18 bp, Homo sapiens
agaaggttaagtcaggga

SEQ ID NO: 706997 - DNA, 19 bp, Homo sapiens
agaaggtttgtgtttttct

SEQ ID NO: 706998 - DNA, 21 bp, Homo sapiens
agaagtaggcatgagggatca

SEQ ID NO: 706999 - DNA, 18 bp, Homo sapiens
agaagtagttttaattca

SEQ ID NO: 707000 - DNA, 15 bp, Homo sapiens
agaagtataaggtgc

SEQ ID NO: 707001 - DNA, 15 bp, Homo sapiens
agaagtatttttaga

SEQ ID NO: 707002 - DNA, 19 bp, Homo sapiens
agaagtatttttagaataa

SEQ ID NO: 707003 - DNA, 17 bp, Homo sapiens
agaagtcaaagtaaaac

SEQ ID NO: 707004 - DNA, 22 bp, Homo sapiens
agaagtcagagagggtgacaag

SEQ ID NO: 707005 - DNA, 23 bp, Homo sapiens
agaagtcagcccgaatgcctgtc

SEQ ID NO: 707006 - DNA, 13 bp, Homo sapiens
agaagtcatgaag

SEQ ID NO: 707007 - DNA, 20 bp, Homo sapiens
agaagtcatgaagcccaagt

SEQ ID NO: 707008 - DNA, 22 bp, Homo sapiens
agaagtccctcccatctctacc

SEQ ID NO: 707009 - DNA, 18 bp, Homo sapiens
agaagtcctgctggatct

SEQ ID NO: 707010 - DNA, 15 bp, Homo sapiens
agaagtctggaaaaa

SEQ ID NO: 707011 - DNA, 14 bp, Homo sapiens
agaagtcttgaagt

SEQ ID NO: 707012 - DNA, 15 bp, Homo sapiens
agaagtctttcagat

SEQ ID NO: 707013 - DNA, 15 bp, Homo sapiens
agaagtgaagaatgc

SEQ ID NO: 707014 - DNA, 21 bp, Homo sapiens
agaagtgaatgctgggactca

SEQ ID NO: 707015 - DNA, 19 bp, Homo sapiens
agaagtgagagctttgctt

SEQ ID NO: 707016 - DNA, 20 bp, Homo sapiens
agaagtgagtttgtaaatat

SEQ ID NO: 707017 - DNA, 21 bp, Homo sapiens
agaagtgagtttgtaaatatt

SEQ ID NO: 707018 - DNA, 13 bp, Homo sapiens
agaagtgcccctg

SEQ ID NO: 707019 - DNA, 22 bp, Homo sapiens
agaagtggaagtgcttgatatg

SEQ ID NO: 707020 - DNA, 23 bp, Homo sapiens
agaagtggaccaggacaggacca

SEQ ID NO: 707021 - DNA, 15 bp, Homo sapiens
agaagtggagacagt

SEQ ID NO: 707022 - DNA, 13 bp, Homo sapiens
agaagtgggagca

SEQ ID NO: 707023 - DNA, 14 bp, Homo sapiens
agaagtgggagcag

SEQ ID NO: 707024 - DNA, 18 bp, Homo sapiens
agaagtgggccaggacag

SEQ ID NO: 707025 - DNA, 15 bp, Homo sapiens
agaagttaagcaaca

SEQ ID NO: 707026 - DNA, 19 bp, Homo sapiens
agaagttaagcaacatcta

SEQ ID NO: 707027 - DNA, 16 bp, Homo sapiens
agaagttagtttgtat

SEQ ID NO: 707028 - DNA, 18 bp, Homo sapiens
agaagttagtttgtatat

SEQ ID NO: 707029 - DNA, 19 bp, Homo sapiens
agaagttagtttgtatata

SEQ ID NO: 707030 - DNA, 18 bp, Homo sapiens
agaagttcaaaatcatgt

SEQ ID NO: 707031 - DNA, 16 bp, Homo sapiens
agaagttcagttttta

SEQ ID NO: 707032 - DNA, 19 bp, Homo sapiens
agaagtttcagttgtcctt

SEQ ID NO: 707033 - DNA, 23 bp, Homo sapiens
agaagtttcatcattttttactt

SEQ ID NO: 707034 - DNA, 16 bp, Homo sapiens
agaagtttctggccct

SEQ ID NO: 707035 - DNA, 13 bp, Homo sapiens
agaagtttctgtc

SEQ ID NO: 707036 - DNA, 22 bp, Homo sapiens
agaagtttgagatcagcctggg

SEQ ID NO: 707037 - DNA, 20 bp, Homo sapiens
agaagtttgatattaaagga

SEQ ID NO: 707038 - DNA, 21 bp, Homo sapiens
agaagtttgtgtctttgtctg

SEQ ID NO: 707039 - DNA, 15 bp, Homo sapiens
agaagttttttactt

SEQ ID NO: 707040 - DNA, 22 bp, Homo sapiens
agaataaaagctataaagtata

SEQ ID NO: 707041 - DNA, 14 bp, Homo sapiens
agaataaaatatga

SEQ ID NO: 707042 - DNA, 13 bp, Homo sapiens
agaataaaatgtt

SEQ ID NO: 707043 - DNA, 15 bp, Homo sapiens
agaataaaattccta

SEQ ID NO: 707044 - DNA, 20 bp, Homo sapiens
agaataaaggtatgaaaggg

SEQ ID NO: 707045 - DNA, 17 bp, Homo sapiens
agaataaagtccaaagt

SEQ ID NO: 707046 - DNA, 18 bp, Homo sapiens
agaataaagttcctgtca

SEQ ID NO: 707047 - DNA, 21 bp, Homo sapiens
agaataaagttctgagtgttt

SEQ ID NO: 707048 - DNA, 14 bp, Homo sapiens
agaataaatccttg

SEQ ID NO: 707049 - DNA, 23 bp, Homo sapiens
agaataaatccttgggagtcatt

SEQ ID NO: 707050 - DNA, 14 bp, Homo sapiens
agaataaatgaaga

SEQ ID NO: 707051 - DNA, 13 bp, Homo sapiens
agaataaattcta

SEQ ID NO: 707052 - DNA, 18 bp, Homo sapiens
agaataacaagaagccca

SEQ ID NO: 707053 - DNA, 17 bp, Homo sapiens
agaataacctttcagaa

SEQ ID NO: 707054 - DNA, 18 bp, Homo sapiens
agaataagaatttgcata

SEQ ID NO: 707055 - DNA, 14 bp, Homo sapiens
agaataagagaaag

SEQ ID NO: 707056 - DNA, 15 bp, Homo sapiens
agaataaggcttttt

SEQ ID NO: 707057 - DNA, 12 bp, Homo sapiens
agaataagttat

SEQ ID NO: 707058 - DNA, 17 bp, Homo sapiens
agaataagttattgcag

SEQ ID NO: 707059 - DNA, 22 bp, Homo sapiens
agaataatatgctgccaaattt

SEQ ID NO: 707060 - DNA, 17 bp, Homo sapiens
agaataatcacgctttc

SEQ ID NO: 707061 - DNA, 22 bp, Homo sapiens
agaataatctcatccccccacc

SEQ ID NO: 707062 - DNA, 21 bp, Homo sapiens
agaataatgtgggaagaaaca

SEQ ID NO: 707063 - DNA, 21 bp, Homo sapiens
agaataattcaattttaaaga

SEQ ID NO: 707064 - DNA, 19 bp, Homo sapiens
agaataattcttttctgag

SEQ ID NO: 707065 - DNA, 21 bp, Homo sapiens
agaatacagaaagatggatgt

SEQ ID NO: 707066 - DNA, 22 bp, Homo sapiens
agaatacagtaagctgctctat

SEQ ID NO: 707067 - DNA, 15 bp, Homo sapiens
agaatacataaacaa

SEQ ID NO: 707068 - DNA, 16 bp, Homo sapiens
agaatacataaacaac

SEQ ID NO: 707069 - DNA, 17 bp, Homo sapiens
agaatacgcagaactac

SEQ ID NO: 707070 - DNA, 21 bp, Homo sapiens
agaatacggaagagcaggtga

SEQ ID NO: 707071 - DNA, 20 bp, Homo sapiens
agaatactgggttcttagtt

SEQ ID NO: 707072 - DNA, 13 bp, Homo sapiens
agaatactggtct

SEQ ID NO: 707073 - DNA, 12 bp, Homo sapiens
agaatacttttt

SEQ ID NO: 707074 - DNA, 14 bp, Homo sapiens
agaatactttttaa

SEQ ID NO: 707075 - DNA, 16 bp, Homo sapiens
agaatagaatacattg

SEQ ID NO: 707076 - DNA, 15 bp, Homo sapiens
agaatagagctgcca

SEQ ID NO: 707077 - DNA, 18 bp, Homo sapiens
agaatagatcagtatttc

SEQ ID NO: 707078 - DNA, 20 bp, Homo sapiens
agaatagatctgatggtgag

SEQ ID NO: 707079 - DNA, 20 bp, Homo sapiens
agaatagccacatttggaat

SEQ ID NO: 707080 - DNA, 20 bp, Homo sapiens
agaatagctgttttgtgtat

SEQ ID NO: 707081 - DNA, 21 bp, Homo sapiens
agaatagctgttttgtgtata

SEQ ID NO: 707082 - DNA, 12 bp, Homo sapiens
agaatagctttt

SEQ ID NO: 707083 - DNA, 12 bp, Homo sapiens
agaataggaaaa

SEQ ID NO: 707084 - DNA, 23 bp, Homo sapiens
agaataggaaaacattgcaataa

SEQ ID NO: 707085 - DNA, 20 bp, Homo sapiens
agaataggcagggggccctg

SEQ ID NO: 707086 - DNA, 21 bp, Homo sapiens
agaatagtcatacctggaatg

SEQ ID NO: 707087 - DNA, 23 bp, Homo sapiens
agaatataaaaactcctgggctt

SEQ ID NO: 707088 - DNA, 15 bp, Homo sapiens
agaatataattatcg

SEQ ID NO: 707089 - DNA, 11 bp, Homo sapiens
agaatatacct

SEQ ID NO: 707090 - DNA, 13 bp, Homo sapiens
agaatatacctta

SEQ ID NO: 707091 - DNA, 19 bp, Homo sapiens
agaatataggtctcttctc

SEQ ID NO: 707092 - DNA, 13 bp, Homo sapiens
agaatatatacat

SEQ ID NO: 707093 - DNA, 12 bp, Homo sapiens
agaatatcaaat

SEQ ID NO: 707094 - DNA, 13 bp, Homo sapiens
agaatatgtaata

SEQ ID NO: 707095 - DNA, 20 bp, Homo sapiens
agaatatgttaatgcaaagc

SEQ ID NO: 707096 - DNA, 20 bp, Homo sapiens
agaatattagctttactgtt

SEQ ID NO: 707097 - DNA, 17 bp, Homo sapiens
agaatattcaaaattcc

SEQ ID NO: 707098 - DNA, 14 bp, Homo sapiens
agaatattcagaca

SEQ ID NO: 707099 - DNA, 13 bp, Homo sapiens
agaatattcagga

SEQ ID NO: 707100 - DNA, 15 bp, Homo sapiens
agaatattcaggact

SEQ ID NO: 707101 - DNA, 15 bp, Homo sapiens
agaatattgtattgt

SEQ ID NO: 707102 - DNA, 16 bp, Homo sapiens
agaatattgtattgtt

SEQ ID NO: 707103 - DNA, 13 bp, Homo sapiens
agaatatttagaa

SEQ ID NO: 707104 - DNA, 14 bp, Homo sapiens
agaatatttagaaa

SEQ ID NO: 707105 - DNA, 19 bp, Homo sapiens
agaatattttaagtattgc

SEQ ID NO: 707106 - DNA, 16 bp, Homo sapiens
agaatcaacagatgat

SEQ ID NO: 707107 - DNA, 16 bp, Homo sapiens
agaatcaatttaagtg

SEQ ID NO: 707108 - DNA, 19 bp, Homo sapiens
agaatcacttaagcctgga

SEQ ID NO: 707109 - DNA, 16 bp, Homo sapiens
agaatcacttttctag

SEQ ID NO: 707110 - DNA, 16 bp, Homo sapiens
agaatcagaagatagt

SEQ ID NO: 707111 - DNA, 17 bp, Homo sapiens
agaatcagatcatttca

SEQ ID NO: 707112 - DNA, 19 bp, Homo sapiens
agaatcagtgttaaattca

SEQ ID NO: 707113 - DNA, 21 bp, Homo sapiens
agaatcagtgttaaattcatt

SEQ ID NO: 707114 - DNA, 22 bp, Homo sapiens
agaatcatatgattctgctttt

SEQ ID NO: 707115 - DNA, 13 bp, Homo sapiens
agaatcatggaga

SEQ ID NO: 707116 - DNA, 15 bp, Homo sapiens
agaatcatttagcat

SEQ ID NO: 707117 - DNA, 14 bp, Homo sapiens
agaatccaaacttg

SEQ ID NO: 707118 - DNA, 16 bp, Homo sapiens
agaatccaaacttgga

SEQ ID NO: 707119 - DNA, 18 bp, Homo sapiens
agaatccaagtgaacact

SEQ ID NO: 707120 - DNA, 22 bp, Homo sapiens
agaatccacccatcctaccaat

SEQ ID NO: 707121 - DNA, 15 bp, Homo sapiens
cacttgagatgattt

SEQ ID NO: 707122 - DNA, 22 bp, Homo sapiens
cacttgaggtcaggagttccta

SEQ ID NO: 707123 - DNA, 14 bp, Homo sapiens
cacttgagttggct

SEQ ID NO: 707124 - DNA, 23 bp, Homo sapiens
cacttgatgatacaatgaacact

SEQ ID NO: 707125 - DNA, 15 bp, Homo sapiens
cacttgattcaggag

SEQ ID NO: 707126 - DNA, 23 bp, Homo sapiens
cacttgcacgcccatgtgtgagt

SEQ ID NO: 707127 - DNA, 13 bp, Homo sapiens
cacttgcagagga

SEQ ID NO: 707128 - DNA, 23 bp, Homo sapiens
cacttgcagaggagcccagtggg

SEQ ID NO: 707129 - DNA, 13 bp, Homo sapiens
cacttgcatttga

SEQ ID NO: 707130 - DNA, 13 bp, Homo sapiens
cacttgccacatg

SEQ ID NO: 707131 - DNA, 15 bp, Homo sapiens
cacttgccatgcagg

SEQ ID NO: 707132 - DNA, 17 bp, Homo sapiens
cacttgccatgcaggaa

SEQ ID NO: 707133 - DNA, 18 bp, Homo sapiens
cacttgccatgcaggaag

SEQ ID NO: 707134 - DNA, 20 bp, Homo sapiens
cacttgccattgccaggaga

SEQ ID NO: 707135 - DNA, 14 bp, Homo sapiens
cacttgcctcttcc

SEQ ID NO: 707136 - DNA, 12 bp, Homo sapiens
cacttgcctgga

SEQ ID NO: 707137 - DNA, 13 bp, Homo sapiens
cacttgcctggaa

SEQ ID NO: 707138 - DNA, 20 bp, Homo sapiens
cacttgcgtcctgcagagga

SEQ ID NO: 707139 - DNA, 23 bp, Homo sapiens
cacttgcgtcctgcagaggacca

SEQ ID NO: 707140 - DNA, 15 bp, Homo sapiens
cacttgctggggctc

SEQ ID NO: 707141 - DNA, 14 bp, Homo sapiens
cacttggaaataaa

SEQ ID NO: 707142 - DNA, 18 bp, Homo sapiens
cacttggaaataaaccat

SEQ ID NO: 707143 - DNA, 12 bp, Homo sapiens
cacttggagccc

SEQ ID NO: 707144 - DNA, 17 bp, Homo sapiens
cacttggcctcatgctg

SEQ ID NO: 707145 - DNA, 21 bp, Homo sapiens
cacttgggagctgctgggcta

SEQ ID NO: 707146 - DNA, 20 bp, Homo sapiens
cacttgggggttcaggcccg

SEQ ID NO: 707147 - DNA, 16 bp, Homo sapiens
cacttgggtcttccct

SEQ ID NO: 707148 - DNA, 20 bp, Homo sapiens
cacttggtcctacctattat

SEQ ID NO: 707149 - DNA, 14 bp, Homo sapiens
cacttggtgtactg

SEQ ID NO: 707150 - DNA, 18 bp, Homo sapiens
cacttggtttttggctct

SEQ ID NO: 707151 - DNA, 20 bp, Homo sapiens
cacttggtttttggctcttt

SEQ ID NO: 707152 - DNA, 12 bp, Homo sapiens
cacttgtacaaa

SEQ ID NO: 707153 - DNA, 23 bp, Homo sapiens
cacttgtaggataagtgaaatgg

SEQ ID NO: 707154 - DNA, 21 bp, Homo sapiens
cacttgtatatacgcatctat

SEQ ID NO: 707155 - DNA, 19 bp, Homo sapiens
cacttgtatatatggatca

SEQ ID NO: 707156 - DNA, 10 bp, Homo sapiens
cacttgtatt

SEQ ID NO: 707157 - DNA, 15 bp, Homo sapiens
cacttgtctcctttc

SEQ ID NO: 707158 - DNA, 22 bp, Homo sapiens
cacttgtctcctttctgactgt

SEQ ID NO: 707159 - DNA, 15 bp, Homo sapiens
cacttgtgccagccc

SEQ ID NO: 707160 - DNA, 18 bp, Homo sapiens
cacttgtgccagcccgga

SEQ ID NO: 707161 - DNA, 16 bp, Homo sapiens
cacttgtgctttgctc

SEQ ID NO: 707162 - DNA, 18 bp, Homo sapiens
cacttgtgctttgctctt

SEQ ID NO: 707163 - DNA, 19 bp, Homo sapiens
cacttgtgtgtgggctgtg

SEQ ID NO: 707164 - DNA, 16 bp, Homo sapiens
cacttgttatattata

SEQ ID NO: 707165 - DNA, 13 bp, Homo sapiens
cacttgttccagc

SEQ ID NO: 707166 - DNA, 16 bp, Homo sapiens
cacttgttccagctct

SEQ ID NO: 707167 - DNA, 13 bp, Homo sapiens
cactttaaaacac

SEQ ID NO: 707168 - DNA, 21 bp, Homo sapiens
cactttaaagaggctgtgtgg

SEQ ID NO: 707169 - DNA, 15 bp, Homo sapiens
cactttaaccctctc

SEQ ID NO: 707170 - DNA, 16 bp, Homo sapiens
cactttaaccctctct

SEQ ID NO: 707171 - DNA, 19 bp, Homo sapiens
cactttaaccctctcttcc

SEQ ID NO: 707172 - DNA, 20 bp, Homo sapiens
cactttaaccctctcttccc

SEQ ID NO: 707173 - DNA, 19 bp, Homo sapiens
cactttaatggcctggagg

SEQ ID NO: 707174 - DNA, 14 bp, Homo sapiens
cactttaattgaag

SEQ ID NO: 707175 - DNA, 22 bp, Homo sapiens
cactttaattgaagaactgcac

SEQ ID NO: 707176 - DNA, 22 bp, Homo sapiens
cactttacaatgttcatcccat

SEQ ID NO: 707177 - DNA, 16 bp, Homo sapiens
cactttacacaagaat

SEQ ID NO: 707178 - DNA, 17 bp, Homo sapiens
cactttacccacctaga

SEQ ID NO: 707179 - DNA, 16 bp, Homo sapiens
cactttagatgctgat

SEQ ID NO: 707180 - DNA, 18 bp, Homo sapiens
cactttagggctgtaaaa

SEQ ID NO: 707181 - DNA, 21 bp, Homo sapiens
cactttcagagcccccagccc

SEQ ID NO: 707182 - DNA, 15 bp, Homo sapiens
cactttcataatctt

SEQ ID NO: 707183 - DNA, 14 bp, Homo sapiens
cactttcatttttg

SEQ ID NO: 707184 - DNA, 16 bp, Homo sapiens
cactttcccccttccc

SEQ ID NO: 707185 - DNA, 17 bp, Homo sapiens
cactttcccccttcccg

SEQ ID NO: 707186 - DNA, 13 bp, Homo sapiens
cactttccctaga

SEQ ID NO: 707187 - DNA, 14 bp, Homo sapiens
cactttccctagaa

SEQ ID NO: 707188 - DNA, 18 bp, Homo sapiens
cactttccttctctgtaa

SEQ ID NO: 707189 - DNA, 23 bp, Homo sapiens
cactttctacaatgtgaacttta

SEQ ID NO: 707190 - DNA, 20 bp, Homo sapiens
cactttctatcctctgtaaa

SEQ ID NO: 707191 - DNA, 11 bp, Homo sapiens
cactttctctt

SEQ ID NO: 707192 - DNA, 22 bp, Homo sapiens
cactttctcttcttgtttctcc

SEQ ID NO: 707193 - DNA, 13 bp, Homo sapiens
cactttctgttcc

SEQ ID NO: 707194 - DNA, 11 bp, Homo sapiens
cactttcttat

SEQ ID NO: 707195 - DNA, 22 bp, Homo sapiens
cactttcttctagctgagcttt

SEQ ID NO: 707196 - DNA, 12 bp, Homo sapiens
cactttgaaaag

SEQ ID NO: 707197 - DNA, 18 bp, Homo sapiens
cactttgaaaatatttct

SEQ ID NO: 707198 - DNA, 20 bp, Homo sapiens
cactttgaaatgtgtttctg

SEQ ID NO: 707199 - DNA, 21 bp, Homo sapiens
cactttgagcatttttaaggg

SEQ ID NO: 707200 - DNA, 19 bp, Homo sapiens
cactttgcactgatatatc

SEQ ID NO: 707201 - DNA, 19 bp, Homo sapiens
cactttgctctcaattaaa

SEQ ID NO: 707202 - DNA, 19 bp, Homo sapiens
cactttgctctgggtggaa

SEQ ID NO: 707203 - DNA, 20 bp, Homo sapiens
cactttggcttctcctgtga

SEQ ID NO: 707204 - DNA, 22 bp, Homo sapiens
cactttggcttctcctgtgacc

SEQ ID NO: 707205 - DNA, 14 bp, Homo sapiens
cactttgggaggct

SEQ ID NO: 707206 - DNA, 23 bp, Homo sapiens
cactttgggagtttttgtttgtt

SEQ ID NO: 707207 - DNA, 13 bp, Homo sapiens
cactttggttatt

SEQ ID NO: 707208 - DNA, 15 bp, Homo sapiens
cactttgtattactt

SEQ ID NO: 707209 - DNA, 20 bp, Homo sapiens
cactttgtcgcccaggctgg

SEQ ID NO: 707210 - DNA, 15 bp, Homo sapiens
cactttgtctgtaca

SEQ ID NO: 707211 - DNA, 14 bp, Homo sapiens
cactttgtgaatta

SEQ ID NO: 707212 - DNA, 20 bp, Homo sapiens
cactttgtgaattaacacag

SEQ ID NO: 707213 - DNA, 12 bp, Homo sapiens
cactttgttctt

SEQ ID NO: 707214 - DNA, 23 bp, Homo sapiens
cactttgttgcaagatgtgaatt

SEQ ID NO: 707215 - DNA, 13 bp, Homo sapiens
cactttgtttaga

SEQ ID NO: 707216 - DNA, 19 bp, Homo sapiens
cactttgtttagaaaaaaa

SEQ ID NO: 707217 - DNA, 19 bp, Homo sapiens
cacttttaaaaaaattttt

SEQ ID NO: 707218 - DNA, 21 bp, Homo sapiens
cacttttaaacataaagaatt

SEQ ID NO: 707219 - DNA, 22 bp, Homo sapiens
cacttttcaaaagaagacatct

SEQ ID NO: 707220 - DNA, 14 bp, Homo sapiens
cacttttcacttgt

SEQ ID NO: 707221 - DNA, 21 bp, Homo sapiens
cacttttcacttgtcttgctc

SEQ ID NO: 707222 - DNA, 17 bp, Homo sapiens
cacttttcatatcattt

SEQ ID NO: 707223 - DNA, 18 bp, Homo sapiens
cacttttcatatcatttc

SEQ ID NO: 707224 - DNA, 14 bp, Homo sapiens
cacttttcatcctt

SEQ ID NO: 707225 - DNA, 19 bp, Homo sapiens
cacttttcatccttcccca

SEQ ID NO: 707226 - DNA, 12 bp, Homo sapiens
cacttttctcca

SEQ ID NO: 707227 - DNA, 23 bp, Homo sapiens
cacttttgaagtcttccctcaga

SEQ ID NO: 707228 - DNA, 18 bp, Homo sapiens
cacttttgctaaaaagaa

SEQ ID NO: 707229 - DNA, 19 bp, Homo sapiens
cacttttgttgcccaggct

SEQ ID NO: 707230 - DNA, 16 bp, Homo sapiens
cactttttccatttct

SEQ ID NO: 707231 - DNA, 21 bp, Homo sapiens
cactttttgtattttttcctt

SEQ ID NO: 707232 - DNA, 23 bp, Homo sapiens
cactttttgtattttttccttaa

SEQ ID NO: 707233 - DNA, 21 bp, Homo sapiens
cacttttttgagtggatgatg

SEQ ID NO: 707234 - DNA, 14 bp, Homo sapiens
cagaaaaaaaagtg

SEQ ID NO: 707235 - DNA, 21 bp, Homo sapiens
cagaaaaaaagagtgaaaaag

SEQ ID NO: 707236 - DNA, 19 bp, Homo sapiens
cagaaaaaaataactattt

SEQ ID NO: 707237 - DNA, 20 bp, Homo sapiens
cagaaaaaaataactatttt

SEQ ID NO: 707238 - DNA, 12 bp, Homo sapiens
cagaaaaacaat

SEQ ID NO: 707239 - DNA, 13 bp, Homo sapiens
cagaaaaacaatc

SEQ ID NO: 707240 - DNA, 19 bp, Homo sapiens
cagaaaaactctgggaaat

SEQ ID NO: 707241 - DNA, 16 bp, Homo sapiens
cagaaaaactggctct

SEQ ID NO: 707242 - DNA, 17 bp, Homo sapiens
cagaaaaactggctctg

SEQ ID NO: 707243 - DNA, 13 bp, Homo sapiens
cagaaaaagcatg

SEQ ID NO: 707244 - DNA, 17 bp, Homo sapiens
cagaaaaatgaaaagca

SEQ ID NO: 707245 - DNA, 18 bp, Homo sapiens
cagaaaaattaaaaaaga

SEQ ID NO: 707246 - DNA, 17 bp, Homo sapiens
agaatccagtttctttc

SEQ ID NO: 707247 - DNA, 19 bp, Homo sapiens
agaatccataaatgtgttc

SEQ ID NO: 707248 - DNA, 15 bp, Homo sapiens
agaatcccaaatttg

SEQ ID NO: 707249 - DNA, 17 bp, Homo sapiens
agaatcccaaatttgat

SEQ ID NO: 707250 - DNA, 19 bp, Homo sapiens
agaatcccaaatttgattg

SEQ ID NO: 707251 - DNA, 18 bp, Homo sapiens
agaatccccaagtgcctg

SEQ ID NO: 707252 - DNA, 12 bp, Homo sapiens
agaatccctgca

SEQ ID NO: 707253 - DNA, 15 bp, Homo sapiens
agaatcccttaaaat

SEQ ID NO: 707254 - DNA, 23 bp, Homo sapiens
agaatccctttgcacctgagacc

SEQ ID NO: 707255 - DNA, 12 bp, Homo sapiens
agaatcctctcc

SEQ ID NO: 707256 - DNA, 21 bp, Homo sapiens
agaatcctctcctttcttatt

SEQ ID NO: 707257 - DNA, 13 bp, Homo sapiens
agaatcctgcctc

SEQ ID NO: 707258 - DNA, 21 bp, Homo sapiens
agaatcctgcctctccccaaa

SEQ ID NO: 707259 - DNA, 21 bp, Homo sapiens
agaatcctttacattcaactt

SEQ ID NO: 707260 - DNA, 18 bp, Homo sapiens
agaatctaattctgttga

SEQ ID NO: 707261 - DNA, 17 bp, Homo sapiens
agaatctacccaaagga

SEQ ID NO: 707262 - DNA, 14 bp, Homo sapiens
agaatctagaagat

SEQ ID NO: 707263 - DNA, 14 bp, Homo sapiens
agaatctatcacta

SEQ ID NO: 707264 - DNA, 22 bp, Homo sapiens
agaatctctctactcagatgac

SEQ ID NO: 707265 - DNA, 21 bp, Homo sapiens
agaatctgagacatcttgcct

SEQ ID NO: 707266 - DNA, 20 bp, Homo sapiens
agaatcttaaggtctaactg

SEQ ID NO: 707267 - DNA, 19 bp, Homo sapiens
agaatcttgttttgaaaat

SEQ ID NO: 707268 - DNA, 22 bp, Homo sapiens
agaatcttgttttgaaaataac

SEQ ID NO: 707269 - DNA, 23 bp, Homo sapiens
agaatctttagagaagtatacat

SEQ ID NO: 707270 - DNA, 16 bp, Homo sapiens
agaatctttattgaga

SEQ ID NO: 707271 - DNA, 17 bp, Homo sapiens
agaatctttattgagaa

SEQ ID NO: 707272 - DNA, 20 bp, Homo sapiens
agaatgaaattgctgaaaga

SEQ ID NO: 707273 - DNA, 20 bp, Homo sapiens
agaatgaaccctcctccttt

SEQ ID NO: 707274 - DNA, 14 bp, Homo sapiens
agaatgaactgtgg

SEQ ID NO: 707275 - DNA, 15 bp, Homo sapiens
agaatgaactgtgga

SEQ ID NO: 707276 - DNA, 21 bp, Homo sapiens
agaatgaactgtggaatttat

SEQ ID NO: 707277 - DNA, 18 bp, Homo sapiens
agaatgaattcgatgcgt

SEQ ID NO: 707278 - DNA, 22 bp, Homo sapiens
agaatgaatttatctttaccaa

SEQ ID NO: 707279 - DNA, 14 bp, Homo sapiens
agaatgagaaacat

SEQ ID NO: 707280 - DNA, 20 bp, Homo sapiens
agaatgagagcgacacagac

SEQ ID NO: 707281 - DNA, 16 bp, Homo sapiens
agaatgagcacccatt

SEQ ID NO: 707282 - DNA, 21 bp, Homo sapiens
agaatgagggaaattgctatt

SEQ ID NO: 707283 - DNA, 16 bp, Homo sapiens
agaatgagtgggaatc

SEQ ID NO: 707284 - DNA, 17 bp, Homo sapiens
agaatgatagaactttg

SEQ ID NO: 707285 - DNA, 16 bp, Homo sapiens
agaatgatgcacactg

SEQ ID NO: 707286 - DNA, 18 bp, Homo sapiens
agaatgatgttttaaaaa

SEQ ID NO: 707287 - DNA, 12 bp, Homo sapiens
agaatgatttgt

SEQ ID NO: 707288 - DNA, 18 bp, Homo sapiens
agaatgatttgtaaatag

SEQ ID NO: 707289 - DNA, 11 bp, Homo sapiens
agaatgcaagc

SEQ ID NO: 707290 - DNA, 12 bp, Homo sapiens
agaatgcaagca

SEQ ID NO: 707291 - DNA, 23 bp, Homo sapiens
agaatgcacagtgggtggagcca

SEQ ID NO: 707292 - DNA, 23 bp, Homo sapiens
agaatgcacttgattcaggaggt

SEQ ID NO: 707293 - DNA, 19 bp, Homo sapiens
agaatgcagcccaccagga

SEQ ID NO: 707294 - DNA, 19 bp, Homo sapiens
agaatgccactttggctga

SEQ ID NO: 707295 - DNA, 16 bp, Homo sapiens
agaatgccatttctca

SEQ ID NO: 707296 - DNA, 17 bp, Homo sapiens
agaatgccatttctcac

SEQ ID NO: 707297 - DNA, 11 bp, Homo sapiens
agaatgctcct

SEQ ID NO: 707298 - DNA, 18 bp, Homo sapiens
agaatgctctttacttca

SEQ ID NO: 707299 - DNA, 20 bp, Homo sapiens
agaatgcttaatcagataga

SEQ ID NO: 707300 - DNA, 14 bp, Homo sapiens
agaatggaagcctg

SEQ ID NO: 707301 - DNA, 17 bp, Homo sapiens
agaatggagaaagtaag

SEQ ID NO: 707302 - DNA, 14 bp, Homo sapiens
agaatggcatttgc

SEQ ID NO: 707303 - DNA, 20 bp, Homo sapiens
agaatggtgatccacccagt

SEQ ID NO: 707304 - DNA, 22 bp, Homo sapiens
agaatggtgctgtttaaagtca

SEQ ID NO: 707305 - DNA, 21 bp, Homo sapiens
agaatggttgccttaaagaaa

SEQ ID NO: 707306 - DNA, 16 bp, Homo sapiens
agaatgtaaaagaact

SEQ ID NO: 707307 - DNA, 17 bp, Homo sapiens
agaatgtaaagcttgtc

SEQ ID NO: 707308 - DNA, 21 bp, Homo sapiens
agaatgtaactccagatagag

SEQ ID NO: 707309 - DNA, 17 bp, Homo sapiens
agaatgtatctcctcct

SEQ ID NO: 707310 - DNA, 15 bp, Homo sapiens
agaatgtatctgtga

SEQ ID NO: 707311 - DNA, 22 bp, Homo sapiens
agaatgtatctgtgaagtagtt

SEQ ID NO: 707312 - DNA, 11 bp, Homo sapiens
agaatgtattt

SEQ ID NO: 707313 - DNA, 18 bp, Homo sapiens
agaatgtcaccagtcctg

SEQ ID NO: 707314 - DNA, 18 bp, Homo sapiens
agaatgtcagatttctgg

SEQ ID NO: 707315 - DNA, 20 bp, Homo sapiens
agaatgtcagatttctggtt

SEQ ID NO: 707316 - DNA, 17 bp, Homo sapiens
agaatgtccccttaggt

SEQ ID NO: 707317 - DNA, 19 bp, Homo sapiens
agaatgtctgaagtacaaa

SEQ ID NO: 707318 - DNA, 21 bp, Homo sapiens
agaatgtctgaagtacaaaca

SEQ ID NO: 707319 - DNA, 11 bp, Homo sapiens
agaatgtgaaa

SEQ ID NO: 707320 - DNA, 19 bp, Homo sapiens
agaatgtgaaaaaggaata

SEQ ID NO: 707321 - DNA, 20 bp, Homo sapiens
agaatgtgaaaaaggaataa

SEQ ID NO: 707322 - DNA, 14 bp, Homo sapiens
agaatgtgattttt

SEQ ID NO: 707323 - DNA, 13 bp, Homo sapiens
agaatgtgttctt

SEQ ID NO: 707324 - DNA, 21 bp, Homo sapiens
agaatgtgtttaaacttggtt

SEQ ID NO: 707325 - DNA, 19 bp, Homo sapiens
agaatgtgtttcaaaacca

SEQ ID NO: 707326 - DNA, 14 bp, Homo sapiens
agaatgttaagact

SEQ ID NO: 707327 - DNA, 19 bp, Homo sapiens
agaatgttaagacttgaca

SEQ ID NO: 707328 - DNA, 17 bp, Homo sapiens
agaatgttactgcctta

SEQ ID NO: 707329 - DNA, 16 bp, Homo sapiens
agaatgttagagtaat

SEQ ID NO: 707330 - DNA, 14 bp, Homo sapiens
agaatgttccagac

SEQ ID NO: 707331 - DNA, 18 bp, Homo sapiens
agaatgttcccaatttga

SEQ ID NO: 707332 - DNA, 19 bp, Homo sapiens
agaatgttcccaatttgaa

SEQ ID NO: 707333 - DNA, 23 bp, Homo sapiens
agaatgttcccaatttgaattta

SEQ ID NO: 707334 - DNA, 17 bp, Homo sapiens
agaatgttgtacttgaa

SEQ ID NO: 707335 - DNA, 18 bp, Homo sapiens
agaatgttttactgtgaa

SEQ ID NO: 707336 - DNA, 13 bp, Homo sapiens
agaattaaaactg

SEQ ID NO: 707337 - DNA, 15 bp, Homo sapiens
agaattaaaactgag

SEQ ID NO: 707338 - DNA, 23 bp, Homo sapiens
agaattaaaactgagtccatgaa

SEQ ID NO: 707339 - DNA, 14 bp, Homo sapiens
agaattaaactttt

SEQ ID NO: 707340 - DNA, 15 bp, Homo sapiens
agaattaaactttta

SEQ ID NO: 707341 - DNA, 21 bp, Homo sapiens
agaattaaacttttaattcat

SEQ ID NO: 707342 - DNA, 14 bp, Homo sapiens
agaattaagcagaa

SEQ ID NO: 707343 - DNA, 17 bp, Homo sapiens
agaattacagtacacat

SEQ ID NO: 707344 - DNA, 16 bp, Homo sapiens
agaattaccattaatt

SEQ ID NO: 707345 - DNA, 22 bp, Homo sapiens
agaattaccatttgttaatatc

SEQ ID NO: 707346 - DNA, 13 bp, Homo sapiens
agaattagacatc

SEQ ID NO: 707347 - DNA, 19 bp, Homo sapiens
agaattagtatgtctgttt

SEQ ID NO: 707348 - DNA, 22 bp, Homo sapiens
agaattagtatgtctgtttttg

SEQ ID NO: 707349 - DNA, 16 bp, Homo sapiens
agaattatccattacg

SEQ ID NO: 707350 - DNA, 17 bp, Homo sapiens
agaattatccattacgt

SEQ ID NO: 707351 - DNA, 15 bp, Homo sapiens
agaattatgtaatat

SEQ ID NO: 707352 - DNA, 18 bp, Homo sapiens
agaattatttttaaaaag

SEQ ID NO: 707353 - DNA, 14 bp, Homo sapiens
agaattatttttgt

SEQ ID NO: 707354 - DNA, 17 bp, Homo sapiens
agaattatttttgtgtt

SEQ ID NO: 707355 - DNA, 14 bp, Homo sapiens
agaattcaaaagtg

SEQ ID NO: 707356 - DNA, 13 bp, Homo sapiens
agaattcagacat

SEQ ID NO: 707357 - DNA, 21 bp, Homo sapiens
agaattcattcatacttaaaa

SEQ ID NO: 707358 - DNA, 19 bp, Homo sapiens
agaattccatagtggacca

SEQ ID NO: 707359 - DNA, 15 bp, Homo sapiens
agaattcccttgaat

SEQ ID NO: 707360 - DNA, 18 bp, Homo sapiens
agaattcctgaagccaga

SEQ ID NO: 707361 - DNA, 16 bp, Homo sapiens
agaattcggtgtgctg

SEQ ID NO: 707362 - DNA, 18 bp, Homo sapiens
agaattcggtgtgctgcc

SEQ ID NO: 707363 - DNA, 18 bp, Homo sapiens
agaattctagtgctgctg

SEQ ID NO: 707364 - DNA, 19 bp, Homo sapiens
agaattctctagtttgatt

SEQ ID NO: 707365 - DNA, 13 bp, Homo sapiens
agaattctgctac

SEQ ID NO: 707366 - DNA, 20 bp, Homo sapiens
agaattctgctacctcactg

SEQ ID NO: 707367 - DNA, 22 bp, Homo sapiens
agaattctgctacctcactggg

SEQ ID NO: 707368 - DNA, 17 bp, Homo sapiens
agaattcttatgcttat

SEQ ID NO: 707369 - DNA, 16 bp, Homo sapiens
agaattgaaaatgcat

SEQ ID NO: 707370 - DNA, 20 bp, Homo sapiens
cagaaaacaaaagagagaat

SEQ ID NO: 707371 - DNA, 21 bp, Homo sapiens
cagaaaacaacttggcatttc

SEQ ID NO: 707372 - DNA, 23 bp, Homo sapiens
cagaaaacaacttggcatttcta

SEQ ID NO: 707373 - DNA, 22 bp, Homo sapiens
cagaaaacccttgggccagaag

SEQ ID NO: 707374 - DNA, 20 bp, Homo sapiens
cagaaaagaggagaccctgg

SEQ ID NO: 707375 - DNA, 21 bp, Homo sapiens
cagaaaagaggagaccctgga

SEQ ID NO: 707376 - DNA, 17 bp, Homo sapiens
cagaaaagcacctgccg

SEQ ID NO: 707377 - DNA, 12 bp, Homo sapiens
cagaaaagctat

SEQ ID NO: 707378 - DNA, 14 bp, Homo sapiens
cagaaaagctcaga

SEQ ID NO: 707379 - DNA, 16 bp, Homo sapiens
cagaaaagctcagagt

SEQ ID NO: 707380 - DNA, 23 bp, Homo sapiens
cagaaaaggagtggccacagcac

SEQ ID NO: 707381 - DNA, 19 bp, Homo sapiens
cagaaaagtaattttgtca

SEQ ID NO: 707382 - DNA, 21 bp, Homo sapiens
cagaaaataaggcacccatct

SEQ ID NO: 707383 - DNA, 18 bp, Homo sapiens
cagaaaatgttgagaatc

SEQ ID NO: 707384 - DNA, 14 bp, Homo sapiens
cagaaaatttaact

SEQ ID NO: 707385 - DNA, 20 bp, Homo sapiens
cagaaacaaaaacactaaaa

SEQ ID NO: 707386 - DNA, 17 bp, Homo sapiens
cagaaacaatgacatcc

SEQ ID NO: 707387 - DNA, 16 bp, Homo sapiens
cagaaacacccctctg

SEQ ID NO: 707388 - DNA, 17 bp, Homo sapiens
cagaaacacccctctgt

SEQ ID NO: 707389 - DNA, 14 bp, Homo sapiens
cagaaacagctgct

SEQ ID NO: 707390 - DNA, 16 bp, Homo sapiens
cagaaacagctgcttc

SEQ ID NO: 707391 - DNA, 17 bp, Homo sapiens
cagaaacagctgcttct

SEQ ID NO: 707392 - DNA, 18 bp, Homo sapiens
cagaaacagctgcttctc

SEQ ID NO: 707393 - DNA, 18 bp, Homo sapiens
cagaaacaggtgcatctg

SEQ ID NO: 707394 - DNA, 15 bp, Homo sapiens
cagaaacatctctgg

SEQ ID NO: 707395 - DNA, 16 bp, Homo sapiens
cagaaacatctctggc

SEQ ID NO: 707396 - DNA, 13 bp, Homo sapiens
cagaaaccagtta

SEQ ID NO: 707397 - DNA, 19 bp, Homo sapiens
cagaaacccggcttcctgt

SEQ ID NO: 707398 - DNA, 22 bp, Homo sapiens
cagaaacctatcctcactgccc

SEQ ID NO: 707399 - DNA, 21 bp, Homo sapiens
cagaaacctatctcagggagg

SEQ ID NO: 707400 - DNA, 18 bp, Homo sapiens
cagaaaccttcctgctga

SEQ ID NO: 707401 - DNA, 22 bp, Homo sapiens
cagaaacgagatcgggaagcag

SEQ ID NO: 707402 - DNA, 17 bp, Homo sapiens
cagaaacgcatccagca

SEQ ID NO: 707403 - DNA, 15 bp, Homo sapiens
cagaaacgtgttaaa

SEQ ID NO: 707404 - DNA, 17 bp, Homo sapiens
cagaaactcccctgggg

SEQ ID NO: 707405 - DNA, 14 bp, Homo sapiens
cagaaactcctgtt

SEQ ID NO: 707406 - DNA, 17 bp, Homo sapiens
cagaaactcctgtttct

SEQ ID NO: 707407 - DNA, 19 bp, Homo sapiens
cagaaactcctgtttctcc

SEQ ID NO: 707408 - DNA, 19 bp, Homo sapiens
cagaaactgttcccacctg

SEQ ID NO: 707409 - DNA, 16 bp, Homo sapiens
cagaaacttgaactcc

SEQ ID NO: 707410 - DNA, 12 bp, Homo sapiens
cagaaagagctc

SEQ ID NO: 707411 - DNA, 19 bp, Homo sapiens
cagaaagatggatgtgctt

SEQ ID NO: 707412 - DNA, 21 bp, Homo sapiens
cagaaagatggatgtgctttg

SEQ ID NO: 707413 - DNA, 21 bp, Homo sapiens
cagaaagctagatatgcctta

SEQ ID NO: 707414 - DNA, 15 bp, Homo sapiens
cagaaagctgcggat

SEQ ID NO: 707415 - DNA, 15 bp, Homo sapiens
cagaaaggaaaacct

SEQ ID NO: 707416 - DNA, 18 bp, Homo sapiens
cagaaaggaaaacctgaa

SEQ ID NO: 707417 - DNA, 20 bp, Homo sapiens
cagaaaggactcctcctttt

SEQ ID NO: 707418 - DNA, 22 bp, Homo sapiens
cagaaaggatatttaagaaaat

SEQ ID NO: 707419 - DNA, 12 bp, Homo sapiens
cagaaaggattt

SEQ ID NO: 707420 - DNA, 22 bp, Homo sapiens
cagaaaggcaggtttcatttct

SEQ ID NO: 707421 - DNA, 23 bp, Homo sapiens
cagaaaggcaggtttcatttctt

SEQ ID NO: 707422 - DNA, 16 bp, Homo sapiens
cagaaagtcaccagga

SEQ ID NO: 707423 - DNA, 18 bp, Homo sapiens
cagaaagtgataagtgca

SEQ ID NO: 707424 - DNA, 16 bp, Homo sapiens
cagaaagtgcctgaca

SEQ ID NO: 707425 - DNA, 12 bp, Homo sapiens
cagaaataaaat

SEQ ID NO: 707426 - DNA, 17 bp, Homo sapiens
cagaaataacagctggg

SEQ ID NO: 707427 - DNA, 17 bp, Homo sapiens
cagaaatactgctctga

SEQ ID NO: 707428 - DNA, 20 bp, Homo sapiens
cagaaatagacaaaaagtat

SEQ ID NO: 707429 - DNA, 21 bp, Homo sapiens
cagaaatatttgtgacaaaaa

SEQ ID NO: 707430 - DNA, 20 bp, Homo sapiens
cagaaatcacagtcaatgga

SEQ ID NO: 707431 - DNA, 18 bp, Homo sapiens
cagaaatcactgtgaaat

SEQ ID NO: 707432 - DNA, 15 bp, Homo sapiens
cagaaatcagaggag

SEQ ID NO: 707433 - DNA, 16 bp, Homo sapiens
cagaaatcagaggaga

SEQ ID NO: 707434 - DNA, 19 bp, Homo sapiens
cagaaatcaggtgttttaa

SEQ ID NO: 707435 - DNA, 16 bp, Homo sapiens
cagaaatcgagagtgt

SEQ ID NO: 707436 - DNA, 17 bp, Homo sapiens
cagaaatcgagagtgtg

SEQ ID NO: 707437 - DNA, 18 bp, Homo sapiens
cagaaatcggttgctgtt

SEQ ID NO: 707438 - DNA, 19 bp, Homo sapiens
cagaaatctagaagactgt

SEQ ID NO: 707439 - DNA, 21 bp, Homo sapiens
cagaaatgaggagacacacct

SEQ ID NO: 707440 - DNA, 23 bp, Homo sapiens
cagaaatgcccccattctcccag

SEQ ID NO: 707441 - DNA, 14 bp, Homo sapiens
cagaaatgctgctg

SEQ ID NO: 707442 - DNA, 17 bp, Homo sapiens
cagaaatgctgctggcc

SEQ ID NO: 707443 - DNA, 19 bp, Homo sapiens
cagaaatgctgctggccaa

SEQ ID NO: 707444 - DNA, 14 bp, Homo sapiens
cagaaatgggcagt

SEQ ID NO: 707445 - DNA, 21 bp, Homo sapiens
cagaaatgggcagttctccca

SEQ ID NO: 707446 - DNA, 16 bp, Homo sapiens
cagaaatgtaaatgtt

SEQ ID NO: 707447 - DNA, 14 bp, Homo sapiens
cagaaatgtctaaa

SEQ ID NO: 707448 - DNA, 17 bp, Homo sapiens
cagaaatgtgttatcac

SEQ ID NO: 707449 - DNA, 12 bp, Homo sapiens
cagaaattaaaa

SEQ ID NO: 707450 - DNA, 13 bp, Homo sapiens
cagaaattaaaat

SEQ ID NO: 707451 - DNA, 16 bp, Homo sapiens
cagaaattaaaatatt

SEQ ID NO: 707452 - DNA, 16 bp, Homo sapiens
cagaaattagccgggc

SEQ ID NO: 707453 - DNA, 18 bp, Homo sapiens
cagaaattattgggctct

SEQ ID NO: 707454 - DNA, 20 bp, Homo sapiens
cagaaattccaactcctgat

SEQ ID NO: 707455 - DNA, 14 bp, Homo sapiens
cagaaattccagta

SEQ ID NO: 707456 - DNA, 20 bp, Homo sapiens
cagaaattggaacagaatgt

SEQ ID NO: 707457 - DNA, 18 bp, Homo sapiens
cagaaattgtatattgta

SEQ ID NO: 707458 - DNA, 21 bp, Homo sapiens
cagaaattgtatattgtaatt

SEQ ID NO: 707459 - DNA, 23 bp, Homo sapiens
cagaaatttaattcatgtttctt

SEQ ID NO: 707460 - DNA, 15 bp, Homo sapiens
cagaaatttttattt

SEQ ID NO: 707461 - DNA, 19 bp, Homo sapiens
cagaaatttttatttttct

SEQ ID NO: 707462 - DNA, 12 bp, Homo sapiens
cagaacaaatgt

SEQ ID NO: 707463 - DNA, 14 bp, Homo sapiens
cagaacaaatgtgt

SEQ ID NO: 707464 - DNA, 20 bp, Homo sapiens
cagaacaacttgctacttat

SEQ ID NO: 707465 - DNA, 21 bp, Homo sapiens
cagaacaaggttccctctgag

SEQ ID NO: 707466 - DNA, 17 bp, Homo sapiens
cagaacacaaatgtcta

SEQ ID NO: 707467 - DNA, 13 bp, Homo sapiens
cagaacactgcag

SEQ ID NO: 707468 - DNA, 16 bp, Homo sapiens
cagaacagagggccag

SEQ ID NO: 707469 - DNA, 19 bp, Homo sapiens
cagaacagatgctgagcca

SEQ ID NO: 707470 - DNA, 12 bp, Homo sapiens
cagaacagcaga

SEQ ID NO: 707471 - DNA, 14 bp, Homo sapiens
cagaacagcagagg

SEQ ID NO: 707472 - DNA, 21 bp, Homo sapiens
cagaacagcagaggttctttt

SEQ ID NO: 707473 - DNA, 14 bp, Homo sapiens
cagaacagccctcg

SEQ ID NO: 707474 - DNA, 12 bp, Homo sapiens
cagaacagctga

SEQ ID NO: 707475 - DNA, 18 bp, Homo sapiens
cagaacagtatgaatttg

SEQ ID NO: 707476 - DNA, 19 bp, Homo sapiens
cagaacatagacagaagaa

SEQ ID NO: 707477 - DNA, 21 bp, Homo sapiens
cagaacatagacagaagaaac

SEQ ID NO: 707478 - DNA, 17 bp, Homo sapiens
cagaacatcattagaac

SEQ ID NO: 707479 - DNA, 14 bp, Homo sapiens
cagaacatgttaag

SEQ ID NO: 707480 - DNA, 16 bp, Homo sapiens
cagaacattgccttcc

SEQ ID NO: 707481 - DNA, 16 bp, Homo sapiens
cagaaccaaagctcaa

SEQ ID NO: 707482 - DNA, 15 bp, Homo sapiens
cagaaccacaaacaa

SEQ ID NO: 707483 - DNA, 15 bp, Homo sapiens
cagaaccagagggca

SEQ ID NO: 707484 - DNA, 15 bp, Homo sapiens
cagaaccatccatag

SEQ ID NO: 707485 - DNA, 20 bp, Homo sapiens
cagaaccatttaagagactc

SEQ ID NO: 707486 - DNA, 22 bp, Homo sapiens
cagaaccatttaagagactctt

SEQ ID NO: 707487 - DNA, 19 bp, Homo sapiens
cagaaccgagaagggggtg

SEQ ID NO: 707488 - DNA, 15 bp, Homo sapiens
cagaacctcttcccc

SEQ ID NO: 707489 - DNA, 13 bp, Homo sapiens
cagaacctgagct

SEQ ID NO: 707490 - DNA, 14 bp, Homo sapiens
cagaacctgagcta

SEQ ID NO: 707491 - DNA, 22 bp, Homo sapiens
cagaacctgagctattttcctc

SEQ ID NO: 707492 - DNA, 16 bp, Homo sapiens
cagaaccttgtcccag

SEQ ID NO: 707493 - DNA, 16 bp, Homo sapiens
cagaacgcaccccact

SEQ ID NO: 707494 - DNA, 15 bp, Homo sapiens
cagaacgtggctctg

SEQ ID NO: 707495 - DNA, 18 bp, Homo sapiens
agaattgaacccaggagg

SEQ ID NO: 707496 - DNA, 19 bp, Homo sapiens
agaattgaacccaggaggt

SEQ ID NO: 707497 - DNA, 22 bp, Homo sapiens
agaattgaacccaggaggtgga

SEQ ID NO: 707498 - DNA, 16 bp, Homo sapiens
agaattgacattgaaa

SEQ ID NO: 707499 - DNA, 18 bp, Homo sapiens
agaattgacattgaaatc

SEQ ID NO: 707500 - DNA, 18 bp, Homo sapiens
agaattgagtaatggtgt

SEQ ID NO: 707501 - DNA, 15 bp, Homo sapiens
agaattgatcagaat

SEQ ID NO: 707502 - DNA, 21 bp, Homo sapiens
agaattgatcattttcccccc

SEQ ID NO: 707503 - DNA, 19 bp, Homo sapiens
agaattgcacacagatgtg

SEQ ID NO: 707504 - DNA, 17 bp, Homo sapiens
agaattggcataatttg

SEQ ID NO: 707505 - DNA, 20 bp, Homo sapiens
agaattgtatctcatactgt

SEQ ID NO: 707506 - DNA, 15 bp, Homo sapiens
agaattgtcttgcaa

SEQ ID NO: 707507 - DNA, 19 bp, Homo sapiens
agaattgtgtcagactgtt

SEQ ID NO: 707508 - DNA, 23 bp, Homo sapiens
agaattgtgtcagactgtttagt

SEQ ID NO: 707509 - DNA, 14 bp, Homo sapiens
agaatttagggaga

SEQ ID NO: 707510 - DNA, 14 bp, Homo sapiens
agaatttctaagaa

SEQ ID NO: 707511 - DNA, 14 bp, Homo sapiens
agaatttctggtgg

SEQ ID NO: 707512 - DNA, 21 bp, Homo sapiens
agaatttctttgtcattcaag

SEQ ID NO: 707513 - DNA, 19 bp, Homo sapiens
agaatttgaagacttcaaa

SEQ ID NO: 707514 - DNA, 21 bp, Homo sapiens
agaatttgaagacttcaaaat

SEQ ID NO: 707515 - DNA, 12 bp, Homo sapiens
agaatttgagaa

SEQ ID NO: 707516 - DNA, 20 bp, Homo sapiens
agaatttgagaaccttggac

SEQ ID NO: 707517 - DNA, 17 bp, Homo sapiens
agaatttgcatacttac

SEQ ID NO: 707518 - DNA, 15 bp, Homo sapiens
agaatttgtgttgaa

SEQ ID NO: 707519 - DNA, 13 bp, Homo sapiens
agaattttaaatt

SEQ ID NO: 707520 - DNA, 15 bp, Homo sapiens
agaattttaaattat

SEQ ID NO: 707521 - DNA, 18 bp, Homo sapiens
agaattttaaattataac

SEQ ID NO: 707522 - DNA, 13 bp, Homo sapiens
agaattttaggaa

SEQ ID NO: 707523 - DNA, 14 bp, Homo sapiens
agaattttaggaac

SEQ ID NO: 707524 - DNA, 20 bp, Homo sapiens
agaattttcagaccccagcg

SEQ ID NO: 707525 - DNA, 15 bp, Homo sapiens
agaattttcatcccg

SEQ ID NO: 707526 - DNA, 22 bp, Homo sapiens
agaattttgagtattccatgag

SEQ ID NO: 707527 - DNA, 16 bp, Homo sapiens
agaattttgtttcaaa

SEQ ID NO: 707528 - DNA, 23 bp, Homo sapiens
agaattttgttttacttttttaa

SEQ ID NO: 707529 - DNA, 14 bp, Homo sapiens
agaatttttttaat

SEQ ID NO: 707530 - DNA, 23 bp, Homo sapiens
agaatttttttttaaattttatt

SEQ ID NO: 707531 - DNA, 14 bp, Homo sapiens
agacaaaaagtata

SEQ ID NO: 707532 - DNA, 14 bp, Homo sapiens
agacaaaaatcaaa

SEQ ID NO: 707533 - DNA, 16 bp, Homo sapiens
agacaaaagaaactta

SEQ ID NO: 707534 - DNA, 18 bp, Homo sapiens
agacaaaagaaacttacc

SEQ ID NO: 707535 - DNA, 21 bp, Homo sapiens
agacaaaagctgtaaattact

SEQ ID NO: 707536 - DNA, 22 bp, Homo sapiens
agacaaaatggatacataaaga

SEQ ID NO: 707537 - DNA, 15 bp, Homo sapiens
agacaaactttgcat

SEQ ID NO: 707538 - DNA, 19 bp, Homo sapiens
agacaaaggaggaatttac

SEQ ID NO: 707539 - DNA, 23 bp, Homo sapiens
agacaaagtgggtgtgtggcctc

SEQ ID NO: 707540 - DNA, 19 bp, Homo sapiens
agacaaatagaaaatggtc

SEQ ID NO: 707541 - DNA, 12 bp, Homo sapiens
agacaaatattc

SEQ ID NO: 707542 - DNA, 18 bp, Homo sapiens
agacaaatcaacagaagc

SEQ ID NO: 707543 - DNA, 21 bp, Homo sapiens
agacaaatcaacagaagcatt

SEQ ID NO: 707544 - DNA, 20 bp, Homo sapiens
agacaaatcctttctgcccc

SEQ ID NO: 707545 - DNA, 18 bp, Homo sapiens
agacaaattctgtttctt

SEQ ID NO: 707546 - DNA, 19 bp, Homo sapiens
agacaaattctgtttcttg

SEQ ID NO: 707547 - DNA, 17 bp, Homo sapiens
agacaacagcccaggca

SEQ ID NO: 707548 - DNA, 23 bp, Homo sapiens
agacaacaggtaaaacagggcca

SEQ ID NO: 707549 - DNA, 12 bp, Homo sapiens
agacaaccaaaa

SEQ ID NO: 707550 - DNA, 21 bp, Homo sapiens
agacaaccctgcaaaggactg

SEQ ID NO: 707551 - DNA, 17 bp, Homo sapiens
agacaacctgaaattta

SEQ ID NO: 707552 - DNA, 14 bp, Homo sapiens
agacaaccttgtcc

SEQ ID NO: 707553 - DNA, 12 bp, Homo sapiens
agacaactagat

SEQ ID NO: 707554 - DNA, 14 bp, Homo sapiens
agacaactagattt

SEQ ID NO: 707555 - DNA, 17 bp, Homo sapiens
agacaactagatttgtc

SEQ ID NO: 707556 - DNA, 14 bp, Homo sapiens
agacaactggacaa

SEQ ID NO: 707557 - DNA, 14 bp, Homo sapiens
agacaacttctgtt

SEQ ID NO: 707558 - DNA, 17 bp, Homo sapiens
agacaagaaatccctgt

SEQ ID NO: 707559 - DNA, 18 bp, Homo sapiens
agacaagaaatccctgtt

SEQ ID NO: 707560 - DNA, 15 bp, Homo sapiens
agacaagagatggga

SEQ ID NO: 707561 - DNA, 20 bp, Homo sapiens
agacaagatattgtacataa

SEQ ID NO: 707562 - DNA, 22 bp, Homo sapiens
agacaagattttttaattgttt

SEQ ID NO: 707563 - DNA, 23 bp, Homo sapiens
agacaagattttttaattgttta

SEQ ID NO: 707564 - DNA, 14 bp, Homo sapiens
agacaagccctggc

SEQ ID NO: 707565 - DNA, 16 bp, Homo sapiens
agacaagccctggcaa

SEQ ID NO: 707566 - DNA, 13 bp, Homo sapiens
agacaaggtgcta

SEQ ID NO: 707567 - DNA, 18 bp, Homo sapiens
agacaagtaatttcagtg

SEQ ID NO: 707568 - DNA, 23 bp, Homo sapiens
agacaagtgactgtatctgtgta

SEQ ID NO: 707569 - DNA, 21 bp, Homo sapiens
agacaatactccctttaaaga

SEQ ID NO: 707570 - DNA, 19 bp, Homo sapiens
agacaatgacttactgtac

SEQ ID NO: 707571 - DNA, 23 bp, Homo sapiens
agacaatgacttactgtacatga

SEQ ID NO: 707572 - DNA, 20 bp, Homo sapiens
agacaatgcacctagctgtg

SEQ ID NO: 707573 - DNA, 12 bp, Homo sapiens
agacaattagca

SEQ ID NO: 707574 - DNA, 15 bp, Homo sapiens
agacaattagcagaa

SEQ ID NO: 707575 - DNA, 23 bp, Homo sapiens
agacaattgaggtaagttttttg

SEQ ID NO: 707576 - DNA, 13 bp, Homo sapiens
agacaatttgata

SEQ ID NO: 707577 - DNA, 17 bp, Homo sapiens
agacaatttgatacata

SEQ ID NO: 707578 - DNA, 18 bp, Homo sapiens
agacaatttgatacataa

SEQ ID NO: 707579 - DNA, 12 bp, Homo sapiens
agacacaaatgc

SEQ ID NO: 707580 - DNA, 12 bp, Homo sapiens
agacacacacac

SEQ ID NO: 707581 - DNA, 12 bp, Homo sapiens
agacacacagcc

SEQ ID NO: 707582 - DNA, 20 bp, Homo sapiens
agacacacagcctcacgccc

SEQ ID NO: 707583 - DNA, 20 bp, Homo sapiens
agacacagactggcaataaa

SEQ ID NO: 707584 - DNA, 21 bp, Homo sapiens
agacacagactggcaataaac

SEQ ID NO: 707585 - DNA, 22 bp, Homo sapiens
agacacagactggcaataaact

SEQ ID NO: 707586 - DNA, 21 bp, Homo sapiens
agacacagatttttacactaa

SEQ ID NO: 707587 - DNA, 16 bp, Homo sapiens
agacacaggaaaaata

SEQ ID NO: 707588 - DNA, 18 bp, Homo sapiens
agacacaggaaaaataaa

SEQ ID NO: 707589 - DNA, 20 bp, Homo sapiens
agacacaggaaaaataaacg

SEQ ID NO: 707590 - DNA, 15 bp, Homo sapiens
agacacagggacttg

SEQ ID NO: 707591 - DNA, 20 bp, Homo sapiens
agacacagggacttgaagtt

SEQ ID NO: 707592 - DNA, 21 bp, Homo sapiens
agacacagtcatactgtcact

SEQ ID NO: 707593 - DNA, 12 bp, Homo sapiens
agacacatgaag

SEQ ID NO: 707594 - DNA, 23 bp, Homo sapiens
agacacatgaaggtaaataaaaa

SEQ ID NO: 707595 - DNA, 21 bp, Homo sapiens
agacacatgccagggccatgt

SEQ ID NO: 707596 - DNA, 21 bp, Homo sapiens
agacacatgctgaggttttga

SEQ ID NO: 707597 - DNA, 22 bp, Homo sapiens
agacacattgactcctttccaa

SEQ ID NO: 707598 - DNA, 21 bp, Homo sapiens
agacacattgccttctggagc

SEQ ID NO: 707599 - DNA, 14 bp, Homo sapiens
agacaccacctgga

SEQ ID NO: 707600 - DNA, 18 bp, Homo sapiens
agacaccatgtgcaataa

SEQ ID NO: 707601 - DNA, 16 bp, Homo sapiens
agacaccgtggacagc

SEQ ID NO: 707602 - DNA, 19 bp, Homo sapiens
agacaccgttcattcaggc

SEQ ID NO: 707603 - DNA, 14 bp, Homo sapiens
agacacctccccct

SEQ ID NO: 707604 - DNA, 20 bp, Homo sapiens
agacacctgcacctcccccc

SEQ ID NO: 707605 - DNA, 15 bp, Homo sapiens
agacacctggactga

SEQ ID NO: 707606 - DNA, 17 bp, Homo sapiens
agacacctgttcacaga

SEQ ID NO: 707607 - DNA, 22 bp, Homo sapiens
agacaccttggacatcctcctc

SEQ ID NO: 707608 - DNA, 13 bp, Homo sapiens
agacacgcacggc

SEQ ID NO: 707609 - DNA, 22 bp, Homo sapiens
agacacgcacggcagccacagc

SEQ ID NO: 707610 - DNA, 16 bp, Homo sapiens
agacacgctcttctat

SEQ ID NO: 707611 - DNA, 21 bp, Homo sapiens
agacacggagcccagccctcc

SEQ ID NO: 707612 - DNA, 15 bp, Homo sapiens
agacacgttctgatt

SEQ ID NO: 707613 - DNA, 20 bp, Homo sapiens
agacactaacgaaatatcaa

SEQ ID NO: 707614 - DNA, 22 bp, Homo sapiens
agacactaacgacttcagggca

SEQ ID NO: 707615 - DNA, 23 bp, Homo sapiens
agacactccccgaagtcttttgt

SEQ ID NO: 707616 - DNA, 20 bp, Homo sapiens
agacactcctataaggagag

SEQ ID NO: 707617 - DNA, 22 bp, Homo sapiens
agacactgcacagaagacagca

SEQ ID NO: 707618 - DNA, 21 bp, Homo sapiens
agacactgccgacatcagcat

SEQ ID NO: 707619 - DNA, 22 bp, Homo sapiens
cagaacgtggtttgcctgaggc

SEQ ID NO: 707620 - DNA, 14 bp, Homo sapiens
cagaactaaatttt

SEQ ID NO: 707621 - DNA, 20 bp, Homo sapiens
cagaactaaatttttcatag

SEQ ID NO: 707622 - DNA, 22 bp, Homo sapiens
cagaactaaatttttcatagaa

SEQ ID NO: 707623 - DNA, 17 bp, Homo sapiens
cagaactcgatgcactg

SEQ ID NO: 707624 - DNA, 22 bp, Homo sapiens
cagaactcgatgcactgacctg

SEQ ID NO: 707625 - DNA, 20 bp, Homo sapiens
cagaactcttaaaaatgttt

SEQ ID NO: 707626 - DNA, 14 bp, Homo sapiens
cagaactctttcaa

SEQ ID NO: 707627 - DNA, 19 bp, Homo sapiens
cagaactgaagccacttgg

SEQ ID NO: 707628 - DNA, 20 bp, Homo sapiens
cagaactgaagccacttggc

SEQ ID NO: 707629 - DNA, 21 bp, Homo sapiens
cagaactgaagccacttggcc

SEQ ID NO: 707630 - DNA, 15 bp, Homo sapiens
cagaactgagctcct

SEQ ID NO: 707631 - DNA, 24 bp, Homo sapiens
cagaactgagctcctctgggcagg

SEQ ID NO: 707632 - DNA, 21 bp, Homo sapiens
cagaactgccattattttctg

SEQ ID NO: 707633 - DNA, 22 bp, Homo sapiens
cagaactgccattattttctgt

SEQ ID NO: 707634 - DNA, 13 bp, Homo sapiens
cagaactgccccc

SEQ ID NO: 707635 - DNA, 15 bp, Homo sapiens
cagaactgcccccac

SEQ ID NO: 707636 - DNA, 14 bp, Homo sapiens
cagaactgcccttg

SEQ ID NO: 707637 - DNA, 14 bp, Homo sapiens
cagaactggctggg

SEQ ID NO: 707638 - DNA, 23 bp, Homo sapiens
cagaactggctgggcccctgggg

SEQ ID NO: 707639 - DNA, 14 bp, Homo sapiens
cagaacttccctga

SEQ ID NO: 707640 - DNA, 15 bp, Homo sapiens
cagaacttccctgat

SEQ ID NO: 707641 - DNA, 22 bp, Homo sapiens
cagaagaaaaggaaatgaacat

SEQ ID NO: 707642 - DNA, 15 bp, Homo sapiens
cagaagaaataaata

SEQ ID NO: 707643 - DNA, 15 bp, Homo sapiens
cagaagaaccctggc

SEQ ID NO: 707644 - DNA, 20 bp, Homo sapiens
cagaagaagagaagctgctg

SEQ ID NO: 707645 - DNA, 19 bp, Homo sapiens
cagaagaagtgggagcagc

SEQ ID NO: 707646 - DNA, 14 bp, Homo sapiens
cagaagaatattca

SEQ ID NO: 707647 - DNA, 21 bp, Homo sapiens
cagaagactagaggccagggc

SEQ ID NO: 707648 - DNA, 14 bp, Homo sapiens
cagaagatgccctc

SEQ ID NO: 707649 - DNA, 16 bp, Homo sapiens
cagaagatgccctcca

SEQ ID NO: 707650 - DNA, 21 bp, Homo sapiens
cagaagatggtgaagacagaa

SEQ ID NO: 707651 - DNA, 18 bp, Homo sapiens
cagaagcaagccagacct

SEQ ID NO: 707652 - DNA, 13 bp, Homo sapiens
cagaagcagcccc

SEQ ID NO: 707653 - DNA, 21 bp, Homo sapiens
cagaagcagcccctcgaggcc

SEQ ID NO: 707654 - DNA, 23 bp, Homo sapiens
cagaagcagcccctcgaggccta

SEQ ID NO: 707655 - DNA, 23 bp, Homo sapiens
cagaagcagtgtgagcagggctg

SEQ ID NO: 707656 - DNA, 23 bp, Homo sapiens
cagaagcagttgagtcgtcatca

SEQ ID NO: 707657 - DNA, 18 bp, Homo sapiens
cagaagcatattttgctg

SEQ ID NO: 707658 - DNA, 13 bp, Homo sapiens
cagaagcatttgt

SEQ ID NO: 707659 - DNA, 17 bp, Homo sapiens
cagaagcatttgtattt

SEQ ID NO: 707660 - DNA, 22 bp, Homo sapiens
cagaagcatttgtattttgtgt

SEQ ID NO: 707661 - DNA, 15 bp, Homo sapiens
cagaagccagaaggt

SEQ ID NO: 707662 - DNA, 19 bp, Homo sapiens
cagaagccaggagcaaatg

SEQ ID NO: 707663 - DNA, 19 bp, Homo sapiens
cagaagcccatgtcttctg

SEQ ID NO: 707664 - DNA, 20 bp, Homo sapiens
cagaagcccatgtcttctgc

SEQ ID NO: 707665 - DNA, 21 bp, Homo sapiens
cagaagccccacagcctggca

SEQ ID NO: 707666 - DNA, 21 bp, Homo sapiens
cagaagcctccaagcctgcct

SEQ ID NO: 707667 - DNA, 22 bp, Homo sapiens
cagaagcctccaagcctgcctc

SEQ ID NO: 707668 - DNA, 14 bp, Homo sapiens
cagaagcctgaggc

SEQ ID NO: 707669 - DNA, 21 bp, Homo sapiens
cagaagcctggactctgcccc

SEQ ID NO: 707670 - DNA, 12 bp, Homo sapiens
cagaagctggga

SEQ ID NO: 707671 - DNA, 14 bp, Homo sapiens
cagaagcttcagaa

SEQ ID NO: 707672 - DNA, 12 bp, Homo sapiens
cagaagcttcca

SEQ ID NO: 707673 - DNA, 17 bp, Homo sapiens
cagaaggaaaaatgtgt

SEQ ID NO: 707674 - DNA, 20 bp, Homo sapiens
cagaaggaaaaatgtgtaat

SEQ ID NO: 707675 - DNA, 13 bp, Homo sapiens
cagaaggaaatga

SEQ ID NO: 707676 - DNA, 16 bp, Homo sapiens
cagaaggaaatgatgg

SEQ ID NO: 707677 - DNA, 12 bp, Homo sapiens
cagaaggaaggt

SEQ ID NO: 707678 - DNA, 17 bp, Homo sapiens
cagaaggaatcttctca

SEQ ID NO: 707679 - DNA, 23 bp, Homo sapiens
cagaaggagaaggaaaaagaaag

SEQ ID NO: 707680 - DNA, 18 bp, Homo sapiens
cagaaggagaaggaagga

SEQ ID NO: 707681 - DNA, 18 bp, Homo sapiens
cagaaggagggcagagcc

SEQ ID NO: 707682 - DNA, 22 bp, Homo sapiens
cagaaggagggcagagccatgg

SEQ ID NO: 707683 - DNA, 14 bp, Homo sapiens
cagaaggccaagaa

SEQ ID NO: 707684 - DNA, 20 bp, Homo sapiens
cagaaggccccagagagacc

SEQ ID NO: 707685 - DNA, 11 bp, Homo sapiens
cagaagggaat

SEQ ID NO: 707686 - DNA, 17 bp, Homo sapiens
cagaagggaattgctca

SEQ ID NO: 707687 - DNA, 19 bp, Homo sapiens
cagaagggacttcacgaag

SEQ ID NO: 707688 - DNA, 13 bp, Homo sapiens
cagaaggggagct

SEQ ID NO: 707689 - DNA, 16 bp, Homo sapiens
cagaagggggccatga

SEQ ID NO: 707690 - DNA, 20 bp, Homo sapiens
cagaaggggtttggtctggg

SEQ ID NO: 707691 - DNA, 17 bp, Homo sapiens
cagaaggtgtgtccttg

SEQ ID NO: 707692 - DNA, 23 bp, Homo sapiens
cagaaggtgtgtccttgaactga

SEQ ID NO: 707693 - DNA, 20 bp, Homo sapiens
cagaagtaccagactagatg

SEQ ID NO: 707694 - DNA, 14 bp, Homo sapiens
cagaagtcatcttg

SEQ ID NO: 707695 - DNA, 16 bp, Homo sapiens
cagaagtcatcttgct

SEQ ID NO: 707696 - DNA, 22 bp, Homo sapiens
cagaagtcatcttgctaccagt

SEQ ID NO: 707697 - DNA, 15 bp, Homo sapiens
cagaagtctcctcaa

SEQ ID NO: 707698 - DNA, 19 bp, Homo sapiens
cagaagtctggctttgctc

SEQ ID NO: 707699 - DNA, 18 bp, Homo sapiens
cagaagtgagctttgctg

SEQ ID NO: 707700 - DNA, 22 bp, Homo sapiens
cagaagtgagctttgctgctac

SEQ ID NO: 707701 - DNA, 24 bp, Homo sapiens
cagaagtgatttagttgtggaaag

SEQ ID NO: 707702 - DNA, 16 bp, Homo sapiens
cagaagtgtcaccctg

SEQ ID NO: 707703 - DNA, 23 bp, Homo sapiens
cagaagtgtttcagattttttaa

SEQ ID NO: 707704 - DNA, 19 bp, Homo sapiens
cagaagttagtttgtatat

SEQ ID NO: 707705 - DNA, 20 bp, Homo sapiens
cagaagtttgagatcagcct

SEQ ID NO: 707706 - DNA, 23 bp, Homo sapiens
cagaagtttgagatcagcctggg

SEQ ID NO: 707707 - DNA, 20 bp, Homo sapiens
cagaagtttgcaaataggca

SEQ ID NO: 707708 - DNA, 23 bp, Homo sapiens
cagaataaaagttcctctccctt

SEQ ID NO: 707709 - DNA, 19 bp, Homo sapiens
cagaataagttattgcagt

SEQ ID NO: 707710 - DNA, 14 bp, Homo sapiens
cagaataatgaatg

SEQ ID NO: 707711 - DNA, 23 bp, Homo sapiens
cagaataatgaatggactcaaac

SEQ ID NO: 707712 - DNA, 18 bp, Homo sapiens
cagaataatggaaacatt

SEQ ID NO: 707713 - DNA, 17 bp, Homo sapiens
cagaatactgggttctt

SEQ ID NO: 707714 - DNA, 21 bp, Homo sapiens
cagaatactgggttcttagtt

SEQ ID NO: 707715 - DNA, 14 bp, Homo sapiens
cagaatactggtct

SEQ ID NO: 707716 - DNA, 15 bp, Homo sapiens
cagaatactggtctc

SEQ ID NO: 707717 - DNA, 22 bp, Homo sapiens
cagaatagaatacattgataca

SEQ ID NO: 707718 - DNA, 22 bp, Homo sapiens
cagaatagccacatttggaata

SEQ ID NO: 707719 - DNA, 23 bp, Homo sapiens
cagaatagggtggcagaagtgtc

SEQ ID NO: 707720 - DNA, 15 bp, Homo sapiens
cagaatatctgggat

SEQ ID NO: 707721 - DNA, 13 bp, Homo sapiens
cagaatattttta

SEQ ID NO: 707722 - DNA, 21 bp, Homo sapiens
cagaatatttttatatttcct

SEQ ID NO: 707723 - DNA, 13 bp, Homo sapiens
cagaatcagtgtt

SEQ ID NO: 707724 - DNA, 16 bp, Homo sapiens
cagaatcatggagaaa

SEQ ID NO: 707725 - DNA, 20 bp, Homo sapiens
cagaatcatggagaaaatgg

SEQ ID NO: 707726 - DNA, 20 bp, Homo sapiens
cagaatcattgcttatgaca

SEQ ID NO: 707727 - DNA, 19 bp, Homo sapiens
cagaatccaagtgaacact

SEQ ID NO: 707728 - DNA, 17 bp, Homo sapiens
cagaatccataaatgtg

SEQ ID NO: 707729 - DNA, 14 bp, Homo sapiens
cagaatcccagccg

SEQ ID NO: 707730 - DNA, 13 bp, Homo sapiens
cagaatcccttaa

SEQ ID NO: 707731 - DNA, 18 bp, Homo sapiens
cagaatctacccaaagga

SEQ ID NO: 707732 - DNA, 17 bp, Homo sapiens
cagaatctcaaataact

SEQ ID NO: 707733 - DNA, 18 bp, Homo sapiens
cagaatctcaaataacta

SEQ ID NO: 707734 - DNA, 14 bp, Homo sapiens
cagaatctccatcc

SEQ ID NO: 707735 - DNA, 16 bp, Homo sapiens
cagaatctgctgttgc

SEQ ID NO: 707736 - DNA, 17 bp, Homo sapiens
cagaatctgctgttgcc

SEQ ID NO: 707737 - DNA, 20 bp, Homo sapiens
cagaatctgctgttgccata

SEQ ID NO: 707738 - DNA, 21 bp, Homo sapiens
cagaatctgctgttgccatag

SEQ ID NO: 707739 - DNA, 22 bp, Homo sapiens
cagaatctgctgttgccatagc

SEQ ID NO: 707740 - DNA, 23 bp, Homo sapiens
cagaatctgctgttgccatagcc

SEQ ID NO: 707741 - DNA, 14 bp, Homo sapiens
cagaatcttctggg

SEQ ID NO: 707742 - DNA, 17 bp, Homo sapiens
cagaatcttgactttct

SEQ ID NO: 707743 - DNA, 13 bp, Homo sapiens
cagaatcttgtat

SEQ ID NO: 707744 - DNA, 16 bp, Homo sapiens
cagaatcttgtatttg

SEQ ID NO: 707745 - DNA, 19 bp, Homo sapiens
cagaatcttgttttgaaaa

SEQ ID NO: 707746 - DNA, 13 bp, Homo sapiens
cagaatctttgtt

SEQ ID NO: 707747 - DNA, 18 bp, Homo sapiens
cagaatgaacccataggg

SEQ ID NO: 707748 - DNA, 18 bp, Homo sapiens
cagaatgaggaataataa

SEQ ID NO: 707749 - DNA, 14 bp, Homo sapiens
cagaatgcattaaa

SEQ ID NO: 707750 - DNA, 12 bp, Homo sapiens
cagaatgctcag

SEQ ID NO: 707751 - DNA, 18 bp, Homo sapiens
cagaatgctgaactcctt

SEQ ID NO: 707752 - DNA, 15 bp, Homo sapiens
cagaatggaagagag

SEQ ID NO: 707753 - DNA, 19 bp, Homo sapiens
cagaatggaagagagaaag

SEQ ID NO: 707754 - DNA, 19 bp, Homo sapiens
cagaatggaatccatctgt

SEQ ID NO: 707755 - DNA, 15 bp, Homo sapiens
cagaatggagaaagt

SEQ ID NO: 707756 - DNA, 22 bp, Homo sapiens
cagaatggatttgttaaactag

SEQ ID NO: 707757 - DNA, 22 bp, Homo sapiens
cagaatgtaagaaaacaaaatc

SEQ ID NO: 707758 - DNA, 14 bp, Homo sapiens
cagaatgtatctgt

SEQ ID NO: 707759 - DNA, 17 bp, Homo sapiens
cagaatgtatctgtgaa

SEQ ID NO: 707760 - DNA, 19 bp, Homo sapiens
cagaatgttaatttatttt

SEQ ID NO: 707761 - DNA, 15 bp, Homo sapiens
cagaatgttgtactt

SEQ ID NO: 707762 - DNA, 16 bp, Homo sapiens
cagaatgttttactgt

SEQ ID NO: 707763 - DNA, 17 bp, Homo sapiens
cagaatgtttttaaaat

SEQ ID NO: 707764 - DNA, 23 bp, Homo sapiens
cagaattaaacttttaattcatt

SEQ ID NO: 707765 - DNA, 23 bp, Homo sapiens
cagaattaagcagaacactgcag

SEQ ID NO: 707766 - DNA, 16 bp, Homo sapiens
cagaattatccattac

SEQ ID NO: 707767 - DNA, 13 bp, Homo sapiens
cagaattattttt

SEQ ID NO: 707768 - DNA, 22 bp, Homo sapiens
cagaattcattcatacttaaaa

SEQ ID NO: 707769 - DNA, 13 bp, Homo sapiens
cagaattcccttg

SEQ ID NO: 707770 - DNA, 21 bp, Homo sapiens
cagaattcccttgaattgtgt

SEQ ID NO: 707771 - DNA, 16 bp, Homo sapiens
cagaattcggtgtgct

SEQ ID NO: 707772 - DNA, 11 bp, Homo sapiens
cagaattctca

SEQ ID NO: 707773 - DNA, 23 bp, Homo sapiens
cagaattgctacaatcccaaagc

SEQ ID NO: 707774 - DNA, 16 bp, Homo sapiens
cagaattggtaaaaac

SEQ ID NO: 707775 - DNA, 14 bp, Homo sapiens
cagaattgtcctca

SEQ ID NO: 707776 - DNA, 13 bp, Homo sapiens
cagaatttgaatt

SEQ ID NO: 707777 - DNA, 12 bp, Homo sapiens
cagaatttgaga

SEQ ID NO: 707778 - DNA, 22 bp, Homo sapiens
cagaatttggaaatcctagttt

SEQ ID NO: 707779 - DNA, 23 bp, Homo sapiens
cagaattttaggaacttcagaga

SEQ ID NO: 707780 - DNA, 15 bp, Homo sapiens
cagacaaaatgaaag

SEQ ID NO: 707781 - DNA, 22 bp, Homo sapiens
cagacaaatgtggttacacact

SEQ ID NO: 707782 - DNA, 16 bp, Homo sapiens
cagacaacaccttcct

SEQ ID NO: 707783 - DNA, 13 bp, Homo sapiens
cagacaacagaag

SEQ ID NO: 707784 - DNA, 16 bp, Homo sapiens
cagacaacagaagtca

SEQ ID NO: 707785 - DNA, 17 bp, Homo sapiens
cagacaacagaagtcat

SEQ ID NO: 707786 - DNA, 22 bp, Homo sapiens
cagacaacagaagtcatgaagc

SEQ ID NO: 707787 - DNA, 17 bp, Homo sapiens
cagacaacagcccaggc

SEQ ID NO: 707788 - DNA, 17 bp, Homo sapiens
cagacaaccttgtccca

SEQ ID NO: 707789 - DNA, 22 bp, Homo sapiens
cagacaacttctgtttcttctc

SEQ ID NO: 707790 - DNA, 14 bp, Homo sapiens
cagacaagagctgc

SEQ ID NO: 707791 - DNA, 16 bp, Homo sapiens
cagacaagagctgctg

SEQ ID NO: 707792 - DNA, 20 bp, Homo sapiens
cagacaagcactattttata

SEQ ID NO: 707793 - DNA, 23 bp, Homo sapiens
cagacaaggagagcggaggagga

SEQ ID NO: 707794 - DNA, 21 bp, Homo sapiens
cagacaagtgactgtatctgt

SEQ ID NO: 707795 - DNA, 22 bp, Homo sapiens
cagacaatatgtgagtgccttt

SEQ ID NO: 707796 - DNA, 14 bp, Homo sapiens
cagacacacacacg

SEQ ID NO: 707797 - DNA, 18 bp, Homo sapiens
cagacacacacacgcacg

SEQ ID NO: 707798 - DNA, 18 bp, Homo sapiens
cagacacacgcacacaca

SEQ ID NO: 707799 - DNA, 23 bp, Homo sapiens
cagacacagctcttccagggcag

SEQ ID NO: 707800 - DNA, 15 bp, Homo sapiens
cagacacaggaaaaa

SEQ ID NO: 707801 - DNA, 16 bp, Homo sapiens
cagacacaggaaaaat

SEQ ID NO: 707802 - DNA, 17 bp, Homo sapiens
cagacacaggaaaaata

SEQ ID NO: 707803 - DNA, 21 bp, Homo sapiens
cagacacagggacttgaagtt

SEQ ID NO: 707804 - DNA, 22 bp, Homo sapiens
cagacacattgtcatcagaggg

SEQ ID NO: 707805 - DNA, 16 bp, Homo sapiens
cagacaccatgtgcaa

SEQ ID NO: 707806 - DNA, 23 bp, Homo sapiens
cagacaccgtttgtcccccgggg

SEQ ID NO: 707807 - DNA, 14 bp, Homo sapiens
cagacaccttggac

SEQ ID NO: 707808 - DNA, 22 bp, Homo sapiens
cagacacggatctgagaatctt

SEQ ID NO: 707809 - DNA, 17 bp, Homo sapiens
cagacactacatgatga

SEQ ID NO: 707810 - DNA, 19 bp, Homo sapiens
cagacactctgctctgccc

SEQ ID NO: 707811 - DNA, 13 bp, Homo sapiens
cagacactgagct

SEQ ID NO: 707812 - DNA, 21 bp, Homo sapiens
cagacactgagcttctgagac

SEQ ID NO: 707813 - DNA, 21 bp, Homo sapiens
cagacactgccgacatcagca

SEQ ID NO: 707814 - DNA, 22 bp, Homo sapiens
cagacactgccgacatcagcat

SEQ ID NO: 707815 - DNA, 24 bp, Homo sapiens
cagacactgcgccccgcctgacct

SEQ ID NO: 707816 - DNA, 22 bp, Homo sapiens
cagacactggtttgaagaatgt

SEQ ID NO: 707817 - DNA, 14 bp, Homo sapiens
cagacactttggaa

SEQ ID NO: 707818 - DNA, 17 bp, Homo sapiens
cagacagaagtctcctc

SEQ ID NO: 707819 - DNA, 18 bp, Homo sapiens
cagacagaagtctcctca

SEQ ID NO: 707820 - DNA, 16 bp, Homo sapiens
cagacagagactttaa

SEQ ID NO: 707821 - DNA, 17 bp, Homo sapiens
cagacagagccaggaga

SEQ ID NO: 707822 - DNA, 20 bp, Homo sapiens
cagacagagccaggagaagc

SEQ ID NO: 707823 - DNA, 19 bp, Homo sapiens
cagacagatgttgggagga

SEQ ID NO: 707824 - DNA, 17 bp, Homo sapiens
cagacagcagctcaggc

SEQ ID NO: 707825 - DNA, 15 bp, Homo sapiens
cagacagcaggcagc

SEQ ID NO: 707826 - DNA, 20 bp, Homo sapiens
cagacaggccctccctgtct

SEQ ID NO: 707827 - DNA, 14 bp, Homo sapiens
cagacaggctctta

SEQ ID NO: 707828 - DNA, 22 bp, Homo sapiens
cagacaggctcttagcagcttc

SEQ ID NO: 707829 - DNA, 15 bp, Homo sapiens
cagacagggtctgaa

SEQ ID NO: 707830 - DNA, 22 bp, Homo sapiens
cagacagggtgggcttcctgcc

SEQ ID NO: 707831 - DNA, 16 bp, Homo sapiens
cagacaggtttaaaag

SEQ ID NO: 707832 - DNA, 17 bp, Homo sapiens
cagacaggtttaaaagt

SEQ ID NO: 707833 - DNA, 14 bp, Homo sapiens
cagacagtctgtta

SEQ ID NO: 707834 - DNA, 17 bp, Homo sapiens
cagacatacagctgcct

SEQ ID NO: 707835 - DNA, 21 bp, Homo sapiens
cagacatacagctgcctacct

SEQ ID NO: 707836 - DNA, 17 bp, Homo sapiens
cagacatacatagacat

SEQ ID NO: 707837 - DNA, 21 bp, Homo sapiens
cagacatatccaaagggaata

SEQ ID NO: 707838 - DNA, 22 bp, Homo sapiens
cagacatccatgtttgtaaaac

SEQ ID NO: 707839 - DNA, 19 bp, Homo sapiens
cagacatctccagtgtgcc

SEQ ID NO: 707840 - DNA, 20 bp, Homo sapiens
cagacatctccagtgtgcca

SEQ ID NO: 707841 - DNA, 15 bp, Homo sapiens
cagacatctctgcac

SEQ ID NO: 707842 - DNA, 15 bp, Homo sapiens
cagacatctctggag

SEQ ID NO: 707843 - DNA, 18 bp, Homo sapiens
cagacatctctggagcca

SEQ ID NO: 707844 - DNA, 20 bp, Homo sapiens
cagacatctgaggttttatt

SEQ ID NO: 707845 - DNA, 22 bp, Homo sapiens
cagacatgttttccgtgaaaac

SEQ ID NO: 707846 - DNA, 14 bp, Homo sapiens
cagacattctcaaa

SEQ ID NO: 707847 - DNA, 16 bp, Homo sapiens
cagacattctcaaagc

SEQ ID NO: 707848 - DNA, 18 bp, Homo sapiens
cagacattgctctcagtg

SEQ ID NO: 707849 - DNA, 22 bp, Homo sapiens
cagacattgctctcagtgcttt

SEQ ID NO: 707850 - DNA, 16 bp, Homo sapiens
cagaccaaccctggga

SEQ ID NO: 707851 - DNA, 17 bp, Homo sapiens
cagaccaaccctgggac

SEQ ID NO: 707852 - DNA, 14 bp, Homo sapiens
cagaccacaaaact

SEQ ID NO: 707853 - DNA, 20 bp, Homo sapiens
cagaccacaaaacttttcta

SEQ ID NO: 707854 - DNA, 22 bp, Homo sapiens
cagaccacgcccgtcctgcctg

SEQ ID NO: 707855 - DNA, 13 bp, Homo sapiens
cagaccactgtct

SEQ ID NO: 707856 - DNA, 15 bp, Homo sapiens
cagaccactgtctcc

SEQ ID NO: 707857 - DNA, 16 bp, Homo sapiens
cagaccagagctgtct

SEQ ID NO: 707858 - DNA, 18 bp, Homo sapiens
cagaccagagctgtctga

SEQ ID NO: 707859 - DNA, 13 bp, Homo sapiens
cagaccagctctt

SEQ ID NO: 707860 - DNA, 16 bp, Homo sapiens
cagaccataatgttac

SEQ ID NO: 707861 - DNA, 23 bp, Homo sapiens
cagaccatgaagtaaattatgta

SEQ ID NO: 707862 - DNA, 21 bp, Homo sapiens
cagaccatggacactacaccc

SEQ ID NO: 707863 - DNA, 22 bp, Homo sapiens
cagaccatggacactacaccca

SEQ ID NO: 707864 - DNA, 22 bp, Homo sapiens
cagacccaactcgcctgtggac

SEQ ID NO: 707865 - DNA, 19 bp, Homo sapiens
cagacccacctggagcccg

SEQ ID NO: 707866 - DNA, 13 bp, Homo sapiens
agacactggcccc

SEQ ID NO: 707867 - DNA, 20 bp, Homo sapiens
agacactgtgagagttgtct

SEQ ID NO: 707868 - DNA, 21 bp, Homo sapiens
agacactgtgagagttgtctc

SEQ ID NO: 707869 - DNA, 19 bp, Homo sapiens
agacactgttgataaaaac

SEQ ID NO: 707870 - DNA, 17 bp, Homo sapiens
agacactgttgcaaagg

SEQ ID NO: 707871 - DNA, 20 bp, Homo sapiens
agacactgtttacaagaaaa

SEQ ID NO: 707872 - DNA, 22 bp, Homo sapiens
agacacttccccttgtctccct

SEQ ID NO: 707873 - DNA, 14 bp, Homo sapiens
agacacttgctccc

SEQ ID NO: 707874 - DNA, 13 bp, Homo sapiens
agacactttggaa

SEQ ID NO: 707875 - DNA, 22 bp, Homo sapiens
agacactttggaatctaaccac

SEQ ID NO: 707876 - DNA, 11 bp, Homo sapiens
agacagaaaag

SEQ ID NO: 707877 - DNA, 20 bp, Homo sapiens
agacagaaaagtgcctgagc

SEQ ID NO: 707878 - DNA, 15 bp, Homo sapiens
agacagaaaccaagc

SEQ ID NO: 707879 - DNA, 18 bp, Homo sapiens
agacagaaactggattaa

SEQ ID NO: 707880 - DNA, 17 bp, Homo sapiens
agacagaacttgaatgt

SEQ ID NO: 707881 - DNA, 12 bp, Homo sapiens
agacagaagaaa

SEQ ID NO: 707882 - DNA, 15 bp, Homo sapiens
agacagaagcaggct

SEQ ID NO: 707883 - DNA, 16 bp, Homo sapiens
agacagaagcaggctg

SEQ ID NO: 707884 - DNA, 17 bp, Homo sapiens
agacagaagcaggctgg

SEQ ID NO: 707885 - DNA, 20 bp, Homo sapiens
agacagaagcaggctggagg

SEQ ID NO: 707886 - DNA, 18 bp, Homo sapiens
agacagaagctgaagtgc

SEQ ID NO: 707887 - DNA, 16 bp, Homo sapiens
agacagaagtctcctc

SEQ ID NO: 707888 - DNA, 20 bp, Homo sapiens
agacagaatataaaaactcc

SEQ ID NO: 707889 - DNA, 15 bp, Homo sapiens
agacagaatgtatct

SEQ ID NO: 707890 - DNA, 18 bp, Homo sapiens
agacagaatgtatctgtg

SEQ ID NO: 707891 - DNA, 20 bp, Homo sapiens
agacagaatgtatctgtgaa

SEQ ID NO: 707892 - DNA, 14 bp, Homo sapiens
agacagaatgtcac

SEQ ID NO: 707893 - DNA, 14 bp, Homo sapiens
agacagacatacat

SEQ ID NO: 707894 - DNA, 15 bp, Homo sapiens
agacagacatacata

SEQ ID NO: 707895 - DNA, 18 bp, Homo sapiens
agacagacccagtgagtg

SEQ ID NO: 707896 - DNA, 16 bp, Homo sapiens
agacagacgcatgtgg

SEQ ID NO: 707897 - DNA, 16 bp, Homo sapiens
agacagagacgcagga

SEQ ID NO: 707898 - DNA, 19 bp, Homo sapiens
agacagagccaggagaagc

SEQ ID NO: 707899 - DNA, 21 bp, Homo sapiens
agacagagccaggagaagctc

SEQ ID NO: 707900 - DNA, 23 bp, Homo sapiens
agacagaggaaagggctggctcc

SEQ ID NO: 707901 - DNA, 22 bp, Homo sapiens
agacagaggggatggggataga

SEQ ID NO: 707902 - DNA, 23 bp, Homo sapiens
agacagagtccctggctcctcta

SEQ ID NO: 707903 - DNA, 14 bp, Homo sapiens
agacagatcactcc

SEQ ID NO: 707904 - DNA, 17 bp, Homo sapiens
agacagatcactcctgg

SEQ ID NO: 707905 - DNA, 16 bp, Homo sapiens
agacagatgccccaga

SEQ ID NO: 707906 - DNA, 16 bp, Homo sapiens
agacagatgttgggag

SEQ ID NO: 707907 - DNA, 14 bp, Homo sapiens
agacagcagcctgt

SEQ ID NO: 707908 - DNA, 14 bp, Homo sapiens
agacagcaggcagc

SEQ ID NO: 707909 - DNA, 21 bp, Homo sapiens
agacagcattgatctcctgga

SEQ ID NO: 707910 - DNA, 22 bp, Homo sapiens
agacagccttcacttttctgag

SEQ ID NO: 707911 - DNA, 17 bp, Homo sapiens
agacagctccaccctgg

SEQ ID NO: 707912 - DNA, 20 bp, Homo sapiens
agacagctgatacttcattt

SEQ ID NO: 707913 - DNA, 14 bp, Homo sapiens
agacagcttctctg

SEQ ID NO: 707914 - DNA, 15 bp, Homo sapiens
agacagcttctctgc

SEQ ID NO: 707915 - DNA, 16 bp, Homo sapiens
agacagcttctctgca

SEQ ID NO: 707916 - DNA, 18 bp, Homo sapiens
agacaggaaaatcctctg

SEQ ID NO: 707917 - DNA, 20 bp, Homo sapiens
agacaggaaaatcctctggc

SEQ ID NO: 707918 - DNA, 20 bp, Homo sapiens
agacaggacagaatgtgttc

SEQ ID NO: 707919 - DNA, 18 bp, Homo sapiens
agacaggacctgactatt

SEQ ID NO: 707920 - DNA, 14 bp, Homo sapiens
agacaggagcctag

SEQ ID NO: 707921 - DNA, 14 bp, Homo sapiens
agacaggagggcaa

SEQ ID NO: 707922 - DNA, 19 bp, Homo sapiens
agacaggagggcaagggcc

SEQ ID NO: 707923 - DNA, 21 bp, Homo sapiens
agacaggctctgaggggcacg

SEQ ID NO: 707924 - DNA, 20 bp, Homo sapiens
agacaggctcttagcagctt

SEQ ID NO: 707925 - DNA, 17 bp, Homo sapiens
agacaggctggcattct

SEQ ID NO: 707926 - DNA, 19 bp, Homo sapiens
agacagggtaggaaagggc

SEQ ID NO: 707927 - DNA, 19 bp, Homo sapiens
agacagggtcaaagtgttt

SEQ ID NO: 707928 - DNA, 15 bp, Homo sapiens
agacagggtctcact

SEQ ID NO: 707929 - DNA, 22 bp, Homo sapiens
agacagggtctcactctgtcgc

SEQ ID NO: 707930 - DNA, 19 bp, Homo sapiens
agacagggtgggcttcctg

SEQ ID NO: 707931 - DNA, 21 bp, Homo sapiens
agacagggtgggcttcctgcc

SEQ ID NO: 707932 - DNA, 21 bp, Homo sapiens
agacagggtttggctgtgtct

SEQ ID NO: 707933 - DNA, 22 bp, Homo sapiens
agacagggtttggctgtgtcta

SEQ ID NO: 707934 - DNA, 18 bp, Homo sapiens
agacagtatatttatagt

SEQ ID NO: 707935 - DNA, 22 bp, Homo sapiens
agacagtatgagtcaatgtgca

SEQ ID NO: 707936 - DNA, 15 bp, Homo sapiens
agacagtcctttccc

SEQ ID NO: 707937 - DNA, 22 bp, Homo sapiens
agacagtcgctcagtctgttca

SEQ ID NO: 707938 - DNA, 19 bp, Homo sapiens
agacagtgaagtaaaattg

SEQ ID NO: 707939 - DNA, 16 bp, Homo sapiens
agacagtgctgccctg

SEQ ID NO: 707940 - DNA, 19 bp, Homo sapiens
agacagtgctgccctgcga

SEQ ID NO: 707941 - DNA, 13 bp, Homo sapiens
agacagtgtacaa

SEQ ID NO: 707942 - DNA, 14 bp, Homo sapiens
agacagttcaagaa

SEQ ID NO: 707943 - DNA, 14 bp, Homo sapiens
agacataaaacttt

SEQ ID NO: 707944 - DNA, 15 bp, Homo sapiens
agacataaaacttta

SEQ ID NO: 707945 - DNA, 20 bp, Homo sapiens
agacataaaactttaaaagg

SEQ ID NO: 707946 - DNA, 21 bp, Homo sapiens
agacatacagagatatacaaa

SEQ ID NO: 707947 - DNA, 15 bp, Homo sapiens
agacatactgcttga

SEQ ID NO: 707948 - DNA, 21 bp, Homo sapiens
agacatagccgattctctgcc

SEQ ID NO: 707949 - DNA, 18 bp, Homo sapiens
agacatccataaagaagc

SEQ ID NO: 707950 - DNA, 19 bp, Homo sapiens
agacatccataaagaagca

SEQ ID NO: 707951 - DNA, 17 bp, Homo sapiens
agacatccatgtttgta

SEQ ID NO: 707952 - DNA, 22 bp, Homo sapiens
agacatccatgtttgtaaaact

SEQ ID NO: 707953 - DNA, 22 bp, Homo sapiens
agacatctcaggatttcaccag

SEQ ID NO: 707954 - DNA, 16 bp, Homo sapiens
agacatctctggagcc

SEQ ID NO: 707955 - DNA, 19 bp, Homo sapiens
agacatctctggagccaga

SEQ ID NO: 707956 - DNA, 22 bp, Homo sapiens
agacatctctggagccagagag

SEQ ID NO: 707957 - DNA, 14 bp, Homo sapiens
agacatctgcctgt

SEQ ID NO: 707958 - DNA, 18 bp, Homo sapiens
agacatctgcctgtaatt

SEQ ID NO: 707959 - DNA, 12 bp, Homo sapiens
agacatctgtag

SEQ ID NO: 707960 - DNA, 21 bp, Homo sapiens
agacatgagaaagggagagga

SEQ ID NO: 707961 - DNA, 16 bp, Homo sapiens
agacatgagccactgc

SEQ ID NO: 707962 - DNA, 15 bp, Homo sapiens
agacatggaccagca

SEQ ID NO: 707963 - DNA, 17 bp, Homo sapiens
agacatggaccagcatc

SEQ ID NO: 707964 - DNA, 18 bp, Homo sapiens
agacatggagactcctgc

SEQ ID NO: 707965 - DNA, 15 bp, Homo sapiens
agacatggagatgta

SEQ ID NO: 707966 - DNA, 16 bp, Homo sapiens
agacatgtaggtgttt

SEQ ID NO: 707967 - DNA, 17 bp, Homo sapiens
agacatgtgacatttat

SEQ ID NO: 707968 - DNA, 18 bp, Homo sapiens
agacatgttttccgtgaa

SEQ ID NO: 707969 - DNA, 22 bp, Homo sapiens
agacattaactcattagactgg

SEQ ID NO: 707970 - DNA, 14 bp, Homo sapiens
agacattctcacat

SEQ ID NO: 707971 - DNA, 13 bp, Homo sapiens
agacattctggtg

SEQ ID NO: 707972 - DNA, 16 bp, Homo sapiens
agacattcttttaatg

SEQ ID NO: 707973 - DNA, 23 bp, Homo sapiens
agacattgctctatgtctgcctt

SEQ ID NO: 707974 - DNA, 16 bp, Homo sapiens
agacattgtcaataaa

SEQ ID NO: 707975 - DNA, 15 bp, Homo sapiens
agacatttcaaaatt

SEQ ID NO: 707976 - DNA, 19 bp, Homo sapiens
agacatttcaaaattaata

SEQ ID NO: 707977 - DNA, 13 bp, Homo sapiens
agacatttgctga

SEQ ID NO: 707978 - DNA, 19 bp, Homo sapiens
agacatttgctgaactcag

SEQ ID NO: 707979 - DNA, 20 bp, Homo sapiens
agacatttgctgaactcagc

SEQ ID NO: 707980 - DNA, 22 bp, Homo sapiens
agacatttgctgaactcagcac

SEQ ID NO: 707981 - DNA, 23 bp, Homo sapiens
agacatttgctgaactcagcaca

SEQ ID NO: 707982 - DNA, 15 bp, Homo sapiens
agacatttgtatatt

SEQ ID NO: 707983 - DNA, 18 bp, Homo sapiens
agacattttgttacataa

SEQ ID NO: 707984 - DNA, 16 bp, Homo sapiens
agaccaaacagtgctg

SEQ ID NO: 707985 - DNA, 19 bp, Homo sapiens
agaccaaagcaaagaaaat

SEQ ID NO: 707986 - DNA, 15 bp, Homo sapiens
agaccaaatctcagt

SEQ ID NO: 707987 - DNA, 21 bp, Homo sapiens
agaccaacgttactcagggct

SEQ ID NO: 707988 - DNA, 17 bp, Homo sapiens
agaccaagactctgaaa

SEQ ID NO: 707989 - DNA, 14 bp, Homo sapiens
agaccaaggcggga

SEQ ID NO: 707990 - DNA, 12 bp, Homo sapiens
cagacccagaga

SEQ ID NO: 707991 - DNA, 13 bp, Homo sapiens
cagacccagagcc

SEQ ID NO: 707992 - DNA, 16 bp, Homo sapiens
cagacccagaggccct

SEQ ID NO: 707993 - DNA, 15 bp, Homo sapiens
cagacccagcttaga

SEQ ID NO: 707994 - DNA, 20 bp, Homo sapiens
cagacccagcttagagttct

SEQ ID NO: 707995 - DNA, 19 bp, Homo sapiens
cagacccaggacccccgag

SEQ ID NO: 707996 - DNA, 15 bp, Homo sapiens
cagacccagtcccac

SEQ ID NO: 707997 - DNA, 17 bp, Homo sapiens
cagacccagtcccacac

SEQ ID NO: 707998 - DNA, 12 bp, Homo sapiens
cagacccagtga

SEQ ID NO: 707999 - DNA, 17 bp, Homo sapiens
cagacccatgtgctggg

SEQ ID NO: 708000 - DNA, 18 bp, Homo sapiens
cagacccatgtgctggga

SEQ ID NO: 708001 - DNA, 18 bp, Homo sapiens
cagaccccacgctgacca

SEQ ID NO: 708002 - DNA, 14 bp, Homo sapiens
cagaccccagcggc

SEQ ID NO: 708003 - DNA, 16 bp, Homo sapiens
cagaccccagcggctg

SEQ ID NO: 708004 - DNA, 13 bp, Homo sapiens
cagaccccagggc

SEQ ID NO: 708005 - DNA, 20 bp, Homo sapiens
cagacccccaccccttcccc

SEQ ID NO: 708006 - DNA, 22 bp, Homo sapiens
cagacccccaccccttccccac

SEQ ID NO: 708007 - DNA, 18 bp, Homo sapiens
cagacccccagcaaccct

SEQ ID NO: 708008 - DNA, 15 bp, Homo sapiens
cagacccccagtgta

SEQ ID NO: 708009 - DNA, 13 bp, Homo sapiens
cagaccccctgag

SEQ ID NO: 708010 - DNA, 13 bp, Homo sapiens
cagaccccgcccc

SEQ ID NO: 708011 - DNA, 20 bp, Homo sapiens
cagaccccgtggctctggga

SEQ ID NO: 708012 - DNA, 22 bp, Homo sapiens
cagaccccgtggctctgggaga

SEQ ID NO: 708013 - DNA, 13 bp, Homo sapiens
cagacccctctca

SEQ ID NO: 708014 - DNA, 17 bp, Homo sapiens
cagacccctctggccag

SEQ ID NO: 708015 - DNA, 20 bp, Homo sapiens
cagacccctctggccaggat

SEQ ID NO: 708016 - DNA, 22 bp, Homo sapiens
cagacccctctggccaggatgg

SEQ ID NO: 708017 - DNA, 12 bp, Homo sapiens
cagacccctgcc

SEQ ID NO: 708018 - DNA, 19 bp, Homo sapiens
cagacccctgcctggactt

SEQ ID NO: 708019 - DNA, 22 bp, Homo sapiens
cagacccctggcttttcactgc

SEQ ID NO: 708020 - DNA, 17 bp, Homo sapiens
cagaccctaccccacca

SEQ ID NO: 708021 - DNA, 20 bp, Homo sapiens
cagaccctgaacccacacct

SEQ ID NO: 708022 - DNA, 17 bp, Homo sapiens
cagaccgcagagaggct

SEQ ID NO: 708023 - DNA, 23 bp, Homo sapiens
cagaccggggttcaagccatggc

SEQ ID NO: 708024 - DNA, 17 bp, Homo sapiens
cagacctagcaggctgt

SEQ ID NO: 708025 - DNA, 13 bp, Homo sapiens
cagacctcatgcc

SEQ ID NO: 708026 - DNA, 14 bp, Homo sapiens
cagacctctgcttg

SEQ ID NO: 708027 - DNA, 16 bp, Homo sapiens
cagacctctgcttgga

SEQ ID NO: 708028 - DNA, 12 bp, Homo sapiens
cagacctgcagt

SEQ ID NO: 708029 - DNA, 13 bp, Homo sapiens
cagacctggaaga

SEQ ID NO: 708030 - DNA, 16 bp, Homo sapiens
cagacctggagcccct

SEQ ID NO: 708031 - DNA, 20 bp, Homo sapiens
cagacctggagcccctgggt

SEQ ID NO: 708032 - DNA, 22 bp, Homo sapiens
cagacctggagcccctgggtgg

SEQ ID NO: 708033 - DNA, 23 bp, Homo sapiens
cagacctggagcccctgggtggg

SEQ ID NO: 708034 - DNA, 15 bp, Homo sapiens
cagacctgtcaccct

SEQ ID NO: 708035 - DNA, 14 bp, Homo sapiens
cagacctgtcttcc

SEQ ID NO: 708036 - DNA, 20 bp, Homo sapiens
cagaccttaagacactgtga

SEQ ID NO: 708037 - DNA, 19 bp, Homo sapiens
cagaccttactcaggggat

SEQ ID NO: 708038 - DNA, 14 bp, Homo sapiens
cagacctttactga

SEQ ID NO: 708039 - DNA, 18 bp, Homo sapiens
cagacctttactgatact

SEQ ID NO: 708040 - DNA, 21 bp, Homo sapiens
cagacgaagagtttaaagaga

SEQ ID NO: 708041 - DNA, 17 bp, Homo sapiens
cagacgcttgcgccgag

SEQ ID NO: 708042 - DNA, 17 bp, Homo sapiens
cagacgggtctgagact

SEQ ID NO: 708043 - DNA, 14 bp, Homo sapiens
cagacggtctgtgt

SEQ ID NO: 708044 - DNA, 21 bp, Homo sapiens
cagacggtctgtgtgctgttt

SEQ ID NO: 708045 - DNA, 15 bp, Homo sapiens
cagacgtcaggccct

SEQ ID NO: 708046 - DNA, 22 bp, Homo sapiens
cagactaaaggatccagagagc

SEQ ID NO: 708047 - DNA, 17 bp, Homo sapiens
cagactaagaaggaaaa

SEQ ID NO: 708048 - DNA, 16 bp, Homo sapiens
cagactacacaggatg

SEQ ID NO: 708049 - DNA, 22 bp, Homo sapiens
cagactagaattctagtgctgc

SEQ ID NO: 708050 - DNA, 23 bp, Homo sapiens
cagactagatggacctgcctgca

SEQ ID NO: 708051 - DNA, 14 bp, Homo sapiens
cagactagatgtag

SEQ ID NO: 708052 - DNA, 19 bp, Homo sapiens
cagactagatgtagtattt

SEQ ID NO: 708053 - DNA, 19 bp, Homo sapiens
cagactagccactcctgcc

SEQ ID NO: 708054 - DNA, 20 bp, Homo sapiens
cagactatttttagattttc

SEQ ID NO: 708055 - DNA, 18 bp, Homo sapiens
cagactcaaggggctgga

SEQ ID NO: 708056 - DNA, 19 bp, Homo sapiens
cagactcacaacctgaacc

SEQ ID NO: 708057 - DNA, 20 bp, Homo sapiens
cagactcacaacctgaacct

SEQ ID NO: 708058 - DNA, 23 bp, Homo sapiens
cagactcactgggaagctcccac

SEQ ID NO: 708059 - DNA, 14 bp, Homo sapiens
cagactcagctcca

SEQ ID NO: 708060 - DNA, 17 bp, Homo sapiens
cagactcagctccagaa

SEQ ID NO: 708061 - DNA, 22 bp, Homo sapiens
cagactcaggttccagaacagc

SEQ ID NO: 708062 - DNA, 14 bp, Homo sapiens
cagactcctcagat

SEQ ID NO: 708063 - DNA, 13 bp, Homo sapiens
cagactcctgagg

SEQ ID NO: 708064 - DNA, 14 bp, Homo sapiens
cagactcctgagga

SEQ ID NO: 708065 - DNA, 21 bp, Homo sapiens
cagactcctgtgcaactttcc

SEQ ID NO: 708066 - DNA, 18 bp, Homo sapiens
cagactccttcaacaatt

SEQ ID NO: 708067 - DNA, 17 bp, Homo sapiens
cagactcgctagcactc

SEQ ID NO: 708068 - DNA, 12 bp, Homo sapiens
cagactctgcct

SEQ ID NO: 708069 - DNA, 21 bp, Homo sapiens
cagactctgggtccctcggag

SEQ ID NO: 708070 - DNA, 14 bp, Homo sapiens
cagactctggtctt

SEQ ID NO: 708071 - DNA, 18 bp, Homo sapiens
cagactctttaataaatt

SEQ ID NO: 708072 - DNA, 19 bp, Homo sapiens
cagactctttaataaattg

SEQ ID NO: 708073 - DNA, 20 bp, Homo sapiens
cagactctttttttgagtga

SEQ ID NO: 708074 - DNA, 23 bp, Homo sapiens
cagactctttttttgagtgacag

SEQ ID NO: 708075 - DNA, 15 bp, Homo sapiens
cagactgacactact

SEQ ID NO: 708076 - DNA, 23 bp, Homo sapiens
cagactgacccccatctgagctg

SEQ ID NO: 708077 - DNA, 15 bp, Homo sapiens
cagactgagctctcc

SEQ ID NO: 708078 - DNA, 14 bp, Homo sapiens
cagactgatgagca

SEQ ID NO: 708079 - DNA, 12 bp, Homo sapiens
cagactgcagac

SEQ ID NO: 708080 - DNA, 22 bp, Homo sapiens
cagactgcagacattctcaaag

SEQ ID NO: 708081 - DNA, 16 bp, Homo sapiens
cagactgccccagcca

SEQ ID NO: 708082 - DNA, 15 bp, Homo sapiens
cagactgctgggact

SEQ ID NO: 708083 - DNA, 14 bp, Homo sapiens
cagactgcttccaa

SEQ ID NO: 708084 - DNA, 17 bp, Homo sapiens
cagactgcttggccaga

SEQ ID NO: 708085 - DNA, 20 bp, Homo sapiens
cagactgcttggccagatgc

SEQ ID NO: 708086 - DNA, 23 bp, Homo sapiens
cagactggaaaagtgatgtattt

SEQ ID NO: 708087 - DNA, 12 bp, Homo sapiens
cagactggaaga

SEQ ID NO: 708088 - DNA, 22 bp, Homo sapiens
cagactggaagacacttcagat

SEQ ID NO: 708089 - DNA, 15 bp, Homo sapiens
cagactggcaataaa

SEQ ID NO: 708090 - DNA, 17 bp, Homo sapiens
cagactggcaataaact

SEQ ID NO: 708091 - DNA, 19 bp, Homo sapiens
cagactggcaataaactcc

SEQ ID NO: 708092 - DNA, 20 bp, Homo sapiens
cagactggcaataaactcct

SEQ ID NO: 708093 - DNA, 14 bp, Homo sapiens
cagactgggcccag

SEQ ID NO: 708094 - DNA, 20 bp, Homo sapiens
cagactgggcccaggcaggt

SEQ ID NO: 708095 - DNA, 24 bp, Homo sapiens
cagactgggcccaggcaggtctgc

SEQ ID NO: 708096 - DNA, 16 bp, Homo sapiens
cagactggggcatcct

SEQ ID NO: 708097 - DNA, 22 bp, Homo sapiens
cagactggggcatcctgtgcca

SEQ ID NO: 708098 - DNA, 15 bp, Homo sapiens
cagactgggtttcta

SEQ ID NO: 708099 - DNA, 18 bp, Homo sapiens
cagactgggtttctagcc

SEQ ID NO: 708100 - DNA, 13 bp, Homo sapiens
cagactgtagaga

SEQ ID NO: 708101 - DNA, 15 bp, Homo sapiens
cagacttcacactgc

SEQ ID NO: 708102 - DNA, 20 bp, Homo sapiens
cagacttcccagctaggaag

SEQ ID NO: 708103 - DNA, 21 bp, Homo sapiens
cagacttccctgaatgtattg

SEQ ID NO: 708104 - DNA, 20 bp, Homo sapiens
cagacttctggaaggctggc

SEQ ID NO: 708105 - DNA, 22 bp, Homo sapiens
cagacttggcctccagctgttc

SEQ ID NO: 708106 - DNA, 24 bp, Homo sapiens
cagacttggcctccagctgttctt

SEQ ID NO: 708107 - DNA, 13 bp, Homo sapiens
cagacttgtcaag

SEQ ID NO: 708108 - DNA, 22 bp, Homo sapiens
cagactttcccaaatgtattga

SEQ ID NO: 708109 - DNA, 13 bp, Homo sapiens
cagactttgagcc

SEQ ID NO: 708110 - DNA, 18 bp, Homo sapiens
cagactttgctgcatttt

SEQ ID NO: 708111 - DNA, 23 bp, Homo sapiens
cagacttttgcttaccttttcct

SEQ ID NO: 708112 - DNA, 23 bp, Homo sapiens
cagagaaaaatgctccccacagc

SEQ ID NO: 708113 - DNA, 16 bp, Homo sapiens
cagagaaaatgaattt

SEQ ID NO: 708114 - DNA, 24 bp, Homo sapiens
agaccacactgcacacagtgactt

SEQ ID NO: 708115 - DNA, 22 bp, Homo sapiens
agaccaccagccgccccagccc

SEQ ID NO: 708116 - DNA, 17 bp, Homo sapiens
agaccacccatatcatg

SEQ ID NO: 708117 - DNA, 19 bp, Homo sapiens
agaccacccatatcatgca

SEQ ID NO: 708118 - DNA, 14 bp, Homo sapiens
agaccaccccgcct

SEQ ID NO: 708119 - DNA, 20 bp, Homo sapiens
agaccacgcccgtcctgcct

SEQ ID NO: 708120 - DNA, 16 bp, Homo sapiens
agaccacttgccacgc

SEQ ID NO: 708121 - DNA, 13 bp, Homo sapiens
agaccagaattcc

SEQ ID NO: 708122 - DNA, 21 bp, Homo sapiens
agaccagaattcccttgaatt

SEQ ID NO: 708123 - DNA, 22 bp, Homo sapiens
agaccagaattcccttgaattg

SEQ ID NO: 708124 - DNA, 14 bp, Homo sapiens
agaccagactgtgg

SEQ ID NO: 708125 - DNA, 16 bp, Homo sapiens
agaccagcactcagcc

SEQ ID NO: 708126 - DNA, 21 bp, Homo sapiens
agaccagcagacagagccagg

SEQ ID NO: 708127 - DNA, 12 bp, Homo sapiens
agaccagcctgg

SEQ ID NO: 708128 - DNA, 18 bp, Homo sapiens
agaccagcctgggcaaca

SEQ ID NO: 708129 - DNA, 15 bp, Homo sapiens
agaccaggctgtgtc

SEQ ID NO: 708130 - DNA, 22 bp, Homo sapiens
agaccagggtcttacctctctg

SEQ ID NO: 708131 - DNA, 20 bp, Homo sapiens
agaccagtggtctggaaaca

SEQ ID NO: 708132 - DNA, 22 bp, Homo sapiens
agaccagttagattattgaaat

SEQ ID NO: 708133 - DNA, 21 bp, Homo sapiens
agaccagttgggagcactgga

SEQ ID NO: 708134 - DNA, 23 bp, Homo sapiens
agaccagttgggagcactggagt

SEQ ID NO: 708135 - DNA, 17 bp, Homo sapiens
agaccagtttgcatgat

SEQ ID NO: 708136 - DNA, 14 bp, Homo sapiens
agaccatattctaa

SEQ ID NO: 708137 - DNA, 20 bp, Homo sapiens
agaccatcctggcccctcca

SEQ ID NO: 708138 - DNA, 21 bp, Homo sapiens
agaccatgaagtaaattatgt

SEQ ID NO: 708139 - DNA, 15 bp, Homo sapiens
agaccattctgtgac

SEQ ID NO: 708140 - DNA, 22 bp, Homo sapiens
agacccaaagcggtccctgtcc

SEQ ID NO: 708141 - DNA, 21 bp, Homo sapiens
agacccaacagcaaaggaact

SEQ ID NO: 708142 - DNA, 21 bp, Homo sapiens
agacccactgaaatgaccaag

SEQ ID NO: 708143 - DNA, 20 bp, Homo sapiens
agacccagagccctctgagc

SEQ ID NO: 708144 - DNA, 22 bp, Homo sapiens
agacccagagccctctgagccg

SEQ ID NO: 708145 - DNA, 16 bp, Homo sapiens
agacccagaggccctg

SEQ ID NO: 708146 - DNA, 19 bp, Homo sapiens
agacccagaggccctgaag

SEQ ID NO: 708147 - DNA, 18 bp, Homo sapiens
agacccagccctcatccc

SEQ ID NO: 708148 - DNA, 17 bp, Homo sapiens
agacccagtcccacact

SEQ ID NO: 708149 - DNA, 18 bp, Homo sapiens
agacccagtcccacactg

SEQ ID NO: 708150 - DNA, 16 bp, Homo sapiens
agacccagtgcactcc

SEQ ID NO: 708151 - DNA, 17 bp, Homo sapiens
agacccatgtgctggga

SEQ ID NO: 708152 - DNA, 23 bp, Homo sapiens
agacccattgcgatggccgctcc

SEQ ID NO: 708153 - DNA, 19 bp, Homo sapiens
agaccccaagaggaagttc

SEQ ID NO: 708154 - DNA, 16 bp, Homo sapiens
agaccccacccaagct

SEQ ID NO: 708155 - DNA, 20 bp, Homo sapiens
agaccccacccaagcttggc

SEQ ID NO: 708156 - DNA, 19 bp, Homo sapiens
agacccccaccccttcccc

SEQ ID NO: 708157 - DNA, 20 bp, Homo sapiens
agacccccaccccttcccca

SEQ ID NO: 708158 - DNA, 13 bp, Homo sapiens
agacccccactct

SEQ ID NO: 708159 - DNA, 12 bp, Homo sapiens
agacccccaggc

SEQ ID NO: 708160 - DNA, 18 bp, Homo sapiens
agacccccccccaactcc

SEQ ID NO: 708161 - DNA, 23 bp, Homo sapiens
agaccccgaggtaggggtgggga

SEQ ID NO: 708162 - DNA, 14 bp, Homo sapiens
agaccccgcactgc

SEQ ID NO: 708163 - DNA, 17 bp, Homo sapiens
agaccccgcactgcaga

SEQ ID NO: 708164 - DNA, 11 bp, Homo sapiens
agaccccgccc

SEQ ID NO: 708165 - DNA, 19 bp, Homo sapiens
agaccccgggtctccttgg

SEQ ID NO: 708166 - DNA, 14 bp, Homo sapiens
agacccctctggcc

SEQ ID NO: 708167 - DNA, 22 bp, Homo sapiens
agacccctctggccaggatgga

SEQ ID NO: 708168 - DNA, 14 bp, Homo sapiens
agacccctggcttt

SEQ ID NO: 708169 - DNA, 15 bp, Homo sapiens
agacccctggctttt

SEQ ID NO: 708170 - DNA, 13 bp, Homo sapiens
agacccctgtctt

SEQ ID NO: 708171 - DNA, 18 bp, Homo sapiens
agaccccttcctttcctc

SEQ ID NO: 708172 - DNA, 23 bp, Homo sapiens
agacccggttattcgcccacccg

SEQ ID NO: 708173 - DNA, 19 bp, Homo sapiens
agaccctactgaagtggct

SEQ ID NO: 708174 - DNA, 13 bp, Homo sapiens
agaccctcgggcc

SEQ ID NO: 708175 - DNA, 19 bp, Homo sapiens
agaccctgaacccacacct

SEQ ID NO: 708176 - DNA, 14 bp, Homo sapiens
agaccctgagactc

SEQ ID NO: 708177 - DNA, 14 bp, Homo sapiens
agaccctgccccct

SEQ ID NO: 708178 - DNA, 14 bp, Homo sapiens
agaccctgcctgag

SEQ ID NO: 708179 - DNA, 13 bp, Homo sapiens
agaccctggcctc

SEQ ID NO: 708180 - DNA, 17 bp, Homo sapiens
agaccgaactgttgtat

SEQ ID NO: 708181 - DNA, 20 bp, Homo sapiens
agaccgaactgttgtataaa

SEQ ID NO: 708182 - DNA, 14 bp, Homo sapiens
agaccgccccaggg

SEQ ID NO: 708183 - DNA, 19 bp, Homo sapiens
agaccgtacaaactcagat

SEQ ID NO: 708184 - DNA, 22 bp, Homo sapiens
agaccgtgtcccaaggagctga

SEQ ID NO: 708185 - DNA, 14 bp, Homo sapiens
agacctaaagtgct

SEQ ID NO: 708186 - DNA, 21 bp, Homo sapiens
agacctaaagtgcttgctttt

SEQ ID NO: 708187 - DNA, 14 bp, Homo sapiens
agacctacaggctg

SEQ ID NO: 708188 - DNA, 18 bp, Homo sapiens
agacctacattccctctc

SEQ ID NO: 708189 - DNA, 18 bp, Homo sapiens
agacctactgcactgagt

SEQ ID NO: 708190 - DNA, 15 bp, Homo sapiens
agacctagcaggctg

SEQ ID NO: 708191 - DNA, 22 bp, Homo sapiens
agacctagtcccctttcctcta

SEQ ID NO: 708192 - DNA, 16 bp, Homo sapiens
agacctatgtaagaat

SEQ ID NO: 708193 - DNA, 15 bp, Homo sapiens
agacctcaagccatc

SEQ ID NO: 708194 - DNA, 12 bp, Homo sapiens
agacctcactgt

SEQ ID NO: 708195 - DNA, 14 bp, Homo sapiens
agacctcactgtca

SEQ ID NO: 708196 - DNA, 12 bp, Homo sapiens
agacctcagcca

SEQ ID NO: 708197 - DNA, 14 bp, Homo sapiens
agacctcagcctgt

SEQ ID NO: 708198 - DNA, 18 bp, Homo sapiens
agacctcagtgccttcct

SEQ ID NO: 708199 - DNA, 20 bp, Homo sapiens
agacctcagtgccttcctgt

SEQ ID NO: 708200 - DNA, 20 bp, Homo sapiens
agacctcatctgtggagctg

SEQ ID NO: 708201 - DNA, 21 bp, Homo sapiens
agacctcatctgtggagctgc

SEQ ID NO: 708202 - DNA, 20 bp, Homo sapiens
agacctcatgcccagctctc

SEQ ID NO: 708203 - DNA, 19 bp, Homo sapiens
agacctctggttaatttat

SEQ ID NO: 708204 - DNA, 18 bp, Homo sapiens
agacctctgtgcacttat

SEQ ID NO: 708205 - DNA, 22 bp, Homo sapiens
agacctgacaccgtccctcagt

SEQ ID NO: 708206 - DNA, 17 bp, Homo sapiens
agacctgacccaacacc

SEQ ID NO: 708207 - DNA, 16 bp, Homo sapiens
agacctgagaatgtat

SEQ ID NO: 708208 - DNA, 15 bp, Homo sapiens
agacctgagtatttt

SEQ ID NO: 708209 - DNA, 22 bp, Homo sapiens
agacctgagtattttttataat

SEQ ID NO: 708210 - DNA, 17 bp, Homo sapiens
agacctgctctggacac

SEQ ID NO: 708211 - DNA, 15 bp, Homo sapiens
agacctggaaccaga

SEQ ID NO: 708212 - DNA, 13 bp, Homo sapiens
agacctggagccc

SEQ ID NO: 708213 - DNA, 15 bp, Homo sapiens
agacctgggatttga

SEQ ID NO: 708214 - DNA, 16 bp, Homo sapiens
agacctggtgtgcgga

SEQ ID NO: 708215 - DNA, 22 bp, Homo sapiens
agacctggtgtgcggaggcagg

SEQ ID NO: 708216 - DNA, 18 bp, Homo sapiens
agacctgtcttccaagga

SEQ ID NO: 708217 - DNA, 19 bp, Homo sapiens
agacctgtgctagttttac

SEQ ID NO: 708218 - DNA, 23 bp, Homo sapiens
agacctgtgctagttttacagat

SEQ ID NO: 708219 - DNA, 19 bp, Homo sapiens
agacctgttggcctgtggg

SEQ ID NO: 708220 - DNA, 18 bp, Homo sapiens
agaccttactcaggggat

SEQ ID NO: 708221 - DNA, 22 bp, Homo sapiens
agaccttccataatgctactgt

SEQ ID NO: 708222 - DNA, 16 bp, Homo sapiens
agaccttctccaaatg

SEQ ID NO: 708223 - DNA, 21 bp, Homo sapiens
agaccttgagggtgggccagc

SEQ ID NO: 708224 - DNA, 19 bp, Homo sapiens
agaccttgggggaagactt

SEQ ID NO: 708225 - DNA, 18 bp, Homo sapiens
agaccttgttacttctga

SEQ ID NO: 708226 - DNA, 22 bp, Homo sapiens
agaccttttctagtctgtcttc

SEQ ID NO: 708227 - DNA, 22 bp, Homo sapiens
agaccttttttttttttccaat

SEQ ID NO: 708228 - DNA, 22 bp, Homo sapiens
agacgaagagtttaaagagaaa

SEQ ID NO: 708229 - DNA, 23 bp, Homo sapiens
agacgatatttaattcacctcag

SEQ ID NO: 708230 - DNA, 15 bp, Homo sapiens
agacgcaccatgtgg

SEQ ID NO: 708231 - DNA, 14 bp, Homo sapiens
agacgcaggaatgg

SEQ ID NO: 708232 - DNA, 23 bp, Homo sapiens
agacgccactccctgggacacag

SEQ ID NO: 708233 - DNA, 12 bp, Homo sapiens
agacgcccctcc

SEQ ID NO: 708234 - DNA, 16 bp, Homo sapiens
agacgccctatttcta

SEQ ID NO: 708235 - DNA, 21 bp, Homo sapiens
agacgccttcatctgggacaa

SEQ ID NO: 708236 - DNA, 14 bp, Homo sapiens
agacgccttcctct

SEQ ID NO: 708237 - DNA, 19 bp, Homo sapiens
agacgccttcctctctgga

SEQ ID NO: 708238 - DNA, 18 bp, Homo sapiens
cagagaaaatgaatttgg

SEQ ID NO: 708239 - DNA, 19 bp, Homo sapiens
cagagaaacttaagcaaag

SEQ ID NO: 708240 - DNA, 9 bp, Homo sapiens
cagagaaag

SEQ ID NO: 708241 - DNA, 14 bp, Homo sapiens
cagagaaagaaaag

SEQ ID NO: 708242 - DNA, 15 bp, Homo sapiens
cagagaaagaaaagg

SEQ ID NO: 708243 - DNA, 17 bp, Homo sapiens
cagagaaagaaaaggca

SEQ ID NO: 708244 - DNA, 18 bp, Homo sapiens
cagagaaagaaaaggcaa

SEQ ID NO: 708245 - DNA, 19 bp, Homo sapiens
cagagaaagaaaaggcaaa

SEQ ID NO: 708246 - DNA, 22 bp, Homo sapiens
cagagaaagaaagggaaactgg

SEQ ID NO: 708247 - DNA, 22 bp, Homo sapiens
cagagaaagaagagacaggagg

SEQ ID NO: 708248 - DNA, 23 bp, Homo sapiens
cagagaaagaagagacaggaggg

SEQ ID NO: 708249 - DNA, 24 bp, Homo sapiens
cagagaacagcgaagtagcttgct

SEQ ID NO: 708250 - DNA, 15 bp, Homo sapiens
cagagaactgcagac

SEQ ID NO: 708251 - DNA, 18 bp, Homo sapiens
cagagaactgcagacctc

SEQ ID NO: 708252 - DNA, 19 bp, Homo sapiens
cagagaactgcagacctca

SEQ ID NO: 708253 - DNA, 13 bp, Homo sapiens
cagagaagaaaac

SEQ ID NO: 708254 - DNA, 23 bp, Homo sapiens
cagagaagagagtattgggtaga

SEQ ID NO: 708255 - DNA, 19 bp, Homo sapiens
cagagaagataatgttctt

SEQ ID NO: 708256 - DNA, 21 bp, Homo sapiens
cagagaagccccgcacgggct

SEQ ID NO: 708257 - DNA, 21 bp, Homo sapiens
cagagaagctataaattcctc

SEQ ID NO: 708258 - DNA, 23 bp, Homo sapiens
cagagaagctataaattcctctt

SEQ ID NO: 708259 - DNA, 14 bp, Homo sapiens
cagagaaggaaaag

SEQ ID NO: 708260 - DNA, 22 bp, Homo sapiens
cagagaaggaaaagactgaatc

SEQ ID NO: 708261 - DNA, 18 bp, Homo sapiens
cagagaaggcctcttgtg

SEQ ID NO: 708262 - DNA, 16 bp, Homo sapiens
cagagaaggctatgta

SEQ ID NO: 708263 - DNA, 22 bp, Homo sapiens
cagagaagttctcaaagttaat

SEQ ID NO: 708264 - DNA, 18 bp, Homo sapiens
cagagaagtttgtagcca

SEQ ID NO: 708265 - DNA, 20 bp, Homo sapiens
cagagaatagatcagtattt

SEQ ID NO: 708266 - DNA, 11 bp, Homo sapiens
cagagaatata

SEQ ID NO: 708267 - DNA, 15 bp, Homo sapiens
cagagaatctcttgg

SEQ ID NO: 708268 - DNA, 21 bp, Homo sapiens
cagagaatggctgggtcaggg

SEQ ID NO: 708269 - DNA, 13 bp, Homo sapiens
cagagaatttcta

SEQ ID NO: 708270 - DNA, 16 bp, Homo sapiens
cagagaatttctacca

SEQ ID NO: 708271 - DNA, 14 bp, Homo sapiens
cagagacaacaggt

SEQ ID NO: 708272 - DNA, 23 bp, Homo sapiens
cagagacaacaggtaaaacaggg

SEQ ID NO: 708273 - DNA, 13 bp, Homo sapiens
cagagacacctgc

SEQ ID NO: 708274 - DNA, 21 bp, Homo sapiens
cagagacactgttgataaaaa

SEQ ID NO: 708275 - DNA, 22 bp, Homo sapiens
cagagacactgttgataaaaac

SEQ ID NO: 708276 - DNA, 14 bp, Homo sapiens
cagagacaggaaaa

SEQ ID NO: 708277 - DNA, 22 bp, Homo sapiens
cagagacaggaaaatcctctgg

SEQ ID NO: 708278 - DNA, 10 bp, Homo sapiens
cagagacata

SEQ ID NO: 708279 - DNA, 18 bp, Homo sapiens
cagagaccagcactcagc

SEQ ID NO: 708280 - DNA, 16 bp, Homo sapiens
cagagaccaggctgtg

SEQ ID NO: 708281 - DNA, 13 bp, Homo sapiens
cagagaccagggc

SEQ ID NO: 708282 - DNA, 17 bp, Homo sapiens
cagagacccaacagcag

SEQ ID NO: 708283 - DNA, 17 bp, Homo sapiens
cagagaccctggttttt

SEQ ID NO: 708284 - DNA, 12 bp, Homo sapiens
cagagacctcca

SEQ ID NO: 708285 - DNA, 13 bp, Homo sapiens
cagagacctccaa

SEQ ID NO: 708286 - DNA, 18 bp, Homo sapiens
cagagacctgaggcagat

SEQ ID NO: 708287 - DNA, 16 bp, Homo sapiens
cagagactaatgttgg

SEQ ID NO: 708288 - DNA, 12 bp, Homo sapiens
cagagactcaga

SEQ ID NO: 708289 - DNA, 21 bp, Homo sapiens
cagagactcatttcacagcct

SEQ ID NO: 708290 - DNA, 23 bp, Homo sapiens
cagagactcatttcacagccttt

SEQ ID NO: 708291 - DNA, 13 bp, Homo sapiens
cagagactgccct

SEQ ID NO: 708292 - DNA, 17 bp, Homo sapiens
cagagactgcccttctc

SEQ ID NO: 708293 - DNA, 21 bp, Homo sapiens
cagagactgtccctgaaacct

SEQ ID NO: 708294 - DNA, 21 bp, Homo sapiens
cagagagaacaacaggcaggg

SEQ ID NO: 708295 - DNA, 12 bp, Homo sapiens
cagagagaagcc

SEQ ID NO: 708296 - DNA, 16 bp, Homo sapiens
cagagagacagaccgg

SEQ ID NO: 708297 - DNA, 17 bp, Homo sapiens
cagagagacagacttga

SEQ ID NO: 708298 - DNA, 18 bp, Homo sapiens
cagagagacagacttgag

SEQ ID NO: 708299 - DNA, 20 bp, Homo sapiens
cagagagacctcatcctgct

SEQ ID NO: 708300 - DNA, 20 bp, Homo sapiens
cagagagagaagtgcccctg

SEQ ID NO: 708301 - DNA, 21 bp, Homo sapiens
cagagagagaggacagagggg

SEQ ID NO: 708302 - DNA, 20 bp, Homo sapiens
cagagagcaactctgagatc

SEQ ID NO: 708303 - DNA, 21 bp, Homo sapiens
cagagagcagctccctttctc

SEQ ID NO: 708304 - DNA, 15 bp, Homo sapiens
cagagagcaggcagg

SEQ ID NO: 708305 - DNA, 20 bp, Homo sapiens
cagagagcaggggagcttgg

SEQ ID NO: 708306 - DNA, 13 bp, Homo sapiens
cagagagccctgg

SEQ ID NO: 708307 - DNA, 17 bp, Homo sapiens
cagagagcctagaacat

SEQ ID NO: 708308 - DNA, 15 bp, Homo sapiens
cagagaggaatcaga

SEQ ID NO: 708309 - DNA, 18 bp, Homo sapiens
cagagaggagaaacacat

SEQ ID NO: 708310 - DNA, 14 bp, Homo sapiens
cagagaggagcacc

SEQ ID NO: 708311 - DNA, 16 bp, Homo sapiens
cagagaggagcacctg

SEQ ID NO: 708312 - DNA, 13 bp, Homo sapiens
cagagaggagggg

SEQ ID NO: 708313 - DNA, 20 bp, Homo sapiens
cagagaggatacatttaata

SEQ ID NO: 708314 - DNA, 13 bp, Homo sapiens
cagagaggcaagg

SEQ ID NO: 708315 - DNA, 21 bp, Homo sapiens
cagagagggacacatgcccct

SEQ ID NO: 708316 - DNA, 23 bp, Homo sapiens
cagagagggacacatgcccctcc

SEQ ID NO: 708317 - DNA, 21 bp, Homo sapiens
cagagagggagagcagagaaa

SEQ ID NO: 708318 - DNA, 16 bp, Homo sapiens
cagagagggcccagct

SEQ ID NO: 708319 - DNA, 18 bp, Homo sapiens
cagagagggcccagctgt

SEQ ID NO: 708320 - DNA, 22 bp, Homo sapiens
cagagagggcccagctgtagcc

SEQ ID NO: 708321 - DNA, 17 bp, Homo sapiens
cagagagggtgacaaga

SEQ ID NO: 708322 - DNA, 21 bp, Homo sapiens
cagagaggtctcaggttcttt

SEQ ID NO: 708323 - DNA, 19 bp, Homo sapiens
cagagagtacagactgcag

SEQ ID NO: 708324 - DNA, 21 bp, Homo sapiens
cagagagtacagactgcagac

SEQ ID NO: 708325 - DNA, 14 bp, Homo sapiens
cagagagtcctctg

SEQ ID NO: 708326 - DNA, 16 bp, Homo sapiens
cagagagtcctctgga

SEQ ID NO: 708327 - DNA, 16 bp, Homo sapiens
cagagataaagacctt

SEQ ID NO: 708328 - DNA, 16 bp, Homo sapiens
cagagatatacaaata

SEQ ID NO: 708329 - DNA, 20 bp, Homo sapiens
cagagatgcaccaccaagcc

SEQ ID NO: 708330 - DNA, 13 bp, Homo sapiens
cagagatgcctcc

SEQ ID NO: 708331 - DNA, 14 bp, Homo sapiens
cagagatgcctcca

SEQ ID NO: 708332 - DNA, 19 bp, Homo sapiens
cagagatgcctccaccgct

SEQ ID NO: 708333 - DNA, 21 bp, Homo sapiens
cagagatgcctccaccgctgc

SEQ ID NO: 708334 - DNA, 21 bp, Homo sapiens
cagagatgcgaaccacccaaa

SEQ ID NO: 708335 - DNA, 19 bp, Homo sapiens
cagagattcattttctaga

SEQ ID NO: 708336 - DNA, 19 bp, Homo sapiens
cagagattgaactccaaga

SEQ ID NO: 708337 - DNA, 16 bp, Homo sapiens
cagagcaaaataattt

SEQ ID NO: 708338 - DNA, 12 bp, Homo sapiens
cagagcaataac

SEQ ID NO: 708339 - DNA, 15 bp, Homo sapiens
cagagcaataacact

SEQ ID NO: 708340 - DNA, 22 bp, Homo sapiens
cagagcaatgcttttaatgaat

SEQ ID NO: 708341 - DNA, 20 bp, Homo sapiens
cagagcaatttacaagagct

SEQ ID NO: 708342 - DNA, 17 bp, Homo sapiens
cagagcacacttattta

SEQ ID NO: 708343 - DNA, 21 bp, Homo sapiens
cagagcacacttatttatgaa

SEQ ID NO: 708344 - DNA, 14 bp, Homo sapiens
cagagcacagccca

SEQ ID NO: 708345 - DNA, 22 bp, Homo sapiens
cagagcacaggagctgccatgt

SEQ ID NO: 708346 - DNA, 14 bp, Homo sapiens
cagagcacctcacc

SEQ ID NO: 708347 - DNA, 12 bp, Homo sapiens
cagagcacgcct

SEQ ID NO: 708348 - DNA, 16 bp, Homo sapiens
cagagcacgcctgcca

SEQ ID NO: 708349 - DNA, 20 bp, Homo sapiens
cagagcactgggttgcaggg

SEQ ID NO: 708350 - DNA, 19 bp, Homo sapiens
cagagcagagcaaatgagg

SEQ ID NO: 708351 - DNA, 21 bp, Homo sapiens
cagagcagagcaaatgaggga

SEQ ID NO: 708352 - DNA, 21 bp, Homo sapiens
cagagcaggaagcattcagag

SEQ ID NO: 708353 - DNA, 14 bp, Homo sapiens
cagagcaggacctc

SEQ ID NO: 708354 - DNA, 18 bp, Homo sapiens
cagagcaggacctccctt

SEQ ID NO: 708355 - DNA, 13 bp, Homo sapiens
cagagcaggagcc

SEQ ID NO: 708356 - DNA, 14 bp, Homo sapiens
cagagcaggagccc

SEQ ID NO: 708357 - DNA, 17 bp, Homo sapiens
cagagcaggagcccctg

SEQ ID NO: 708358 - DNA, 23 bp, Homo sapiens
cagagcaggaggcccctggccca

SEQ ID NO: 708359 - DNA, 13 bp, Homo sapiens
cagagcaggcaat

SEQ ID NO: 708360 - DNA, 17 bp, Homo sapiens
cagagcaggggctccag

SEQ ID NO: 708361 - DNA, 18 bp, Homo sapiens
cagagcattacgtgagcc

SEQ ID NO: 708362 - DNA, 15 bp, Homo sapiens
agacgctgctgtcac

SEQ ID NO: 708363 - DNA, 14 bp, Homo sapiens
agacggaaaacaat

SEQ ID NO: 708364 - DNA, 16 bp, Homo sapiens
agacggaggggagtag

SEQ ID NO: 708365 - DNA, 14 bp, Homo sapiens
agacggattgcatt

SEQ ID NO: 708366 - DNA, 13 bp, Homo sapiens
agacgggaatgcc

SEQ ID NO: 708367 - DNA, 17 bp, Homo sapiens
agacgggtctgagactg

SEQ ID NO: 708368 - DNA, 16 bp, Homo sapiens
agacggtctgtgtgct

SEQ ID NO: 708369 - DNA, 16 bp, Homo sapiens
agacggtgttttgcca

SEQ ID NO: 708370 - DNA, 21 bp, Homo sapiens
agacgtggaacctctgtctca

SEQ ID NO: 708371 - DNA, 22 bp, Homo sapiens
agacgtttttgtgctgtgggca

SEQ ID NO: 708372 - DNA, 20 bp, Homo sapiens
agactaaaggatccagagag

SEQ ID NO: 708373 - DNA, 12 bp, Homo sapiens
agactaaatgaa

SEQ ID NO: 708374 - DNA, 14 bp, Homo sapiens
agactaagaaatat

SEQ ID NO: 708375 - DNA, 13 bp, Homo sapiens
agactaagccctg

SEQ ID NO: 708376 - DNA, 14 bp, Homo sapiens
agactaagccctgt

SEQ ID NO: 708377 - DNA, 15 bp, Homo sapiens
agactaagccctgtc

SEQ ID NO: 708378 - DNA, 14 bp, Homo sapiens
agactaattaaaat

SEQ ID NO: 708379 - DNA, 16 bp, Homo sapiens
agactaattaaaatct

SEQ ID NO: 708380 - DNA, 17 bp, Homo sapiens
agactaattaaaatctg

SEQ ID NO: 708381 - DNA, 14 bp, Homo sapiens
agactactaagagg

SEQ ID NO: 708382 - DNA, 15 bp, Homo sapiens
agactagaggccagg

SEQ ID NO: 708383 - DNA, 19 bp, Homo sapiens
agactagaggccagggcag

SEQ ID NO: 708384 - DNA, 16 bp, Homo sapiens
agactagatgtagtat

SEQ ID NO: 708385 - DNA, 19 bp, Homo sapiens
agactagattgcctttgtt

SEQ ID NO: 708386 - DNA, 23 bp, Homo sapiens
agactagcaatctcttcattatt

SEQ ID NO: 708387 - DNA, 12 bp, Homo sapiens
agactaggttta

SEQ ID NO: 708388 - DNA, 22 bp, Homo sapiens
agactagtttttattccttgtg

SEQ ID NO: 708389 - DNA, 18 bp, Homo sapiens
agactataaagcagtaga

SEQ ID NO: 708390 - DNA, 14 bp, Homo sapiens
agactatctacaaa

SEQ ID NO: 708391 - DNA, 17 bp, Homo sapiens
agactatggcctcgcct

SEQ ID NO: 708392 - DNA, 18 bp, Homo sapiens
agactatggcctcgcctc

SEQ ID NO: 708393 - DNA, 22 bp, Homo sapiens
agactatggcctcgcctcccca

SEQ ID NO: 708394 - DNA, 14 bp, Homo sapiens
agactatttcaaaa

SEQ ID NO: 708395 - DNA, 23 bp, Homo sapiens
agactatttcaaaatgtccagat

SEQ ID NO: 708396 - DNA, 14 bp, Homo sapiens
agactatttttcta

SEQ ID NO: 708397 - DNA, 19 bp, Homo sapiens
agactcaaaacctggagat

SEQ ID NO: 708398 - DNA, 20 bp, Homo sapiens
agactcacaacctgaaccta

SEQ ID NO: 708399 - DNA, 17 bp, Homo sapiens
agactcacactctctgc

SEQ ID NO: 708400 - DNA, 21 bp, Homo sapiens
agactcacactctctgcagcc

SEQ ID NO: 708401 - DNA, 16 bp, Homo sapiens
agactcacaggaagga

SEQ ID NO: 708402 - DNA, 18 bp, Homo sapiens
agactcacctctgcctca

SEQ ID NO: 708403 - DNA, 14 bp, Homo sapiens
agactcacttacat

SEQ ID NO: 708404 - DNA, 21 bp, Homo sapiens
agactcagccaagacaaggag

SEQ ID NO: 708405 - DNA, 11 bp, Homo sapiens
agactcagctc

SEQ ID NO: 708406 - DNA, 13 bp, Homo sapiens
agactcagctctg

SEQ ID NO: 708407 - DNA, 20 bp, Homo sapiens
agactcaggagtctgccact

SEQ ID NO: 708408 - DNA, 19 bp, Homo sapiens
agactcaggccaagaaacg

SEQ ID NO: 708409 - DNA, 21 bp, Homo sapiens
agactcagggccccagcacta

SEQ ID NO: 708410 - DNA, 20 bp, Homo sapiens
agactcaggttccagaacag

SEQ ID NO: 708411 - DNA, 22 bp, Homo sapiens
agactcaggttgtagtaaagaa

SEQ ID NO: 708412 - DNA, 23 bp, Homo sapiens
agactcagtatgctttccctgag

SEQ ID NO: 708413 - DNA, 13 bp, Homo sapiens
agactcagtgttc

SEQ ID NO: 708414 - DNA, 19 bp, Homo sapiens
agactcatttcacagcctt

SEQ ID NO: 708415 - DNA, 14 bp, Homo sapiens
agactccagaatct

SEQ ID NO: 708416 - DNA, 14 bp, Homo sapiens
agactccagcccct

SEQ ID NO: 708417 - DNA, 16 bp, Homo sapiens
agactccagcccctgg

SEQ ID NO: 708418 - DNA, 18 bp, Homo sapiens
agactcccgccccgggct

SEQ ID NO: 708419 - DNA, 23 bp, Homo sapiens
agactcccgccccgggctggccc

SEQ ID NO: 708420 - DNA, 22 bp, Homo sapiens
agactcctcctgggggctggct

SEQ ID NO: 708421 - DNA, 13 bp, Homo sapiens
agactcctctggg

SEQ ID NO: 708422 - DNA, 19 bp, Homo sapiens
agactcctctgggcctggg

SEQ ID NO: 708423 - DNA, 17 bp, Homo sapiens
agactccttcaacaatt

SEQ ID NO: 708424 - DNA, 18 bp, Homo sapiens
agactccttgtggactgg

SEQ ID NO: 708425 - DNA, 16 bp, Homo sapiens
agactcctttcctctg

SEQ ID NO: 708426 - DNA, 13 bp, Homo sapiens
agactctaagata

SEQ ID NO: 708427 - DNA, 23 bp, Homo sapiens
agactctagacaagatattgtac

SEQ ID NO: 708428 - DNA, 21 bp, Homo sapiens
agactctaggacataaattag

SEQ ID NO: 708429 - DNA, 15 bp, Homo sapiens
agactctagtattta

SEQ ID NO: 708430 - DNA, 12 bp, Homo sapiens
agactctgagcc

SEQ ID NO: 708431 - DNA, 13 bp, Homo sapiens
agactctgagcca

SEQ ID NO: 708432 - DNA, 18 bp, Homo sapiens
agactctgagccaaggga

SEQ ID NO: 708433 - DNA, 16 bp, Homo sapiens
agactctgcagccctc

SEQ ID NO: 708434 - DNA, 23 bp, Homo sapiens
agactctgcctcctggtttcctt

SEQ ID NO: 708435 - DNA, 19 bp, Homo sapiens
agactctggtcttctttgg

SEQ ID NO: 708436 - DNA, 17 bp, Homo sapiens
agactctttaataaatt

SEQ ID NO: 708437 - DNA, 22 bp, Homo sapiens
agactctttaataaattgctta

SEQ ID NO: 708438 - DNA, 22 bp, Homo sapiens
agactctttatttttctctttc

SEQ ID NO: 708439 - DNA, 15 bp, Homo sapiens
agactctttgcatat

SEQ ID NO: 708440 - DNA, 18 bp, Homo sapiens
agactctttttttgagtg

SEQ ID NO: 708441 - DNA, 21 bp, Homo sapiens
agactctttttttgagtgaca

SEQ ID NO: 708442 - DNA, 23 bp, Homo sapiens
agactgaaaatatataagctcag

SEQ ID NO: 708443 - DNA, 18 bp, Homo sapiens
agactgaaacgccttgca

SEQ ID NO: 708444 - DNA, 16 bp, Homo sapiens
agactgaacatgttta

SEQ ID NO: 708445 - DNA, 19 bp, Homo sapiens
agactgaacatgtttacag

SEQ ID NO: 708446 - DNA, 17 bp, Homo sapiens
agactgaactcgcaggg

SEQ ID NO: 708447 - DNA, 22 bp, Homo sapiens
agactgaatagatatgaaagct

SEQ ID NO: 708448 - DNA, 20 bp, Homo sapiens
agactgaatgttttatttat

SEQ ID NO: 708449 - DNA, 22 bp, Homo sapiens
agactgacagtttacagacgct

SEQ ID NO: 708450 - DNA, 18 bp, Homo sapiens
agactgagaacttttttg

SEQ ID NO: 708451 - DNA, 15 bp, Homo sapiens
agactgagaggcaga

SEQ ID NO: 708452 - DNA, 16 bp, Homo sapiens
agactgagcacctgct

SEQ ID NO: 708453 - DNA, 13 bp, Homo sapiens
agactgagcagcc

SEQ ID NO: 708454 - DNA, 15 bp, Homo sapiens
agactgagcagccgc

SEQ ID NO: 708455 - DNA, 14 bp, Homo sapiens
agactgagtcagat

SEQ ID NO: 708456 - DNA, 21 bp, Homo sapiens
agactgataacttggggaggc

SEQ ID NO: 708457 - DNA, 15 bp, Homo sapiens
agactgatccctggc

SEQ ID NO: 708458 - DNA, 15 bp, Homo sapiens
agactgatgagcaca

SEQ ID NO: 708459 - DNA, 17 bp, Homo sapiens
agactgatggaacagaa

SEQ ID NO: 708460 - DNA, 21 bp, Homo sapiens
agactgattgattattcaaca

SEQ ID NO: 708461 - DNA, 13 bp, Homo sapiens
agactgcagacat

SEQ ID NO: 708462 - DNA, 12 bp, Homo sapiens
agactgccaggt

SEQ ID NO: 708463 - DNA, 21 bp, Homo sapiens
agactgccatattaaattttt

SEQ ID NO: 708464 - DNA, 15 bp, Homo sapiens
agactgccccagcca

SEQ ID NO: 708465 - DNA, 13 bp, Homo sapiens
agactgcctccct

SEQ ID NO: 708466 - DNA, 21 bp, Homo sapiens
agactgcctccctctcttccg

SEQ ID NO: 708467 - DNA, 22 bp, Homo sapiens
agactgcgggatggtcctgggg

SEQ ID NO: 708468 - DNA, 23 bp, Homo sapiens
agactgcgggatggtcctggggc

SEQ ID NO: 708469 - DNA, 15 bp, Homo sapiens
agactgctgggactg

SEQ ID NO: 708470 - DNA, 17 bp, Homo sapiens
agactgcttcccatcct

SEQ ID NO: 708471 - DNA, 23 bp, Homo sapiens
agactgcttcccatcctaccctc

SEQ ID NO: 708472 - DNA, 20 bp, Homo sapiens
agactgcttggccagatgcg

SEQ ID NO: 708473 - DNA, 23 bp, Homo sapiens
agactggaaaagtgatgtatttt

SEQ ID NO: 708474 - DNA, 23 bp, Homo sapiens
agactggaacttgaactgattca

SEQ ID NO: 708475 - DNA, 11 bp, Homo sapiens
agactggaaga

SEQ ID NO: 708476 - DNA, 14 bp, Homo sapiens
agactggaagctaa

SEQ ID NO: 708477 - DNA, 21 bp, Homo sapiens
agactggaagctaatttgcat

SEQ ID NO: 708478 - DNA, 16 bp, Homo sapiens
agactggacagcttgt

SEQ ID NO: 708479 - DNA, 20 bp, Homo sapiens
agactggaccgctgactgca

SEQ ID NO: 708480 - DNA, 14 bp, Homo sapiens
agactggagtgagg

SEQ ID NO: 708481 - DNA, 15 bp, Homo sapiens
agactggatactgcc

SEQ ID NO: 708482 - DNA, 13 bp, Homo sapiens
agactggcaataa

SEQ ID NO: 708483 - DNA, 22 bp, Homo sapiens
agactgggaagataggctctgc

SEQ ID NO: 708484 - DNA, 16 bp, Homo sapiens
agactgggcccaggca

SEQ ID NO: 708485 - DNA, 17 bp, Homo sapiens
agactgggcccaggcag

SEQ ID NO: 708486 - DNA, 15 bp, Homo sapiens
agactgggctgaggg

SEQ ID NO: 708487 - DNA, 14 bp, Homo sapiens
aaaagtcagagaca

SEQ ID NO: 708488 - DNA, 16 bp, Homo sapiens
aaaagtcattattcct

SEQ ID NO: 708489 - DNA, 22 bp, Homo sapiens
aaaagtccaattttaatttagt

SEQ ID NO: 708490 - DNA, 21 bp, Homo sapiens
aaaagtctacctgtgtttttt

SEQ ID NO: 708491 - DNA, 19 bp, Homo sapiens
aaaagtcttcactctctga

SEQ ID NO: 708492 - DNA, 17 bp, Homo sapiens
aaaagtgaaaaaaagaa

SEQ ID NO: 708493 - DNA, 17 bp, Homo sapiens
aaaatggcgaacatgtg

SEQ ID NO: 708494 - DNA, 18 bp, Homo sapiens
aaaatggcgaacatgtgt

SEQ ID NO: 708495 - DNA, 15 bp, Homo sapiens
aaaatggctaataaa

SEQ ID NO: 708496 - DNA, 17 bp, Homo sapiens
aaaatggctaataaact

SEQ ID NO: 708497 - DNA, 15 bp, Homo sapiens
aaaatgggaagactg

SEQ ID NO: 708498 - DNA, 21 bp, Homo sapiens
aaaatgggcgggggtggtgtg

SEQ ID NO: 708499 - DNA, 14 bp, Homo sapiens
aaaatggtcagtat

SEQ ID NO: 708500 - DNA, 23 bp, Homo sapiens
aaaatggtgttttcatgtaaata

SEQ ID NO: 708501 - DNA, 19 bp, Homo sapiens
aaaatgtaaaggagtcaaa

SEQ ID NO: 708502 - DNA, 20 bp, Homo sapiens
aaaatgtaaatattctatat

SEQ ID NO: 708503 - DNA, 12 bp, Homo sapiens
aaaatgtaacat

SEQ ID NO: 708504 - DNA, 23 bp, Homo sapiens
aaaatgtaacatcataattacat

SEQ ID NO: 708505 - DNA, 16 bp, Homo sapiens
aaaatgtaataacttt

SEQ ID NO: 708506 - DNA, 19 bp, Homo sapiens
aaaatgtaatttagaaact

SEQ ID NO: 708507 - DNA, 12 bp, Homo sapiens
aaaatgtacact

SEQ ID NO: 708508 - DNA, 18 bp, Homo sapiens
aaaatgtactgagatttt

SEQ ID NO: 708509 - DNA, 20 bp, Homo sapiens
aaaatgtataaattattcag

SEQ ID NO: 708510 - DNA, 18 bp, Homo sapiens
aaaatgtatccagaggaa

SEQ ID NO: 708511 - DNA, 13 bp, Homo sapiens
aaaatgtatctaa

SEQ ID NO: 708512 - DNA, 18 bp, Homo sapiens
aaaatgtatgtgtaagta

SEQ ID NO: 708513 - DNA, 20 bp, Homo sapiens
aaaatgtcccagtgtcagta

SEQ ID NO: 708514 - DNA, 21 bp, Homo sapiens
aaaatgtctgtagctcctcaa

SEQ ID NO: 708515 - DNA, 18 bp, Homo sapiens
aaaatgtctgttaactta

SEQ ID NO: 708516 - DNA, 15 bp, Homo sapiens
aaaatgtgaaatctc

SEQ ID NO: 708517 - DNA, 12 bp, Homo sapiens
aaaatgtgattt

SEQ ID NO: 708518 - DNA, 16 bp, Homo sapiens
aaaatgtgatttttct

SEQ ID NO: 708519 - DNA, 20 bp, Homo sapiens
aaaatgtgtaattttgttct

SEQ ID NO: 708520 - DNA, 18 bp, Homo sapiens
aaaatgtgtacagtgaat

SEQ ID NO: 708521 - DNA, 22 bp, Homo sapiens
aaaatgtgtacagtgaattgtc

SEQ ID NO: 708522 - DNA, 11 bp, Homo sapiens
aaaatgtgtgg

SEQ ID NO: 708523 - DNA, 14 bp, Homo sapiens
aaaatgtgtttgct

SEQ ID NO: 708524 - DNA, 21 bp, Homo sapiens
aaaatgttacggcatcacact

SEQ ID NO: 708525 - DNA, 20 bp, Homo sapiens
aaaatgttacgtgaagaaat

SEQ ID NO: 708526 - DNA, 16 bp, Homo sapiens
aaaatgttctatttaa

SEQ ID NO: 708527 - DNA, 12 bp, Homo sapiens
aaaatgttcttt

SEQ ID NO: 708528 - DNA, 17 bp, Homo sapiens
aaaatgttgaaaagtca

SEQ ID NO: 708529 - DNA, 22 bp, Homo sapiens
aaaatgttgagaagcgttttta

SEQ ID NO: 708530 - DNA, 19 bp, Homo sapiens
aaaatgttggatttataaa

SEQ ID NO: 708531 - DNA, 22 bp, Homo sapiens
aaaatgttggatttataaatgc

SEQ ID NO: 708532 - DNA, 22 bp, Homo sapiens
aaaatgtttcattatgcacttt

SEQ ID NO: 708533 - DNA, 16 bp, Homo sapiens
aaaatgtttccactgg

SEQ ID NO: 708534 - DNA, 12 bp, Homo sapiens
aaaatgtttcct

SEQ ID NO: 708535 - DNA, 14 bp, Homo sapiens
aaaatgtttgagca

SEQ ID NO: 708536 - DNA, 13 bp, Homo sapiens
aaaatgttttatt

SEQ ID NO: 708537 - DNA, 22 bp, Homo sapiens
aaaatgtttttggtcttttata

SEQ ID NO: 708538 - DNA, 12 bp, Homo sapiens
aaaattaaaatg

SEQ ID NO: 708539 - DNA, 13 bp, Homo sapiens
aaaattaactgct

SEQ ID NO: 708540 - DNA, 18 bp, Homo sapiens
aaaattaagtagaacaaa

SEQ ID NO: 708541 - DNA, 14 bp, Homo sapiens
aaaattaagttgaa

SEQ ID NO: 708542 - DNA, 14 bp, Homo sapiens
aaaattacatgttt

SEQ ID NO: 708543 - DNA, 21 bp, Homo sapiens
aaaattacatgttttttcatt

SEQ ID NO: 708544 - DNA, 20 bp, Homo sapiens
aaaattacctttaattttaa

SEQ ID NO: 708545 - DNA, 12 bp, Homo sapiens
aaaattactaat

SEQ ID NO: 708546 - DNA, 23 bp, Homo sapiens
aaaattactattcttggttctta

SEQ ID NO: 708547 - DNA, 17 bp, Homo sapiens
aaaattactgtgaattg

SEQ ID NO: 708548 - DNA, 18 bp, Homo sapiens
aaaattactgtgaattgt

SEQ ID NO: 708549 - DNA, 14 bp, Homo sapiens
aaaattagaaagga

SEQ ID NO: 708550 - DNA, 14 bp, Homo sapiens
aaaattagaaattg

SEQ ID NO: 708551 - DNA, 20 bp, Homo sapiens
aaaattagaaattggctgga

SEQ ID NO: 708552 - DNA, 19 bp, Homo sapiens
aaaattaggatttcatgat

SEQ ID NO: 708553 - DNA, 13 bp, Homo sapiens
aaaattagtcttt

SEQ ID NO: 708554 - DNA, 23 bp, Homo sapiens
aaaattagtgaccattattcaca

SEQ ID NO: 708555 - DNA, 12 bp, Homo sapiens
aaaattataaag

SEQ ID NO: 708556 - DNA, 23 bp, Homo sapiens
aaaattataggaatatcaatata

SEQ ID NO: 708557 - DNA, 12 bp, Homo sapiens
aaaattattaga

SEQ ID NO: 708558 - DNA, 14 bp, Homo sapiens
aaaattattagaac

SEQ ID NO: 708559 - DNA, 21 bp, Homo sapiens
aaaattatttgaaaacatata

SEQ ID NO: 708560 - DNA, 14 bp, Homo sapiens
aaaattcaaaaagt

SEQ ID NO: 708561 - DNA, 17 bp, Homo sapiens
aaaattcaaaaagtgtt

SEQ ID NO: 708562 - DNA, 21 bp, Homo sapiens
aaaattcaaagcatggacatt

SEQ ID NO: 708563 - DNA, 18 bp, Homo sapiens
aaaattcaacaaacattt

SEQ ID NO: 708564 - DNA, 17 bp, Homo sapiens
aaaattcaattgtaaat

SEQ ID NO: 708565 - DNA, 13 bp, Homo sapiens
aaaattcagtttt

SEQ ID NO: 708566 - DNA, 16 bp, Homo sapiens
aaaattcagtttttgt

SEQ ID NO: 708567 - DNA, 21 bp, Homo sapiens
aaaattcagtttttgtatctt

SEQ ID NO: 708568 - DNA, 12 bp, Homo sapiens
aaaattcatttt

SEQ ID NO: 708569 - DNA, 22 bp, Homo sapiens
aaaattccaaatttttttctta

SEQ ID NO: 708570 - DNA, 12 bp, Homo sapiens
aaaattccagaa

SEQ ID NO: 708571 - DNA, 15 bp, Homo sapiens
aaaattcctatctca

SEQ ID NO: 708572 - DNA, 16 bp, Homo sapiens
aaaattcgctttctaa

SEQ ID NO: 708573 - DNA, 16 bp, Homo sapiens
aaaattctagctgtat

SEQ ID NO: 708574 - DNA, 12 bp, Homo sapiens
aaaattctggaa

SEQ ID NO: 708575 - DNA, 22 bp, Homo sapiens
aaaattctgttgttccatttta

SEQ ID NO: 708576 - DNA, 13 bp, Homo sapiens
aaaattctttaga

SEQ ID NO: 708577 - DNA, 16 bp, Homo sapiens
aaaattgaaaatatgt

SEQ ID NO: 708578 - DNA, 12 bp, Homo sapiens
aaaattgaaagt

SEQ ID NO: 708579 - DNA, 18 bp, Homo sapiens
aaaattgaaatgtaaggc

SEQ ID NO: 708580 - DNA, 14 bp, Homo sapiens
aaaattgacaaaaa

SEQ ID NO: 708581 - DNA, 14 bp, Homo sapiens
aaaattgataatta

SEQ ID NO: 708582 - DNA, 16 bp, Homo sapiens
aaaattgcatgaaact

SEQ ID NO: 708583 - DNA, 13 bp, Homo sapiens
aaaattgctatgt

SEQ ID NO: 708584 - DNA, 20 bp, Homo sapiens
aaaattgctatgttactatt

SEQ ID NO: 708585 - DNA, 22 bp, Homo sapiens
aaaattgctatgttactatttt

SEQ ID NO: 708586 - DNA, 16 bp, Homo sapiens
aaaattggttggagaa

SEQ ID NO: 708587 - DNA, 19 bp, Homo sapiens
aaaattgtaacctgcattt

SEQ ID NO: 708588 - DNA, 18 bp, Homo sapiens
aaaattgtataccaatgt

SEQ ID NO: 708589 - DNA, 13 bp, Homo sapiens
aaaattgtattga

SEQ ID NO: 708590 - DNA, 22 bp, Homo sapiens
aaaattgtattgaaaacactta

SEQ ID NO: 708591 - DNA, 15 bp, Homo sapiens
aaaattgtttcttga

SEQ ID NO: 708592 - DNA, 21 bp, Homo sapiens
aaaattgtttcttgacaagct

SEQ ID NO: 708593 - DNA, 20 bp, Homo sapiens
aaaattgttttcacttgtat

SEQ ID NO: 708594 - DNA, 21 bp, Homo sapiens
aaaatttaagcattgtttgct

SEQ ID NO: 708595 - DNA, 19 bp, Homo sapiens
aaaatttaagtatcttttt

SEQ ID NO: 708596 - DNA, 12 bp, Homo sapiens
aaaatttaattt

SEQ ID NO: 708597 - DNA, 12 bp, Homo sapiens
aaaatttataag

SEQ ID NO: 708598 - DNA, 14 bp, Homo sapiens
aaaatttatacacc

SEQ ID NO: 708599 - DNA, 20 bp, Homo sapiens
aaaatttattatatatttac

SEQ ID NO: 708600 - DNA, 22 bp, Homo sapiens
aaaatttattatatatttacag

SEQ ID NO: 708601 - DNA, 23 bp, Homo sapiens
aaaatttattatatatttacaga

SEQ ID NO: 708602 - DNA, 18 bp, Homo sapiens
aaaatttattttataaga

SEQ ID NO: 708603 - DNA, 14 bp, Homo sapiens
aaaatttcacagtt

SEQ ID NO: 708604 - DNA, 13 bp, Homo sapiens
aaaatttcacatt

SEQ ID NO: 708605 - DNA, 21 bp, Homo sapiens
aaaatttcataattctgaaac

SEQ ID NO: 708606 - DNA, 17 bp, Homo sapiens
aaaatttccagtacctt

SEQ ID NO: 708607 - DNA, 18 bp, Homo sapiens
aaaatttgaaatttagct

SEQ ID NO: 708608 - DNA, 16 bp, Homo sapiens
aaaatttgaacactgg

SEQ ID NO: 708609 - DNA, 20 bp, Homo sapiens
aaaatttgtgtaaatttgta

SEQ ID NO: 708610 - DNA, 15 bp, Homo sapiens
aaaatttgtgtgctt

SEQ ID NO: 708611 - DNA, 20 bp, Homo sapiens
aaaatttgttcttgtattta

SEQ ID NO: 708612 - DNA, 14 bp, Homo sapiens
aaaatttgttgcat

SEQ ID NO: 708613 - DNA, 21 bp, Homo sapiens
aaaattttacctctctctggg

SEQ ID NO: 708614 - DNA, 13 bp, Homo sapiens
aaaattttacttc

SEQ ID NO: 708615 - DNA, 16 bp, Homo sapiens
aaaattttacttccat

SEQ ID NO: 708616 - DNA, 18 bp, Homo sapiens
aaacagaataaaagttcc

SEQ ID NO: 708617 - DNA, 22 bp, Homo sapiens
aaacagacaatatgtgagtgcc

SEQ ID NO: 708618 - DNA, 12 bp, Homo sapiens
aaacagacactg

SEQ ID NO: 708619 - DNA, 14 bp, Homo sapiens
aaacagagaaagaa

SEQ ID NO: 708620 - DNA, 15 bp, Homo sapiens
aaacagagaaagaaa

SEQ ID NO: 708621 - DNA, 21 bp, Homo sapiens
aaacagagaaagaaaaggcaa

SEQ ID NO: 708622 - DNA, 23 bp, Homo sapiens
aaacagagaaagaaaaggcaaaa

SEQ ID NO: 708623 - DNA, 20 bp, Homo sapiens
aaacagaggccatggcagaa

SEQ ID NO: 708624 - DNA, 21 bp, Homo sapiens
aaacagagtggcctccctgct

SEQ ID NO: 708625 - DNA, 14 bp, Homo sapiens
aaacagatgaaaag

SEQ ID NO: 708626 - DNA, 18 bp, Homo sapiens
aaacagatgataaatatt

SEQ ID NO: 708627 - DNA, 20 bp, Homo sapiens
aaacagatgtaatgggaaga

SEQ ID NO: 708628 - DNA, 14 bp, Homo sapiens
aaaccaaacttgtt

SEQ ID NO: 708629 - DNA, 15 bp, Homo sapiens
aaaccaaagctgcct

SEQ ID NO: 708630 - DNA, 16 bp, Homo sapiens
aaaccaaagctgcctg

SEQ ID NO: 708631 - DNA, 21 bp, Homo sapiens
aaaccaagattttgaaggaaa

SEQ ID NO: 708632 - DNA, 14 bp, Homo sapiens
aaaccaaggactga

SEQ ID NO: 708633 - DNA, 13 bp, Homo sapiens
aaaccaagttatt

SEQ ID NO: 708634 - DNA, 13 bp, Homo sapiens
aaaccaatgctga

SEQ ID NO: 708635 - DNA, 21 bp, Homo sapiens
aaaccaatggtgatcctctat

SEQ ID NO: 708636 - DNA, 14 bp, Homo sapiens
aaaccaatttcttc

SEQ ID NO: 708637 - DNA, 16 bp, Homo sapiens
aaaccaatttcttcct

SEQ ID NO: 708638 - DNA, 19 bp, Homo sapiens
aaaccacaaacggagcccc

SEQ ID NO: 708639 - DNA, 12 bp, Homo sapiens
aaaccacacaaa

SEQ ID NO: 708640 - DNA, 14 bp, Homo sapiens
aaaccacacaaaga

SEQ ID NO: 708641 - DNA, 12 bp, Homo sapiens
aaaccacagcag

SEQ ID NO: 708642 - DNA, 18 bp, Homo sapiens
aaaccacagccctgtcag

SEQ ID NO: 708643 - DNA, 22 bp, Homo sapiens
aaaccacatcatggaccaaatg

SEQ ID NO: 708644 - DNA, 12 bp, Homo sapiens
aaaccacatggg

SEQ ID NO: 708645 - DNA, 13 bp, Homo sapiens
aaaccacttctcc

SEQ ID NO: 708646 - DNA, 13 bp, Homo sapiens
aaagccagggtct

SEQ ID NO: 708647 - DNA, 13 bp, Homo sapiens
aaagccatattcc

SEQ ID NO: 708648 - DNA, 20 bp, Homo sapiens
aaagccatattccagcagtg

SEQ ID NO: 708649 - DNA, 17 bp, Homo sapiens
aaagccatcatgccttg

SEQ ID NO: 708650 - DNA, 18 bp, Homo sapiens
aaagccatgccaataaag

SEQ ID NO: 708651 - DNA, 17 bp, Homo sapiens
aaagccattctgattat

SEQ ID NO: 708652 - DNA, 15 bp, Homo sapiens
aaagcccaaagtggt

SEQ ID NO: 708653 - DNA, 23 bp, Homo sapiens
aaagcccaagggatctggtccta

SEQ ID NO: 708654 - DNA, 14 bp, Homo sapiens
aaagcccacaggcc

SEQ ID NO: 708655 - DNA, 12 bp, Homo sapiens
aaagcccacctg

SEQ ID NO: 708656 - DNA, 13 bp, Homo sapiens
aaagcccacctga

SEQ ID NO: 708657 - DNA, 18 bp, Homo sapiens
aaagcccacctgggctgg

SEQ ID NO: 708658 - DNA, 19 bp, Homo sapiens
aaagcccacctgggctggg

SEQ ID NO: 708659 - DNA, 22 bp, Homo sapiens
aaagcccataaggccagaaact

SEQ ID NO: 708660 - DNA, 14 bp, Homo sapiens
aaagccctgcctct

SEQ ID NO: 708661 - DNA, 15 bp, Homo sapiens
aaagccctgcctctg

SEQ ID NO: 708662 - DNA, 18 bp, Homo sapiens
aaagccctgcctctgtgt

SEQ ID NO: 708663 - DNA, 21 bp, Homo sapiens
aaagccctggtaaaagggata

SEQ ID NO: 708664 - DNA, 13 bp, Homo sapiens
aaagccctgtgtt

SEQ ID NO: 708665 - DNA, 23 bp, Homo sapiens
aaagcccttatgtttaatcagcg

SEQ ID NO: 708666 - DNA, 18 bp, Homo sapiens
aaagccgtgctcttttaa

SEQ ID NO: 708667 - DNA, 20 bp, Homo sapiens
aaagcctagacaacctttct

SEQ ID NO: 708668 - DNA, 22 bp, Homo sapiens
aaagcctagacaacctttctgt

SEQ ID NO: 708669 - DNA, 17 bp, Homo sapiens
aaagcctatttttcaaa

SEQ ID NO: 708670 - DNA, 15 bp, Homo sapiens
aaagcctcagaaagg

SEQ ID NO: 708671 - DNA, 13 bp, Homo sapiens
aaagcctcagtga

SEQ ID NO: 708672 - DNA, 15 bp, Homo sapiens
aaagcctccaagggt

SEQ ID NO: 708673 - DNA, 19 bp, Homo sapiens
aaagcctccgcctgctgtg

SEQ ID NO: 708674 - DNA, 20 bp, Homo sapiens
aaagcctcctgccccctgcc

SEQ ID NO: 708675 - DNA, 19 bp, Homo sapiens
aaagcctctctctccctcc

SEQ ID NO: 708676 - DNA, 16 bp, Homo sapiens
aaagcctctgttttga

SEQ ID NO: 708677 - DNA, 19 bp, Homo sapiens
aaagcctcttatttttcta

SEQ ID NO: 708678 - DNA, 13 bp, Homo sapiens
aaagcctgctcaa

SEQ ID NO: 708679 - DNA, 13 bp, Homo sapiens
aaagcctggcttc

SEQ ID NO: 708680 - DNA, 14 bp, Homo sapiens
aaagcctggcttct

SEQ ID NO: 708681 - DNA, 17 bp, Homo sapiens
aaagcctgtattctcaa

SEQ ID NO: 708682 - DNA, 19 bp, Homo sapiens
aaagcctgtcccaggactc

SEQ ID NO: 708683 - DNA, 20 bp, Homo sapiens
aaagcctgtcccaggactca

SEQ ID NO: 708684 - DNA, 23 bp, Homo sapiens
aaagcctgtcccaggactcaccc

SEQ ID NO: 708685 - DNA, 21 bp, Homo sapiens
aaagcctgttgtttaagtgac

SEQ ID NO: 708686 - DNA, 18 bp, Homo sapiens
aaagccttaactaagact

SEQ ID NO: 708687 - DNA, 16 bp, Homo sapiens
aaagccttaagcaaat

SEQ ID NO: 708688 - DNA, 17 bp, Homo sapiens
aaagccttatcaagtgt

SEQ ID NO: 708689 - DNA, 10 bp, Homo sapiens
aaagccttta

SEQ ID NO: 708690 - DNA, 22 bp, Homo sapiens
aaagaagacctgagaatgtatc

SEQ ID NO: 708691 - DNA, 16 bp, Homo sapiens
aaagaagagaggggaa

SEQ ID NO: 708692 - DNA, 12 bp, Homo sapiens
aaagaagagcct

SEQ ID NO: 708693 - DNA, 22 bp, Homo sapiens
aaagaagagcgagagatcaaag

SEQ ID NO: 708694 - DNA, 19 bp, Homo sapiens
aaagaagagttttagagaa

SEQ ID NO: 708695 - DNA, 13 bp, Homo sapiens
aaagaagcttcat

SEQ ID NO: 708696 - DNA, 19 bp, Homo sapiens
aaagaagcttccacaaaat

SEQ ID NO: 708697 - DNA, 22 bp, Homo sapiens
aaagaagggatattaagaatct

SEQ ID NO: 708698 - DNA, 19 bp, Homo sapiens
aaagaagtgtccgagaact

SEQ ID NO: 708699 - DNA, 15 bp, Homo sapiens
aaagaagtttgatat

SEQ ID NO: 708700 - DNA, 15 bp, Homo sapiens
aaagaatacagaaag

SEQ ID NO: 708701 - DNA, 17 bp, Homo sapiens
aaagaatacagaaagat

SEQ ID NO: 708702 - DNA, 19 bp, Homo sapiens
aaagaatccctgcagcctg

SEQ ID NO: 708703 - DNA, 16 bp, Homo sapiens
aaagaatccctgttca

SEQ ID NO: 708704 - DNA, 15 bp, Homo sapiens
aaagaatctgtattc

SEQ ID NO: 708705 - DNA, 16 bp, Homo sapiens
aaagaatgagaaacat

SEQ ID NO: 708706 - DNA, 17 bp, Homo sapiens
aaagaatgagaaacata

SEQ ID NO: 708707 - DNA, 18 bp, Homo sapiens
aaagaatgccatttctca

SEQ ID NO: 708708 - DNA, 13 bp, Homo sapiens
aaagaatgttact

SEQ ID NO: 708709 - DNA, 19 bp, Homo sapiens
aaagaatgttactgcctta

SEQ ID NO: 708710 - DNA, 15 bp, Homo sapiens
aaagaattaaaaact

SEQ ID NO: 708711 - DNA, 21 bp, Homo sapiens
aaagaattaaacccacaagct

SEQ ID NO: 708712 - DNA, 18 bp, Homo sapiens
aaagaattccaaagcaaa

SEQ ID NO: 708713 - DNA, 19 bp, Homo sapiens
aaagacaaaaatcaaagaa

SEQ ID NO: 708714 - DNA, 21 bp, Homo sapiens
aaagacaaaaatcaaagaaca

SEQ ID NO: 708715 - DNA, 14 bp, Homo sapiens
aaagacaaaagaaa

SEQ ID NO: 708716 - DNA, 18 bp, Homo sapiens
aaagacaaaagtctgtct

SEQ ID NO: 708717 - DNA, 16 bp, Homo sapiens
aaagacaaattctgtt

SEQ ID NO: 708718 - DNA, 22 bp, Homo sapiens
aaagacaaattctgtttcttga

SEQ ID NO: 708719 - DNA, 21 bp, Homo sapiens
aaagacaagagagatgaaaac

SEQ ID NO: 708720 - DNA, 18 bp, Homo sapiens
aaagacacagaacacaga

SEQ ID NO: 708721 - DNA, 13 bp, Homo sapiens
aaagacacctact

SEQ ID NO: 708722 - DNA, 9 bp, Homo sapiens
aaagacaga

SEQ ID NO: 708723 - DNA, 13 bp, Homo sapiens
aaaaaaaaaaact

SEQ ID NO: 708724 - DNA, 13 bp, Homo sapiens
aaaaaaaaagaaa

SEQ ID NO: 708725 - DNA, 13 bp, Homo sapiens
aaaaaaaaaggaa

SEQ ID NO: 708726 - DNA, 14 bp, Homo sapiens
aaaaaaaaatgttc

SEQ ID NO: 708727 - DNA, 11 bp, Homo sapiens
aaaaaaaactc

SEQ ID NO: 708728 - DNA, 11 bp, Homo sapiens
aaaaaaaagaa

SEQ ID NO: 708729 - DNA, 13 bp, Homo sapiens
aaaaaaaagcttc

SEQ ID NO: 708730 - DNA, 10 bp, Homo sapiens
aaaaaaaagt

SEQ ID NO: 708731 - DNA, 13 bp, Homo sapiens
aaaaaaaagtcag

SEQ ID NO: 708732 - DNA, 13 bp, Homo sapiens
aaaaaaaatactt

SEQ ID NO: 708733 - DNA, 13 bp, Homo sapiens
aaaaaaaattgta

SEQ ID NO: 708734 - DNA, 11 bp, Homo sapiens
aaaaaaactga

SEQ ID NO: 708735 - DNA, 9 bp, Homo sapiens
aaaaaaaga

SEQ ID NO: 708736 - DNA, 12 bp, Homo sapiens
aaaaaaagactg

SEQ ID NO: 708737 - DNA, 14 bp, Homo sapiens
aaaaaaagatctgt

SEQ ID NO: 708738 - DNA, 12 bp, Homo sapiens
aaaaaaagcaaa

SEQ ID NO: 708739 - DNA, 12 bp, Homo sapiens
aaaaaaagcata

SEQ ID NO: 708740 - DNA, 12 bp, Homo sapiens
aaaaaaatacaa

SEQ ID NO: 708741 - DNA, 11 bp, Homo sapiens
aaaaaaatata

SEQ ID NO: 708742 - DNA, 12 bp, Homo sapiens
aaaaaaatatat

SEQ ID NO: 708743 - DNA, 13 bp, Homo sapiens
aaaaaaattttta

SEQ ID NO: 708744 - DNA, 11 bp, Homo sapiens
aaaaaacaaaa

SEQ ID NO: 708745 - DNA, 13 bp, Homo sapiens
aaaaaacaagaaa

SEQ ID NO: 708746 - DNA, 11 bp, Homo sapiens
aacctcccaga

SEQ ID NO: 708747 - DNA, 17 bp, Homo sapiens
aacctcccagaggtcca

SEQ ID NO: 708748 - DNA, 19 bp, Homo sapiens
aacctccgcctcccgggtt

SEQ ID NO: 708749 - DNA, 13 bp, Homo sapiens
aacctcctggaca

SEQ ID NO: 708750 - DNA, 23 bp, Homo sapiens
aacctcgaggaactccaggacga

SEQ ID NO: 708751 - DNA, 19 bp, Homo sapiens
aacctcgctggactctcag

SEQ ID NO: 708752 - DNA, 21 bp, Homo sapiens
aacctcggcttgtgggctggt

SEQ ID NO: 708753 - DNA, 16 bp, Homo sapiens
aacctcgggcctgctg

SEQ ID NO: 708754 - DNA, 19 bp, Homo sapiens
aacctctcgccatgatcag

SEQ ID NO: 708755 - DNA, 22 bp, Homo sapiens
aacctctcgccatgatcagaca

SEQ ID NO: 708756 - DNA, 20 bp, Homo sapiens
aacctctctaagccacagct

SEQ ID NO: 708757 - DNA, 20 bp, Homo sapiens
aacctctgatttattttgta

SEQ ID NO: 708758 - DNA, 9 bp, Homo sapiens
aacctctgg

SEQ ID NO: 708759 - DNA, 13 bp, Homo sapiens
aacctctggccct

SEQ ID NO: 708760 - DNA, 21 bp, Homo sapiens
aacctctggcccttggaataa

SEQ ID NO: 708761 - DNA, 12 bp, Homo sapiens
aacctcttcccc

SEQ ID NO: 708762 - DNA, 11 bp, Homo sapiens
aacctgaagat

SEQ ID NO: 708763 - DNA, 21 bp, Homo sapiens
aacctgaagatgtctcctcaa

SEQ ID NO: 708764 - DNA, 15 bp, Homo sapiens
aacctgaagtttttt

SEQ ID NO: 708765 - DNA, 13 bp, Homo sapiens
aacctgacaaaaa

SEQ ID NO: 708766 - DNA, 18 bp, Homo sapiens
aacctgatgccccttccc

SEQ ID NO: 708767 - DNA, 17 bp, Homo sapiens
aacctgatgttaaaatt

SEQ ID NO: 708768 - DNA, 18 bp, Homo sapiens
aacctgatgttaaaattc

SEQ ID NO: 708769 - DNA, 14 bp, Homo sapiens
aacctgcaaaaaat

SEQ ID NO: 708770 - DNA, 13 bp, Homo sapiens
aacctgcacacag

SEQ ID NO: 708771 - DNA, 15 bp, Homo sapiens
aacctgcacacagga

SEQ ID NO: 708772 - DNA, 19 bp, Homo sapiens
aacctgcacacaggacagc

SEQ ID NO: 708773 - DNA, 14 bp, Homo sapiens
aacctgcactgaaa

SEQ ID NO: 708774 - DNA, 16 bp, Homo sapiens
aacctgccagtcccag

SEQ ID NO: 708775 - DNA, 14 bp, Homo sapiens
aacctgcctgtgca

SEQ ID NO: 708776 - DNA, 19 bp, Homo sapiens
aacctgcctgtgcatgacc

SEQ ID NO: 708777 - DNA, 19 bp, Homo sapiens
aacctgctggatgggactc

SEQ ID NO: 708778 - DNA, 11 bp, Homo sapiens
aacctggaaag

SEQ ID NO: 708779 - DNA, 22 bp, Homo sapiens
aacctggaatctacaagccaaa

SEQ ID NO: 708780 - DNA, 15 bp, Homo sapiens
aacctggacctggaa

SEQ ID NO: 708781 - DNA, 20 bp, Homo sapiens
aacctggagatgcagctact

SEQ ID NO: 708782 - DNA, 16 bp, Homo sapiens
aaccccagttctgctc

SEQ ID NO: 708783 - DNA, 20 bp, Homo sapiens
aacccccaaaatccaaaact

SEQ ID NO: 708784 - DNA, 12 bp, Homo sapiens
aacccccaagga

SEQ ID NO: 708785 - DNA, 15 bp, Homo sapiens
aacccccaccccaca

SEQ ID NO: 708786 - DNA, 18 bp, Homo sapiens
aacccccaccccacactt

SEQ ID NO: 708787 - DNA, 15 bp, Homo sapiens
aaccccccaagacca

SEQ ID NO: 708788 - DNA, 17 bp, Homo sapiens
aaccccccaatgtctgt

SEQ ID NO: 708789 - DNA, 16 bp, Homo sapiens
aaccccccaggcccta

SEQ ID NO: 708790 - DNA, 13 bp, Homo sapiens
aacccccctcctg

SEQ ID NO: 708791 - DNA, 18 bp, Homo sapiens
aacccccctcctgctcct

SEQ ID NO: 708792 - DNA, 15 bp, Homo sapiens
aaccccctccctgtc

SEQ ID NO: 708793 - DNA, 21 bp, Homo sapiens
aaccccctcggagcctgtgtt

SEQ ID NO: 708794 - DNA, 17 bp, Homo sapiens
aaccccgcggtgctctg

SEQ ID NO: 708795 - DNA, 20 bp, Homo sapiens
aaccccgcggtgctctggcg

SEQ ID NO: 708796 - DNA, 20 bp, Homo sapiens
aaccccggggtgcccacagg

SEQ ID NO: 708797 - DNA, 11 bp, Homo sapiens
aacccctaaga

SEQ ID NO: 708798 - DNA, 19 bp, Homo sapiens
aacccctaagactgccttc

SEQ ID NO: 708799 - DNA, 16 bp, Homo sapiens
aacccctcctggcctg

SEQ ID NO: 708800 - DNA, 13 bp, Homo sapiens
aacccctggccag

SEQ ID NO: 708801 - DNA, 21 bp, Homo sapiens
aacccctggccagctctgagg

SEQ ID NO: 708802 - DNA, 21 bp, Homo sapiens
aacccctgtacccagctcctt

SEQ ID NO: 708803 - DNA, 12 bp, Homo sapiens
aacccctgtccc

SEQ ID NO: 708804 - DNA, 12 bp, Homo sapiens
aacccctgtgtc

SEQ ID NO: 708805 - DNA, 23 bp, Homo sapiens
aacccgagtcattcgttctgtgg

SEQ ID NO: 708806 - DNA, 17 bp, Homo sapiens
aacccgccctcaggggc

SEQ ID NO: 708807 - DNA, 23 bp, Homo sapiens
aacccgccctcaggggcctctct

SEQ ID NO: 708808 - DNA, 20 bp, Homo sapiens
aacccgctggagcccacagc

SEQ ID NO: 708809 - DNA, 16 bp, Homo sapiens
aacccggcttcctgtg

SEQ ID NO: 708810 - DNA, 18 bp, Homo sapiens
aacccggtgctccctctg

SEQ ID NO: 708811 - DNA, 14 bp, Homo sapiens
aaccctagcaaaag

SEQ ID NO: 708812 - DNA, 17 bp, Homo sapiens
aaccctatacaagttgt

SEQ ID NO: 708813 - DNA, 16 bp, Homo sapiens
aacttgctttcttctt

SEQ ID NO: 708814 - DNA, 19 bp, Homo sapiens
aacttgctttcttctttcc

SEQ ID NO: 708815 - DNA, 23 bp, Homo sapiens
aacttggaaaaatccagaaagaa

SEQ ID NO: 708816 - DNA, 16 bp, Homo sapiens
aacttggacccttgga

SEQ ID NO: 708817 - DNA, 20 bp, Homo sapiens
aacttggagagggggccgga

SEQ ID NO: 708818 - DNA, 15 bp, Homo sapiens
aacttggatttttga

SEQ ID NO: 708819 - DNA, 22 bp, Homo sapiens
aacttggcagctttttctgtgg

SEQ ID NO: 708820 - DNA, 12 bp, Homo sapiens
aacttggcattt

SEQ ID NO: 708821 - DNA, 16 bp, Homo sapiens
aacttggcatttctat

SEQ ID NO: 708822 - DNA, 13 bp, Homo sapiens
aacttggggaaca

SEQ ID NO: 708823 - DNA, 21 bp, Homo sapiens
aacttgtaaaaagggggctgc

SEQ ID NO: 708824 - DNA, 14 bp, Homo sapiens
aacttgtaaataca

SEQ ID NO: 708825 - DNA, 13 bp, Homo sapiens
aacttgtatattc

SEQ ID NO: 708826 - DNA, 14 bp, Homo sapiens
aacttgtatattcc

SEQ ID NO: 708827 - DNA, 15 bp, Homo sapiens
aacttgtctcttcat

SEQ ID NO: 708828 - DNA, 22 bp, Homo sapiens
aacttgtgaactccatcattca

SEQ ID NO: 708829 - DNA, 18 bp, Homo sapiens
aacttgttattgtgaatg

SEQ ID NO: 708830 - DNA, 20 bp, Homo sapiens
aacttgttattgtgaatgat

SEQ ID NO: 708831 - DNA, 14 bp, Homo sapiens
aacttgttcattta

SEQ ID NO: 708832 - DNA, 16 bp, Homo sapiens
aacttgttcatttaga

SEQ ID NO: 708833 - DNA, 19 bp, Homo sapiens
aactttaaaactgtattta

SEQ ID NO: 708834 - DNA, 21 bp, Homo sapiens
aactttaaacctgtagaatca

SEQ ID NO: 708835 - DNA, 15 bp, Homo sapiens
aactttaagaggaca

SEQ ID NO: 708836 - DNA, 12 bp, Homo sapiens
aactttaatcaa

SEQ ID NO: 708837 - DNA, 20 bp, Homo sapiens
aactttaccataaagccttt

SEQ ID NO: 708838 - DNA, 21 bp, Homo sapiens
aactttaccataaagccttta

SEQ ID NO: 708839 - DNA, 22 bp, Homo sapiens
aactttaccataaagcctttaa

SEQ ID NO: 708840 - DNA, 13 bp, Homo sapiens
aactttacctttt

SEQ ID NO: 708841 - DNA, 15 bp, Homo sapiens
aactttactctgtgt

SEQ ID NO: 708842 - DNA, 21 bp, Homo sapiens
aactttactctgtgtttaaaa

SEQ ID NO: 708843 - DNA, 11 bp, Homo sapiens
aactttactgt

SEQ ID NO: 708844 - DNA, 15 bp, Homo sapiens
aactttagaaataaa

SEQ ID NO: 708845 - DNA, 20 bp, Homo sapiens
aactttagaaataaacctta

SEQ ID NO: 708846 - DNA, 23 bp, Homo sapiens
aactttagtttgcctgcagtttc

SEQ ID NO: 708847 - DNA, 22 bp, Homo sapiens
aactttatcagggaaactaaga

SEQ ID NO: 708848 - DNA, 17 bp, Homo sapiens
aactttatgtactgctg

SEQ ID NO: 708849 - DNA, 13 bp, Homo sapiens
aactttatgtgta

SEQ ID NO: 708850 - DNA, 14 bp, Homo sapiens
aactttattaaata

SEQ ID NO: 708851 - DNA, 17 bp, Homo sapiens
aactttattaaatacaa

SEQ ID NO: 708852 - DNA, 15 bp, Homo sapiens
aactttattgcatat

SEQ ID NO: 708853 - DNA, 20 bp, Homo sapiens
aactttatttaaatgcatgt

SEQ ID NO: 708854 - DNA, 22 bp, Homo sapiens
aactttatttaaatgcatgtct

SEQ ID NO: 708855 - DNA, 23 bp, Homo sapiens
aactttcaaaagggaagagtttt

SEQ ID NO: 708856 - DNA, 17 bp, Homo sapiens
aactttcacttcttcct

SEQ ID NO: 708857 - DNA, 12 bp, Homo sapiens
aactttcacttt

SEQ ID NO: 708858 - DNA, 16 bp, Homo sapiens
aactttcactttgaaa

SEQ ID NO: 708859 - DNA, 14 bp, Homo sapiens
aactttcagaggca

SEQ ID NO: 708860 - DNA, 18 bp, Homo sapiens
aactttcataccacttga

SEQ ID NO: 708861 - DNA, 19 bp, Homo sapiens
aactttcattccttcagat

SEQ ID NO: 708862 - DNA, 16 bp, Homo sapiens
aactttccaaacacca

SEQ ID NO: 708863 - DNA, 23 bp, Homo sapiens
aactttcccaggttctgtttatg

SEQ ID NO: 708864 - DNA, 16 bp, Homo sapiens
aactttcgaccgactt

SEQ ID NO: 708865 - DNA, 21 bp, Homo sapiens
aactttcgaccgactttcccc

SEQ ID NO: 708866 - DNA, 22 bp, Homo sapiens
aactttctccatttaagacaca

SEQ ID NO: 708867 - DNA, 23 bp, Homo sapiens
aactttctccatttaagacacat

SEQ ID NO: 708868 - DNA, 12 bp, Homo sapiens
aactttctccct

SEQ ID NO: 708869 - DNA, 14 bp, Homo sapiens
aactttctccctca

SEQ ID NO: 708870 - DNA, 11 bp, Homo sapiens
aactttgaaag

SEQ ID NO: 708871 - DNA, 12 bp, Homo sapiens
aactttgaaagt

SEQ ID NO: 708872 - DNA, 12 bp, Homo sapiens
aactttgatctc

SEQ ID NO: 708873 - DNA, 22 bp, Homo sapiens
aactttgcaaattatttattac

SEQ ID NO: 708874 - DNA, 16 bp, Homo sapiens
aagaaaggaaaagaaa

SEQ ID NO: 708875 - DNA, 16 bp, Homo sapiens
aagaaaggaaaccttt

SEQ ID NO: 708876 - DNA, 20 bp, Homo sapiens
aagaaaggaagcattgtaaa

SEQ ID NO: 708877 - DNA, 16 bp, Homo sapiens
aagaaaggaggggaga

SEQ ID NO: 708878 - DNA, 17 bp, Homo sapiens
aagaaaggatataaaag

SEQ ID NO: 708879 - DNA, 20 bp, Homo sapiens
aagaaaggatataaaaggat

SEQ ID NO: 708880 - DNA, 20 bp, Homo sapiens
aagaaagggaaactggctga

SEQ ID NO: 708881 - DNA, 16 bp, Homo sapiens
aagaaagtcagccata

SEQ ID NO: 708882 - DNA, 18 bp, Homo sapiens
aagaaagtgtatttggaa

SEQ ID NO: 708883 - DNA, 16 bp, Homo sapiens
aagaaagttctacagt

SEQ ID NO: 708884 - DNA, 13 bp, Homo sapiens
aagaaataaaaat

SEQ ID NO: 708885 - DNA, 21 bp, Homo sapiens
aagaaataaaaggaagccaaa

SEQ ID NO: 708886 - DNA, 14 bp, Homo sapiens
aagaaataaatgaa

SEQ ID NO: 708887 - DNA, 13 bp, Homo sapiens
aagaaatactgta

SEQ ID NO: 708888 - DNA, 15 bp, Homo sapiens
aagaaatactgtaca

SEQ ID NO: 708889 - DNA, 14 bp, Homo sapiens
aagaaatagaacaa

SEQ ID NO: 708890 - DNA, 17 bp, Homo sapiens
aagaaatagagccaact

SEQ ID NO: 708891 - DNA, 15 bp, Homo sapiens
aagaaatatctgtga

SEQ ID NO: 708892 - DNA, 17 bp, Homo sapiens
aagaaatatctgtgaaa

SEQ ID NO: 708893 - DNA, 19 bp, Homo sapiens
aagaaatatctgtgaaata

SEQ ID NO: 708894 - DNA, 20 bp, Homo sapiens
aagaaatattccaaatgtct

SEQ ID NO: 708895 - DNA, 13 bp, Homo sapiens
aagaaatgatgga

SEQ ID NO: 708896 - DNA, 21 bp, Homo sapiens
aagaaatgattcaaattgctg

SEQ ID NO: 708897 - DNA, 22 bp, Homo sapiens
aagaaatgattcaaattgctgc

SEQ ID NO: 708898 - DNA, 19 bp, Homo sapiens
aagaaatggaatgaatctc

SEQ ID NO: 708899 - DNA, 11 bp, Homo sapiens
aagaaatggcg

SEQ ID NO: 708900 - DNA, 17 bp, Homo sapiens
aagaaatgggcctgcct

SEQ ID NO: 708901 - DNA, 18 bp, Homo sapiens
aagaaatgggcctgcctg

SEQ ID NO: 708902 - DNA, 19 bp, Homo sapiens
aagaaatgggcctgcctgc

SEQ ID NO: 708903 - DNA, 19 bp, Homo sapiens
aagaaatgggtttcttgcc

SEQ ID NO: 708904 - DNA, 21 bp, Homo sapiens
aagaaattcaggtacagaaaa

SEQ ID NO: 708905 - DNA, 23 bp, Homo sapiens
aagaaattccatacttctctcag

SEQ ID NO: 708906 - DNA, 21 bp, Homo sapiens
aagaacaaagagaaaaaatac

SEQ ID NO: 708907 - DNA, 21 bp, Homo sapiens
aagaacacaaagcggggggag

SEQ ID NO: 708908 - DNA, 15 bp, Homo sapiens
aagaacacacacata

SEQ ID NO: 708909 - DNA, 16 bp, Homo sapiens
aagaacacagcatgtg

SEQ ID NO: 708910 - DNA, 17 bp, Homo sapiens
aagaacacagcatgtgc

SEQ ID NO: 708911 - DNA, 19 bp, Homo sapiens
aagaacaccctatattttg

SEQ ID NO: 708912 - DNA, 18 bp, Homo sapiens
aagaacatacatgataca

SEQ ID NO: 708913 - DNA, 14 bp, Homo sapiens
aagaacatgatttt

SEQ ID NO: 708914 - DNA, 11 bp, Homo sapiens
aagaacatgtg

SEQ ID NO: 708915 - DNA, 16 bp, Homo sapiens
aagaaccaaaacttcc

SEQ ID NO: 708916 - DNA, 16 bp, Homo sapiens
aagaaccaaagaagaa

SEQ ID NO: 708917 - DNA, 12 bp, Homo sapiens
aagaaccaaata

SEQ ID NO: 708918 - DNA, 15 bp, Homo sapiens
aagaaccaaatacct

SEQ ID NO: 708919 - DNA, 14 bp, Homo sapiens
aagaaccagcccag

SEQ ID NO: 708920 - DNA, 15 bp, Homo sapiens
aagaaccagcccagc

SEQ ID NO: 708921 - DNA, 21 bp, Homo sapiens
aagaaccagcccagcctgccc

SEQ ID NO: 708922 - DNA, 22 bp, Homo sapiens
aagaacccatggaaaaatgcca

SEQ ID NO: 708923 - DNA, 21 bp, Homo sapiens
aagaacccctcgttagccttc

SEQ ID NO: 708924 - DNA, 13 bp, Homo sapiens
aagaacccctctg

SEQ ID NO: 708925 - DNA, 15 bp, Homo sapiens
aagaacccctctgct

SEQ ID NO: 708926 - DNA, 16 bp, Homo sapiens
aagaacccctctgtct

SEQ ID NO: 708927 - DNA, 20 bp, Homo sapiens
aagaacctgacatccactgt

SEQ ID NO: 708928 - DNA, 13 bp, Homo sapiens
aagaacctggaaa

SEQ ID NO: 708929 - DNA, 23 bp, Homo sapiens
aagaactatatgtgaatcctctt

SEQ ID NO: 708930 - DNA, 18 bp, Homo sapiens
aagaactcaccagggttt

SEQ ID NO: 708931 - DNA, 16 bp, Homo sapiens
aagaactccaccccca

SEQ ID NO: 708932 - DNA, 13 bp, Homo sapiens
aagaactccttat

SEQ ID NO: 708933 - DNA, 17 bp, Homo sapiens
aagaactccttattttg

SEQ ID NO: 708934 - DNA, 13 bp, Homo sapiens
aagaactgcactt

SEQ ID NO: 708935 - DNA, 21 bp, Homo sapiens
aagaactgcagatagcccagg

SEQ ID NO: 708936 - DNA, 23 bp, Homo sapiens
aagaactgcagatagcccaggag

SEQ ID NO: 708937 - DNA, 13 bp, Homo sapiens
aagaactgcatgg

SEQ ID NO: 708938 - DNA, 18 bp, Homo sapiens
aagaactgcatggaccta

SEQ ID NO: 708939 - DNA, 21 bp, Homo sapiens
aagaactgcttcatgtgaaca

SEQ ID NO: 708940 - DNA, 14 bp, Homo sapiens
aagaactgtacatt

SEQ ID NO: 708941 - DNA, 20 bp, Homo sapiens
aagaactgtacattgtgagc

SEQ ID NO: 708942 - DNA, 14 bp, Homo sapiens
aagaactgtgtctg

SEQ ID NO: 708943 - DNA, 18 bp, Homo sapiens
aactgatttaacactttt

SEQ ID NO: 708944 - DNA, 14 bp, Homo sapiens
aactgattttgtat

SEQ ID NO: 708945 - DNA, 15 bp, Homo sapiens
aactgcaaacagaaa

SEQ ID NO: 708946 - DNA, 18 bp, Homo sapiens
aactgcaaagtgaagttg

SEQ ID NO: 708947 - DNA, 18 bp, Homo sapiens
aactgcaatagagactgt

SEQ ID NO: 708948 - DNA, 23 bp, Homo sapiens
aactgcaatagagactgtagatt

SEQ ID NO: 708949 - DNA, 19 bp, Homo sapiens
aactgcacactatttccct

SEQ ID NO: 708950 - DNA, 14 bp, Homo sapiens
aactgcacagtgct

SEQ ID NO: 708951 - DNA, 11 bp, Homo sapiens
aactgcacatc

SEQ ID NO: 708952 - DNA, 13 bp, Homo sapiens
aactgcacatcta

SEQ ID NO: 708953 - DNA, 16 bp, Homo sapiens
aactgcagatagccca

SEQ ID NO: 708954 - DNA, 16 bp, Homo sapiens
aactgcagcctctctg

SEQ ID NO: 708955 - DNA, 16 bp, Homo sapiens
aactgcagctgtgagt

SEQ ID NO: 708956 - DNA, 16 bp, Homo sapiens
aactgcaggccctggc

SEQ ID NO: 708957 - DNA, 17 bp, Homo sapiens
aactgcaggccctggcc

SEQ ID NO: 708958 - DNA, 23 bp, Homo sapiens
aactgcagggaaaattatttgca

SEQ ID NO: 708959 - DNA, 13 bp, Homo sapiens
aactgcatctgga

SEQ ID NO: 708960 - DNA, 21 bp, Homo sapiens
aactgcattaccgcgttgtaa

SEQ ID NO: 708961 - DNA, 22 bp, Homo sapiens
aactgcattaccgcgttgtaaa

SEQ ID NO: 708962 - DNA, 23 bp, Homo sapiens
aactgcattaccgcgttgtaaaa

SEQ ID NO: 708963 - DNA, 10 bp, Homo sapiens
aactgcattt

SEQ ID NO: 708964 - DNA, 11 bp, Homo sapiens
aactgccatta

SEQ ID NO: 708965 - DNA, 12 bp, Homo sapiens
aactgccattat

SEQ ID NO: 708966 - DNA, 18 bp, Homo sapiens
aactgccattattttctg

SEQ ID NO: 708967 - DNA, 23 bp, Homo sapiens
aactgccattattttctgtcaga

SEQ ID NO: 708968 - DNA, 15 bp, Homo sapiens
aactgcccagcccct

SEQ ID NO: 708969 - DNA, 13 bp, Homo sapiens
aactgccccaggg

SEQ ID NO: 708970 - DNA, 16 bp, Homo sapiens
aactgcccccaacttt

SEQ ID NO: 708971 - DNA, 13 bp, Homo sapiens
aactgcccccact

SEQ ID NO: 708972 - DNA, 18 bp, Homo sapiens
aactgccctaagccccca

SEQ ID NO: 708973 - DNA, 19 bp, Homo sapiens
aactgccctaagcccccag

SEQ ID NO: 708974 - DNA, 10 bp, Homo sapiens
aactgccctt

SEQ ID NO: 708975 - DNA, 17 bp, Homo sapiens
aactgcccttgctgccc

SEQ ID NO: 708976 - DNA, 17 bp, Homo sapiens
aactgccgtaatttaac

SEQ ID NO: 708977 - DNA, 20 bp, Homo sapiens
aactgcctactccaaaatgt

SEQ ID NO: 708978 - DNA, 18 bp, Homo sapiens
aactgcctggggggcagg

SEQ ID NO: 708979 - DNA, 20 bp, Homo sapiens
aactgcgataactgagaaac

SEQ ID NO: 708980 - DNA, 19 bp, Homo sapiens
aactgctaaattctatgtt

SEQ ID NO: 708981 - DNA, 17 bp, Homo sapiens
aactgctcagctctggt

SEQ ID NO: 708982 - DNA, 15 bp, Homo sapiens
aactgctcttacttt

SEQ ID NO: 708983 - DNA, 17 bp, Homo sapiens
aactgctcttgaacatt

SEQ ID NO: 708984 - DNA, 15 bp, Homo sapiens
aactgctgactgttt

SEQ ID NO: 708985 - DNA, 20 bp, Homo sapiens
aactgctgactgttttctct

SEQ ID NO: 708986 - DNA, 21 bp, Homo sapiens
aactgctgactgttttctctt

SEQ ID NO: 708987 - DNA, 13 bp, Homo sapiens
aactgctgagcca

SEQ ID NO: 708988 - DNA, 16 bp, Homo sapiens
aactgctgagccactc

SEQ ID NO: 708989 - DNA, 17 bp, Homo sapiens
aactgcttcatctcctt

SEQ ID NO: 708990 - DNA, 18 bp, Homo sapiens
aactgcttcatgtgaaca

SEQ ID NO: 708991 - DNA, 18 bp, Homo sapiens
aactgctttattttccct

SEQ ID NO: 708992 - DNA, 17 bp, Homo sapiens
aactgctttcaagtctg

SEQ ID NO: 708993 - DNA, 18 bp, Homo sapiens
aactgctttcaagtctga

SEQ ID NO: 708994 - DNA, 17 bp, Homo sapiens
aactgctttctgttcca

SEQ ID NO: 708995 - DNA, 21 bp, Homo sapiens
aactgctttctttcgtttgtt

SEQ ID NO: 708996 - DNA, 17 bp, Homo sapiens
aactgctttgtgcatat

SEQ ID NO: 708997 - DNA, 18 bp, Homo sapiens
aactgctttgtgcatatg

SEQ ID NO: 708998 - DNA, 21 bp, Homo sapiens
aactgcttttcctcaagcaat

SEQ ID NO: 708999 - DNA, 17 bp, Homo sapiens
aactggaaaacagaaca

SEQ ID NO: 709000 - DNA, 19 bp, Homo sapiens
aactggaaaacagaacact

SEQ ID NO: 709001 - DNA, 20 bp, Homo sapiens
aactggaaaacagaacactt

SEQ ID NO: 709002 - DNA, 20 bp, Homo sapiens
aactggaagcacagcctcgg

SEQ ID NO: 709003 - DNA, 20 bp, Homo sapiens
aactggaagcatgtaggaga

SEQ ID NO: 709004 - DNA, 14 bp, Homo sapiens
aactggattaaaac

SEQ ID NO: 709005 - DNA, 16 bp, Homo sapiens
aactggattaaaacaa

SEQ ID NO: 709006 - DNA, 15 bp, Homo sapiens
aactggattaaactt

SEQ ID NO: 709007 - DNA, 16 bp, Homo sapiens
aactggattaaactta

SEQ ID NO: 709008 - DNA, 18 bp, Homo sapiens
aactggattatcacctta

SEQ ID NO: 709009 - DNA, 23 bp, Homo sapiens
aactggattttgaacgcttaagt

SEQ ID NO: 709010 - DNA, 19 bp, Homo sapiens
aactggcaattgtctattt

SEQ ID NO: 709011 - DNA, 22 bp, Homo sapiens
aactggcaggggagacaggagc

SEQ ID NO: 709012 - DNA, 24 bp, Homo sapiens
aacaccttcttggcttctgggacc

SEQ ID NO: 709013 - DNA, 12 bp, Homo sapiens
aacacctttcct

SEQ ID NO: 709014 - DNA, 19 bp, Homo sapiens
aacacgaaacttgttattg

SEQ ID NO: 709015 - DNA, 15 bp, Homo sapiens
aacacgaaagaaatg

SEQ ID NO: 709016 - DNA, 17 bp, Homo sapiens
aacacgcacaccctgcc

SEQ ID NO: 709017 - DNA, 14 bp, Homo sapiens
aacacgctgcctgg

SEQ ID NO: 709018 - DNA, 14 bp, Homo sapiens
aacacggcagctgt

SEQ ID NO: 709019 - DNA, 18 bp, Homo sapiens
aacacggcagctgtagct

SEQ ID NO: 709020 - DNA, 13 bp, Homo sapiens
aacacggccacat

SEQ ID NO: 709021 - DNA, 14 bp, Homo sapiens
aacactaaaaataa

SEQ ID NO: 709022 - DNA, 18 bp, Homo sapiens
aacactaacatataatgt

SEQ ID NO: 709023 - DNA, 19 bp, Homo sapiens
aacactaactcaccagccc

SEQ ID NO: 709024 - DNA, 16 bp, Homo sapiens
aacactaaggctgctt

SEQ ID NO: 709025 - DNA, 15 bp, Homo sapiens
aacactacagagtac

SEQ ID NO: 709026 - DNA, 17 bp, Homo sapiens
aacactatataaataag

SEQ ID NO: 709027 - DNA, 18 bp, Homo sapiens
aacactatataaataagc

SEQ ID NO: 709028 - DNA, 15 bp, Homo sapiens
aacactatatttatt

SEQ ID NO: 709029 - DNA, 16 bp, Homo sapiens
aacactatatttattt

SEQ ID NO: 709030 - DNA, 16 bp, Homo sapiens
aacactatgtttattt

SEQ ID NO: 709031 - DNA, 24 bp, Homo sapiens
aacactcagtggcccatggcattt

SEQ ID NO: 709032 - DNA, 21 bp, Homo sapiens
aacactccccattaacagatg

SEQ ID NO: 709033 - DNA, 23 bp, Homo sapiens
aacactccggtcagcccctggca

SEQ ID NO: 709034 - DNA, 12 bp, Homo sapiens
aacactcttttg

SEQ ID NO: 709035 - DNA, 20 bp, Homo sapiens
aacactgaagtgcttgcaga

SEQ ID NO: 709036 - DNA, 14 bp, Homo sapiens
aacactgcaggaca

SEQ ID NO: 709037 - DNA, 18 bp, Homo sapiens
aacactgcagtttcctgg

SEQ ID NO: 709038 - DNA, 14 bp, Homo sapiens
aacactgcctctga

SEQ ID NO: 709039 - DNA, 13 bp, Homo sapiens
aacactgcctgcc

SEQ ID NO: 709040 - DNA, 17 bp, Homo sapiens
aacactggacctggggg

SEQ ID NO: 709041 - DNA, 23 bp, Homo sapiens
aacactggcacactgctcttaag

SEQ ID NO: 709042 - DNA, 18 bp, Homo sapiens
aacactgtgatttatctt

SEQ ID NO: 709043 - DNA, 13 bp, Homo sapiens
aacactgtgccct

SEQ ID NO: 709044 - DNA, 18 bp, Homo sapiens
aacactgtgccctggtgg

SEQ ID NO: 709045 - DNA, 15 bp, Homo sapiens
aacacttcagacaca

SEQ ID NO: 709046 - DNA, 11 bp, Homo sapiens
aacacttccat

SEQ ID NO: 709047 - DNA, 20 bp, Homo sapiens
aacacttctcatcatattgt

SEQ ID NO: 709048 - DNA, 13 bp, Homo sapiens
aacacttctgctt

SEQ ID NO: 709049 - DNA, 14 bp, Homo sapiens
aacacttctgcttt

SEQ ID NO: 709050 - DNA, 13 bp, Homo sapiens
aacacttctgtat

SEQ ID NO: 709051 - DNA, 18 bp, Homo sapiens
aacacttctgtatgcatc

SEQ ID NO: 709052 - DNA, 21 bp, Homo sapiens
aacacttctgtatgcatcaga

SEQ ID NO: 709053 - DNA, 20 bp, Homo sapiens
aacactttagttatattcac

SEQ ID NO: 709054 - DNA, 21 bp, Homo sapiens
aacactttagttatattcact

SEQ ID NO: 709055 - DNA, 23 bp, Homo sapiens
aacactttgagcatttttaaggg

SEQ ID NO: 709056 - DNA, 13 bp, Homo sapiens
aacactttgtatt

SEQ ID NO: 709057 - DNA, 24 bp, Homo sapiens
aacactttttccatttcttcagag

SEQ ID NO: 709058 - DNA, 14 bp, Homo sapiens
aacagaaaacatcc

SEQ ID NO: 709059 - DNA, 14 bp, Homo sapiens
aacagaaaacattc

SEQ ID NO: 709060 - DNA, 19 bp, Homo sapiens
aacagaaaacattctgatt

SEQ ID NO: 709061 - DNA, 22 bp, Homo sapiens
aacagaaaactcccaatacaaa

SEQ ID NO: 709062 - DNA, 13 bp, Homo sapiens
aacagaaacaaaa

SEQ ID NO: 709063 - DNA, 16 bp, Homo sapiens
aacagaaacaaaaaca

SEQ ID NO: 709064 - DNA, 20 bp, Homo sapiens
aacagaaactacatttctac

SEQ ID NO: 709065 - DNA, 17 bp, Homo sapiens
aacagaaattgtatatt

SEQ ID NO: 709066 - DNA, 18 bp, Homo sapiens
aacagaaattgtatattg

SEQ ID NO: 709067 - DNA, 16 bp, Homo sapiens
aacagaactcgatgca

SEQ ID NO: 709068 - DNA, 19 bp, Homo sapiens
aacagaagcagcaaatgaa

SEQ ID NO: 709069 - DNA, 15 bp, Homo sapiens
aacagaagcatttgt

SEQ ID NO: 709070 - DNA, 17 bp, Homo sapiens
aacagaagcatttgtat

SEQ ID NO: 709071 - DNA, 21 bp, Homo sapiens
aacagaagcatttgtattttg

SEQ ID NO: 709072 - DNA, 13 bp, Homo sapiens
aacagaaggatga

SEQ ID NO: 709073 - DNA, 21 bp, Homo sapiens
aacagaagtatcaagccatgt

SEQ ID NO: 709074 - DNA, 16 bp, Homo sapiens
aacagaatcagtgtta

SEQ ID NO: 709075 - DNA, 23 bp, Homo sapiens
aacagaatcagtgttaaattcat

SEQ ID NO: 709076 - DNA, 14 bp, Homo sapiens
aacagaatttgaga

SEQ ID NO: 709077 - DNA, 15 bp, Homo sapiens
aacagaatttgagaa

SEQ ID NO: 709078 - DNA, 16 bp, Homo sapiens
aacagacaacagaagt

SEQ ID NO: 709079 - DNA, 14 bp, Homo sapiens
aacagacaggagaa

SEQ ID NO: 709080 - DNA, 15 bp, Homo sapiens
aacagacaggagaaa

SEQ ID NO: 709081 - DNA, 20 bp, Homo sapiens
aacagactagaagtatttgt

SEQ ID NO: 709082 - DNA, 13 bp, Homo sapiens
aacagactctcac

SEQ ID NO: 709083 - DNA, 15 bp, Homo sapiens
aacagagaaggcagg

SEQ ID NO: 709084 - DNA, 14 bp, Homo sapiens
aacagagagaatga

SEQ ID NO: 709085 - DNA, 23 bp, Homo sapiens
aacagagggagtttaatacagga

SEQ ID NO: 709086 - DNA, 21 bp, Homo sapiens
aacagagggccagagctaggg

SEQ ID NO: 709087 - DNA, 17 bp, Homo sapiens
aacagagtgaaaaatct

SEQ ID NO: 709088 - DNA, 19 bp, Homo sapiens
aacagagtgagaccctgtc

SEQ ID NO: 709089 - DNA, 20 bp, Homo sapiens
aacagagtggattgggctgc

SEQ ID NO: 709090 - DNA, 15 bp, Homo sapiens
aacagatatgttttt

SEQ ID NO: 709091 - DNA, 21 bp, Homo sapiens
aacagatcaacaatacctttt

SEQ ID NO: 709092 - DNA, 17 bp, Homo sapiens
aacagatcctttcaaaa

SEQ ID NO: 709093 - DNA, 14 bp, Homo sapiens
aacagatgaaaagc

SEQ ID NO: 709094 - DNA, 20 bp, Homo sapiens
aacagatgtttcttttgtat

SEQ ID NO: 709095 - DNA, 17 bp, Homo sapiens
aacagattcaggccagc

SEQ ID NO: 709096 - DNA, 14 bp, Homo sapiens
aacagattctgatt

SEQ ID NO: 709097 - DNA, 16 bp, Homo sapiens
aacagattgtttgcaa

SEQ ID NO: 709098 - DNA, 14 bp, Homo sapiens
aacagatttggaaa

SEQ ID NO: 709099 - DNA, 15 bp, Homo sapiens
aacagatttggaaag

SEQ ID NO: 709100 - DNA, 16 bp, Homo sapiens
aacagattttggggtt

SEQ ID NO: 709101 - DNA, 14 bp, Homo sapiens
aacagcaagaaata

SEQ ID NO: 709102 - DNA, 18 bp, Homo sapiens
aacagcactggctctctc

SEQ ID NO: 709103 - DNA, 20 bp, Homo sapiens
aacagcagactcagctctga

SEQ ID NO: 709104 - DNA, 21 bp, Homo sapiens
aacagcagaggttcttttaaa

SEQ ID NO: 709105 - DNA, 14 bp, Homo sapiens
aacagcagctcata

SEQ ID NO: 709106 - DNA, 19 bp, Homo sapiens
aacagcagctcatagaatt

SEQ ID NO: 709107 - DNA, 19 bp, Homo sapiens
aacagcagtgatctcaggg

SEQ ID NO: 709108 - DNA, 23 bp, Homo sapiens
aacagcagtgatctcagggcaga

SEQ ID NO: 709109 - DNA, 15 bp, Homo sapiens
aacagcagtgttccc

SEQ ID NO: 709110 - DNA, 19 bp, Homo sapiens
aacagcatgaataaaacac

SEQ ID NO: 709111 - DNA, 22 bp, Homo sapiens
aacagcatgtacggattttcag

SEQ ID NO: 709112 - DNA, 20 bp, Homo sapiens
aacagcattgctttctgaaa

SEQ ID NO: 709113 - DNA, 18 bp, Homo sapiens
aacagccaagattttcct

SEQ ID NO: 709114 - DNA, 20 bp, Homo sapiens
aacagcccaggcatctcctt

SEQ ID NO: 709115 - DNA, 19 bp, Homo sapiens
aacagccccccccttgaat

SEQ ID NO: 709116 - DNA, 17 bp, Homo sapiens
aacagccctcctctgca

SEQ ID NO: 709117 - DNA, 20 bp, Homo sapiens
aacagccgctcctgtctgcc

SEQ ID NO: 709118 - DNA, 16 bp, Homo sapiens
aacagcctctttttga

SEQ ID NO: 709119 - DNA, 21 bp, Homo sapiens
aacagcctggggttgtccccg

SEQ ID NO: 709120 - DNA, 12 bp, Homo sapiens
aacagccttagc

SEQ ID NO: 709121 - DNA, 22 bp, Homo sapiens
aacatgaatatggttggagagc

SEQ ID NO: 709122 - DNA, 17 bp, Homo sapiens
aacatgacccagcctga

SEQ ID NO: 709123 - DNA, 16 bp, Homo sapiens
aacatgaccctgggct

SEQ ID NO: 709124 - DNA, 21 bp, Homo sapiens
aacatgagtgaatagctttca

SEQ ID NO: 709125 - DNA, 14 bp, Homo sapiens
aacatgatgtgaga

SEQ ID NO: 709126 - DNA, 14 bp, Homo sapiens
aacatgatttcaaa

SEQ ID NO: 709127 - DNA, 12 bp, Homo sapiens
aacatgcacatt

SEQ ID NO: 709128 - DNA, 19 bp, Homo sapiens
aacatgcacatttatatat

SEQ ID NO: 709129 - DNA, 19 bp, Homo sapiens
aacatgcactgatgttgtg

SEQ ID NO: 709130 - DNA, 23 bp, Homo sapiens
aacatgcagctcttcaacatgac

SEQ ID NO: 709131 - DNA, 21 bp, Homo sapiens
aacatgcagttcattattttg

SEQ ID NO: 709132 - DNA, 12 bp, Homo sapiens
aacatgcctagt

SEQ ID NO: 709133 - DNA, 19 bp, Homo sapiens
aacatggacttgtatattt

SEQ ID NO: 709134 - DNA, 20 bp, Homo sapiens
aacatggagaaaccctgtct

SEQ ID NO: 709135 - DNA, 17 bp, Homo sapiens
aacatggcttaatctta

SEQ ID NO: 709136 - DNA, 12 bp, Homo sapiens
aacatgggaggg

SEQ ID NO: 709137 - DNA, 23 bp, Homo sapiens
aacatgggagggatcagccccgc

SEQ ID NO: 709138 - DNA, 15 bp, Homo sapiens
aacatgggcattggg

SEQ ID NO: 709139 - DNA, 21 bp, Homo sapiens
aacatgggctcttcactagtg

SEQ ID NO: 709140 - DNA, 23 bp, Homo sapiens
aacatggggttggctgggcccag

SEQ ID NO: 709141 - DNA, 14 bp, Homo sapiens
aacatgtaattaag

SEQ ID NO: 709142 - DNA, 13 bp, Homo sapiens
aaatgcccaagga

SEQ ID NO: 709143 - DNA, 17 bp, Homo sapiens
aaatgcccatttttgct

SEQ ID NO: 709144 - DNA, 14 bp, Homo sapiens
aaatgcctcagcta

SEQ ID NO: 709145 - DNA, 18 bp, Homo sapiens
aaatgcctcagtgtattt

SEQ ID NO: 709146 - DNA, 19 bp, Homo sapiens
aaatgcctcagtgtatttg

SEQ ID NO: 709147 - DNA, 22 bp, Homo sapiens
aaatgcctcagtgtatttgtat

SEQ ID NO: 709148 - DNA, 19 bp, Homo sapiens
aaatgcctgtctctagctg

SEQ ID NO: 709149 - DNA, 23 bp, Homo sapiens
aaatgcctgttgtatttatggat

SEQ ID NO: 709150 - DNA, 23 bp, Homo sapiens
aaatgccttaccctcatgttctt

SEQ ID NO: 709151 - DNA, 23 bp, Homo sapiens
aaatgccttagaaatgtaaactg

SEQ ID NO: 709152 - DNA, 13 bp, Homo sapiens
aaatgccttgtat

SEQ ID NO: 709153 - DNA, 14 bp, Homo sapiens
aaatgccttgtata

SEQ ID NO: 709154 - DNA, 15 bp, Homo sapiens
aaatgccttgtataa

SEQ ID NO: 709155 - DNA, 21 bp, Homo sapiens
aaatgcggaccaaactacttc

SEQ ID NO: 709156 - DNA, 21 bp, Homo sapiens
aaatgctattgttgtgggctt

SEQ ID NO: 709157 - DNA, 17 bp, Homo sapiens
aaatgctcataaagatg

SEQ ID NO: 709158 - DNA, 21 bp, Homo sapiens
aaatgctcataaagatgttaa

SEQ ID NO: 709159 - DNA, 24 bp, Homo sapiens
aaatgctcataaagatgttaaatg

SEQ ID NO: 709160 - DNA, 18 bp, Homo sapiens
aaatgctcattttctggt

SEQ ID NO: 709161 - DNA, 19 bp, Homo sapiens
aaatgctcattttctttag

SEQ ID NO: 709162 - DNA, 21 bp, Homo sapiens
aaatgctcttaaaatatcttc

SEQ ID NO: 709163 - DNA, 14 bp, Homo sapiens
aaatgctgcatttt

SEQ ID NO: 709164 - DNA, 19 bp, Homo sapiens
aaggtattttgtagatgtg

SEQ ID NO: 709165 - DNA, 14 bp, Homo sapiens
aaggtcactgtttc

SEQ ID NO: 709166 - DNA, 19 bp, Homo sapiens
aaggtcagcccgtttcaga

SEQ ID NO: 709167 - DNA, 22 bp, Homo sapiens
aaggtcagggacacatcccctt

SEQ ID NO: 709168 - DNA, 19 bp, Homo sapiens
aaggtcattttttttaaga

SEQ ID NO: 709169 - DNA, 12 bp, Homo sapiens
aaggtctattgg

SEQ ID NO: 709170 - DNA, 19 bp, Homo sapiens
aaggtctccttactctgag

SEQ ID NO: 709171 - DNA, 20 bp, Homo sapiens
aaggtctccttactctgagc

SEQ ID NO: 709172 - DNA, 22 bp, Homo sapiens
aaggtctccttactctgagccc

SEQ ID NO: 709173 - DNA, 19 bp, Homo sapiens
aaggtctgcactcctttat

SEQ ID NO: 709174 - DNA, 19 bp, Homo sapiens
aaggtcttcttgtgtcctg

SEQ ID NO: 709175 - DNA, 23 bp, Homo sapiens
aaggtcttcttgtgtcctgatga

SEQ ID NO: 709176 - DNA, 18 bp, Homo sapiens
aaggtctttcagtacttt

SEQ ID NO: 709177 - DNA, 19 bp, Homo sapiens
aaggtctttcagtactttt

SEQ ID NO: 709178 - DNA, 19 bp, Homo sapiens
aaggtctttggttcagcta

SEQ ID NO: 709179 - DNA, 11 bp, Homo sapiens
aaggtctttgt

SEQ ID NO: 709180 - DNA, 12 bp, Homo sapiens
aaggtctttgta

SEQ ID NO: 709181 - DNA, 23 bp, Homo sapiens
aaggagactcacctctgcctcaa

SEQ ID NO: 709182 - DNA, 17 bp, Homo sapiens
aaggagagatgacccct

SEQ ID NO: 709183 - DNA, 18 bp, Homo sapiens
aaggagagatgaccccta

SEQ ID NO: 709184 - DNA, 17 bp, Homo sapiens
aaggagagttcaagcct

SEQ ID NO: 709185 - DNA, 18 bp, Homo sapiens
aaggagatgtcttggaac

SEQ ID NO: 709186 - DNA, 17 bp, Homo sapiens
aaggagatttacaactg

SEQ ID NO: 709187 - DNA, 13 bp, Homo sapiens
aaggagatttctt

SEQ ID NO: 709188 - DNA, 20 bp, Homo sapiens
aaggagatttcttagttcat

SEQ ID NO: 709189 - DNA, 21 bp, Homo sapiens
aaggagcaaaaatctgagaaa

SEQ ID NO: 709190 - DNA, 12 bp, Homo sapiens
aaggagcacagg

SEQ ID NO: 709191 - DNA, 12 bp, Homo sapiens
aaggagcagaga

SEQ ID NO: 709192 - DNA, 15 bp, Homo sapiens
aaggagcagggtcct

SEQ ID NO: 709193 - DNA, 14 bp, Homo sapiens
aaggagcatcagcc

SEQ ID NO: 709194 - DNA, 15 bp, Homo sapiens
aaggagccagtttgc

SEQ ID NO: 709195 - DNA, 15 bp, Homo sapiens
aaggagcgctagtgc

SEQ ID NO: 709196 - DNA, 16 bp, Homo sapiens
aaggagctcaccctgc

SEQ ID NO: 709197 - DNA, 12 bp, Homo sapiens
aaggagctgcta

SEQ ID NO: 709198 - DNA, 14 bp, Homo sapiens
aaggagctgctata

SEQ ID NO: 709199 - DNA, 20 bp, Homo sapiens
aaggagctgctatagcctgg

SEQ ID NO: 709200 - DNA, 21 bp, Homo sapiens
aaggagcttacccaagctgtg

SEQ ID NO: 709201 - DNA, 13 bp, Homo sapiens
aaggagctttctc

SEQ ID NO: 709202 - DNA, 16 bp, Homo sapiens
aaggagctttctcaat

SEQ ID NO: 709203 - DNA, 20 bp, Homo sapiens
aaggagctttctcaatgtct

SEQ ID NO: 709204 - DNA, 14 bp, Homo sapiens
aaggaggacccagg

SEQ ID NO: 709205 - DNA, 15 bp, Homo sapiens
aaggaggacccagga

SEQ ID NO: 709206 - DNA, 18 bp, Homo sapiens
aaggaggacccaggacag

SEQ ID NO: 709207 - DNA, 18 bp, Homo sapiens
aaggaggccaaccagccc

SEQ ID NO: 709208 - DNA, 17 bp, Homo sapiens
aaggagggacttggctg

SEQ ID NO: 709209 - DNA, 16 bp, Homo sapiens
aaggagggcagagcca

SEQ ID NO: 709210 - DNA, 22 bp, Homo sapiens
aaggaggggaaaaaaatgttgt

SEQ ID NO: 709211 - DNA, 18 bp, Homo sapiens
aaggaggggaaacaatga

SEQ ID NO: 709212 - DNA, 21 bp, Homo sapiens
aaggaggggaaacaatgaaaa

SEQ ID NO: 709213 - DNA, 21 bp, Homo sapiens
aaggaggggagagacaggcag

SEQ ID NO: 709214 - DNA, 13 bp, Homo sapiens
aaggaggggccag

SEQ ID NO: 709215 - DNA, 12 bp, Homo sapiens
aaggagggtcca

SEQ ID NO: 709216 - DNA, 12 bp, Homo sapiens
aaggagggtgag

SEQ ID NO: 709217 - DNA, 15 bp, Homo sapiens
aaggaggtgagggat

SEQ ID NO: 709218 - DNA, 19 bp, Homo sapiens
aaggaggtgagggatgtga

SEQ ID NO: 709219 - DNA, 15 bp, Homo sapiens
aaggagtaagaacct

SEQ ID NO: 709220 - DNA, 18 bp, Homo sapiens
aaggagtaatctgtgtac

SEQ ID NO: 709221 - DNA, 17 bp, Homo sapiens
aaggagtcaaaactaca

SEQ ID NO: 709222 - DNA, 18 bp, Homo sapiens
aaggagtcactgagacca

SEQ ID NO: 709223 - DNA, 17 bp, Homo sapiens
aaggagtgcccgccttg

SEQ ID NO: 709224 - DNA, 23 bp, Homo sapiens
aaggatactgtaacactttacaa

SEQ ID NO: 709225 - DNA, 19 bp, Homo sapiens
aaggatatttaagaaaata

SEQ ID NO: 709226 - DNA, 22 bp, Homo sapiens
aaggatatttactacttttgca

SEQ ID NO: 709227 - DNA, 16 bp, Homo sapiens
aaggatccaggaatat

SEQ ID NO: 709228 - DNA, 17 bp, Homo sapiens
aaggatccaggaatatg

SEQ ID NO: 709229 - DNA, 20 bp, Homo sapiens
aaggatctctataacagatc

SEQ ID NO: 709230 - DNA, 20 bp, Homo sapiens
aaggatctctcaggagcaca

SEQ ID NO: 709231 - DNA, 22 bp, Homo sapiens
aaggatctctcaggagcacagg

SEQ ID NO: 709232 - DNA, 12 bp, Homo sapiens
aaggatctgctg

SEQ ID NO: 709233 - DNA, 15 bp, Homo sapiens
aaggatctgctgagg

SEQ ID NO: 709234 - DNA, 18 bp, Homo sapiens
aaggatctttgtggccaa

SEQ ID NO: 709235 - DNA, 20 bp, Homo sapiens
aaggatctttgtggccaagg

SEQ ID NO: 709236 - DNA, 20 bp, Homo sapiens
aaggatgaagaacacagcat

SEQ ID NO: 709237 - DNA, 23 bp, Homo sapiens
aaggatgatcgcccgataaagac

SEQ ID NO: 709238 - DNA, 22 bp, Homo sapiens
aaggatgcacagagttgttaca

SEQ ID NO: 709239 - DNA, 15 bp, Homo sapiens
aaggatgcacatata

SEQ ID NO: 709240 - DNA, 22 bp, Homo sapiens
aaggatgccaagaagtttaagg

SEQ ID NO: 709241 - DNA, 17 bp, Homo sapiens
aaggatgcttgtacata

SEQ ID NO: 709242 - DNA, 19 bp, Homo sapiens
aaggatgcttgtacataat

SEQ ID NO: 709243 - DNA, 17 bp, Homo sapiens
aaggatgggtcccctcc

SEQ ID NO: 709244 - DNA, 16 bp, Homo sapiens
aaggatggttagacag

SEQ ID NO: 709245 - DNA, 17 bp, Homo sapiens
aaggatgtaaacagtgc

SEQ ID NO: 709246 - DNA, 20 bp, Homo sapiens
aaggatgtaaacagtgcctg

SEQ ID NO: 709247 - DNA, 16 bp, Homo sapiens
aaggatgtacatttcc

SEQ ID NO: 709248 - DNA, 15 bp, Homo sapiens
aaggatgtcacaggg

SEQ ID NO: 709249 - DNA, 22 bp, Homo sapiens
aaggatgtgattgtggaatgga

SEQ ID NO: 709250 - DNA, 22 bp, Homo sapiens
aaggatgttacaagtttgctaa

SEQ ID NO: 709251 - DNA, 23 bp, Homo sapiens
aaggatgttacaagtttgctaaa

SEQ ID NO: 709252 - DNA, 18 bp, Homo sapiens
aaggatgtttagcagtgg

SEQ ID NO: 709253 - DNA, 13 bp, Homo sapiens
aaggattttacca

SEQ ID NO: 709254 - DNA, 20 bp, Homo sapiens
aaggattttaccaaagcatc

SEQ ID NO: 709255 - DNA, 16 bp, Homo sapiens
aaggatttttccatgt

SEQ ID NO: 709256 - DNA, 23 bp, Homo sapiens
aaggcaaaaaactcttaatctgt

SEQ ID NO: 709257 - DNA, 14 bp, Homo sapiens
aaggcaaaaaaggt

SEQ ID NO: 709258 - DNA, 18 bp, Homo sapiens
aaggcaaaaaaggtggag

SEQ ID NO: 709259 - DNA, 21 bp, Homo sapiens
aaggcaaaaatagtttggata

SEQ ID NO: 709260 - DNA, 20 bp, Homo sapiens
aaggcaaagcacgaaatgtt

SEQ ID NO: 709261 - DNA, 11 bp, Homo sapiens
aaggcaaaggc

SEQ ID NO: 709262 - DNA, 13 bp, Homo sapiens
aaggcaaaggcag

SEQ ID NO: 709263 - DNA, 12 bp, Homo sapiens
aaggcaaataat

SEQ ID NO: 709264 - DNA, 20 bp, Homo sapiens
aaggcaaatattgaagttgt

SEQ ID NO: 709265 - DNA, 13 bp, Homo sapiens
aaggcaagagggg

SEQ ID NO: 709266 - DNA, 21 bp, Homo sapiens
aaggcaagagggggtggaggg

SEQ ID NO: 709267 - DNA, 16 bp, Homo sapiens
aaggcaattttagtgt

SEQ ID NO: 709268 - DNA, 19 bp, Homo sapiens
aaggcactgtcaggaatgg

SEQ ID NO: 709269 - DNA, 17 bp, Homo sapiens
aaggcagaaagcaaaat

SEQ ID NO: 709270 - DNA, 14 bp, Homo sapiens
aaggcagacagcag

SEQ ID NO: 709271 - DNA, 15 bp, Homo sapiens
aaggcagagaaatct

SEQ ID NO: 709272 - DNA, 18 bp, Homo sapiens
aaggcagaggcctgggct

SEQ ID NO: 709273 - DNA, 21 bp, Homo sapiens
aaggcagccctcacctctgag

SEQ ID NO: 709274 - DNA, 23 bp, Homo sapiens
aaggcagctcacccctgggcagg

SEQ ID NO: 709275 - DNA, 11 bp, Homo sapiens
aaggcagctgc

SEQ ID NO: 709276 - DNA, 15 bp, Homo sapiens
aaggcagctgcctct

SEQ ID NO: 709277 - DNA, 17 bp, Homo sapiens
aaggcagctgcctctgc

SEQ ID NO: 709278 - DNA, 19 bp, Homo sapiens
aaggcagctgcctctgctc

SEQ ID NO: 709279 - DNA, 12 bp, Homo sapiens
aaggcagctgct

SEQ ID NO: 709280 - DNA, 15 bp, Homo sapiens
aaggcaggaagggaa

SEQ ID NO: 709281 - DNA, 19 bp, Homo sapiens
aaggcaggaatgtgtggca

SEQ ID NO: 709282 - DNA, 15 bp, Homo sapiens
aaggcaggcctattt

SEQ ID NO: 709283 - DNA, 17 bp, Homo sapiens
aaggcaggcctatttca

SEQ ID NO: 709284 - DNA, 19 bp, Homo sapiens
aaggcagggaatgcctgga

SEQ ID NO: 709285 - DNA, 12 bp, Homo sapiens
aaggcagggcag

SEQ ID NO: 709286 - DNA, 23 bp, Homo sapiens
aaggcaggtagatcgcttgagcc

SEQ ID NO: 709287 - DNA, 16 bp, Homo sapiens
aaggcaggtgcctcca

SEQ ID NO: 709288 - DNA, 22 bp, Homo sapiens
aaggcaggttggatgggagtgg

SEQ ID NO: 709289 - DNA, 23 bp, Homo sapiens
aaggcagtagaactccaggccct

SEQ ID NO: 709290 - DNA, 12 bp, Homo sapiens
aaggcagtgcat

SEQ ID NO: 709291 - DNA, 16 bp, Homo sapiens
aaggcagtgcatgcat

SEQ ID NO: 709292 - DNA, 21 bp, Homo sapiens
aaggcatacgagagcagaggt

SEQ ID NO: 709293 - DNA, 22 bp, Homo sapiens
aaggcatacgagagcagaggtc

SEQ ID NO: 709294 - DNA, 20 bp, Homo sapiens
aaggcatcagtccctatgta

SEQ ID NO: 709295 - DNA, 20 bp, Homo sapiens
aaggcatccttgtcttttga

SEQ ID NO: 709296 - DNA, 22 bp, Homo sapiens
aaggcatcgtcatgcacagtat

SEQ ID NO: 709297 - DNA, 12 bp, Homo sapiens
aaggcatgagaa

SEQ ID NO: 709298 - DNA, 21 bp, Homo sapiens
aaggcatgcctggacaaaccc

SEQ ID NO: 709299 - DNA, 14 bp, Homo sapiens
aaggcattctctga

SEQ ID NO: 709300 - DNA, 17 bp, Homo sapiens
aaggcattctctgaaga

SEQ ID NO: 709301 - DNA, 17 bp, Homo sapiens
aaggcatttattgccat

SEQ ID NO: 709302 - DNA, 17 bp, Homo sapiens
aaggccaaagataaaag

SEQ ID NO: 709303 - DNA, 20 bp, Homo sapiens
aaggccaaagataaaaggtt

SEQ ID NO: 709304 - DNA, 21 bp, Homo sapiens
aaggccaattcctatacgcag

SEQ ID NO: 709305 - DNA, 21 bp, Homo sapiens
aagggagggtgcagccctctt

SEQ ID NO: 709306 - DNA, 15 bp, Homo sapiens
aagggagtttaaaaa

SEQ ID NO: 709307 - DNA, 13 bp, Homo sapiens
aagggatcctgcc

SEQ ID NO: 709308 - DNA, 15 bp, Homo sapiens
aagggatctggtcct

SEQ ID NO: 709309 - DNA, 15 bp, Homo sapiens
aagggatggaaaagg

SEQ ID NO: 709310 - DNA, 21 bp, Homo sapiens
aagggatggaaaaggaagact

SEQ ID NO: 709311 - DNA, 14 bp, Homo sapiens
aagggatgggggaa

SEQ ID NO: 709312 - DNA, 14 bp, Homo sapiens
aagggatggtggag

SEQ ID NO: 709313 - DNA, 22 bp, Homo sapiens
aagggattgaggagttgcctga

SEQ ID NO: 709314 - DNA, 15 bp, Homo sapiens
aagggcaaataatga

SEQ ID NO: 709315 - DNA, 20 bp, Homo sapiens
aagggcacaaactgcagctg

SEQ ID NO: 709316 - DNA, 14 bp, Homo sapiens
aagggcacttaatt

SEQ ID NO: 709317 - DNA, 19 bp, Homo sapiens
aagggcacttaatttgtaa

SEQ ID NO: 709318 - DNA, 23 bp, Homo sapiens
aagctcatattttgtatatatct

SEQ ID NO: 709319 - DNA, 13 bp, Homo sapiens
aagctccaagccc

SEQ ID NO: 709320 - DNA, 16 bp, Homo sapiens
aagctccactgtcacc

SEQ ID NO: 709321 - DNA, 13 bp, Homo sapiens
aagctccagcttt

SEQ ID NO: 709322 - DNA, 19 bp, Homo sapiens
aagctccatgtgcatataa

SEQ ID NO: 709323 - DNA, 15 bp, Homo sapiens
aagctcccaccccac

SEQ ID NO: 709324 - DNA, 13 bp, Homo sapiens
aagctcccaggaa

SEQ ID NO: 709325 - DNA, 14 bp, Homo sapiens
aagctcccaggaac

SEQ ID NO: 709326 - DNA, 18 bp, Homo sapiens
aaggaaaattgaaagtat

SEQ ID NO: 709327 - DNA, 20 bp, Homo sapiens
aaggaaacaaccatgtcatt

SEQ ID NO: 709328 - DNA, 18 bp, Homo sapiens
aaggaaaccttttcttgt

SEQ ID NO: 709329 - DNA, 19 bp, Homo sapiens
aaggaaaccttttcttgta

SEQ ID NO: 709330 - DNA, 16 bp, Homo sapiens
aaggaaacgctacctc

SEQ ID NO: 709331 - DNA, 13 bp, Homo sapiens
aaggaaactttat

SEQ ID NO: 709332 - DNA, 20 bp, Homo sapiens
aaggaaagcaataaatgaat

SEQ ID NO: 709333 - DNA, 22 bp, Homo sapiens
aaggaaaggctcatttaaaaca

SEQ ID NO: 709334 - DNA, 13 bp, Homo sapiens
aaggaaagggaag

SEQ ID NO: 709335 - DNA, 21 bp, Homo sapiens
aaggaaagtcaagaagaatga

SEQ ID NO: 709336 - DNA, 11 bp, Homo sapiens
aaggaaagttg

SEQ ID NO: 709337 - DNA, 19 bp, Homo sapiens
aaggaaagttggacttgag

SEQ ID NO: 709338 - DNA, 23 bp, Homo sapiens
aaggaaagttggacttgagaaag

SEQ ID NO: 709339 - DNA, 14 bp, Homo sapiens
aaggaaataacatt

SEQ ID NO: 709340 - DNA, 22 bp, Homo sapiens
aaggaaataccagttctgggca

SEQ ID NO: 709341 - DNA, 15 bp, Homo sapiens
aaggaaatatatttg

SEQ ID NO: 709342 - DNA, 14 bp, Homo sapiens
aaggaaatattctt

SEQ ID NO: 709343 - DNA, 22 bp, Homo sapiens
aaggaaatctcaccccatccca

SEQ ID NO: 709344 - DNA, 14 bp, Homo sapiens
aaggaaatgatgga

SEQ ID NO: 709345 - DNA, 20 bp, Homo sapiens
aaggaaatgttgagggcaag

SEQ ID NO: 709346 - DNA, 13 bp, Homo sapiens
aaggaaattttac

SEQ ID NO: 709347 - DNA, 13 bp, Homo sapiens
aaggaacaaagac

SEQ ID NO: 709348 - DNA, 16 bp, Homo sapiens
aaggaacacagagcag

SEQ ID NO: 709349 - DNA, 13 bp, Homo sapiens
aaggaaccttcct

SEQ ID NO: 709350 - DNA, 18 bp, Homo sapiens
aaggaactctggcttcca

SEQ ID NO: 709351 - DNA, 12 bp, Homo sapiens
aaggaagaaaac

SEQ ID NO: 709352 - DNA, 14 bp, Homo sapiens
aaggaagaagaaat

SEQ ID NO: 709353 - DNA, 16 bp, Homo sapiens
aaggaagacagttcta

SEQ ID NO: 709354 - DNA, 14 bp, Homo sapiens
aaggaagagggctg

SEQ ID NO: 709355 - DNA, 13 bp, Homo sapiens
aaggaagatttga

SEQ ID NO: 709356 - DNA, 23 bp, Homo sapiens
aaggaagcattgtaaaataattc

SEQ ID NO: 709357 - DNA, 22 bp, Homo sapiens
aaggaagccagtcaccttctgg

SEQ ID NO: 709358 - DNA, 16 bp, Homo sapiens
aaggaagccttgctca

SEQ ID NO: 709359 - DNA, 18 bp, Homo sapiens
aaggaagctccactgtca

SEQ ID NO: 709360 - DNA, 16 bp, Homo sapiens
aaggaagctccttcct

SEQ ID NO: 709361 - DNA, 11 bp, Homo sapiens
aaggaaggaaa

SEQ ID NO: 709362 - DNA, 13 bp, Homo sapiens
aaggaaggaaaga

SEQ ID NO: 709363 - DNA, 20 bp, Homo sapiens
aaggaaggagactcacctct

SEQ ID NO: 709364 - DNA, 14 bp, Homo sapiens
aaggaaggagagat

SEQ ID NO: 709365 - DNA, 11 bp, Homo sapiens
aaggaaggagc

SEQ ID NO: 709366 - DNA, 16 bp, Homo sapiens
aaggaaggagggcaca

SEQ ID NO: 709367 - DNA, 23 bp, Homo sapiens
aaggaagggcagagaatggctgg

SEQ ID NO: 709368 - DNA, 14 bp, Homo sapiens
aaggaaggggtttt

SEQ ID NO: 709369 - DNA, 18 bp, Homo sapiens
aaggaaggtggatggccc

SEQ ID NO: 709370 - DNA, 21 bp, Homo sapiens
aaggaagtcaaagcaaggaaa

SEQ ID NO: 709371 - DNA, 14 bp, Homo sapiens
aaggaagtctagga

SEQ ID NO: 709372 - DNA, 17 bp, Homo sapiens
aaggaagtggggacaga

SEQ ID NO: 709373 - DNA, 14 bp, Homo sapiens
aaggaagtggggtg

SEQ ID NO: 709374 - DNA, 21 bp, Homo sapiens
aaggaataaattgctccttga

SEQ ID NO: 709375 - DNA, 21 bp, Homo sapiens
aaggaatagccagagaggagc

SEQ ID NO: 709376 - DNA, 16 bp, Homo sapiens
aaggaatataagaaaa

SEQ ID NO: 709377 - DNA, 22 bp, Homo sapiens
aaggaatatatggcagagttgt

SEQ ID NO: 709378 - DNA, 15 bp, Homo sapiens
aaggaatcaaatctt

SEQ ID NO: 709379 - DNA, 20 bp, Homo sapiens
aaggaatcattccagtgcta

SEQ ID NO: 709380 - DNA, 17 bp, Homo sapiens
aaggaatccatcctgca

SEQ ID NO: 709381 - DNA, 20 bp, Homo sapiens
aaggaatccatcctgcaaag

SEQ ID NO: 709382 - DNA, 14 bp, Homo sapiens
aaggaatctgaaag

SEQ ID NO: 709383 - DNA, 17 bp, Homo sapiens
aaggaatctggcattct

SEQ ID NO: 709384 - DNA, 19 bp, Homo sapiens
aaggaatgcctgtgccaat

SEQ ID NO: 709385 - DNA, 21 bp, Homo sapiens
aaggaatgtagctggtttcct

SEQ ID NO: 709386 - DNA, 21 bp, Homo sapiens
aaggaatgtccatttgctgag

SEQ ID NO: 709387 - DNA, 15 bp, Homo sapiens
aaggaatgtgtccaa

SEQ ID NO: 709388 - DNA, 18 bp, Homo sapiens
aaggaatgtgtccaagac

SEQ ID NO: 709389 - DNA, 16 bp, Homo sapiens
aaggaattatcaatta

SEQ ID NO: 709390 - DNA, 15 bp, Homo sapiens
aaggaattctaggca

SEQ ID NO: 709391 - DNA, 20 bp, Homo sapiens
aaggaattctaggcatccca

SEQ ID NO: 709392 - DNA, 14 bp, Homo sapiens
aaggaatttgtact

SEQ ID NO: 709393 - DNA, 21 bp, Homo sapiens
aaggacaaattagcatgcaag

SEQ ID NO: 709394 - DNA, 12 bp, Homo sapiens
aaggacacagtg

SEQ ID NO: 709395 - DNA, 20 bp, Homo sapiens
aaggacacagtgatgaatgt

SEQ ID NO: 709396 - DNA, 14 bp, Homo sapiens
aaggacacttcctg

SEQ ID NO: 709397 - DNA, 18 bp, Homo sapiens
aaggacacttcctgccta

SEQ ID NO: 709398 - DNA, 17 bp, Homo sapiens
aaggacagacagcaggc

SEQ ID NO: 709399 - DNA, 17 bp, Homo sapiens
aaggacagagtatgaac

SEQ ID NO: 709400 - DNA, 16 bp, Homo sapiens
aaggacaggaagctgg

SEQ ID NO: 709401 - DNA, 13 bp, Homo sapiens
aaggacaggagcc

SEQ ID NO: 709402 - DNA, 19 bp, Homo sapiens
aaggacaggagcctggtcc

SEQ ID NO: 709403 - DNA, 20 bp, Homo sapiens
aaggacaggaggaggagatg

SEQ ID NO: 709404 - DNA, 13 bp, Homo sapiens
aaggacagggctg

SEQ ID NO: 709405 - DNA, 14 bp, Homo sapiens
aaggacatcagcaa

SEQ ID NO: 709406 - DNA, 20 bp, Homo sapiens
aaggacatgaacagacactt

SEQ ID NO: 709407 - DNA, 15 bp, Homo sapiens
aaggacattgtatgc

SEQ ID NO: 709408 - DNA, 21 bp, Homo sapiens
aaggacattgtatgcagggag

SEQ ID NO: 709409 - DNA, 23 bp, Homo sapiens
aaggaccaactggcttctgtgca

SEQ ID NO: 709410 - DNA, 20 bp, Homo sapiens
aaggaccacattttatattt

SEQ ID NO: 709411 - DNA, 12 bp, Homo sapiens
aaggaccaggac

SEQ ID NO: 709412 - DNA, 13 bp, Homo sapiens
aaggaccccaggt

SEQ ID NO: 709413 - DNA, 13 bp, Homo sapiens
aaggacccctcac

SEQ ID NO: 709414 - DNA, 19 bp, Homo sapiens
aaggacccctcaccacccc

SEQ ID NO: 709415 - DNA, 20 bp, Homo sapiens
aaggacccctcaccttgcaa

SEQ ID NO: 709416 - DNA, 19 bp, Homo sapiens
aaggaccctgtttctgtag

SEQ ID NO: 709417 - DNA, 21 bp, Homo sapiens
aaggaccctgtttctgtagaa

SEQ ID NO: 709418 - DNA, 22 bp, Homo sapiens
aaggaccctgtttctgtagaaa

SEQ ID NO: 709419 - DNA, 12 bp, Homo sapiens
aaggacctaaaa

SEQ ID NO: 709420 - DNA, 15 bp, Homo sapiens
aaggacgcctgcagg

SEQ ID NO: 709421 - DNA, 21 bp, Homo sapiens
aaggacggccttcaactgaaa

SEQ ID NO: 709422 - DNA, 17 bp, Homo sapiens
aaggactaacataaaat

SEQ ID NO: 709423 - DNA, 18 bp, Homo sapiens
aaggactaacataaaatc

SEQ ID NO: 709424 - DNA, 15 bp, Homo sapiens
aaggactaatagaaa

SEQ ID NO: 709425 - DNA, 22 bp, Homo sapiens
aaggactcaagtgtagaagaaa

SEQ ID NO: 709426 - DNA, 21 bp, Homo sapiens
aaggactgagcaccctctgga

SEQ ID NO: 709427 - DNA, 22 bp, Homo sapiens
aaggactgccgaccgaggctgg

SEQ ID NO: 709428 - DNA, 18 bp, Homo sapiens
aaggactggattggccaa

SEQ ID NO: 709429 - DNA, 23 bp, Homo sapiens
aaggacttacccagtattactgc

SEQ ID NO: 709430 - DNA, 13 bp, Homo sapiens
aaggacttctgca

SEQ ID NO: 709431 - DNA, 16 bp, Homo sapiens
aaggacttctgcagct

SEQ ID NO: 709432 - DNA, 17 bp, Homo sapiens
aaggacttgaaagcatc

SEQ ID NO: 709433 - DNA, 17 bp, Homo sapiens
aaggactttgtacattt

SEQ ID NO: 709434 - DNA, 15 bp, Homo sapiens
aaggagaaaaaaaac

SEQ ID NO: 709435 - DNA, 17 bp, Homo sapiens
aaggagaaaagtgggct

SEQ ID NO: 709436 - DNA, 19 bp, Homo sapiens
aaggagaaacagagacagg

SEQ ID NO: 709437 - DNA, 15 bp, Homo sapiens
aaggagaaattttgg

SEQ ID NO: 709438 - DNA, 15 bp, Homo sapiens
aaggagaaccagcac

SEQ ID NO: 709439 - DNA, 23 bp, Homo sapiens
aaggagaagactgggctagggag

SEQ ID NO: 709440 - DNA, 23 bp, Homo sapiens
aaggagaagcacagctcctgcca

SEQ ID NO: 709441 - DNA, 18 bp, Homo sapiens
aaggagaaggaaaaagaa

SEQ ID NO: 709442 - DNA, 15 bp, Homo sapiens
aaggagaaggaagga

SEQ ID NO: 709443 - DNA, 16 bp, Homo sapiens
aaggagaatatgataa

SEQ ID NO: 709444 - DNA, 14 bp, Homo sapiens
aaggagaattgaat

SEQ ID NO: 709445 - DNA, 19 bp, Homo sapiens
aaggagacaaagcaggagt

SEQ ID NO: 709446 - DNA, 19 bp, Homo sapiens
aaggagaccttttcacaat

SEQ ID NO: 709447 - DNA, 17 bp, Homo sapiens
aaggagactcacctctg

SEQ ID NO: 709448 - DNA, 20 bp, Homo sapiens
aagtactgctgtaaataaat

SEQ ID NO: 709449 - DNA, 23 bp, Homo sapiens
aagtactgctgtaaataaatgct

SEQ ID NO: 709450 - DNA, 16 bp, Homo sapiens
aagtactgtgtacaga

SEQ ID NO: 709451 - DNA, 23 bp, Homo sapiens
aagtacttgagtaaatctaaaga

SEQ ID NO: 709452 - DNA, 20 bp, Homo sapiens
aagtactttaaaaaggaaat

SEQ ID NO: 709453 - DNA, 20 bp, Homo sapiens
aagtagaaaagttgcagatg

SEQ ID NO: 709454 - DNA, 23 bp, Homo sapiens
aagtagaaaagttgcagatgtat

SEQ ID NO: 709455 - DNA, 17 bp, Homo sapiens
aagtagaactcttaaat

SEQ ID NO: 709456 - DNA, 15 bp, Homo sapiens
aagtagcaggactag

SEQ ID NO: 709457 - DNA, 16 bp, Homo sapiens
aagtagctagtagcaa

SEQ ID NO: 709458 - DNA, 15 bp, Homo sapiens
aagtaggaaaaataa

SEQ ID NO: 709459 - DNA, 14 bp, Homo sapiens
aagtaggaaagtca

SEQ ID NO: 709460 - DNA, 13 bp, Homo sapiens
aagtaggaagtaa

SEQ ID NO: 709461 - DNA, 15 bp, Homo sapiens
aagtaggcatgaggg

SEQ ID NO: 709462 - DNA, 22 bp, Homo sapiens
aagtagtacttcttctgtaata

SEQ ID NO: 709463 - DNA, 12 bp, Homo sapiens
aagtagtcctgg

SEQ ID NO: 709464 - DNA, 22 bp, Homo sapiens
aagtagtgtctggatcagtaaa

SEQ ID NO: 709465 - DNA, 23 bp, Homo sapiens
aagtagttctgtttggtgtgtcc

SEQ ID NO: 709466 - DNA, 13 bp, Homo sapiens
aagtataaggtgc

SEQ ID NO: 709467 - DNA, 15 bp, Homo sapiens
aagtataaggtgctc

SEQ ID NO: 709468 - DNA, 20 bp, Homo sapiens
aagtatacaacaggagagag

SEQ ID NO: 709469 - DNA, 15 bp, Homo sapiens
aagtatacctggctt

SEQ ID NO: 709470 - DNA, 20 bp, Homo sapiens
aagtatacctggctttttaa

SEQ ID NO: 709471 - DNA, 23 bp, Homo sapiens
aagtatatagtatatttatactc

SEQ ID NO: 709472 - DNA, 16 bp, Homo sapiens
aagtatatatagaatc

SEQ ID NO: 709473 - DNA, 16 bp, Homo sapiens
aagtatatattaggat

SEQ ID NO: 709474 - DNA, 22 bp, Homo sapiens
aagtatatctctagatgcaaat

SEQ ID NO: 709475 - DNA, 22 bp, Homo sapiens
aagtatatgtgaaaaaaatgag

SEQ ID NO: 709476 - DNA, 14 bp, Homo sapiens
aagtatattaaaca

SEQ ID NO: 709477 - DNA, 20 bp, Homo sapiens
aagtatcaaagaaaaacaat

SEQ ID NO: 709478 - DNA, 18 bp, Homo sapiens
aagtatcaagtatagaaa

SEQ ID NO: 709479 - DNA, 21 bp, Homo sapiens
aagtatcaagtatagaaaatc

SEQ ID NO: 709480 - DNA, 14 bp, Homo sapiens
aagtatcatgcatt

SEQ ID NO: 709481 - DNA, 15 bp, Homo sapiens
aagtatcatgcattc

SEQ ID NO: 709482 - DNA, 17 bp, Homo sapiens
aagtatccctactgtaa

SEQ ID NO: 709483 - DNA, 23 bp, Homo sapiens
aagtatccctactgtaatttgtg

SEQ ID NO: 709484 - DNA, 15 bp, Homo sapiens
aagtatcctgcgacc

SEQ ID NO: 709485 - DNA, 16 bp, Homo sapiens
aagtatcctgcgacct

SEQ ID NO: 709486 - DNA, 18 bp, Homo sapiens
aagtatcctgcttctgat

SEQ ID NO: 709487 - DNA, 19 bp, Homo sapiens
aagtatctgggattattct

SEQ ID NO: 709488 - DNA, 21 bp, Homo sapiens
aagtatctgggattattcttt

SEQ ID NO: 709489 - DNA, 19 bp, Homo sapiens
aagtatcttgtgcttcttc

SEQ ID NO: 709490 - DNA, 12 bp, Homo sapiens
aagtatctttaa

SEQ ID NO: 709491 - DNA, 24 bp, Homo sapiens
aagtatctttaacaattgtcttaa

SEQ ID NO: 709492 - DNA, 21 bp, Homo sapiens
aagtatgaatattactctcaa

SEQ ID NO: 709493 - DNA, 16 bp, Homo sapiens
aagtatgaatctatgc

SEQ ID NO: 709494 - DNA, 21 bp, Homo sapiens
aagtatgcattattaaattgt

SEQ ID NO: 709495 - DNA, 12 bp, Homo sapiens
aagtatgcctta

SEQ ID NO: 709496 - DNA, 13 bp, Homo sapiens
aagtatgccttaa

SEQ ID NO: 709497 - DNA, 21 bp, Homo sapiens
aagtatgccttaagcagaaca

SEQ ID NO: 709498 - DNA, 23 bp, Homo sapiens
aagtatgccttaagcagaacaaa

SEQ ID NO: 709499 - DNA, 15 bp, Homo sapiens
aagtatgttgtacat

SEQ ID NO: 709500 - DNA, 14 bp, Homo sapiens
aagtatgtttttaa

SEQ ID NO: 709501 - DNA, 17 bp, Homo sapiens
aagtatgtttttacatt

SEQ ID NO: 709502 - DNA, 18 bp, Homo sapiens
aagtatgtttttacatta

SEQ ID NO: 709503 - DNA, 16 bp, Homo sapiens
aagtattatacctttt

SEQ ID NO: 709504 - DNA, 19 bp, Homo sapiens
aagtattatacctttttta

SEQ ID NO: 709505 - DNA, 23 bp, Homo sapiens
aagtattatcattgctcccctga

SEQ ID NO: 709506 - DNA, 17 bp, Homo sapiens
aagtattcaacaatttc

SEQ ID NO: 709507 - DNA, 19 bp, Homo sapiens
aagtattcaacaatttcaa

SEQ ID NO: 709508 - DNA, 21 bp, Homo sapiens
aagtattcaacaatttcaata

SEQ ID NO: 709509 - DNA, 19 bp, Homo sapiens
aagtattcagaaattaaaa

SEQ ID NO: 709510 - DNA, 21 bp, Homo sapiens
aagtattcagaaattaaaata

SEQ ID NO: 709511 - DNA, 19 bp, Homo sapiens
aagtattccaccttaaatt

SEQ ID NO: 709512 - DNA, 22 bp, Homo sapiens
aagtattcctttcctgatcact

SEQ ID NO: 709513 - DNA, 18 bp, Homo sapiens
aagtattctcaaagatgc

SEQ ID NO: 709514 - DNA, 14 bp, Homo sapiens
aagtattcttgtta

SEQ ID NO: 709515 - DNA, 22 bp, Homo sapiens
aagtattgcatctgtataagta

SEQ ID NO: 709516 - DNA, 13 bp, Homo sapiens
aagtattgtaaat

SEQ ID NO: 709517 - DNA, 14 bp, Homo sapiens
aagtattgtaaatt

SEQ ID NO: 709518 - DNA, 21 bp, Homo sapiens
aagtattgtaaattatatttg

SEQ ID NO: 709519 - DNA, 22 bp, Homo sapiens
aagtattgtaaattatatttgt

SEQ ID NO: 709520 - DNA, 13 bp, Homo sapiens
aagtattgtttcc

SEQ ID NO: 709521 - DNA, 12 bp, Homo sapiens
aagtatttatat

SEQ ID NO: 709522 - DNA, 21 bp, Homo sapiens
aagtatttatatatttataac

SEQ ID NO: 709523 - DNA, 22 bp, Homo sapiens
aagtatttatatatttataact

SEQ ID NO: 709524 - DNA, 22 bp, Homo sapiens
aagtatttcaaattggagcttc

SEQ ID NO: 709525 - DNA, 14 bp, Homo sapiens
aagtatttcccagc

SEQ ID NO: 709526 - DNA, 12 bp, Homo sapiens
aagtatttgtgg

SEQ ID NO: 709527 - DNA, 20 bp, Homo sapiens
aagtcaaagcaaggaaacta

SEQ ID NO: 709528 - DNA, 17 bp, Homo sapiens
aagtcaaatgtcacata

SEQ ID NO: 709529 - DNA, 15 bp, Homo sapiens
aagtcaacagtaaac

SEQ ID NO: 709530 - DNA, 17 bp, Homo sapiens
aagtcaacagtaaacca

SEQ ID NO: 709531 - DNA, 16 bp, Homo sapiens
aagtcaaccaatgtag

SEQ ID NO: 709532 - DNA, 22 bp, Homo sapiens
aagtcaaccaatgtagaaagct

SEQ ID NO: 709533 - DNA, 18 bp, Homo sapiens
aagtcaagatcaacattc

SEQ ID NO: 709534 - DNA, 14 bp, Homo sapiens
aagtcaagcacatg

SEQ ID NO: 709535 - DNA, 17 bp, Homo sapiens
aagtcaagcacatgtaa

SEQ ID NO: 709536 - DNA, 21 bp, Homo sapiens
aagtcacacattacaaagtta

SEQ ID NO: 709537 - DNA, 14 bp, Homo sapiens
aagtcacagctgca

SEQ ID NO: 709538 - DNA, 19 bp, Homo sapiens
aagtcacagctgcagctgg

SEQ ID NO: 709539 - DNA, 17 bp, Homo sapiens
aagtcacatcacaggac

SEQ ID NO: 709540 - DNA, 19 bp, Homo sapiens
aagtcacatcacaggacac

SEQ ID NO: 709541 - DNA, 16 bp, Homo sapiens
aagtcaccaaatagtg

SEQ ID NO: 709542 - DNA, 18 bp, Homo sapiens
aagtcacgtcatttgttt

SEQ ID NO: 709543 - DNA, 21 bp, Homo sapiens
aagtcactagaagtcctgctg

SEQ ID NO: 709544 - DNA, 16 bp, Homo sapiens
aagtgcatgctctctg

SEQ ID NO: 709545 - DNA, 13 bp, Homo sapiens
aagtgcatttaag

SEQ ID NO: 709546 - DNA, 14 bp, Homo sapiens
aagtgcatttaagg

SEQ ID NO: 709547 - DNA, 15 bp, Homo sapiens
aagtgccagggctgg

SEQ ID NO: 709548 - DNA, 17 bp, Homo sapiens
aagtgcccacatttgat

SEQ ID NO: 709549 - DNA, 18 bp, Homo sapiens
aagtgcccacatttgatg

SEQ ID NO: 709550 - DNA, 19 bp, Homo sapiens
aagtgcccctgctgcctcc

SEQ ID NO: 709551 - DNA, 22 bp, Homo sapiens
aagtgcccctgctgcctcccca

SEQ ID NO: 709552 - DNA, 17 bp, Homo sapiens
aagtgcctactgggggg

SEQ ID NO: 709553 - DNA, 17 bp, Homo sapiens
aagtgcctcttgttgca

SEQ ID NO: 709554 - DNA, 11 bp, Homo sapiens
aagtgcctgct

SEQ ID NO: 709555 - DNA, 12 bp, Homo sapiens
aagtgcctggga

SEQ ID NO: 709556 - DNA, 18 bp, Homo sapiens
aagtgcctttctgcagtt

SEQ ID NO: 709557 - DNA, 17 bp, Homo sapiens
aagtgcggtgctttagc

SEQ ID NO: 709558 - DNA, 20 bp, Homo sapiens
aagtgcgtgccgtgtgagtg

SEQ ID NO: 709559 - DNA, 17 bp, Homo sapiens
aagtgcgttctcccagc

SEQ ID NO: 709560 - DNA, 18 bp, Homo sapiens
aagtgctaaagttttctt

SEQ ID NO: 709561 - DNA, 14 bp, Homo sapiens
aagtgctcagtgaa

SEQ ID NO: 709562 - DNA, 18 bp, Homo sapiens
aagtgctcagtgaagtac

SEQ ID NO: 709563 - DNA, 20 bp, Homo sapiens
aagtgctcttggctgacccc

SEQ ID NO: 709564 - DNA, 22 bp, Homo sapiens
aagtgctcttggctgacccctc

SEQ ID NO: 709565 - DNA, 14 bp, Homo sapiens
aagtgctgcacaaa

SEQ ID NO: 709566 - DNA, 14 bp, Homo sapiens
aagtgctgcattta

SEQ ID NO: 709567 - DNA, 22 bp, Homo sapiens
aagtgctggaactttagtgaaa

SEQ ID NO: 709568 - DNA, 23 bp, Homo sapiens
aagtgctgtcttgatgactgctg

SEQ ID NO: 709569 - DNA, 16 bp, Homo sapiens
aagtgcttaaaaatac

SEQ ID NO: 709570 - DNA, 19 bp, Homo sapiens
aagtgcttcattctttgca

SEQ ID NO: 709571 - DNA, 23 bp, Homo sapiens
aagtgcttgcagatcatctgggg

SEQ ID NO: 709572 - DNA, 22 bp, Homo sapiens
aagtgcttggaacatactgttc

SEQ ID NO: 709573 - DNA, 21 bp, Homo sapiens
aagtggaaaaatagcctgcct

SEQ ID NO: 709574 - DNA, 16 bp, Homo sapiens
aagtggaaaatgcaat

SEQ ID NO: 709575 - DNA, 20 bp, Homo sapiens
aagtggaacgaaaatgaaag

SEQ ID NO: 709576 - DNA, 16 bp, Homo sapiens
aagtggaggcacttta

SEQ ID NO: 709577 - DNA, 16 bp, Homo sapiens
aagtggatggcccagc

SEQ ID NO: 709578 - DNA, 14 bp, Homo sapiens
aagtggatgggaat

SEQ ID NO: 709579 - DNA, 16 bp, Homo sapiens
aagtggatgtttttaa

SEQ ID NO: 709580 - DNA, 13 bp, Homo sapiens
aagtggcctcttg

SEQ ID NO: 709581 - DNA, 20 bp, Homo sapiens
aagtggcgtgggagccagcc

SEQ ID NO: 709582 - DNA, 19 bp, Homo sapiens
aagtggctccccacctgga

SEQ ID NO: 709583 - DNA, 18 bp, Homo sapiens
aagtggctgggtgccctc

SEQ ID NO: 709584 - DNA, 21 bp, Homo sapiens
aagtggctgggtgccctctca

SEQ ID NO: 709585 - DNA, 23 bp, Homo sapiens
aagtggctgggtgccctctcagg

SEQ ID NO: 709586 - DNA, 19 bp, Homo sapiens
aagtggctggtctggagtc

SEQ ID NO: 709587 - DNA, 12 bp, Homo sapiens
aagtgggagcag

SEQ ID NO: 709588 - DNA, 13 bp, Homo sapiens
aagtgggagcagc

SEQ ID NO: 709589 - DNA, 15 bp, Homo sapiens
aagtgggagcagctt

SEQ ID NO: 709590 - DNA, 22 bp, Homo sapiens
aagtgggagcagcttcttgggc

SEQ ID NO: 709591 - DNA, 20 bp, Homo sapiens
aagtgggaggtcaggaaact

SEQ ID NO: 709592 - DNA, 12 bp, Homo sapiens
aagtgggctgca

SEQ ID NO: 709593 - DNA, 11 bp, Homo sapiens
aagtgggctgg

SEQ ID NO: 709594 - DNA, 16 bp, Homo sapiens
aagtggggacagattc

SEQ ID NO: 709595 - DNA, 18 bp, Homo sapiens
aagtggggctaaatgaag

SEQ ID NO: 709596 - DNA, 15 bp, Homo sapiens
aagtggggctcgcca

SEQ ID NO: 709597 - DNA, 15 bp, Homo sapiens
aagtgggggcgggga

SEQ ID NO: 709598 - DNA, 18 bp, Homo sapiens
aagtggggtgctgggagg

SEQ ID NO: 709599 - DNA, 14 bp, Homo sapiens
aagtggggtgttct

SEQ ID NO: 709600 - DNA, 20 bp, Homo sapiens
aagtggggtgttcttcttgg

SEQ ID NO: 709601 - DNA, 14 bp, Homo sapiens
aagtgggtgtgtgg

SEQ ID NO: 709602 - DNA, 16 bp, Homo sapiens
aagtggtaaatactgt

SEQ ID NO: 709603 - DNA, 18 bp, Homo sapiens
aagtggtaaatactgtga

SEQ ID NO: 709604 - DNA, 15 bp, Homo sapiens
aagtggtagggatga

SEQ ID NO: 709605 - DNA, 15 bp, Homo sapiens
aagtggtagtaattt

SEQ ID NO: 709606 - DNA, 19 bp, Homo sapiens
aagtggtagtaatttcctt

SEQ ID NO: 709607 - DNA, 15 bp, Homo sapiens
aagtggtctctgctg

SEQ ID NO: 709608 - DNA, 19 bp, Homo sapiens
aagtggtgcttagaaaatt

SEQ ID NO: 709609 - DNA, 17 bp, Homo sapiens
aagtggtggtaaccctg

SEQ ID NO: 709610 - DNA, 18 bp, Homo sapiens
aagtggtggtaaccctgg

SEQ ID NO: 709611 - DNA, 12 bp, Homo sapiens
aagtgtaaaaaa

SEQ ID NO: 709612 - DNA, 14 bp, Homo sapiens
aagtgtaaaaaatg

SEQ ID NO: 709613 - DNA, 16 bp, Homo sapiens
aagtgtaaaaaatgtc

SEQ ID NO: 709614 - DNA, 12 bp, Homo sapiens
aagtgtaaatga

SEQ ID NO: 709615 - DNA, 15 bp, Homo sapiens
aagtgtaaatgaagt

SEQ ID NO: 709616 - DNA, 15 bp, Homo sapiens
aagtgtaacagctga

SEQ ID NO: 709617 - DNA, 16 bp, Homo sapiens
aagtgtaacagctgag

SEQ ID NO: 709618 - DNA, 10 bp, Homo sapiens
aagtgtaacc

SEQ ID NO: 709619 - DNA, 18 bp, Homo sapiens
aagtgtaacctcagtatt

SEQ ID NO: 709620 - DNA, 11 bp, Homo sapiens
aagtgtacaat

SEQ ID NO: 709621 - DNA, 14 bp, Homo sapiens
aagtgtacatgtgt

SEQ ID NO: 709622 - DNA, 14 bp, Homo sapiens
aagtgtagaagaaa

SEQ ID NO: 709623 - DNA, 19 bp, Homo sapiens
aagtgtagatgtagcattg

SEQ ID NO: 709624 - DNA, 11 bp, Homo sapiens
aagtgtagctc

SEQ ID NO: 709625 - DNA, 15 bp, Homo sapiens
aagtgtaggcagaca

SEQ ID NO: 709626 - DNA, 20 bp, Homo sapiens
aagtgtaggcagacacaggg

SEQ ID NO: 709627 - DNA, 15 bp, Homo sapiens
aagtgtatatttatt

SEQ ID NO: 709628 - DNA, 19 bp, Homo sapiens
aagtgtatatttattcata

SEQ ID NO: 709629 - DNA, 21 bp, Homo sapiens
aagtgtatatttattcataat

SEQ ID NO: 709630 - DNA, 11 bp, Homo sapiens
aagttcttgga

SEQ ID NO: 709631 - DNA, 18 bp, Homo sapiens
aagttctttgatttgtac

SEQ ID NO: 709632 - DNA, 19 bp, Homo sapiens
aagttctttgatttgtacc

SEQ ID NO: 709633 - DNA, 20 bp, Homo sapiens
aagttctttgatttgtacca

SEQ ID NO: 709634 - DNA, 23 bp, Homo sapiens
aagttctttgatttgtaccattc

SEQ ID NO: 709635 - DNA, 21 bp, Homo sapiens
aagttgaaaaaggaaatattc

SEQ ID NO: 709636 - DNA, 17 bp, Homo sapiens
aagttgaaattaaccat

SEQ ID NO: 709637 - DNA, 20 bp, Homo sapiens
aagttgacttatagtacatg

SEQ ID NO: 709638 - DNA, 21 bp, Homo sapiens
aagttgacttatagtacatga

SEQ ID NO: 709639 - DNA, 18 bp, Homo sapiens
aagttgagatagttttca

SEQ ID NO: 709640 - DNA, 19 bp, Homo sapiens
aagttgagatagttttcat

SEQ ID NO: 709641 - DNA, 15 bp, Homo sapiens
aagttgagattttta

SEQ ID NO: 709642 - DNA, 14 bp, Homo sapiens
aagttgatgcaatc

SEQ ID NO: 709643 - DNA, 17 bp, Homo sapiens
aagttgattttgaactt

SEQ ID NO: 709644 - DNA, 18 bp, Homo sapiens
aagttgcactgatatttt

SEQ ID NO: 709645 - DNA, 20 bp, Homo sapiens
aagttgcactgatattttac

SEQ ID NO: 709646 - DNA, 18 bp, Homo sapiens
aagttgcagatgtattga

SEQ ID NO: 709647 - DNA, 22 bp, Homo sapiens
aagttgcagatgtattgactgt

SEQ ID NO: 709648 - DNA, 14 bp, Homo sapiens
aagttgcagctgtt

SEQ ID NO: 709649 - DNA, 22 bp, Homo sapiens
aagttgcagtgagctgatatca

SEQ ID NO: 709650 - DNA, 23 bp, Homo sapiens
aagttgcgacggagagaaaaaag

SEQ ID NO: 709651 - DNA, 17 bp, Homo sapiens
aagttgctgcttgtgat

SEQ ID NO: 709652 - DNA, 19 bp, Homo sapiens
aagttgctgtaaaatttgt

SEQ ID NO: 709653 - DNA, 23 bp, Homo sapiens
aagttgctgtaaaatttgtgtaa

SEQ ID NO: 709654 - DNA, 13 bp, Homo sapiens
aagttggaaggat

SEQ ID NO: 709655 - DNA, 19 bp, Homo sapiens
aagttggaaggatctgctg

SEQ ID NO: 709656 - DNA, 13 bp, Homo sapiens
aagttggactggg

SEQ ID NO: 709657 - DNA, 18 bp, Homo sapiens
aagttggacttgttttaa

SEQ ID NO: 709658 - DNA, 15 bp, Homo sapiens
aagttggccatgtat

SEQ ID NO: 709659 - DNA, 20 bp, Homo sapiens
aagttggtatcgaaatttgt

SEQ ID NO: 709660 - DNA, 21 bp, Homo sapiens
aagttggtattaataaaaaga

SEQ ID NO: 709661 - DNA, 23 bp, Homo sapiens
aagttggtcctttacactcaggc

SEQ ID NO: 709662 - DNA, 16 bp, Homo sapiens
aagttggttggataag

SEQ ID NO: 709663 - DNA, 11 bp, Homo sapiens
aagttgtacca

SEQ ID NO: 709664 - DNA, 16 bp, Homo sapiens
aagttgtaccaaaaca

SEQ ID NO: 709665 - DNA, 13 bp, Homo sapiens
aagttgtagtgtt

SEQ ID NO: 709666 - DNA, 13 bp, Homo sapiens
aagttgtctcctt

SEQ ID NO: 709667 - DNA, 14 bp, Homo sapiens
aagttgtctccttc

SEQ ID NO: 709668 - DNA, 19 bp, Homo sapiens
aagttgtgccttttatagc

SEQ ID NO: 709669 - DNA, 20 bp, Homo sapiens
aagttgtgcttgagccagga

SEQ ID NO: 709670 - DNA, 13 bp, Homo sapiens
aagttgttattgt

SEQ ID NO: 709671 - DNA, 20 bp, Homo sapiens
aagttgttccttaagtcaga

SEQ ID NO: 709672 - DNA, 17 bp, Homo sapiens
aagttgtttatcaactt

SEQ ID NO: 709673 - DNA, 14 bp, Homo sapiens
aataaactactctt

SEQ ID NO: 709674 - DNA, 20 bp, Homo sapiens
aataaactactctttgattt

SEQ ID NO: 709675 - DNA, 21 bp, Homo sapiens
aataaactgaatattttggaa

SEQ ID NO: 709676 - DNA, 11 bp, Homo sapiens
aataaactgag

SEQ ID NO: 709677 - DNA, 13 bp, Homo sapiens
aataaactgtatt

SEQ ID NO: 709678 - DNA, 15 bp, Homo sapiens
aataaactgttttca

SEQ ID NO: 709679 - DNA, 19 bp, Homo sapiens
aataaacttagaggaaaat

SEQ ID NO: 709680 - DNA, 12 bp, Homo sapiens
aataaacttctt

SEQ ID NO: 709681 - DNA, 18 bp, Homo sapiens
aataaagaaatttggtac

SEQ ID NO: 709682 - DNA, 20 bp, Homo sapiens
aataaagaactccttatttt

SEQ ID NO: 709683 - DNA, 18 bp, Homo sapiens
aataaagagatagttcta

SEQ ID NO: 709684 - DNA, 21 bp, Homo sapiens
aataaagaggagtgttattgc

SEQ ID NO: 709685 - DNA, 15 bp, Homo sapiens
aataaagcactgagc

SEQ ID NO: 709686 - DNA, 14 bp, Homo sapiens
aataaagcagagcc

SEQ ID NO: 709687 - DNA, 16 bp, Homo sapiens
aataaagcagagccaa

SEQ ID NO: 709688 - DNA, 10 bp, Homo sapiens
aataaagcat

SEQ ID NO: 709689 - DNA, 14 bp, Homo sapiens
aataaagcattctt

SEQ ID NO: 709690 - DNA, 21 bp, Homo sapiens
aataaagccttttaaatcatc

SEQ ID NO: 709691 - DNA, 16 bp, Homo sapiens
aataaaggatgtgatt

SEQ ID NO: 709692 - DNA, 18 bp, Homo sapiens
aataaaggatgtgattgt

SEQ ID NO: 709693 - DNA, 21 bp, Homo sapiens
aataaaggcagctgcctctgc

SEQ ID NO: 709694 - DNA, 16 bp, Homo sapiens
aataaagggataaaga

SEQ ID NO: 709695 - DNA, 12 bp, Homo sapiens
aataaagtataa

SEQ ID NO: 709696 - DNA, 15 bp, Homo sapiens
aataaagtatatata

SEQ ID NO: 709697 - DNA, 11 bp, Homo sapiens
aataaagtatt

SEQ ID NO: 709698 - DNA, 18 bp, Homo sapiens
aataaagtgccttctggg

SEQ ID NO: 709699 - DNA, 18 bp, Homo sapiens
aataaagtgtaacaattg

SEQ ID NO: 709700 - DNA, 15 bp, Homo sapiens
aataaagttgcagat

SEQ ID NO: 709701 - DNA, 12 bp, Homo sapiens
aataaataattt

SEQ ID NO: 709702 - DNA, 16 bp, Homo sapiens
aataaatacattcttg

SEQ ID NO: 709703 - DNA, 19 bp, Homo sapiens
aataaatagctatatccat

SEQ ID NO: 709704 - DNA, 10 bp, Homo sapiens
aataaatagt

SEQ ID NO: 709705 - DNA, 15 bp, Homo sapiens
aataaatagttcttc

SEQ ID NO: 709706 - DNA, 11 bp, Homo sapiens
aataaatatat

SEQ ID NO: 709707 - DNA, 23 bp, Homo sapiens
aataaatatatctaccccagact

SEQ ID NO: 709708 - DNA, 20 bp, Homo sapiens
aataaatatgtaatataaat

SEQ ID NO: 709709 - DNA, 14 bp, Homo sapiens
aataaatattctgc

SEQ ID NO: 709710 - DNA, 21 bp, Homo sapiens
aataaatcattcttactaaaa

SEQ ID NO: 709711 - DNA, 19 bp, Homo sapiens
aataaatctaggatgtgat

SEQ ID NO: 709712 - DNA, 19 bp, Homo sapiens
aataaatctcttctttgct

SEQ ID NO: 709713 - DNA, 20 bp, Homo sapiens
aataaatctggtagaaaaat

SEQ ID NO: 709714 - DNA, 22 bp, Homo sapiens
aataaatctgttgccaagctgg

SEQ ID NO: 709715 - DNA, 15 bp, Homo sapiens
aataaatctttggaa

SEQ ID NO: 709716 - DNA, 16 bp, Homo sapiens
aataaatctttggaaa

SEQ ID NO: 709717 - DNA, 20 bp, Homo sapiens
aataaatgaaacttggccag

SEQ ID NO: 709718 - DNA, 22 bp, Homo sapiens
aataaatgaaacttggccagtt

SEQ ID NO: 709719 - DNA, 23 bp, Homo sapiens
aataaatgaatgtcacttctgga

SEQ ID NO: 709720 - DNA, 19 bp, Homo sapiens
aataaatgagaaaaaatgc

SEQ ID NO: 709721 - DNA, 16 bp, Homo sapiens
aataaatgccctcttc

SEQ ID NO: 709722 - DNA, 21 bp, Homo sapiens
aataaatggccagtgctgctt

SEQ ID NO: 709723 - DNA, 13 bp, Homo sapiens
aataaatgtatca

SEQ ID NO: 709724 - DNA, 14 bp, Homo sapiens
aataaatgtatcat

SEQ ID NO: 709725 - DNA, 22 bp, Homo sapiens
aataaatgtgaaacatcttctc

SEQ ID NO: 709726 - DNA, 15 bp, Homo sapiens
aataaatgtttcaaa

SEQ ID NO: 709727 - DNA, 15 bp, Homo sapiens
aataaatgtttctag

SEQ ID NO: 709728 - DNA, 15 bp, Homo sapiens
aataaatgtttgtta

SEQ ID NO: 709729 - DNA, 20 bp, Homo sapiens
aataaattaaacatgctgtt

SEQ ID NO: 709730 - DNA, 17 bp, Homo sapiens
aataaattcctaaactc

SEQ ID NO: 709731 - DNA, 21 bp, Homo sapiens
aataaattctgacttatgaat

SEQ ID NO: 709732 - DNA, 22 bp, Homo sapiens
aataaattgatttttataaata

SEQ ID NO: 709733 - DNA, 13 bp, Homo sapiens
aataaattgctta

SEQ ID NO: 709734 - DNA, 20 bp, Homo sapiens
aataaatttatatacttttt

SEQ ID NO: 709735 - DNA, 21 bp, Homo sapiens
aataaatttgacttttctgta

SEQ ID NO: 709736 - DNA, 14 bp, Homo sapiens
aataaattttgttt

SEQ ID NO: 709737 - DNA, 16 bp, Homo sapiens
aataaattttgtttca

SEQ ID NO: 709738 - DNA, 18 bp, Homo sapiens
aataacaactttcagtgg

SEQ ID NO: 709739 - DNA, 19 bp, Homo sapiens
aataacactaaaattttag

SEQ ID NO: 709740 - DNA, 15 bp, Homo sapiens
aataacactatattt

SEQ ID NO: 709741 - DNA, 11 bp, Homo sapiens
aataacactgt

SEQ ID NO: 709742 - DNA, 22 bp, Homo sapiens
aataacagaagaaaatagaatt

SEQ ID NO: 709743 - DNA, 20 bp, Homo sapiens
aataacattcccactgccag

SEQ ID NO: 709744 - DNA, 15 bp, Homo sapiens
aataacattgcactt

SEQ ID NO: 709745 - DNA, 13 bp, Homo sapiens
aataacatttgtg

SEQ ID NO: 709746 - DNA, 21 bp, Homo sapiens
aataacattttatacaatttc

SEQ ID NO: 709747 - DNA, 21 bp, Homo sapiens
aataaccacaaggtccactcc

SEQ ID NO: 709748 - DNA, 15 bp, Homo sapiens
aataaccctgccagt

SEQ ID NO: 709749 - DNA, 19 bp, Homo sapiens
aataaccctgggctgtcca

SEQ ID NO: 709750 - DNA, 20 bp, Homo sapiens
aataaccctgggctgtccag

SEQ ID NO: 709751 - DNA, 23 bp, Homo sapiens
aataacctctggcccttggaata

SEQ ID NO: 709752 - DNA, 13 bp, Homo sapiens
aataacctttctg

SEQ ID NO: 709753 - DNA, 22 bp, Homo sapiens
aataacgtttaagccaaaacaa

SEQ ID NO: 709754 - DNA, 13 bp, Homo sapiens
aataactaaaatg

SEQ ID NO: 709755 - DNA, 21 bp, Homo sapiens
aataactaatgctaagaaatg

SEQ ID NO: 709756 - DNA, 16 bp, Homo sapiens
aataactactgtgttc

SEQ ID NO: 709757 - DNA, 14 bp, Homo sapiens
aataactattttgt

SEQ ID NO: 709758 - DNA, 21 bp, Homo sapiens
aataactattttgttttaatc

SEQ ID NO: 709759 - DNA, 14 bp, Homo sapiens
aataactccaagca

SEQ ID NO: 709760 - DNA, 21 bp, Homo sapiens
aataactccttcttgtagtag

SEQ ID NO: 709761 - DNA, 14 bp, Homo sapiens
aataactgaactgt

SEQ ID NO: 709762 - DNA, 16 bp, Homo sapiens
aataactgaactgttt

SEQ ID NO: 709763 - DNA, 19 bp, Homo sapiens
aataactgcttactcaaca

SEQ ID NO: 709764 - DNA, 18 bp, Homo sapiens
aataactggaaaacagaa

SEQ ID NO: 709765 - DNA, 20 bp, Homo sapiens
aataactggaaaacagaaca

SEQ ID NO: 709766 - DNA, 20 bp, Homo sapiens
aataactggaacaaattatt

SEQ ID NO: 709767 - DNA, 12 bp, Homo sapiens
aataactgtgta

SEQ ID NO: 709768 - DNA, 15 bp, Homo sapiens
aataactgtgtactg

SEQ ID NO: 709769 - DNA, 23 bp, Homo sapiens
aataacttagactctagtattta

SEQ ID NO: 709770 - DNA, 21 bp, Homo sapiens
aataacttctatattttaata

SEQ ID NO: 709771 - DNA, 12 bp, Homo sapiens
aataacttgaag

SEQ ID NO: 709772 - DNA, 19 bp, Homo sapiens
aataacttgtcctatgtca

SEQ ID NO: 709773 - DNA, 19 bp, Homo sapiens
aataactttattgcatata

SEQ ID NO: 709774 - DNA, 20 bp, Homo sapiens
aataactttattgcatatag

SEQ ID NO: 709775 - DNA, 17 bp, Homo sapiens
aataacttttatattaa

SEQ ID NO: 709776 - DNA, 15 bp, Homo sapiens
aataagaaagtataa

SEQ ID NO: 709777 - DNA, 12 bp, Homo sapiens
aataagaaatga

SEQ ID NO: 709778 - DNA, 20 bp, Homo sapiens
aataagaagggggagtgaaa

SEQ ID NO: 709779 - DNA, 23 bp, Homo sapiens
aataagaagggggagtgaaacag

SEQ ID NO: 709780 - DNA, 12 bp, Homo sapiens
aataagaatttg

SEQ ID NO: 709781 - DNA, 16 bp, Homo sapiens
aataagaatttgcata

SEQ ID NO: 709782 - DNA, 23 bp, Homo sapiens
aataagacatgcttactttttaa

SEQ ID NO: 709783 - DNA, 14 bp, Homo sapiens
aataagagaaagaa

SEQ ID NO: 709784 - DNA, 23 bp, Homo sapiens
aataagagttgctttgccagagc

SEQ ID NO: 709785 - DNA, 15 bp, Homo sapiens
aataagatggctgtg

SEQ ID NO: 709786 - DNA, 16 bp, Homo sapiens
aataagattggtgttc

SEQ ID NO: 709787 - DNA, 22 bp, Homo sapiens
aataagattggtgttcgtttcc

SEQ ID NO: 709788 - DNA, 14 bp, Homo sapiens
aataagcaaaaaga

SEQ ID NO: 709789 - DNA, 18 bp, Homo sapiens
aataagcacttgcctgga

SEQ ID NO: 709790 - DNA, 14 bp, Homo sapiens
aataagcaggatgt

SEQ ID NO: 709791 - DNA, 19 bp, Homo sapiens
aataagctactagcaaaat

SEQ ID NO: 709792 - DNA, 14 bp, Homo sapiens
aataagctctagtt

SEQ ID NO: 709793 - DNA, 15 bp, Homo sapiens
aataagctctagttc

SEQ ID NO: 709794 - DNA, 18 bp, Homo sapiens
aataagctggactagtgt

SEQ ID NO: 709795 - DNA, 16 bp, Homo sapiens
aataagctttctcaga

SEQ ID NO: 709796 - DNA, 16 bp, Homo sapiens
aataaggaatttcctc

SEQ ID NO: 709797 - DNA, 22 bp, Homo sapiens
aataaggacaagcctaacttca

SEQ ID NO: 709798 - DNA, 18 bp, Homo sapiens
acgcacacacacatacag

SEQ ID NO: 709799 - DNA, 16 bp, Homo sapiens
acgcacacagctgagc

SEQ ID NO: 709800 - DNA, 17 bp, Homo sapiens
acgcacacgcacacatc

SEQ ID NO: 709801 - DNA, 22 bp, Homo sapiens
acgcacacgtacttaaatgaaa

SEQ ID NO: 709802 - DNA, 16 bp, Homo sapiens
acgcaccactgccaat

SEQ ID NO: 709803 - DNA, 22 bp, Homo sapiens
acgcacctccacgccactgcct

SEQ ID NO: 709804 - DNA, 11 bp, Homo sapiens
acgcacgcaca

SEQ ID NO: 709805 - DNA, 13 bp, Homo sapiens
acgcacgcacaca

SEQ ID NO: 709806 - DNA, 16 bp, Homo sapiens
acgcactccatgagca

SEQ ID NO: 709807 - DNA, 11 bp, Homo sapiens
acgcagacctg

SEQ ID NO: 709808 - DNA, 15 bp, Homo sapiens
acgcagaggaatttt

SEQ ID NO: 709809 - DNA, 21 bp, Homo sapiens
acgcagcagctgggacccctc

SEQ ID NO: 709810 - DNA, 22 bp, Homo sapiens
acgcagcagctgggacccctcc

SEQ ID NO: 709811 - DNA, 23 bp, Homo sapiens
acgcagcagctgggacccctccc

SEQ ID NO: 709812 - DNA, 14 bp, Homo sapiens
acgcagccggaggg

SEQ ID NO: 709813 - DNA, 14 bp, Homo sapiens
acgcagcctccagt

SEQ ID NO: 709814 - DNA, 17 bp, Homo sapiens
acgcaggaactcccagc

SEQ ID NO: 709815 - DNA, 14 bp, Homo sapiens
acgcaggaccagtt

SEQ ID NO: 709816 - DNA, 14 bp, Homo sapiens
acgcaggcggccag

SEQ ID NO: 709817 - DNA, 18 bp, Homo sapiens
acgcaggggctctgagcc

SEQ ID NO: 709818 - DNA, 19 bp, Homo sapiens
acgcaggggctctgagccc

SEQ ID NO: 709819 - DNA, 21 bp, Homo sapiens
acgcagtccgcccaggtcccc

SEQ ID NO: 709820 - DNA, 15 bp, Homo sapiens
acgcagtgcctggag

SEQ ID NO: 709821 - DNA, 14 bp, Homo sapiens
acgcatccagcaag

SEQ ID NO: 709822 - DNA, 18 bp, Homo sapiens
acgcatcccatctctccc

SEQ ID NO: 709823 - DNA, 20 bp, Homo sapiens
acgcatcccatctctcccac

SEQ ID NO: 709824 - DNA, 15 bp, Homo sapiens
acgcatctgtagttc

SEQ ID NO: 709825 - DNA, 19 bp, Homo sapiens
acgcatgggcattgcagcc

SEQ ID NO: 709826 - DNA, 23 bp, Homo sapiens
acgcatgggcattgcagccttgc

SEQ ID NO: 709827 - DNA, 18 bp, Homo sapiens
acgccaacttctcccacc

SEQ ID NO: 709828 - DNA, 17 bp, Homo sapiens
acgccaataataaaaaa

SEQ ID NO: 709829 - DNA, 14 bp, Homo sapiens
acgccactgcactc

SEQ ID NO: 709830 - DNA, 21 bp, Homo sapiens
acgccactgcactccagcctg

SEQ ID NO: 709831 - DNA, 14 bp, Homo sapiens
acgccagtctccca

SEQ ID NO: 709832 - DNA, 14 bp, Homo sapiens
acgccagtgtgttt

SEQ ID NO: 709833 - DNA, 19 bp, Homo sapiens
acgccatgtgatggacact

SEQ ID NO: 709834 - DNA, 16 bp, Homo sapiens
acgcccaacccttccc

SEQ ID NO: 709835 - DNA, 23 bp, Homo sapiens
acgcccacccccagtctccaggg

SEQ ID NO: 709836 - DNA, 13 bp, Homo sapiens
acgcccagctccg

SEQ ID NO: 709837 - DNA, 12 bp, Homo sapiens
acgcccaggaca

SEQ ID NO: 709838 - DNA, 15 bp, Homo sapiens
acgcccatctcagga

SEQ ID NO: 709839 - DNA, 12 bp, Homo sapiens
acgccccagccc

SEQ ID NO: 709840 - DNA, 17 bp, Homo sapiens
acgcccccaggaatgca

SEQ ID NO: 709841 - DNA, 16 bp, Homo sapiens
acgcccctcccaagcg

SEQ ID NO: 709842 - DNA, 14 bp, Homo sapiens
acgcccctgtggcc

SEQ ID NO: 709843 - DNA, 16 bp, Homo sapiens
acgcccctgtggccaa

SEQ ID NO: 709844 - DNA, 17 bp, Homo sapiens
acgcccctgtggccaac

SEQ ID NO: 709845 - DNA, 18 bp, Homo sapiens
acgcccggctaatgtttg

SEQ ID NO: 709846 - DNA, 21 bp, Homo sapiens
acgccctactccactgccctg

SEQ ID NO: 709847 - DNA, 14 bp, Homo sapiens
acgccctatttcta

SEQ ID NO: 709848 - DNA, 18 bp, Homo sapiens
acgccctctccccacccc

SEQ ID NO: 709849 - DNA, 17 bp, Homo sapiens
acgccctctcctccccc

SEQ ID NO: 709850 - DNA, 19 bp, Homo sapiens
acgccctgcgttggagcca

SEQ ID NO: 709851 - DNA, 18 bp, Homo sapiens
acgccctttcctcctcag

SEQ ID NO: 709852 - DNA, 12 bp, Homo sapiens
acgccggcctct

SEQ ID NO: 709853 - DNA, 19 bp, Homo sapiens
acgccggcctctgctgccc

SEQ ID NO: 709854 - DNA, 22 bp, Homo sapiens
acgccggcctctgctgccccct

SEQ ID NO: 709855 - DNA, 20 bp, Homo sapiens
acgccgggagaagccacctt

SEQ ID NO: 709856 - DNA, 15 bp, Homo sapiens
acgccgtctgtcctc

SEQ ID NO: 709857 - DNA, 18 bp, Homo sapiens
acgcctatgatcccagca

SEQ ID NO: 709858 - DNA, 18 bp, Homo sapiens
acgcctcactgaaacatg

SEQ ID NO: 709859 - DNA, 18 bp, Homo sapiens
acgcctcttctgtccctg

SEQ ID NO: 709860 - DNA, 23 bp, Homo sapiens
acgcctcttctgtccctgttaga

SEQ ID NO: 709861 - DNA, 24 bp, Homo sapiens
acgcctcttgaccaggctgcctcc

SEQ ID NO: 709862 - DNA, 19 bp, Homo sapiens
acgcctcttttccctctct

SEQ ID NO: 709863 - DNA, 21 bp, Homo sapiens
acgcctcttttccctctctag

SEQ ID NO: 709864 - DNA, 18 bp, Homo sapiens
acgcctgagacagcacca

SEQ ID NO: 709865 - DNA, 21 bp, Homo sapiens
acgcctgaggaacccttacag

SEQ ID NO: 709866 - DNA, 23 bp, Homo sapiens
acgcctgatggtgctgctcaggc

SEQ ID NO: 709867 - DNA, 21 bp, Homo sapiens
acgcctgccctccccagagca

SEQ ID NO: 709868 - DNA, 22 bp, Homo sapiens
acgcctgccctccccagagcac

SEQ ID NO: 709869 - DNA, 14 bp, Homo sapiens
acgcctgccctgcc

SEQ ID NO: 709870 - DNA, 17 bp, Homo sapiens
acgcctgccctgcccag

SEQ ID NO: 709871 - DNA, 13 bp, Homo sapiens
acgcctgctggcc

SEQ ID NO: 709872 - DNA, 14 bp, Homo sapiens
acgcctgctggccg

SEQ ID NO: 709873 - DNA, 11 bp, Homo sapiens
acgcctggcta

SEQ ID NO: 709874 - DNA, 18 bp, Homo sapiens
acgcctgggggtgccagg

SEQ ID NO: 709875 - DNA, 16 bp, Homo sapiens
acgcgcgtcgccgcca

SEQ ID NO: 709876 - DNA, 12 bp, Homo sapiens
acgcgtatttac

SEQ ID NO: 709877 - DNA, 15 bp, Homo sapiens
acgcgtctcctgttt

SEQ ID NO: 709878 - DNA, 13 bp, Homo sapiens
acgcgtctgcctg

SEQ ID NO: 709879 - DNA, 20 bp, Homo sapiens
acgcgtggtaaatgacccag

SEQ ID NO: 709880 - DNA, 16 bp, Homo sapiens
acgctaaagagccctt

SEQ ID NO: 709881 - DNA, 17 bp, Homo sapiens
acgctaagcctggaagc

SEQ ID NO: 709882 - DNA, 13 bp, Homo sapiens
acgctacggggaa

SEQ ID NO: 709883 - DNA, 11 bp, Homo sapiens
acgctcagtgc

SEQ ID NO: 709884 - DNA, 15 bp, Homo sapiens
acgctcatctctgga

SEQ ID NO: 709885 - DNA, 23 bp, Homo sapiens
acgctcatctctggaaggggcag

SEQ ID NO: 709886 - DNA, 17 bp, Homo sapiens
acgctccagctgccccg

SEQ ID NO: 709887 - DNA, 19 bp, Homo sapiens
acgctccagctgccccggc

SEQ ID NO: 709888 - DNA, 14 bp, Homo sapiens
acgctcccccgcag

SEQ ID NO: 709889 - DNA, 12 bp, Homo sapiens
acgctcccctcc

SEQ ID NO: 709890 - DNA, 20 bp, Homo sapiens
acgctcccctgagaggtttc

SEQ ID NO: 709891 - DNA, 20 bp, Homo sapiens
acgctccctgacttctcccc

SEQ ID NO: 709892 - DNA, 21 bp, Homo sapiens
acgctcctttgtgtgtgtgtc

SEQ ID NO: 709893 - DNA, 15 bp, Homo sapiens
acgctgaccgtggag

SEQ ID NO: 709894 - DNA, 23 bp, Homo sapiens
acgctgagatacaagtcatccat

SEQ ID NO: 709895 - DNA, 13 bp, Homo sapiens
acgctgccctgca

SEQ ID NO: 709896 - DNA, 23 bp, Homo sapiens
acgctgccgctgccgctgcacca

SEQ ID NO: 709897 - DNA, 11 bp, Homo sapiens
acgctgcctct

SEQ ID NO: 709898 - DNA, 20 bp, Homo sapiens
acgctgcctctcattggcac

SEQ ID NO: 709899 - DNA, 18 bp, Homo sapiens
acgctgcctgccaaagta

SEQ ID NO: 709900 - DNA, 15 bp, Homo sapiens
acgctgcctggtctg

SEQ ID NO: 709901 - DNA, 14 bp, Homo sapiens
acgctgtcctctcg

SEQ ID NO: 709902 - DNA, 14 bp, Homo sapiens
acgctgtctccaga

SEQ ID NO: 709903 - DNA, 17 bp, Homo sapiens
acgctgtctccagaccc

SEQ ID NO: 709904 - DNA, 19 bp, Homo sapiens
acgctgtctccagaccccc

SEQ ID NO: 709905 - DNA, 20 bp, Homo sapiens
acgcttgcttaggagattta

SEQ ID NO: 709906 - DNA, 21 bp, Homo sapiens
acgcttgtagaactcactctg

SEQ ID NO: 709907 - DNA, 22 bp, Homo sapiens
acgcttgtagaactcactctgg

SEQ ID NO: 709908 - DNA, 23 bp, Homo sapiens
acgcttgtagaactcactctggg

SEQ ID NO: 709909 - DNA, 18 bp, Homo sapiens
acgcttgtgacagtgcct

SEQ ID NO: 709910 - DNA, 19 bp, Homo sapiens
acgctttcatgaccactgg

SEQ ID NO: 709911 - DNA, 11 bp, Homo sapiens
acgctttgatt

SEQ ID NO: 709912 - DNA, 13 bp, Homo sapiens
acgctttgattca

SEQ ID NO: 709913 - DNA, 17 bp, Homo sapiens
acgctttttgaaaaagc

SEQ ID NO: 709914 - DNA, 22 bp, Homo sapiens
acctgtcaatgatacagtccct

SEQ ID NO: 709915 - DNA, 19 bp, Homo sapiens
acctgtcaccgtgagcagc

SEQ ID NO: 709916 - DNA, 15 bp, Homo sapiens
acctgtcatgccccc

SEQ ID NO: 709917 - DNA, 20 bp, Homo sapiens
acctgtccccaccctccact

SEQ ID NO: 709918 - DNA, 13 bp, Homo sapiens
acctgtcccccac

SEQ ID NO: 709919 - DNA, 18 bp, Homo sapiens
acctgtccggcccagtgc

SEQ ID NO: 709920 - DNA, 20 bp, Homo sapiens
acctgtccggcccagtgcca

SEQ ID NO: 709921 - DNA, 14 bp, Homo sapiens
acctgtctcagcct

SEQ ID NO: 709922 - DNA, 17 bp, Homo sapiens
acctgtctccactgtgc

SEQ ID NO: 709923 - DNA, 17 bp, Homo sapiens
acctgtcttccaaggag

SEQ ID NO: 709924 - DNA, 19 bp, Homo sapiens
acctgtcttccaaggagac

SEQ ID NO: 709925 - DNA, 16 bp, Homo sapiens
acctgtcttgctcctg

SEQ ID NO: 709926 - DNA, 20 bp, Homo sapiens
acctgtgacaaaggatgaag

SEQ ID NO: 709927 - DNA, 15 bp, Homo sapiens
acctgtgagcccagc

SEQ ID NO: 709928 - DNA, 19 bp, Homo sapiens
acctgtgcacaccccactc

SEQ ID NO: 709929 - DNA, 13 bp, Homo sapiens
acctgtgccaggc

SEQ ID NO: 709930 - DNA, 14 bp, Homo sapiens
acctgtgccaggct

SEQ ID NO: 709931 - DNA, 16 bp, Homo sapiens
acctgtgccctcacca

SEQ ID NO: 709932 - DNA, 17 bp, Homo sapiens
acctgtgccctcaccac

SEQ ID NO: 709933 - DNA, 13 bp, Homo sapiens
acctgtgctgctg

SEQ ID NO: 709934 - DNA, 13 bp, Homo sapiens
acctgtgctttga

SEQ ID NO: 709935 - DNA, 15 bp, Homo sapiens
accttgttacttctg

SEQ ID NO: 709936 - DNA, 20 bp, Homo sapiens
accttgttctatttttcaat

SEQ ID NO: 709937 - DNA, 15 bp, Homo sapiens
accttgttggagcct

SEQ ID NO: 709938 - DNA, 19 bp, Homo sapiens
accttgttggagcctgcag

SEQ ID NO: 709939 - DNA, 20 bp, Homo sapiens
accttgttgtgtttctatct

SEQ ID NO: 709940 - DNA, 12 bp, Homo sapiens
acctttactgtg

SEQ ID NO: 709941 - DNA, 21 bp, Homo sapiens
acctttagaaactcaaaaact

SEQ ID NO: 709942 - DNA, 17 bp, Homo sapiens
acctttagaatatcttt

SEQ ID NO: 709943 - DNA, 14 bp, Homo sapiens
acctttagggcagc

SEQ ID NO: 709944 - DNA, 22 bp, Homo sapiens
acctttaggtcaaactccctag

SEQ ID NO: 709945 - DNA, 18 bp, Homo sapiens
acctttatatctgtcttt

SEQ ID NO: 709946 - DNA, 14 bp, Homo sapiens
acctttattaaaat

SEQ ID NO: 709947 - DNA, 17 bp, Homo sapiens
acctttattttagaatt

SEQ ID NO: 709948 - DNA, 18 bp, Homo sapiens
acctttatttttctatct

SEQ ID NO: 709949 - DNA, 20 bp, Homo sapiens
acctttcaccctcatgaaaa

SEQ ID NO: 709950 - DNA, 19 bp, Homo sapiens
acctttcagtgcagtttct

SEQ ID NO: 709951 - DNA, 13 bp, Homo sapiens
acctttcataatt

SEQ ID NO: 709952 - DNA, 23 bp, Homo sapiens
acctttccaaagttaacagattt

SEQ ID NO: 709953 - DNA, 13 bp, Homo sapiens
acctttccctcac

SEQ ID NO: 709954 - DNA, 20 bp, Homo sapiens
acctttcctctccctcaggg

SEQ ID NO: 709955 - DNA, 14 bp, Homo sapiens
acctttctagcctt

SEQ ID NO: 709956 - DNA, 13 bp, Homo sapiens
acctttctctgag

SEQ ID NO: 709957 - DNA, 21 bp, Homo sapiens
acctttctgggctttctcctg

SEQ ID NO: 709958 - DNA, 15 bp, Homo sapiens
acctttctgtagcct

SEQ ID NO: 709959 - DNA, 20 bp, Homo sapiens
acctttcttcaccaaatctt

SEQ ID NO: 709960 - DNA, 19 bp, Homo sapiens
acctttgatgaattcttcc

SEQ ID NO: 709961 - DNA, 23 bp, Homo sapiens
acctttgcacaggatgctggcct

SEQ ID NO: 709962 - DNA, 18 bp, Homo sapiens
acctttgggatcagcctc

SEQ ID NO: 709963 - DNA, 17 bp, Homo sapiens
acctttgggttctttct

SEQ ID NO: 709964 - DNA, 12 bp, Homo sapiens
acctttggtgca

SEQ ID NO: 709965 - DNA, 14 bp, Homo sapiens
acctttggtgcaga

SEQ ID NO: 709966 - DNA, 16 bp, Homo sapiens
acctttgtaagacatt

SEQ ID NO: 709967 - DNA, 20 bp, Homo sapiens
acctttgtaagacatttgta

SEQ ID NO: 709968 - DNA, 19 bp, Homo sapiens
acctttgtattctctcctg

SEQ ID NO: 709969 - DNA, 19 bp, Homo sapiens
acctttgtgtggctcctgg

SEQ ID NO: 709970 - DNA, 16 bp, Homo sapiens
acctttgttttttgtt

SEQ ID NO: 709971 - DNA, 20 bp, Homo sapiens
accttttatgtagtaattga

SEQ ID NO: 709972 - DNA, 20 bp, Homo sapiens
accttttattgacacagaaa

SEQ ID NO: 709973 - DNA, 22 bp, Homo sapiens
accttttcaggaaaataactta

SEQ ID NO: 709974 - DNA, 15 bp, Homo sapiens
accttttcagggctg

SEQ ID NO: 709975 - DNA, 16 bp, Homo sapiens
accttttcatgtacag

SEQ ID NO: 709976 - DNA, 20 bp, Homo sapiens
accttttctagtctgtcttc

SEQ ID NO: 709977 - DNA, 22 bp, Homo sapiens
accttttctagtctgtcttcct

SEQ ID NO: 709978 - DNA, 17 bp, Homo sapiens
accttttctataagttg

SEQ ID NO: 709979 - DNA, 18 bp, Homo sapiens
accttttctataagttgt

SEQ ID NO: 709980 - DNA, 17 bp, Homo sapiens
accttttgaggagcccc

SEQ ID NO: 709981 - DNA, 16 bp, Homo sapiens
accttttgggaatgtt

SEQ ID NO: 709982 - DNA, 19 bp, Homo sapiens
accttttgggaatgtttta

SEQ ID NO: 709983 - DNA, 14 bp, Homo sapiens
accttttgttttct

SEQ ID NO: 709984 - DNA, 23 bp, Homo sapiens
acctttttatatttaaaaaatta

SEQ ID NO: 709985 - DNA, 17 bp, Homo sapiens
acctttttgtaaatact

SEQ ID NO: 709986 - DNA, 14 bp, Homo sapiens
accttttttataca

SEQ ID NO: 709987 - DNA, 17 bp, Homo sapiens
accttttttatacataa

SEQ ID NO: 709988 - DNA, 18 bp, Homo sapiens
accttttttatacataaa

SEQ ID NO: 709989 - DNA, 19 bp, Homo sapiens
accttttttatacataaac

SEQ ID NO: 709990 - DNA, 20 bp, Homo sapiens
accttttttatacataaaca

SEQ ID NO: 709991 - DNA, 14 bp, Homo sapiens
acgaacccacctgc

SEQ ID NO: 709992 - DNA, 15 bp, Homo sapiens
acgaacccacctgct

SEQ ID NO: 709993 - DNA, 20 bp, Homo sapiens
acgaacccctagaaaggaga

SEQ ID NO: 709994 - DNA, 15 bp, Homo sapiens
acgaaggctgcccct

SEQ ID NO: 709995 - DNA, 17 bp, Homo sapiens
acgaaggctgcccctgt

SEQ ID NO: 709996 - DNA, 22 bp, Homo sapiens
acgaaggggccccggggctggc

SEQ ID NO: 709997 - DNA, 23 bp, Homo sapiens
acgaaggggccccggggctggca

SEQ ID NO: 709998 - DNA, 21 bp, Homo sapiens
acgaaggtaaaaagtattttt

SEQ ID NO: 709999 - DNA, 14 bp, Homo sapiens
acgaatatgaatgt

SEQ ID NO: 710000 - DNA, 15 bp, Homo sapiens
acgaatatgaatgtc

SEQ ID NO: 710001 - DNA, 18 bp, Homo sapiens
acgaatatgaatgtcaca

SEQ ID NO: 710002 - DNA, 21 bp, Homo sapiens
acgaatggtctttgctccaga

SEQ ID NO: 710003 - DNA, 20 bp, Homo sapiens
acgacaaaaacaagactgcc

SEQ ID NO: 710004 - DNA, 16 bp, Homo sapiens
acgacgccctctcccc

SEQ ID NO: 710005 - DNA, 14 bp, Homo sapiens
acgacgctgcagag

SEQ ID NO: 710006 - DNA, 21 bp, Homo sapiens
acgactaacctatctatgaac

SEQ ID NO: 710007 - DNA, 11 bp, Homo sapiens
acgactcttcc

SEQ ID NO: 710008 - DNA, 15 bp, Homo sapiens
acgactgcccggcag

SEQ ID NO: 710009 - DNA, 12 bp, Homo sapiens
acgactgtctcc

SEQ ID NO: 710010 - DNA, 17 bp, Homo sapiens
acgagacacattgcctt

SEQ ID NO: 710011 - DNA, 18 bp, Homo sapiens
acgagacacattgccttc

SEQ ID NO: 710012 - DNA, 20 bp, Homo sapiens
acgagaccctacaggagagg

SEQ ID NO: 710013 - DNA, 13 bp, Homo sapiens
acgagatcttcct

SEQ ID NO: 710014 - DNA, 19 bp, Homo sapiens
acgagcacctccagcctga

SEQ ID NO: 710015 - DNA, 14 bp, Homo sapiens
acgagcactggcca

SEQ ID NO: 710016 - DNA, 16 bp, Homo sapiens
acgagcatccccctcc

SEQ ID NO: 710017 - DNA, 15 bp, Homo sapiens
acgagccacaagctg

SEQ ID NO: 710018 - DNA, 18 bp, Homo sapiens
acgagccacaagctgcac

SEQ ID NO: 710019 - DNA, 15 bp, Homo sapiens
acgagcctcctcagg

SEQ ID NO: 710020 - DNA, 12 bp, Homo sapiens
acgaggagcagc

SEQ ID NO: 710021 - DNA, 15 bp, Homo sapiens
acgaggagcagcagc

SEQ ID NO: 710022 - DNA, 14 bp, Homo sapiens
acgagggcaacagg

SEQ ID NO: 710023 - DNA, 18 bp, Homo sapiens
acgagggcaacagggagc

SEQ ID NO: 710024 - DNA, 20 bp, Homo sapiens
acgaggggtgtcttgggcag

SEQ ID NO: 710025 - DNA, 20 bp, Homo sapiens
acgaggtcaggagatcgaga

SEQ ID NO: 710026 - DNA, 12 bp, Homo sapiens
acgagtcacctg

SEQ ID NO: 710027 - DNA, 17 bp, Homo sapiens
acgagtcacctgcaagc

SEQ ID NO: 710028 - DNA, 17 bp, Homo sapiens
acgagtgggaaggactt

SEQ ID NO: 710029 - DNA, 16 bp, Homo sapiens
acgagttcatggggat

SEQ ID NO: 710030 - DNA, 21 bp, Homo sapiens
acgagtttggatgttgtaaat

SEQ ID NO: 710031 - DNA, 22 bp, Homo sapiens
acgatatttaattcacctcagc

SEQ ID NO: 710032 - DNA, 13 bp, Homo sapiens
acgatcccctccc

SEQ ID NO: 710033 - DNA, 15 bp, Homo sapiens
acgatccttcaaagt

SEQ ID NO: 710034 - DNA, 15 bp, Homo sapiens
acgatcggtttcata

SEQ ID NO: 710035 - DNA, 14 bp, Homo sapiens
acgatgaaaaactt

SEQ ID NO: 710036 - DNA, 16 bp, Homo sapiens
acgatgaatttcttct

SEQ ID NO: 710037 - DNA, 14 bp, Homo sapiens
acgatgcatttaat

SEQ ID NO: 710038 - DNA, 15 bp, Homo sapiens
acgatgggtgttgct

SEQ ID NO: 710039 - DNA, 22 bp, Homo sapiens
acgatgtggccctggcctgctg

SEQ ID NO: 710040 - DNA, 20 bp, Homo sapiens
acgattcatttttgaaactg

SEQ ID NO: 710041 - DNA, 11 bp, Homo sapiens
acgattctccc

SEQ ID NO: 710042 - DNA, 15 bp, Homo sapiens
acgattgagaactga

SEQ ID NO: 710043 - DNA, 13 bp, Homo sapiens
acgatttctgttt

SEQ ID NO: 710044 - DNA, 17 bp, Homo sapiens
acgatttctgtttagat

SEQ ID NO: 710045 - DNA, 20 bp, Homo sapiens
acctgccctgctgagtccca

SEQ ID NO: 710046 - DNA, 18 bp, Homo sapiens
acctgccgacctcgtcct

SEQ ID NO: 710047 - DNA, 23 bp, Homo sapiens
acctgcctcggcctcccaaagtg

SEQ ID NO: 710048 - DNA, 14 bp, Homo sapiens
acctgcctctgacc

SEQ ID NO: 710049 - DNA, 13 bp, Homo sapiens
acctgccttggcc

SEQ ID NO: 710050 - DNA, 17 bp, Homo sapiens
acctgcctttgtatgtg

SEQ ID NO: 710051 - DNA, 14 bp, Homo sapiens
acctgcgaaggatg

SEQ ID NO: 710052 - DNA, 23 bp, Homo sapiens
acctgcgacagcttgtgattcct

SEQ ID NO: 710053 - DNA, 16 bp, Homo sapiens
acctgcgcacaggtgg

SEQ ID NO: 710054 - DNA, 17 bp, Homo sapiens
acctgcgcttctgctgg

SEQ ID NO: 710055 - DNA, 17 bp, Homo sapiens
acctgcggccgcccccc

SEQ ID NO: 710056 - DNA, 21 bp, Homo sapiens
acctgcggccgccccccgccc

SEQ ID NO: 710057 - DNA, 15 bp, Homo sapiens
acctgcgggtcctca

SEQ ID NO: 710058 - DNA, 16 bp, Homo sapiens
acctgctagaacctct

SEQ ID NO: 710059 - DNA, 18 bp, Homo sapiens
acctgctcacagggatgc

SEQ ID NO: 710060 - DNA, 19 bp, Homo sapiens
acctgctcatcatattcca

SEQ ID NO: 710061 - DNA, 13 bp, Homo sapiens
acctgctccagaa

SEQ ID NO: 710062 - DNA, 14 bp, Homo sapiens
acctgctccagaag

SEQ ID NO: 710063 - DNA, 23 bp, Homo sapiens
acctgctccagaagatgccagct

SEQ ID NO: 710064 - DNA, 18 bp, Homo sapiens
acctgctccgctgctcct

SEQ ID NO: 710065 - DNA, 14 bp, Homo sapiens
acctgctctggaca

SEQ ID NO: 710066 - DNA, 16 bp, Homo sapiens
acctgctctgtcccca

SEQ ID NO: 710067 - DNA, 17 bp, Homo sapiens
acctgctctgtccccaa

SEQ ID NO: 710068 - DNA, 17 bp, Homo sapiens
acctgctgacctgtgca

SEQ ID NO: 710069 - DNA, 22 bp, Homo sapiens
acctgctgagagacccaaggag

SEQ ID NO: 710070 - DNA, 16 bp, Homo sapiens
acctgctgccccagct

SEQ ID NO: 710071 - DNA, 12 bp, Homo sapiens
acctgctgcgct

SEQ ID NO: 710072 - DNA, 15 bp, Homo sapiens
acctgctgctgctat

SEQ ID NO: 710073 - DNA, 18 bp, Homo sapiens
acctgctggatgggactc

SEQ ID NO: 710074 - DNA, 14 bp, Homo sapiens
acctgctggcccct

SEQ ID NO: 710075 - DNA, 21 bp, Homo sapiens
acctgcttagctgccttgagc

SEQ ID NO: 710076 - DNA, 14 bp, Homo sapiens
acctgcttatgcat

SEQ ID NO: 710077 - DNA, 19 bp, Homo sapiens
acctgcttccacccgtctc

SEQ ID NO: 710078 - DNA, 12 bp, Homo sapiens
acctgcttcctg

SEQ ID NO: 710079 - DNA, 14 bp, Homo sapiens
acctgcttccttca

SEQ ID NO: 710080 - DNA, 15 bp, Homo sapiens
acctgcttggtcttt

SEQ ID NO: 710081 - DNA, 15 bp, Homo sapiens
acctggaaccagagc

SEQ ID NO: 710082 - DNA, 17 bp, Homo sapiens
acctggaaccagagcca

SEQ ID NO: 710083 - DNA, 20 bp, Homo sapiens
acctggaactgtagggccag

SEQ ID NO: 710084 - DNA, 17 bp, Homo sapiens
acctggaatatataacc

SEQ ID NO: 710085 - DNA, 19 bp, Homo sapiens
acctggaatctacaagcca

SEQ ID NO: 710086 - DNA, 22 bp, Homo sapiens
acctggaatcttccatctgcat

SEQ ID NO: 710087 - DNA, 22 bp, Homo sapiens
acctggacaaagtccaagtctg

SEQ ID NO: 710088 - DNA, 14 bp, Homo sapiens
acctggacacacac

SEQ ID NO: 710089 - DNA, 15 bp, Homo sapiens
acctggacacacact

SEQ ID NO: 710090 - DNA, 19 bp, Homo sapiens
acctggaccccctgcccgc

SEQ ID NO: 710091 - DNA, 16 bp, Homo sapiens
acctggactgaccctg

SEQ ID NO: 710092 - DNA, 14 bp, Homo sapiens
acctggactgagcc

SEQ ID NO: 710093 - DNA, 22 bp, Homo sapiens
acctggacttaagcatctggct

SEQ ID NO: 710094 - DNA, 15 bp, Homo sapiens
acctggagcccctgg

SEQ ID NO: 710095 - DNA, 17 bp, Homo sapiens
acctggagcccctgggt

SEQ ID NO: 710096 - DNA, 14 bp, Homo sapiens
acctggagcccgct

SEQ ID NO: 710097 - DNA, 19 bp, Homo sapiens
acctggaggcaagagggag

SEQ ID NO: 710098 - DNA, 15 bp, Homo sapiens
acctggagtttaata

SEQ ID NO: 710099 - DNA, 17 bp, Homo sapiens
acctggatagttaaggg

SEQ ID NO: 710100 - DNA, 16 bp, Homo sapiens
acctggcactgggagg

SEQ ID NO: 710101 - DNA, 13 bp, Homo sapiens
acctggccacctg

SEQ ID NO: 710102 - DNA, 21 bp, Homo sapiens
acctggccacctgaggtgggc

SEQ ID NO: 710103 - DNA, 23 bp, Homo sapiens
acctggccccatgtctctcagaa

SEQ ID NO: 710104 - DNA, 23 bp, Homo sapiens
acctggccgggtcaccctgtgac

SEQ ID NO: 710105 - DNA, 22 bp, Homo sapiens
acctggcctgagcctcctgaag

SEQ ID NO: 710106 - DNA, 13 bp, Homo sapiens
acctggcctgctg

SEQ ID NO: 710107 - DNA, 23 bp, Homo sapiens
acctggccttaaagagggacagg

SEQ ID NO: 710108 - DNA, 13 bp, Homo sapiens
acctggcctttca

SEQ ID NO: 710109 - DNA, 18 bp, Homo sapiens
acctggcctttcactttt

SEQ ID NO: 710110 - DNA, 17 bp, Homo sapiens
acctggcgtgctcagac

SEQ ID NO: 710111 - DNA, 23 bp, Homo sapiens
acctggctaattttttgtacttt

SEQ ID NO: 710112 - DNA, 11 bp, Homo sapiens
acctggctccc

SEQ ID NO: 710113 - DNA, 19 bp, Homo sapiens
acctggctgaggttcctct

SEQ ID NO: 710114 - DNA, 21 bp, Homo sapiens
acctggctgaggttcctctgc

SEQ ID NO: 710115 - DNA, 19 bp, Homo sapiens
acctggctgctaggccaga

SEQ ID NO: 710116 - DNA, 20 bp, Homo sapiens
acctggctgctaggccagag

SEQ ID NO: 710117 - DNA, 18 bp, Homo sapiens
acctggcttttactttat

SEQ ID NO: 710118 - DNA, 23 bp, Homo sapiens
acctgggaaaggacccacccatc

SEQ ID NO: 710119 - DNA, 24 bp, Homo sapiens
acctgggaaaggacccacccatct

SEQ ID NO: 710120 - DNA, 21 bp, Homo sapiens
acctgggaacacagttctggg

SEQ ID NO: 710121 - DNA, 20 bp, Homo sapiens
acctgggaacgactggactg

SEQ ID NO: 710122 - DNA, 18 bp, Homo sapiens
acctgggattcaggaatg

SEQ ID NO: 710123 - DNA, 15 bp, Homo sapiens
acctgggcagctcct

SEQ ID NO: 710124 - DNA, 16 bp, Homo sapiens
acctgggcagctcctc

SEQ ID NO: 710125 - DNA, 19 bp, Homo sapiens
acctgggcccacagagcct

SEQ ID NO: 710126 - DNA, 22 bp, Homo sapiens
acctgggcccacagagcctggc

SEQ ID NO: 710127 - DNA, 23 bp, Homo sapiens
acctgggcccacagagcctggct

SEQ ID NO: 710128 - DNA, 18 bp, Homo sapiens
acctgggccccactggac

SEQ ID NO: 710129 - DNA, 20 bp, Homo sapiens
acctgggccccactggacaa

SEQ ID NO: 710130 - DNA, 19 bp, Homo sapiens
acctgggcccgggcaggcc

SEQ ID NO: 710131 - DNA, 20 bp, Homo sapiens
acctgggccgggctgtagat

SEQ ID NO: 710132 - DNA, 18 bp, Homo sapiens
acctgggcctttcctgtg

SEQ ID NO: 710133 - DNA, 20 bp, Homo sapiens
acctgggcctttcctgtgcc

SEQ ID NO: 710134 - DNA, 15 bp, Homo sapiens
acctgggctcagcct

SEQ ID NO: 710135 - DNA, 12 bp, Homo sapiens
acctgggctggg

SEQ ID NO: 710136 - DNA, 14 bp, Homo sapiens
acctgggctgggcg

SEQ ID NO: 710137 - DNA, 17 bp, Homo sapiens
acctggggactcctcaa

SEQ ID NO: 710138 - DNA, 21 bp, Homo sapiens
acctggggcacagtccaggaa

SEQ ID NO: 710139 - DNA, 15 bp, Homo sapiens
acctggggggaggga

SEQ ID NO: 710140 - DNA, 22 bp, Homo sapiens
acctggggggagggacagggca

SEQ ID NO: 710141 - DNA, 17 bp, Homo sapiens
acctggggtctctctcc

SEQ ID NO: 710142 - DNA, 18 bp, Homo sapiens
acctggggtctctctccc

SEQ ID NO: 710143 - DNA, 20 bp, Homo sapiens
acctggggtctctctcccta

SEQ ID NO: 710144 - DNA, 17 bp, Homo sapiens
acctggggtgaatactt

SEQ ID NO: 710145 - DNA, 19 bp, Homo sapiens
acctggggtttattttcag

SEQ ID NO: 710146 - DNA, 21 bp, Homo sapiens
acctgggtaactagggaagat

SEQ ID NO: 710147 - DNA, 19 bp, Homo sapiens
acctgggtatcccctgcct

SEQ ID NO: 710148 - DNA, 23 bp, Homo sapiens
acctgggtatcccctgcctcctg

SEQ ID NO: 710149 - DNA, 18 bp, Homo sapiens
acctgggtatgttcctaa

SEQ ID NO: 710150 - DNA, 19 bp, Homo sapiens
acctgggtatgttcctaag

SEQ ID NO: 710151 - DNA, 23 bp, Homo sapiens
acctgggttagggtgtgtgttca

SEQ ID NO: 710152 - DNA, 22 bp, Homo sapiens
acctggtaagcaaaactttcct

SEQ ID NO: 710153 - DNA, 16 bp, Homo sapiens
acctggtaccctcctg

SEQ ID NO: 710154 - DNA, 21 bp, Homo sapiens
acctggtcacaggactctgcc

SEQ ID NO: 710155 - DNA, 16 bp, Homo sapiens
acctggtgctgcctct

SEQ ID NO: 710156 - DNA, 20 bp, Homo sapiens
acctggtggcaccagatgca

SEQ ID NO: 710157 - DNA, 18 bp, Homo sapiens
acctggtgtgcggaggca

SEQ ID NO: 710158 - DNA, 21 bp, Homo sapiens
acctggtttacttctttagca

SEQ ID NO: 710159 - DNA, 15 bp, Homo sapiens
acctgtaaaacttta

SEQ ID NO: 710160 - DNA, 11 bp, Homo sapiens
acctgtaatca

SEQ ID NO: 710161 - DNA, 15 bp, Homo sapiens
acctgtaatcccagc

SEQ ID NO: 710162 - DNA, 20 bp, Homo sapiens
acctgtaatcccagctactt

SEQ ID NO: 710163 - DNA, 16 bp, Homo sapiens
acctgtacactgactt

SEQ ID NO: 710164 - DNA, 18 bp, Homo sapiens
acctgtacatacattgta

SEQ ID NO: 710165 - DNA, 20 bp, Homo sapiens
acctgtagtcccagctactt

SEQ ID NO: 710166 - DNA, 21 bp, Homo sapiens
acctgtataagtggaggcact

SEQ ID NO: 710167 - DNA, 17 bp, Homo sapiens
acctgtatgtctccagt

SEQ ID NO: 710168 - DNA, 12 bp, Homo sapiens
acctgtcaatac

SEQ ID NO: 710169 - DNA, 22 bp, Homo sapiens
acctccccctttcacactggat

SEQ ID NO: 710170 - DNA, 17 bp, Homo sapiens
acctcccctatccaccc

SEQ ID NO: 710171 - DNA, 18 bp, Homo sapiens
acctcccctatccaccca

SEQ ID NO: 710172 - DNA, 20 bp, Homo sapiens
acctcccctatccacccagc

SEQ ID NO: 710173 - DNA, 15 bp, Homo sapiens
acctcccctccccag

SEQ ID NO: 710174 - DNA, 17 bp, Homo sapiens
acctcccctccttgcct

SEQ ID NO: 710175 - DNA, 13 bp, Homo sapiens
acctcccctgcct

SEQ ID NO: 710176 - DNA, 14 bp, Homo sapiens
acctccccttttct

SEQ ID NO: 710177 - DNA, 15 bp, Homo sapiens
acctcccgccctcac

SEQ ID NO: 710178 - DNA, 11 bp, Homo sapiens
acctccctact

SEQ ID NO: 710179 - DNA, 14 bp, Homo sapiens
acctccctccctct

SEQ ID NO: 710180 - DNA, 12 bp, Homo sapiens
acctccctcctc

SEQ ID NO: 710181 - DNA, 16 bp, Homo sapiens
acctccctcctcaggg

SEQ ID NO: 710182 - DNA, 14 bp, Homo sapiens
acctccctgaacca

SEQ ID NO: 710183 - DNA, 14 bp, Homo sapiens
acctccctgcaacc

SEQ ID NO: 710184 - DNA, 13 bp, Homo sapiens
acctccctgcgcc

SEQ ID NO: 710185 - DNA, 14 bp, Homo sapiens
acctccctgctcag

SEQ ID NO: 710186 - DNA, 20 bp, Homo sapiens
acctccgagaggcagccaga

SEQ ID NO: 710187 - DNA, 22 bp, Homo sapiens
acctccgcccctgcccccgctc

SEQ ID NO: 710188 - DNA, 19 bp, Homo sapiens
acctccggctgcctagccc

SEQ ID NO: 710189 - DNA, 21 bp, Homo sapiens
acctccggctgcctagccctc

SEQ ID NO: 710190 - DNA, 19 bp, Homo sapiens
acctcctaccccttcctgt

SEQ ID NO: 710191 - DNA, 23 bp, Homo sapiens
acctcctaccccttcctgtcctg

SEQ ID NO: 710192 - DNA, 19 bp, Homo sapiens
acctcctagaggtgggcag

SEQ ID NO: 710193 - DNA, 19 bp, Homo sapiens
acctcctatgggttgtcac

SEQ ID NO: 710194 - DNA, 16 bp, Homo sapiens
acctcctccacaccag

SEQ ID NO: 710195 - DNA, 13 bp, Homo sapiens
acctcctccactc

SEQ ID NO: 710196 - DNA, 18 bp, Homo sapiens
acctcctccactcactcc

SEQ ID NO: 710197 - DNA, 19 bp, Homo sapiens
acctcctccactcactcca

SEQ ID NO: 710198 - DNA, 13 bp, Homo sapiens
acctcctccccct

SEQ ID NO: 710199 - DNA, 18 bp, Homo sapiens
acctcctccccctgttct

SEQ ID NO: 710200 - DNA, 23 bp, Homo sapiens
acctcctcccgaaaaatgtgtgg

SEQ ID NO: 710201 - DNA, 13 bp, Homo sapiens
acctcctccctca

SEQ ID NO: 710202 - DNA, 21 bp, Homo sapiens
acctcctccctcattcatctt

SEQ ID NO: 710203 - DNA, 22 bp, Homo sapiens
acctcctccctcattcatcttg

SEQ ID NO: 710204 - DNA, 20 bp, Homo sapiens
acctcctctgtgatttcttt

SEQ ID NO: 710205 - DNA, 21 bp, Homo sapiens
acctcctctgtgatttctttc

SEQ ID NO: 710206 - DNA, 15 bp, Homo sapiens
accccttccatgtgg

SEQ ID NO: 710207 - DNA, 19 bp, Homo sapiens
accccttccatgtggagaa

SEQ ID NO: 710208 - DNA, 11 bp, Homo sapiens
accccttccca

SEQ ID NO: 710209 - DNA, 18 bp, Homo sapiens
accccttccccactgcct

SEQ ID NO: 710210 - DNA, 23 bp, Homo sapiens
accccttccccactgcctgccca

SEQ ID NO: 710211 - DNA, 19 bp, Homo sapiens
accccttccccaggcccac

SEQ ID NO: 710212 - DNA, 12 bp, Homo sapiens
accccttcctgt

SEQ ID NO: 710213 - DNA, 15 bp, Homo sapiens
accccttcctgtcct

SEQ ID NO: 710214 - DNA, 18 bp, Homo sapiens
accccttcctgtcctgcc

SEQ ID NO: 710215 - DNA, 22 bp, Homo sapiens
accccttcctgtcctgcctcct

SEQ ID NO: 710216 - DNA, 15 bp, Homo sapiens
accccttcctttcct

SEQ ID NO: 710217 - DNA, 17 bp, Homo sapiens
accccttcctttcctct

SEQ ID NO: 710218 - DNA, 17 bp, Homo sapiens
accccttctctctccag

SEQ ID NO: 710219 - DNA, 20 bp, Homo sapiens
accccttggaaatgtctgct

SEQ ID NO: 710220 - DNA, 16 bp, Homo sapiens
accccttggcccctca

SEQ ID NO: 710221 - DNA, 17 bp, Homo sapiens
accccttgttgcactgc

SEQ ID NO: 710222 - DNA, 23 bp, Homo sapiens
accccttgttgcactgccccctg

SEQ ID NO: 710223 - DNA, 16 bp, Homo sapiens
acccctttcctcccca

SEQ ID NO: 710224 - DNA, 18 bp, Homo sapiens
acccctttcctccccata

SEQ ID NO: 710225 - DNA, 21 bp, Homo sapiens
acccctttcctccccatacac

SEQ ID NO: 710226 - DNA, 12 bp, Homo sapiens
acccctttctag

SEQ ID NO: 710227 - DNA, 14 bp, Homo sapiens
acccctttcttctc

SEQ ID NO: 710228 - DNA, 21 bp, Homo sapiens
acccctttcttctcgggccac

SEQ ID NO: 710229 - DNA, 18 bp, Homo sapiens
acccgaaagcatcactgc

SEQ ID NO: 710230 - DNA, 14 bp, Homo sapiens
acccgacttctttt

SEQ ID NO: 710231 - DNA, 15 bp, Homo sapiens
acccgacttcttttg

SEQ ID NO: 710232 - DNA, 22 bp, Homo sapiens
acccgagcccagctacattcct

SEQ ID NO: 710233 - DNA, 14 bp, Homo sapiens
acccgaggcccaga

SEQ ID NO: 710234 - DNA, 23 bp, Homo sapiens
acccgaggcccagatccaaggcc

SEQ ID NO: 710235 - DNA, 16 bp, Homo sapiens
acccgaggctgagaat

SEQ ID NO: 710236 - DNA, 19 bp, Homo sapiens
acccgagggacagcagatt

SEQ ID NO: 710237 - DNA, 19 bp, Homo sapiens
acccgagttcctctgggtt

SEQ ID NO: 710238 - DNA, 23 bp, Homo sapiens
acccgagttcctctgggtttcta

SEQ ID NO: 710239 - DNA, 13 bp, Homo sapiens
acccgatgctgct

SEQ ID NO: 710240 - DNA, 14 bp, Homo sapiens
acccgatgctgctt

SEQ ID NO: 710241 - DNA, 23 bp, Homo sapiens
acccgatgctgctttcccctgtg

SEQ ID NO: 710242 - DNA, 12 bp, Homo sapiens
acccgccagccc

SEQ ID NO: 710243 - DNA, 13 bp, Homo sapiens
acccgccagcccc

SEQ ID NO: 710244 - DNA, 20 bp, Homo sapiens
acccgcccgcgtccaacccc

SEQ ID NO: 710245 - DNA, 21 bp, Homo sapiens
acccgccgcctcccacggcac

SEQ ID NO: 710246 - DNA, 18 bp, Homo sapiens
acccgcctctcccgtcag

SEQ ID NO: 710247 - DNA, 21 bp, Homo sapiens
acccgcctctcccgtcagggc

SEQ ID NO: 710248 - DNA, 18 bp, Homo sapiens
acccgctgcccctccccg

SEQ ID NO: 710249 - DNA, 22 bp, Homo sapiens
acccgctgcccctccccgtccc

SEQ ID NO: 710250 - DNA, 13 bp, Homo sapiens
acccgctggagcc

SEQ ID NO: 710251 - DNA, 23 bp, Homo sapiens
acccgctggagcccacagcgagc

SEQ ID NO: 710252 - DNA, 16 bp, Homo sapiens
acccgctttcttgctg

SEQ ID NO: 710253 - DNA, 14 bp, Homo sapiens
acccggccacagct

SEQ ID NO: 710254 - DNA, 17 bp, Homo sapiens
acccggccacagctgct

SEQ ID NO: 710255 - DNA, 22 bp, Homo sapiens
acccggccgccgccaggactgt

SEQ ID NO: 710256 - DNA, 14 bp, Homo sapiens
acccggcttcctgt

SEQ ID NO: 710257 - DNA, 24 bp, Homo sapiens
acccgggaccaaactcacggacca

SEQ ID NO: 710258 - DNA, 21 bp, Homo sapiens
acccgggaggcggagcttgca

SEQ ID NO: 710259 - DNA, 15 bp, Homo sapiens
acccgggctgcctgc

SEQ ID NO: 710260 - DNA, 13 bp, Homo sapiens
acccgggggagcc

SEQ ID NO: 710261 - DNA, 17 bp, Homo sapiens
acccgggggagcccagt

SEQ ID NO: 710262 - DNA, 19 bp, Homo sapiens
acccgggggagcccagtga

SEQ ID NO: 710263 - DNA, 14 bp, Homo sapiens
acccggttgcagtc

SEQ ID NO: 710264 - DNA, 17 bp, Homo sapiens
acccggttgcagtcact

SEQ ID NO: 710265 - DNA, 15 bp, Homo sapiens
acccgtacaacgtgt

SEQ ID NO: 710266 - DNA, 17 bp, Homo sapiens
acccgtaggcagcctct

SEQ ID NO: 710267 - DNA, 21 bp, Homo sapiens
acccgtaggcagcctctctgc

SEQ ID NO: 710268 - DNA, 13 bp, Homo sapiens
acccgtcctccct

SEQ ID NO: 710269 - DNA, 19 bp, Homo sapiens
acccgtcctccctcagcct

SEQ ID NO: 710270 - DNA, 13 bp, Homo sapiens
acccgtgcctggg

SEQ ID NO: 710271 - DNA, 20 bp, Homo sapiens
acccgtgcctgggcccctcc

SEQ ID NO: 710272 - DNA, 21 bp, Homo sapiens
acataccaagacccccgtctc

SEQ ID NO: 710273 - DNA, 22 bp, Homo sapiens
acatacccgcctagctgctgtc

SEQ ID NO: 710274 - DNA, 14 bp, Homo sapiens
acataccctccccc

SEQ ID NO: 710275 - DNA, 20 bp, Homo sapiens
acataccctggccgccccct

SEQ ID NO: 710276 - DNA, 21 bp, Homo sapiens
acataccctggccgccccctg

SEQ ID NO: 710277 - DNA, 14 bp, Homo sapiens
acatacctaagaag

SEQ ID NO: 710278 - DNA, 15 bp, Homo sapiens
acatacctaccagta

SEQ ID NO: 710279 - DNA, 15 bp, Homo sapiens
acatacgcaaaaact

SEQ ID NO: 710280 - DNA, 19 bp, Homo sapiens
acatacgggctttaatagt

SEQ ID NO: 710281 - DNA, 13 bp, Homo sapiens
acatacgtgcaca

SEQ ID NO: 710282 - DNA, 15 bp, Homo sapiens
acatacgtgcacagg

SEQ ID NO: 710283 - DNA, 21 bp, Homo sapiens
acatactaaccagcagaaatg

SEQ ID NO: 710284 - DNA, 14 bp, Homo sapiens
acatactctgctta

SEQ ID NO: 710285 - DNA, 13 bp, Homo sapiens
acatactgcatgt

SEQ ID NO: 710286 - DNA, 19 bp, Homo sapiens
acatactgcatgtaagcca

SEQ ID NO: 710287 - DNA, 14 bp, Homo sapiens
acatactgttcact

SEQ ID NO: 710288 - DNA, 18 bp, Homo sapiens
acatacttttcctaaagt

SEQ ID NO: 710289 - DNA, 20 bp, Homo sapiens
acatacttttgctttcagta

SEQ ID NO: 710290 - DNA, 22 bp, Homo sapiens
acatagaaatggaaattttgct

SEQ ID NO: 710291 - DNA, 16 bp, Homo sapiens
acatagaacatgtgtc

SEQ ID NO: 710292 - DNA, 20 bp, Homo sapiens
acatagagagggagaagaag

SEQ ID NO: 710293 - DNA, 23 bp, Homo sapiens
acatagagagggagaagaagtca

SEQ ID NO: 710294 - DNA, 15 bp, Homo sapiens
acatagagtatataa

SEQ ID NO: 710295 - DNA, 17 bp, Homo sapiens
acatagatcagccatta

SEQ ID NO: 710296 - DNA, 19 bp, Homo sapiens
acatagatcagccattaaa

SEQ ID NO: 710297 - DNA, 22 bp, Homo sapiens
acatagatcagccattaaaata

SEQ ID NO: 710298 - DNA, 17 bp, Homo sapiens
acatagattcacctgta

SEQ ID NO: 710299 - DNA, 19 bp, Homo sapiens
acatagattcacctgtaaa

SEQ ID NO: 710300 - DNA, 19 bp, Homo sapiens
acatagcccacttacattt

SEQ ID NO: 710301 - DNA, 13 bp, Homo sapiens
acatagcccctgc

SEQ ID NO: 710302 - DNA, 16 bp, Homo sapiens
acatagcccctgcccc

SEQ ID NO: 710303 - DNA, 21 bp, Homo sapiens
acatagccctggtgctcctgc

SEQ ID NO: 710304 - DNA, 12 bp, Homo sapiens
acatagcctcat

SEQ ID NO: 710305 - DNA, 19 bp, Homo sapiens
acatagcgccgtgctgtaa

SEQ ID NO: 710306 - DNA, 21 bp, Homo sapiens
acatagcgccgtgctgtaaat

SEQ ID NO: 710307 - DNA, 19 bp, Homo sapiens
acatagctatcaagtgtgc

SEQ ID NO: 710308 - DNA, 21 bp, Homo sapiens
acatagcttacaagccagctg

SEQ ID NO: 710309 - DNA, 20 bp, Homo sapiens
acataggccaaggcccaact

SEQ ID NO: 710310 - DNA, 20 bp, Homo sapiens
acataggcttctattaccta

SEQ ID NO: 710311 - DNA, 14 bp, Homo sapiens
acatagtcctcagg

SEQ ID NO: 710312 - DNA, 19 bp, Homo sapiens
acatagttatttttctctt

SEQ ID NO: 710313 - DNA, 13 bp, Homo sapiens
acatatacatact

SEQ ID NO: 710314 - DNA, 17 bp, Homo sapiens
acatatacatacttaca

SEQ ID NO: 710315 - DNA, 14 bp, Homo sapiens
acatatacatatat

SEQ ID NO: 710316 - DNA, 16 bp, Homo sapiens
acatatacatatatat

SEQ ID NO: 710317 - DNA, 15 bp, Homo sapiens
acatatatatataca

SEQ ID NO: 710318 - DNA, 14 bp, Homo sapiens
acatatatatattt

SEQ ID NO: 710319 - DNA, 13 bp, Homo sapiens
acatatatatctg

SEQ ID NO: 710320 - DNA, 20 bp, Homo sapiens
acatatatatctgataaaat

SEQ ID NO: 710321 - DNA, 16 bp, Homo sapiens
acatatatctacacat

SEQ ID NO: 710322 - DNA, 19 bp, Homo sapiens
acatatattttttaaaata

SEQ ID NO: 710323 - DNA, 20 bp, Homo sapiens
acatatattttttaaaataa

SEQ ID NO: 710324 - DNA, 15 bp, Homo sapiens
acatatcatggtaat

SEQ ID NO: 710325 - DNA, 13 bp, Homo sapiens
acatatcatttgt

SEQ ID NO: 710326 - DNA, 20 bp, Homo sapiens
acatatcatttgtgaagaat

SEQ ID NO: 710327 - DNA, 17 bp, Homo sapiens
acatatcgctgacttca

SEQ ID NO: 710328 - DNA, 16 bp, Homo sapiens
acatatctttattaat

SEQ ID NO: 710329 - DNA, 18 bp, Homo sapiens
acatatctttattaatca

SEQ ID NO: 710330 - DNA, 12 bp, Homo sapiens
acatatgaacac

SEQ ID NO: 710331 - DNA, 14 bp, Homo sapiens
acatatgaggggga

SEQ ID NO: 710332 - DNA, 13 bp, Homo sapiens
acatatggatgtt

SEQ ID NO: 710333 - DNA, 20 bp, Homo sapiens
acatatgtcacgaacttgaa

SEQ ID NO: 710334 - DNA, 15 bp, Homo sapiens
acatatgttcctaat

SEQ ID NO: 710335 - DNA, 18 bp, Homo sapiens
acatattaggaaaatatg

SEQ ID NO: 710336 - DNA, 20 bp, Homo sapiens
acatattagtgcagccaagt

SEQ ID NO: 710337 - DNA, 21 bp, Homo sapiens
acatattagtgcagccaagta

SEQ ID NO: 710338 - DNA, 14 bp, Homo sapiens
acatattatgtctt

SEQ ID NO: 710339 - DNA, 15 bp, Homo sapiens
acatattcaagtgat

SEQ ID NO: 710340 - DNA, 17 bp, Homo sapiens
acatattcaatgcaagt

SEQ ID NO: 710341 - DNA, 21 bp, Homo sapiens
acatattcctttgaccaaata

SEQ ID NO: 710342 - DNA, 13 bp, Homo sapiens
acatattctaaat

SEQ ID NO: 710343 - DNA, 21 bp, Homo sapiens
acatattcttttgatcacatt

SEQ ID NO: 710344 - DNA, 16 bp, Homo sapiens
acatattgatttccgt

SEQ ID NO: 710345 - DNA, 13 bp, Homo sapiens
acatatttaactg

SEQ ID NO: 710346 - DNA, 15 bp, Homo sapiens
acatatttaactggt

SEQ ID NO: 710347 - DNA, 18 bp, Homo sapiens
acatatttaactggtgca

SEQ ID NO: 710348 - DNA, 14 bp, Homo sapiens
acatatttaatgtt

SEQ ID NO: 710349 - DNA, 22 bp, Homo sapiens
acatatttgactctttcaaaga

SEQ ID NO: 710350 - DNA, 15 bp, Homo sapiens
acatatttgtggaat

SEQ ID NO: 710351 - DNA, 16 bp, Homo sapiens
acatatttgtggaata

SEQ ID NO: 710352 - DNA, 20 bp, Homo sapiens
acatatttttatactttatt

SEQ ID NO: 710353 - DNA, 18 bp, Homo sapiens
acatcaaaacttaagatg

SEQ ID NO: 710354 - DNA, 20 bp, Homo sapiens
acatcaaactcaatgcttta

SEQ ID NO: 710355 - DNA, 12 bp, Homo sapiens
acatcaaagagg

SEQ ID NO: 710356 - DNA, 17 bp, Homo sapiens
acatcaaatttgccacc

SEQ ID NO: 710357 - DNA, 18 bp, Homo sapiens
acatcaacccgagtcatt

SEQ ID NO: 710358 - DNA, 18 bp, Homo sapiens
acatcaagactatctaca

SEQ ID NO: 710359 - DNA, 21 bp, Homo sapiens
acatcaagactatctacaaaa

SEQ ID NO: 710360 - DNA, 22 bp, Homo sapiens
acatcaagtccatctgacaaaa

SEQ ID NO: 710361 - DNA, 13 bp, Homo sapiens
acatcaatgttca

SEQ ID NO: 710362 - DNA, 14 bp, Homo sapiens
acatcaatgttcat

SEQ ID NO: 710363 - DNA, 15 bp, Homo sapiens
acatcaatgttcatt

SEQ ID NO: 710364 - DNA, 17 bp, Homo sapiens
acatcaatgttcattgt

SEQ ID NO: 710365 - DNA, 20 bp, Homo sapiens
acatcaatgttcattgtaat

SEQ ID NO: 710366 - DNA, 14 bp, Homo sapiens
acatcacaagacta

SEQ ID NO: 710367 - DNA, 16 bp, Homo sapiens
acatcaccaggtgcat

SEQ ID NO: 710368 - DNA, 18 bp, Homo sapiens
acatcaccctatatataa

SEQ ID NO: 710369 - DNA, 22 bp, Homo sapiens
acatcaccgacgcgtctcctgt

SEQ ID NO: 710370 - DNA, 23 bp, Homo sapiens
acatcaccgacgcgtctcctgtt

SEQ ID NO: 710371 - DNA, 19 bp, Homo sapiens
acatcactctgctgcttag

SEQ ID NO: 710372 - DNA, 19 bp, Homo sapiens
acatcactttgtgaattaa

SEQ ID NO: 710373 - DNA, 11 bp, Homo sapiens
acatcagaaag

SEQ ID NO: 710374 - DNA, 19 bp, Homo sapiens
acatcagactctagaaaaa

SEQ ID NO: 710375 - DNA, 20 bp, Homo sapiens
acatcagactctagaaaaaa

SEQ ID NO: 710376 - DNA, 14 bp, Homo sapiens
acatcagattgtta

SEQ ID NO: 710377 - DNA, 13 bp, Homo sapiens
acatcagcaaaca

SEQ ID NO: 710378 - DNA, 17 bp, Homo sapiens
acatcagcaatttcaga

SEQ ID NO: 710379 - DNA, 15 bp, Homo sapiens
acatcagcacgattt

SEQ ID NO: 710380 - DNA, 22 bp, Homo sapiens
acatcagctggtcaaacaaact

SEQ ID NO: 710381 - DNA, 18 bp, Homo sapiens
acatcaggagactgggct

SEQ ID NO: 710382 - DNA, 16 bp, Homo sapiens
acatcagtagcatttt

SEQ ID NO: 710383 - DNA, 23 bp, Homo sapiens
acatcagtatagtgttttattat

SEQ ID NO: 710384 - DNA, 20 bp, Homo sapiens
acatcagtctccaacatgtt

SEQ ID NO: 710385 - DNA, 17 bp, Homo sapiens
accctgtgaccctctca

SEQ ID NO: 710386 - DNA, 23 bp, Homo sapiens
accctgtggaagcatggctgtct

SEQ ID NO: 710387 - DNA, 20 bp, Homo sapiens
accctgtgggaccgcctggc

SEQ ID NO: 710388 - DNA, 21 bp, Homo sapiens
accctgtgggaccgcctggcc

SEQ ID NO: 710389 - DNA, 15 bp, Homo sapiens
accctgtgtcagagc

SEQ ID NO: 710390 - DNA, 21 bp, Homo sapiens
accctgtgtcagagcctacct

SEQ ID NO: 710391 - DNA, 16 bp, Homo sapiens
accctgttagttttgt

SEQ ID NO: 710392 - DNA, 17 bp, Homo sapiens
acccttaacccaaggag

SEQ ID NO: 710393 - DNA, 14 bp, Homo sapiens
acccttaactgaca

SEQ ID NO: 710394 - DNA, 22 bp, Homo sapiens
acccttaataacatacaatgac

SEQ ID NO: 710395 - DNA, 19 bp, Homo sapiens
acccttacagtaggagccc

SEQ ID NO: 710396 - DNA, 18 bp, Homo sapiens
acccttaccccttagcct

SEQ ID NO: 710397 - DNA, 22 bp, Homo sapiens
acccttaggatggggctcccag

SEQ ID NO: 710398 - DNA, 23 bp, Homo sapiens
acccttaggatggggctcccagc

SEQ ID NO: 710399 - DNA, 17 bp, Homo sapiens
acccttcaactcctggc

SEQ ID NO: 710400 - DNA, 12 bp, Homo sapiens
acccttcagacc

SEQ ID NO: 710401 - DNA, 18 bp, Homo sapiens
acccttcatcttcctgtg

SEQ ID NO: 710402 - DNA, 19 bp, Homo sapiens
acccttcatcttcctgtgt

SEQ ID NO: 710403 - DNA, 21 bp, Homo sapiens
acccttcatcttcctgtgtcc

SEQ ID NO: 710404 - DNA, 13 bp, Homo sapiens
acccttccacctc

SEQ ID NO: 710405 - DNA, 17 bp, Homo sapiens
acccttcccagccctca

SEQ ID NO: 710406 - DNA, 19 bp, Homo sapiens
acccttcccagccctcatc

SEQ ID NO: 710407 - DNA, 17 bp, Homo sapiens
acccttcctgcatttct

SEQ ID NO: 710408 - DNA, 13 bp, Homo sapiens
acccttcctggcc

SEQ ID NO: 710409 - DNA, 20 bp, Homo sapiens
acccttctccaaaggctctg

SEQ ID NO: 710410 - DNA, 19 bp, Homo sapiens
acccttctcctcttgtaaa

SEQ ID NO: 710411 - DNA, 23 bp, Homo sapiens
acccttctcctcttgtaaataaa

SEQ ID NO: 710412 - DNA, 20 bp, Homo sapiens
acccttctttcctcttcccc

SEQ ID NO: 710413 - DNA, 20 bp, Homo sapiens
acccttgagacctggaacca

SEQ ID NO: 710414 - DNA, 21 bp, Homo sapiens
acccttgcatccattgttgtg

SEQ ID NO: 710415 - DNA, 15 bp, Homo sapiens
acccttgcctgcctc

SEQ ID NO: 710416 - DNA, 17 bp, Homo sapiens
acccttgcctgcctcct

SEQ ID NO: 710417 - DNA, 18 bp, Homo sapiens
acccttgcctgcctccta

SEQ ID NO: 710418 - DNA, 19 bp, Homo sapiens
acccttgcctgcctcctag

SEQ ID NO: 710419 - DNA, 14 bp, Homo sapiens
acccttgctttcct

SEQ ID NO: 710420 - DNA, 15 bp, Homo sapiens
acccttgctttcctg

SEQ ID NO: 710421 - DNA, 20 bp, Homo sapiens
acccttgctttcctgggcct

SEQ ID NO: 710422 - DNA, 19 bp, Homo sapiens
acccttggcctccatttct

SEQ ID NO: 710423 - DNA, 21 bp, Homo sapiens
acccttggcctccatttctgt

SEQ ID NO: 710424 - DNA, 22 bp, Homo sapiens
acccttggcctccatttctgtc

SEQ ID NO: 710425 - DNA, 16 bp, Homo sapiens
acccttggtgtttccc

SEQ ID NO: 710426 - DNA, 20 bp, Homo sapiens
acccttggtgtttcccttcc

SEQ ID NO: 710427 - DNA, 21 bp, Homo sapiens
acccttggtgtttcccttcct

SEQ ID NO: 710428 - DNA, 22 bp, Homo sapiens
acccttggtgtttcccttcctc

SEQ ID NO: 710429 - DNA, 18 bp, Homo sapiens
acccttgttggggagtgg

SEQ ID NO: 710430 - DNA, 20 bp, Homo sapiens
accctttaagatatccatct

SEQ ID NO: 710431 - DNA, 21 bp, Homo sapiens
accctttaagatatccatctt

SEQ ID NO: 710432 - DNA, 20 bp, Homo sapiens
accctttagccaaacccttg

SEQ ID NO: 710433 - DNA, 13 bp, Homo sapiens
accctttcacaag

SEQ ID NO: 710434 - DNA, 14 bp, Homo sapiens
accctttccttcct

SEQ ID NO: 710435 - DNA, 18 bp, Homo sapiens
accctttccttccttccc

SEQ ID NO: 710436 - DNA, 18 bp, Homo sapiens
accgtgtcctcctctgag

SEQ ID NO: 710437 - DNA, 22 bp, Homo sapiens
accgtgtcctcctctgaggaag

SEQ ID NO: 710438 - DNA, 13 bp, Homo sapiens
accgtttcttccc

SEQ ID NO: 710439 - DNA, 13 bp, Homo sapiens
acctaaaaaagat

SEQ ID NO: 710440 - DNA, 22 bp, Homo sapiens
acctaaaaggaaatctcacccc

SEQ ID NO: 710441 - DNA, 19 bp, Homo sapiens
acctaaacggttcagtttc

SEQ ID NO: 710442 - DNA, 17 bp, Homo sapiens
acctaaagaaaaacaaa

SEQ ID NO: 710443 - DNA, 22 bp, Homo sapiens
acctaaagacgtctctttttgg

SEQ ID NO: 710444 - DNA, 20 bp, Homo sapiens
acctaaagcattttttaaaa

SEQ ID NO: 710445 - DNA, 22 bp, Homo sapiens
acctaaagtgcttgctttttgc

SEQ ID NO: 710446 - DNA, 17 bp, Homo sapiens
acctaacccctttcctg

SEQ ID NO: 710447 - DNA, 15 bp, Homo sapiens
acctaactgcaatgt

SEQ ID NO: 710448 - DNA, 18 bp, Homo sapiens
acctaagtcctttatgtg

SEQ ID NO: 710449 - DNA, 14 bp, Homo sapiens
acctaagtctctgt

SEQ ID NO: 710450 - DNA, 15 bp, Homo sapiens
acctaagtctctgtg

SEQ ID NO: 710451 - DNA, 17 bp, Homo sapiens
acctaagtgttgattgt

SEQ ID NO: 710452 - DNA, 20 bp, Homo sapiens
acctaatcaccatgtaagca

SEQ ID NO: 710453 - DNA, 17 bp, Homo sapiens
acctaatcaggctgagg

SEQ ID NO: 710454 - DNA, 11 bp, Homo sapiens
acctaatccaa

SEQ ID NO: 710455 - DNA, 15 bp, Homo sapiens
acctaatgctggcct

SEQ ID NO: 710456 - DNA, 18 bp, Homo sapiens
acctaatgtctcactgtt

SEQ ID NO: 710457 - DNA, 22 bp, Homo sapiens
acctaatgtctcactgttctgc

SEQ ID NO: 710458 - DNA, 23 bp, Homo sapiens
acctaatgtctcactgttctgca

SEQ ID NO: 710459 - DNA, 20 bp, Homo sapiens
acctaatgtttatgagccag

SEQ ID NO: 710460 - DNA, 22 bp, Homo sapiens
acctaattcgatgaaggctgcc

SEQ ID NO: 710461 - DNA, 14 bp, Homo sapiens
acctaattgtggat

SEQ ID NO: 710462 - DNA, 15 bp, Homo sapiens
acctacaagatttcc

SEQ ID NO: 710463 - DNA, 15 bp, Homo sapiens
acctacacaggagtc

SEQ ID NO: 710464 - DNA, 13 bp, Homo sapiens
acctacacccctg

SEQ ID NO: 710465 - DNA, 20 bp, Homo sapiens
acctacagtgtacagtcttg

SEQ ID NO: 710466 - DNA, 11 bp, Homo sapiens
acctacagttt

SEQ ID NO: 710467 - DNA, 20 bp, Homo sapiens
acctacatatgctgatcttt

SEQ ID NO: 710468 - DNA, 18 bp, Homo sapiens
acctacatgctgaaaaat

SEQ ID NO: 710469 - DNA, 19 bp, Homo sapiens
acctacatgttattctagt

SEQ ID NO: 710470 - DNA, 16 bp, Homo sapiens
acctacattccctctc

SEQ ID NO: 710471 - DNA, 14 bp, Homo sapiens
acctaccaggacag

SEQ ID NO: 710472 - DNA, 17 bp, Homo sapiens
acctaccagttggccat

SEQ ID NO: 710473 - DNA, 14 bp, Homo sapiens
acctaccatgctgc

SEQ ID NO: 710474 - DNA, 12 bp, Homo sapiens
acctacctccct

SEQ ID NO: 710475 - DNA, 14 bp, Homo sapiens
acctacctccctcc

SEQ ID NO: 710476 - DNA, 18 bp, Homo sapiens
acctacctccctccctct

SEQ ID NO: 710477 - DNA, 18 bp, Homo sapiens
acctaccttactatttaa

SEQ ID NO: 710478 - DNA, 20 bp, Homo sapiens
acctaccttactatttaaag

SEQ ID NO: 710479 - DNA, 18 bp, Homo sapiens
acctactatgtgctgggt

SEQ ID NO: 710480 - DNA, 16 bp, Homo sapiens
acctactcctgggtca

SEQ ID NO: 710481 - DNA, 19 bp, Homo sapiens
acctactgcactttccccc

SEQ ID NO: 710482 - DNA, 17 bp, Homo sapiens
acctactgttcctttca

SEQ ID NO: 710483 - DNA, 21 bp, Homo sapiens
acctactttgactttttgcat

SEQ ID NO: 710484 - DNA, 15 bp, Homo sapiens
acctagaaatctatc

SEQ ID NO: 710485 - DNA, 21 bp, Homo sapiens
acctagaatgtcagatttctg

SEQ ID NO: 710486 - DNA, 20 bp, Homo sapiens
acctagagacttcacccggg

SEQ ID NO: 710487 - DNA, 13 bp, Homo sapiens
acctagagccaga

SEQ ID NO: 710488 - DNA, 22 bp, Homo sapiens
acctagatgtttaacaaatcta

SEQ ID NO: 710489 - DNA, 22 bp, Homo sapiens
acctagattatagtcttagtaa

SEQ ID NO: 710490 - DNA, 23 bp, Homo sapiens
acctagcacacctgaatcagctg

SEQ ID NO: 710491 - DNA, 15 bp, Homo sapiens
acctagctacactga

SEQ ID NO: 710492 - DNA, 14 bp, Homo sapiens
acctagctgtgcaa

SEQ ID NO: 710493 - DNA, 14 bp, Homo sapiens
acctagctgtgccc

SEQ ID NO: 710494 - DNA, 18 bp, Homo sapiens
acctagctgtgccccctc

SEQ ID NO: 710495 - DNA, 20 bp, Homo sapiens
acctagctgtgccccctctg

SEQ ID NO: 710496 - DNA, 21 bp, Homo sapiens
acctagctgtgccccctctgg

SEQ ID NO: 710497 - DNA, 16 bp, Homo sapiens
acctagctgttgtaaa

SEQ ID NO: 710498 - DNA, 24 bp, Homo sapiens
acctagggaggaccttatctgtgc

SEQ ID NO: 710499 - DNA, 22 bp, Homo sapiens
acctagggcgacgtcttcagag

SEQ ID NO: 710500 - DNA, 15 bp, Homo sapiens
acctaggtctccagt

SEQ ID NO: 710501 - DNA, 21 bp, Homo sapiens
acctagtactctctgctctag

SEQ ID NO: 710502 - DNA, 18 bp, Homo sapiens
acctagtcccctttcctc

SEQ ID NO: 710503 - DNA, 21 bp, Homo sapiens
acctagtcccctttcctctaa

SEQ ID NO: 710504 - DNA, 20 bp, Homo sapiens
acctagtgaaacttttctag

SEQ ID NO: 710505 - DNA, 19 bp, Homo sapiens
acctagtgcatttggcact

SEQ ID NO: 710506 - DNA, 17 bp, Homo sapiens
acctagtgccccagact

SEQ ID NO: 710507 - DNA, 18 bp, Homo sapiens
acctagtgccccagactg

SEQ ID NO: 710508 - DNA, 18 bp, Homo sapiens
acctagttaaagaaagga

SEQ ID NO: 710509 - DNA, 22 bp, Homo sapiens
acctagttaaagaaaggaaaag

SEQ ID NO: 710510 - DNA, 18 bp, Homo sapiens
acctataaagtaaagcta

SEQ ID NO: 710511 - DNA, 19 bp, Homo sapiens
acctataaagtaaagctaa

SEQ ID NO: 710512 - DNA, 18 bp, Homo sapiens
acctataggaaagtctgt

SEQ ID NO: 710513 - DNA, 19 bp, Homo sapiens
actggctgggcccctgggg

SEQ ID NO: 710514 - DNA, 21 bp, Homo sapiens
actggctgggcccctggggac

SEQ ID NO: 710515 - DNA, 15 bp, Homo sapiens
actggctggggcaga

SEQ ID NO: 710516 - DNA, 17 bp, Homo sapiens
actggctgtcagtatga

SEQ ID NO: 710517 - DNA, 12 bp, Homo sapiens
actggctgtgcc

SEQ ID NO: 710518 - DNA, 21 bp, Homo sapiens
actggctgtgcccctgatgca

SEQ ID NO: 710519 - DNA, 13 bp, Homo sapiens
actggcttcagca

SEQ ID NO: 710520 - DNA, 15 bp, Homo sapiens
actggcttgaaggac

SEQ ID NO: 710521 - DNA, 13 bp, Homo sapiens
actggctttggct

SEQ ID NO: 710522 - DNA, 18 bp, Homo sapiens
actggctttggcttcttg

SEQ ID NO: 710523 - DNA, 17 bp, Homo sapiens
actggcttttgcctgta

SEQ ID NO: 710524 - DNA, 23 bp, Homo sapiens
actgggaaagttaggattcagat

SEQ ID NO: 710525 - DNA, 22 bp, Homo sapiens
actgggaagataggctctgcac

SEQ ID NO: 710526 - DNA, 17 bp, Homo sapiens
actgggactcccagcag

SEQ ID NO: 710527 - DNA, 20 bp, Homo sapiens
actgggactcccagcagagc

SEQ ID NO: 710528 - DNA, 16 bp, Homo sapiens
actgggagaatcacta

SEQ ID NO: 710529 - DNA, 23 bp, Homo sapiens
actgggagaggtgccagcaactg

SEQ ID NO: 710530 - DNA, 20 bp, Homo sapiens
actgggagccacttctcccc

SEQ ID NO: 710531 - DNA, 22 bp, Homo sapiens
actgggagccacttctccccag

SEQ ID NO: 710532 - DNA, 19 bp, Homo sapiens
actgggagtcagagccctg

SEQ ID NO: 710533 - DNA, 22 bp, Homo sapiens
actgggagtgtccttagtgtat

SEQ ID NO: 710534 - DNA, 15 bp, Homo sapiens
actgggatcgcacct

SEQ ID NO: 710535 - DNA, 16 bp, Homo sapiens
actgggcaacactgca

SEQ ID NO: 710536 - DNA, 15 bp, Homo sapiens
actgggcagcaaggc

SEQ ID NO: 710537 - DNA, 22 bp, Homo sapiens
actgggcagcaaggctgctgcc

SEQ ID NO: 710538 - DNA, 14 bp, Homo sapiens
actgggccagccct

SEQ ID NO: 710539 - DNA, 21 bp, Homo sapiens
actgggccagccctgcagccc

SEQ ID NO: 710540 - DNA, 19 bp, Homo sapiens
actgggcccctgtccccag

SEQ ID NO: 710541 - DNA, 20 bp, Homo sapiens
actgggcccctgtccccagt

SEQ ID NO: 710542 - DNA, 11 bp, Homo sapiens
actgggcctgg

SEQ ID NO: 710543 - DNA, 12 bp, Homo sapiens
actgggcctgga

SEQ ID NO: 710544 - DNA, 20 bp, Homo sapiens
actgggccttagtgggccag

SEQ ID NO: 710545 - DNA, 21 bp, Homo sapiens
actgggccttagtgggccagg

SEQ ID NO: 710546 - DNA, 13 bp, Homo sapiens
actgggcctttcc

SEQ ID NO: 710547 - DNA, 15 bp, Homo sapiens
actgggcctttccag

SEQ ID NO: 710548 - DNA, 17 bp, Homo sapiens
actgggcgtctgactcc

SEQ ID NO: 710549 - DNA, 13 bp, Homo sapiens
actgggctctgga

SEQ ID NO: 710550 - DNA, 14 bp, Homo sapiens
actgggctctggac

SEQ ID NO: 710551 - DNA, 14 bp, Homo sapiens
actgggctgaggga

SEQ ID NO: 710552 - DNA, 17 bp, Homo sapiens
actgggctgagggagcc

SEQ ID NO: 710553 - DNA, 16 bp, Homo sapiens
actggggactttattt

SEQ ID NO: 710554 - DNA, 17 bp, Homo sapiens
actggggagcccgtctc

SEQ ID NO: 710555 - DNA, 17 bp, Homo sapiens
actggggatgtgggagg

SEQ ID NO: 710556 - DNA, 18 bp, Homo sapiens
actggggatgtgggaggg

SEQ ID NO: 710557 - DNA, 12 bp, Homo sapiens
actggggcactt

SEQ ID NO: 710558 - DNA, 15 bp, Homo sapiens
actggggcatcctgt

SEQ ID NO: 710559 - DNA, 15 bp, Homo sapiens
actggggggccacca

SEQ ID NO: 710560 - DNA, 17 bp, Homo sapiens
actggggggctttggcc

SEQ ID NO: 710561 - DNA, 20 bp, Homo sapiens
actggggtcctggggcctcg

SEQ ID NO: 710562 - DNA, 15 bp, Homo sapiens
actgggtaggaaaga

SEQ ID NO: 710563 - DNA, 15 bp, Homo sapiens
actgggtctcactcc

SEQ ID NO: 710564 - DNA, 19 bp, Homo sapiens
actgggtgcgtctccagtc

SEQ ID NO: 710565 - DNA, 18 bp, Homo sapiens
actgggtggtggcctggt

SEQ ID NO: 710566 - DNA, 22 bp, Homo sapiens
actgggtgttgatcttacaaga

SEQ ID NO: 710567 - DNA, 16 bp, Homo sapiens
actgggttctttggaa

SEQ ID NO: 710568 - DNA, 20 bp, Homo sapiens
actgggttgactttcaggta

SEQ ID NO: 710569 - DNA, 15 bp, Homo sapiens
actgggttgcgggac

SEQ ID NO: 710570 - DNA, 20 bp, Homo sapiens
actgggtttcaagaaaatct

SEQ ID NO: 710571 - DNA, 19 bp, Homo sapiens
actgggtttggaccccagc

SEQ ID NO: 710572 - DNA, 20 bp, Homo sapiens
actggtaaagcctcatttga

SEQ ID NO: 710573 - DNA, 20 bp, Homo sapiens
actggtacttagagtttctg

SEQ ID NO: 710574 - DNA, 18 bp, Homo sapiens
actggtatgtaaaagaaa

SEQ ID NO: 710575 - DNA, 22 bp, Homo sapiens
actggtattagttaaaacacat

SEQ ID NO: 710576 - DNA, 17 bp, Homo sapiens
actggtcagggcagtgg

SEQ ID NO: 710577 - DNA, 18 bp, Homo sapiens
actggtcagggcagtggc

SEQ ID NO: 710578 - DNA, 19 bp, Homo sapiens
actggtcagggcagtggcc

SEQ ID NO: 710579 - DNA, 20 bp, Homo sapiens
actggtcagggcagtggcca

SEQ ID NO: 710580 - DNA, 16 bp, Homo sapiens
actggtcattaatgtg

SEQ ID NO: 710581 - DNA, 12 bp, Homo sapiens
actggtccagct

SEQ ID NO: 710582 - DNA, 19 bp, Homo sapiens
actggtccagctctgacat

SEQ ID NO: 710583 - DNA, 21 bp, Homo sapiens
actggtccagctctgacatcc

SEQ ID NO: 710584 - DNA, 13 bp, Homo sapiens
actggtcccggtc

SEQ ID NO: 710585 - DNA, 14 bp, Homo sapiens
actggtcctgtgtg

SEQ ID NO: 710586 - DNA, 20 bp, Homo sapiens
actggtcctgtgtgcagtga

SEQ ID NO: 710587 - DNA, 16 bp, Homo sapiens
actggtctaatgtttg

SEQ ID NO: 710588 - DNA, 23 bp, Homo sapiens
actggtctgcttaaagcttccct

SEQ ID NO: 710589 - DNA, 12 bp, Homo sapiens
actggtctgtct

SEQ ID NO: 710590 - DNA, 12 bp, Homo sapiens
actggtgactgc

SEQ ID NO: 710591 - DNA, 17 bp, Homo sapiens
actggtgcacttcttac

SEQ ID NO: 710592 - DNA, 13 bp, Homo sapiens
actggtgcacttt

SEQ ID NO: 710593 - DNA, 18 bp, Homo sapiens
actggtgcactttgtaaa

SEQ ID NO: 710594 - DNA, 20 bp, Homo sapiens
actggtgcactttgtaaatt

SEQ ID NO: 710595 - DNA, 12 bp, Homo sapiens
actggtgggcca

SEQ ID NO: 710596 - DNA, 22 bp, Homo sapiens
actggtgggggttctggcagga

SEQ ID NO: 710597 - DNA, 18 bp, Homo sapiens
actggtgggtctttaata

SEQ ID NO: 710598 - DNA, 17 bp, Homo sapiens
actggtggtttttgctc

SEQ ID NO: 710599 - DNA, 23 bp, Homo sapiens
actggtgtcataaactttctcca

SEQ ID NO: 710600 - DNA, 21 bp, Homo sapiens
actggtgttatcaccgtgggc

SEQ ID NO: 710601 - DNA, 12 bp, Homo sapiens
actggttctcaa

SEQ ID NO: 710602 - DNA, 18 bp, Homo sapiens
actggttctcaatgaaaa

SEQ ID NO: 710603 - DNA, 13 bp, Homo sapiens
actggttgcatgg

SEQ ID NO: 710604 - DNA, 18 bp, Homo sapiens
actggttgcatggaaatc

SEQ ID NO: 710605 - DNA, 19 bp, Homo sapiens
actggttggttttgccatt

SEQ ID NO: 710606 - DNA, 20 bp, Homo sapiens
actgcttacctactttcttc

SEQ ID NO: 710607 - DNA, 21 bp, Homo sapiens
actgcttctctttgtgcagtg

SEQ ID NO: 710608 - DNA, 16 bp, Homo sapiens
actgcttctcttttga

SEQ ID NO: 710609 - DNA, 17 bp, Homo sapiens
actgcttctcttttgaa

SEQ ID NO: 710610 - DNA, 21 bp, Homo sapiens
actgcttctcttttgaaagta

SEQ ID NO: 710611 - DNA, 21 bp, Homo sapiens
actgcttcttggagctttgga

SEQ ID NO: 710612 - DNA, 15 bp, Homo sapiens
actgcttgattttaa

SEQ ID NO: 710613 - DNA, 23 bp, Homo sapiens
actgcttgattttaatacattga

SEQ ID NO: 710614 - DNA, 20 bp, Homo sapiens
actgctttattttccctact

SEQ ID NO: 710615 - DNA, 12 bp, Homo sapiens
actgctttctgt

SEQ ID NO: 710616 - DNA, 16 bp, Homo sapiens
actgctttctgttcca

SEQ ID NO: 710617 - DNA, 17 bp, Homo sapiens
actgctttctgttccaa

SEQ ID NO: 710618 - DNA, 19 bp, Homo sapiens
actgctttctgttccaaat

SEQ ID NO: 710619 - DNA, 22 bp, Homo sapiens
actgctttgggatttaatttcc

SEQ ID NO: 710620 - DNA, 16 bp, Homo sapiens
actgctttgtgcatat

SEQ ID NO: 710621 - DNA, 16 bp, Homo sapiens
actggaaaacagaaca

SEQ ID NO: 710622 - DNA, 19 bp, Homo sapiens
actggaaaacagaacactt

SEQ ID NO: 710623 - DNA, 23 bp, Homo sapiens
actggaaaacagaacacttatgt

SEQ ID NO: 710624 - DNA, 21 bp, Homo sapiens
actggaaaaggtgaaaatgtt

SEQ ID NO: 710625 - DNA, 22 bp, Homo sapiens
actggaaaaggtgaaaatgttt

SEQ ID NO: 710626 - DNA, 17 bp, Homo sapiens
actggaaaggggagagc

SEQ ID NO: 710627 - DNA, 18 bp, Homo sapiens
actggaaatgtagcactt

SEQ ID NO: 710628 - DNA, 14 bp, Homo sapiens
actggaaattccag

SEQ ID NO: 710629 - DNA, 15 bp, Homo sapiens
actggaacatggcta

SEQ ID NO: 710630 - DNA, 15 bp, Homo sapiens
actggaaccagggag

SEQ ID NO: 710631 - DNA, 18 bp, Homo sapiens
actggaacggtgaaggtg

SEQ ID NO: 710632 - DNA, 21 bp, Homo sapiens
actggaacggtgaaggtgaca

SEQ ID NO: 710633 - DNA, 17 bp, Homo sapiens
actggaacttgaactga

SEQ ID NO: 710634 - DNA, 18 bp, Homo sapiens
actggaacttgaactgat

SEQ ID NO: 710635 - DNA, 18 bp, Homo sapiens
actggaagacacttcaga

SEQ ID NO: 710636 - DNA, 22 bp, Homo sapiens
actggaagcacagcctcgggga

SEQ ID NO: 710637 - DNA, 13 bp, Homo sapiens
actggaagttttg

SEQ ID NO: 710638 - DNA, 16 bp, Homo sapiens
actggaataatttgta

SEQ ID NO: 710639 - DNA, 22 bp, Homo sapiens
actggaataatttgtaaatgat

SEQ ID NO: 710640 - DNA, 22 bp, Homo sapiens
actggaatggtgttttgtcaga

SEQ ID NO: 710641 - DNA, 20 bp, Homo sapiens
actggacaacactgattcct

SEQ ID NO: 710642 - DNA, 21 bp, Homo sapiens
actggacacactaaactctgg

SEQ ID NO: 710643 - DNA, 12 bp, Homo sapiens
actggacagctt

SEQ ID NO: 710644 - DNA, 18 bp, Homo sapiens
actggacatggcccattg

SEQ ID NO: 710645 - DNA, 16 bp, Homo sapiens
actggaccactgggca

SEQ ID NO: 710646 - DNA, 21 bp, Homo sapiens
actggaccactgggcaatgat

SEQ ID NO: 710647 - DNA, 22 bp, Homo sapiens
actggaccccactggctgagaa

SEQ ID NO: 710648 - DNA, 22 bp, Homo sapiens
actggacccccagcccccaggg

SEQ ID NO: 710649 - DNA, 17 bp, Homo sapiens
actggactcaggaactt

SEQ ID NO: 710650 - DNA, 18 bp, Homo sapiens
actggactcaggaacttt

SEQ ID NO: 710651 - DNA, 18 bp, Homo sapiens
actggactccggccctcc

SEQ ID NO: 710652 - DNA, 12 bp, Homo sapiens
actggactgcat

SEQ ID NO: 710653 - DNA, 13 bp, Homo sapiens
actggactgcatg

SEQ ID NO: 710654 - DNA, 14 bp, Homo sapiens
actggactgcatgg

SEQ ID NO: 710655 - DNA, 22 bp, Homo sapiens
actggacttgagcttggcagct

SEQ ID NO: 710656 - DNA, 18 bp, Homo sapiens
actggagaaaacccctcc

SEQ ID NO: 710657 - DNA, 21 bp, Homo sapiens
actggagaagaatatcaaata

SEQ ID NO: 710658 - DNA, 13 bp, Homo sapiens
actggagcaccag

SEQ ID NO: 710659 - DNA, 14 bp, Homo sapiens
actggagcatctga

SEQ ID NO: 710660 - DNA, 17 bp, Homo sapiens
actggagcatctgactc

SEQ ID NO: 710661 - DNA, 18 bp, Homo sapiens
actggagcatctgactca

SEQ ID NO: 710662 - DNA, 20 bp, Homo sapiens
actggagccacaggcagggg

SEQ ID NO: 710663 - DNA, 12 bp, Homo sapiens
actggagcccag

SEQ ID NO: 710664 - DNA, 13 bp, Homo sapiens
actggagcccagg

SEQ ID NO: 710665 - DNA, 24 bp, Homo sapiens
actggaggaaccacatataacact

SEQ ID NO: 710666 - DNA, 15 bp, Homo sapiens
actggaggagcagct

SEQ ID NO: 710667 - DNA, 18 bp, Homo sapiens
actggaggagcagcttcc

SEQ ID NO: 710668 - DNA, 20 bp, Homo sapiens
actggaggtcacattcagga

SEQ ID NO: 710669 - DNA, 15 bp, Homo sapiens
actggaggtgggcat

SEQ ID NO: 710670 - DNA, 17 bp, Homo sapiens
actggaggttgaagcca

SEQ ID NO: 710671 - DNA, 19 bp, Homo sapiens
actggaggttgaagccaag

SEQ ID NO: 710672 - DNA, 13 bp, Homo sapiens
actggagtgcagg

SEQ ID NO: 710673 - DNA, 18 bp, Homo sapiens
actggagtgcagggagga

SEQ ID NO: 710674 - DNA, 13 bp, Homo sapiens
actggataaattg

SEQ ID NO: 710675 - DNA, 14 bp, Homo sapiens
actggataaattgt

SEQ ID NO: 710676 - DNA, 18 bp, Homo sapiens
actggatactgcccgggg

SEQ ID NO: 710677 - DNA, 19 bp, Homo sapiens
actggatcccaacaccaaa

SEQ ID NO: 710678 - DNA, 22 bp, Homo sapiens
actggatgaaataactccttct

SEQ ID NO: 710679 - DNA, 18 bp, Homo sapiens
actggatgcagaaacagt

SEQ ID NO: 710680 - DNA, 12 bp, Homo sapiens
actggattaaaa

SEQ ID NO: 710681 - DNA, 17 bp, Homo sapiens
actggattaaaacaatt

SEQ ID NO: 710682 - DNA, 14 bp, Homo sapiens
actggattggccaa

SEQ ID NO: 710683 - DNA, 13 bp, Homo sapiens
actggcaataaac

SEQ ID NO: 710684 - DNA, 16 bp, Homo sapiens
actggcaataaactcc

SEQ ID NO: 710685 - DNA, 17 bp, Homo sapiens
actggcacacacccctc

SEQ ID NO: 710686 - DNA, 16 bp, Homo sapiens
actggcactgaattaa

SEQ ID NO: 710687 - DNA, 20 bp, Homo sapiens
actggcagactcaaggggct

SEQ ID NO: 710688 - DNA, 17 bp, Homo sapiens
actggcagagcacagcc

SEQ ID NO: 710689 - DNA, 18 bp, Homo sapiens
actggcagagcacagccc

SEQ ID NO: 710690 - DNA, 20 bp, Homo sapiens
actgatgttactagcctctc

SEQ ID NO: 710691 - DNA, 17 bp, Homo sapiens
actgatgttgtgttttt

SEQ ID NO: 710692 - DNA, 14 bp, Homo sapiens
actgattaaatatt

SEQ ID NO: 710693 - DNA, 18 bp, Homo sapiens
actgattattttcttcat

SEQ ID NO: 710694 - DNA, 17 bp, Homo sapiens
actgattcaattataat

SEQ ID NO: 710695 - DNA, 20 bp, Homo sapiens
actgatttagaagcaaagat

SEQ ID NO: 710696 - DNA, 13 bp, Homo sapiens
actgatttcacaa

SEQ ID NO: 710697 - DNA, 14 bp, Homo sapiens
actgatttcctttg

SEQ ID NO: 710698 - DNA, 20 bp, Homo sapiens
actgattttaaaatgaataa

SEQ ID NO: 710699 - DNA, 21 bp, Homo sapiens
actgattttaaaatgaataat

SEQ ID NO: 710700 - DNA, 14 bp, Homo sapiens
actgattttgtatg

SEQ ID NO: 710701 - DNA, 15 bp, Homo sapiens
actgatttttgtgat

SEQ ID NO: 710702 - DNA, 18 bp, Homo sapiens
actgcaaaaaaagcctcc

SEQ ID NO: 710703 - DNA, 22 bp, Homo sapiens
actgcaaaaagaaaatctttat

SEQ ID NO: 710704 - DNA, 14 bp, Homo sapiens
actgcaaacagaaa

SEQ ID NO: 710705 - DNA, 24 bp, Homo sapiens
actgcaaacttttttatatctttt

SEQ ID NO: 710706 - DNA, 17 bp, Homo sapiens
actgcaaagctttggct

SEQ ID NO: 710707 - DNA, 13 bp, Homo sapiens
actgcaaaggctt

SEQ ID NO: 710708 - DNA, 15 bp, Homo sapiens
actgcaaataaagcc

SEQ ID NO: 710709 - DNA, 18 bp, Homo sapiens
actgcaaatcaggctttt

SEQ ID NO: 710710 - DNA, 20 bp, Homo sapiens
actgcaaatcaggcttttgt

SEQ ID NO: 710711 - DNA, 21 bp, Homo sapiens
actgcaaatcaggcttttgtt

SEQ ID NO: 710712 - DNA, 14 bp, Homo sapiens
actgcaacactgga

SEQ ID NO: 710713 - DNA, 17 bp, Homo sapiens
actgcaacctccgcctc

SEQ ID NO: 710714 - DNA, 17 bp, Homo sapiens
actgcaacctctgcctc

SEQ ID NO: 710715 - DNA, 14 bp, Homo sapiens
actgcaacttgtga

SEQ ID NO: 710716 - DNA, 21 bp, Homo sapiens
actgcaacttgtgaactccat

SEQ ID NO: 710717 - DNA, 16 bp, Homo sapiens
actgcaagaaaatgat

SEQ ID NO: 710718 - DNA, 15 bp, Homo sapiens
actgcaagagccttg

SEQ ID NO: 710719 - DNA, 16 bp, Homo sapiens
actgcaagagccttgg

SEQ ID NO: 710720 - DNA, 22 bp, Homo sapiens
actgcaagcatttttccatctg

SEQ ID NO: 710721 - DNA, 17 bp, Homo sapiens
actgcaattaaagtgat

SEQ ID NO: 710722 - DNA, 17 bp, Homo sapiens
actgcacacacagctcc

SEQ ID NO: 710723 - DNA, 19 bp, Homo sapiens
actgcacacacagctcctc

SEQ ID NO: 710724 - DNA, 20 bp, Homo sapiens
actgcacacagtgacttcct

SEQ ID NO: 710725 - DNA, 13 bp, Homo sapiens
actgcacaccagc

SEQ ID NO: 710726 - DNA, 15 bp, Homo sapiens
actgcacagtggcac

SEQ ID NO: 710727 - DNA, 12 bp, Homo sapiens
actgcacatcta

SEQ ID NO: 710728 - DNA, 14 bp, Homo sapiens
actgcaccagcgcc

SEQ ID NO: 710729 - DNA, 21 bp, Homo sapiens
actgcaccagcgcccccagaa

SEQ ID NO: 710730 - DNA, 13 bp, Homo sapiens
actgcacccagct

SEQ ID NO: 710731 - DNA, 14 bp, Homo sapiens
actgcacccagctc

SEQ ID NO: 710732 - DNA, 18 bp, Homo sapiens
actgcacccagctccagg

SEQ ID NO: 710733 - DNA, 19 bp, Homo sapiens
actgcacccagctccaggg

SEQ ID NO: 710734 - DNA, 20 bp, Homo sapiens
actgcacctgggcagctcct

SEQ ID NO: 710735 - DNA, 15 bp, Homo sapiens
actgcactccagcct

SEQ ID NO: 710736 - DNA, 20 bp, Homo sapiens
actgcactccagcctgggcg

SEQ ID NO: 710737 - DNA, 20 bp, Homo sapiens
actgcactccagcctgggtg

SEQ ID NO: 710738 - DNA, 17 bp, Homo sapiens
actgcactttccccctt

SEQ ID NO: 710739 - DNA, 13 bp, Homo sapiens
actgcactttgtt

SEQ ID NO: 710740 - DNA, 20 bp, Homo sapiens
actgcactttgtttagaaaa

SEQ ID NO: 710741 - DNA, 22 bp, Homo sapiens
actgcagacattctcaaagcct

SEQ ID NO: 710742 - DNA, 21 bp, Homo sapiens
actgcagaccatgaagtaaat

SEQ ID NO: 710743 - DNA, 20 bp, Homo sapiens
actgcagacctcactgtcag

SEQ ID NO: 710744 - DNA, 23 bp, Homo sapiens
actgcagacgggaatgcctaggt

SEQ ID NO: 710745 - DNA, 12 bp, Homo sapiens
actgcagagact

SEQ ID NO: 710746 - DNA, 18 bp, Homo sapiens
actgcagatagcccagga

SEQ ID NO: 710747 - DNA, 15 bp, Homo sapiens
actgcagcacctcca

SEQ ID NO: 710748 - DNA, 18 bp, Homo sapiens
actgcagcacctccaggc

SEQ ID NO: 710749 - DNA, 17 bp, Homo sapiens
actgcagcctcaacctc

SEQ ID NO: 710750 - DNA, 21 bp, Homo sapiens
actgcagcctcaacctcctgg

SEQ ID NO: 710751 - DNA, 20 bp, Homo sapiens
actgcagcctctctggctgg

SEQ ID NO: 710752 - DNA, 20 bp, Homo sapiens
actgcagcctgggctccctc

SEQ ID NO: 710753 - DNA, 12 bp, Homo sapiens
actgcagctgca

SEQ ID NO: 710754 - DNA, 14 bp, Homo sapiens
actgcagctgtgag

SEQ ID NO: 710755 - DNA, 20 bp, Homo sapiens
actgcaggacagtcaaggtg

SEQ ID NO: 710756 - DNA, 13 bp, Homo sapiens
actgcaggccctg

SEQ ID NO: 710757 - DNA, 14 bp, Homo sapiens
actgcaggccctgg

SEQ ID NO: 710758 - DNA, 10 bp, Homo sapiens
actgcaggga

SEQ ID NO: 710759 - DNA, 19 bp, Homo sapiens
actgcaggggccactccaa

SEQ ID NO: 710760 - DNA, 21 bp, Homo sapiens
actgcaggtgggctgggccca

SEQ ID NO: 710761 - DNA, 16 bp, Homo sapiens
actgcagtttcctgga

SEQ ID NO: 710762 - DNA, 14 bp, Homo sapiens
actgcatacaatct

SEQ ID NO: 710763 - DNA, 16 bp, Homo sapiens
actgcatactttttaa

SEQ ID NO: 710764 - DNA, 19 bp, Homo sapiens
acggaagttttcaatgatg

SEQ ID NO: 710765 - DNA, 16 bp, Homo sapiens
acggacaccccctcgc

SEQ ID NO: 710766 - DNA, 17 bp, Homo sapiens
acggacactcaaaagct

SEQ ID NO: 710767 - DNA, 16 bp, Homo sapiens
acggacactgtggaga

SEQ ID NO: 710768 - DNA, 22 bp, Homo sapiens
acggacccccagagcaccccca

SEQ ID NO: 710769 - DNA, 22 bp, Homo sapiens
acggagagtgcttgggtggtgg

SEQ ID NO: 710770 - DNA, 19 bp, Homo sapiens
acggagccactcctctgac

SEQ ID NO: 710771 - DNA, 20 bp, Homo sapiens
acggagcccctgaaagcctc

SEQ ID NO: 710772 - DNA, 21 bp, Homo sapiens
acggaggtccccggttgctgg

SEQ ID NO: 710773 - DNA, 22 bp, Homo sapiens
acggagtggggggacagagact

SEQ ID NO: 710774 - DNA, 22 bp, Homo sapiens
acggataggcaggaacatacag

SEQ ID NO: 710775 - DNA, 20 bp, Homo sapiens
acggatccatgtagcaggac

SEQ ID NO: 710776 - DNA, 22 bp, Homo sapiens
acggatggtgcatgggctcgcc

SEQ ID NO: 710777 - DNA, 14 bp, Homo sapiens
acggattttcagtt

SEQ ID NO: 710778 - DNA, 15 bp, Homo sapiens
acggattttcagtta

SEQ ID NO: 710779 - DNA, 14 bp, Homo sapiens
acggcaacagcatg

SEQ ID NO: 710780 - DNA, 15 bp, Homo sapiens
acggcaaccacatgt

SEQ ID NO: 710781 - DNA, 20 bp, Homo sapiens
acggcaaccacatgtcccag

SEQ ID NO: 710782 - DNA, 15 bp, Homo sapiens
acggcaggctcactg

SEQ ID NO: 710783 - DNA, 23 bp, Homo sapiens
acggcatcgcatccgtcctgggc

SEQ ID NO: 710784 - DNA, 22 bp, Homo sapiens
acggccaatggtgcttccccca

SEQ ID NO: 710785 - DNA, 15 bp, Homo sapiens
acggccatgagactg

SEQ ID NO: 710786 - DNA, 16 bp, Homo sapiens
acggcccggcccctca

SEQ ID NO: 710787 - DNA, 18 bp, Homo sapiens
acggccctgcagccagct

SEQ ID NO: 710788 - DNA, 17 bp, Homo sapiens
acggccctgcaggagca

SEQ ID NO: 710789 - DNA, 13 bp, Homo sapiens
acggccctgcctg

SEQ ID NO: 710790 - DNA, 16 bp, Homo sapiens
acggccctgcctgcct

SEQ ID NO: 710791 - DNA, 20 bp, Homo sapiens
acggccctgcctgcctcttg

SEQ ID NO: 710792 - DNA, 22 bp, Homo sapiens
acggccttcttggtttcagcca

SEQ ID NO: 710793 - DNA, 19 bp, Homo sapiens
acggcgttgtacctgtagg

SEQ ID NO: 710794 - DNA, 13 bp, Homo sapiens
acggcgttttttt

SEQ ID NO: 710795 - DNA, 20 bp, Homo sapiens
acggctccgagggcggccag

SEQ ID NO: 710796 - DNA, 23 bp, Homo sapiens
acggctccgagggcggccaggga

SEQ ID NO: 710797 - DNA, 18 bp, Homo sapiens
acggctcctcagagcgcc

SEQ ID NO: 710798 - DNA, 22 bp, Homo sapiens
acggctcctcagagcgccagga

SEQ ID NO: 710799 - DNA, 16 bp, Homo sapiens
acggctcctccccgat

SEQ ID NO: 710800 - DNA, 18 bp, Homo sapiens
acggctcgatttctccag

SEQ ID NO: 710801 - DNA, 16 bp, Homo sapiens
acggctgatgtggact

SEQ ID NO: 710802 - DNA, 23 bp, Homo sapiens
acggctgccattggtccaccctt

SEQ ID NO: 710803 - DNA, 16 bp, Homo sapiens
acggctgcgcactgtg

SEQ ID NO: 710804 - DNA, 18 bp, Homo sapiens
acggctgcgcactgtgtc

SEQ ID NO: 710805 - DNA, 19 bp, Homo sapiens
acggctggtcactctgccc

SEQ ID NO: 710806 - DNA, 20 bp, Homo sapiens
acggctggtcactctgccct

SEQ ID NO: 710807 - DNA, 22 bp, Homo sapiens
acggctggtcactctgccctct

SEQ ID NO: 710808 - DNA, 23 bp, Homo sapiens
acggctggtcactctgccctctg

SEQ ID NO: 710809 - DNA, 19 bp, Homo sapiens
acggctgtgacgcagccgg

SEQ ID NO: 710810 - DNA, 21 bp, Homo sapiens
acggctgtgacgcagccggag

SEQ ID NO: 710811 - DNA, 23 bp, Homo sapiens
acggctgttcccctcacccaaaa

SEQ ID NO: 710812 - DNA, 18 bp, Homo sapiens
acgggaacatgccccctg

SEQ ID NO: 710813 - DNA, 15 bp, Homo sapiens
acgggactgacgcaa

SEQ ID NO: 710814 - DNA, 17 bp, Homo sapiens
acgggagtgacccagct

SEQ ID NO: 710815 - DNA, 16 bp, Homo sapiens
acgggatgcgtgggag

SEQ ID NO: 710816 - DNA, 19 bp, Homo sapiens
acgggcaagtgagagggga

SEQ ID NO: 710817 - DNA, 20 bp, Homo sapiens
acgggcaagtgagaggggag

SEQ ID NO: 710818 - DNA, 23 bp, Homo sapiens
acgggcaagtgagaggggaggga

SEQ ID NO: 710819 - DNA, 16 bp, Homo sapiens
acgggcacacagactg

SEQ ID NO: 710820 - DNA, 11 bp, Homo sapiens
acgggcagcca

SEQ ID NO: 710821 - DNA, 12 bp, Homo sapiens
acgggcagccac

SEQ ID NO: 710822 - DNA, 16 bp, Homo sapiens
acgggcagtagctgtg

SEQ ID NO: 710823 - DNA, 15 bp, Homo sapiens
acgggcagtctgctc

SEQ ID NO: 710824 - DNA, 16 bp, Homo sapiens
acgggcagtctgctct

SEQ ID NO: 710825 - DNA, 23 bp, Homo sapiens
acgggcatgcacacggctggtca

SEQ ID NO: 710826 - DNA, 18 bp, Homo sapiens
acgggcatgggcactccc

SEQ ID NO: 710827 - DNA, 15 bp, Homo sapiens
acgggcatgggcctc

SEQ ID NO: 710828 - DNA, 17 bp, Homo sapiens
acgggcattcacaaccc

SEQ ID NO: 710829 - DNA, 15 bp, Homo sapiens
acgggcccatggcct

SEQ ID NO: 710830 - DNA, 18 bp, Homo sapiens
acgggccctccctcccag

SEQ ID NO: 710831 - DNA, 19 bp, Homo sapiens
acgggccctccctcccagc

SEQ ID NO: 710832 - DNA, 16 bp, Homo sapiens
acgggccctccttccc

SEQ ID NO: 710833 - DNA, 12 bp, Homo sapiens
acgggccctgcc

SEQ ID NO: 710834 - DNA, 13 bp, Homo sapiens
acgggccctgccc

SEQ ID NO: 710835 - DNA, 18 bp, Homo sapiens
acgggccgcaggagggag

SEQ ID NO: 710836 - DNA, 20 bp, Homo sapiens
acgggccgcaggagggaggc

SEQ ID NO: 710837 - DNA, 16 bp, Homo sapiens
acgggcgagctttctc

SEQ ID NO: 710838 - DNA, 14 bp, Homo sapiens
acgggctccttccc

SEQ ID NO: 710839 - DNA, 16 bp, Homo sapiens
acgggctccttcccct

SEQ ID NO: 710840 - DNA, 19 bp, Homo sapiens
acgggctctatgcctgcac

SEQ ID NO: 710841 - DNA, 20 bp, Homo sapiens
acgggctctatgcctgcact

SEQ ID NO: 710842 - DNA, 23 bp, Homo sapiens
acgggcttgttgctgttgatgtt

SEQ ID NO: 710843 - DNA, 14 bp, Homo sapiens
acggggaggccaag

SEQ ID NO: 710844 - DNA, 19 bp, Homo sapiens
acggggcagttagagcagc

SEQ ID NO: 710845 - DNA, 21 bp, Homo sapiens
acggggccgacattgtctccc

SEQ ID NO: 710846 - DNA, 15 bp, Homo sapiens
acgggggcagtgtga

SEQ ID NO: 710847 - DNA, 12 bp, Homo sapiens
acgggggtggga

SEQ ID NO: 710848 - DNA, 15 bp, Homo sapiens
acggggtttcaccat

SEQ ID NO: 710849 - DNA, 16 bp, Homo sapiens
acggggtttcaccatg

SEQ ID NO: 710850 - DNA, 20 bp, Homo sapiens
acgggtcagtattaaggttt

SEQ ID NO: 710851 - DNA, 14 bp, Homo sapiens
acgggtggggaaag

SEQ ID NO: 710852 - DNA, 13 bp, Homo sapiens
acgggtggtcccc

SEQ ID NO: 710853 - DNA, 18 bp, Homo sapiens
acggtaagtgttctcatg

SEQ ID NO: 710854 - DNA, 16 bp, Homo sapiens
acggtcaggtttaaca

SEQ ID NO: 710855 - DNA, 21 bp, Homo sapiens
acggtcccacactggtgactg

SEQ ID NO: 710856 - DNA, 21 bp, Homo sapiens
acggtcctttaggcagcctgc

SEQ ID NO: 710857 - DNA, 16 bp, Homo sapiens
acggtctgtgtgctgt

SEQ ID NO: 710858 - DNA, 17 bp, Homo sapiens
acggtgacaaagatggc

SEQ ID NO: 710859 - DNA, 21 bp, Homo sapiens
acggtgacacaggtcagggct

SEQ ID NO: 710860 - DNA, 23 bp, Homo sapiens
acggtgacacaggtcagggctca

SEQ ID NO: 710861 - DNA, 17 bp, Homo sapiens
acggtgccaagggcccc

SEQ ID NO: 710862 - DNA, 14 bp, Homo sapiens
acggtgcccaagcc

SEQ ID NO: 710863 - DNA, 15 bp, Homo sapiens
acggtgcgtggctgt

SEQ ID NO: 710864 - DNA, 19 bp, Homo sapiens
acggtgcgtggctgtggca

SEQ ID NO: 710865 - DNA, 20 bp, Homo sapiens
acggtgctgtgagggagggg

SEQ ID NO: 710866 - DNA, 22 bp, Homo sapiens
acggtggcggctgcacaacagc

SEQ ID NO: 710867 - DNA, 19 bp, Homo sapiens
acggtgggcatttgtgagg

SEQ ID NO: 710868 - DNA, 15 bp, Homo sapiens
acggtgttttgccat

SEQ ID NO: 710869 - DNA, 18 bp, Homo sapiens
acggttaacttgtatatt

SEQ ID NO: 710870 - DNA, 14 bp, Homo sapiens
acggtttgtgagag

SEQ ID NO: 710871 - DNA, 14 bp, Homo sapiens
acgtaaatattcat

SEQ ID NO: 710872 - DNA, 13 bp, Homo sapiens
acgtacacatttt

SEQ ID NO: 710873 - DNA, 15 bp, Homo sapiens
acgtaccttcatgtg

SEQ ID NO: 710874 - DNA, 13 bp, Homo sapiens
acgtactgtaact

SEQ ID NO: 710875 - DNA, 18 bp, Homo sapiens
acgtactgtaactgctca

SEQ ID NO: 710876 - DNA, 15 bp, Homo sapiens
acgtagaagctcttg

SEQ ID NO: 710877 - DNA, 12 bp, Homo sapiens
acgtagcctggg

SEQ ID NO: 710878 - DNA, 17 bp, Homo sapiens
acgtagctgaggccgga

SEQ ID NO: 710879 - DNA, 16 bp, Homo sapiens
acgtagttgtgctttt

SEQ ID NO: 710880 - DNA, 13 bp, Homo sapiens
acgtataaatatc

SEQ ID NO: 710881 - DNA, 13 bp, Homo sapiens
acgtatgcatgtg

SEQ ID NO: 710882 - DNA, 14 bp, Homo sapiens
acgtattgctgtgt

SEQ ID NO: 710883 - DNA, 17 bp, Homo sapiens
acgtattgctgtgtctc

SEQ ID NO: 710884 - DNA, 18 bp, Homo sapiens
acgtatttagccattacc

SEQ ID NO: 710885 - DNA, 17 bp, Homo sapiens
accctcccatggcacct

SEQ ID NO: 710886 - DNA, 23 bp, Homo sapiens
accctcccccaggaggtcgaccc

SEQ ID NO: 710887 - DNA, 23 bp, Homo sapiens
accctccccgcaccccccaagct

SEQ ID NO: 710888 - DNA, 20 bp, Homo sapiens
accctccccggcggtgccgc

SEQ ID NO: 710889 - DNA, 12 bp, Homo sapiens
accctcccctct

SEQ ID NO: 710890 - DNA, 19 bp, Homo sapiens
accctcccctctcttgcac

SEQ ID NO: 710891 - DNA, 15 bp, Homo sapiens
accctccccttttat

SEQ ID NO: 710892 - DNA, 19 bp, Homo sapiens
accctccccttttttcttc

SEQ ID NO: 710893 - DNA, 15 bp, Homo sapiens
accctcccggcctgg

SEQ ID NO: 710894 - DNA, 18 bp, Homo sapiens
accctccctcagcccctc

SEQ ID NO: 710895 - DNA, 23 bp, Homo sapiens
accctccctcagcccctcttgcc

SEQ ID NO: 710896 - DNA, 18 bp, Homo sapiens
accctccctccactcctc

SEQ ID NO: 710897 - DNA, 20 bp, Homo sapiens
accctccctccactcctctc

SEQ ID NO: 710898 - DNA, 23 bp, Homo sapiens
accctccctccgatccttcctcc

SEQ ID NO: 710899 - DNA, 17 bp, Homo sapiens
accctcctatcacctcc

SEQ ID NO: 710900 - DNA, 14 bp, Homo sapiens
accctcctccactc

SEQ ID NO: 710901 - DNA, 20 bp, Homo sapiens
accctcctccctccaagcct

SEQ ID NO: 710902 - DNA, 21 bp, Homo sapiens
accctcctccctccaagcctg

SEQ ID NO: 710903 - DNA, 23 bp, Homo sapiens
accctcctccctccaagcctggc

SEQ ID NO: 710904 - DNA, 16 bp, Homo sapiens
accctcctctgctggg

SEQ ID NO: 710905 - DNA, 14 bp, Homo sapiens
accctcctggcctt

SEQ ID NO: 710906 - DNA, 15 bp, Homo sapiens
accctcctggccttc

SEQ ID NO: 710907 - DNA, 14 bp, Homo sapiens
accctcctgtaaat

SEQ ID NO: 710908 - DNA, 14 bp, Homo sapiens
accctcgggcccac

SEQ ID NO: 710909 - DNA, 17 bp, Homo sapiens
accctcgggcccacctg

SEQ ID NO: 710910 - DNA, 22 bp, Homo sapiens
accctcgggcccacctggccac

SEQ ID NO: 710911 - DNA, 12 bp, Homo sapiens
accctctcactt

SEQ ID NO: 710912 - DNA, 13 bp, Homo sapiens
accctctcacttt

SEQ ID NO: 710913 - DNA, 23 bp, Homo sapiens
accctctccggtttgggttggga

SEQ ID NO: 710914 - DNA, 22 bp, Homo sapiens
accctctcctgtctgccctctg

SEQ ID NO: 710915 - DNA, 15 bp, Homo sapiens
accctctgcccaggg

SEQ ID NO: 710916 - DNA, 19 bp, Homo sapiens
accctctgggaacctccca

SEQ ID NO: 710917 - DNA, 20 bp, Homo sapiens
accctctgggaacctcccag

SEQ ID NO: 710918 - DNA, 21 bp, Homo sapiens
accctctgggaacctcccaga

SEQ ID NO: 710919 - DNA, 17 bp, Homo sapiens
accctctggggacagga

SEQ ID NO: 710920 - DNA, 15 bp, Homo sapiens
accctctggtccttc

SEQ ID NO: 710921 - DNA, 18 bp, Homo sapiens
accctctggtccttctga

SEQ ID NO: 710922 - DNA, 23 bp, Homo sapiens
accctctgtccccaggcctggct

SEQ ID NO: 710923 - DNA, 20 bp, Homo sapiens
accctcttcctgtgatccac

SEQ ID NO: 710924 - DNA, 16 bp, Homo sapiens
accctcttgccatcct

SEQ ID NO: 710925 - DNA, 17 bp, Homo sapiens
accctcttgccatcctg

SEQ ID NO: 710926 - DNA, 19 bp, Homo sapiens
accctcttgccatcctgat

SEQ ID NO: 710927 - DNA, 20 bp, Homo sapiens
accctctttgctgcagagaa

SEQ ID NO: 710928 - DNA, 16 bp, Homo sapiens
accctcttttaccaac

SEQ ID NO: 710929 - DNA, 16 bp, Homo sapiens
accctgaaagccctga

SEQ ID NO: 710930 - DNA, 18 bp, Homo sapiens
accctgaaagccctgagc

SEQ ID NO: 710931 - DNA, 19 bp, Homo sapiens
accctgaaaggaacactgg

SEQ ID NO: 710932 - DNA, 20 bp, Homo sapiens
accctgaaaggaacactggc

SEQ ID NO: 710933 - DNA, 20 bp, Homo sapiens
accctgaacccacacctggg

SEQ ID NO: 710934 - DNA, 21 bp, Homo sapiens
accctgaacccacacctgggc

SEQ ID NO: 710935 - DNA, 21 bp, Homo sapiens
accctgacaaattttaattat

SEQ ID NO: 710936 - DNA, 20 bp, Homo sapiens
accctgagatacttcccaaa

SEQ ID NO: 710937 - DNA, 21 bp, Homo sapiens
accctgagatacttcccaaag

SEQ ID NO: 710938 - DNA, 11 bp, Homo sapiens
accctgagccc

SEQ ID NO: 710939 - DNA, 12 bp, Homo sapiens
accctgagccgg

SEQ ID NO: 710940 - DNA, 23 bp, Homo sapiens
accctgaggaggccgcttagtgc

SEQ ID NO: 710941 - DNA, 17 bp, Homo sapiens
accctgatccttttcaa

SEQ ID NO: 710942 - DNA, 20 bp, Homo sapiens
accctgatgtgacattccat

SEQ ID NO: 710943 - DNA, 23 bp, Homo sapiens
accctgattcatactccttttgg

SEQ ID NO: 710944 - DNA, 15 bp, Homo sapiens
accctgattcttgat

SEQ ID NO: 710945 - DNA, 17 bp, Homo sapiens
acttcacacacaggcaa

SEQ ID NO: 710946 - DNA, 13 bp, Homo sapiens
acttcacactgca

SEQ ID NO: 710947 - DNA, 23 bp, Homo sapiens
acttcaccaccccctgtcccatt

SEQ ID NO: 710948 - DNA, 16 bp, Homo sapiens
acttcacctttcctct

SEQ ID NO: 710949 - DNA, 21 bp, Homo sapiens
acttcacctttcctctccctc

SEQ ID NO: 710950 - DNA, 23 bp, Homo sapiens
acttcacctttcctctccctcag

SEQ ID NO: 710951 - DNA, 19 bp, Homo sapiens
acttcactgtcaggaagaa

SEQ ID NO: 710952 - DNA, 21 bp, Homo sapiens
acttcactgtgaggggaaggc

SEQ ID NO: 710953 - DNA, 16 bp, Homo sapiens
acttcagaaagacttg

SEQ ID NO: 710954 - DNA, 17 bp, Homo sapiens
acttcagaagcaaacaa

SEQ ID NO: 710955 - DNA, 18 bp, Homo sapiens
acttcagacacaggaaaa

SEQ ID NO: 710956 - DNA, 15 bp, Homo sapiens
acttcagagagctgg

SEQ ID NO: 710957 - DNA, 16 bp, Homo sapiens
acttcagagagctggt

SEQ ID NO: 710958 - DNA, 12 bp, Homo sapiens
acttcagatctc

SEQ ID NO: 710959 - DNA, 14 bp, Homo sapiens
acttcagattgaac

SEQ ID NO: 710960 - DNA, 16 bp, Homo sapiens
acttcagcaatgaatt

SEQ ID NO: 710961 - DNA, 14 bp, Homo sapiens
acttcagctctgtt

SEQ ID NO: 710962 - DNA, 17 bp, Homo sapiens
acttcaggaacaagtaa

SEQ ID NO: 710963 - DNA, 22 bp, Homo sapiens
acttcaggaacaagtaatgtat

SEQ ID NO: 710964 - DNA, 20 bp, Homo sapiens
acttcaggctcttctccttt

SEQ ID NO: 710965 - DNA, 12 bp, Homo sapiens
acttcaggtgct

SEQ ID NO: 710966 - DNA, 22 bp, Homo sapiens
acttcaggtggagagcactaga

SEQ ID NO: 710967 - DNA, 23 bp, Homo sapiens
acttcagtatgttgtcaaagaga

SEQ ID NO: 710968 - DNA, 17 bp, Homo sapiens
acttcagtgaaattttc

SEQ ID NO: 710969 - DNA, 22 bp, Homo sapiens
acttcagtgtggtacaaggtgg

SEQ ID NO: 710970 - DNA, 16 bp, Homo sapiens
acttcagttgatcttc

SEQ ID NO: 710971 - DNA, 22 bp, Homo sapiens
acttcagtttcacagaaaataa

SEQ ID NO: 710972 - DNA, 19 bp, Homo sapiens
acttcagttttatttttgc

SEQ ID NO: 710973 - DNA, 15 bp, Homo sapiens
acttcataataaact

SEQ ID NO: 710974 - DNA, 20 bp, Homo sapiens
acttcatactggcaggaggg

SEQ ID NO: 710975 - DNA, 19 bp, Homo sapiens
acttcatagatgcaggagg

SEQ ID NO: 710976 - DNA, 18 bp, Homo sapiens
acttcatatatgaggact

SEQ ID NO: 710977 - DNA, 19 bp, Homo sapiens
acttcatcaaaatcatgga

SEQ ID NO: 710978 - DNA, 20 bp, Homo sapiens
acttcatcaaacatgggttt

SEQ ID NO: 710979 - DNA, 20 bp, Homo sapiens
acttcatggaatggacatcc

SEQ ID NO: 710980 - DNA, 23 bp, Homo sapiens
acttcatggcctttgataaatgt

SEQ ID NO: 710981 - DNA, 23 bp, Homo sapiens
acttcatgtaattttattttaaa

SEQ ID NO: 710982 - DNA, 21 bp, Homo sapiens
acttcattattttaaaaatat

SEQ ID NO: 710983 - DNA, 15 bp, Homo sapiens
acttcattccagcag

SEQ ID NO: 710984 - DNA, 17 bp, Homo sapiens
acttcattccagcagct

SEQ ID NO: 710985 - DNA, 13 bp, Homo sapiens
acttcattctaaa

SEQ ID NO: 710986 - DNA, 22 bp, Homo sapiens
acttcattctaaaccaaaacag

SEQ ID NO: 710987 - DNA, 19 bp, Homo sapiens
acttcattcttgaaagctg

SEQ ID NO: 710988 - DNA, 21 bp, Homo sapiens
acttcattcttgaaagctgtg

SEQ ID NO: 710989 - DNA, 20 bp, Homo sapiens
acttcatttgacacaaagct

SEQ ID NO: 710990 - DNA, 17 bp, Homo sapiens
acttcatttggtgctgg

SEQ ID NO: 710991 - DNA, 16 bp, Homo sapiens
acttcattttctcaaa

SEQ ID NO: 710992 - DNA, 15 bp, Homo sapiens
acttccaaacagtgt

SEQ ID NO: 710993 - DNA, 21 bp, Homo sapiens
acttccaaacagtgtgttggt

SEQ ID NO: 710994 - DNA, 22 bp, Homo sapiens
acttccaaacagtgtgttggtg

SEQ ID NO: 710995 - DNA, 14 bp, Homo sapiens
acttccaaactaat

SEQ ID NO: 710996 - DNA, 15 bp, Homo sapiens
acttccaaatcctgg

SEQ ID NO: 710997 - DNA, 17 bp, Homo sapiens
acttccaagaaaaataa

SEQ ID NO: 710998 - DNA, 20 bp, Homo sapiens
acttccaagtgataatttta

SEQ ID NO: 710999 - DNA, 23 bp, Homo sapiens
acttccacctccaccacatctgc

SEQ ID NO: 711000 - DNA, 17 bp, Homo sapiens
acttccactgccatcct

SEQ ID NO: 711001 - DNA, 19 bp, Homo sapiens
acttccagaggacagctct

SEQ ID NO: 711002 - DNA, 20 bp, Homo sapiens
acttccagaggacagctctg

SEQ ID NO: 711003 - DNA, 21 bp, Homo sapiens
acttccagaggacagctctgg

SEQ ID NO: 711004 - DNA, 15 bp, Homo sapiens
acttccagatatcca

SEQ ID NO: 711005 - DNA, 17 bp, Homo sapiens
acttccagatatccaca

SEQ ID NO: 711006 - DNA, 18 bp, Homo sapiens
acttccagatatccacat

SEQ ID NO: 711007 - DNA, 12 bp, Homo sapiens
acttccagcaag

SEQ ID NO: 711008 - DNA, 20 bp, Homo sapiens
acttccaggggaacctgcca

SEQ ID NO: 711009 - DNA, 21 bp, Homo sapiens
acttccagtgttggctgtgtg

SEQ ID NO: 711010 - DNA, 16 bp, Homo sapiens
acttccatacagctct

SEQ ID NO: 711011 - DNA, 14 bp, Homo sapiens
acttccatgaattt

SEQ ID NO: 711012 - DNA, 19 bp, Homo sapiens
acttccattggttcttcct

SEQ ID NO: 711013 - DNA, 20 bp, Homo sapiens
acttccattggttcttcctt

SEQ ID NO: 711014 - DNA, 21 bp, Homo sapiens
acttccattggttcttccttt

SEQ ID NO: 711015 - DNA, 22 bp, Homo sapiens
acttcccacacggcagcccccc

SEQ ID NO: 711016 - DNA, 14 bp, Homo sapiens
acttcccactgttc

SEQ ID NO: 711017 - DNA, 22 bp, Homo sapiens
acttcccagttcaggagtccca

SEQ ID NO: 711018 - DNA, 13 bp, Homo sapiens
acttcccatctcc

SEQ ID NO: 711019 - DNA, 12 bp, Homo sapiens
acttcccctggg

SEQ ID NO: 711020 - DNA, 14 bp, Homo sapiens
acttcccctgggat

SEQ ID NO: 711021 - DNA, 16 bp, Homo sapiens
acttcccctgggatgc

SEQ ID NO: 711022 - DNA, 13 bp, Homo sapiens
acttcccctgggc

SEQ ID NO: 711023 - DNA, 19 bp, Homo sapiens
acttccccttcctaattcc

SEQ ID NO: 711024 - DNA, 17 bp, Homo sapiens
acttccccttgtctccc

SEQ ID NO: 711025 - DNA, 19 bp, Homo sapiens
acttccccttgtctccctg

SEQ ID NO: 711026 - DNA, 14 bp, Homo sapiens
acttccctagtccc

SEQ ID NO: 711027 - DNA, 22 bp, Homo sapiens
acttccctgctccaacccccgc

SEQ ID NO: 711028 - DNA, 11 bp, Homo sapiens
acttccctggc

SEQ ID NO: 711029 - DNA, 16 bp, Homo sapiens
acttccctggtcacca

SEQ ID NO: 711030 - DNA, 23 bp, Homo sapiens
acttccctggtcaccaaggcagt

SEQ ID NO: 711031 - DNA, 13 bp, Homo sapiens
acttccgctgagg

SEQ ID NO: 711032 - DNA, 14 bp, Homo sapiens
acttccgctgaggg

SEQ ID NO: 711033 - DNA, 22 bp, Homo sapiens
acttcctccacagtcccccacc

SEQ ID NO: 711034 - DNA, 18 bp, Homo sapiens
acttcctcctccccactt

SEQ ID NO: 711035 - DNA, 12 bp, Homo sapiens
acttcctcctga

SEQ ID NO: 711036 - DNA, 19 bp, Homo sapiens
acttcctctctacccccca

SEQ ID NO: 711037 - DNA, 15 bp, Homo sapiens
acttcctctctcgga

SEQ ID NO: 711038 - DNA, 12 bp, Homo sapiens
acttcctgccta

SEQ ID NO: 711039 - DNA, 16 bp, Homo sapiens
acttcctgctgcaccc

SEQ ID NO: 711040 - DNA, 17 bp, Homo sapiens
acttcctgctgcaccct

SEQ ID NO: 711041 - DNA, 19 bp, Homo sapiens
acttcctgctgcaccctgc

SEQ ID NO: 711042 - DNA, 22 bp, Homo sapiens
acttcctgctgcaccctgcgcc

SEQ ID NO: 711043 - DNA, 19 bp, Homo sapiens
acttcctggggatgtcata

SEQ ID NO: 711044 - DNA, 13 bp, Homo sapiens
acttcctgtccag

SEQ ID NO: 711045 - DNA, 17 bp, Homo sapiens
acttcctgtccagagag

SEQ ID NO: 711046 - DNA, 16 bp, Homo sapiens
acttcctgtgcctttc

SEQ ID NO: 711047 - DNA, 20 bp, Homo sapiens
acttcctgtgcctttcctat

SEQ ID NO: 711048 - DNA, 14 bp, Homo sapiens
acttccttgagaca

SEQ ID NO: 711049 - DNA, 14 bp, Homo sapiens
acttccttttaact

SEQ ID NO: 711050 - DNA, 19 bp, Homo sapiens
acttcgactcaggatccag

SEQ ID NO: 711051 - DNA, 14 bp, Homo sapiens
acttcgactgtgac

SEQ ID NO: 711052 - DNA, 22 bp, Homo sapiens
acttcgggaggtcgaggcagga

SEQ ID NO: 711053 - DNA, 23 bp, Homo sapiens
acttcgtcttcgccctctgaaat

SEQ ID NO: 711054 - DNA, 14 bp, Homo sapiens
acttctagctgtct

SEQ ID NO: 711055 - DNA, 15 bp, Homo sapiens
acttctagctgtctg

SEQ ID NO: 711056 - DNA, 18 bp, Homo sapiens
acttctagctgtctgtga

SEQ ID NO: 711057 - DNA, 22 bp, Homo sapiens
actgtgaggaagtgtggaaaaa

SEQ ID NO: 711058 - DNA, 22 bp, Homo sapiens
actgtgatgccacacagagtgg

SEQ ID NO: 711059 - DNA, 12 bp, Homo sapiens
actgtgattaga

SEQ ID NO: 711060 - DNA, 16 bp, Homo sapiens
actgtgattagatcac

SEQ ID NO: 711061 - DNA, 21 bp, Homo sapiens
actgtgattttgccctcctgc

SEQ ID NO: 711062 - DNA, 19 bp, Homo sapiens
actgtgcaaagggctgcct

SEQ ID NO: 711063 - DNA, 18 bp, Homo sapiens
actgtgcaactttttaaa

SEQ ID NO: 711064 - DNA, 15 bp, Homo sapiens
actgtgcacatctgt

SEQ ID NO: 711065 - DNA, 18 bp, Homo sapiens
actgtgcaccaagcagga

SEQ ID NO: 711066 - DNA, 22 bp, Homo sapiens
actgtgcagaataatggaaaca

SEQ ID NO: 711067 - DNA, 24 bp, Homo sapiens
actgtgcagacccagtcccacact

SEQ ID NO: 711068 - DNA, 16 bp, Homo sapiens
actgtgcagttgctgt

SEQ ID NO: 711069 - DNA, 21 bp, Homo sapiens
actgtgcatcaaccaggaaga

SEQ ID NO: 711070 - DNA, 12 bp, Homo sapiens
actgtgccctgg

SEQ ID NO: 711071 - DNA, 15 bp, Homo sapiens
actgtgccctggtgg

SEQ ID NO: 711072 - DNA, 21 bp, Homo sapiens
actgtgcctcaggccagggct

SEQ ID NO: 711073 - DNA, 12 bp, Homo sapiens
actgtgcctggt

SEQ ID NO: 711074 - DNA, 18 bp, Homo sapiens
actgtgcctggtttgatt

SEQ ID NO: 711075 - DNA, 23 bp, Homo sapiens
actgtgcctttgcaaatcagtgt

SEQ ID NO: 711076 - DNA, 13 bp, Homo sapiens
actgtgctgagaa

SEQ ID NO: 711077 - DNA, 21 bp, Homo sapiens
actgtggaatataaatagctg

SEQ ID NO: 711078 - DNA, 16 bp, Homo sapiens
actgtggaatttattg

SEQ ID NO: 711079 - DNA, 18 bp, Homo sapiens
actgtggaatttattggc

SEQ ID NO: 711080 - DNA, 20 bp, Homo sapiens
actgtggacctctatcatct

SEQ ID NO: 711081 - DNA, 17 bp, Homo sapiens
actgtggccagagctgg

SEQ ID NO: 711082 - DNA, 13 bp, Homo sapiens
actgtggccaggc

SEQ ID NO: 711083 - DNA, 20 bp, Homo sapiens
actgtggccatatatgctgt

SEQ ID NO: 711084 - DNA, 22 bp, Homo sapiens
actgtggccatatatgctgtat

SEQ ID NO: 711085 - DNA, 23 bp, Homo sapiens
actgtggccatatatgctgtatt

SEQ ID NO: 711086 - DNA, 14 bp, Homo sapiens
actgtggccccaag

SEQ ID NO: 711087 - DNA, 19 bp, Homo sapiens
actgtggccccctccgtga

SEQ ID NO: 711088 - DNA, 23 bp, Homo sapiens
actgtggccgttatctggaagta

SEQ ID NO: 711089 - DNA, 20 bp, Homo sapiens
actgtgggaaggccagctgc

SEQ ID NO: 711090 - DNA, 12 bp, Homo sapiens
actgtggggaga

SEQ ID NO: 711091 - DNA, 15 bp, Homo sapiens
actgtggggagagat

SEQ ID NO: 711092 - DNA, 19 bp, Homo sapiens
actgtggggagagatggca

SEQ ID NO: 711093 - DNA, 22 bp, Homo sapiens
actgtggggcttacagaaatga

SEQ ID NO: 711094 - DNA, 16 bp, Homo sapiens
actgtgggtggggagg

SEQ ID NO: 711095 - DNA, 21 bp, Homo sapiens
actgtgggtggggaggccctg

SEQ ID NO: 711096 - DNA, 17 bp, Homo sapiens
actgtggtaggggcagg

SEQ ID NO: 711097 - DNA, 14 bp, Homo sapiens
actgtggtcctatg

SEQ ID NO: 711098 - DNA, 20 bp, Homo sapiens
actgtggtgatctgtagact

SEQ ID NO: 711099 - DNA, 15 bp, Homo sapiens
actgtggtttcagat

SEQ ID NO: 711100 - DNA, 14 bp, Homo sapiens
actgtgtactgttc

SEQ ID NO: 711101 - DNA, 17 bp, Homo sapiens
actgtgtatcattaaaa

SEQ ID NO: 711102 - DNA, 20 bp, Homo sapiens
actgtgtatcattaaaatat

SEQ ID NO: 711103 - DNA, 13 bp, Homo sapiens
actgtgtatgttt

SEQ ID NO: 711104 - DNA, 21 bp, Homo sapiens
actgtgtatttatttaaaact

SEQ ID NO: 711105 - DNA, 22 bp, Homo sapiens
actgtgtatttatttaaaactc

SEQ ID NO: 711106 - DNA, 23 bp, Homo sapiens
actgtgtatttatttaaaactct

SEQ ID NO: 711107 - DNA, 13 bp, Homo sapiens
actgtgtcctggt

SEQ ID NO: 711108 - DNA, 14 bp, Homo sapiens
actgtgtctctgtt

SEQ ID NO: 711109 - DNA, 22 bp, Homo sapiens
actgtgtctctgtttcctgaaa

SEQ ID NO: 711110 - DNA, 19 bp, Homo sapiens
actgtgtctggcgttctca

SEQ ID NO: 711111 - DNA, 19 bp, Homo sapiens
actgtgtgaccagcggaaa

SEQ ID NO: 711112 - DNA, 14 bp, Homo sapiens
actgtgtgagaggg

SEQ ID NO: 711113 - DNA, 20 bp, Homo sapiens
actgtgtgaggctgtgtctc

SEQ ID NO: 711114 - DNA, 15 bp, Homo sapiens
actgtgtgtgtgaat

SEQ ID NO: 711115 - DNA, 18 bp, Homo sapiens
actgtgtgtgtgaatgaa

SEQ ID NO: 711116 - DNA, 16 bp, Homo sapiens
actgtgtgtgtgtgtg

SEQ ID NO: 711117 - DNA, 14 bp, Homo sapiens
actgtgtgttgaca

SEQ ID NO: 711118 - DNA, 14 bp, Homo sapiens
actgtgttcattag

SEQ ID NO: 711119 - DNA, 12 bp, Homo sapiens
actgtgttcctg

SEQ ID NO: 711120 - DNA, 17 bp, Homo sapiens
actgtgttgtattaaca

SEQ ID NO: 711121 - DNA, 14 bp, Homo sapiens
actgtgtttcaagt

SEQ ID NO: 711122 - DNA, 20 bp, Homo sapiens
actgtgtttccaaaggttcc

SEQ ID NO: 711123 - DNA, 19 bp, Homo sapiens
actgtgtttcgcattaagc

SEQ ID NO: 711124 - DNA, 19 bp, Homo sapiens
actgttacacgtgcctgta

SEQ ID NO: 711125 - DNA, 14 bp, Homo sapiens
actgttagatgctg

SEQ ID NO: 711126 - DNA, 14 bp, Homo sapiens
actgttcacggcag

SEQ ID NO: 711127 - DNA, 18 bp, Homo sapiens
actgttcacggcagacca

SEQ ID NO: 711128 - DNA, 17 bp, Homo sapiens
actgttccagattccta

SEQ ID NO: 711129 - DNA, 19 bp, Homo sapiens
actgttccaggccctccag

SEQ ID NO: 711130 - DNA, 15 bp, Homo sapiens
actgttctgaaagga

SEQ ID NO: 711131 - DNA, 16 bp, Homo sapiens
actgttctgtgtcttt

SEQ ID NO: 711132 - DNA, 17 bp, Homo sapiens
actgttctgtgtctttc

SEQ ID NO: 711133 - DNA, 13 bp, Homo sapiens
actgttcttttgc

SEQ ID NO: 711134 - DNA, 17 bp, Homo sapiens
actgttgagccccagtg

SEQ ID NO: 711135 - DNA, 20 bp, Homo sapiens
actgttgagccccagtgctg

SEQ ID NO: 711136 - DNA, 20 bp, Homo sapiens
actgttgatgtatctgagtt

SEQ ID NO: 711137 - DNA, 22 bp, Homo sapiens
actgttgcacagccagaagggg

SEQ ID NO: 711138 - DNA, 16 bp, Homo sapiens
actgttgcatttactt

SEQ ID NO: 711139 - DNA, 17 bp, Homo sapiens
actgttgcatttacttt

SEQ ID NO: 711140 - DNA, 18 bp, Homo sapiens
actgttgcatttactttt

SEQ ID NO: 711141 - DNA, 20 bp, Homo sapiens
actgttgcatttacttttaa

SEQ ID NO: 711142 - DNA, 15 bp, Homo sapiens
actgttggattcaga

SEQ ID NO: 711143 - DNA, 17 bp, Homo sapiens
actgttggctctctgac

SEQ ID NO: 711144 - DNA, 22 bp, Homo sapiens
actgttgggtgggtgggccctg

SEQ ID NO: 711145 - DNA, 20 bp, Homo sapiens
actgtttaatgttctgtgat

SEQ ID NO: 711146 - DNA, 11 bp, Homo sapiens
actgtttacag

SEQ ID NO: 711147 - DNA, 14 bp, Homo sapiens
actgtttatacact

SEQ ID NO: 711148 - DNA, 20 bp, Homo sapiens
actgtttattgaaagaatta

SEQ ID NO: 711149 - DNA, 15 bp, Homo sapiens
actgtttcaaacttt

SEQ ID NO: 711150 - DNA, 18 bp, Homo sapiens
actgtttcaaactttact

SEQ ID NO: 711151 - DNA, 19 bp, Homo sapiens
actgtttcaaactttacta

SEQ ID NO: 711152 - DNA, 21 bp, Homo sapiens
actgtttcactgaaatgtttg

SEQ ID NO: 711153 - DNA, 20 bp, Homo sapiens
actgtttcacttgctcttgg

SEQ ID NO: 711154 - DNA, 16 bp, Homo sapiens
actgtttcattcactg

SEQ ID NO: 711155 - DNA, 13 bp, Homo sapiens
actgtttcctggg

SEQ ID NO: 711156 - DNA, 13 bp, Homo sapiens
actgtttctctgc

SEQ ID NO: 711157 - DNA, 18 bp, Homo sapiens
actgtttctcttgagctg

SEQ ID NO: 711158 - DNA, 19 bp, Homo sapiens
actgtttctcttgagctgg

SEQ ID NO: 711159 - DNA, 19 bp, Homo sapiens
acttgcatacaccactgca

SEQ ID NO: 711160 - DNA, 12 bp, Homo sapiens
acttgcatgaag

SEQ ID NO: 711161 - DNA, 17 bp, Homo sapiens
acttgcatgaatgattt

SEQ ID NO: 711162 - DNA, 17 bp, Homo sapiens
acttgcatttttgcagg

SEQ ID NO: 711163 - DNA, 16 bp, Homo sapiens
acttgccaaaatgttg

SEQ ID NO: 711164 - DNA, 14 bp, Homo sapiens
acttgccatgcagg

SEQ ID NO: 711165 - DNA, 18 bp, Homo sapiens
acttgccattgccaggag

SEQ ID NO: 711166 - DNA, 16 bp, Homo sapiens
acttgccctgaccatg

SEQ ID NO: 711167 - DNA, 22 bp, Homo sapiens
acttgccgcgtcgccctcccag

SEQ ID NO: 711168 - DNA, 17 bp, Homo sapiens
acttgcctcatttccct

SEQ ID NO: 711169 - DNA, 13 bp, Homo sapiens
acttgcctcttcc

SEQ ID NO: 711170 - DNA, 12 bp, Homo sapiens
acttgcctggaa

SEQ ID NO: 711171 - DNA, 13 bp, Homo sapiens
acttgcctggggc

SEQ ID NO: 711172 - DNA, 17 bp, Homo sapiens
acttgcctggggtctga

SEQ ID NO: 711173 - DNA, 22 bp, Homo sapiens
acttgctaaagcactttgcact

SEQ ID NO: 711174 - DNA, 12 bp, Homo sapiens
acttgctactta

SEQ ID NO: 711175 - DNA, 13 bp, Homo sapiens
acttgctcccaac

SEQ ID NO: 711176 - DNA, 23 bp, Homo sapiens
acttgctgctgtgcctgcgtcgc

SEQ ID NO: 711177 - DNA, 17 bp, Homo sapiens
acttgctgtccaggcag

SEQ ID NO: 711178 - DNA, 18 bp, Homo sapiens
acttgctgtccaggcagc

SEQ ID NO: 711179 - DNA, 18 bp, Homo sapiens
acttgcttaaatttctta

SEQ ID NO: 711180 - DNA, 19 bp, Homo sapiens
acttgcttaaatttcttat

SEQ ID NO: 711181 - DNA, 16 bp, Homo sapiens
acttgcttatttgaca

SEQ ID NO: 711182 - DNA, 13 bp, Homo sapiens
acttgcttcagtg

SEQ ID NO: 711183 - DNA, 14 bp, Homo sapiens
acttgcttcagtgg

SEQ ID NO: 711184 - DNA, 18 bp, Homo sapiens
acttgcttctaaatgccc

SEQ ID NO: 711185 - DNA, 22 bp, Homo sapiens
acttgctttaccttttcagggc

SEQ ID NO: 711186 - DNA, 20 bp, Homo sapiens
acttgctttcaattgacaaa

SEQ ID NO: 711187 - DNA, 22 bp, Homo sapiens
acttggaaataaaccattggac

SEQ ID NO: 711188 - DNA, 22 bp, Homo sapiens
acttggaatcaaggtaagctca

SEQ ID NO: 711189 - DNA, 14 bp, Homo sapiens
acttggacatctct

SEQ ID NO: 711190 - DNA, 15 bp, Homo sapiens
acttggacatctctc

SEQ ID NO: 711191 - DNA, 17 bp, Homo sapiens
acttggacatctctctg

SEQ ID NO: 711192 - DNA, 16 bp, Homo sapiens
acttggactcttgctc

SEQ ID NO: 711193 - DNA, 18 bp, Homo sapiens
acttggactcttgctctt

SEQ ID NO: 711194 - DNA, 17 bp, Homo sapiens
acttggacttttgatag

SEQ ID NO: 711195 - DNA, 22 bp, Homo sapiens
acttggagactcctggtctgtg

SEQ ID NO: 711196 - DNA, 20 bp, Homo sapiens
acttggagagcaaaggccca

SEQ ID NO: 711197 - DNA, 16 bp, Homo sapiens
acttggagcccgtgca

SEQ ID NO: 711198 - DNA, 24 bp, Homo sapiens
acttggagggtctgggggcagctg

SEQ ID NO: 711199 - DNA, 13 bp, Homo sapiens
acttggattctct

SEQ ID NO: 711200 - DNA, 15 bp, Homo sapiens
acttggattctctaa

SEQ ID NO: 711201 - DNA, 20 bp, Homo sapiens
acttggatttagtttcagta

SEQ ID NO: 711202 - DNA, 12 bp, Homo sapiens
acttggcactta

SEQ ID NO: 711203 - DNA, 22 bp, Homo sapiens
acttggcagctttttctgtgga

SEQ ID NO: 711204 - DNA, 14 bp, Homo sapiens
acttggcatacaaa

SEQ ID NO: 711205 - DNA, 17 bp, Homo sapiens
acttggcatacaaaata

SEQ ID NO: 711206 - DNA, 14 bp, Homo sapiens
acttggcatttcta

SEQ ID NO: 711207 - DNA, 23 bp, Homo sapiens
acttggccctcttgcgggcctgg

SEQ ID NO: 711208 - DNA, 21 bp, Homo sapiens
acttggctcgaatctctgtgc

SEQ ID NO: 711209 - DNA, 23 bp, Homo sapiens
acttggctcgaatctctgtgcct

SEQ ID NO: 711210 - DNA, 15 bp, Homo sapiens
acttggctggggagg

SEQ ID NO: 711211 - DNA, 11 bp, Homo sapiens
acttggctgtc

SEQ ID NO: 711212 - DNA, 13 bp, Homo sapiens
acttggctgtcct

SEQ ID NO: 711213 - DNA, 19 bp, Homo sapiens
acttggctgtccttcccct

SEQ ID NO: 711214 - DNA, 20 bp, Homo sapiens
acttgggagacctgtaatca

SEQ ID NO: 711215 - DNA, 15 bp, Homo sapiens
acttgggagctgctg

SEQ ID NO: 711216 - DNA, 20 bp, Homo sapiens
acttgggagctgctgggcta

SEQ ID NO: 711217 - DNA, 15 bp, Homo sapiens
acttgggccactgtg

SEQ ID NO: 711218 - DNA, 15 bp, Homo sapiens
acttgggttgatctc

SEQ ID NO: 711219 - DNA, 20 bp, Homo sapiens
acttgggttgatctcttaga

SEQ ID NO: 711220 - DNA, 17 bp, Homo sapiens
acttggtggcttttcct

SEQ ID NO: 711221 - DNA, 18 bp, Homo sapiens
acttggtggcttttcctt

SEQ ID NO: 711222 - DNA, 23 bp, Homo sapiens
acttggtttcctatttcccctta

SEQ ID NO: 711223 - DNA, 12 bp, Homo sapiens
acttggtttgtg

SEQ ID NO: 711224 - DNA, 22 bp, Homo sapiens
acttggtttgttatatcaggga

SEQ ID NO: 711225 - DNA, 13 bp, Homo sapiens
acttggttttatg

SEQ ID NO: 711226 - DNA, 21 bp, Homo sapiens
acttggtttttttttttctta

SEQ ID NO: 711227 - DNA, 14 bp, Homo sapiens
acttgtaaaatgct

SEQ ID NO: 711228 - DNA, 19 bp, Homo sapiens
acttgtaaaatgcttttca

SEQ ID NO: 711229 - DNA, 15 bp, Homo sapiens
acttgtaaatacacc

SEQ ID NO: 711230 - DNA, 14 bp, Homo sapiens
acttgtaagttgct

SEQ ID NO: 711231 - DNA, 18 bp, Homo sapiens
acttgtacaaaataaaca

SEQ ID NO: 711232 - DNA, 14 bp, Homo sapiens
acttgtagcagcta

SEQ ID NO: 711233 - DNA, 21 bp, Homo sapiens
acttgtatagtgagagaggag

SEQ ID NO: 711234 - DNA, 23 bp, Homo sapiens
acttgtatagtgagagaggaggc

SEQ ID NO: 711235 - DNA, 22 bp, Homo sapiens
acttgtatatatggatcagagg

SEQ ID NO: 711236 - DNA, 14 bp, Homo sapiens
acttgtatatttgt

SEQ ID NO: 711237 - DNA, 16 bp, Homo sapiens
acttgtatatttgtac

SEQ ID NO: 711238 - DNA, 18 bp, Homo sapiens
acttgtattaaagacaga

SEQ ID NO: 711239 - DNA, 14 bp, Homo sapiens
acttgtattgactt

SEQ ID NO: 711240 - DNA, 21 bp, Homo sapiens
acttgtattttgtcacttttt

SEQ ID NO: 711241 - DNA, 16 bp, Homo sapiens
acttgtcaaagaaggt

SEQ ID NO: 711242 - DNA, 20 bp, Homo sapiens
acttgtcaagcctgtgcaaa

SEQ ID NO: 711243 - DNA, 16 bp, Homo sapiens
acttgtcaatatttaa

SEQ ID NO: 711244 - DNA, 22 bp, Homo sapiens
acttgtcatagactcctttgct

SEQ ID NO: 711245 - DNA, 13 bp, Homo sapiens
acttgtcatgtga

SEQ ID NO: 711246 - DNA, 18 bp, Homo sapiens
acttgtcccactatctgg

SEQ ID NO: 711247 - DNA, 15 bp, Homo sapiens
acttgtcctatgtca

SEQ ID NO: 711248 - DNA, 13 bp, Homo sapiens
acttgtcctcagc

SEQ ID NO: 711249 - DNA, 19 bp, Homo sapiens
acttgtcctcagcttgggc

SEQ ID NO: 711250 - DNA, 16 bp, Homo sapiens
acttgtcgggggccca

SEQ ID NO: 711251 - DNA, 16 bp, Homo sapiens
acttgtctcctttctg

SEQ ID NO: 711252 - DNA, 19 bp, Homo sapiens
acttgtctcctttctgact

SEQ ID NO: 711253 - DNA, 22 bp, Homo sapiens
acttgtctgaggcctcatccct

SEQ ID NO: 711254 - DNA, 19 bp, Homo sapiens
acttgtctgggaattgtgt

SEQ ID NO: 711255 - DNA, 20 bp, Homo sapiens
acttgtctgggaattgtgtg

SEQ ID NO: 711256 - DNA, 14 bp, Homo sapiens
acttgtcttgaaaa

SEQ ID NO: 711257 - DNA, 14 bp, Homo sapiens
acttgtctttactg

SEQ ID NO: 711258 - DNA, 21 bp, Homo sapiens
acttgtgaactccatcattca

SEQ ID NO: 711259 - DNA, 16 bp, Homo sapiens
acttgtgattatttat

SEQ ID NO: 711260 - DNA, 17 bp, Homo sapiens
acttgtgattatttatt

SEQ ID NO: 711261 - DNA, 20 bp, Homo sapiens
acttgtgattatttattatt

SEQ ID NO: 711262 - DNA, 16 bp, Homo sapiens
acttgtgcacttagta

SEQ ID NO: 711263 - DNA, 13 bp, Homo sapiens
acttgtgccagcc

SEQ ID NO: 711264 - DNA, 16 bp, Homo sapiens
acttgtgccagcccgg

SEQ ID NO: 711265 - DNA, 22 bp, Homo sapiens
acttgtgctgatcgtgctaaat

SEQ ID NO: 711266 - DNA, 23 bp, Homo sapiens
acttgtggtgtgaccatgttcat

SEQ ID NO: 711267 - DNA, 21 bp, Homo sapiens
acttgtgtactgataaaatac

SEQ ID NO: 711268 - DNA, 12 bp, Homo sapiens
acttgtgtatat

SEQ ID NO: 711269 - DNA, 23 bp, Homo sapiens
acttgtgtatattttaatgaata

SEQ ID NO: 711270 - DNA, 21 bp, Homo sapiens
acttgtgtctctgtgctttta

SEQ ID NO: 711271 - DNA, 22 bp, Homo sapiens
acttgtgtgtgggctgtgagtg

SEQ ID NO: 711272 - DNA, 21 bp, Homo sapiens
acttgtgtttgcttaaacaaa

SEQ ID NO: 711273 - DNA, 13 bp, Homo sapiens
acttgttattgtg

SEQ ID NO: 711274 - DNA, 15 bp, Homo sapiens
acttgttattgtgaa

SEQ ID NO: 711275 - DNA, 19 bp, Homo sapiens
acttgttattgtgaatgat

SEQ ID NO: 711276 - DNA, 20 bp, Homo sapiens
acttgttattgtgaatgatt

SEQ ID NO: 711277 - DNA, 12 bp, Homo sapiens
acttgttcattt

SEQ ID NO: 711278 - DNA, 14 bp, Homo sapiens
acttgttggtgtgg

SEQ ID NO: 711279 - DNA, 21 bp, Homo sapiens
acttgttgttttactaaagaa

SEQ ID NO: 711280 - DNA, 16 bp, Homo sapiens
acttgtttgaatattt

SEQ ID NO: 711281 - DNA, 18 bp, Homo sapiens
actttaaaactgtattta

SEQ ID NO: 711282 - DNA, 15 bp, Homo sapiens
actttaaaaggcaac

SEQ ID NO: 711283 - DNA, 18 bp, Homo sapiens
actttaaaaggcaactca

SEQ ID NO: 711284 - DNA, 20 bp, Homo sapiens
actttaaaaggcaactcaaa

SEQ ID NO: 711285 - DNA, 15 bp, Homo sapiens
actttaaaatgcgaa

SEQ ID NO: 711286 - DNA, 23 bp, Homo sapiens
actttaaaatgcgaaattattgg

SEQ ID NO: 711287 - DNA, 17 bp, Homo sapiens
actttaaacatctagca

SEQ ID NO: 711288 - DNA, 20 bp, Homo sapiens
actttaaagaggctgtgtgg

SEQ ID NO: 711289 - DNA, 21 bp, Homo sapiens
actttaaaggaaaaaatgttg

SEQ ID NO: 711290 - DNA, 15 bp, Homo sapiens
actttaagcactaca

SEQ ID NO: 711291 - DNA, 14 bp, Homo sapiens
actttaatttatgt

SEQ ID NO: 711292 - DNA, 19 bp, Homo sapiens
actttacaatgttcatccc

SEQ ID NO: 711293 - DNA, 14 bp, Homo sapiens
actttacaggaggt

SEQ ID NO: 711294 - DNA, 21 bp, Homo sapiens
actttacaggaggttgtggat

SEQ ID NO: 711295 - DNA, 23 bp, Homo sapiens
actttacaggaggttgtggatgc

SEQ ID NO: 711296 - DNA, 18 bp, Homo sapiens
actttaccataaagcctt

SEQ ID NO: 711297 - DNA, 13 bp, Homo sapiens
actttacccacct

SEQ ID NO: 711298 - DNA, 15 bp, Homo sapiens
actttacctctctgt

SEQ ID NO: 711299 - DNA, 19 bp, Homo sapiens
actttactctgtgtttaaa

SEQ ID NO: 711300 - DNA, 21 bp, Homo sapiens
actttacttgtggtgtgacca

SEQ ID NO: 711301 - DNA, 22 bp, Homo sapiens
actttacttgtggtgtgaccat

SEQ ID NO: 711302 - DNA, 14 bp, Homo sapiens
actttacttttgct

SEQ ID NO: 711303 - DNA, 17 bp, Homo sapiens
actttagaaagctgaca

SEQ ID NO: 711304 - DNA, 16 bp, Homo sapiens
actttagaagcctgca

SEQ ID NO: 711305 - DNA, 19 bp, Homo sapiens
actttagacttcccactgt

SEQ ID NO: 711306 - DNA, 15 bp, Homo sapiens
actttagagtagcat

SEQ ID NO: 711307 - DNA, 19 bp, Homo sapiens
actttagagtagcatgaga

SEQ ID NO: 711308 - DNA, 21 bp, Homo sapiens
actttagagtagcatgagaga

SEQ ID NO: 711309 - DNA, 22 bp, Homo sapiens
actttagatgttttgggatcag

SEQ ID NO: 711310 - DNA, 15 bp, Homo sapiens
actttagcatcagaa

SEQ ID NO: 711311 - DNA, 16 bp, Homo sapiens
actttagcttttcctt

SEQ ID NO: 711312 - DNA, 22 bp, Homo sapiens
actttagggctgtaaaatgcat

SEQ ID NO: 711313 - DNA, 18 bp, Homo sapiens
actttagtgaaacataat

SEQ ID NO: 711314 - DNA, 22 bp, Homo sapiens
actttataagtcattgtatgtt

SEQ ID NO: 711315 - DNA, 17 bp, Homo sapiens
actttatatcttgttta

SEQ ID NO: 711316 - DNA, 14 bp, Homo sapiens
actttatcaattaa

SEQ ID NO: 711317 - DNA, 14 bp, Homo sapiens
actttatcacatta

SEQ ID NO: 711318 - DNA, 17 bp, Homo sapiens
actttatctcctgctct

SEQ ID NO: 711319 - DNA, 14 bp, Homo sapiens
actttatgtactgc

SEQ ID NO: 711320 - DNA, 16 bp, Homo sapiens
actttatgttgtatga

SEQ ID NO: 711321 - DNA, 22 bp, Homo sapiens
actttatgttgtatgattccaa

SEQ ID NO: 711322 - DNA, 23 bp, Homo sapiens
actttatgttgtatgattccaat

SEQ ID NO: 711323 - DNA, 20 bp, Homo sapiens
actttattaaatacaaaact

SEQ ID NO: 711324 - DNA, 17 bp, Homo sapiens
actttattgacaagtga

SEQ ID NO: 711325 - DNA, 14 bp, Homo sapiens
actttattgcatat

SEQ ID NO: 711326 - DNA, 15 bp, Homo sapiens
actttattgcatata

SEQ ID NO: 711327 - DNA, 17 bp, Homo sapiens
actttattgcatataga

SEQ ID NO: 711328 - DNA, 13 bp, Homo sapiens
actttattgcatc

SEQ ID NO: 711329 - DNA, 13 bp, Homo sapiens
actttattgctat

SEQ ID NO: 711330 - DNA, 22 bp, Homo sapiens
actttattgctatcgccctcct

SEQ ID NO: 711331 - DNA, 16 bp, Homo sapiens
actttattgtacagac

SEQ ID NO: 711332 - DNA, 19 bp, Homo sapiens
actttatttaaatgcatgt

SEQ ID NO: 711333 - DNA, 20 bp, Homo sapiens
actttatttaaatgcatgtc

SEQ ID NO: 711334 - DNA, 21 bp, Homo sapiens
actttatttaaatgcatgtct

SEQ ID NO: 711335 - DNA, 22 bp, Homo sapiens
actttatttaaatgcatgtctt

SEQ ID NO: 711336 - DNA, 20 bp, Homo sapiens
actttattttatataataaa

SEQ ID NO: 711337 - DNA, 17 bp, Homo sapiens
actttattttgcttttc

SEQ ID NO: 711338 - DNA, 19 bp, Homo sapiens
actttatttttctaagtgt

SEQ ID NO: 711339 - DNA, 17 bp, Homo sapiens
actttatttttctgata

SEQ ID NO: 711340 - DNA, 14 bp, Homo sapiens
actttatttttgta

SEQ ID NO: 711341 - DNA, 20 bp, Homo sapiens
actttcaaaatatattttgt

SEQ ID NO: 711342 - DNA, 21 bp, Homo sapiens
actttcacatagatgtccctt

SEQ ID NO: 711343 - DNA, 18 bp, Homo sapiens
actttcacgtggcctccg

SEQ ID NO: 711344 - DNA, 19 bp, Homo sapiens
actttcagaagtgccactt

SEQ ID NO: 711345 - DNA, 21 bp, Homo sapiens
actttcagagcccccagccct

SEQ ID NO: 711346 - DNA, 23 bp, Homo sapiens
actttcagagcccccagccctgg

SEQ ID NO: 711347 - DNA, 15 bp, Homo sapiens
actttcatcttaaac

SEQ ID NO: 711348 - DNA, 24 bp, Homo sapiens
actttcatcttaaactaatacgtg

SEQ ID NO: 711349 - DNA, 15 bp, Homo sapiens
actttcattccttca

SEQ ID NO: 711350 - DNA, 11 bp, Homo sapiens
actttccaaat

SEQ ID NO: 711351 - DNA, 16 bp, Homo sapiens
actttccaccccctcc

SEQ ID NO: 711352 - DNA, 18 bp, Homo sapiens
actttcccccttcccgcc

SEQ ID NO: 711353 - DNA, 19 bp, Homo sapiens
actttccctagaaagccat

SEQ ID NO: 711354 - DNA, 21 bp, Homo sapiens
actttcctattttcttttcca

SEQ ID NO: 711355 - DNA, 17 bp, Homo sapiens
actttccttctctgtaa

SEQ ID NO: 711356 - DNA, 14 bp, Homo sapiens
actttctcaatgct

SEQ ID NO: 711357 - DNA, 13 bp, Homo sapiens
actttctcagttt

SEQ ID NO: 711358 - DNA, 18 bp, Homo sapiens
actttctcagttttcata

SEQ ID NO: 711359 - DNA, 21 bp, Homo sapiens
actttctccatttaagacaca

SEQ ID NO: 711360 - DNA, 19 bp, Homo sapiens
actttctctaataataaat

SEQ ID NO: 711361 - DNA, 21 bp, Homo sapiens
actttctctaataataaatag

SEQ ID NO: 711362 - DNA, 19 bp, Homo sapiens
actttctgtaaactcaaaa

SEQ ID NO: 711363 - DNA, 15 bp, Homo sapiens
actttctgttttctg

SEQ ID NO: 711364 - DNA, 16 bp, Homo sapiens
actttctttagtcttt

SEQ ID NO: 711365 - DNA, 22 bp, Homo sapiens
actttctttctcactaaatctt

SEQ ID NO: 711366 - DNA, 15 bp, Homo sapiens
actttcttttctgga

SEQ ID NO: 711367 - DNA, 13 bp, Homo sapiens
actttgaaaactg

SEQ ID NO: 711368 - DNA, 16 bp, Homo sapiens
actttgaaaagttgga

SEQ ID NO: 711369 - DNA, 17 bp, Homo sapiens
actttgaaaatatttct

SEQ ID NO: 711370 - DNA, 22 bp, Homo sapiens
actttgacacttttcatatcat

SEQ ID NO: 711371 - DNA, 22 bp, Homo sapiens
actttgacctaaattatttact

SEQ ID NO: 711372 - DNA, 15 bp, Homo sapiens
actttgacctctgca

SEQ ID NO: 711373 - DNA, 23 bp, Homo sapiens
actttgacctctgcagcaataaa

SEQ ID NO: 711374 - DNA, 20 bp, Homo sapiens
actttgagcatttttaaggg

SEQ ID NO: 711375 - DNA, 16 bp, Homo sapiens
actttgatccttggaa

SEQ ID NO: 711376 - DNA, 14 bp, Homo sapiens
actttgcaaattat

SEQ ID NO: 711377 - DNA, 21 bp, Homo sapiens
actttgcaaattatttattac

SEQ ID NO: 711378 - DNA, 19 bp, Homo sapiens
actttgcacgacgccctct

SEQ ID NO: 711379 - DNA, 19 bp, Homo sapiens
actttgcactgatatatca

SEQ ID NO: 711380 - DNA, 23 bp, Homo sapiens
actttgcagccggcacagggtct

SEQ ID NO: 711381 - DNA, 17 bp, Homo sapiens
actttgcaggcggccct

SEQ ID NO: 711382 - DNA, 13 bp, Homo sapiens
actttgcattgtc

SEQ ID NO: 711383 - DNA, 22 bp, Homo sapiens
actttgccaaggctctcccctc

SEQ ID NO: 711384 - DNA, 23 bp, Homo sapiens
actttgccagcttttcctccctt

SEQ ID NO: 711385 - DNA, 23 bp, Homo sapiens
actttgcccccttgcccatcagc

SEQ ID NO: 711386 - DNA, 15 bp, Homo sapiens
actttgcctcaagac

SEQ ID NO: 711387 - DNA, 13 bp, Homo sapiens
actttgctcctca

SEQ ID NO: 711388 - DNA, 14 bp, Homo sapiens
actttgctctgggt

SEQ ID NO: 711389 - DNA, 15 bp, Homo sapiens
actttgctgcatttt

SEQ ID NO: 711390 - DNA, 19 bp, Homo sapiens
actttgctgcattttacac

SEQ ID NO: 711391 - DNA, 15 bp, Homo sapiens
actttgctgttactg

SEQ ID NO: 711392 - DNA, 13 bp, Homo sapiens
actttgcttcata

SEQ ID NO: 711393 - DNA, 20 bp, Homo sapiens
actttgcttcatagtattgg

SEQ ID NO: 711394 - DNA, 13 bp, Homo sapiens
actttgcttgctt

SEQ ID NO: 711395 - DNA, 16 bp, Homo sapiens
actttggaaccagact

SEQ ID NO: 711396 - DNA, 21 bp, Homo sapiens
actttggaaccagactcttgc

SEQ ID NO: 711397 - DNA, 13 bp, Homo sapiens
actctattcttta

SEQ ID NO: 711398 - DNA, 12 bp, Homo sapiens
actctattttaa

SEQ ID NO: 711399 - DNA, 15 bp, Homo sapiens
actctattttaatgt

SEQ ID NO: 711400 - DNA, 12 bp, Homo sapiens
actctcaagcta

SEQ ID NO: 711401 - DNA, 21 bp, Homo sapiens
actctcacactggttctcaat

SEQ ID NO: 711402 - DNA, 16 bp, Homo sapiens
actctcacatgtggca

SEQ ID NO: 711403 - DNA, 21 bp, Homo sapiens
actctcaccatgatgtgaaga

SEQ ID NO: 711404 - DNA, 22 bp, Homo sapiens
actctcaccatgatgtgaagag

SEQ ID NO: 711405 - DNA, 20 bp, Homo sapiens
actctcaccccaagcggcct

SEQ ID NO: 711406 - DNA, 22 bp, Homo sapiens
actctcacctgtactattgcag

SEQ ID NO: 711407 - DNA, 14 bp, Homo sapiens
actctcactcctga

SEQ ID NO: 711408 - DNA, 19 bp, Homo sapiens
actctcaggatcaagaaag

SEQ ID NO: 711409 - DNA, 16 bp, Homo sapiens
actctcagtctctgag

SEQ ID NO: 711410 - DNA, 17 bp, Homo sapiens
actctcagtctctgagc

SEQ ID NO: 711411 - DNA, 15 bp, Homo sapiens
actctcagtgcttct

SEQ ID NO: 711412 - DNA, 22 bp, Homo sapiens
actctcagtgcttcttactatt

SEQ ID NO: 711413 - DNA, 18 bp, Homo sapiens
actctcatcaccccagag

SEQ ID NO: 711414 - DNA, 17 bp, Homo sapiens
actctcattccccaggt

SEQ ID NO: 711415 - DNA, 13 bp, Homo sapiens
actctcattcttt

SEQ ID NO: 711416 - DNA, 13 bp, Homo sapiens
actctccatatcc

SEQ ID NO: 711417 - DNA, 17 bp, Homo sapiens
actctccatcagatgtg

SEQ ID NO: 711418 - DNA, 20 bp, Homo sapiens
actctcccaggcctgcctgc

SEQ ID NO: 711419 - DNA, 21 bp, Homo sapiens
actctcccaggcctgcctgca

SEQ ID NO: 711420 - DNA, 11 bp, Homo sapiens
actctccccac

SEQ ID NO: 711421 - DNA, 12 bp, Homo sapiens
actctccccaca

SEQ ID NO: 711422 - DNA, 12 bp, Homo sapiens
actctccccagt

SEQ ID NO: 711423 - DNA, 14 bp, Homo sapiens
actctccccagtgc

SEQ ID NO: 711424 - DNA, 11 bp, Homo sapiens
actctcccctc

SEQ ID NO: 711425 - DNA, 19 bp, Homo sapiens
actctcccctgaatcctca

SEQ ID NO: 711426 - DNA, 12 bp, Homo sapiens
actctcctagag

SEQ ID NO: 711427 - DNA, 23 bp, Homo sapiens
actctcctagagacagaagcagg

SEQ ID NO: 711428 - DNA, 16 bp, Homo sapiens
actctcctcctcccct

SEQ ID NO: 711429 - DNA, 20 bp, Homo sapiens
actctcctcctcccctcctc

SEQ ID NO: 711430 - DNA, 19 bp, Homo sapiens
actctcctcggccccctcc

SEQ ID NO: 711431 - DNA, 23 bp, Homo sapiens
actctcctgcctcagcctcccca

SEQ ID NO: 711432 - DNA, 17 bp, Homo sapiens
actctcggggcccttgg

SEQ ID NO: 711433 - DNA, 22 bp, Homo sapiens
actctcggggcccttggggcct

SEQ ID NO: 711434 - DNA, 20 bp, Homo sapiens
actctctcacccaccagctc

SEQ ID NO: 711435 - DNA, 21 bp, Homo sapiens
actctctccctggtctctgcc

SEQ ID NO: 711436 - DNA, 21 bp, Homo sapiens
actctctgaacccctccctcc

SEQ ID NO: 711437 - DNA, 13 bp, Homo sapiens
actctctgagctg

SEQ ID NO: 711438 - DNA, 15 bp, Homo sapiens
actctctgcagccca

SEQ ID NO: 711439 - DNA, 20 bp, Homo sapiens
actctctgctctagccagga

SEQ ID NO: 711440 - DNA, 23 bp, Homo sapiens
actctctgctctagccaggagtc

SEQ ID NO: 711441 - DNA, 20 bp, Homo sapiens
actctctgtcttctctccac

SEQ ID NO: 711442 - DNA, 15 bp, Homo sapiens
actctgaaaaacatt

SEQ ID NO: 711443 - DNA, 23 bp, Homo sapiens
actctgaaaagcaattgccctgt

SEQ ID NO: 711444 - DNA, 9 bp, Homo sapiens
actctgaac

SEQ ID NO: 711445 - DNA, 11 bp, Homo sapiens
actctgagccc

SEQ ID NO: 711446 - DNA, 15 bp, Homo sapiens
actctgagcccaggc

SEQ ID NO: 711447 - DNA, 13 bp, Homo sapiens
actctgagcccat

SEQ ID NO: 711448 - DNA, 21 bp, Homo sapiens
actctgaggctctttctgggc

SEQ ID NO: 711449 - DNA, 22 bp, Homo sapiens
actctgagtaactggttgctgt

SEQ ID NO: 711450 - DNA, 19 bp, Homo sapiens
actctgagtcacaggtgtg

SEQ ID NO: 711451 - DNA, 22 bp, Homo sapiens
actctgagtcacaggtgtggga

SEQ ID NO: 711452 - DNA, 16 bp, Homo sapiens
actctgagtccactgc

SEQ ID NO: 711453 - DNA, 18 bp, Homo sapiens
actctgagtccactgctc

SEQ ID NO: 711454 - DNA, 20 bp, Homo sapiens
accccagttctgctcctctc

SEQ ID NO: 711455 - DNA, 21 bp, Homo sapiens
accccagttctgctcctctcc

SEQ ID NO: 711456 - DNA, 22 bp, Homo sapiens
accccagttctgctcctctcca

SEQ ID NO: 711457 - DNA, 20 bp, Homo sapiens
accccataataaccctgcca

SEQ ID NO: 711458 - DNA, 21 bp, Homo sapiens
accccataataaccctgccag

SEQ ID NO: 711459 - DNA, 16 bp, Homo sapiens
accccatcactcgcag

SEQ ID NO: 711460 - DNA, 20 bp, Homo sapiens
accccatcactcgcaggacc

SEQ ID NO: 711461 - DNA, 22 bp, Homo sapiens
accccatcctccctcccccagc

SEQ ID NO: 711462 - DNA, 18 bp, Homo sapiens
accccatctctacaaaaa

SEQ ID NO: 711463 - DNA, 15 bp, Homo sapiens
accccatctgtgaat

SEQ ID NO: 711464 - DNA, 15 bp, Homo sapiens
accccatgagctcgg

SEQ ID NO: 711465 - DNA, 16 bp, Homo sapiens
accccatgccaaagct

SEQ ID NO: 711466 - DNA, 19 bp, Homo sapiens
accccatggagctgggcta

SEQ ID NO: 711467 - DNA, 13 bp, Homo sapiens
accccatgggctt

SEQ ID NO: 711468 - DNA, 17 bp, Homo sapiens
accccatgggcttggac

SEQ ID NO: 711469 - DNA, 16 bp, Homo sapiens
accccatgtgccttta

SEQ ID NO: 711470 - DNA, 15 bp, Homo sapiens
acccccaaacacaaa

SEQ ID NO: 711471 - DNA, 17 bp, Homo sapiens
acccccaacttcaccac

SEQ ID NO: 711472 - DNA, 14 bp, Homo sapiens
acccccaagcctgg

SEQ ID NO: 711473 - DNA, 15 bp, Homo sapiens
acccccaagcctggg

SEQ ID NO: 711474 - DNA, 15 bp, Homo sapiens
acccccaataaacct

SEQ ID NO: 711475 - DNA, 22 bp, Homo sapiens
acccccacagacctgctctgga

SEQ ID NO: 711476 - DNA, 17 bp, Homo sapiens
acccccacccacctcca

SEQ ID NO: 711477 - DNA, 18 bp, Homo sapiens
acccccacccacctccac

SEQ ID NO: 711478 - DNA, 17 bp, Homo sapiens
acccccactctcattcc

SEQ ID NO: 711479 - DNA, 21 bp, Homo sapiens
acccccactctcattccccag

SEQ ID NO: 711480 - DNA, 18 bp, Homo sapiens
acccccagaggtggccct

SEQ ID NO: 711481 - DNA, 19 bp, Homo sapiens
acccccagaggtggccctt

SEQ ID NO: 711482 - DNA, 16 bp, Homo sapiens
acccccagccaggcta

SEQ ID NO: 711483 - DNA, 16 bp, Homo sapiens
acccccagcccacaga

SEQ ID NO: 711484 - DNA, 22 bp, Homo sapiens
acccccagccccgactccagcc

SEQ ID NO: 711485 - DNA, 16 bp, Homo sapiens
acccccagctttgcta

SEQ ID NO: 711486 - DNA, 14 bp, Homo sapiens
acccccaggcctcc

SEQ ID NO: 711487 - DNA, 16 bp, Homo sapiens
acccccaggcctccta

SEQ ID NO: 711488 - DNA, 21 bp, Homo sapiens
acccccaggcctcctagggga

SEQ ID NO: 711489 - DNA, 13 bp, Homo sapiens
acccccaggtgca

SEQ ID NO: 711490 - DNA, 16 bp, Homo sapiens
acccccagtcctcact

SEQ ID NO: 711491 - DNA, 21 bp, Homo sapiens
acccccagtcctcactgtcct

SEQ ID NO: 711492 - DNA, 17 bp, Homo sapiens
acccccagtctccaggg

SEQ ID NO: 711493 - DNA, 20 bp, Homo sapiens
acccccagttcctatgacac

SEQ ID NO: 711494 - DNA, 17 bp, Homo sapiens
acccccatctctccctc

SEQ ID NO: 711495 - DNA, 15 bp, Homo sapiens
acccccatctgagct

SEQ ID NO: 711496 - DNA, 19 bp, Homo sapiens
acccccatcttccacctgt

SEQ ID NO: 711497 - DNA, 21 bp, Homo sapiens
acccccatcttccacctgtgc

SEQ ID NO: 711498 - DNA, 19 bp, Homo sapiens
acccccatgctgccttcag

SEQ ID NO: 711499 - DNA, 19 bp, Homo sapiens
acccccatgtggcagccca

SEQ ID NO: 711500 - DNA, 16 bp, Homo sapiens
acccccattctcatct

SEQ ID NO: 711501 - DNA, 17 bp, Homo sapiens
acccccatttctattta

SEQ ID NO: 711502 - DNA, 16 bp, Homo sapiens
acagtgcttgcatcct

SEQ ID NO: 711503 - DNA, 17 bp, Homo sapiens
acagtgctttgtaaatt

SEQ ID NO: 711504 - DNA, 21 bp, Homo sapiens
acagtgcttttaagtgaaaat

SEQ ID NO: 711505 - DNA, 18 bp, Homo sapiens
acagtggaactacattag

SEQ ID NO: 711506 - DNA, 19 bp, Homo sapiens
acagtggctgggtgggccc

SEQ ID NO: 711507 - DNA, 15 bp, Homo sapiens
acagtgggaaatatt

SEQ ID NO: 711508 - DNA, 14 bp, Homo sapiens
acagtgggagctga

SEQ ID NO: 711509 - DNA, 18 bp, Homo sapiens
acagtgggagctgagctg

SEQ ID NO: 711510 - DNA, 20 bp, Homo sapiens
acagtgggagctgagctgga

SEQ ID NO: 711511 - DNA, 23 bp, Homo sapiens
acagtgggagctgagctggaagg

SEQ ID NO: 711512 - DNA, 21 bp, Homo sapiens
acagtggggctgcaggcaggc

SEQ ID NO: 711513 - DNA, 21 bp, Homo sapiens
acagtgggtggcacctcctga

SEQ ID NO: 711514 - DNA, 21 bp, Homo sapiens
acagtggtggcaacattcatt

SEQ ID NO: 711515 - DNA, 23 bp, Homo sapiens
acagtggtggcaacattcattgc

SEQ ID NO: 711516 - DNA, 20 bp, Homo sapiens
acagtggttcgtttaccaaa

SEQ ID NO: 711517 - DNA, 19 bp, Homo sapiens
acagtgtaatccaggggtg

SEQ ID NO: 711518 - DNA, 18 bp, Homo sapiens
acagtgtatattgaaatt

SEQ ID NO: 711519 - DNA, 23 bp, Homo sapiens
acagtgtctgtatcggagacagt

SEQ ID NO: 711520 - DNA, 15 bp, Homo sapiens
acagtgtctgttcag

SEQ ID NO: 711521 - DNA, 18 bp, Homo sapiens
acagtgtctgttcagcaa

SEQ ID NO: 711522 - DNA, 17 bp, Homo sapiens
acagtgtctttctagcc

SEQ ID NO: 711523 - DNA, 14 bp, Homo sapiens
acagtgtgtgaact

SEQ ID NO: 711524 - DNA, 14 bp, Homo sapiens
acagtgtgttggtg

SEQ ID NO: 711525 - DNA, 21 bp, Homo sapiens
acagtgttagtgctggtcaga

SEQ ID NO: 711526 - DNA, 22 bp, Homo sapiens
acagtgttattttctttgaaat

SEQ ID NO: 711527 - DNA, 21 bp, Homo sapiens
acagtgttcatttgaaagagg

SEQ ID NO: 711528 - DNA, 16 bp, Homo sapiens
acagtgttgtgcccct

SEQ ID NO: 711529 - DNA, 21 bp, Homo sapiens
acagtgttgtgccccttcact

SEQ ID NO: 711530 - DNA, 12 bp, Homo sapiens
acagtgtttcaa

SEQ ID NO: 711531 - DNA, 18 bp, Homo sapiens
acagtgtttcccataatt

SEQ ID NO: 711532 - DNA, 23 bp, Homo sapiens
acagtgtttcccataattttctt

SEQ ID NO: 711533 - DNA, 19 bp, Homo sapiens
acagtgtttcgacagctga

SEQ ID NO: 711534 - DNA, 21 bp, Homo sapiens
acagttactatagtggtgaga

SEQ ID NO: 711535 - DNA, 22 bp, Homo sapiens
acagttagggttgagttacttc

SEQ ID NO: 711536 - DNA, 18 bp, Homo sapiens
acagttagggttttgcaa

SEQ ID NO: 711537 - DNA, 21 bp, Homo sapiens
acagttagggttttgcaataa

SEQ ID NO: 711538 - DNA, 14 bp, Homo sapiens
acagttatattttt

SEQ ID NO: 711539 - DNA, 22 bp, Homo sapiens
acagttatatttttgtgttttc

SEQ ID NO: 711540 - DNA, 17 bp, Homo sapiens
acagttatctaagttaa

SEQ ID NO: 711541 - DNA, 23 bp, Homo sapiens
acagttatctaagttaatttaaa

SEQ ID NO: 711542 - DNA, 15 bp, Homo sapiens
acagttattttgata

SEQ ID NO: 711543 - DNA, 12 bp, Homo sapiens
acagttcaagaa

SEQ ID NO: 711544 - DNA, 12 bp, Homo sapiens
acagttcataat

SEQ ID NO: 711545 - DNA, 15 bp, Homo sapiens
acagttcctcgccct

SEQ ID NO: 711546 - DNA, 19 bp, Homo sapiens
acagttcctcgccctgggt

SEQ ID NO: 711547 - DNA, 13 bp, Homo sapiens
acagttcctggga

SEQ ID NO: 711548 - DNA, 15 bp, Homo sapiens
acagttctcactggg

SEQ ID NO: 711549 - DNA, 13 bp, Homo sapiens
acagttctgaaga

SEQ ID NO: 711550 - DNA, 16 bp, Homo sapiens
acagttctgctctggt

SEQ ID NO: 711551 - DNA, 12 bp, Homo sapiens
acagttctgtaa

SEQ ID NO: 711552 - DNA, 13 bp, Homo sapiens
acagttctttcct

SEQ ID NO: 711553 - DNA, 17 bp, Homo sapiens
acagttgaaaacttgta

SEQ ID NO: 711554 - DNA, 22 bp, Homo sapiens
acagttgaagggaggggctgtg

SEQ ID NO: 711555 - DNA, 13 bp, Homo sapiens
acagttgatgttt

SEQ ID NO: 711556 - DNA, 13 bp, Homo sapiens
acagttgcatgta

SEQ ID NO: 711557 - DNA, 23 bp, Homo sapiens
acagttgctgtgaactttcatgt

SEQ ID NO: 711558 - DNA, 13 bp, Homo sapiens
acagttggcagag

SEQ ID NO: 711559 - DNA, 21 bp, Homo sapiens
acagttggcagagaaggcctc

SEQ ID NO: 711560 - DNA, 12 bp, Homo sapiens
acagttgtattt

SEQ ID NO: 711561 - DNA, 13 bp, Homo sapiens
acagttgtattta

SEQ ID NO: 711562 - DNA, 20 bp, Homo sapiens
acagttgtctattctgagcc

SEQ ID NO: 711563 - DNA, 22 bp, Homo sapiens
acagttgtctattctgagcctt

SEQ ID NO: 711564 - DNA, 11 bp, Homo sapiens
acagttgtttg

SEQ ID NO: 711565 - DNA, 13 bp, Homo sapiens
acagttgtttgat

SEQ ID NO: 711566 - DNA, 15 bp, Homo sapiens
acagttgtttgatgc

SEQ ID NO: 711567 - DNA, 14 bp, Homo sapiens
acagtttaaaaaat

SEQ ID NO: 711568 - DNA, 19 bp, Homo sapiens
acagtttaccagttgcctt

SEQ ID NO: 711569 - DNA, 19 bp, Homo sapiens
acagtttatattgtggaat

SEQ ID NO: 711570 - DNA, 15 bp, Homo sapiens
acagtttatcctgtc

SEQ ID NO: 711571 - DNA, 14 bp, Homo sapiens
acagtttgcctgct

SEQ ID NO: 711572 - DNA, 15 bp, Homo sapiens
acagtttgcctgctg

SEQ ID NO: 711573 - DNA, 12 bp, Homo sapiens
acagtttgtgtt

SEQ ID NO: 711574 - DNA, 14 bp, Homo sapiens
acagtttgtgtttt

SEQ ID NO: 711575 - DNA, 17 bp, Homo sapiens
acagtttgtgttttaaa

SEQ ID NO: 711576 - DNA, 19 bp, Homo sapiens
acagtttgtgttttaaaaa

SEQ ID NO: 711577 - DNA, 20 bp, Homo sapiens
acagtttgtgttttaaaaaa

SEQ ID NO: 711578 - DNA, 23 bp, Homo sapiens
acagtttgtgttttaaaaaaact

SEQ ID NO: 711579 - DNA, 16 bp, Homo sapiens
acagtttgttagtatg

SEQ ID NO: 711580 - DNA, 17 bp, Homo sapiens
acagttttaactgtgga

SEQ ID NO: 711581 - DNA, 19 bp, Homo sapiens
acagttttaataagaacag

SEQ ID NO: 711582 - DNA, 14 bp, Homo sapiens
acagttttcaccat

SEQ ID NO: 711583 - DNA, 12 bp, Homo sapiens
acagttttccat

SEQ ID NO: 711584 - DNA, 19 bp, Homo sapiens
acagttttccatgaaaacg

SEQ ID NO: 711585 - DNA, 21 bp, Homo sapiens
acagttttccatgaaaacgtt

SEQ ID NO: 711586 - DNA, 14 bp, Homo sapiens
acagttttccttct

SEQ ID NO: 711587 - DNA, 15 bp, Homo sapiens
acagtttttattgct

SEQ ID NO: 711588 - DNA, 13 bp, Homo sapiens
acataaaaaccaa

SEQ ID NO: 711589 - DNA, 20 bp, Homo sapiens
acataaaaagcagaatttta

SEQ ID NO: 711590 - DNA, 21 bp, Homo sapiens
acataaaaagcagaattttaa

SEQ ID NO: 711591 - DNA, 23 bp, Homo sapiens
acataaaaagcagaattttaatg

SEQ ID NO: 711592 - DNA, 15 bp, Homo sapiens
acataaaaaggacat

SEQ ID NO: 711593 - DNA, 20 bp, Homo sapiens
acataaaaaggacatcagca

SEQ ID NO: 711594 - DNA, 18 bp, Homo sapiens
acataaaacaaaaccaag

SEQ ID NO: 711595 - DNA, 13 bp, Homo sapiens
acataaaacttta

SEQ ID NO: 711596 - DNA, 17 bp, Homo sapiens
acataaaactttaaaag

SEQ ID NO: 711597 - DNA, 18 bp, Homo sapiens
acataaaactttaaaagg

SEQ ID NO: 711598 - DNA, 14 bp, Homo sapiens
acataaaagaaata

SEQ ID NO: 711599 - DNA, 14 bp, Homo sapiens
acataaaagaattt

SEQ ID NO: 711600 - DNA, 21 bp, Homo sapiens
acataaaccatttttgttact

SEQ ID NO: 711601 - DNA, 21 bp, Homo sapiens
acataaagccttttgctttat

SEQ ID NO: 711602 - DNA, 15 bp, Homo sapiens
acataaagctccctt

SEQ ID NO: 711603 - DNA, 13 bp, Homo sapiens
acataaattagag

SEQ ID NO: 711604 - DNA, 18 bp, Homo sapiens
acataacaacaacagtta

SEQ ID NO: 711605 - DNA, 12 bp, Homo sapiens
acataactgaaa

SEQ ID NO: 711606 - DNA, 15 bp, Homo sapiens
acataactgcttctt

SEQ ID NO: 711607 - DNA, 18 bp, Homo sapiens
acataactgcttcttgga

SEQ ID NO: 711608 - DNA, 14 bp, Homo sapiens
acataactggattt

SEQ ID NO: 711609 - DNA, 16 bp, Homo sapiens
acataagaaggcaatt

SEQ ID NO: 711610 - DNA, 17 bp, Homo sapiens
acataagaaggcaattt

SEQ ID NO: 711611 - DNA, 21 bp, Homo sapiens
acataagaaggcaattttagt

SEQ ID NO: 711612 - DNA, 17 bp, Homo sapiens
acataagagagatgaga

SEQ ID NO: 711613 - DNA, 16 bp, Homo sapiens
acataagcaatcattt

SEQ ID NO: 711614 - DNA, 22 bp, Homo sapiens
acataagcggcgtaagtttaaa

SEQ ID NO: 711615 - DNA, 17 bp, Homo sapiens
acataagtaacttttaa

SEQ ID NO: 711616 - DNA, 18 bp, Homo sapiens
acataagtaacttttaaa

SEQ ID NO: 711617 - DNA, 21 bp, Homo sapiens
acataagtccattaactgctt

SEQ ID NO: 711618 - DNA, 17 bp, Homo sapiens
acataataaaaaattat

SEQ ID NO: 711619 - DNA, 22 bp, Homo sapiens
acataatgcgtgcataccactt

SEQ ID NO: 711620 - DNA, 18 bp, Homo sapiens
acataatggttgtgaaat

SEQ ID NO: 711621 - DNA, 21 bp, Homo sapiens
acataatggttgtgaaatgta

SEQ ID NO: 711622 - DNA, 15 bp, Homo sapiens
acataattgattaaa

SEQ ID NO: 711623 - DNA, 21 bp, Homo sapiens
acataattgattaaaatctct

SEQ ID NO: 711624 - DNA, 15 bp, Homo sapiens
acataattgtggatt

SEQ ID NO: 711625 - DNA, 18 bp, Homo sapiens
acataatttagttgtttc

SEQ ID NO: 711626 - DNA, 19 bp, Homo sapiens
acataatttagttgtttct

SEQ ID NO: 711627 - DNA, 21 bp, Homo sapiens
acaggatggtgggcaggatct

SEQ ID NO: 711628 - DNA, 21 bp, Homo sapiens
acaggcaaaccaatacagaat

SEQ ID NO: 711629 - DNA, 21 bp, Homo sapiens
acaggcaccgagaatgttgta

SEQ ID NO: 711630 - DNA, 20 bp, Homo sapiens
acaggcactgaacaggctgg

SEQ ID NO: 711631 - DNA, 17 bp, Homo sapiens
acaggcagcccagcagt

SEQ ID NO: 711632 - DNA, 22 bp, Homo sapiens
acaggcagcgatggtctcagaa

SEQ ID NO: 711633 - DNA, 20 bp, Homo sapiens
acaggcaggccagatggccc

SEQ ID NO: 711634 - DNA, 22 bp, Homo sapiens
acaggcaggccagatggcccct

SEQ ID NO: 711635 - DNA, 15 bp, Homo sapiens
acaggcaggggccca

SEQ ID NO: 711636 - DNA, 20 bp, Homo sapiens
acaggcaggggtgagagcac

SEQ ID NO: 711637 - DNA, 23 bp, Homo sapiens
acaggcagttaggtgctgaatga

SEQ ID NO: 711638 - DNA, 17 bp, Homo sapiens
acaggcatgagccactg

SEQ ID NO: 711639 - DNA, 22 bp, Homo sapiens
acaggcatgaggaatctgggag

SEQ ID NO: 711640 - DNA, 19 bp, Homo sapiens
acaggcatgtgtcaccatg

SEQ ID NO: 711641 - DNA, 18 bp, Homo sapiens
acaggcatttgttcactg

SEQ ID NO: 711642 - DNA, 18 bp, Homo sapiens
acaggccatgtgagccac

SEQ ID NO: 711643 - DNA, 19 bp, Homo sapiens
acaggccattgtgaaccaa

SEQ ID NO: 711644 - DNA, 22 bp, Homo sapiens
acaggcccaagagatgaagagt

SEQ ID NO: 711645 - DNA, 15 bp, Homo sapiens
acaggcccagcattg

SEQ ID NO: 711646 - DNA, 20 bp, Homo sapiens
acaggcccagcattgctggt

SEQ ID NO: 711647 - DNA, 12 bp, Homo sapiens
acaggccccacg

SEQ ID NO: 711648 - DNA, 15 bp, Homo sapiens
acaggccccacgccc

SEQ ID NO: 711649 - DNA, 23 bp, Homo sapiens
acaggccccacgccctctcctcc

SEQ ID NO: 711650 - DNA, 20 bp, Homo sapiens
acaggcccgccctctgcctc

SEQ ID NO: 711651 - DNA, 22 bp, Homo sapiens
acaggcccggcgcggtggctca

SEQ ID NO: 711652 - DNA, 13 bp, Homo sapiens
acaggccctctgt

SEQ ID NO: 711653 - DNA, 15 bp, Homo sapiens
acaggccctctgtgg

SEQ ID NO: 711654 - DNA, 19 bp, Homo sapiens
acaggccctctgtggcctg

SEQ ID NO: 711655 - DNA, 14 bp, Homo sapiens
acaggccctgctcc

SEQ ID NO: 711656 - DNA, 20 bp, Homo sapiens
acaggccctggagaagcagc

SEQ ID NO: 711657 - DNA, 13 bp, Homo sapiens
acaggcccttcct

SEQ ID NO: 711658 - DNA, 22 bp, Homo sapiens
acaggcccttcctctccactgc

SEQ ID NO: 711659 - DNA, 14 bp, Homo sapiens
acaggcctcacctc

SEQ ID NO: 711660 - DNA, 11 bp, Homo sapiens
acaggccttct

SEQ ID NO: 711661 - DNA, 15 bp, Homo sapiens
acaggcgtgagccac

SEQ ID NO: 711662 - DNA, 17 bp, Homo sapiens
acaggctcgtcagccac

SEQ ID NO: 711663 - DNA, 23 bp, Homo sapiens
acaggctcgtcagccacctggga

SEQ ID NO: 711664 - DNA, 13 bp, Homo sapiens
acaggctcttagc

SEQ ID NO: 711665 - DNA, 14 bp, Homo sapiens
acaggctgaagaga

SEQ ID NO: 711666 - DNA, 17 bp, Homo sapiens
acaggctgatttggagt

SEQ ID NO: 711667 - DNA, 14 bp, Homo sapiens
acaggctggcgggg

SEQ ID NO: 711668 - DNA, 16 bp, Homo sapiens
acaggcttagggacag

SEQ ID NO: 711669 - DNA, 17 bp, Homo sapiens
acagggaaacctttttt

SEQ ID NO: 711670 - DNA, 22 bp, Homo sapiens
acagggaaccctgcttgcactt

SEQ ID NO: 711671 - DNA, 22 bp, Homo sapiens
acagggaatgctgaggcctcga

SEQ ID NO: 711672 - DNA, 16 bp, Homo sapiens
acagggacttgaagtt

SEQ ID NO: 711673 - DNA, 18 bp, Homo sapiens
acagggagaagtagctag

SEQ ID NO: 711674 - DNA, 12 bp, Homo sapiens
acagggaggggg

SEQ ID NO: 711675 - DNA, 21 bp, Homo sapiens
acagggatggcgaggcctctc

SEQ ID NO: 711676 - DNA, 15 bp, Homo sapiens
acagggattctcaca

SEQ ID NO: 711677 - DNA, 16 bp, Homo sapiens
acagggattctcacaa

SEQ ID NO: 711678 - DNA, 12 bp, Homo sapiens
acagggcactga

SEQ ID NO: 711679 - DNA, 20 bp, Homo sapiens
acagggcagagcaggaagga

SEQ ID NO: 711680 - DNA, 16 bp, Homo sapiens
acagggcagagccggg

SEQ ID NO: 711681 - DNA, 14 bp, Homo sapiens
acagggcaggcctt

SEQ ID NO: 711682 - DNA, 22 bp, Homo sapiens
acagggcagtccttactccccc

SEQ ID NO: 711683 - DNA, 17 bp, Homo sapiens
acagggccagtgcagtt

SEQ ID NO: 711684 - DNA, 19 bp, Homo sapiens
acagggccagtggggcctg

SEQ ID NO: 711685 - DNA, 21 bp, Homo sapiens
acagggcccaggaatctgtgt

SEQ ID NO: 711686 - DNA, 15 bp, Homo sapiens
acagggcccaggcct

SEQ ID NO: 711687 - DNA, 16 bp, Homo sapiens
acagggcccaggcctg

SEQ ID NO: 711688 - DNA, 20 bp, Homo sapiens
acagggcccaggcctggagc

SEQ ID NO: 711689 - DNA, 14 bp, Homo sapiens
acagggcggggggg

SEQ ID NO: 711690 - DNA, 21 bp, Homo sapiens
acagggcgggggggggggcgg

SEQ ID NO: 711691 - DNA, 16 bp, Homo sapiens
acagggctcacagggc

SEQ ID NO: 711692 - DNA, 19 bp, Homo sapiens
acagggctcacagggcagg

SEQ ID NO: 711693 - DNA, 22 bp, Homo sapiens
acagggctctttgatggaccca

SEQ ID NO: 711694 - DNA, 16 bp, Homo sapiens
acagggctgccttctg

SEQ ID NO: 711695 - DNA, 13 bp, Homo sapiens
acagggcttgttt

SEQ ID NO: 711696 - DNA, 20 bp, Homo sapiens
acaggggaggaaaaaagaac

SEQ ID NO: 711697 - DNA, 16 bp, Homo sapiens
acaggggaggtgatag

SEQ ID NO: 711698 - DNA, 22 bp, Homo sapiens
acaggggaggtgatagcattgc

SEQ ID NO: 711699 - DNA, 16 bp, Homo sapiens
acaggggcaggcctgg

SEQ ID NO: 711700 - DNA, 20 bp, Homo sapiens
acaggggcaggcctgggacc

SEQ ID NO: 711701 - DNA, 18 bp, Homo sapiens
acaggggccctgtacagt

SEQ ID NO: 711702 - DNA, 19 bp, Homo sapiens
acaggggggtcggaagcct

SEQ ID NO: 711703 - DNA, 20 bp, Homo sapiens
acaggggggtcggaagcctg

SEQ ID NO: 711704 - DNA, 21 bp, Homo sapiens
acaggggggtcggaagcctgt

SEQ ID NO: 711705 - DNA, 23 bp, Homo sapiens
acaggggggtcggaagcctgtcc

SEQ ID NO: 711706 - DNA, 19 bp, Homo sapiens
acaggggttagcctggact

SEQ ID NO: 711707 - DNA, 17 bp, Homo sapiens
acagggtagatttctct

SEQ ID NO: 711708 - DNA, 17 bp, Homo sapiens
acagggtagcaggtacc

SEQ ID NO: 711709 - DNA, 21 bp, Homo sapiens
acagggtccccgagtgcctag

SEQ ID NO: 711710 - DNA, 23 bp, Homo sapiens
acagggtctgctctttctctgcc

SEQ ID NO: 711711 - DNA, 15 bp, Homo sapiens
acagggtcttgctct

SEQ ID NO: 711712 - DNA, 15 bp, Homo sapiens
acagggtttcaccat

SEQ ID NO: 711713 - DNA, 22 bp, Homo sapiens
acagggtttggctgtgtctaaa

SEQ ID NO: 711714 - DNA, 13 bp, Homo sapiens
acagggttttgta

SEQ ID NO: 711715 - DNA, 22 bp, Homo sapiens
acaggtagaattatctaattta

SEQ ID NO: 711716 - DNA, 16 bp, Homo sapiens
acaggtatatactttg

SEQ ID NO: 711717 - DNA, 23 bp, Homo sapiens
acaggtcaagaaatagcgcagtg

SEQ ID NO: 711718 - DNA, 15 bp, Homo sapiens
acaggtcagggctca

SEQ ID NO: 711719 - DNA, 21 bp, Homo sapiens
acaggtcagtagtcacaaact

SEQ ID NO: 711720 - DNA, 19 bp, Homo sapiens
acaggtcatcagatgcctg

SEQ ID NO: 711721 - DNA, 21 bp, Homo sapiens
acaggtcccacctccagcccg

SEQ ID NO: 711722 - DNA, 13 bp, Homo sapiens
acagcgctatgca

SEQ ID NO: 711723 - DNA, 18 bp, Homo sapiens
acagcggagtctgtcctg

SEQ ID NO: 711724 - DNA, 22 bp, Homo sapiens
acagctaatcagcattctcact

SEQ ID NO: 711725 - DNA, 21 bp, Homo sapiens
acagctacttggtttgtgttc

SEQ ID NO: 711726 - DNA, 15 bp, Homo sapiens
acagctatatttctg

SEQ ID NO: 711727 - DNA, 23 bp, Homo sapiens
acagctcaagtcttccctgatca

SEQ ID NO: 711728 - DNA, 20 bp, Homo sapiens
acagctcacctctgaaggca

SEQ ID NO: 711729 - DNA, 15 bp, Homo sapiens
acagctcactgcagc

SEQ ID NO: 711730 - DNA, 22 bp, Homo sapiens
acagctcactgcagcctcaacc

SEQ ID NO: 711731 - DNA, 14 bp, Homo sapiens
acagctcagagatg

SEQ ID NO: 711732 - DNA, 17 bp, Homo sapiens
acagctcattaaacttt

SEQ ID NO: 711733 - DNA, 14 bp, Homo sapiens
acagctccaggaca

SEQ ID NO: 711734 - DNA, 13 bp, Homo sapiens
acagctcccaccc

SEQ ID NO: 711735 - DNA, 15 bp, Homo sapiens
acagctcccacccca

SEQ ID NO: 711736 - DNA, 15 bp, Homo sapiens
acagctcccttccct

SEQ ID NO: 711737 - DNA, 19 bp, Homo sapiens
acagctcccttccctgcag

SEQ ID NO: 711738 - DNA, 12 bp, Homo sapiens
acagctcctccc

SEQ ID NO: 711739 - DNA, 14 bp, Homo sapiens
acagctcctcccac

SEQ ID NO: 711740 - DNA, 12 bp, Homo sapiens
acagctccttta

SEQ ID NO: 711741 - DNA, 13 bp, Homo sapiens
acagctctagaca

SEQ ID NO: 711742 - DNA, 19 bp, Homo sapiens
acagctctgagatcctgga

SEQ ID NO: 711743 - DNA, 16 bp, Homo sapiens
acagctcttggcattt

SEQ ID NO: 711744 - DNA, 16 bp, Homo sapiens
acagctgaattatcta

SEQ ID NO: 711745 - DNA, 22 bp, Homo sapiens
acagctgagagacttttaatca

SEQ ID NO: 711746 - DNA, 16 bp, Homo sapiens
acagctgagcacttag

SEQ ID NO: 711747 - DNA, 19 bp, Homo sapiens
acagctgagttatgatgta

SEQ ID NO: 711748 - DNA, 19 bp, Homo sapiens
acagctgcaattccctgga

SEQ ID NO: 711749 - DNA, 12 bp, Homo sapiens
acagctgcccta

SEQ ID NO: 711750 - DNA, 20 bp, Homo sapiens
acagctgctcctagagggag

SEQ ID NO: 711751 - DNA, 21 bp, Homo sapiens
acagctgctcctagagggagg

SEQ ID NO: 711752 - DNA, 22 bp, Homo sapiens
acagctgctcctagagggaggg

SEQ ID NO: 711753 - DNA, 18 bp, Homo sapiens
acagctgctgttctcagg

SEQ ID NO: 711754 - DNA, 15 bp, Homo sapiens
acagctgcttctccc

SEQ ID NO: 711755 - DNA, 22 bp, Homo sapiens
acagctgcttctccccccatcc

SEQ ID NO: 711756 - DNA, 11 bp, Homo sapiens
acagctgcttg

SEQ ID NO: 711757 - DNA, 18 bp, Homo sapiens
acagctgcttgtcctgct

SEQ ID NO: 711758 - DNA, 15 bp, Homo sapiens
acagctgctttctgt

SEQ ID NO: 711759 - DNA, 14 bp, Homo sapiens
acagctgctttgag

SEQ ID NO: 711760 - DNA, 23 bp, Homo sapiens
acagctggaccctgcttcaccct

SEQ ID NO: 711761 - DNA, 21 bp, Homo sapiens
acagctggaggaatacatttt

SEQ ID NO: 711762 - DNA, 20 bp, Homo sapiens
acagctggctatctactacc

SEQ ID NO: 711763 - DNA, 11 bp, Homo sapiens
acagctgggca

SEQ ID NO: 711764 - DNA, 12 bp, Homo sapiens
acagctgggcaa

SEQ ID NO: 711765 - DNA, 16 bp, Homo sapiens
acagctgggcagggtg

SEQ ID NO: 711766 - DNA, 17 bp, Homo sapiens
acagctgtattgtctga

SEQ ID NO: 711767 - DNA, 20 bp, Homo sapiens
acagctgtattgtctgaact

SEQ ID NO: 711768 - DNA, 15 bp, Homo sapiens
acagctgtatttata

SEQ ID NO: 711769 - DNA, 12 bp, Homo sapiens
acagctgtctgc

SEQ ID NO: 711770 - DNA, 13 bp, Homo sapiens
acagctgtgtctg

SEQ ID NO: 711771 - DNA, 14 bp, Homo sapiens
acagctgtgtctgc

SEQ ID NO: 711772 - DNA, 22 bp, Homo sapiens
acagctgtgtctgccaaacaca

SEQ ID NO: 711773 - DNA, 23 bp, Homo sapiens
acagctgtgtgacatttggagag

SEQ ID NO: 711774 - DNA, 13 bp, Homo sapiens
acagctgttcctg

SEQ ID NO: 711775 - DNA, 15 bp, Homo sapiens
acagctgtttaagat

SEQ ID NO: 711776 - DNA, 14 bp, Homo sapiens
acagcttagatttc

SEQ ID NO: 711777 - DNA, 23 bp, Homo sapiens
acagcttcattatctgagttgca

SEQ ID NO: 711778 - DNA, 18 bp, Homo sapiens
acagcttcctttcctgtg

SEQ ID NO: 711779 - DNA, 13 bp, Homo sapiens
acagcttctctgc

SEQ ID NO: 711780 - DNA, 16 bp, Homo sapiens
acagcttcttcatctt

SEQ ID NO: 711781 - DNA, 13 bp, Homo sapiens
acagcttcttctg

SEQ ID NO: 711782 - DNA, 17 bp, Homo sapiens
acagcttgacctgaggc

SEQ ID NO: 711783 - DNA, 19 bp, Homo sapiens
acagcttgacctgaggctg

SEQ ID NO: 711784 - DNA, 22 bp, Homo sapiens
acagcttgacctgaggctgtgg

SEQ ID NO: 711785 - DNA, 23 bp, Homo sapiens
acagcttgacctgaggctgtggt

SEQ ID NO: 711786 - DNA, 15 bp, Homo sapiens
acagctttcaagtgc

SEQ ID NO: 711787 - DNA, 12 bp, Homo sapiens
acagctttctgg

SEQ ID NO: 711788 - DNA, 13 bp, Homo sapiens
acagctttctggg

SEQ ID NO: 711789 - DNA, 20 bp, Homo sapiens
acagctttctgggatgtcac

SEQ ID NO: 711790 - DNA, 22 bp, Homo sapiens
acagctttctgggatgtcacag

SEQ ID NO: 711791 - DNA, 13 bp, Homo sapiens
acagctttgcacc

SEQ ID NO: 711792 - DNA, 14 bp, Homo sapiens
acagctttgcaccc

SEQ ID NO: 711793 - DNA, 19 bp, Homo sapiens
acagctttgcacccctttc

SEQ ID NO: 711794 - DNA, 14 bp, Homo sapiens
acagctttgccttg

SEQ ID NO: 711795 - DNA, 19 bp, Homo sapiens
acagctttgctccgctccc

SEQ ID NO: 711796 - DNA, 20 bp, Homo sapiens
acagctttgctccgctccca

SEQ ID NO: 711797 - DNA, 12 bp, Homo sapiens
acagctttgctg

SEQ ID NO: 711798 - DNA, 21 bp, Homo sapiens
acagctttgctgctgaaggct

SEQ ID NO: 711799 - DNA, 17 bp, Homo sapiens
acagcttttcccaggag

SEQ ID NO: 711800 - DNA, 15 bp, Homo sapiens
acagcttttgcaact

SEQ ID NO: 711801 - DNA, 17 bp, Homo sapiens
acaggaaaaaaactttt

SEQ ID NO: 711802 - DNA, 23 bp, Homo sapiens
acaggaaaaaaacttttataaat

SEQ ID NO: 711803 - DNA, 14 bp, Homo sapiens
acaggaaaaaccaa

SEQ ID NO: 711804 - DNA, 17 bp, Homo sapiens
acaggaaaaaccaacag

SEQ ID NO: 711805 - DNA, 15 bp, Homo sapiens
acaggaaaaataaac

SEQ ID NO: 711806 - DNA, 17 bp, Homo sapiens
acaggaaaatcctctgg

SEQ ID NO: 711807 - DNA, 23 bp, Homo sapiens
acaggaaaatcctctggctggct

SEQ ID NO: 711808 - DNA, 18 bp, Homo sapiens
acaggaaaatgtatccag

SEQ ID NO: 711809 - DNA, 17 bp, Homo sapiens
acaggaaagccctcccc

SEQ ID NO: 711810 - DNA, 18 bp, Homo sapiens
acaggaaagccctccccc

SEQ ID NO: 711811 - DNA, 15 bp, Homo sapiens
acaggaacggccctg

SEQ ID NO: 711812 - DNA, 13 bp, Homo sapiens
acaggaaggcttg

SEQ ID NO: 711813 - DNA, 15 bp, Homo sapiens
acaggaaggtgcctg

SEQ ID NO: 711814 - DNA, 15 bp, Homo sapiens
acacatttgcccaat

SEQ ID NO: 711815 - DNA, 22 bp, Homo sapiens
acacatttgggatgttcctttt

SEQ ID NO: 711816 - DNA, 14 bp, Homo sapiens
acacattttatttt

SEQ ID NO: 711817 - DNA, 19 bp, Homo sapiens
acacattttattttattat

SEQ ID NO: 711818 - DNA, 20 bp, Homo sapiens
acacattttattttattatg

SEQ ID NO: 711819 - DNA, 21 bp, Homo sapiens
acacattttattttattatgc

SEQ ID NO: 711820 - DNA, 14 bp, Homo sapiens
acacatttttcaga

SEQ ID NO: 711821 - DNA, 12 bp, Homo sapiens
acacatttttct

SEQ ID NO: 711822 - DNA, 18 bp, Homo sapiens
acacattttttaaatgca

SEQ ID NO: 711823 - DNA, 19 bp, Homo sapiens
acacattttttaaatgcac

SEQ ID NO: 711824 - DNA, 20 bp, Homo sapiens
acaccaagcacagcagcctg

SEQ ID NO: 711825 - DNA, 21 bp, Homo sapiens
acaccaagcacagcagcctgg

SEQ ID NO: 711826 - DNA, 14 bp, Homo sapiens
acaccaataaatgt

SEQ ID NO: 711827 - DNA, 23 bp, Homo sapiens
acaccaatattaacacgctgcct

SEQ ID NO: 711828 - DNA, 15 bp, Homo sapiens
acaccaatcagagag

SEQ ID NO: 711829 - DNA, 13 bp, Homo sapiens
acaccacagacac

SEQ ID NO: 711830 - DNA, 16 bp, Homo sapiens
acaccacagacacaca

SEQ ID NO: 711831 - DNA, 17 bp, Homo sapiens
acaccacagcaagccgg

SEQ ID NO: 711832 - DNA, 18 bp, Homo sapiens
acaccaccatgctcaact

SEQ ID NO: 711833 - DNA, 13 bp, Homo sapiens
acaccacctggag

SEQ ID NO: 711834 - DNA, 22 bp, Homo sapiens
acaccacgtccttattggaata

SEQ ID NO: 711835 - DNA, 20 bp, Homo sapiens
acaccactacattctgttaa

SEQ ID NO: 711836 - DNA, 14 bp, Homo sapiens
acaccactgccctg

SEQ ID NO: 711837 - DNA, 19 bp, Homo sapiens
acaccactgccctgcctgc

SEQ ID NO: 711838 - DNA, 21 bp, Homo sapiens
acaccactgccctgcctgccc

SEQ ID NO: 711839 - DNA, 14 bp, Homo sapiens
acaccagacagaca

SEQ ID NO: 711840 - DNA, 22 bp, Homo sapiens
acaccagactgaagtaaacagc

SEQ ID NO: 711841 - DNA, 21 bp, Homo sapiens
acaccagatgcttttgtgaga

SEQ ID NO: 711842 - DNA, 13 bp, Homo sapiens
acaccagccgctg

SEQ ID NO: 711843 - DNA, 21 bp, Homo sapiens
acaccaggccgtcctcccggg

SEQ ID NO: 711844 - DNA, 22 bp, Homo sapiens
acaccaggccgtcctcccgggc

SEQ ID NO: 711845 - DNA, 23 bp, Homo sapiens
acaccagtggcagctgccccagg

SEQ ID NO: 711846 - DNA, 21 bp, Homo sapiens
acaccataggtagaatgtaaa

SEQ ID NO: 711847 - DNA, 16 bp, Homo sapiens
acaccattaccaaaat

SEQ ID NO: 711848 - DNA, 12 bp, Homo sapiens
acacccactgcc

SEQ ID NO: 711849 - DNA, 23 bp, Homo sapiens
acacccagcaatagagacgggac

SEQ ID NO: 711850 - DNA, 14 bp, Homo sapiens
acacccaggaaggg

SEQ ID NO: 711851 - DNA, 20 bp, Homo sapiens
acacccaggtgatttcctct

SEQ ID NO: 711852 - DNA, 19 bp, Homo sapiens
acaccccacaccccagccc

SEQ ID NO: 711853 - DNA, 21 bp, Homo sapiens
acaccccatgcacctcagggc

SEQ ID NO: 711854 - DNA, 13 bp, Homo sapiens
acacccccagctg

SEQ ID NO: 711855 - DNA, 20 bp, Homo sapiens
acaccccccgccccccacct

SEQ ID NO: 711856 - DNA, 22 bp, Homo sapiens
acaccccctccccgcccctgtg

SEQ ID NO: 711857 - DNA, 16 bp, Homo sapiens
acacccctcccctgcc

SEQ ID NO: 711858 - DNA, 14 bp, Homo sapiens
acacccctgtgctc

SEQ ID NO: 711859 - DNA, 21 bp, Homo sapiens
acacccctgtgctcccctgcc

SEQ ID NO: 711860 - DNA, 23 bp, Homo sapiens
acaccccttttccagttgctgtg

SEQ ID NO: 711861 - DNA, 15 bp, Homo sapiens
acacccgaagtcctg

SEQ ID NO: 711862 - DNA, 22 bp, Homo sapiens
acacccgtgtggtaccttcagc

SEQ ID NO: 711863 - DNA, 14 bp, Homo sapiens
acaccctccagaga

SEQ ID NO: 711864 - DNA, 13 bp, Homo sapiens
acaccctcccccg

SEQ ID NO: 711865 - DNA, 19 bp, Homo sapiens
acaccctcccccgccactc

SEQ ID NO: 711866 - DNA, 17 bp, Homo sapiens
acaccctgcccctggtg

SEQ ID NO: 711867 - DNA, 14 bp, Homo sapiens
acaccctggcctga

SEQ ID NO: 711868 - DNA, 17 bp, Homo sapiens
acaccctggcctgaact

SEQ ID NO: 711869 - DNA, 22 bp, Homo sapiens
acaccctgtactgttctgtgtc

SEQ ID NO: 711870 - DNA, 22 bp, Homo sapiens
acaccctttcatctcagagtcc

SEQ ID NO: 711871 - DNA, 16 bp, Homo sapiens
acaccgactagccagg

SEQ ID NO: 711872 - DNA, 24 bp, Homo sapiens
acaccgctcagtattactttctgc

SEQ ID NO: 711873 - DNA, 16 bp, Homo sapiens
acaccgggcctggaga

SEQ ID NO: 711874 - DNA, 19 bp, Homo sapiens
acagatttttacactaata

SEQ ID NO: 711875 - DNA, 20 bp, Homo sapiens
acagcaaaaccattgcttca

SEQ ID NO: 711876 - DNA, 18 bp, Homo sapiens
acagcaaaactccatctc

SEQ ID NO: 711877 - DNA, 18 bp, Homo sapiens
acagcaaaatgttgaaga

SEQ ID NO: 711878 - DNA, 22 bp, Homo sapiens
acagcaaacaggtgctaatttg

SEQ ID NO: 711879 - DNA, 16 bp, Homo sapiens
acagcaaatgcaaaaa

SEQ ID NO: 711880 - DNA, 19 bp, Homo sapiens
acagcaagtacagcggctc

SEQ ID NO: 711881 - DNA, 15 bp, Homo sapiens
acagcaagtagataa

SEQ ID NO: 711882 - DNA, 16 bp, Homo sapiens
acagcacaagggcaca

SEQ ID NO: 711883 - DNA, 14 bp, Homo sapiens
acagcacaccagcc

SEQ ID NO: 711884 - DNA, 20 bp, Homo sapiens
acagcacaccagccgctgca

SEQ ID NO: 711885 - DNA, 18 bp, Homo sapiens
acagcaccaaaggctcag

SEQ ID NO: 711886 - DNA, 15 bp, Homo sapiens
acagcaccactgctg

SEQ ID NO: 711887 - DNA, 19 bp, Homo sapiens
acagcacgggggccaagga

SEQ ID NO: 711888 - DNA, 15 bp, Homo sapiens
acagcactactctgt

SEQ ID NO: 711889 - DNA, 16 bp, Homo sapiens
acagcactactgggtg

SEQ ID NO: 711890 - DNA, 17 bp, Homo sapiens
acagcactactgggtgt

SEQ ID NO: 711891 - DNA, 19 bp, Homo sapiens
acagcactactgggtgtca

SEQ ID NO: 711892 - DNA, 19 bp, Homo sapiens
acagcactggctctctcca

SEQ ID NO: 711893 - DNA, 13 bp, Homo sapiens
acagcagactcag

SEQ ID NO: 711894 - DNA, 23 bp, Homo sapiens
acagcagcactcccgctgcacac

SEQ ID NO: 711895 - DNA, 17 bp, Homo sapiens
acagcagcccctgcaca

SEQ ID NO: 711896 - DNA, 12 bp, Homo sapiens
acagcagcctgt

SEQ ID NO: 711897 - DNA, 13 bp, Homo sapiens
acagcagcctgtg

SEQ ID NO: 711898 - DNA, 14 bp, Homo sapiens
acagcagctcaggc

SEQ ID NO: 711899 - DNA, 16 bp, Homo sapiens
acagcagctcaggcac

SEQ ID NO: 711900 - DNA, 12 bp, Homo sapiens
acagcagctcat

SEQ ID NO: 711901 - DNA, 14 bp, Homo sapiens
acagcagctgaaca

SEQ ID NO: 711902 - DNA, 12 bp, Homo sapiens
acagcagcttca

SEQ ID NO: 711903 - DNA, 17 bp, Homo sapiens
acagcagcttcaccaga

SEQ ID NO: 711904 - DNA, 21 bp, Homo sapiens
acagcaggacctgtgctttga

SEQ ID NO: 711905 - DNA, 22 bp, Homo sapiens
acagcaggatcgaagggttttt

SEQ ID NO: 711906 - DNA, 22 bp, Homo sapiens
acagcaggattggatgttgtgt

SEQ ID NO: 711907 - DNA, 14 bp, Homo sapiens
acagcaggccacta

SEQ ID NO: 711908 - DNA, 20 bp, Homo sapiens
acagcaggccatctttttat

SEQ ID NO: 711909 - DNA, 22 bp, Homo sapiens
acagcaggggagccctgatttt

SEQ ID NO: 711910 - DNA, 11 bp, Homo sapiens
acagcaggtgt

SEQ ID NO: 711911 - DNA, 14 bp, Homo sapiens
acagcagtgagact

SEQ ID NO: 711912 - DNA, 21 bp, Homo sapiens
acagcagtgagactggggcca

SEQ ID NO: 711913 - DNA, 16 bp, Homo sapiens
acagcagtgtcatcag

SEQ ID NO: 711914 - DNA, 17 bp, Homo sapiens
acagcagtgtcatcaga

SEQ ID NO: 711915 - DNA, 20 bp, Homo sapiens
acagcagtttgtgatatagc

SEQ ID NO: 711916 - DNA, 16 bp, Homo sapiens
acagcatcattttgca

SEQ ID NO: 711917 - DNA, 17 bp, Homo sapiens
acagcatcattttgcat

SEQ ID NO: 711918 - DNA, 16 bp, Homo sapiens
acagcatcccttccca

SEQ ID NO: 711919 - DNA, 18 bp, Homo sapiens
acagcatcgggagcaccc

SEQ ID NO: 711920 - DNA, 23 bp, Homo sapiens
acagcatgaataaaacactcatc

SEQ ID NO: 711921 - DNA, 16 bp, Homo sapiens
acagcatggcctctcg

SEQ ID NO: 711922 - DNA, 12 bp, Homo sapiens
acagcatgtgcc

SEQ ID NO: 711923 - DNA, 16 bp, Homo sapiens
acagcatgtgccctcc

SEQ ID NO: 711924 - DNA, 20 bp, Homo sapiens
acagcatgtgccctcctgag

SEQ ID NO: 711925 - DNA, 13 bp, Homo sapiens
acagcatgtgtat

SEQ ID NO: 711926 - DNA, 14 bp, Homo sapiens
acagcatgtgttaa

SEQ ID NO: 711927 - DNA, 23 bp, Homo sapiens
acagcattcttgtcacaataaat

SEQ ID NO: 711928 - DNA, 22 bp, Homo sapiens
acagcattgactcagatataga

SEQ ID NO: 711929 - DNA, 19 bp, Homo sapiens
acagcattgatctcctgga

SEQ ID NO: 711930 - DNA, 11 bp, Homo sapiens
acagcattgtc

SEQ ID NO: 711931 - DNA, 22 bp, Homo sapiens
acagccaacacgcacctgcctc

SEQ ID NO: 711932 - DNA, 13 bp, Homo sapiens
acagccaacaggt

SEQ ID NO: 711933 - DNA, 23 bp, Homo sapiens
acagccaacaggtggcaggacca

SEQ ID NO: 711934 - DNA, 21 bp, Homo sapiens
acagccaactagcccctgggg

SEQ ID NO: 711935 - DNA, 23 bp, Homo sapiens
acagccaaggggatatttactgc

SEQ ID NO: 711936 - DNA, 11 bp, Homo sapiens
acagccacccg

SEQ ID NO: 711937 - DNA, 11 bp, Homo sapiens
acagccacctc

SEQ ID NO: 711938 - DNA, 12 bp, Homo sapiens
acagccagagct

SEQ ID NO: 711939 - DNA, 17 bp, Homo sapiens
acagccagagctgggtg

SEQ ID NO: 711940 - DNA, 13 bp, Homo sapiens
acagccagaggag

SEQ ID NO: 711941 - DNA, 16 bp, Homo sapiens
acagccagcacctggc

SEQ ID NO: 711942 - DNA, 12 bp, Homo sapiens
acagccagcagc

SEQ ID NO: 711943 - DNA, 14 bp, Homo sapiens
acagccagcagcag

SEQ ID NO: 711944 - DNA, 16 bp, Homo sapiens
acagccagcagcagga

SEQ ID NO: 711945 - DNA, 21 bp, Homo sapiens
acagccagtgggagatgttag

SEQ ID NO: 711946 - DNA, 18 bp, Homo sapiens
acagccatgtccaagttc

SEQ ID NO: 711947 - DNA, 14 bp, Homo sapiens
acagcccagaacca

SEQ ID NO: 711948 - DNA, 18 bp, Homo sapiens
acagcccagaaccacaga

SEQ ID NO: 711949 - DNA, 18 bp, Homo sapiens
acagcccagagcctggct

SEQ ID NO: 711950 - DNA, 19 bp, Homo sapiens
acagcccaggcatctcctt

SEQ ID NO: 711951 - DNA, 20 bp, Homo sapiens
acagcccaggcatctccttg

SEQ ID NO: 711952 - DNA, 13 bp, Homo sapiens
acagcccagggcc

SEQ ID NO: 711953 - DNA, 17 bp, Homo sapiens
acagcccatcacctcta

SEQ ID NO: 711954 - DNA, 18 bp, Homo sapiens
acagccccaagcttctga

SEQ ID NO: 711955 - DNA, 17 bp, Homo sapiens
acagcccccttgccctc

SEQ ID NO: 711956 - DNA, 20 bp, Homo sapiens
acagcccctatagcactgag

SEQ ID NO: 711957 - DNA, 17 bp, Homo sapiens
acagcccgctctctggc

SEQ ID NO: 711958 - DNA, 23 bp, Homo sapiens
acagcccgggtgtgcctgccctg

SEQ ID NO: 711959 - DNA, 13 bp, Homo sapiens
acagccctgggag

SEQ ID NO: 711960 - DNA, 22 bp, Homo sapiens
acagcccttatgcggttaattt

SEQ ID NO: 711961 - DNA, 20 bp, Homo sapiens
acagccgcagcctccctctg

SEQ ID NO: 711962 - DNA, 14 bp, Homo sapiens
acacaactttattg

SEQ ID NO: 711963 - DNA, 15 bp, Homo sapiens
acacaagctggaagc

SEQ ID NO: 711964 - DNA, 22 bp, Homo sapiens
acacaagcttttttacacaaat

SEQ ID NO: 711965 - DNA, 20 bp, Homo sapiens
acacaaggggcccttggagc

SEQ ID NO: 711966 - DNA, 14 bp, Homo sapiens
acacaagtaaaact

SEQ ID NO: 711967 - DNA, 21 bp, Homo sapiens
acacaagtttgtgctatctat

SEQ ID NO: 711968 - DNA, 15 bp, Homo sapiens
acacaataaagaacc

SEQ ID NO: 711969 - DNA, 14 bp, Homo sapiens
acacaataagcaaa

SEQ ID NO: 711970 - DNA, 21 bp, Homo sapiens
acacaataggtctttctctca

SEQ ID NO: 711971 - DNA, 23 bp, Homo sapiens
acacaataggtctttctctcagt

SEQ ID NO: 711972 - DNA, 12 bp, Homo sapiens
acacaatatgta

SEQ ID NO: 711973 - DNA, 22 bp, Homo sapiens
acacaatatgtatgctttttac

SEQ ID NO: 711974 - DNA, 17 bp, Homo sapiens
acacaatggcacctctg

SEQ ID NO: 711975 - DNA, 22 bp, Homo sapiens
acacaatggcacctctgccctt

SEQ ID NO: 711976 - DNA, 20 bp, Homo sapiens
acacaattgatacttcaggt

SEQ ID NO: 711977 - DNA, 21 bp, Homo sapiens
acacaatttaattcctctttt

SEQ ID NO: 711978 - DNA, 19 bp, Homo sapiens
acacacaaaaaggagcggg

SEQ ID NO: 711979 - DNA, 9 bp, Homo sapiens
acacacaca

SEQ ID NO: 711980 - DNA, 11 bp, Homo sapiens
acacacacaca

SEQ ID NO: 711981 - DNA, 15 bp, Homo sapiens
acacacacacacaca

SEQ ID NO: 711982 - DNA, 16 bp, Homo sapiens
acacacacacgatgca

SEQ ID NO: 711983 - DNA, 14 bp, Homo sapiens
acacacacaggagg

SEQ ID NO: 711984 - DNA, 11 bp, Homo sapiens
acacacacata

SEQ ID NO: 711985 - DNA, 17 bp, Homo sapiens
acacacaccacacatac

SEQ ID NO: 711986 - DNA, 12 bp, Homo sapiens
acacacacgcac

SEQ ID NO: 711987 - DNA, 14 bp, Homo sapiens
acacacacgcacgc

SEQ ID NO: 711988 - DNA, 19 bp, Homo sapiens
acacacacgcacgcacaca

SEQ ID NO: 711989 - DNA, 13 bp, Homo sapiens
acacacacgccag

SEQ ID NO: 711990 - DNA, 19 bp, Homo sapiens
acacacagatacacacaca

SEQ ID NO: 711991 - DNA, 23 bp, Homo sapiens
acacacagatttgagctcagccc

SEQ ID NO: 711992 - DNA, 13 bp, Homo sapiens
acacacagcagtg

SEQ ID NO: 711993 - DNA, 20 bp, Homo sapiens
acacacagctgggcaaagcc

SEQ ID NO: 711994 - DNA, 11 bp, Homo sapiens
acacacaggcc

SEQ ID NO: 711995 - DNA, 14 bp, Homo sapiens
acacacaggccttc

SEQ ID NO: 711996 - DNA, 19 bp, Homo sapiens
acacacataccttcatgtg

SEQ ID NO: 711997 - DNA, 19 bp, Homo sapiens
acacacatacgtgcacagg

SEQ ID NO: 711998 - DNA, 14 bp, Homo sapiens
acacacatatacat

SEQ ID NO: 711999 - DNA, 15 bp, Homo sapiens
acacacatatacata

SEQ ID NO: 712000 - DNA, 17 bp, Homo sapiens
acacacatctggccctg

SEQ ID NO: 712001 - DNA, 18 bp, Homo sapiens
acacacatgccctcctgg

SEQ ID NO: 712002 - DNA, 22 bp, Homo sapiens
acacaccaggctgtgggcctca

SEQ ID NO: 712003 - DNA, 23 bp, Homo sapiens
acacaccccacaccccagcccac

SEQ ID NO: 712004 - DNA, 19 bp, Homo sapiens
acacacgagcaaacccaga

SEQ ID NO: 712005 - DNA, 18 bp, Homo sapiens
acacacgatgcatttaat

SEQ ID NO: 712006 - DNA, 13 bp, Homo sapiens
acacacgcacgca

SEQ ID NO: 712007 - DNA, 14 bp, Homo sapiens
acacacgcaggaac

SEQ ID NO: 712008 - DNA, 15 bp, Homo sapiens
acacacgccagctcc

SEQ ID NO: 712009 - DNA, 16 bp, Homo sapiens
acacacgccagctcct

SEQ ID NO: 712010 - DNA, 20 bp, Homo sapiens
acacacggttttggcagctg

SEQ ID NO: 712011 - DNA, 17 bp, Homo sapiens
acacacgtatttatatt

SEQ ID NO: 712012 - DNA, 22 bp, Homo sapiens
acacactaccgaatgtgtcttt

SEQ ID NO: 712013 - DNA, 20 bp, Homo sapiens
acacactcacaatttaaaat

SEQ ID NO: 712014 - DNA, 23 bp, Homo sapiens
acacactctcatgtccccttcct

SEQ ID NO: 712015 - DNA, 15 bp, Homo sapiens
acacactgatgctta

SEQ ID NO: 712016 - DNA, 22 bp, Homo sapiens
aatgtattagtatggttcaaga

SEQ ID NO: 712017 - DNA, 17 bp, Homo sapiens
aatgtattattctgcag

SEQ ID NO: 712018 - DNA, 22 bp, Homo sapiens
aatgtattattctgcagcatga

SEQ ID NO: 712019 - DNA, 12 bp, Homo sapiens
aatgtattcaag

SEQ ID NO: 712020 - DNA, 15 bp, Homo sapiens
aatgtattcccttca

SEQ ID NO: 712021 - DNA, 18 bp, Homo sapiens
aatgtattgattacaaat

SEQ ID NO: 712022 - DNA, 19 bp, Homo sapiens
aatgtattgttggtaatta

SEQ ID NO: 712023 - DNA, 17 bp, Homo sapiens
aatgtatttaactcaga

SEQ ID NO: 712024 - DNA, 16 bp, Homo sapiens
aatgtatttgaaaatt

SEQ ID NO: 712025 - DNA, 19 bp, Homo sapiens
aatgtatttgaaaattaca

SEQ ID NO: 712026 - DNA, 17 bp, Homo sapiens
aatgtatttgatttata

SEQ ID NO: 712027 - DNA, 19 bp, Homo sapiens
aatgtatttgatttataag

SEQ ID NO: 712028 - DNA, 22 bp, Homo sapiens
aatgtattttcatagatgtgtt

SEQ ID NO: 712029 - DNA, 19 bp, Homo sapiens
aatgtcaaatcaaggcaaa

SEQ ID NO: 712030 - DNA, 20 bp, Homo sapiens
aatgtcaaccatctttaagg

SEQ ID NO: 712031 - DNA, 18 bp, Homo sapiens
aatgtcaccaccttccca

SEQ ID NO: 712032 - DNA, 19 bp, Homo sapiens
aatgtcactgtagttttga

SEQ ID NO: 712033 - DNA, 17 bp, Homo sapiens
aatgtcacttaaaggct

SEQ ID NO: 712034 - DNA, 16 bp, Homo sapiens
aatgtcagactttgct

SEQ ID NO: 712035 - DNA, 13 bp, Homo sapiens
aatgtcagagcta

SEQ ID NO: 712036 - DNA, 23 bp, Homo sapiens
aatgtcagagctatgttccctcc

SEQ ID NO: 712037 - DNA, 17 bp, Homo sapiens
aatgtcagatttctggt

SEQ ID NO: 712038 - DNA, 18 bp, Homo sapiens
aatgtcagcctttgttaa

SEQ ID NO: 712039 - DNA, 22 bp, Homo sapiens
aatgtcagcctttgttaacctt

SEQ ID NO: 712040 - DNA, 16 bp, Homo sapiens
aatgtcagggccaggt

SEQ ID NO: 712041 - DNA, 12 bp, Homo sapiens
aatgtcagtgac

SEQ ID NO: 712042 - DNA, 18 bp, Homo sapiens
aatgtcagtgtttgggaa

SEQ ID NO: 712043 - DNA, 19 bp, Homo sapiens
aatgtcatggccttgaaac

SEQ ID NO: 712044 - DNA, 23 bp, Homo sapiens
aatgtcatggccttgaaacagtt

SEQ ID NO: 712045 - DNA, 15 bp, Homo sapiens
aatgtcattgctaaa

SEQ ID NO: 712046 - DNA, 16 bp, Homo sapiens
aatgtcattgctaaaa

SEQ ID NO: 712047 - DNA, 21 bp, Homo sapiens
aatgtcattgctaaaaaataa

SEQ ID NO: 712048 - DNA, 14 bp, Homo sapiens
aatgtcattgtcta

SEQ ID NO: 712049 - DNA, 16 bp, Homo sapiens
aatgtcattgtctact

SEQ ID NO: 712050 - DNA, 18 bp, Homo sapiens
aatgtcattgtctactcc

SEQ ID NO: 712051 - DNA, 19 bp, Homo sapiens
aatgtcattttggtacttt

SEQ ID NO: 712052 - DNA, 18 bp, Homo sapiens
aatgtccatgatggaata

SEQ ID NO: 712053 - DNA, 12 bp, Homo sapiens
aatgtccccact

SEQ ID NO: 712054 - DNA, 19 bp, Homo sapiens
aatgtcccccatcatgtgg

SEQ ID NO: 712055 - DNA, 21 bp, Homo sapiens
aatgtcctccagaagcctctg

SEQ ID NO: 712056 - DNA, 14 bp, Homo sapiens
aatgtcctcttgga

SEQ ID NO: 712057 - DNA, 14 bp, Homo sapiens
aatgtcctgaaaca

SEQ ID NO: 712058 - DNA, 15 bp, Homo sapiens
aatgtcggggttggg

SEQ ID NO: 712059 - DNA, 20 bp, Homo sapiens
aatgtcggggttggggtggg

SEQ ID NO: 712060 - DNA, 16 bp, Homo sapiens
aatgtctagtttctag

SEQ ID NO: 712061 - DNA, 14 bp, Homo sapiens
aatgtctcactgtt

SEQ ID NO: 712062 - DNA, 15 bp, Homo sapiens
aatgtctcactgttc

SEQ ID NO: 712063 - DNA, 19 bp, Homo sapiens
aatgtctcactgttctgca

SEQ ID NO: 712064 - DNA, 14 bp, Homo sapiens
aatgtctcttcctc

SEQ ID NO: 712065 - DNA, 21 bp, Homo sapiens
aatgtctgaagtacaaacatg

SEQ ID NO: 712066 - DNA, 22 bp, Homo sapiens
aatgtctgaagtacaaacatga

SEQ ID NO: 712067 - DNA, 15 bp, Homo sapiens
aatgtctgctgagga

SEQ ID NO: 712068 - DNA, 13 bp, Homo sapiens
aatgtctgctggt

SEQ ID NO: 712069 - DNA, 17 bp, Homo sapiens
aatgtctgctggtattt

SEQ ID NO: 712070 - DNA, 22 bp, Homo sapiens
aatgtctgctggtatttctaat

SEQ ID NO: 712071 - DNA, 17 bp, Homo sapiens
aatgtctgtaataatag

SEQ ID NO: 712072 - DNA, 19 bp, Homo sapiens
aatgtctgtaataatagac

SEQ ID NO: 712073 - DNA, 10 bp, Homo sapiens
aatgtctgtt

SEQ ID NO: 712074 - DNA, 13 bp, Homo sapiens
aatgtcttgtgtt

SEQ ID NO: 712075 - DNA, 22 bp, Homo sapiens
aatgtctttgttggaaaagaat

SEQ ID NO: 712076 - DNA, 20 bp, Homo sapiens
aatgtcttttttcaaacttt

SEQ ID NO: 712077 - DNA, 17 bp, Homo sapiens
aatgtgaaaaaggaata

SEQ ID NO: 712078 - DNA, 15 bp, Homo sapiens
aatgtgaaaaatctg

SEQ ID NO: 712079 - DNA, 17 bp, Homo sapiens
aatgtgaaaagaaaaat

SEQ ID NO: 712080 - DNA, 15 bp, Homo sapiens
aatgtgaaactggat

SEQ ID NO: 712081 - DNA, 22 bp, Homo sapiens
aatgtgaaactggattaaactt

SEQ ID NO: 712082 - DNA, 17 bp, Homo sapiens
aatgtgaaatctcagaa

SEQ ID NO: 712083 - DNA, 14 bp, Homo sapiens
aatgtgaaatttaa

SEQ ID NO: 712084 - DNA, 20 bp, Homo sapiens
aatgtgaaatttaaataata

SEQ ID NO: 712085 - DNA, 15 bp, Homo sapiens
aatgtgaactttatt

SEQ ID NO: 712086 - DNA, 12 bp, Homo sapiens
aatgtgaatttt

SEQ ID NO: 712087 - DNA, 18 bp, Homo sapiens
aatgtgaatttttgccta

SEQ ID NO: 712088 - DNA, 15 bp, Homo sapiens
aatgtgaccaggggt

SEQ ID NO: 712089 - DNA, 15 bp, Homo sapiens
aatgtgagaaatgtc

SEQ ID NO: 712090 - DNA, 17 bp, Homo sapiens
aatgtgagaaatgtcta

SEQ ID NO: 712091 - DNA, 12 bp, Homo sapiens
aatgtgagtgtg

SEQ ID NO: 712092 - DNA, 21 bp, Homo sapiens
aatgtgagtttggtctggact

SEQ ID NO: 712093 - DNA, 14 bp, Homo sapiens
aatgtgatcaactg

SEQ ID NO: 712094 - DNA, 15 bp, Homo sapiens
aatgtgatcatatga

SEQ ID NO: 712095 - DNA, 21 bp, Homo sapiens
aatgtgatcatatgaggacct

SEQ ID NO: 712096 - DNA, 16 bp, Homo sapiens
aatgtgatgaatactg

SEQ ID NO: 712097 - DNA, 20 bp, Homo sapiens
aatgtgatggatggcacaat

SEQ ID NO: 712098 - DNA, 22 bp, Homo sapiens
aatgtgatggatggcacaatga

SEQ ID NO: 712099 - DNA, 23 bp, Homo sapiens
aatgtgatggatggcacaatgaa

SEQ ID NO: 712100 - DNA, 16 bp, Homo sapiens
aatgtgatttttctga

SEQ ID NO: 712101 - DNA, 14 bp, Homo sapiens
aatgtgcaaatttt

SEQ ID NO: 712102 - DNA, 15 bp, Homo sapiens
aatgtgcaatagaag

SEQ ID NO: 712103 - DNA, 17 bp, Homo sapiens
aatgtgcaatagaaggt

SEQ ID NO: 712104 - DNA, 16 bp, Homo sapiens
aatgtgcagggatatt

SEQ ID NO: 712105 - DNA, 21 bp, Homo sapiens
aatgtgcagggatattgcctt

SEQ ID NO: 712106 - DNA, 17 bp, Homo sapiens
aatgtgcataatgataa

SEQ ID NO: 712107 - DNA, 24 bp, Homo sapiens
aatgtgcattcttttaaaagacaa

SEQ ID NO: 712108 - DNA, 18 bp, Homo sapiens
aatgtgccacctgtccgg

SEQ ID NO: 712109 - DNA, 18 bp, Homo sapiens
aatgtgcccctggcccat

SEQ ID NO: 712110 - DNA, 15 bp, Homo sapiens
aatgtgccttgattg

SEQ ID NO: 712111 - DNA, 19 bp, Homo sapiens
aatgtgctactgattgttt

SEQ ID NO: 712112 - DNA, 21 bp, Homo sapiens
aatgtgctggtgaacactgtg

SEQ ID NO: 712113 - DNA, 17 bp, Homo sapiens
aatgtggacgtgcactg

SEQ ID NO: 712114 - DNA, 17 bp, Homo sapiens
aatgtggagcagcagcc

SEQ ID NO: 712115 - DNA, 19 bp, Homo sapiens
aatgtggataaaactgtgt

SEQ ID NO: 712116 - DNA, 21 bp, Homo sapiens
aatgtggataaaactgtgtaa

SEQ ID NO: 712117 - DNA, 17 bp, Homo sapiens
aatgtggatttgattca

SEQ ID NO: 712118 - DNA, 17 bp, Homo sapiens
aatgtggccgaggactt

SEQ ID NO: 712119 - DNA, 18 bp, Homo sapiens
aatgtgggagcagcggtt

SEQ ID NO: 712120 - DNA, 13 bp, Homo sapiens
aatgtgggcactg

SEQ ID NO: 712121 - DNA, 16 bp, Homo sapiens
aatgtggtagcctcac

SEQ ID NO: 712122 - DNA, 21 bp, Homo sapiens
aatgtggtgacacctccccct

SEQ ID NO: 712123 - DNA, 18 bp, Homo sapiens
aatgtggttatttctctg

SEQ ID NO: 712124 - DNA, 19 bp, Homo sapiens
aatgtggttatttctctga

SEQ ID NO: 712125 - DNA, 17 bp, Homo sapiens
aatgtggttttcctgaa

SEQ ID NO: 712126 - DNA, 21 bp, Homo sapiens
aatgtgtaagaacaactacct

SEQ ID NO: 712127 - DNA, 15 bp, Homo sapiens
aatgtgtaattttgt

SEQ ID NO: 712128 - DNA, 16 bp, Homo sapiens
aatgtgtaattttgtt

SEQ ID NO: 712129 - DNA, 16 bp, Homo sapiens
aatgtgtacaacttaa

SEQ ID NO: 712130 - DNA, 19 bp, Homo sapiens
aatgtgtacaatgtacaca

SEQ ID NO: 712131 - DNA, 15 bp, Homo sapiens
aatgtgtacagtgaa

SEQ ID NO: 712132 - DNA, 16 bp, Homo sapiens
aatgtgtacagtgaat

SEQ ID NO: 712133 - DNA, 18 bp, Homo sapiens
aatgtgtataaattgtct

SEQ ID NO: 712134 - DNA, 19 bp, Homo sapiens
aatgtgtatcggatgcttt

SEQ ID NO: 712135 - DNA, 19 bp, Homo sapiens
acaagatttcctactttct

SEQ ID NO: 712136 - DNA, 20 bp, Homo sapiens
acaagattttttaattgttt

SEQ ID NO: 712137 - DNA, 22 bp, Homo sapiens
acaagcaaggatatcagagctg

SEQ ID NO: 712138 - DNA, 11 bp, Homo sapiens
acaagcagagg

SEQ ID NO: 712139 - DNA, 15 bp, Homo sapiens
acaagcagtgtctgt

SEQ ID NO: 712140 - DNA, 17 bp, Homo sapiens
acaagcatatttgagaa

SEQ ID NO: 712141 - DNA, 14 bp, Homo sapiens
acaagcatgtctct

SEQ ID NO: 712142 - DNA, 22 bp, Homo sapiens
acaagcatgtctctctgccaag

SEQ ID NO: 712143 - DNA, 18 bp, Homo sapiens
acaagccaaaagtccctc

SEQ ID NO: 712144 - DNA, 23 bp, Homo sapiens
acaagccaaagagcctcccacca

SEQ ID NO: 712145 - DNA, 14 bp, Homo sapiens
acaagccaacttgt

SEQ ID NO: 712146 - DNA, 21 bp, Homo sapiens
acaagccaacttgtaaataca

SEQ ID NO: 712147 - DNA, 12 bp, Homo sapiens
acaagccacaga

SEQ ID NO: 712148 - DNA, 13 bp, Homo sapiens
acaagccagctgg

SEQ ID NO: 712149 - DNA, 15 bp, Homo sapiens
acaagccagctggag

SEQ ID NO: 712150 - DNA, 14 bp, Homo sapiens
acaagccccaggca

SEQ ID NO: 712151 - DNA, 15 bp, Homo sapiens
acaagccccaggcag

SEQ ID NO: 712152 - DNA, 16 bp, Homo sapiens
acaagccccaggcagg

SEQ ID NO: 712153 - DNA, 19 bp, Homo sapiens
acaagccctaacttctgta

SEQ ID NO: 712154 - DNA, 14 bp, Homo sapiens
acaagcctcttctg

SEQ ID NO: 712155 - DNA, 14 bp, Homo sapiens
acaagctaaaatta

SEQ ID NO: 712156 - DNA, 16 bp, Homo sapiens
acaagctaacttccac

SEQ ID NO: 712157 - DNA, 22 bp, Homo sapiens
acaagctaattgggagtccagg

SEQ ID NO: 712158 - DNA, 23 bp, Homo sapiens
acaagctaattgggagtccaggc

SEQ ID NO: 712159 - DNA, 13 bp, Homo sapiens
acaagctgcaccc

SEQ ID NO: 712160 - DNA, 21 bp, Homo sapiens
acaagctgcaccctcaggcag

SEQ ID NO: 712161 - DNA, 23 bp, Homo sapiens
acaagctgcaccctcaggcaggt

SEQ ID NO: 712162 - DNA, 16 bp, Homo sapiens
acaagctgcactgtga

SEQ ID NO: 712163 - DNA, 24 bp, Homo sapiens
acaagctgcctctgacagcagcct

SEQ ID NO: 712164 - DNA, 15 bp, Homo sapiens
acaagctggcttctg

SEQ ID NO: 712165 - DNA, 16 bp, Homo sapiens
acaagctggcttctgt

SEQ ID NO: 712166 - DNA, 18 bp, Homo sapiens
acaagctgtgcaggcatg

SEQ ID NO: 712167 - DNA, 19 bp, Homo sapiens
acaagcttaaagcttgatt

SEQ ID NO: 712168 - DNA, 16 bp, Homo sapiens
acaagcttcagtaagt

SEQ ID NO: 712169 - DNA, 19 bp, Homo sapiens
acaagcttcagtaagttat

SEQ ID NO: 712170 - DNA, 23 bp, Homo sapiens
acaagcttttagtatccacagga

SEQ ID NO: 712171 - DNA, 15 bp, Homo sapiens
acaaggaaccctcag

SEQ ID NO: 712172 - DNA, 13 bp, Homo sapiens
acaaggaataaat

SEQ ID NO: 712173 - DNA, 14 bp, Homo sapiens
acaaggaataaatg

SEQ ID NO: 712174 - DNA, 19 bp, Homo sapiens
acaaggaatgcctgtgcca

SEQ ID NO: 712175 - DNA, 20 bp, Homo sapiens
acaaggaatgcctgtgccaa

SEQ ID NO: 712176 - DNA, 20 bp, Homo sapiens
acaaggacagacagcaggca

SEQ ID NO: 712177 - DNA, 19 bp, Homo sapiens
acaaggcagcctgaacact

SEQ ID NO: 712178 - DNA, 18 bp, Homo sapiens
acaaggccccagagactc

SEQ ID NO: 712179 - DNA, 20 bp, Homo sapiens
acaaggctgaccaagagaga

SEQ ID NO: 712180 - DNA, 15 bp, Homo sapiens
acaaaagggccaggt

SEQ ID NO: 712181 - DNA, 13 bp, Homo sapiens
acaaaagggtgta

SEQ ID NO: 712182 - DNA, 15 bp, Homo sapiens
acaaaagggtgtata

SEQ ID NO: 712183 - DNA, 16 bp, Homo sapiens
acaaaagggtgtatag

SEQ ID NO: 712184 - DNA, 20 bp, Homo sapiens
acaaaagggtgtatagtgtt

SEQ ID NO: 712185 - DNA, 17 bp, Homo sapiens
acaaaagtacattgctt

SEQ ID NO: 712186 - DNA, 18 bp, Homo sapiens
acaaaagttttaattaaa

SEQ ID NO: 712187 - DNA, 12 bp, Homo sapiens
acaaaataaaca

SEQ ID NO: 712188 - DNA, 19 bp, Homo sapiens
acaaaatacaatcctgttt

SEQ ID NO: 712189 - DNA, 14 bp, Homo sapiens
acaaaatagaaagt

SEQ ID NO: 712190 - DNA, 12 bp, Homo sapiens
acaaaatagaag

SEQ ID NO: 712191 - DNA, 13 bp, Homo sapiens
acaaaatatttaa

SEQ ID NO: 712192 - DNA, 15 bp, Homo sapiens
acaaaatatttaagt

SEQ ID NO: 712193 - DNA, 19 bp, Homo sapiens
acaaaatccatgtgaccat

SEQ ID NO: 712194 - DNA, 17 bp, Homo sapiens
acaaaatccattccagg

SEQ ID NO: 712195 - DNA, 14 bp, Homo sapiens
acaaaatctcctct

SEQ ID NO: 712196 - DNA, 14 bp, Homo sapiens
acaaaatctgaact

SEQ ID NO: 712197 - DNA, 23 bp, Homo sapiens
acaaaatctgaactctcaaaagt

SEQ ID NO: 712198 - DNA, 11 bp, Homo sapiens
acaaaatgaaa

SEQ ID NO: 712199 - DNA, 15 bp, Homo sapiens
acaaaatgataatca

SEQ ID NO: 712200 - DNA, 16 bp, Homo sapiens
acaaaatgtagaatat

SEQ ID NO: 712201 - DNA, 22 bp, Homo sapiens
acaaaatgtagaatattcagac

SEQ ID NO: 712202 - DNA, 23 bp, Homo sapiens
acaaaatgtagaatattcagaca

SEQ ID NO: 712203 - DNA, 15 bp, Homo sapiens
acaaaattaatacat

SEQ ID NO: 712204 - DNA, 18 bp, Homo sapiens
acaaaattagaaaggaca

SEQ ID NO: 712205 - DNA, 15 bp, Homo sapiens
acaaaatttcacagt

SEQ ID NO: 712206 - DNA, 18 bp, Homo sapiens
acaaaatttcacagttct

SEQ ID NO: 712207 - DNA, 21 bp, Homo sapiens
acaaaatttgagaatacataa

SEQ ID NO: 712208 - DNA, 15 bp, Homo sapiens
acaaaattttatttt

SEQ ID NO: 712209 - DNA, 12 bp, Homo sapiens
acaaacaaaaaa

SEQ ID NO: 712210 - DNA, 14 bp, Homo sapiens
acaaacaaaactta

SEQ ID NO: 712211 - DNA, 15 bp, Homo sapiens
acaaacactgaatca

SEQ ID NO: 712212 - DNA, 20 bp, Homo sapiens
acaaacagggctgccttctg

SEQ ID NO: 712213 - DNA, 22 bp, Homo sapiens
acaaacatctaataagtatata

SEQ ID NO: 712214 - DNA, 11 bp, Homo sapiens
acaaacatgaa

SEQ ID NO: 712215 - DNA, 17 bp, Homo sapiens
acaaaccaccaggactg

SEQ ID NO: 712216 - DNA, 20 bp, Homo sapiens
aattggtgcttcagccctgg

SEQ ID NO: 712217 - DNA, 13 bp, Homo sapiens
aattggtgtatat

SEQ ID NO: 712218 - DNA, 21 bp, Homo sapiens
aattggttggagaatttaggt

SEQ ID NO: 712219 - DNA, 23 bp, Homo sapiens
aattggttgtttaacacttctgt

SEQ ID NO: 712220 - DNA, 19 bp, Homo sapiens
aattgtaacctgcattttt

SEQ ID NO: 712221 - DNA, 14 bp, Homo sapiens
aattgtaactgttc

SEQ ID NO: 712222 - DNA, 18 bp, Homo sapiens
aattgtaagtgaaattaa

SEQ ID NO: 712223 - DNA, 14 bp, Homo sapiens
aattgtaatggatt

SEQ ID NO: 712224 - DNA, 18 bp, Homo sapiens
aattgtacctatttctga

SEQ ID NO: 712225 - DNA, 13 bp, Homo sapiens
aattgtagctttt

SEQ ID NO: 712226 - DNA, 23 bp, Homo sapiens
aattgtagttctgtgtacttttt

SEQ ID NO: 712227 - DNA, 16 bp, Homo sapiens
aattgtataagtcaag

SEQ ID NO: 712228 - DNA, 21 bp, Homo sapiens
aattgtataagtcaagcacat

SEQ ID NO: 712229 - DNA, 21 bp, Homo sapiens
aattgtatacattttgttata

SEQ ID NO: 712230 - DNA, 18 bp, Homo sapiens
aattgtatcatttgaaca

SEQ ID NO: 712231 - DNA, 22 bp, Homo sapiens
aattgtatctcatactgtctgg

SEQ ID NO: 712232 - DNA, 20 bp, Homo sapiens
aattgtatcttattataaaa

SEQ ID NO: 712233 - DNA, 16 bp, Homo sapiens
aattgtattgaaaaca

SEQ ID NO: 712234 - DNA, 19 bp, Homo sapiens
aattgtattgaaaacactt

SEQ ID NO: 712235 - DNA, 20 bp, Homo sapiens
aattgtcagatcgttcattg

SEQ ID NO: 712236 - DNA, 13 bp, Homo sapiens
aattgtccccagt

SEQ ID NO: 712237 - DNA, 18 bp, Homo sapiens
aattgtccctgtttcaaa

SEQ ID NO: 712238 - DNA, 17 bp, Homo sapiens
aattgtcgggggagaga

SEQ ID NO: 712239 - DNA, 19 bp, Homo sapiens
aattgtcgtttttattcct

SEQ ID NO: 712240 - DNA, 19 bp, Homo sapiens
aattgtcttaaaaccagag

SEQ ID NO: 712241 - DNA, 12 bp, Homo sapiens
aattgtgaaaaa

SEQ ID NO: 712242 - DNA, 16 bp, Homo sapiens
aattgtgatgttttgt

SEQ ID NO: 712243 - DNA, 21 bp, Homo sapiens
aattgtgatgttttgttcaaa

SEQ ID NO: 712244 - DNA, 18 bp, Homo sapiens
aattgtgattagacagaa

SEQ ID NO: 712245 - DNA, 21 bp, Homo sapiens
aattgtgcagtactttgtgca

SEQ ID NO: 712246 - DNA, 12 bp, Homo sapiens
aattgtgctgcc

SEQ ID NO: 712247 - DNA, 18 bp, Homo sapiens
aattgtggctatcctgat

SEQ ID NO: 712248 - DNA, 15 bp, Homo sapiens
aattgtgtagccttt

SEQ ID NO: 712249 - DNA, 16 bp, Homo sapiens
aattgtgtagcctttt

SEQ ID NO: 712250 - DNA, 18 bp, Homo sapiens
aattgtgtatatatctta

SEQ ID NO: 712251 - DNA, 19 bp, Homo sapiens
aattgtgtattgatgcaat

SEQ ID NO: 712252 - DNA, 21 bp, Homo sapiens
aattgtgtattgatgcaatat

SEQ ID NO: 712253 - DNA, 19 bp, Homo sapiens
aattgtgtattttctttgg

SEQ ID NO: 712254 - DNA, 15 bp, Homo sapiens
aattgtgtggattct

SEQ ID NO: 712255 - DNA, 17 bp, Homo sapiens
aattgtgtgttaatgtc

SEQ ID NO: 712256 - DNA, 15 bp, Homo sapiens
aattgttatgaaaat

SEQ ID NO: 712257 - DNA, 23 bp, Homo sapiens
aattgttcgtttcatcaggctct

SEQ ID NO: 712258 - DNA, 20 bp, Homo sapiens
aattgttgaacaggtgtttt

SEQ ID NO: 712259 - DNA, 13 bp, Homo sapiens
aattgttgacagt

SEQ ID NO: 712260 - DNA, 20 bp, Homo sapiens
aattgttgacagttctgaag

SEQ ID NO: 712261 - DNA, 14 bp, Homo sapiens
aattgttgatattt

SEQ ID NO: 712262 - DNA, 21 bp, Homo sapiens
aattgttgattaatttgagaa

SEQ ID NO: 712263 - DNA, 23 bp, Homo sapiens
aattgttgctaatcttcttatgc

SEQ ID NO: 712264 - DNA, 14 bp, Homo sapiens
aattgttgttctgt

SEQ ID NO: 712265 - DNA, 17 bp, Homo sapiens
aattgttgtttgtatgt

SEQ ID NO: 712266 - DNA, 15 bp, Homo sapiens
aattgtttaagtgtt

SEQ ID NO: 712267 - DNA, 22 bp, Homo sapiens
aattgtttaccatagaaagatg

SEQ ID NO: 712268 - DNA, 14 bp, Homo sapiens
aattgtttatacac

SEQ ID NO: 712269 - DNA, 21 bp, Homo sapiens
aattgtttatgtgttatgaac

SEQ ID NO: 712270 - DNA, 14 bp, Homo sapiens
aattgtttcagaat

SEQ ID NO: 712271 - DNA, 21 bp, Homo sapiens
aattgtttcagtttttttaaa

SEQ ID NO: 712272 - DNA, 16 bp, Homo sapiens
aattgtttccaacttg

SEQ ID NO: 712273 - DNA, 21 bp, Homo sapiens
aattgtttgacggcaaggttt

SEQ ID NO: 712274 - DNA, 19 bp, Homo sapiens
aattgttttaaagagatac

SEQ ID NO: 712275 - DNA, 22 bp, Homo sapiens
aattgttttacctgttctgaaa

SEQ ID NO: 712276 - DNA, 14 bp, Homo sapiens
aattgttttcactt

SEQ ID NO: 712277 - DNA, 17 bp, Homo sapiens
aattgttttcacttgta

SEQ ID NO: 712278 - DNA, 18 bp, Homo sapiens
aattgttttcacttgtat

SEQ ID NO: 712279 - DNA, 17 bp, Homo sapiens
aattgtttttgaattta

SEQ ID NO: 712280 - DNA, 17 bp, Homo sapiens
aattgttttttaaagca

SEQ ID NO: 712281 - DNA, 19 bp, Homo sapiens
aattgttttttaaagcaag

SEQ ID NO: 712282 - DNA, 18 bp, Homo sapiens
aattgttttttaatttaa

SEQ ID NO: 712283 - DNA, 13 bp, Homo sapiens
aatttaaaaaata

SEQ ID NO: 712284 - DNA, 14 bp, Homo sapiens
aatttaaaaatata

SEQ ID NO: 712285 - DNA, 19 bp, Homo sapiens
aatttaaaataattatata

SEQ ID NO: 712286 - DNA, 17 bp, Homo sapiens
aatttaaaatatttccc

SEQ ID NO: 712287 - DNA, 23 bp, Homo sapiens
aatttaaaatccattttaggtga

SEQ ID NO: 712288 - DNA, 12 bp, Homo sapiens
aatttaaaatta

SEQ ID NO: 712289 - DNA, 13 bp, Homo sapiens
aatttaaaattaa

SEQ ID NO: 712290 - DNA, 18 bp, Homo sapiens
aatttaaaattaagtaga

SEQ ID NO: 712291 - DNA, 9 bp, Homo sapiens
aatttaaac

SEQ ID NO: 712292 - DNA, 10 bp, Homo sapiens
aatttaaaca

SEQ ID NO: 712293 - DNA, 16 bp, Homo sapiens
aatttaaacatttgtt

SEQ ID NO: 712294 - DNA, 20 bp, Homo sapiens
aatttaaacatttgttcctg

SEQ ID NO: 712295 - DNA, 21 bp, Homo sapiens
aatttaaacatttgttcctgg

SEQ ID NO: 712296 - DNA, 22 bp, Homo sapiens
aatttaaactataagcaagaag

SEQ ID NO: 712297 - DNA, 19 bp, Homo sapiens
aatttaaaggaaacactaa

SEQ ID NO: 712298 - DNA, 13 bp, Homo sapiens
aatttaaataaag

SEQ ID NO: 712299 - DNA, 16 bp, Homo sapiens
aatttaaatataattc

SEQ ID NO: 712300 - DNA, 15 bp, Homo sapiens
aatttaaatggcttt

SEQ ID NO: 712301 - DNA, 13 bp, Homo sapiens
aatttaaccataa

SEQ ID NO: 712302 - DNA, 18 bp, Homo sapiens
aatttaaccataaatcaa

SEQ ID NO: 712303 - DNA, 21 bp, Homo sapiens
aatttaagaaaacaagtatat

SEQ ID NO: 712304 - DNA, 13 bp, Homo sapiens
aatttaagcattg

SEQ ID NO: 712305 - DNA, 12 bp, Homo sapiens
aatttaaggcaa

SEQ ID NO: 712306 - DNA, 13 bp, Homo sapiens
aatttaaggcaaa

SEQ ID NO: 712307 - DNA, 19 bp, Homo sapiens
aatttaataaaaaggaata

SEQ ID NO: 712308 - DNA, 15 bp, Homo sapiens
aatttaatgctgcct

SEQ ID NO: 712309 - DNA, 17 bp, Homo sapiens
aatttaatgctgccttt

SEQ ID NO: 712310 - DNA, 22 bp, Homo sapiens
aatttaatggactgtgaatttc

SEQ ID NO: 712311 - DNA, 19 bp, Homo sapiens
aatttaatggatatttctc

SEQ ID NO: 712312 - DNA, 20 bp, Homo sapiens
aatttaattcctctttttag

SEQ ID NO: 712313 - DNA, 13 bp, Homo sapiens
aatttaattgctt

SEQ ID NO: 712314 - DNA, 17 bp, Homo sapiens
aatttaattgctttgaa

SEQ ID NO: 712315 - DNA, 16 bp, Homo sapiens
aatttacaaaaatata

SEQ ID NO: 712316 - DNA, 18 bp, Homo sapiens
aatttacaaaaatataaa

SEQ ID NO: 712317 - DNA, 15 bp, Homo sapiens
aatttacactgccat

SEQ ID NO: 712318 - DNA, 18 bp, Homo sapiens
aatttacagtcaatctat

SEQ ID NO: 712319 - DNA, 22 bp, Homo sapiens
aatttaccaaggatgaattctt

SEQ ID NO: 712320 - DNA, 20 bp, Homo sapiens
aatttcttcactgttgaaaa

SEQ ID NO: 712321 - DNA, 21 bp, Homo sapiens
aatttcttcactgttgaaaat

SEQ ID NO: 712322 - DNA, 12 bp, Homo sapiens
aatttcttcctt

SEQ ID NO: 712323 - DNA, 20 bp, Homo sapiens
aatttcttggtaagaagccg

SEQ ID NO: 712324 - DNA, 12 bp, Homo sapiens
aatttctttgtt

SEQ ID NO: 712325 - DNA, 12 bp, Homo sapiens
aatttcttttcc

SEQ ID NO: 712326 - DNA, 20 bp, Homo sapiens
aatttcttttccttcattca

SEQ ID NO: 712327 - DNA, 18 bp, Homo sapiens
aatttgaaaataattgtt

SEQ ID NO: 712328 - DNA, 14 bp, Homo sapiens
aatttgaaaatgtc

SEQ ID NO: 712329 - DNA, 19 bp, Homo sapiens
aatttgaataaaaatctta

SEQ ID NO: 712330 - DNA, 16 bp, Homo sapiens
aatttgaatgaaaaat

SEQ ID NO: 712331 - DNA, 17 bp, Homo sapiens
aatttgaattaaagttt

SEQ ID NO: 712332 - DNA, 16 bp, Homo sapiens
aatttgactaatttta

SEQ ID NO: 712333 - DNA, 17 bp, Homo sapiens
aatttgactaattttac

SEQ ID NO: 712334 - DNA, 19 bp, Homo sapiens
aatttgacttttctgtaat

SEQ ID NO: 712335 - DNA, 15 bp, Homo sapiens
aatttgagaattatt

SEQ ID NO: 712336 - DNA, 13 bp, Homo sapiens
aatttgaggacaa

SEQ ID NO: 712337 - DNA, 13 bp, Homo sapiens
aatttgagtgctc

SEQ ID NO: 712338 - DNA, 19 bp, Homo sapiens
aatttgagtgtatatatat

SEQ ID NO: 712339 - DNA, 20 bp, Homo sapiens
aatttgagtgtatatatatt

SEQ ID NO: 712340 - DNA, 14 bp, Homo sapiens
aatttgataaaaac

SEQ ID NO: 712341 - DNA, 19 bp, Homo sapiens
aatttgataaaaacccaaa

SEQ ID NO: 712342 - DNA, 19 bp, Homo sapiens
aatttgataaacattcctg

SEQ ID NO: 712343 - DNA, 14 bp, Homo sapiens
aatttgatacataa

SEQ ID NO: 712344 - DNA, 16 bp, Homo sapiens
aatttgatgaaagctg

SEQ ID NO: 712345 - DNA, 20 bp, Homo sapiens
aatttgattgactgcccatt

SEQ ID NO: 712346 - DNA, 13 bp, Homo sapiens
aatcccatttctt

SEQ ID NO: 712347 - DNA, 22 bp, Homo sapiens
aatccccaagtgcctgcttttg

SEQ ID NO: 712348 - DNA, 11 bp, Homo sapiens
aatccccagcc

SEQ ID NO: 712349 - DNA, 13 bp, Homo sapiens
aatccccagccta

SEQ ID NO: 712350 - DNA, 20 bp, Homo sapiens
aatcccctcagcctcttctc

SEQ ID NO: 712351 - DNA, 21 bp, Homo sapiens
aatcccctccctgtcaaagct

SEQ ID NO: 712352 - DNA, 19 bp, Homo sapiens
aatcccctccttgggcact

SEQ ID NO: 712353 - DNA, 21 bp, Homo sapiens
aatcccgtgcccctttccttc

SEQ ID NO: 712354 - DNA, 23 bp, Homo sapiens
aatccctagggctggcagaaagg

SEQ ID NO: 712355 - DNA, 19 bp, Homo sapiens
aatccctgggcattgcttt

SEQ ID NO: 712356 - DNA, 21 bp, Homo sapiens
aatccctgggcattgctttcc

SEQ ID NO: 712357 - DNA, 15 bp, Homo sapiens
aatcccttaaaatta

SEQ ID NO: 712358 - DNA, 20 bp, Homo sapiens
aatccgaagggaattaaaaa

SEQ ID NO: 712359 - DNA, 17 bp, Homo sapiens
aatccgctctcttcctg

SEQ ID NO: 712360 - DNA, 18 bp, Homo sapiens
aatccgctctcttcctgc

SEQ ID NO: 712361 - DNA, 19 bp, Homo sapiens
aatccgctctcttcctgcc

SEQ ID NO: 712362 - DNA, 23 bp, Homo sapiens
aatccgggacacctgggccgggc

SEQ ID NO: 712363 - DNA, 24 bp, Homo sapiens
aatcctaatttctcctcccttcct

SEQ ID NO: 712364 - DNA, 15 bp, Homo sapiens
aatcctaccccctct

SEQ ID NO: 712365 - DNA, 17 bp, Homo sapiens
aatcctaccttgctttt

SEQ ID NO: 712366 - DNA, 14 bp, Homo sapiens
aatcctagagtctt

SEQ ID NO: 712367 - DNA, 15 bp, Homo sapiens
aatcctatatctgtt

SEQ ID NO: 712368 - DNA, 16 bp, Homo sapiens
aatcctatctggggag

SEQ ID NO: 712369 - DNA, 21 bp, Homo sapiens
aatcctcccaaccaaccagca

SEQ ID NO: 712370 - DNA, 18 bp, Homo sapiens
aatcctccctacttccaa

SEQ ID NO: 712371 - DNA, 13 bp, Homo sapiens
aatcctcctgcct

SEQ ID NO: 712372 - DNA, 16 bp, Homo sapiens
aatcctcctgcctcag

SEQ ID NO: 712373 - DNA, 17 bp, Homo sapiens
aatcctctgtaaaaaga

SEQ ID NO: 712374 - DNA, 16 bp, Homo sapiens
aatcctgccatttaaa

SEQ ID NO: 712375 - DNA, 19 bp, Homo sapiens
aatcctggtaaccaaatat

SEQ ID NO: 712376 - DNA, 21 bp, Homo sapiens
aatcctgtcgattagactgga

SEQ ID NO: 712377 - DNA, 19 bp, Homo sapiens
aatcctgtcggtctccagt

SEQ ID NO: 712378 - DNA, 20 bp, Homo sapiens
aatccttcaaaataaaaagt

SEQ ID NO: 712379 - DNA, 19 bp, Homo sapiens
aatctgtagggctggacct

SEQ ID NO: 712380 - DNA, 22 bp, Homo sapiens
aatctgtagggctggacctatg

SEQ ID NO: 712381 - DNA, 18 bp, Homo sapiens
aatctgtatatgttgtaa

SEQ ID NO: 712382 - DNA, 22 bp, Homo sapiens
aatctgtatatgttgtaataaa

SEQ ID NO: 712383 - DNA, 23 bp, Homo sapiens
aatctgtatatgttgtaataaaa

SEQ ID NO: 712384 - DNA, 20 bp, Homo sapiens
aatctgtatctgtagtgaga

SEQ ID NO: 712385 - DNA, 18 bp, Homo sapiens
aatctgtcaaaacactgt

SEQ ID NO: 712386 - DNA, 22 bp, Homo sapiens
aatctgtcacgtagaacttgga

SEQ ID NO: 712387 - DNA, 14 bp, Homo sapiens
aatctgtcctctgt

SEQ ID NO: 712388 - DNA, 15 bp, Homo sapiens
aatctgtcctctgta

SEQ ID NO: 712389 - DNA, 17 bp, Homo sapiens
aatctgtcctctgtagt

SEQ ID NO: 712390 - DNA, 12 bp, Homo sapiens
aatctgtgatga

SEQ ID NO: 712391 - DNA, 15 bp, Homo sapiens
aatctgtgcaaacag

SEQ ID NO: 712392 - DNA, 20 bp, Homo sapiens
aatctgtgtacaaagaaata

SEQ ID NO: 712393 - DNA, 20 bp, Homo sapiens
aatctgtgtgaaactttcat

SEQ ID NO: 712394 - DNA, 21 bp, Homo sapiens
aatctgtgtgcatatttgtta

SEQ ID NO: 712395 - DNA, 23 bp, Homo sapiens
aatctgtttcaacagatgaccgt

SEQ ID NO: 712396 - DNA, 20 bp, Homo sapiens
aatctgtttcaggtttccat

SEQ ID NO: 712397 - DNA, 18 bp, Homo sapiens
aatctgtttctctgctgt

SEQ ID NO: 712398 - DNA, 23 bp, Homo sapiens
aatctgtttctctgctgtcaact

SEQ ID NO: 712399 - DNA, 12 bp, Homo sapiens
aatctgtttgtg

SEQ ID NO: 712400 - DNA, 13 bp, Homo sapiens
aatctgtttgtgc

SEQ ID NO: 712401 - DNA, 15 bp, Homo sapiens
aatctgtttgtgcaa

SEQ ID NO: 712402 - DNA, 12 bp, Homo sapiens
aatctgttttgg

SEQ ID NO: 712403 - DNA, 13 bp, Homo sapiens
aatctgttttgta

SEQ ID NO: 712404 - DNA, 17 bp, Homo sapiens
aatcttaaacaatgtat

SEQ ID NO: 712405 - DNA, 20 bp, Homo sapiens
aatcttaaggtctaactgtg

SEQ ID NO: 712406 - DNA, 14 bp, Homo sapiens
aatcttaatgttcc

SEQ ID NO: 712407 - DNA, 22 bp, Homo sapiens
aatcttacaaaatcctggaaga

SEQ ID NO: 712408 - DNA, 24 bp, Homo sapiens
aatcttacaaaatcctggaagatt

SEQ ID NO: 712409 - DNA, 22 bp, Homo sapiens
aatcttagataacttcttgaaa

SEQ ID NO: 712410 - DNA, 19 bp, Homo sapiens
aatcttaggggagagcttt

SEQ ID NO: 712411 - DNA, 22 bp, Homo sapiens
aatcttagtatagtagaaagac

SEQ ID NO: 712412 - DNA, 23 bp, Homo sapiens
aatcttagtatagtagaaagaca

SEQ ID NO: 712413 - DNA, 13 bp, Homo sapiens
aatcttataaaaa

SEQ ID NO: 712414 - DNA, 15 bp, Homo sapiens
aatcttataattgtt

SEQ ID NO: 712415 - DNA, 20 bp, Homo sapiens
aatcttatcttttggcttct

SEQ ID NO: 712416 - DNA, 17 bp, Homo sapiens
aatcttatgtttccaag

SEQ ID NO: 712417 - DNA, 20 bp, Homo sapiens
aatcttattccgagcattcc

SEQ ID NO: 712418 - DNA, 15 bp, Homo sapiens
aatcttcacctcaga

SEQ ID NO: 712419 - DNA, 22 bp, Homo sapiens
aatcttcagttttatctttaat

SEQ ID NO: 712420 - DNA, 17 bp, Homo sapiens
aatcttctcatctttta

SEQ ID NO: 712421 - DNA, 13 bp, Homo sapiens
aatcttgaaaatg

SEQ ID NO: 712422 - DNA, 14 bp, Homo sapiens
aatcttgaatttct

SEQ ID NO: 712423 - DNA, 15 bp, Homo sapiens
aatcttgaatttctg

SEQ ID NO: 712424 - DNA, 21 bp, Homo sapiens
aatcttgcagttttgtaagcc

SEQ ID NO: 712425 - DNA, 14 bp, Homo sapiens
aatcttgcttcaga

SEQ ID NO: 712426 - DNA, 15 bp, Homo sapiens
aatcttgctttcttt

SEQ ID NO: 712427 - DNA, 16 bp, Homo sapiens
aatcttgctttcttta

SEQ ID NO: 712428 - DNA, 16 bp, Homo sapiens
aatcttggcttcttaa

SEQ ID NO: 712429 - DNA, 19 bp, Homo sapiens
aatcttggcttcttaaaaa

SEQ ID NO: 712430 - DNA, 22 bp, Homo sapiens
aatcttgttactgctgattctt

SEQ ID NO: 712431 - DNA, 21 bp, Homo sapiens
aatcttgttattgaagtgttc

SEQ ID NO: 712432 - DNA, 15 bp, Homo sapiens
aatctttacctgtat

SEQ ID NO: 712433 - DNA, 18 bp, Homo sapiens
aatctttacctgtataca

SEQ ID NO: 712434 - DNA, 23 bp, Homo sapiens
aatctttacctgtatacagtgca

SEQ ID NO: 712435 - DNA, 21 bp, Homo sapiens
aatctttagagaagtatacat

SEQ ID NO: 712436 - DNA, 22 bp, Homo sapiens
aatctttagagaagtatacata

SEQ ID NO: 712437 - DNA, 16 bp, Homo sapiens
aatctttataaatgta

SEQ ID NO: 712438 - DNA, 15 bp, Homo sapiens
aatctttattgagaa

SEQ ID NO: 712439 - DNA, 13 bp, Homo sapiens
aatctttcataca

SEQ ID NO: 712440 - DNA, 15 bp, Homo sapiens
aatctttcatacata

SEQ ID NO: 712441 - DNA, 15 bp, Homo sapiens
aatctttctatataa

SEQ ID NO: 712442 - DNA, 13 bp, Homo sapiens
aatctttctcctg

SEQ ID NO: 712443 - DNA, 16 bp, Homo sapiens
aatctttctgtaaaca

SEQ ID NO: 712444 - DNA, 19 bp, Homo sapiens
aatctttctttacctgaga

SEQ ID NO: 712445 - DNA, 19 bp, Homo sapiens
aatctttgttgaagtttga

SEQ ID NO: 712446 - DNA, 12 bp, Homo sapiens
aatcttttacaa

SEQ ID NO: 712447 - DNA, 21 bp, Homo sapiens
aatcttttacaactgcctcga

SEQ ID NO: 712448 - DNA, 14 bp, Homo sapiens
aatcttttcttatt

SEQ ID NO: 712449 - DNA, 15 bp, Homo sapiens
aatctttttctccac

SEQ ID NO: 712450 - DNA, 19 bp, Homo sapiens
aatctttttgcttctactt

SEQ ID NO: 712451 - DNA, 20 bp, Homo sapiens
aatctttttgcttctacttt

SEQ ID NO: 712452 - DNA, 20 bp, Homo sapiens
aatcttttttttatataaat

SEQ ID NO: 712453 - DNA, 17 bp, Homo sapiens
aatgaaaaaaaaaaaca

SEQ ID NO: 712454 - DNA, 19 bp, Homo sapiens
aatgaaaaaaaaaaacaat

SEQ ID NO: 712455 - DNA, 14 bp, Homo sapiens
aatgaaaaaatgta

SEQ ID NO: 712456 - DNA, 19 bp, Homo sapiens
aatgaaaaacaaaaagcta

SEQ ID NO: 712457 - DNA, 17 bp, Homo sapiens
aatgaaaaatacatatt

SEQ ID NO: 712458 - DNA, 16 bp, Homo sapiens
aatgaaaaatataatg

SEQ ID NO: 712459 - DNA, 18 bp, Homo sapiens
aatgaaaaatataatgtt

SEQ ID NO: 712460 - DNA, 14 bp, Homo sapiens
aatgaaaaattctc

SEQ ID NO: 712461 - DNA, 17 bp, Homo sapiens
aatgaaaaatttaagca

SEQ ID NO: 712462 - DNA, 18 bp, Homo sapiens
aatgaaaaatttaagcat

SEQ ID NO: 712463 - DNA, 16 bp, Homo sapiens
aatgaaaacaatgcag

SEQ ID NO: 712464 - DNA, 18 bp, Homo sapiens
aatgaaaacattttattt

SEQ ID NO: 712465 - DNA, 19 bp, Homo sapiens
aatgaaaacattttatttt

SEQ ID NO: 712466 - DNA, 15 bp, Homo sapiens
aatgaaaaggaagtt

SEQ ID NO: 712467 - DNA, 21 bp, Homo sapiens
aatgaaaataaaacacacctc

SEQ ID NO: 712468 - DNA, 13 bp, Homo sapiens
aatgaaaatgaat

SEQ ID NO: 712469 - DNA, 16 bp, Homo sapiens
aatgaaaatgaatatc

SEQ ID NO: 712470 - DNA, 16 bp, Homo sapiens
aatgaaaatgcagtcc

SEQ ID NO: 712471 - DNA, 12 bp, Homo sapiens
aatgaaaatgtc

SEQ ID NO: 712472 - DNA, 17 bp, Homo sapiens
aatgaacatctcttgaa

SEQ ID NO: 712473 - DNA, 18 bp, Homo sapiens
aatgaacatctcttgaaa

SEQ ID NO: 712474 - DNA, 12 bp, Homo sapiens
aatgaacatttt

SEQ ID NO: 712475 - DNA, 16 bp, Homo sapiens
aatgaacctgatcact

SEQ ID NO: 712476 - DNA, 14 bp, Homo sapiens
aatgaactgaagtt

SEQ ID NO: 712477 - DNA, 15 bp, Homo sapiens
aatgaacttttacag

SEQ ID NO: 712478 - DNA, 16 bp, Homo sapiens
aatgaacttttacaga

SEQ ID NO: 712479 - DNA, 22 bp, Homo sapiens
aatgaacttttacagaatgcat

SEQ ID NO: 712480 - DNA, 14 bp, Homo sapiens
aatgaagaaagtca

SEQ ID NO: 712481 - DNA, 23 bp, Homo sapiens
aatgaagaaagtcaaaaaattat

SEQ ID NO: 712482 - DNA, 19 bp, Homo sapiens
aatgaagcagctttaaaca

SEQ ID NO: 712483 - DNA, 21 bp, Homo sapiens
aatgaaggttaggatttaaca

SEQ ID NO: 712484 - DNA, 22 bp, Homo sapiens
aatgaaggttaggatttaacag

SEQ ID NO: 712485 - DNA, 14 bp, Homo sapiens
aatgaagtgattct

SEQ ID NO: 712486 - DNA, 10 bp, Homo sapiens
aatgaataat

SEQ ID NO: 712487 - DNA, 15 bp, Homo sapiens
aatgaataataatta

SEQ ID NO: 712488 - DNA, 19 bp, Homo sapiens
aatgaataatgcctttgta

SEQ ID NO: 712489 - DNA, 15 bp, Homo sapiens
aatgaataatggaaa

SEQ ID NO: 712490 - DNA, 21 bp, Homo sapiens
aatgaataatggaaaatgcca

SEQ ID NO: 712491 - DNA, 23 bp, Homo sapiens
aatgaatagcttgtttctgtcaa

SEQ ID NO: 712492 - DNA, 18 bp, Homo sapiens
aatgaatatctattaata

SEQ ID NO: 712493 - DNA, 20 bp, Homo sapiens
aatgaatatctattaatata

SEQ ID NO: 712494 - DNA, 17 bp, Homo sapiens
aatgaatgaatggcttg

SEQ ID NO: 712495 - DNA, 14 bp, Homo sapiens
aatgaattataaca

SEQ ID NO: 712496 - DNA, 18 bp, Homo sapiens
aatgaattataacagtta

SEQ ID NO: 712497 - DNA, 21 bp, Homo sapiens
aatgaattcctagaattaaac

SEQ ID NO: 712498 - DNA, 17 bp, Homo sapiens
aatgaatttatctttac

SEQ ID NO: 712499 - DNA, 18 bp, Homo sapiens
aatgaatttatctttacc

SEQ ID NO: 712500 - DNA, 11 bp, Homo sapiens
aatgaatttgg

SEQ ID NO: 712501 - DNA, 17 bp, Homo sapiens
aatgaatttttatgata

SEQ ID NO: 712502 - DNA, 13 bp, Homo sapiens
aatgacaacactt

SEQ ID NO: 712503 - DNA, 15 bp, Homo sapiens
aatgacaacagaagc

SEQ ID NO: 712504 - DNA, 16 bp, Homo sapiens
aatgacaacagaagct

SEQ ID NO: 712505 - DNA, 13 bp, Homo sapiens
aatgacaatatca

SEQ ID NO: 712506 - DNA, 13 bp, Homo sapiens
aatgacacagtct

SEQ ID NO: 712507 - DNA, 14 bp, Homo sapiens
aatgacacccagac

SEQ ID NO: 712508 - DNA, 16 bp, Homo sapiens
aatgacacccagacct

SEQ ID NO: 712509 - DNA, 11 bp, Homo sapiens
aatgacactgt

SEQ ID NO: 712510 - DNA, 16 bp, Homo sapiens
aatgacagatgcaagt

SEQ ID NO: 712511 - DNA, 13 bp, Homo sapiens
aatgacagatggt

SEQ ID NO: 712512 - DNA, 16 bp, Homo sapiens
aatgacagattctgac

SEQ ID NO: 712513 - DNA, 17 bp, Homo sapiens
aatgacagattctgaca

SEQ ID NO: 712514 - DNA, 22 bp, Homo sapiens
aatgacagtccgtcaaaacaga

SEQ ID NO: 712515 - DNA, 13 bp, Homo sapiens
aatgacatcttca

SEQ ID NO: 712516 - DNA, 18 bp, Homo sapiens
aatgacatgttcctttaa

SEQ ID NO: 712517 - DNA, 23 bp, Homo sapiens
aatgacattaaatgcaataattt

SEQ ID NO: 712518 - DNA, 18 bp, Homo sapiens
aatgaccaacgaaattgt

SEQ ID NO: 712519 - DNA, 14 bp, Homo sapiens
aatgaccaatatta

SEQ ID NO: 712520 - DNA, 14 bp, Homo sapiens
aatgaccagcagca

SEQ ID NO: 712521 - DNA, 18 bp, Homo sapiens
aatgacccagacccaact

SEQ ID NO: 712522 - DNA, 18 bp, Homo sapiens
aatgaccgctctcccttt

SEQ ID NO: 712523 - DNA, 22 bp, Homo sapiens
aatgaccttcattctgagacca

SEQ ID NO: 712524 - DNA, 22 bp, Homo sapiens
aatgacggtaagtgttctcatg

SEQ ID NO: 712525 - DNA, 23 bp, Homo sapiens
aatgacggtaagtgttctcatga

SEQ ID NO: 712526 - DNA, 24 bp, Homo sapiens
aatgacggtaagtgttctcatgaa

SEQ ID NO: 712527 - DNA, 23 bp, Homo sapiens
aatgactatataatttatttcca

SEQ ID NO: 712528 - DNA, 21 bp, Homo sapiens
aatgactccaccttctcacct

SEQ ID NO: 712529 - DNA, 13 bp, Homo sapiens
aatgactgaaaga

SEQ ID NO: 712530 - DNA, 17 bp, Homo sapiens
aatgacttactgtacat

SEQ ID NO: 712531 - DNA, 16 bp, Homo sapiens
aatgacttagaaactg

SEQ ID NO: 712532 - DNA, 22 bp, Homo sapiens
aatgacttatttctgctctgga

SEQ ID NO: 712533 - DNA, 23 bp, Homo sapiens
aatgacttatttctgctctggaa

SEQ ID NO: 712534 - DNA, 19 bp, Homo sapiens
aatgacttctaatttatat

SEQ ID NO: 712535 - DNA, 15 bp, Homo sapiens
aatgactttatacaa

SEQ ID NO: 712536 - DNA, 19 bp, Homo sapiens
aatgagaattttatattct

SEQ ID NO: 712537 - DNA, 12 bp, Homo sapiens
aatgagagcata

SEQ ID NO: 712538 - DNA, 23 bp, Homo sapiens
aatgagagggcagtgtttccttt

SEQ ID NO: 712539 - DNA, 17 bp, Homo sapiens
aatgagatcccgcctct

SEQ ID NO: 712540 - DNA, 14 bp, Homo sapiens
aatgagcccagaga

SEQ ID NO: 712541 - DNA, 19 bp, Homo sapiens
aatgagccctggctcccac

SEQ ID NO: 712542 - DNA, 12 bp, Homo sapiens
aatgagcctggc

SEQ ID NO: 712543 - DNA, 22 bp, Homo sapiens
aatgagctcgcatttgtcaatg

SEQ ID NO: 712544 - DNA, 19 bp, Homo sapiens
aatgagctgtatctgtaat

SEQ ID NO: 712545 - DNA, 15 bp, Homo sapiens
aatgaggaagcaaag

SEQ ID NO: 712546 - DNA, 14 bp, Homo sapiens
aatgaggaatccaa

SEQ ID NO: 712547 - DNA, 16 bp, Homo sapiens
aatgaggacatgtttt

SEQ ID NO: 712548 - DNA, 16 bp, Homo sapiens
aatgaggacttcaagc

SEQ ID NO: 712549 - DNA, 19 bp, Homo sapiens
aatgaggaggtacattgaa

SEQ ID NO: 712550 - DNA, 15 bp, Homo sapiens
aatgaggattattga

SEQ ID NO: 712551 - DNA, 17 bp, Homo sapiens
aatgaggattattgata

SEQ ID NO: 712552 - DNA, 18 bp, Homo sapiens
aatgagggccaagaaaga

SEQ ID NO: 712553 - DNA, 15 bp, Homo sapiens
aatgaggtcagcatg

SEQ ID NO: 712554 - DNA, 16 bp, Homo sapiens
aatgaggtctgtttaa

SEQ ID NO: 712555 - DNA, 22 bp, Homo sapiens
aatgaggtttttccaaacttag

SEQ ID NO: 712556 - DNA, 14 bp, Homo sapiens
aatgagtaaatggt

SEQ ID NO: 712557 - DNA, 12 bp, Homo sapiens
aatgagtaacat

SEQ ID NO: 712558 - DNA, 14 bp, Homo sapiens
aatgagtggccagc

SEQ ID NO: 712559 - DNA, 15 bp, Homo sapiens
aatgagtggccagcg

SEQ ID NO: 712560 - DNA, 21 bp, Homo sapiens
aatgagtttttatggggctga

SEQ ID NO: 712561 - DNA, 20 bp, Homo sapiens
aatgataaaataaataattt

SEQ ID NO: 712562 - DNA, 21 bp, Homo sapiens
aatgataaaataaataatttt

SEQ ID NO: 712563 - DNA, 19 bp, Homo sapiens
aatgataaactcagatctg

SEQ ID NO: 712564 - DNA, 15 bp, Homo sapiens
aatgataaagacttt

SEQ ID NO: 712565 - DNA, 15 bp, Homo sapiens
aatgatactgtgtgt

SEQ ID NO: 712566 - DNA, 17 bp, Homo sapiens
aatgatagcccagaaca

SEQ ID NO: 712567 - DNA, 18 bp, Homo sapiens
aatgatagtaagaaaagt

SEQ ID NO: 712568 - DNA, 15 bp, Homo sapiens
aatgatatgcttgta

SEQ ID NO: 712569 - DNA, 22 bp, Homo sapiens
aatgatcacatctaaagcttta

SEQ ID NO: 712570 - DNA, 23 bp, Homo sapiens
aatgatcaccatgttagccttag

SEQ ID NO: 712571 - DNA, 17 bp, Homo sapiens
aatgatcagcatctgtg

SEQ ID NO: 712572 - DNA, 19 bp, Homo sapiens
aataaaactgcacagtgct

SEQ ID NO: 712573 - DNA, 12 bp, Homo sapiens
aataaaactgtc

SEQ ID NO: 712574 - DNA, 22 bp, Homo sapiens
aataaaacttatgctagtttat

SEQ ID NO: 712575 - DNA, 13 bp, Homo sapiens
aataaaacttcac

SEQ ID NO: 712576 - DNA, 13 bp, Homo sapiens
aataaaactttcc

SEQ ID NO: 712577 - DNA, 12 bp, Homo sapiens
aataaaactttt

SEQ ID NO: 712578 - DNA, 15 bp, Homo sapiens
aataaaactttttaa

SEQ ID NO: 712579 - DNA, 12 bp, Homo sapiens
aataaaagaaca

SEQ ID NO: 712580 - DNA, 13 bp, Homo sapiens
aataaaagaacat

SEQ ID NO: 712581 - DNA, 14 bp, Homo sapiens
aataaaagagctgt

SEQ ID NO: 712582 - DNA, 16 bp, Homo sapiens
aataaaagagctgtct

SEQ ID NO: 712583 - DNA, 13 bp, Homo sapiens
aataaaagagctt

SEQ ID NO: 712584 - DNA, 18 bp, Homo sapiens
aataaaagcagcatctgc

SEQ ID NO: 712585 - DNA, 20 bp, Homo sapiens
aataaaagctataaagtata

SEQ ID NO: 712586 - DNA, 20 bp, Homo sapiens
aataaaaggaagccaaagag

SEQ ID NO: 712587 - DNA, 22 bp, Homo sapiens
aataaaagtgaagtgaatctga

SEQ ID NO: 712588 - DNA, 13 bp, Homo sapiens
aataaaagtgact

SEQ ID NO: 712589 - DNA, 14 bp, Homo sapiens
aataaaagttcctc

SEQ ID NO: 712590 - DNA, 17 bp, Homo sapiens
aataaaagtttacaact

SEQ ID NO: 712591 - DNA, 12 bp, Homo sapiens
aataaaataacc

SEQ ID NO: 712592 - DNA, 15 bp, Homo sapiens
aataaaatatatctt

SEQ ID NO: 712593 - DNA, 19 bp, Homo sapiens
aataaaatatcataaagca

SEQ ID NO: 712594 - DNA, 19 bp, Homo sapiens
aataaaatgaggacatgtt

SEQ ID NO: 712595 - DNA, 21 bp, Homo sapiens
aataaaatgccatagtttgtg

SEQ ID NO: 712596 - DNA, 14 bp, Homo sapiens
aataaaatgcctca

SEQ ID NO: 712597 - DNA, 18 bp, Homo sapiens
aataaaatggtacatttc

SEQ ID NO: 712598 - DNA, 14 bp, Homo sapiens
aataaaatgtgatt

SEQ ID NO: 712599 - DNA, 21 bp, Homo sapiens
aataaaatgtgatttttctga

SEQ ID NO: 712600 - DNA, 16 bp, Homo sapiens
aataaaatgtgtacag

SEQ ID NO: 712601 - DNA, 17 bp, Homo sapiens
aataaaatgtgtacagt

SEQ ID NO: 712602 - DNA, 18 bp, Homo sapiens
aataaaatgtgtacagtg

SEQ ID NO: 712603 - DNA, 21 bp, Homo sapiens
aataaaatgtgtacagtgaat

SEQ ID NO: 712604 - DNA, 19 bp, Homo sapiens
aataaaatgtttcattatg

SEQ ID NO: 712605 - DNA, 19 bp, Homo sapiens
aataaaattcaacaaacat

SEQ ID NO: 712606 - DNA, 15 bp, Homo sapiens
aataaaattggcacc

SEQ ID NO: 712607 - DNA, 12 bp, Homo sapiens
aataaaatttcc

SEQ ID NO: 712608 - DNA, 13 bp, Homo sapiens
aataaaatttgtt

SEQ ID NO: 712609 - DNA, 21 bp, Homo sapiens
aataaacacatagattcacct

SEQ ID NO: 712610 - DNA, 23 bp, Homo sapiens
aataaacaggaattttattttgc

SEQ ID NO: 712611 - DNA, 20 bp, Homo sapiens
aataaacagtgagcatatct

SEQ ID NO: 712612 - DNA, 13 bp, Homo sapiens
aataaacatcctt

SEQ ID NO: 712613 - DNA, 23 bp, Homo sapiens
aataaacatgtcacaatacagta

SEQ ID NO: 712614 - DNA, 13 bp, Homo sapiens
aataaacattaat

SEQ ID NO: 712615 - DNA, 21 bp, Homo sapiens
aataaacattaattttgtgca

SEQ ID NO: 712616 - DNA, 23 bp, Homo sapiens
aataaacattaattttgtgcatt

SEQ ID NO: 712617 - DNA, 18 bp, Homo sapiens
aataaaccaaaggaaaat

SEQ ID NO: 712618 - DNA, 21 bp, Homo sapiens
aataaaccattggacagattt

SEQ ID NO: 712619 - DNA, 15 bp, Homo sapiens
aataaacctgcactg

SEQ ID NO: 712620 - DNA, 18 bp, Homo sapiens
aataaacctgggctcagc

SEQ ID NO: 712621 - DNA, 12 bp, Homo sapiens
aataaactacac

SEQ ID NO: 712622 - DNA, 23 bp, Homo sapiens
aatggtaaaataaaatgcctcag

SEQ ID NO: 712623 - DNA, 22 bp, Homo sapiens
aatggtaactgcacctgggcag

SEQ ID NO: 712624 - DNA, 18 bp, Homo sapiens
aatggtatcaaaattaca

SEQ ID NO: 712625 - DNA, 12 bp, Homo sapiens
aatggtatcttt

SEQ ID NO: 712626 - DNA, 16 bp, Homo sapiens
aatggtattgtaacta

SEQ ID NO: 712627 - DNA, 22 bp, Homo sapiens
aatggtcacgtttggtgcttct

SEQ ID NO: 712628 - DNA, 13 bp, Homo sapiens
aatggtccagggt

SEQ ID NO: 712629 - DNA, 18 bp, Homo sapiens
aatggtcccaattaagaa

SEQ ID NO: 712630 - DNA, 22 bp, Homo sapiens
aatggtctttctaatgtgtgaa

SEQ ID NO: 712631 - DNA, 14 bp, Homo sapiens
aatggtctttgctc

SEQ ID NO: 712632 - DNA, 20 bp, Homo sapiens
aatggtgatttaaaaacttg

SEQ ID NO: 712633 - DNA, 12 bp, Homo sapiens
aatggtgcaaaa

SEQ ID NO: 712634 - DNA, 22 bp, Homo sapiens
aatggtgcaaaaaaaaacttaa

SEQ ID NO: 712635 - DNA, 15 bp, Homo sapiens
aatggtgcttccccc

SEQ ID NO: 712636 - DNA, 22 bp, Homo sapiens
aatggtggggaactataaagaa

SEQ ID NO: 712637 - DNA, 21 bp, Homo sapiens
aatggtggtcttctccaccag

SEQ ID NO: 712638 - DNA, 18 bp, Homo sapiens
aatggtgtcatggctgaa

SEQ ID NO: 712639 - DNA, 20 bp, Homo sapiens
aatggtgtctcttttatgtt

SEQ ID NO: 712640 - DNA, 18 bp, Homo sapiens
aatggtgttacattaaag

SEQ ID NO: 712641 - DNA, 22 bp, Homo sapiens
aatggtgttttgtcagacttcc

SEQ ID NO: 712642 - DNA, 22 bp, Homo sapiens
aatggttaaattttacatgaca

SEQ ID NO: 712643 - DNA, 23 bp, Homo sapiens
aatggttaaattttacatgacag

SEQ ID NO: 712644 - DNA, 23 bp, Homo sapiens
aatggttaataaaactgcacagt

SEQ ID NO: 712645 - DNA, 20 bp, Homo sapiens
aatggttaatttttcctgca

SEQ ID NO: 712646 - DNA, 17 bp, Homo sapiens
aatggttgatgatactt

SEQ ID NO: 712647 - DNA, 17 bp, Homo sapiens
aatggttgatggaaaat

SEQ ID NO: 712648 - DNA, 15 bp, Homo sapiens
aatggttgccttaaa

SEQ ID NO: 712649 - DNA, 18 bp, Homo sapiens
aatggttgccttaaagaa

SEQ ID NO: 712650 - DNA, 14 bp, Homo sapiens
aatggttgggacaa

SEQ ID NO: 712651 - DNA, 18 bp, Homo sapiens
aatggttgggacaatggc

SEQ ID NO: 712652 - DNA, 19 bp, Homo sapiens
aatggttgggacaatggca

SEQ ID NO: 712653 - DNA, 18 bp, Homo sapiens
aatggttggtttttgtgt

SEQ ID NO: 712654 - DNA, 22 bp, Homo sapiens
aatggttgtgaaatgtaacatg

SEQ ID NO: 712655 - DNA, 14 bp, Homo sapiens
aatggtttcctctg

SEQ ID NO: 712656 - DNA, 20 bp, Homo sapiens
aatggtttctcattaaactc

SEQ ID NO: 712657 - DNA, 21 bp, Homo sapiens
aatggtttctgaaaatgttta

SEQ ID NO: 712658 - DNA, 17 bp, Homo sapiens
aatggtttggtgctttt

SEQ ID NO: 712659 - DNA, 14 bp, Homo sapiens
aatggtttgtgtca

SEQ ID NO: 712660 - DNA, 17 bp, Homo sapiens
aatgtaaaaaagaaaaa

SEQ ID NO: 712661 - DNA, 19 bp, Homo sapiens
aatgtaaaaagatctacat

SEQ ID NO: 712662 - DNA, 17 bp, Homo sapiens
aatgtaaaaatgaagga

SEQ ID NO: 712663 - DNA, 14 bp, Homo sapiens
aatgtaaaacacat

SEQ ID NO: 712664 - DNA, 20 bp, Homo sapiens
aatgtaaaactccattcata

SEQ ID NO: 712665 - DNA, 13 bp, Homo sapiens
aatgtaaaattat

SEQ ID NO: 712666 - DNA, 14 bp, Homo sapiens
aatgtaaaattatg

SEQ ID NO: 712667 - DNA, 15 bp, Homo sapiens
aatgtaaactgccat

SEQ ID NO: 712668 - DNA, 19 bp, Homo sapiens
aatgtaaagcttgtctgat

SEQ ID NO: 712669 - DNA, 23 bp, Homo sapiens
aatgtaaaggagtcaaaactaca

SEQ ID NO: 712670 - DNA, 12 bp, Homo sapiens
aatgtaaaggtt

SEQ ID NO: 712671 - DNA, 18 bp, Homo sapiens
aatgtaaatattctatat

SEQ ID NO: 712672 - DNA, 19 bp, Homo sapiens
aatgtaaatcaaatttgaa

SEQ ID NO: 712673 - DNA, 13 bp, Homo sapiens
aatgtaaatgtta

SEQ ID NO: 712674 - DNA, 20 bp, Homo sapiens
aatgtaacatcataattaca

SEQ ID NO: 712675 - DNA, 21 bp, Homo sapiens
aatgtaacatcataattacat

SEQ ID NO: 712676 - DNA, 13 bp, Homo sapiens
aatgtaacttatt

SEQ ID NO: 712677 - DNA, 18 bp, Homo sapiens
aatgtaacttattccaag

SEQ ID NO: 712678 - DNA, 22 bp, Homo sapiens
aatgtaagcaaaggctctgaaa

SEQ ID NO: 712679 - DNA, 19 bp, Homo sapiens
aatgtaatcaatgtttctt

SEQ ID NO: 712680 - DNA, 20 bp, Homo sapiens
aatgtaattaactgtaaact

SEQ ID NO: 712681 - DNA, 16 bp, Homo sapiens
aatgtaattcaggact

SEQ ID NO: 712682 - DNA, 17 bp, Homo sapiens
aatgtaattcaggactc

SEQ ID NO: 712683 - DNA, 14 bp, Homo sapiens
aatgtaattgaata

SEQ ID NO: 712684 - DNA, 15 bp, Homo sapiens
aatgtaattggaatc

SEQ ID NO: 712685 - DNA, 20 bp, Homo sapiens
aatgtaattggaatcttcac

SEQ ID NO: 712686 - DNA, 15 bp, Homo sapiens
aatgtaattgtaatt

SEQ ID NO: 712687 - DNA, 23 bp, Homo sapiens
aatgtaattgtaattttgaaatg

SEQ ID NO: 712688 - DNA, 22 bp, Homo sapiens
aatgtaatttagaaactgattt

SEQ ID NO: 712689 - DNA, 17 bp, Homo sapiens
aatgtacaagttttgta

SEQ ID NO: 712690 - DNA, 19 bp, Homo sapiens
aatgtacaattatgtctct

SEQ ID NO: 712691 - DNA, 22 bp, Homo sapiens
aatgtacaattatgtctcttga

SEQ ID NO: 712692 - DNA, 16 bp, Homo sapiens
aatgtacactggatat

SEQ ID NO: 712693 - DNA, 16 bp, Homo sapiens
aatgtacagacatatt

SEQ ID NO: 712694 - DNA, 16 bp, Homo sapiens
aatgtacagttgaaat

SEQ ID NO: 712695 - DNA, 17 bp, Homo sapiens
aatgtacagttgaaata

SEQ ID NO: 712696 - DNA, 17 bp, Homo sapiens
aatgtacatctggcctt

SEQ ID NO: 712697 - DNA, 15 bp, Homo sapiens
aatgtaccttctttc

SEQ ID NO: 712698 - DNA, 18 bp, Homo sapiens
aatgtactatgtctgaac

SEQ ID NO: 712699 - DNA, 15 bp, Homo sapiens
aatgtactgagattt

SEQ ID NO: 712700 - DNA, 19 bp, Homo sapiens
aatgtactgatttcagtaa

SEQ ID NO: 712701 - DNA, 17 bp, Homo sapiens
aatgtactgtacataaa

SEQ ID NO: 712702 - DNA, 20 bp, Homo sapiens
aatgtactgtacataaattc

SEQ ID NO: 712703 - DNA, 22 bp, Homo sapiens
aatgtactgtacataaattcca

SEQ ID NO: 712704 - DNA, 14 bp, Homo sapiens
aatgtacttaaatg

SEQ ID NO: 712705 - DNA, 13 bp, Homo sapiens
aatgtacttgttt

SEQ ID NO: 712706 - DNA, 19 bp, Homo sapiens
aatgtacttgtttctctgt

SEQ ID NO: 712707 - DNA, 20 bp, Homo sapiens
aatgtacttttggataagta

SEQ ID NO: 712708 - DNA, 17 bp, Homo sapiens
aatgtagctggtttcct

SEQ ID NO: 712709 - DNA, 22 bp, Homo sapiens
aatgtagcttcagtcattaaat

SEQ ID NO: 712710 - DNA, 18 bp, Homo sapiens
aatgtagcttccacctca

SEQ ID NO: 712711 - DNA, 22 bp, Homo sapiens
aatgtaggcacttttattttca

SEQ ID NO: 712712 - DNA, 23 bp, Homo sapiens
aatgtaggcacttttattttcat

SEQ ID NO: 712713 - DNA, 20 bp, Homo sapiens
aatgtaggtatgaataagtt

SEQ ID NO: 712714 - DNA, 22 bp, Homo sapiens
aatgtagttagctccataaagt

SEQ ID NO: 712715 - DNA, 17 bp, Homo sapiens
aatgtataaagattgta

SEQ ID NO: 712716 - DNA, 20 bp, Homo sapiens
aatgtataaagattgtactt

SEQ ID NO: 712717 - DNA, 13 bp, Homo sapiens
aatgtatagtaaa

SEQ ID NO: 712718 - DNA, 15 bp, Homo sapiens
aatgtatataaaaat

SEQ ID NO: 712719 - DNA, 15 bp, Homo sapiens
aatgtatcaggaaat

SEQ ID NO: 712720 - DNA, 18 bp, Homo sapiens
aatgtatcaggaaatata

SEQ ID NO: 712721 - DNA, 18 bp, Homo sapiens
aatgtatcatagaaatgt

SEQ ID NO: 712722 - DNA, 22 bp, Homo sapiens
aatgtatcatagaaatgtaact

SEQ ID NO: 712723 - DNA, 21 bp, Homo sapiens
aatgtatcatttttgtgcaca

SEQ ID NO: 712724 - DNA, 14 bp, Homo sapiens
aatgtatccagagg

SEQ ID NO: 712725 - DNA, 19 bp, Homo sapiens
aatgtatccagaggaattg

SEQ ID NO: 712726 - DNA, 14 bp, Homo sapiens
aatgtatcctgata

SEQ ID NO: 712727 - DNA, 22 bp, Homo sapiens
aatgtatctatttgtacaattt

SEQ ID NO: 712728 - DNA, 14 bp, Homo sapiens
aatgtatctgtgaa

SEQ ID NO: 712729 - DNA, 17 bp, Homo sapiens
aatgtatctgtgaagta

SEQ ID NO: 712730 - DNA, 18 bp, Homo sapiens
aatgtatcttattcacat

SEQ ID NO: 712731 - DNA, 13 bp, Homo sapiens
aatgtatctttat

SEQ ID NO: 712732 - DNA, 20 bp, Homo sapiens
aatgtatgcattcacattta

SEQ ID NO: 712733 - DNA, 14 bp, Homo sapiens
aatgtatgtacaat

SEQ ID NO: 712734 - DNA, 18 bp, Homo sapiens
aatgtatgtgcactgtca

SEQ ID NO: 712735 - DNA, 20 bp, Homo sapiens
aatgtatgtgcactgtcact

SEQ ID NO: 712736 - DNA, 19 bp, Homo sapiens
aagtcattgtttttctcgc

SEQ ID NO: 712737 - DNA, 20 bp, Homo sapiens
aagtcatttccgtccccccc

SEQ ID NO: 712738 - DNA, 16 bp, Homo sapiens
aagtcattttaacttt

SEQ ID NO: 712739 - DNA, 18 bp, Homo sapiens
aagtcattttaactttat

SEQ ID NO: 712740 - DNA, 12 bp, Homo sapiens
aagtccaaagtc

SEQ ID NO: 712741 - DNA, 20 bp, Homo sapiens
aagtccaaattgtttgtaca

SEQ ID NO: 712742 - DNA, 19 bp, Homo sapiens
aagtccaacctgcctgtgc

SEQ ID NO: 712743 - DNA, 12 bp, Homo sapiens
aagtccactgtc

SEQ ID NO: 712744 - DNA, 13 bp, Homo sapiens
aagtccactgtcc

SEQ ID NO: 712745 - DNA, 15 bp, Homo sapiens
aagtccactgtcctc

SEQ ID NO: 712746 - DNA, 23 bp, Homo sapiens
aagtccattatgtaatagtgaca

SEQ ID NO: 712747 - DNA, 15 bp, Homo sapiens
aagtcccatcataga

SEQ ID NO: 712748 - DNA, 18 bp, Homo sapiens
aagtccctccctgcctga

SEQ ID NO: 712749 - DNA, 22 bp, Homo sapiens
aagtccctgttttctgagcccg

SEQ ID NO: 712750 - DNA, 21 bp, Homo sapiens
aagtcccttcctattctcctg

SEQ ID NO: 712751 - DNA, 22 bp, Homo sapiens
aagtcccttcctattctcctgc

SEQ ID NO: 712752 - DNA, 13 bp, Homo sapiens
aagtcccttcctg

SEQ ID NO: 712753 - DNA, 15 bp, Homo sapiens
aagtcccttcctgct

SEQ ID NO: 712754 - DNA, 20 bp, Homo sapiens
aagtcctaacttcctgtgcc

SEQ ID NO: 712755 - DNA, 11 bp, Homo sapiens
aagtcctctgc

SEQ ID NO: 712756 - DNA, 21 bp, Homo sapiens
aagtcctgctggatcttgcct

SEQ ID NO: 712757 - DNA, 13 bp, Homo sapiens
aagtcctgctttc

SEQ ID NO: 712758 - DNA, 15 bp, Homo sapiens
aagtcctggctacat

SEQ ID NO: 712759 - DNA, 12 bp, Homo sapiens
aagtcctgtcac

SEQ ID NO: 712760 - DNA, 22 bp, Homo sapiens
aagtcctgtcactgagcacagt

SEQ ID NO: 712761 - DNA, 21 bp, Homo sapiens
aagtccttcagtgagcccctc

SEQ ID NO: 712762 - DNA, 16 bp, Homo sapiens
aagtcctttatgtgga

SEQ ID NO: 712763 - DNA, 21 bp, Homo sapiens
aagtcctttttttccatcttt

SEQ ID NO: 712764 - DNA, 16 bp, Homo sapiens
aagtcgagcactctaa

SEQ ID NO: 712765 - DNA, 12 bp, Homo sapiens
aagtcgccagtc

SEQ ID NO: 712766 - DNA, 19 bp, Homo sapiens
aagtcggatgtcagagcct

SEQ ID NO: 712767 - DNA, 18 bp, Homo sapiens
aagtcggggcctgggaca

SEQ ID NO: 712768 - DNA, 16 bp, Homo sapiens
aagtctaaatatttcc

SEQ ID NO: 712769 - DNA, 17 bp, Homo sapiens
aagtctaaatatttcct

SEQ ID NO: 712770 - DNA, 15 bp, Homo sapiens
aagtctacctgtgtt

SEQ ID NO: 712771 - DNA, 16 bp, Homo sapiens
aagtctagtcttctgg

SEQ ID NO: 712772 - DNA, 21 bp, Homo sapiens
aagtctatttttttaactgaa

SEQ ID NO: 712773 - DNA, 23 bp, Homo sapiens
aagtctatttttttaactgaaaa

SEQ ID NO: 712774 - DNA, 21 bp, Homo sapiens
aagtctcactggctgtcagta

SEQ ID NO: 712775 - DNA, 20 bp, Homo sapiens
aagtctcattcgcctttgtc

SEQ ID NO: 712776 - DNA, 13 bp, Homo sapiens
aagtctcctgtct

SEQ ID NO: 712777 - DNA, 18 bp, Homo sapiens
aagtctcctttactgaat

SEQ ID NO: 712778 - DNA, 17 bp, Homo sapiens
aagtctctaggttctga

SEQ ID NO: 712779 - DNA, 11 bp, Homo sapiens
aagtctctgtg

SEQ ID NO: 712780 - DNA, 12 bp, Homo sapiens
aagtctctgtga

SEQ ID NO: 712781 - DNA, 16 bp, Homo sapiens
aagtctctttttcttc

SEQ ID NO: 712782 - DNA, 18 bp, Homo sapiens
aagtctctttttcttcct

SEQ ID NO: 712783 - DNA, 17 bp, Homo sapiens
aagtctggctttgctct

SEQ ID NO: 712784 - DNA, 18 bp, Homo sapiens
aagtctgggatgtagaac

SEQ ID NO: 712785 - DNA, 22 bp, Homo sapiens
aagtctgtatggcatgacaact

SEQ ID NO: 712786 - DNA, 13 bp, Homo sapiens
aagtctgtccttg

SEQ ID NO: 712787 - DNA, 16 bp, Homo sapiens
aagtctgtccttgaag

SEQ ID NO: 712788 - DNA, 22 bp, Homo sapiens
aagtctgtctttcctgaaccat

SEQ ID NO: 712789 - DNA, 15 bp, Homo sapiens
aagtctgttatttat

SEQ ID NO: 712790 - DNA, 20 bp, Homo sapiens
aagtcttaacaaaccaacat

SEQ ID NO: 712791 - DNA, 13 bp, Homo sapiens
aagtcttccttaa

SEQ ID NO: 712792 - DNA, 22 bp, Homo sapiens
aagtcttccttaaatgactttt

SEQ ID NO: 712793 - DNA, 19 bp, Homo sapiens
aagtcttgggtctgaattt

SEQ ID NO: 712794 - DNA, 14 bp, Homo sapiens
aagtctttcagatg

SEQ ID NO: 712795 - DNA, 11 bp, Homo sapiens
aagtctttccc

SEQ ID NO: 712796 - DNA, 17 bp, Homo sapiens
aagtctttgccttctct

SEQ ID NO: 712797 - DNA, 22 bp, Homo sapiens
aagtctttttcattttgcagaa

SEQ ID NO: 712798 - DNA, 19 bp, Homo sapiens
aagtcttttttttttccaa

SEQ ID NO: 712799 - DNA, 20 bp, Homo sapiens
aagtcttttttttttccaaa

SEQ ID NO: 712800 - DNA, 17 bp, Homo sapiens
aagtgaaaaaaagaaac

SEQ ID NO: 712801 - DNA, 16 bp, Homo sapiens
aagtgaaaacaaatct

SEQ ID NO: 712802 - DNA, 13 bp, Homo sapiens
aagtgaaaatctt

SEQ ID NO: 712803 - DNA, 17 bp, Homo sapiens
aagtgaaatggatacta

SEQ ID NO: 712804 - DNA, 13 bp, Homo sapiens
aagtgaaattaag

SEQ ID NO: 712805 - DNA, 17 bp, Homo sapiens
aagtgaagacaatgact

SEQ ID NO: 712806 - DNA, 17 bp, Homo sapiens
aagtgaagagtcagaac

SEQ ID NO: 712807 - DNA, 20 bp, Homo sapiens
aagtgaaggttcccaaggac

SEQ ID NO: 712808 - DNA, 22 bp, Homo sapiens
aagtgaaggtttacaatttaca

SEQ ID NO: 712809 - DNA, 15 bp, Homo sapiens
aagtgaatgctggga

SEQ ID NO: 712810 - DNA, 14 bp, Homo sapiens
aagtgaattgaagt

SEQ ID NO: 712811 - DNA, 16 bp, Homo sapiens
aagtgaattgaagttt

SEQ ID NO: 712812 - DNA, 20 bp, Homo sapiens
aagtgaatttgaatgaaaaa

SEQ ID NO: 712813 - DNA, 16 bp, Homo sapiens
aagtgaatttgcctgt

SEQ ID NO: 712814 - DNA, 20 bp, Homo sapiens
aagtgaatttgcctgtaaca

SEQ ID NO: 712815 - DNA, 21 bp, Homo sapiens
aagtgacaaagccagaggaga

SEQ ID NO: 712816 - DNA, 16 bp, Homo sapiens
aagtgacaaggcccca

SEQ ID NO: 712817 - DNA, 20 bp, Homo sapiens
aagtgacaaggccccagaga

SEQ ID NO: 712818 - DNA, 24 bp, Homo sapiens
aagtgacacagcagcttcaccaga

SEQ ID NO: 712819 - DNA, 18 bp, Homo sapiens
aagtgacacattaatgat

SEQ ID NO: 712820 - DNA, 13 bp, Homo sapiens
aagtgacaccaat

SEQ ID NO: 712821 - DNA, 20 bp, Homo sapiens
aagtgacaccaataaatgtt

SEQ ID NO: 712822 - DNA, 15 bp, Homo sapiens
aagtgaccccagggc

SEQ ID NO: 712823 - DNA, 19 bp, Homo sapiens
aagtgaccccagggcctgt

SEQ ID NO: 712824 - DNA, 15 bp, Homo sapiens
aagtgactctcagcg

SEQ ID NO: 712825 - DNA, 18 bp, Homo sapiens
aagtgactgtatctgtgt

SEQ ID NO: 712826 - DNA, 13 bp, Homo sapiens
aagtgactttaaa

SEQ ID NO: 712827 - DNA, 15 bp, Homo sapiens
aagtgagaagatggt

SEQ ID NO: 712828 - DNA, 17 bp, Homo sapiens
aatgctcattttctggt

SEQ ID NO: 712829 - DNA, 16 bp, Homo sapiens
aatgctccccacagcg

SEQ ID NO: 712830 - DNA, 20 bp, Homo sapiens
aatgctccccacagcgtccc

SEQ ID NO: 712831 - DNA, 14 bp, Homo sapiens
aatgctcccccatc

SEQ ID NO: 712832 - DNA, 22 bp, Homo sapiens
aatgctcccccatcctcccctt

SEQ ID NO: 712833 - DNA, 18 bp, Homo sapiens
aatgctcgtgtgatttcc

SEQ ID NO: 712834 - DNA, 20 bp, Homo sapiens
aatgctctatgtttgtattt

SEQ ID NO: 712835 - DNA, 21 bp, Homo sapiens
aatgctctatgtttgtatttg

SEQ ID NO: 712836 - DNA, 14 bp, Homo sapiens
aatgctctggagtg

SEQ ID NO: 712837 - DNA, 14 bp, Homo sapiens
aatgctctgtgcca

SEQ ID NO: 712838 - DNA, 18 bp, Homo sapiens
aatgctgaaaaaacacct

SEQ ID NO: 712839 - DNA, 19 bp, Homo sapiens
aatgctgcaggaaaagcaa

SEQ ID NO: 712840 - DNA, 23 bp, Homo sapiens
aatgctgcccggttgccatggag

SEQ ID NO: 712841 - DNA, 12 bp, Homo sapiens
aatgctgcctgc

SEQ ID NO: 712842 - DNA, 18 bp, Homo sapiens
aatgctgcctgcctgtct

SEQ ID NO: 712843 - DNA, 17 bp, Homo sapiens
aatgctgcgcttcgctt

SEQ ID NO: 712844 - DNA, 17 bp, Homo sapiens
aatgctgctggccaaat

SEQ ID NO: 712845 - DNA, 18 bp, Homo sapiens
aatgctgctttgtccagg

SEQ ID NO: 712846 - DNA, 20 bp, Homo sapiens
aatgctggctgagctgaaca

SEQ ID NO: 712847 - DNA, 21 bp, Homo sapiens
aatgctgggcccccagcctgg

SEQ ID NO: 712848 - DNA, 14 bp, Homo sapiens
aatgctgggccctc

SEQ ID NO: 712849 - DNA, 22 bp, Homo sapiens
aatgctggttttcctaaatgca

SEQ ID NO: 712850 - DNA, 23 bp, Homo sapiens
aatgctggttttcctaaatgcag

SEQ ID NO: 712851 - DNA, 13 bp, Homo sapiens
aatgctgtacatc

SEQ ID NO: 712852 - DNA, 17 bp, Homo sapiens
aatgctgtacatctatt

SEQ ID NO: 712853 - DNA, 17 bp, Homo sapiens
aatgctgtcaactatga

SEQ ID NO: 712854 - DNA, 14 bp, Homo sapiens
aatgctgtctttgt

SEQ ID NO: 712855 - DNA, 17 bp, Homo sapiens
aatgctgtctttgtgga

SEQ ID NO: 712856 - DNA, 20 bp, Homo sapiens
aatgctgtctttgtggactg

SEQ ID NO: 712857 - DNA, 21 bp, Homo sapiens
aatgctgttctgatttactag

SEQ ID NO: 712858 - DNA, 16 bp, Homo sapiens
aatgctgttgtaaaca

SEQ ID NO: 712859 - DNA, 20 bp, Homo sapiens
aatgcttaaactaaataatg

SEQ ID NO: 712860 - DNA, 20 bp, Homo sapiens
aatgcttatcatctaaagat

SEQ ID NO: 712861 - DNA, 11 bp, Homo sapiens
aatgcttcaga

SEQ ID NO: 712862 - DNA, 13 bp, Homo sapiens
aatgcttcattat

SEQ ID NO: 712863 - DNA, 20 bp, Homo sapiens
aatgcttcattcaatattga

SEQ ID NO: 712864 - DNA, 22 bp, Homo sapiens
aatgcttcattcaatattgaca

SEQ ID NO: 712865 - DNA, 16 bp, Homo sapiens
aatgcttccaagcatg

SEQ ID NO: 712866 - DNA, 21 bp, Homo sapiens
aatgcttcctgacaatcaact

SEQ ID NO: 712867 - DNA, 14 bp, Homo sapiens
aatgcttctaagta

SEQ ID NO: 712868 - DNA, 19 bp, Homo sapiens
aatgcttgtagaagtagga

SEQ ID NO: 712869 - DNA, 21 bp, Homo sapiens
aatgctttatttgtaaattta

SEQ ID NO: 712870 - DNA, 13 bp, Homo sapiens
aatgctttctgaa

SEQ ID NO: 712871 - DNA, 18 bp, Homo sapiens
aatgctttgatatttcaa

SEQ ID NO: 712872 - DNA, 17 bp, Homo sapiens
aatgctttgggaggcca

SEQ ID NO: 712873 - DNA, 21 bp, Homo sapiens
aatgctttgggaggccaaggc

SEQ ID NO: 712874 - DNA, 14 bp, Homo sapiens
aatgcttttagtgt

SEQ ID NO: 712875 - DNA, 16 bp, Homo sapiens
aatgcttttagtgtgt

SEQ ID NO: 712876 - DNA, 19 bp, Homo sapiens
aatgcttttatatggccca

SEQ ID NO: 712877 - DNA, 15 bp, Homo sapiens
aatgcttttatattc

SEQ ID NO: 712878 - DNA, 11 bp, Homo sapiens
aatgctttttg

SEQ ID NO: 712879 - DNA, 17 bp, Homo sapiens
aatgctttttgaatgtt

SEQ ID NO: 712880 - DNA, 15 bp, Homo sapiens
aatggaaaagagaga

SEQ ID NO: 712881 - DNA, 16 bp, Homo sapiens
aatggaaaatgtatat

SEQ ID NO: 712882 - DNA, 14 bp, Homo sapiens
aatggaaacctcac

SEQ ID NO: 712883 - DNA, 19 bp, Homo sapiens
aatggaaagtaactcattt

SEQ ID NO: 712884 - DNA, 15 bp, Homo sapiens
aatggaaattttgct

SEQ ID NO: 712885 - DNA, 18 bp, Homo sapiens
aatggaactactgtactt

SEQ ID NO: 712886 - DNA, 19 bp, Homo sapiens
aatggaactactgtacttt

SEQ ID NO: 712887 - DNA, 14 bp, Homo sapiens
aatggaactgaccc

SEQ ID NO: 712888 - DNA, 16 bp, Homo sapiens
aatggaagaaatggct

SEQ ID NO: 712889 - DNA, 16 bp, Homo sapiens
aatggaagagagaaag

SEQ ID NO: 712890 - DNA, 17 bp, Homo sapiens
aatggaagcaaagacaa

SEQ ID NO: 712891 - DNA, 18 bp, Homo sapiens
aatggaataaaaggcttg

SEQ ID NO: 712892 - DNA, 18 bp, Homo sapiens
aatggaataactatctca

SEQ ID NO: 712893 - DNA, 20 bp, Homo sapiens
aatggaataactatctcact

SEQ ID NO: 712894 - DNA, 14 bp, Homo sapiens
aatggaatccatct

SEQ ID NO: 712895 - DNA, 16 bp, Homo sapiens
aatggaatcgatttcc

SEQ ID NO: 712896 - DNA, 13 bp, Homo sapiens
aatggacattttc

SEQ ID NO: 712897 - DNA, 14 bp, Homo sapiens
aatggacattttct

SEQ ID NO: 712898 - DNA, 22 bp, Homo sapiens
aatggaccctttttgttatgat

SEQ ID NO: 712899 - DNA, 18 bp, Homo sapiens
aatggactaagatgaaat

SEQ ID NO: 712900 - DNA, 23 bp, Homo sapiens
aatggactggaaggggaagggac

SEQ ID NO: 712901 - DNA, 17 bp, Homo sapiens
aatggagaagctgcagg

SEQ ID NO: 712902 - DNA, 15 bp, Homo sapiens
aatggaggaatatga

SEQ ID NO: 712903 - DNA, 20 bp, Homo sapiens
aatggaggccatatttccat

SEQ ID NO: 712904 - DNA, 17 bp, Homo sapiens
aatggaggccattgtgt

SEQ ID NO: 712905 - DNA, 18 bp, Homo sapiens
aatggaggcttttcactg

SEQ ID NO: 712906 - DNA, 19 bp, Homo sapiens
aatggaggggcagagccag

SEQ ID NO: 712907 - DNA, 18 bp, Homo sapiens
aatggatacataaagact

SEQ ID NO: 712908 - DNA, 14 bp, Homo sapiens
aatggatatttctc

SEQ ID NO: 712909 - DNA, 18 bp, Homo sapiens
aatggatcacaagatgga

SEQ ID NO: 712910 - DNA, 17 bp, Homo sapiens
aatggatgccttgaata

SEQ ID NO: 712911 - DNA, 21 bp, Homo sapiens
aatggatttgatgctgtttga

SEQ ID NO: 712912 - DNA, 17 bp, Homo sapiens
aatggatttttctttaa

SEQ ID NO: 712913 - DNA, 18 bp, Homo sapiens
aatggatttttctttaac

SEQ ID NO: 712914 - DNA, 20 bp, Homo sapiens
aatggatttttctttaactg

SEQ ID NO: 712915 - DNA, 19 bp, Homo sapiens
aatggcagctagactggag

SEQ ID NO: 712916 - DNA, 20 bp, Homo sapiens
aatggcagttatattttgca

SEQ ID NO: 712917 - DNA, 13 bp, Homo sapiens
aatggcatttctc

SEQ ID NO: 712918 - DNA, 15 bp, Homo sapiens
aatggcatttgcaat

SEQ ID NO: 712919 - DNA, 19 bp, Homo sapiens
aatggcatttgctggttat

SEQ ID NO: 712920 - DNA, 16 bp, Homo sapiens
aatggccagagcctct

SEQ ID NO: 712921 - DNA, 21 bp, Homo sapiens
aatggccagagcctctggccc

SEQ ID NO: 712922 - DNA, 20 bp, Homo sapiens
aatggccagtgctgcttctt

SEQ ID NO: 712923 - DNA, 10 bp, Homo sapiens
aatggccatg

SEQ ID NO: 712924 - DNA, 15 bp, Homo sapiens
aatggccattttaaa

SEQ ID NO: 712925 - DNA, 21 bp, Homo sapiens
aatggccctagaactgtgcct

SEQ ID NO: 712926 - DNA, 16 bp, Homo sapiens
aatggccggctggaaa

SEQ ID NO: 712927 - DNA, 20 bp, Homo sapiens
aatggcctcatgtggctgga

SEQ ID NO: 712928 - DNA, 22 bp, Homo sapiens
aatggcctcatgtggctggaag

SEQ ID NO: 712929 - DNA, 22 bp, Homo sapiens
aatggcctgccttgaagccact

SEQ ID NO: 712930 - DNA, 17 bp, Homo sapiens
aatggcgtctgctctgg

SEQ ID NO: 712931 - DNA, 19 bp, Homo sapiens
aatggcgtctgctctggtg

SEQ ID NO: 712932 - DNA, 22 bp, Homo sapiens
aatggctaataaactgtattaa

SEQ ID NO: 712933 - DNA, 23 bp, Homo sapiens
aatggctatgaacagaaactaca

SEQ ID NO: 712934 - DNA, 16 bp, Homo sapiens
aatggctatgttttta

SEQ ID NO: 712935 - DNA, 21 bp, Homo sapiens
aatggctgcacctttttgcat

SEQ ID NO: 712936 - DNA, 10 bp, Homo sapiens
aatggctgct

SEQ ID NO: 712937 - DNA, 17 bp, Homo sapiens
aatggctgtaatcattt

SEQ ID NO: 712938 - DNA, 22 bp, Homo sapiens
aatgggaactgcctctttcctg

SEQ ID NO: 712939 - DNA, 13 bp, Homo sapiens
aatgggaagaaat

SEQ ID NO: 712940 - DNA, 16 bp, Homo sapiens
aatgggaccgtgcccc

SEQ ID NO: 712941 - DNA, 21 bp, Homo sapiens
aatgggaccgtgccccacctc

SEQ ID NO: 712942 - DNA, 23 bp, Homo sapiens
aatgggagaaaacgccagtgtgt

SEQ ID NO: 712943 - DNA, 18 bp, Homo sapiens
aatgggagacagcctctt

SEQ ID NO: 712944 - DNA, 14 bp, Homo sapiens
aatgggagccagaa

SEQ ID NO: 712945 - DNA, 14 bp, Homo sapiens
aatgggaggaggaa

SEQ ID NO: 712946 - DNA, 19 bp, Homo sapiens
aatgggcagttctcccagg

SEQ ID NO: 712947 - DNA, 23 bp, Homo sapiens
aatgggccactgtaggggttggg

SEQ ID NO: 712948 - DNA, 13 bp, Homo sapiens
aatgggcctgccc

SEQ ID NO: 712949 - DNA, 14 bp, Homo sapiens
aatgggctcaaact

SEQ ID NO: 712950 - DNA, 16 bp, Homo sapiens
aatgggctcaaccaga

SEQ ID NO: 712951 - DNA, 19 bp, Homo sapiens
aatgggggcaggaaagcca

SEQ ID NO: 712952 - DNA, 20 bp, Homo sapiens
aatgatccccaagtgtgaac

SEQ ID NO: 712953 - DNA, 16 bp, Homo sapiens
aatgatccccagctgt

SEQ ID NO: 712954 - DNA, 20 bp, Homo sapiens
aatgatctgcctctaaaagc

SEQ ID NO: 712955 - DNA, 20 bp, Homo sapiens
aatgatgaaatctttctttc

SEQ ID NO: 712956 - DNA, 15 bp, Homo sapiens
aatgatgagcattta

SEQ ID NO: 712957 - DNA, 23 bp, Homo sapiens
aatgatgatgacgacgacaacga

SEQ ID NO: 712958 - DNA, 21 bp, Homo sapiens
aatgatgatgatgatgatgaa

SEQ ID NO: 712959 - DNA, 21 bp, Homo sapiens
aatgatgcagctgttgagaaa

SEQ ID NO: 712960 - DNA, 23 bp, Homo sapiens
aatgatgccgaacattaggaatt

SEQ ID NO: 712961 - DNA, 12 bp, Homo sapiens
aatgatggaatt

SEQ ID NO: 712962 - DNA, 18 bp, Homo sapiens
aatgatggcaattttgta

SEQ ID NO: 712963 - DNA, 18 bp, Homo sapiens
aatgatggtgttaaagct

SEQ ID NO: 712964 - DNA, 15 bp, Homo sapiens
aatgatgtccagaag

SEQ ID NO: 712965 - DNA, 22 bp, Homo sapiens
aatgattaaaatgtttgagcac

SEQ ID NO: 712966 - DNA, 16 bp, Homo sapiens
aatgattatattcaca

SEQ ID NO: 712967 - DNA, 21 bp, Homo sapiens
aatgattatattcacagactg

SEQ ID NO: 712968 - DNA, 12 bp, Homo sapiens
aatgattccaaa

SEQ ID NO: 712969 - DNA, 13 bp, Homo sapiens
aatgattccaaat

SEQ ID NO: 712970 - DNA, 13 bp, Homo sapiens
aatgattgaaaat

SEQ ID NO: 712971 - DNA, 14 bp, Homo sapiens
aatgatttaaattt

SEQ ID NO: 712972 - DNA, 11 bp, Homo sapiens
aatgatttcag

SEQ ID NO: 712973 - DNA, 19 bp, Homo sapiens
aatgattttatctgtgaat

SEQ ID NO: 712974 - DNA, 18 bp, Homo sapiens
aatgatttttctttacaa

SEQ ID NO: 712975 - DNA, 12 bp, Homo sapiens
aatgcaaaaaaa

SEQ ID NO: 712976 - DNA, 16 bp, Homo sapiens
aatgcaaaaaaaatta

SEQ ID NO: 712977 - DNA, 17 bp, Homo sapiens
aatgcaaaaaaaattag

SEQ ID NO: 712978 - DNA, 17 bp, Homo sapiens
aatgcaaaatgaaataa

SEQ ID NO: 712979 - DNA, 18 bp, Homo sapiens
aatgcaaaattgttttca

SEQ ID NO: 712980 - DNA, 22 bp, Homo sapiens
aatgcaaaattgttttcacttg

SEQ ID NO: 712981 - DNA, 20 bp, Homo sapiens
aatgcaaaatttttttaatc

SEQ ID NO: 712982 - DNA, 12 bp, Homo sapiens
aatgcaaatgaa

SEQ ID NO: 712983 - DNA, 21 bp, Homo sapiens
aatgcaaattaaaacatattt

SEQ ID NO: 712984 - DNA, 13 bp, Homo sapiens
aatgcaaccattt

SEQ ID NO: 712985 - DNA, 21 bp, Homo sapiens
aatgcaagagtgattgcagct

SEQ ID NO: 712986 - DNA, 22 bp, Homo sapiens
aatgcaagagtgattgcagctt

SEQ ID NO: 712987 - DNA, 21 bp, Homo sapiens
aatgcaagattttccacaaga

SEQ ID NO: 712988 - DNA, 22 bp, Homo sapiens
aatgcaatgtcttaaataaaac

SEQ ID NO: 712989 - DNA, 16 bp, Homo sapiens
aatgcaatttaaaatt

SEQ ID NO: 712990 - DNA, 19 bp, Homo sapiens
aatgcacatatagacacat

SEQ ID NO: 712991 - DNA, 17 bp, Homo sapiens
aatgcacatttcagaaa

SEQ ID NO: 712992 - DNA, 17 bp, Homo sapiens
aatgcaccaagaaagct

SEQ ID NO: 712993 - DNA, 16 bp, Homo sapiens
aatgcaccatggagac

SEQ ID NO: 712994 - DNA, 19 bp, Homo sapiens
aatgcacctagctgtgcaa

SEQ ID NO: 712995 - DNA, 21 bp, Homo sapiens
aatgcactgtattgctcctcc

SEQ ID NO: 712996 - DNA, 13 bp, Homo sapiens
aatgcactgtttt

SEQ ID NO: 712997 - DNA, 15 bp, Homo sapiens
aatgcactgttttta

SEQ ID NO: 712998 - DNA, 16 bp, Homo sapiens
aatgcactgtttttaa

SEQ ID NO: 712999 - DNA, 19 bp, Homo sapiens
aatgcactgtttttaatct

SEQ ID NO: 713000 - DNA, 20 bp, Homo sapiens
aatgcacttgattcaggagg

SEQ ID NO: 713001 - DNA, 13 bp, Homo sapiens
aatgcactttcta

SEQ ID NO: 713002 - DNA, 20 bp, Homo sapiens
aatgcagacaacaccttcct

SEQ ID NO: 713003 - DNA, 17 bp, Homo sapiens
aatgcagattacactga

SEQ ID NO: 713004 - DNA, 22 bp, Homo sapiens
aatgcagattcataggcagcat

SEQ ID NO: 713005 - DNA, 19 bp, Homo sapiens
aatgcagattcctgggcct

SEQ ID NO: 713006 - DNA, 21 bp, Homo sapiens
aatgcagattcctgggcctgt

SEQ ID NO: 713007 - DNA, 20 bp, Homo sapiens
aatgcagcagggatgccctg

SEQ ID NO: 713008 - DNA, 21 bp, Homo sapiens
aatgcagccacgattggagaa

SEQ ID NO: 713009 - DNA, 22 bp, Homo sapiens
aatgcagtacaggacatatatt

SEQ ID NO: 713010 - DNA, 14 bp, Homo sapiens
aatgcagtatatag

SEQ ID NO: 713011 - DNA, 20 bp, Homo sapiens
aatgcagtcctgaggagagg

SEQ ID NO: 713012 - DNA, 16 bp, Homo sapiens
aatgcagtttcttcat

SEQ ID NO: 713013 - DNA, 23 bp, Homo sapiens
aatgcatacaataaaagagcttt

SEQ ID NO: 713014 - DNA, 22 bp, Homo sapiens
aatgcatactgttgatacaaac

SEQ ID NO: 713015 - DNA, 19 bp, Homo sapiens
aatgcatatcctgagccat

SEQ ID NO: 713016 - DNA, 18 bp, Homo sapiens
aatgcatatttgcaaagt

SEQ ID NO: 713017 - DNA, 23 bp, Homo sapiens
aatgcatatttgcaaagtgtatt

SEQ ID NO: 713018 - DNA, 23 bp, Homo sapiens
aatgcatcacgtaccccactggg

SEQ ID NO: 713019 - DNA, 19 bp, Homo sapiens
aatgcatccattcctcagg

SEQ ID NO: 713020 - DNA, 20 bp, Homo sapiens
aatgcatctcatcaacttaa

SEQ ID NO: 713021 - DNA, 20 bp, Homo sapiens
aatgcatgtaaggtcttctt

SEQ ID NO: 713022 - DNA, 21 bp, Homo sapiens
aatgcatgtaaggtcttcttg

SEQ ID NO: 713023 - DNA, 16 bp, Homo sapiens
aatgcatgtcttaaat

SEQ ID NO: 713024 - DNA, 19 bp, Homo sapiens
aatgcatgtcttaaatgct

SEQ ID NO: 713025 - DNA, 20 bp, Homo sapiens
aatgcatgtcttaaatgctc

SEQ ID NO: 713026 - DNA, 21 bp, Homo sapiens
aatgcatgtcttaaatgctca

SEQ ID NO: 713027 - DNA, 15 bp, Homo sapiens
aatgcatgtgctgtc

SEQ ID NO: 713028 - DNA, 14 bp, Homo sapiens
aatgcattaataaa

SEQ ID NO: 713029 - DNA, 13 bp, Homo sapiens
aatgcattattga

SEQ ID NO: 713030 - DNA, 19 bp, Homo sapiens
aatgcattcaaaatataac

SEQ ID NO: 713031 - DNA, 14 bp, Homo sapiens
aatgcattgaaaga

SEQ ID NO: 713032 - DNA, 12 bp, Homo sapiens
aatgcatttact

SEQ ID NO: 713033 - DNA, 19 bp, Homo sapiens
aatgcatttctgtggatac

SEQ ID NO: 713034 - DNA, 19 bp, Homo sapiens
aatgcattttcttcagaat

SEQ ID NO: 713035 - DNA, 18 bp, Homo sapiens
aatgccaaaatgtactta

SEQ ID NO: 713036 - DNA, 21 bp, Homo sapiens
aatgccaagggggtgactgga

SEQ ID NO: 713037 - DNA, 15 bp, Homo sapiens
aatgccaagtgcctg

SEQ ID NO: 713038 - DNA, 16 bp, Homo sapiens
aatgccaagtgcctgc

SEQ ID NO: 713039 - DNA, 15 bp, Homo sapiens
aatgccagaaacagt

SEQ ID NO: 713040 - DNA, 20 bp, Homo sapiens
aatgccaggcggacaaagtt

SEQ ID NO: 713041 - DNA, 11 bp, Homo sapiens
aatgccagggc

SEQ ID NO: 713042 - DNA, 15 bp, Homo sapiens
aatgccatcagcccc

SEQ ID NO: 713043 - DNA, 20 bp, Homo sapiens
aatgcccaaaagaggtgtca

SEQ ID NO: 713044 - DNA, 22 bp, Homo sapiens
aatgcccagccagccacccctg

SEQ ID NO: 713045 - DNA, 18 bp, Homo sapiens
aatgccctcctaaatgtc

SEQ ID NO: 713046 - DNA, 13 bp, Homo sapiens
aatgccctgccat

SEQ ID NO: 713047 - DNA, 14 bp, Homo sapiens
aatgccctgccatt

SEQ ID NO: 713048 - DNA, 20 bp, Homo sapiens
aatgccgcgaactgggttct

SEQ ID NO: 713049 - DNA, 18 bp, Homo sapiens
aatgcctataaaatgccc

SEQ ID NO: 713050 - DNA, 15 bp, Homo sapiens
aatgcctcagtgtat

SEQ ID NO: 713051 - DNA, 23 bp, Homo sapiens
aatgcctcagtgtatttgtattt

SEQ ID NO: 713052 - DNA, 14 bp, Homo sapiens
aatgcctcctccct

SEQ ID NO: 713053 - DNA, 15 bp, Homo sapiens
aatgcctcctccctg

SEQ ID NO: 713054 - DNA, 13 bp, Homo sapiens
aatgcctcctgtg

SEQ ID NO: 713055 - DNA, 18 bp, Homo sapiens
aatgcctggagacagata

SEQ ID NO: 713056 - DNA, 15 bp, Homo sapiens
aatgcctggagggta

SEQ ID NO: 713057 - DNA, 22 bp, Homo sapiens
aatgcctgtctctagctgttct

SEQ ID NO: 713058 - DNA, 14 bp, Homo sapiens
aatgcctgtgaagc

SEQ ID NO: 713059 - DNA, 22 bp, Homo sapiens
aatgcctgtgaagcagtcagcc

SEQ ID NO: 713060 - DNA, 18 bp, Homo sapiens
aatgccttcatgaatctt

SEQ ID NO: 713061 - DNA, 17 bp, Homo sapiens
aatgccttgtataaaat

SEQ ID NO: 713062 - DNA, 12 bp, Homo sapiens
aatgcctttaaa

SEQ ID NO: 713063 - DNA, 13 bp, Homo sapiens
aatgcctttgtaa

SEQ ID NO: 713064 - DNA, 23 bp, Homo sapiens
aatgcctttgtaaccacaacttt

SEQ ID NO: 713065 - DNA, 21 bp, Homo sapiens
aatgcctttttagatgtattt

SEQ ID NO: 713066 - DNA, 19 bp, Homo sapiens
aatgcgaaattattggttg

SEQ ID NO: 713067 - DNA, 16 bp, Homo sapiens
aatgcgagactctgat

SEQ ID NO: 713068 - DNA, 18 bp, Homo sapiens
aatgcgtgcataccactt

SEQ ID NO: 713069 - DNA, 16 bp, Homo sapiens
aatgctaagaaatgct

SEQ ID NO: 713070 - DNA, 19 bp, Homo sapiens
aatgctaatttaaagagac

SEQ ID NO: 713071 - DNA, 16 bp, Homo sapiens
aatgctacaaaaattg

SEQ ID NO: 713072 - DNA, 15 bp, Homo sapiens
aatgctaccaggatg

SEQ ID NO: 713073 - DNA, 17 bp, Homo sapiens
aatgctatactggaaat

SEQ ID NO: 713074 - DNA, 15 bp, Homo sapiens
aatgctcagaccagc

SEQ ID NO: 713075 - DNA, 20 bp, Homo sapiens
aatgctcataaagatgttaa

SEQ ID NO: 713076 - DNA, 15 bp, Homo sapiens
agccctgcctctgtg

SEQ ID NO: 713077 - DNA, 17 bp, Homo sapiens
agccctgcctctgtgta

SEQ ID NO: 713078 - DNA, 15 bp, Homo sapiens
agccctgctgtggga

SEQ ID NO: 713079 - DNA, 22 bp, Homo sapiens
agccctgctttgggctgccctg

SEQ ID NO: 713080 - DNA, 11 bp, Homo sapiens
agccctggccc

SEQ ID NO: 713081 - DNA, 14 bp, Homo sapiens
agccctggcccacc

SEQ ID NO: 713082 - DNA, 18 bp, Homo sapiens
agccctggcctggctggg

SEQ ID NO: 713083 - DNA, 16 bp, Homo sapiens
agccctggcctttttc

SEQ ID NO: 713084 - DNA, 13 bp, Homo sapiens
agccctggctccc

SEQ ID NO: 713085 - DNA, 15 bp, Homo sapiens
agccctggctcccac

SEQ ID NO: 713086 - DNA, 16 bp, Homo sapiens
agccctggctcccacc

SEQ ID NO: 713087 - DNA, 17 bp, Homo sapiens
agccctggctctgcccc

SEQ ID NO: 713088 - DNA, 19 bp, Homo sapiens
agccctggctctgcccctc

SEQ ID NO: 713089 - DNA, 14 bp, Homo sapiens
agccctgggaacca

SEQ ID NO: 713090 - DNA, 17 bp, Homo sapiens
agccctgggccccacca

SEQ ID NO: 713091 - DNA, 12 bp, Homo sapiens
agccctgggctt

SEQ ID NO: 713092 - DNA, 22 bp, Homo sapiens
agccctgggcttggctcttggc

SEQ ID NO: 713093 - DNA, 22 bp, Homo sapiens
agccctgggggattcctgagct

SEQ ID NO: 713094 - DNA, 23 bp, Homo sapiens
agccctgggggattcctgagctg

SEQ ID NO: 713095 - DNA, 18 bp, Homo sapiens
agccctggtgctcctgcc

SEQ ID NO: 713096 - DNA, 17 bp, Homo sapiens
agccctgtacccacccc

SEQ ID NO: 713097 - DNA, 20 bp, Homo sapiens
agccctgtacccaccccagc

SEQ ID NO: 713098 - DNA, 11 bp, Homo sapiens
agccctgtcct

SEQ ID NO: 713099 - DNA, 13 bp, Homo sapiens
agccctgtcctgg

SEQ ID NO: 713100 - DNA, 21 bp, Homo sapiens
agccctgtcctggtggtattt

SEQ ID NO: 713101 - DNA, 23 bp, Homo sapiens
agccctgtcctggtggtattttc

SEQ ID NO: 713102 - DNA, 14 bp, Homo sapiens
agccctgtggccgc

SEQ ID NO: 713103 - DNA, 21 bp, Homo sapiens
agccctgtggccgccacctga

SEQ ID NO: 713104 - DNA, 17 bp, Homo sapiens
agccctgtgtctgtcac

SEQ ID NO: 713105 - DNA, 18 bp, Homo sapiens
agccctgtgtctgtcaca

SEQ ID NO: 713106 - DNA, 20 bp, Homo sapiens
agccctgtgtctgtcacagg

SEQ ID NO: 713107 - DNA, 23 bp, Homo sapiens
agccctgttgacacaggtctttc

SEQ ID NO: 713108 - DNA, 17 bp, Homo sapiens
agcccttagcacagaga

SEQ ID NO: 713109 - DNA, 21 bp, Homo sapiens
agcccttatgcggttaatttt

SEQ ID NO: 713110 - DNA, 13 bp, Homo sapiens
agcccttcagatt

SEQ ID NO: 713111 - DNA, 19 bp, Homo sapiens
agcccttccagcctgggac

SEQ ID NO: 713112 - DNA, 20 bp, Homo sapiens
agcccttccagcctgggaca

SEQ ID NO: 713113 - DNA, 15 bp, Homo sapiens
agcccttcctcctga

SEQ ID NO: 713114 - DNA, 17 bp, Homo sapiens
agcccttccttgggcgt

SEQ ID NO: 713115 - DNA, 18 bp, Homo sapiens
agcccttcggtcacctgt

SEQ ID NO: 713116 - DNA, 11 bp, Homo sapiens
agcccttctct

SEQ ID NO: 713117 - DNA, 12 bp, Homo sapiens
agcccttctctt

SEQ ID NO: 713118 - DNA, 13 bp, Homo sapiens
agcccttctcttt

SEQ ID NO: 713119 - DNA, 18 bp, Homo sapiens
agcccttctgcctttctc

SEQ ID NO: 713120 - DNA, 16 bp, Homo sapiens
agcccttgaagatatc

SEQ ID NO: 713121 - DNA, 19 bp, Homo sapiens
agcccttgactgtacagag

SEQ ID NO: 713122 - DNA, 14 bp, Homo sapiens
agcccttgccccca

SEQ ID NO: 713123 - DNA, 15 bp, Homo sapiens
agcccttgcccccat

SEQ ID NO: 713124 - DNA, 18 bp, Homo sapiens
agcccttgcccccatccc

SEQ ID NO: 713125 - DNA, 16 bp, Homo sapiens
agcccttgcctcccca

SEQ ID NO: 713126 - DNA, 12 bp, Homo sapiens
agcccttgggca

SEQ ID NO: 713127 - DNA, 22 bp, Homo sapiens
agcccttgggcagttctcactc

SEQ ID NO: 713128 - DNA, 15 bp, Homo sapiens
agcccttggggaggg

SEQ ID NO: 713129 - DNA, 16 bp, Homo sapiens
agcccttgtgtgtgcc

SEQ ID NO: 713130 - DNA, 19 bp, Homo sapiens
agcccttgtgtgtgccctg

SEQ ID NO: 713131 - DNA, 16 bp, Homo sapiens
agccctttctgtgtgc

SEQ ID NO: 713132 - DNA, 16 bp, Homo sapiens
agccctttgctctgga

SEQ ID NO: 713133 - DNA, 23 bp, Homo sapiens
agccctttggagaacgccagtct

SEQ ID NO: 713134 - DNA, 22 bp, Homo sapiens
agcccttttacagctcttggca

SEQ ID NO: 713135 - DNA, 21 bp, Homo sapiens
agccgacaatgccctgctggc

SEQ ID NO: 713136 - DNA, 14 bp, Homo sapiens
agccgaccctcctg

SEQ ID NO: 713137 - DNA, 16 bp, Homo sapiens
agccgaccctcctggc

SEQ ID NO: 713138 - DNA, 15 bp, Homo sapiens
agccgacctcagcct

SEQ ID NO: 713139 - DNA, 15 bp, Homo sapiens
agccgaccttccctc

SEQ ID NO: 713140 - DNA, 16 bp, Homo sapiens
agccgactctggccct

SEQ ID NO: 713141 - DNA, 17 bp, Homo sapiens
agccgactctggccctg

SEQ ID NO: 713142 - DNA, 14 bp, Homo sapiens
agccgagaaattgg

SEQ ID NO: 713143 - DNA, 19 bp, Homo sapiens
agccgcaccctgcacctgc

SEQ ID NO: 713144 - DNA, 15 bp, Homo sapiens
agccgcagcgcagcc

SEQ ID NO: 713145 - DNA, 17 bp, Homo sapiens
agccgcatcttctccat

SEQ ID NO: 713146 - DNA, 23 bp, Homo sapiens
agccgccagctgggagcactggt

SEQ ID NO: 713147 - DNA, 17 bp, Homo sapiens
agccgccagttcatctt

SEQ ID NO: 713148 - DNA, 21 bp, Homo sapiens
agccgccatgctcctggccca

SEQ ID NO: 713149 - DNA, 17 bp, Homo sapiens
agccgccattgccacca

SEQ ID NO: 713150 - DNA, 19 bp, Homo sapiens
agccgccattgccaccagg

SEQ ID NO: 713151 - DNA, 13 bp, Homo sapiens
agccgccctgaga

SEQ ID NO: 713152 - DNA, 13 bp, Homo sapiens
agccgccctgggc

SEQ ID NO: 713153 - DNA, 12 bp, Homo sapiens
agccgcctgctt

SEQ ID NO: 713154 - DNA, 22 bp, Homo sapiens
agccgcgcggggccgctgtcca

SEQ ID NO: 713155 - DNA, 15 bp, Homo sapiens
agccgctaggagaga

SEQ ID NO: 713156 - DNA, 16 bp, Homo sapiens
agccgctcctgtctgc

SEQ ID NO: 713157 - DNA, 17 bp, Homo sapiens
agccgctcctgtctgcc

SEQ ID NO: 713158 - DNA, 19 bp, Homo sapiens
agccgctgtgagcccctgg

SEQ ID NO: 713159 - DNA, 18 bp, Homo sapiens
agccggaatagagcctcg

SEQ ID NO: 713160 - DNA, 16 bp, Homo sapiens
agccggcacagggtct

SEQ ID NO: 713161 - DNA, 20 bp, Homo sapiens
agccggcatccttgcctgtc

SEQ ID NO: 713162 - DNA, 18 bp, Homo sapiens
agccggccaatggaaacc

SEQ ID NO: 713163 - DNA, 21 bp, Homo sapiens
agccggccgccttctcccctc

SEQ ID NO: 713164 - DNA, 22 bp, Homo sapiens
agccggcctctctggcctccca

SEQ ID NO: 713165 - DNA, 17 bp, Homo sapiens
agccgggaccctcaggt

SEQ ID NO: 713166 - DNA, 16 bp, Homo sapiens
cctcgttgcccagcac

SEQ ID NO: 713167 - DNA, 20 bp, Homo sapiens
cctcgttggaagaggaacag

SEQ ID NO: 713168 - DNA, 16 bp, Homo sapiens
cctctaaagaaacttg

SEQ ID NO: 713169 - DNA, 18 bp, Homo sapiens
cctctaaagcagaggcaa

SEQ ID NO: 713170 - DNA, 14 bp, Homo sapiens
cctctaaccctcat

SEQ ID NO: 713171 - DNA, 17 bp, Homo sapiens
cctctaaccctcattgc

SEQ ID NO: 713172 - DNA, 15 bp, Homo sapiens
cctctaactcactgc

SEQ ID NO: 713173 - DNA, 16 bp, Homo sapiens
cctctaatagaggcag

SEQ ID NO: 713174 - DNA, 23 bp, Homo sapiens
cctctaatagaggcagtgagact

SEQ ID NO: 713175 - DNA, 16 bp, Homo sapiens
cctctaccagaactaa

SEQ ID NO: 713176 - DNA, 16 bp, Homo sapiens
cctctacccaaaccct

SEQ ID NO: 713177 - DNA, 15 bp, Homo sapiens
cctctaccccaattt

SEQ ID NO: 713178 - DNA, 16 bp, Homo sapiens
cctctagaaataggtt

SEQ ID NO: 713179 - DNA, 16 bp, Homo sapiens
cctctagaagccaagg

SEQ ID NO: 713180 - DNA, 21 bp, Homo sapiens
cctctagagccttcagcctta

SEQ ID NO: 713181 - DNA, 22 bp, Homo sapiens
cctctagagccttcagccttaa

SEQ ID NO: 713182 - DNA, 14 bp, Homo sapiens
cctctagagctgga

SEQ ID NO: 713183 - DNA, 22 bp, Homo sapiens
cctctagctgtgggggtgaggg

SEQ ID NO: 713184 - DNA, 20 bp, Homo sapiens
cctctagcttttctattttt

SEQ ID NO: 713185 - DNA, 18 bp, Homo sapiens
cctctaggggcagcctcc

SEQ ID NO: 713186 - DNA, 23 bp, Homo sapiens
cctctagttgagtttctggcgcc

SEQ ID NO: 713187 - DNA, 15 bp, Homo sapiens
cctctatacatctct

SEQ ID NO: 713188 - DNA, 20 bp, Homo sapiens
cctctatacatctctcccca

SEQ ID NO: 713189 - DNA, 16 bp, Homo sapiens
cctctatgccctgcag

SEQ ID NO: 713190 - DNA, 18 bp, Homo sapiens
cctctatgccctgcagag

SEQ ID NO: 713191 - DNA, 22 bp, Homo sapiens
cctctatgccctgcagagcaat

SEQ ID NO: 713192 - DNA, 23 bp, Homo sapiens
cctctatgccctgcagagcaata

SEQ ID NO: 713193 - DNA, 12 bp, Homo sapiens
cctctattttgt

SEQ ID NO: 713194 - DNA, 18 bp, Homo sapiens
cctctcaactgcctcagc

SEQ ID NO: 713195 - DNA, 17 bp, Homo sapiens
cctctcaagctagccag

SEQ ID NO: 713196 - DNA, 16 bp, Homo sapiens
cctctcaccccacttc

SEQ ID NO: 713197 - DNA, 16 bp, Homo sapiens
cctctcacctctccct

SEQ ID NO: 713198 - DNA, 17 bp, Homo sapiens
cctctcacgccaccccc

SEQ ID NO: 713199 - DNA, 18 bp, Homo sapiens
cctctcacgccacccccg

SEQ ID NO: 713200 - DNA, 16 bp, Homo sapiens
cctctcactagtgcca

SEQ ID NO: 713201 - DNA, 17 bp, Homo sapiens
cctctcactagtgccaa

SEQ ID NO: 713202 - DNA, 21 bp, Homo sapiens
cctctcactccagccaaagaa

SEQ ID NO: 713203 - DNA, 14 bp, Homo sapiens
cctctcagacccag

SEQ ID NO: 713204 - DNA, 19 bp, Homo sapiens
cctctcagaggcctgctgc

SEQ ID NO: 713205 - DNA, 22 bp, Homo sapiens
cctctcagaggcctgctgccag

SEQ ID NO: 713206 - DNA, 19 bp, Homo sapiens
cctctcagcatagcctgcc

SEQ ID NO: 713207 - DNA, 21 bp, Homo sapiens
cctctcagctgctgggacgat

SEQ ID NO: 713208 - DNA, 20 bp, Homo sapiens
cctctcaggcatgcctgtgt

SEQ ID NO: 713209 - DNA, 14 bp, Homo sapiens
cctctcaggtgggt

SEQ ID NO: 713210 - DNA, 18 bp, Homo sapiens
cctctcagtgccctccag

SEQ ID NO: 713211 - DNA, 23 bp, Homo sapiens
cctctcatcatttgcattgggca

SEQ ID NO: 713212 - DNA, 18 bp, Homo sapiens
cctctcatgtccctccag

SEQ ID NO: 713213 - DNA, 19 bp, Homo sapiens
cctctcatgtccctccagg

SEQ ID NO: 713214 - DNA, 20 bp, Homo sapiens
cctctccaaccactgtgcca

SEQ ID NO: 713215 - DNA, 21 bp, Homo sapiens
cctctccaaccactgtgccac

SEQ ID NO: 713216 - DNA, 23 bp, Homo sapiens
cctctccaaccactgtgccactg

SEQ ID NO: 713217 - DNA, 13 bp, Homo sapiens
cctctccaagggc

SEQ ID NO: 713218 - DNA, 16 bp, Homo sapiens
cctctccaagtctctc

SEQ ID NO: 713219 - DNA, 22 bp, Homo sapiens
cctctccaagtctctctgtgaa

SEQ ID NO: 713220 - DNA, 13 bp, Homo sapiens
cctctccaccctc

SEQ ID NO: 713221 - DNA, 19 bp, Homo sapiens
cctctccaccctcctctag

SEQ ID NO: 713222 - DNA, 14 bp, Homo sapiens
cctctccactccat

SEQ ID NO: 713223 - DNA, 15 bp, Homo sapiens
cctctccactccatg

SEQ ID NO: 713224 - DNA, 12 bp, Homo sapiens
cctctccactct

SEQ ID NO: 713225 - DNA, 16 bp, Homo sapiens
cctctccactcttctc

SEQ ID NO: 713226 - DNA, 18 bp, Homo sapiens
cctctccactcttctctc

SEQ ID NO: 713227 - DNA, 21 bp, Homo sapiens
cctctccactcttctctcctt

SEQ ID NO: 713228 - DNA, 20 bp, Homo sapiens
atttatctttatacagattt

SEQ ID NO: 713229 - DNA, 19 bp, Homo sapiens
atttatgaagcagatttat

SEQ ID NO: 713230 - DNA, 14 bp, Homo sapiens
atttatgaatataa

SEQ ID NO: 713231 - DNA, 18 bp, Homo sapiens
atttatgatcacttggaa

SEQ ID NO: 713232 - DNA, 17 bp, Homo sapiens
atttatgcacattcacg

SEQ ID NO: 713233 - DNA, 14 bp, Homo sapiens
atttatgcactgtg

SEQ ID NO: 713234 - DNA, 19 bp, Homo sapiens
atttatgcatggaaacctg

SEQ ID NO: 713235 - DNA, 18 bp, Homo sapiens
atttatgcatttcattca

SEQ ID NO: 713236 - DNA, 20 bp, Homo sapiens
atttatgcgaacctatgtct

SEQ ID NO: 713237 - DNA, 19 bp, Homo sapiens
atttatgcgtaatttaatg

SEQ ID NO: 713238 - DNA, 21 bp, Homo sapiens
atttatgcgtaatttaatggg

SEQ ID NO: 713239 - DNA, 21 bp, Homo sapiens
atttatgcttaaaatatgtat

SEQ ID NO: 713240 - DNA, 16 bp, Homo sapiens
atttatgggtggattt

SEQ ID NO: 713241 - DNA, 18 bp, Homo sapiens
atttatggtcaacactta

SEQ ID NO: 713242 - DNA, 15 bp, Homo sapiens
atttatggttgttaa

SEQ ID NO: 713243 - DNA, 23 bp, Homo sapiens
atttatggttgttaaaaatgtca

SEQ ID NO: 713244 - DNA, 13 bp, Homo sapiens
atttatgtaaaag

SEQ ID NO: 713245 - DNA, 12 bp, Homo sapiens
atttatgtagat

SEQ ID NO: 713246 - DNA, 18 bp, Homo sapiens
atttatgtctcatgtaat

SEQ ID NO: 713247 - DNA, 15 bp, Homo sapiens
atttatgtgtatatg

SEQ ID NO: 713248 - DNA, 16 bp, Homo sapiens
atttatgttaaaagat

SEQ ID NO: 713249 - DNA, 16 bp, Homo sapiens
atttattaaaaatgtt

SEQ ID NO: 713250 - DNA, 17 bp, Homo sapiens
atttattaaaaatgttc

SEQ ID NO: 713251 - DNA, 19 bp, Homo sapiens
atttattaaaaatgttctc

SEQ ID NO: 713252 - DNA, 22 bp, Homo sapiens
atttattaaaaatgttctcaaa

SEQ ID NO: 713253 - DNA, 21 bp, Homo sapiens
atttattaaaatgattgtaaa

SEQ ID NO: 713254 - DNA, 12 bp, Homo sapiens
atttattaaata

SEQ ID NO: 713255 - DNA, 15 bp, Homo sapiens
atttattaagatgga

SEQ ID NO: 713256 - DNA, 16 bp, Homo sapiens
atttattaagtctggg

SEQ ID NO: 713257 - DNA, 12 bp, Homo sapiens
atttattaatat

SEQ ID NO: 713258 - DNA, 14 bp, Homo sapiens
atttattactgtcc

SEQ ID NO: 713259 - DNA, 21 bp, Homo sapiens
atttattacttgtgcacttag

SEQ ID NO: 713260 - DNA, 19 bp, Homo sapiens
atttattagccctgcattt

SEQ ID NO: 713261 - DNA, 22 bp, Homo sapiens
atttattagccctgcattttca

SEQ ID NO: 713262 - DNA, 18 bp, Homo sapiens
atttattatatatttaca

SEQ ID NO: 713263 - DNA, 20 bp, Homo sapiens
atttattatatatttacaga

SEQ ID NO: 713264 - DNA, 12 bp, Homo sapiens
atttattattga

SEQ ID NO: 713265 - DNA, 15 bp, Homo sapiens
atttattattgaaat

SEQ ID NO: 713266 - DNA, 16 bp, Homo sapiens
atttattattgaaatt

SEQ ID NO: 713267 - DNA, 17 bp, Homo sapiens
atttattattgaaattg

SEQ ID NO: 713268 - DNA, 13 bp, Homo sapiens
atttattatttat

SEQ ID NO: 713269 - DNA, 20 bp, Homo sapiens
atttattcagcttcatttgt

SEQ ID NO: 713270 - DNA, 16 bp, Homo sapiens
atttattcataatgaa

SEQ ID NO: 713271 - DNA, 14 bp, Homo sapiens
atttattgactttg

SEQ ID NO: 713272 - DNA, 19 bp, Homo sapiens
atttattgactttgacaat

SEQ ID NO: 713273 - DNA, 12 bp, Homo sapiens
atttattgatta

SEQ ID NO: 713274 - DNA, 20 bp, Homo sapiens
atttattgattaaaaatgtg

SEQ ID NO: 713275 - DNA, 19 bp, Homo sapiens
atttattgcacattgttca

SEQ ID NO: 713276 - DNA, 16 bp, Homo sapiens
atttattgcattgctg

SEQ ID NO: 713277 - DNA, 17 bp, Homo sapiens
atttattgtattaggaa

SEQ ID NO: 713278 - DNA, 14 bp, Homo sapiens
atttattgtcagtt

SEQ ID NO: 713279 - DNA, 16 bp, Homo sapiens
atttattgttaaatta

SEQ ID NO: 713280 - DNA, 18 bp, Homo sapiens
atttattgttaaattaca

SEQ ID NO: 713281 - DNA, 13 bp, Homo sapiens
atttattgtttga

SEQ ID NO: 713282 - DNA, 12 bp, Homo sapiens
atttatttaaat

SEQ ID NO: 713283 - DNA, 18 bp, Homo sapiens
atttatttaatatttaat

SEQ ID NO: 713284 - DNA, 13 bp, Homo sapiens
atttatttacaga

SEQ ID NO: 713285 - DNA, 17 bp, Homo sapiens
atttatttactgctagt

SEQ ID NO: 713286 - DNA, 15 bp, Homo sapiens
atttatttatgaaaa

SEQ ID NO: 713287 - DNA, 14 bp, Homo sapiens
atttatttattact

SEQ ID NO: 713288 - DNA, 13 bp, Homo sapiens
atttatttattat

SEQ ID NO: 713289 - DNA, 14 bp, Homo sapiens
atttatttatttat

SEQ ID NO: 713290 - DNA, 14 bp, Homo sapiens
atttatttcatcat

SEQ ID NO: 713291 - DNA, 19 bp, Homo sapiens
atttatttccaatgtttca

SEQ ID NO: 713292 - DNA, 15 bp, Homo sapiens
atttatttcctccct

SEQ ID NO: 713293 - DNA, 13 bp, Homo sapiens
atttatttcctgc

SEQ ID NO: 713294 - DNA, 14 bp, Homo sapiens
atttatttcctgct

SEQ ID NO: 713295 - DNA, 15 bp, Homo sapiens
atttatttcctgcta

SEQ ID NO: 713296 - DNA, 17 bp, Homo sapiens
atttatttcctgctact

SEQ ID NO: 713297 - DNA, 11 bp, Homo sapiens
atttatttcta

SEQ ID NO: 713298 - DNA, 13 bp, Homo sapiens
atttatttctctg

SEQ ID NO: 713299 - DNA, 23 bp, Homo sapiens
atttatttctctggcaaactttt

SEQ ID NO: 713300 - DNA, 13 bp, Homo sapiens
atttatttgaatg

SEQ ID NO: 713301 - DNA, 15 bp, Homo sapiens
atttatttgcttctt

SEQ ID NO: 713302 - DNA, 15 bp, Homo sapiens
atttattttaatgta

SEQ ID NO: 713303 - DNA, 15 bp, Homo sapiens
atttattttacattt

SEQ ID NO: 713304 - DNA, 15 bp, Homo sapiens
atttattttataaga

SEQ ID NO: 713305 - DNA, 20 bp, Homo sapiens
atttattttattttagcagt

SEQ ID NO: 713306 - DNA, 20 bp, Homo sapiens
atttattttcctccccagca

SEQ ID NO: 713307 - DNA, 12 bp, Homo sapiens
atttattttgac

SEQ ID NO: 713308 - DNA, 13 bp, Homo sapiens
atttattttgaca

SEQ ID NO: 713309 - DNA, 16 bp, Homo sapiens
atttattttgctccct

SEQ ID NO: 713310 - DNA, 17 bp, Homo sapiens
atttattttgctccctc

SEQ ID NO: 713311 - DNA, 20 bp, Homo sapiens
atttattttgtatgaaatat

SEQ ID NO: 713312 - DNA, 18 bp, Homo sapiens
atttatttttacaagaag

SEQ ID NO: 713313 - DNA, 22 bp, Homo sapiens
atttatttttgggtttggccag

SEQ ID NO: 713314 - DNA, 19 bp, Homo sapiens
atttattttttttaaagaa

SEQ ID NO: 713315 - DNA, 14 bp, Homo sapiens
atttcaaaaaaaaa

SEQ ID NO: 713316 - DNA, 22 bp, Homo sapiens
atttcaaaaaaaaaaaaaaaga

SEQ ID NO: 713317 - DNA, 19 bp, Homo sapiens
atttcaaaaatataactta

SEQ ID NO: 713318 - DNA, 14 bp, Homo sapiens
atttcaaaactcat

SEQ ID NO: 713319 - DNA, 21 bp, Homo sapiens
atttcaaaatacatttgtaag

SEQ ID NO: 713320 - DNA, 13 bp, Homo sapiens
atttcaaaatgct

SEQ ID NO: 713321 - DNA, 21 bp, Homo sapiens
atttcaaaatgctttttatta

SEQ ID NO: 713322 - DNA, 21 bp, Homo sapiens
atttcaaaatggacgtactgg

SEQ ID NO: 713323 - DNA, 11 bp, Homo sapiens
atttcaaaatt

SEQ ID NO: 713324 - DNA, 13 bp, Homo sapiens
atttcaaaattaa

SEQ ID NO: 713325 - DNA, 18 bp, Homo sapiens
atttcaaacattttgtat

SEQ ID NO: 713326 - DNA, 16 bp, Homo sapiens
atttcaaagccctgcc

SEQ ID NO: 713327 - DNA, 18 bp, Homo sapiens
atttcaaagccctgcctc

SEQ ID NO: 713328 - DNA, 19 bp, Homo sapiens
atttcaaagccctgcctct

SEQ ID NO: 713329 - DNA, 20 bp, Homo sapiens
atttcaaagccctgcctctg

SEQ ID NO: 713330 - DNA, 22 bp, Homo sapiens
atttcaaagccctgcctctgtg

SEQ ID NO: 713331 - DNA, 14 bp, Homo sapiens
atttcaaatgcaga

SEQ ID NO: 713332 - DNA, 15 bp, Homo sapiens
atttcaacaagaata

SEQ ID NO: 713333 - DNA, 14 bp, Homo sapiens
atttcaacttttga

SEQ ID NO: 713334 - DNA, 15 bp, Homo sapiens
atttcaacttttgac

SEQ ID NO: 713335 - DNA, 21 bp, Homo sapiens
atttcaagcagctgaagaaaa

SEQ ID NO: 713336 - DNA, 16 bp, Homo sapiens
atttcaatcattgaag

SEQ ID NO: 713337 - DNA, 16 bp, Homo sapiens
atttcaatgtcagcct

SEQ ID NO: 713338 - DNA, 21 bp, Homo sapiens
atttcaatgtcagcctttgtt

SEQ ID NO: 713339 - DNA, 14 bp, Homo sapiens
atttcaatgtgtat

SEQ ID NO: 713340 - DNA, 20 bp, Homo sapiens
atttcaatgtgtataaattg

SEQ ID NO: 713341 - DNA, 14 bp, Homo sapiens
atttcaattctcaa

SEQ ID NO: 713342 - DNA, 15 bp, Homo sapiens
atttcacaagctatt

SEQ ID NO: 713343 - DNA, 10 bp, Homo sapiens
atttcacagt

SEQ ID NO: 713344 - DNA, 17 bp, Homo sapiens
atttcacagttctgtaa

SEQ ID NO: 713345 - DNA, 13 bp, Homo sapiens
atttcacattaat

SEQ ID NO: 713346 - DNA, 21 bp, Homo sapiens
atttcacattaatatttgctg

SEQ ID NO: 713347 - DNA, 15 bp, Homo sapiens
atttcacctgtaaac

SEQ ID NO: 713348 - DNA, 23 bp, Homo sapiens
atttcacctgtgacaaaggatga

SEQ ID NO: 713349 - DNA, 16 bp, Homo sapiens
atttcactaatcatga

SEQ ID NO: 713350 - DNA, 16 bp, Homo sapiens
atttcactagagacaa

SEQ ID NO: 713351 - DNA, 21 bp, Homo sapiens
atttcactagagacaaatctt

SEQ ID NO: 713352 - DNA, 22 bp, Homo sapiens
atttcactagagacaaatcttt

SEQ ID NO: 713353 - DNA, 20 bp, Homo sapiens
atttcactaggactcagaaa

SEQ ID NO: 713354 - DNA, 22 bp, Homo sapiens
cctctccactcttctctccttt

SEQ ID NO: 713355 - DNA, 14 bp, Homo sapiens
cctctccactgcct

SEQ ID NO: 713356 - DNA, 16 bp, Homo sapiens
cctctccactgctgga

SEQ ID NO: 713357 - DNA, 18 bp, Homo sapiens
cctctccactgctggaca

SEQ ID NO: 713358 - DNA, 19 bp, Homo sapiens
cctctccactgctggacat

SEQ ID NO: 713359 - DNA, 17 bp, Homo sapiens
cctctccaggaagggag

SEQ ID NO: 713360 - DNA, 17 bp, Homo sapiens
cctctccaggcaccctt

SEQ ID NO: 713361 - DNA, 20 bp, Homo sapiens
cctctccagtttgcacctgt

SEQ ID NO: 713362 - DNA, 17 bp, Homo sapiens
cctctccatatctcctt

SEQ ID NO: 713363 - DNA, 22 bp, Homo sapiens
cctctcccacccggccacagct

SEQ ID NO: 713364 - DNA, 23 bp, Homo sapiens
cctctcccacccggccacagctg

SEQ ID NO: 713365 - DNA, 15 bp, Homo sapiens
cctctcccaggctgt

SEQ ID NO: 713366 - DNA, 13 bp, Homo sapiens
cctctcccaggga

SEQ ID NO: 713367 - DNA, 20 bp, Homo sapiens
cctctcccagtccatttcca

SEQ ID NO: 713368 - DNA, 14 bp, Homo sapiens
cctctcccatcccc

SEQ ID NO: 713369 - DNA, 21 bp, Homo sapiens
cctctcccatccccctgccct

SEQ ID NO: 713370 - DNA, 19 bp, Homo sapiens
cctctcccattgtccctct

SEQ ID NO: 713371 - DNA, 23 bp, Homo sapiens
cctctccccaatccatgcttcac

SEQ ID NO: 713372 - DNA, 14 bp, Homo sapiens
cctctccccacccc

SEQ ID NO: 713373 - DNA, 22 bp, Homo sapiens
cctctcccccaaccccctgcaa

SEQ ID NO: 713374 - DNA, 13 bp, Homo sapiens
cctctcccccttc

SEQ ID NO: 713375 - DNA, 15 bp, Homo sapiens
cctctcccccttcag

SEQ ID NO: 713376 - DNA, 16 bp, Homo sapiens
cctctcccccttcagc

SEQ ID NO: 713377 - DNA, 18 bp, Homo sapiens
cctctcccccttcagctc

SEQ ID NO: 713378 - DNA, 22 bp, Homo sapiens
cctctcccccttcagctcctga

SEQ ID NO: 713379 - DNA, 23 bp, Homo sapiens
cctctcccccttcagctcctgag

SEQ ID NO: 713380 - DNA, 16 bp, Homo sapiens
cctctccccttggttc

SEQ ID NO: 713381 - DNA, 12 bp, Homo sapiens
cctctcccggct

SEQ ID NO: 713382 - DNA, 16 bp, Homo sapiens
cctctcccggctgcct

SEQ ID NO: 713383 - DNA, 19 bp, Homo sapiens
cctctcccggctgcctgcc

SEQ ID NO: 713384 - DNA, 17 bp, Homo sapiens
cctctcccgtcagggcc

SEQ ID NO: 713385 - DNA, 19 bp, Homo sapiens
cctctcccgtcagggccca

SEQ ID NO: 713386 - DNA, 23 bp, Homo sapiens
cctctcccgtcagggcccaagtc

SEQ ID NO: 713387 - DNA, 13 bp, Homo sapiens
cctctccctcagg

SEQ ID NO: 713388 - DNA, 17 bp, Homo sapiens
cctctccctcaggggca

SEQ ID NO: 713389 - DNA, 21 bp, Homo sapiens
cctctccctgaccctgtatat

SEQ ID NO: 713390 - DNA, 12 bp, Homo sapiens
cctctccctgca

SEQ ID NO: 713391 - DNA, 19 bp, Homo sapiens
cctctccctgcatcctgag

SEQ ID NO: 713392 - DNA, 20 bp, Homo sapiens
cctctccctgcatcctgagg

SEQ ID NO: 713393 - DNA, 12 bp, Homo sapiens
cctctccctggg

SEQ ID NO: 713394 - DNA, 13 bp, Homo sapiens
cctctccctgggt

SEQ ID NO: 713395 - DNA, 12 bp, Homo sapiens
cctctcccttcc

SEQ ID NO: 713396 - DNA, 16 bp, Homo sapiens
cctctcccttccctcc

SEQ ID NO: 713397 - DNA, 16 bp, Homo sapiens
cctctccgcgggagac

SEQ ID NO: 713398 - DNA, 22 bp, Homo sapiens
cctctccgcgggagaccccttg

SEQ ID NO: 713399 - DNA, 20 bp, Homo sapiens
cctctcctactcggctctgc

SEQ ID NO: 713400 - DNA, 18 bp, Homo sapiens
cctctcctcatgttctgc

SEQ ID NO: 713401 - DNA, 12 bp, Homo sapiens
cctctcctccca

SEQ ID NO: 713402 - DNA, 14 bp, Homo sapiens
cctctcctccccct

SEQ ID NO: 713403 - DNA, 14 bp, Homo sapiens
cctctcctccgcca

SEQ ID NO: 713404 - DNA, 18 bp, Homo sapiens
cctctcctcggttcaagg

SEQ ID NO: 713405 - DNA, 16 bp, Homo sapiens
cctctcctgacccctg

SEQ ID NO: 713406 - DNA, 11 bp, Homo sapiens
cctctcctgcc

SEQ ID NO: 713407 - DNA, 13 bp, Homo sapiens
cctctcctgccca

SEQ ID NO: 713408 - DNA, 18 bp, Homo sapiens
cctctcctgcccaagcac

SEQ ID NO: 713409 - DNA, 16 bp, Homo sapiens
cctctcctgcccagat

SEQ ID NO: 713410 - DNA, 15 bp, Homo sapiens
cctctcctgcctact

SEQ ID NO: 713411 - DNA, 14 bp, Homo sapiens
cctctcctgtctgc

SEQ ID NO: 713412 - DNA, 14 bp, Homo sapiens
cctctccttcccac

SEQ ID NO: 713413 - DNA, 16 bp, Homo sapiens
cctctccttcccacaa

SEQ ID NO: 713414 - DNA, 15 bp, Homo sapiens
cctctccttcctgtg

SEQ ID NO: 713415 - DNA, 15 bp, Homo sapiens
cctctccttctccta

SEQ ID NO: 713416 - DNA, 16 bp, Homo sapiens
cctctccttgggctcc

SEQ ID NO: 713417 - DNA, 20 bp, Homo sapiens
cctctccttgggctcctggc

SEQ ID NO: 713418 - DNA, 21 bp, Homo sapiens
cctctccttgggctcctggct

SEQ ID NO: 713419 - DNA, 17 bp, Homo sapiens
cctctccttttgaggct

SEQ ID NO: 713420 - DNA, 19 bp, Homo sapiens
cctctcgccccatccctgc

SEQ ID NO: 713421 - DNA, 22 bp, Homo sapiens
cctctcgcttcctcagcctcca

SEQ ID NO: 713422 - DNA, 15 bp, Homo sapiens
cctctcggccaggca

SEQ ID NO: 713423 - DNA, 15 bp, Homo sapiens
cctctcggccccatc

SEQ ID NO: 713424 - DNA, 21 bp, Homo sapiens
cctctcggccccatcgcccca

SEQ ID NO: 713425 - DNA, 17 bp, Homo sapiens
cctctcgggctctctca

SEQ ID NO: 713426 - DNA, 19 bp, Homo sapiens
cctctcgggctctctcacc

SEQ ID NO: 713427 - DNA, 16 bp, Homo sapiens
cctctctaagccacag

SEQ ID NO: 713428 - DNA, 20 bp, Homo sapiens
cctctctcccaccctaaggg

SEQ ID NO: 713429 - DNA, 19 bp, Homo sapiens
cctctctcctgcctgccct

SEQ ID NO: 713430 - DNA, 21 bp, Homo sapiens
cctctctccttggccacagac

SEQ ID NO: 713431 - DNA, 20 bp, Homo sapiens
cctctctcggagccctcaga

SEQ ID NO: 713432 - DNA, 16 bp, Homo sapiens
cctctctcggccccct

SEQ ID NO: 713433 - DNA, 19 bp, Homo sapiens
cctctctctaccagtctat

SEQ ID NO: 713434 - DNA, 20 bp, Homo sapiens
cctctctctaccagtctatt

SEQ ID NO: 713435 - DNA, 19 bp, Homo sapiens
cctctctctccctccctct

SEQ ID NO: 713436 - DNA, 16 bp, Homo sapiens
cctctctctctctcct

SEQ ID NO: 713437 - DNA, 19 bp, Homo sapiens
cctctctctctctcctcag

SEQ ID NO: 713438 - DNA, 11 bp, Homo sapiens
cctctctctgt

SEQ ID NO: 713439 - DNA, 19 bp, Homo sapiens
cctctctcttctgctccac

SEQ ID NO: 713440 - DNA, 23 bp, Homo sapiens
cctctctgatcttgtgctcagca

SEQ ID NO: 713441 - DNA, 12 bp, Homo sapiens
cctctctgcacc

SEQ ID NO: 713442 - DNA, 22 bp, Homo sapiens
cctctctgcagacttcccagct

SEQ ID NO: 713443 - DNA, 22 bp, Homo sapiens
cctctctgccgcaatacaggaa

SEQ ID NO: 713444 - DNA, 13 bp, Homo sapiens
cctctctgcctct

SEQ ID NO: 713445 - DNA, 17 bp, Homo sapiens
cctctctgcctctcttc

SEQ ID NO: 713446 - DNA, 14 bp, Homo sapiens
cctctctgcctggg

SEQ ID NO: 713447 - DNA, 15 bp, Homo sapiens
cctctctgctccaga

SEQ ID NO: 713448 - DNA, 22 bp, Homo sapiens
cctctctgctccagactcactt

SEQ ID NO: 713449 - DNA, 14 bp, Homo sapiens
cctctctgctcctt

SEQ ID NO: 713450 - DNA, 12 bp, Homo sapiens
cctctctgctct

SEQ ID NO: 713451 - DNA, 13 bp, Homo sapiens
cctctctgcttca

SEQ ID NO: 713452 - DNA, 22 bp, Homo sapiens
cctctctggcctcccacccgat

SEQ ID NO: 713453 - DNA, 13 bp, Homo sapiens
cctctctgggcct

SEQ ID NO: 713454 - DNA, 11 bp, Homo sapiens
cctctctgggg

SEQ ID NO: 713455 - DNA, 14 bp, Homo sapiens
cctctctgggggag

SEQ ID NO: 713456 - DNA, 22 bp, Homo sapiens
cctctctggtttcctatttgca

SEQ ID NO: 713457 - DNA, 23 bp, Homo sapiens
cctctctggtttcctatttgcag

SEQ ID NO: 713458 - DNA, 19 bp, Homo sapiens
cctctctgtagtttatggc

SEQ ID NO: 713459 - DNA, 12 bp, Homo sapiens
cctctctgtccc

SEQ ID NO: 713460 - DNA, 13 bp, Homo sapiens
cctctctgtccct

SEQ ID NO: 713461 - DNA, 17 bp, Homo sapiens
cctctctgtcccttgct

SEQ ID NO: 713462 - DNA, 13 bp, Homo sapiens
cctctcttcagcc

SEQ ID NO: 713463 - DNA, 12 bp, Homo sapiens
cctctcttccct

SEQ ID NO: 713464 - DNA, 12 bp, Homo sapiens
cctctcttcctc

SEQ ID NO: 713465 - DNA, 17 bp, Homo sapiens
cctctcttctcaccttt

SEQ ID NO: 713466 - DNA, 19 bp, Homo sapiens
cctctcttgattaagggct

SEQ ID NO: 713467 - DNA, 14 bp, Homo sapiens
cctctcttgcaccc

SEQ ID NO: 713468 - DNA, 17 bp, Homo sapiens
cctctcttgcacccgcc

SEQ ID NO: 713469 - DNA, 20 bp, Homo sapiens
cctctcttgccccttgtcct

SEQ ID NO: 713470 - DNA, 16 bp, Homo sapiens
cctctcttttcctctc

SEQ ID NO: 713471 - DNA, 17 bp, Homo sapiens
cctctcttttcctctct

SEQ ID NO: 713472 - DNA, 19 bp, Homo sapiens
cctctcttttcctctctgt

SEQ ID NO: 713473 - DNA, 20 bp, Homo sapiens
cctctcttttcctctctgtc

SEQ ID NO: 713474 - DNA, 20 bp, Homo sapiens
cctctgaagttggacagcaa

SEQ ID NO: 713475 - DNA, 16 bp, Homo sapiens
cctctgaccctccttc

SEQ ID NO: 713476 - DNA, 16 bp, Homo sapiens
cctctgacctgcactg

SEQ ID NO: 713477 - DNA, 16 bp, Homo sapiens
cctctgacctgcaggc

SEQ ID NO: 713478 - DNA, 19 bp, Homo sapiens
cctctgacctgcaggccaa

SEQ ID NO: 713479 - DNA, 22 bp, Homo sapiens
atttcactatttttatttatat

SEQ ID NO: 713480 - DNA, 22 bp, Homo sapiens
atttcactgtctttaattctgt

SEQ ID NO: 713481 - DNA, 15 bp, Homo sapiens
atttcactttagatg

SEQ ID NO: 713482 - DNA, 15 bp, Homo sapiens
atttcacttttgttc

SEQ ID NO: 713483 - DNA, 16 bp, Homo sapiens
atttcacttttgttct

SEQ ID NO: 713484 - DNA, 12 bp, Homo sapiens
atttcagaagag

SEQ ID NO: 713485 - DNA, 12 bp, Homo sapiens
atttcagaagtt

SEQ ID NO: 713486 - DNA, 17 bp, Homo sapiens
atttcagagctgaggct

SEQ ID NO: 713487 - DNA, 14 bp, Homo sapiens
atttcagagggtaa

SEQ ID NO: 713488 - DNA, 16 bp, Homo sapiens
atttcagatgctttag

SEQ ID NO: 713489 - DNA, 15 bp, Homo sapiens
atttcagatgtaatg

SEQ ID NO: 713490 - DNA, 16 bp, Homo sapiens
atttcagatgtaatgt

SEQ ID NO: 713491 - DNA, 18 bp, Homo sapiens
atttcagatgtaatgttt

SEQ ID NO: 713492 - DNA, 19 bp, Homo sapiens
atttcagatgtaatgtttt

SEQ ID NO: 713493 - DNA, 16 bp, Homo sapiens
atttcagccaaagtcc

SEQ ID NO: 713494 - DNA, 18 bp, Homo sapiens
atttcagcttgaacctgc

SEQ ID NO: 713495 - DNA, 22 bp, Homo sapiens
atttcaggaaaatgtattgatt

SEQ ID NO: 713496 - DNA, 13 bp, Homo sapiens
atttcaggaattt

SEQ ID NO: 713497 - DNA, 14 bp, Homo sapiens
atttcaggaattta

SEQ ID NO: 713498 - DNA, 19 bp, Homo sapiens
atttcaggaggaatactga

SEQ ID NO: 713499 - DNA, 22 bp, Homo sapiens
atttcaggaggaatactgaaca

SEQ ID NO: 713500 - DNA, 22 bp, Homo sapiens
atttcaggatactctgtcagat

SEQ ID NO: 713501 - DNA, 22 bp, Homo sapiens
atttcaggcagcaggggctgct

SEQ ID NO: 713502 - DNA, 14 bp, Homo sapiens
atttcagggaaatt

SEQ ID NO: 713503 - DNA, 16 bp, Homo sapiens
atttcagggaaattaa

SEQ ID NO: 713504 - DNA, 18 bp, Homo sapiens
atttcagggacctcaggg

SEQ ID NO: 713505 - DNA, 22 bp, Homo sapiens
atttcaggggtcgtcaccacct

SEQ ID NO: 713506 - DNA, 15 bp, Homo sapiens
atttcagggtgcagc

SEQ ID NO: 713507 - DNA, 14 bp, Homo sapiens
atttcagtaagtct

SEQ ID NO: 713508 - DNA, 17 bp, Homo sapiens
atttcagtaatgtcttc

SEQ ID NO: 713509 - DNA, 14 bp, Homo sapiens
atttcagtagaatt

SEQ ID NO: 713510 - DNA, 20 bp, Homo sapiens
atttcagtatcatctccatc

SEQ ID NO: 713511 - DNA, 19 bp, Homo sapiens
atttcagtgtaaagtgtgt

SEQ ID NO: 713512 - DNA, 17 bp, Homo sapiens
atttcagtgtattgttt

SEQ ID NO: 713513 - DNA, 19 bp, Homo sapiens
atttcagtgttacctgtgt

SEQ ID NO: 713514 - DNA, 21 bp, Homo sapiens
atttcagtgttacctgtgtgc

SEQ ID NO: 713515 - DNA, 20 bp, Homo sapiens
atttcagtttttcatttgtt

SEQ ID NO: 713516 - DNA, 20 bp, Homo sapiens
atttcataattcagaactaa

SEQ ID NO: 713517 - DNA, 15 bp, Homo sapiens
atttcataattctga

SEQ ID NO: 713518 - DNA, 15 bp, Homo sapiens
atttcatagttcaga

SEQ ID NO: 713519 - DNA, 22 bp, Homo sapiens
atttcatatactataattgtaa

SEQ ID NO: 713520 - DNA, 19 bp, Homo sapiens
atttcatccagtttgttct

SEQ ID NO: 713521 - DNA, 16 bp, Homo sapiens
atttcatctatttctg

SEQ ID NO: 713522 - DNA, 14 bp, Homo sapiens
atttcatctatttt

SEQ ID NO: 713523 - DNA, 23 bp, Homo sapiens
atttcatctgggtggtctgaata

SEQ ID NO: 713524 - DNA, 16 bp, Homo sapiens
atttcatgaaaaagct

SEQ ID NO: 713525 - DNA, 18 bp, Homo sapiens
atttcatgaaaaagctgc

SEQ ID NO: 713526 - DNA, 23 bp, Homo sapiens
atttcatgattggcttaaagtga

SEQ ID NO: 713527 - DNA, 15 bp, Homo sapiens
atttcatgatttcat

SEQ ID NO: 713528 - DNA, 18 bp, Homo sapiens
atttcatgctatctctgt

SEQ ID NO: 713529 - DNA, 23 bp, Homo sapiens
atttcattacatttctgaattgt

SEQ ID NO: 713530 - DNA, 18 bp, Homo sapiens
atttcattatgctttgaa

SEQ ID NO: 713531 - DNA, 19 bp, Homo sapiens
atttcattcaaatcagtga

SEQ ID NO: 713532 - DNA, 20 bp, Homo sapiens
atttcattcaaatcagtgat

SEQ ID NO: 713533 - DNA, 12 bp, Homo sapiens
atttcattccat

SEQ ID NO: 713534 - DNA, 18 bp, Homo sapiens
atttcattccattgccta

SEQ ID NO: 713535 - DNA, 14 bp, Homo sapiens
atttcattcctaac

SEQ ID NO: 713536 - DNA, 14 bp, Homo sapiens
atttcattggttaa

SEQ ID NO: 713537 - DNA, 21 bp, Homo sapiens
atttcattttgtaacaaatga

SEQ ID NO: 713538 - DNA, 15 bp, Homo sapiens
atttccaaaagcaca

SEQ ID NO: 713539 - DNA, 16 bp, Homo sapiens
atttccaaagagaaaa

SEQ ID NO: 713540 - DNA, 24 bp, Homo sapiens
atttccaaatgtggcctccatgtg

SEQ ID NO: 713541 - DNA, 19 bp, Homo sapiens
atttccaacaccacagaca

SEQ ID NO: 713542 - DNA, 22 bp, Homo sapiens
atttccaacaccacagacacac

SEQ ID NO: 713543 - DNA, 23 bp, Homo sapiens
atttccaacaccacagacacaca

SEQ ID NO: 713544 - DNA, 13 bp, Homo sapiens
atttccaacagca

SEQ ID NO: 713545 - DNA, 20 bp, Homo sapiens
atttccaactggcactctgt

SEQ ID NO: 713546 - DNA, 14 bp, Homo sapiens
atttccacaccaag

SEQ ID NO: 713547 - DNA, 14 bp, Homo sapiens
atttccactatttt

SEQ ID NO: 713548 - DNA, 21 bp, Homo sapiens
atttccactattttcaaagaa

SEQ ID NO: 713549 - DNA, 14 bp, Homo sapiens
atttccactgaaca

SEQ ID NO: 713550 - DNA, 20 bp, Homo sapiens
atttccagagtccggaggca

SEQ ID NO: 713551 - DNA, 17 bp, Homo sapiens
atttccagccaaagcct

SEQ ID NO: 713552 - DNA, 20 bp, Homo sapiens
atttccaggaaaaaataaaa

SEQ ID NO: 713553 - DNA, 22 bp, Homo sapiens
atttccaggaaaaaataaaaag

SEQ ID NO: 713554 - DNA, 19 bp, Homo sapiens
atttccaggcccctgagga

SEQ ID NO: 713555 - DNA, 22 bp, Homo sapiens
atttccaggcccctgaggactg

SEQ ID NO: 713556 - DNA, 13 bp, Homo sapiens
atttccagtacct

SEQ ID NO: 713557 - DNA, 20 bp, Homo sapiens
atttccagtacctttgtcac

SEQ ID NO: 713558 - DNA, 17 bp, Homo sapiens
atttccagtgagtgtaa

SEQ ID NO: 713559 - DNA, 19 bp, Homo sapiens
atttccagtgagtgtaaat

SEQ ID NO: 713560 - DNA, 21 bp, Homo sapiens
atttccagtgttctatgaaca

SEQ ID NO: 713561 - DNA, 14 bp, Homo sapiens
atttccatatagtc

SEQ ID NO: 713562 - DNA, 17 bp, Homo sapiens
atttccatatggatttt

SEQ ID NO: 713563 - DNA, 12 bp, Homo sapiens
atttccatctta

SEQ ID NO: 713564 - DNA, 15 bp, Homo sapiens
atttccattatttat

SEQ ID NO: 713565 - DNA, 17 bp, Homo sapiens
atttccattccagaata

SEQ ID NO: 713566 - DNA, 19 bp, Homo sapiens
atttccattgtgtggcctg

SEQ ID NO: 713567 - DNA, 19 bp, Homo sapiens
atttccatttacttaagac

SEQ ID NO: 713568 - DNA, 19 bp, Homo sapiens
atttccatttattgtttga

SEQ ID NO: 713569 - DNA, 14 bp, Homo sapiens
atttccatttctga

SEQ ID NO: 713570 - DNA, 23 bp, Homo sapiens
atttcccaaagtcctctgctcca

SEQ ID NO: 713571 - DNA, 18 bp, Homo sapiens
atttcccaacacaaagat

SEQ ID NO: 713572 - DNA, 15 bp, Homo sapiens
atttcccagggttaa

SEQ ID NO: 713573 - DNA, 14 bp, Homo sapiens
atttcccatctgca

SEQ ID NO: 713574 - DNA, 17 bp, Homo sapiens
atttccccaccccagct

SEQ ID NO: 713575 - DNA, 18 bp, Homo sapiens
atttcccccctccgcctc

SEQ ID NO: 713576 - DNA, 14 bp, Homo sapiens
atttccccctcctc

SEQ ID NO: 713577 - DNA, 18 bp, Homo sapiens
atttcccctcttctgcta

SEQ ID NO: 713578 - DNA, 23 bp, Homo sapiens
atttcccctgtcagtttcccctc

SEQ ID NO: 713579 - DNA, 16 bp, Homo sapiens
atttccctatggctga

SEQ ID NO: 713580 - DNA, 24 bp, Homo sapiens
atttcccttcatttaaactaaatt

SEQ ID NO: 713581 - DNA, 23 bp, Homo sapiens
atttcccttgaaattttaaacta

SEQ ID NO: 713582 - DNA, 22 bp, Homo sapiens
atttccgcacttcagaattcca

SEQ ID NO: 713583 - DNA, 15 bp, Homo sapiens
atttccgttaaaata

SEQ ID NO: 713584 - DNA, 14 bp, Homo sapiens
atttcctaaggcat

SEQ ID NO: 713585 - DNA, 15 bp, Homo sapiens
atttcctacagaaat

SEQ ID NO: 713586 - DNA, 18 bp, Homo sapiens
atttcctatcacctattt

SEQ ID NO: 713587 - DNA, 20 bp, Homo sapiens
atttcctatgtaactgcatt

SEQ ID NO: 713588 - DNA, 17 bp, Homo sapiens
atttcctcactgcctgg

SEQ ID NO: 713589 - DNA, 23 bp, Homo sapiens
atttcctccatggtggaaggggg

SEQ ID NO: 713590 - DNA, 19 bp, Homo sapiens
atttcctccctctgcccct

SEQ ID NO: 713591 - DNA, 17 bp, Homo sapiens
atttcctcgcagcctct

SEQ ID NO: 713592 - DNA, 18 bp, Homo sapiens
atttcctctaaagaaact

SEQ ID NO: 713593 - DNA, 11 bp, Homo sapiens
atttcctctat

SEQ ID NO: 713594 - DNA, 10 bp, Homo sapiens
atttcctgat

SEQ ID NO: 713595 - DNA, 15 bp, Homo sapiens
atttcctgatctagc

SEQ ID NO: 713596 - DNA, 18 bp, Homo sapiens
atttcctgggagaaagac

SEQ ID NO: 713597 - DNA, 20 bp, Homo sapiens
atttcctgggagaaagacca

SEQ ID NO: 713598 - DNA, 21 bp, Homo sapiens
atttcctggtgtgaaggtcct

SEQ ID NO: 713599 - DNA, 23 bp, Homo sapiens
atttcctgtacaatcatgaacag

SEQ ID NO: 713600 - DNA, 14 bp, Homo sapiens
atttcctgtttgaa

SEQ ID NO: 713601 - DNA, 18 bp, Homo sapiens
atttccttaaactgtgtg

SEQ ID NO: 713602 - DNA, 17 bp, Homo sapiens
atttccttagtgccagg

SEQ ID NO: 713603 - DNA, 24 bp, Homo sapiens
cctctgactctgagtccactgctc

SEQ ID NO: 713604 - DNA, 13 bp, Homo sapiens
cctctgagatgct

SEQ ID NO: 713605 - DNA, 12 bp, Homo sapiens
cctctgagcctt

SEQ ID NO: 713606 - DNA, 21 bp, Homo sapiens
cctctgaggcactcatctact

SEQ ID NO: 713607 - DNA, 11 bp, Homo sapiens
cctctgaggct

SEQ ID NO: 713608 - DNA, 20 bp, Homo sapiens
cctctgatacccagagcatt

SEQ ID NO: 713609 - DNA, 18 bp, Homo sapiens
cctctgatagactttgtg

SEQ ID NO: 713610 - DNA, 19 bp, Homo sapiens
cctctgatagactttgtga

SEQ ID NO: 713611 - DNA, 17 bp, Homo sapiens
cctctgatcacattctt

SEQ ID NO: 713612 - DNA, 15 bp, Homo sapiens
cctctgatttttcct

SEQ ID NO: 713613 - DNA, 19 bp, Homo sapiens
cctctgcacaccctccaga

SEQ ID NO: 713614 - DNA, 20 bp, Homo sapiens
cctctgcacaccctccagag

SEQ ID NO: 713615 - DNA, 17 bp, Homo sapiens
cctctgcacccagaaca

SEQ ID NO: 713616 - DNA, 16 bp, Homo sapiens
cctctgcagaatccct

SEQ ID NO: 713617 - DNA, 12 bp, Homo sapiens
cctctgcagctg

SEQ ID NO: 713618 - DNA, 15 bp, Homo sapiens
cctctgcagctgacc

SEQ ID NO: 713619 - DNA, 17 bp, Homo sapiens
cctctgcagtgccttgg

SEQ ID NO: 713620 - DNA, 23 bp, Homo sapiens
cctctgcattgagcatattttct

SEQ ID NO: 713621 - DNA, 14 bp, Homo sapiens
cctctgccacctcc

SEQ ID NO: 713622 - DNA, 23 bp, Homo sapiens
cctctgccatgtttttcccctgc

SEQ ID NO: 713623 - DNA, 11 bp, Homo sapiens
cctctgcccag

SEQ ID NO: 713624 - DNA, 13 bp, Homo sapiens
cctctgcccagct

SEQ ID NO: 713625 - DNA, 16 bp, Homo sapiens
cctctgcccagcttgg

SEQ ID NO: 713626 - DNA, 20 bp, Homo sapiens
cctctgcccagcttgggccc

SEQ ID NO: 713627 - DNA, 15 bp, Homo sapiens
cctctgcccagggag

SEQ ID NO: 713628 - DNA, 23 bp, Homo sapiens
cctctgccccaagcagccagcca

SEQ ID NO: 713629 - DNA, 20 bp, Homo sapiens
cctctgcccctcccccagcc

SEQ ID NO: 713630 - DNA, 16 bp, Homo sapiens
cctctgcccgcagagc

SEQ ID NO: 713631 - DNA, 16 bp, Homo sapiens
cctctgccctgcctcc

SEQ ID NO: 713632 - DNA, 15 bp, Homo sapiens
cctctgcccttcctg

SEQ ID NO: 713633 - DNA, 10 bp, Homo sapiens
cctctgccta

SEQ ID NO: 713634 - DNA, 15 bp, Homo sapiens
cctctgcctacagcc

SEQ ID NO: 713635 - DNA, 12 bp, Homo sapiens
cctctgcctcaa

SEQ ID NO: 713636 - DNA, 13 bp, Homo sapiens
cctctgcctcaat

SEQ ID NO: 713637 - DNA, 18 bp, Homo sapiens
cctctgcctcctccccag

SEQ ID NO: 713638 - DNA, 21 bp, Homo sapiens
cctctgcctcctccccaggga

SEQ ID NO: 713639 - DNA, 17 bp, Homo sapiens
cctctgcctgcactccc

SEQ ID NO: 713640 - DNA, 21 bp, Homo sapiens
cctctgcctgcactccctggc

SEQ ID NO: 713641 - DNA, 11 bp, Homo sapiens
cctctgcctgg

SEQ ID NO: 713642 - DNA, 12 bp, Homo sapiens
cctctgcctggg

SEQ ID NO: 713643 - DNA, 14 bp, Homo sapiens
cctctgcctgggct

SEQ ID NO: 713644 - DNA, 14 bp, Homo sapiens
cctctgcctggggc

SEQ ID NO: 713645 - DNA, 12 bp, Homo sapiens
cctctgcctgtc

SEQ ID NO: 713646 - DNA, 15 bp, Homo sapiens
cctctgcctgtctcc

SEQ ID NO: 713647 - DNA, 13 bp, Homo sapiens
cctctgccttgga

SEQ ID NO: 713648 - DNA, 15 bp, Homo sapiens
cctctgccttggaca

SEQ ID NO: 713649 - DNA, 15 bp, Homo sapiens
cctctgctcaccgcc

SEQ ID NO: 713650 - DNA, 15 bp, Homo sapiens
cctctgctcaggcct

SEQ ID NO: 713651 - DNA, 14 bp, Homo sapiens
cctctgctccccag

SEQ ID NO: 713652 - DNA, 14 bp, Homo sapiens
cctctgctctgagg

SEQ ID NO: 713653 - DNA, 20 bp, Homo sapiens
cctctgctctgaggcttcca

SEQ ID NO: 713654 - DNA, 16 bp, Homo sapiens
cctctgctctgcctgg

SEQ ID NO: 713655 - DNA, 17 bp, Homo sapiens
cctctgctgaatgcagg

SEQ ID NO: 713656 - DNA, 22 bp, Homo sapiens
cctctgctgagtgctgggcact

SEQ ID NO: 713657 - DNA, 23 bp, Homo sapiens
cctctgctgcccccttccccagc

SEQ ID NO: 713658 - DNA, 14 bp, Homo sapiens
cctctgctgctgtc

SEQ ID NO: 713659 - DNA, 21 bp, Homo sapiens
cctctgctgggactcctttgc

SEQ ID NO: 713660 - DNA, 16 bp, Homo sapiens
cctctgcttacttttt

SEQ ID NO: 713661 - DNA, 14 bp, Homo sapiens
cctctggaaccccc

SEQ ID NO: 713662 - DNA, 18 bp, Homo sapiens
cctctggaaccccccagg

SEQ ID NO: 713663 - DNA, 22 bp, Homo sapiens
cctctggaaccccccaggccct

SEQ ID NO: 713664 - DNA, 23 bp, Homo sapiens
cctctggaaccccccaggcccta

SEQ ID NO: 713665 - DNA, 22 bp, Homo sapiens
cctctggacagccagtgacctt

SEQ ID NO: 713666 - DNA, 12 bp, Homo sapiens
cctctggacagt

SEQ ID NO: 713667 - DNA, 22 bp, Homo sapiens
cctctggacggcaggctcactg

SEQ ID NO: 713668 - DNA, 14 bp, Homo sapiens
cctctggactggct

SEQ ID NO: 713669 - DNA, 16 bp, Homo sapiens
cctctggactggctag

SEQ ID NO: 713670 - DNA, 17 bp, Homo sapiens
cctctggagccctaacc

SEQ ID NO: 713671 - DNA, 21 bp, Homo sapiens
cctctggaggcctctggccct

SEQ ID NO: 713672 - DNA, 22 bp, Homo sapiens
cctctggaggggtgtggctcct

SEQ ID NO: 713673 - DNA, 13 bp, Homo sapiens
cctctggagtggc

SEQ ID NO: 713674 - DNA, 21 bp, Homo sapiens
cctctggatggcaccagaggc

SEQ ID NO: 713675 - DNA, 12 bp, Homo sapiens
cctctggccctc

SEQ ID NO: 713676 - DNA, 17 bp, Homo sapiens
cctctggccctgccttc

SEQ ID NO: 713677 - DNA, 12 bp, Homo sapiens
cctctggccctt

SEQ ID NO: 713678 - DNA, 16 bp, Homo sapiens
cctctggcccttggaa

SEQ ID NO: 713679 - DNA, 15 bp, Homo sapiens
cctctggccgcagag

SEQ ID NO: 713680 - DNA, 19 bp, Homo sapiens
cctctggccgccaccccca

SEQ ID NO: 713681 - DNA, 12 bp, Homo sapiens
cctctggctaga

SEQ ID NO: 713682 - DNA, 23 bp, Homo sapiens
cctctggctggctaactggaagc

SEQ ID NO: 713683 - DNA, 22 bp, Homo sapiens
cctctggcttgggcagggtctg

SEQ ID NO: 713684 - DNA, 15 bp, Homo sapiens
cctctggctttccca

SEQ ID NO: 713685 - DNA, 17 bp, Homo sapiens
cctctggctttcccagg

SEQ ID NO: 713686 - DNA, 13 bp, Homo sapiens
cctctgggaacct

SEQ ID NO: 713687 - DNA, 15 bp, Homo sapiens
cctctgggaacctcc

SEQ ID NO: 713688 - DNA, 19 bp, Homo sapiens
cctctgggaacctcccaga

SEQ ID NO: 713689 - DNA, 20 bp, Homo sapiens
cctctgggaacctcccagag

SEQ ID NO: 713690 - DNA, 21 bp, Homo sapiens
cctctgggaacctcccagagg

SEQ ID NO: 713691 - DNA, 18 bp, Homo sapiens
cctctgggagtccccatc

SEQ ID NO: 713692 - DNA, 20 bp, Homo sapiens
cctctgggagtccccatccc

SEQ ID NO: 713693 - DNA, 22 bp, Homo sapiens
cctctgggagtccccatcccat

SEQ ID NO: 713694 - DNA, 18 bp, Homo sapiens
cctctgggcacgcctgct

SEQ ID NO: 713695 - DNA, 19 bp, Homo sapiens
cctctgggcagcctgcttt

SEQ ID NO: 713696 - DNA, 20 bp, Homo sapiens
cctctgggcagcctgctttg

SEQ ID NO: 713697 - DNA, 11 bp, Homo sapiens
cctctgggcct

SEQ ID NO: 713698 - DNA, 20 bp, Homo sapiens
cctctgggcctggggtgcat

SEQ ID NO: 713699 - DNA, 10 bp, Homo sapiens
cctctgggct

SEQ ID NO: 713700 - DNA, 19 bp, Homo sapiens
cctctgggtccttggctcc

SEQ ID NO: 713701 - DNA, 20 bp, Homo sapiens
cctctgggtccttggctccc

SEQ ID NO: 713702 - DNA, 22 bp, Homo sapiens
cctctggtaaacattcctccag

SEQ ID NO: 713703 - DNA, 17 bp, Homo sapiens
cctctggtcgctcctgc

SEQ ID NO: 713704 - DNA, 20 bp, Homo sapiens
cctctggtggctcctcctag

SEQ ID NO: 713705 - DNA, 18 bp, Homo sapiens
cctctggtgtgtggtgag

SEQ ID NO: 713706 - DNA, 12 bp, Homo sapiens
cctctggttcct

SEQ ID NO: 713707 - DNA, 16 bp, Homo sapiens
cctctggttgcctccc

SEQ ID NO: 713708 - DNA, 20 bp, Homo sapiens
cctctgtaggcagcagagag

SEQ ID NO: 713709 - DNA, 16 bp, Homo sapiens
cctctgtatagaaatc

SEQ ID NO: 713710 - DNA, 15 bp, Homo sapiens
cctctgtcagtcaca

SEQ ID NO: 713711 - DNA, 16 bp, Homo sapiens
cctctgtcagtcacag

SEQ ID NO: 713712 - DNA, 18 bp, Homo sapiens
cctctgtcagtcacagcc

SEQ ID NO: 713713 - DNA, 15 bp, Homo sapiens
cctctgtcatcactc

SEQ ID NO: 713714 - DNA, 15 bp, Homo sapiens
cctctgtccaggcac

SEQ ID NO: 713715 - DNA, 19 bp, Homo sapiens
cctctgtccaggcactgag

SEQ ID NO: 713716 - DNA, 14 bp, Homo sapiens
cctctgtccagggc

SEQ ID NO: 713717 - DNA, 15 bp, Homo sapiens
cctctgtccagggcc

SEQ ID NO: 713718 - DNA, 18 bp, Homo sapiens
cctctgtccagggccctg

SEQ ID NO: 713719 - DNA, 20 bp, Homo sapiens
cctctgtccagggccctgag

SEQ ID NO: 713720 - DNA, 15 bp, Homo sapiens
cctctgtccccacga

SEQ ID NO: 713721 - DNA, 16 bp, Homo sapiens
cctctgtccccacgag

SEQ ID NO: 713722 - DNA, 20 bp, Homo sapiens
cctctgtccccacgagggga

SEQ ID NO: 713723 - DNA, 15 bp, Homo sapiens
cctctgtccccaggc

SEQ ID NO: 713724 - DNA, 23 bp, Homo sapiens
cctctgtccccaggcctggctcc

SEQ ID NO: 713725 - DNA, 13 bp, Homo sapiens
cctctgtcctccc

SEQ ID NO: 713726 - DNA, 11 bp, Homo sapiens
cctctgtctca

SEQ ID NO: 713727 - DNA, 14 bp, Homo sapiens
cctctgtctggagc

SEQ ID NO: 713728 - DNA, 17 bp, Homo sapiens
cctctgtcttttctcct

SEQ ID NO: 713729 - DNA, 18 bp, Homo sapiens
atttccttagtgccagga

SEQ ID NO: 713730 - DNA, 15 bp, Homo sapiens
atttccttccactgt

SEQ ID NO: 713731 - DNA, 20 bp, Homo sapiens
atttccttccactgtagcta

SEQ ID NO: 713732 - DNA, 19 bp, Homo sapiens
atttccttctgttaagaaa

SEQ ID NO: 713733 - DNA, 20 bp, Homo sapiens
atttccttctgttaagaaag

SEQ ID NO: 713734 - DNA, 14 bp, Homo sapiens
atttccttgaatgt

SEQ ID NO: 713735 - DNA, 13 bp, Homo sapiens
atttcctttataa

SEQ ID NO: 713736 - DNA, 18 bp, Homo sapiens
atttcctttatgtgaatt

SEQ ID NO: 713737 - DNA, 19 bp, Homo sapiens
atttcctttatgtgaattt

SEQ ID NO: 713738 - DNA, 21 bp, Homo sapiens
atttcctttatgtgaattttt

SEQ ID NO: 713739 - DNA, 20 bp, Homo sapiens
atttcctttattattctgta

SEQ ID NO: 713740 - DNA, 15 bp, Homo sapiens
atttcctttttgaca

SEQ ID NO: 713741 - DNA, 18 bp, Homo sapiens
atttcctttttgacactg

SEQ ID NO: 713742 - DNA, 15 bp, Homo sapiens
atttcgaaactgcca

SEQ ID NO: 713743 - DNA, 22 bp, Homo sapiens
atttcgccttaaactctggaca

SEQ ID NO: 713744 - DNA, 14 bp, Homo sapiens
atttctaaaaaaca

SEQ ID NO: 713745 - DNA, 21 bp, Homo sapiens
atttctaaaaaacagaggcca

SEQ ID NO: 713746 - DNA, 23 bp, Homo sapiens
atttctaaagtaaaattgaagca

SEQ ID NO: 713747 - DNA, 22 bp, Homo sapiens
atttctaaataaggaatttcct

SEQ ID NO: 713748 - DNA, 12 bp, Homo sapiens
atttctaacagt

SEQ ID NO: 713749 - DNA, 18 bp, Homo sapiens
atttctaacagtccttgc

SEQ ID NO: 713750 - DNA, 12 bp, Homo sapiens
atttctaacata

SEQ ID NO: 713751 - DNA, 17 bp, Homo sapiens
atttctaacatatgtat

SEQ ID NO: 713752 - DNA, 18 bp, Homo sapiens
atttctaacatatgtatt

SEQ ID NO: 713753 - DNA, 19 bp, Homo sapiens
atttctaactctattaatg

SEQ ID NO: 713754 - DNA, 23 bp, Homo sapiens
atttctaagaagttgtttgaggc

SEQ ID NO: 713755 - DNA, 19 bp, Homo sapiens
atttctaagcgcctattgt

SEQ ID NO: 713756 - DNA, 14 bp, Homo sapiens
atttctaagtattt

SEQ ID NO: 713757 - DNA, 15 bp, Homo sapiens
atttctaagtattta

SEQ ID NO: 713758 - DNA, 22 bp, Homo sapiens
atttctaagtatttaaatgttc

SEQ ID NO: 713759 - DNA, 13 bp, Homo sapiens
atttctaattgta

SEQ ID NO: 713760 - DNA, 19 bp, Homo sapiens
atttctacaactggagttt

SEQ ID NO: 713761 - DNA, 21 bp, Homo sapiens
atttctacaactggagttttt

SEQ ID NO: 713762 - DNA, 13 bp, Homo sapiens
atttctacagaga

SEQ ID NO: 713763 - DNA, 17 bp, Homo sapiens
atttctaccatttcaga

SEQ ID NO: 713764 - DNA, 18 bp, Homo sapiens
atttctaccatttcagag

SEQ ID NO: 713765 - DNA, 13 bp, Homo sapiens
atttctactatga

SEQ ID NO: 713766 - DNA, 19 bp, Homo sapiens
atttctactatgatcagaa

SEQ ID NO: 713767 - DNA, 23 bp, Homo sapiens
atttctactatgatcagaagaac

SEQ ID NO: 713768 - DNA, 18 bp, Homo sapiens
atttctactttgaagtca

SEQ ID NO: 713769 - DNA, 14 bp, Homo sapiens
atttctagactcaa

SEQ ID NO: 713770 - DNA, 16 bp, Homo sapiens
atttctagcagagtga

SEQ ID NO: 713771 - DNA, 14 bp, Homo sapiens
atttctagcaggca

SEQ ID NO: 713772 - DNA, 21 bp, Homo sapiens
atttctagtccaaaattacaa

SEQ ID NO: 713773 - DNA, 13 bp, Homo sapiens
atttctataaatt

SEQ ID NO: 713774 - DNA, 12 bp, Homo sapiens
atttctatactt

SEQ ID NO: 713775 - DNA, 23 bp, Homo sapiens
atttctatagccaaaaatagcta

SEQ ID NO: 713776 - DNA, 14 bp, Homo sapiens
atttctatgtaaat

SEQ ID NO: 713777 - DNA, 18 bp, Homo sapiens
atttctatgtaaattatt

SEQ ID NO: 713778 - DNA, 21 bp, Homo sapiens
atttctatgtaaattattgta

SEQ ID NO: 713779 - DNA, 22 bp, Homo sapiens
atttctatgtaaattattgtaa

SEQ ID NO: 713780 - DNA, 22 bp, Homo sapiens
atttctattattaattgcaaaa

SEQ ID NO: 713781 - DNA, 16 bp, Homo sapiens
atttctatttatttac

SEQ ID NO: 713782 - DNA, 15 bp, Homo sapiens
atttctatttcataa

SEQ ID NO: 713783 - DNA, 15 bp, Homo sapiens
atttctatttctcct

SEQ ID NO: 713784 - DNA, 18 bp, Homo sapiens
atttctatttctcctcca

SEQ ID NO: 713785 - DNA, 20 bp, Homo sapiens
atttctcaaagatctgaatt

SEQ ID NO: 713786 - DNA, 22 bp, Homo sapiens
atttctcaacaaagcacagtgt

SEQ ID NO: 713787 - DNA, 18 bp, Homo sapiens
atttctcaatcagtgcag

SEQ ID NO: 713788 - DNA, 23 bp, Homo sapiens
atttctcacactctaactgtata

SEQ ID NO: 713789 - DNA, 12 bp, Homo sapiens
atttctccagac

SEQ ID NO: 713790 - DNA, 20 bp, Homo sapiens
atttctccagttgggactca

SEQ ID NO: 713791 - DNA, 19 bp, Homo sapiens
atttctccatctttataga

SEQ ID NO: 713792 - DNA, 14 bp, Homo sapiens
atttctcctccctt

SEQ ID NO: 713793 - DNA, 18 bp, Homo sapiens
atttctcgggtgcatttg

SEQ ID NO: 713794 - DNA, 21 bp, Homo sapiens
atttctctatgtttattctag

SEQ ID NO: 713795 - DNA, 23 bp, Homo sapiens
atttctctattttcataatcagt

SEQ ID NO: 713796 - DNA, 17 bp, Homo sapiens
atttctctctcctggtg

SEQ ID NO: 713797 - DNA, 19 bp, Homo sapiens
atttctctctcctggtgtg

SEQ ID NO: 713798 - DNA, 18 bp, Homo sapiens
atttctctgaacagaaaa

SEQ ID NO: 713799 - DNA, 19 bp, Homo sapiens
atttctctttaaactatgt

SEQ ID NO: 713800 - DNA, 11 bp, Homo sapiens
atttctgagaa

SEQ ID NO: 713801 - DNA, 12 bp, Homo sapiens
atttctgataaa

SEQ ID NO: 713802 - DNA, 22 bp, Homo sapiens
atttctgatttcataattcaga

SEQ ID NO: 713803 - DNA, 13 bp, Homo sapiens
atttctgcatatg

SEQ ID NO: 713804 - DNA, 18 bp, Homo sapiens
atttctgcatatgttgaa

SEQ ID NO: 713805 - DNA, 22 bp, Homo sapiens
atttctgcatatgttgaatact

SEQ ID NO: 713806 - DNA, 16 bp, Homo sapiens
atttctgccatgatgt

SEQ ID NO: 713807 - DNA, 19 bp, Homo sapiens
atttctgccatgatgttta

SEQ ID NO: 713808 - DNA, 15 bp, Homo sapiens
atttctgcctcgctc

SEQ ID NO: 713809 - DNA, 12 bp, Homo sapiens
atttctgccttt

SEQ ID NO: 713810 - DNA, 20 bp, Homo sapiens
atttctgctaaatatcacct

SEQ ID NO: 713811 - DNA, 15 bp, Homo sapiens
atttctgctctggaa

SEQ ID NO: 713812 - DNA, 21 bp, Homo sapiens
atttctgctgtggtctataaa

SEQ ID NO: 713813 - DNA, 21 bp, Homo sapiens
atttctggacatgacgtctgt

SEQ ID NO: 713814 - DNA, 15 bp, Homo sapiens
atttctggcctccta

SEQ ID NO: 713815 - DNA, 23 bp, Homo sapiens
atttctggcctcctaaggctccc

SEQ ID NO: 713816 - DNA, 15 bp, Homo sapiens
atttctgggatattt

SEQ ID NO: 713817 - DNA, 11 bp, Homo sapiens
atttctgtaaa

SEQ ID NO: 713818 - DNA, 22 bp, Homo sapiens
atttctgtatactgtaaaagtt

SEQ ID NO: 713819 - DNA, 16 bp, Homo sapiens
atttctgtatatttgt

SEQ ID NO: 713820 - DNA, 19 bp, Homo sapiens
atttctgtatatttgtcat

SEQ ID NO: 713821 - DNA, 15 bp, Homo sapiens
atttctgtctactaa

SEQ ID NO: 713822 - DNA, 16 bp, Homo sapiens
atttctgtctttaaga

SEQ ID NO: 713823 - DNA, 23 bp, Homo sapiens
atttctgtggatacagtgcccac

SEQ ID NO: 713824 - DNA, 16 bp, Homo sapiens
atttctgtgggagaat

SEQ ID NO: 713825 - DNA, 23 bp, Homo sapiens
atttctgtgttgccaagctccaa

SEQ ID NO: 713826 - DNA, 14 bp, Homo sapiens
atttctgttatttt

SEQ ID NO: 713827 - DNA, 16 bp, Homo sapiens
atttctgttccagtca

SEQ ID NO: 713828 - DNA, 16 bp, Homo sapiens
atttctgtttagataa

SEQ ID NO: 713829 - DNA, 20 bp, Homo sapiens
atttctgtttagataataca

SEQ ID NO: 713830 - DNA, 14 bp, Homo sapiens
atttcttaatttgg

SEQ ID NO: 713831 - DNA, 20 bp, Homo sapiens
atttcttactaaacattttg

SEQ ID NO: 713832 - DNA, 23 bp, Homo sapiens
atttcttagtgcttcagagtttg

SEQ ID NO: 713833 - DNA, 16 bp, Homo sapiens
atttcttatcacataa

SEQ ID NO: 713834 - DNA, 15 bp, Homo sapiens
atttcttatcaccac

SEQ ID NO: 713835 - DNA, 14 bp, Homo sapiens
atttcttatgattt

SEQ ID NO: 713836 - DNA, 16 bp, Homo sapiens
atttcttatgtgacat

SEQ ID NO: 713837 - DNA, 17 bp, Homo sapiens
atttcttatgtgacatt

SEQ ID NO: 713838 - DNA, 14 bp, Homo sapiens
atttcttattgaat

SEQ ID NO: 713839 - DNA, 14 bp, Homo sapiens
atttcttcagaggg

SEQ ID NO: 713840 - DNA, 16 bp, Homo sapiens
atttcttcagagggaa

SEQ ID NO: 713841 - DNA, 11 bp, Homo sapiens
atttcttcctt

SEQ ID NO: 713842 - DNA, 16 bp, Homo sapiens
atttcttctctctgtt

SEQ ID NO: 713843 - DNA, 24 bp, Homo sapiens
atttcttctctctgttcccttcct

SEQ ID NO: 713844 - DNA, 19 bp, Homo sapiens
atttcttctctttagtata

SEQ ID NO: 713845 - DNA, 15 bp, Homo sapiens
atttcttcttagaaa

SEQ ID NO: 713846 - DNA, 21 bp, Homo sapiens
atttcttcttctaagaagaca

SEQ ID NO: 713847 - DNA, 23 bp, Homo sapiens
atttcttcttctaagaagacatt

SEQ ID NO: 713848 - DNA, 19 bp, Homo sapiens
atttcttgaaaagccttgg

SEQ ID NO: 713849 - DNA, 22 bp, Homo sapiens
atttcttgaaaagccttggaga

SEQ ID NO: 713850 - DNA, 21 bp, Homo sapiens
atttcttgaagaataaattct

SEQ ID NO: 713851 - DNA, 13 bp, Homo sapiens
atttcttgctttc

SEQ ID NO: 713852 - DNA, 23 bp, Homo sapiens
atttcttggcaaattttaaaaca

SEQ ID NO: 713853 - DNA, 19 bp, Homo sapiens
cctctgtgaccaactgttg

SEQ ID NO: 713854 - DNA, 18 bp, Homo sapiens
cctctgtgaccaatgtct

SEQ ID NO: 713855 - DNA, 19 bp, Homo sapiens
cctctgtgaccaatgtctt

SEQ ID NO: 713856 - DNA, 14 bp, Homo sapiens
cctctgtgattaca

SEQ ID NO: 713857 - DNA, 18 bp, Homo sapiens
cctctgtgattacataga

SEQ ID NO: 713858 - DNA, 22 bp, Homo sapiens
cctctgtgattacatagatcag

SEQ ID NO: 713859 - DNA, 18 bp, Homo sapiens
cctctgtgcacagtggct

SEQ ID NO: 713860 - DNA, 13 bp, Homo sapiens
cctctgtgcccac

SEQ ID NO: 713861 - DNA, 15 bp, Homo sapiens
cctctgtgctgtgtg

SEQ ID NO: 713862 - DNA, 20 bp, Homo sapiens
cctctgtgcttcgactactg

SEQ ID NO: 713863 - DNA, 11 bp, Homo sapiens
cctctgtggaa

SEQ ID NO: 713864 - DNA, 18 bp, Homo sapiens
cctctgtgtatttgcttt

SEQ ID NO: 713865 - DNA, 20 bp, Homo sapiens
cctctgtgtccttccctgca

SEQ ID NO: 713866 - DNA, 18 bp, Homo sapiens
cctctgttcaaagctgcc

SEQ ID NO: 713867 - DNA, 13 bp, Homo sapiens
cctctgttctctc

SEQ ID NO: 713868 - DNA, 22 bp, Homo sapiens
cctctgttctctcccctcacat

SEQ ID NO: 713869 - DNA, 11 bp, Homo sapiens
cctctgttctt

SEQ ID NO: 713870 - DNA, 15 bp, Homo sapiens
cctctgttgtcctcc

SEQ ID NO: 713871 - DNA, 18 bp, Homo sapiens
cctctgttgtcctcccct

SEQ ID NO: 713872 - DNA, 23 bp, Homo sapiens
cctctgttgtcctccccttgggc

SEQ ID NO: 713873 - DNA, 18 bp, Homo sapiens
cctcttaaaaaataaaaa

SEQ ID NO: 713874 - DNA, 19 bp, Homo sapiens
cctcttaaaaaataaaaac

SEQ ID NO: 713875 - DNA, 19 bp, Homo sapiens
cctcttaaagctgcctgta

SEQ ID NO: 713876 - DNA, 20 bp, Homo sapiens
cctcttaaagctgcctgtag

SEQ ID NO: 713877 - DNA, 22 bp, Homo sapiens
cctcttaaagctgcctgtagtt

SEQ ID NO: 713878 - DNA, 19 bp, Homo sapiens
cctcttatctcatcctttc

SEQ ID NO: 713879 - DNA, 19 bp, Homo sapiens
cctcttattccaggagaag

SEQ ID NO: 713880 - DNA, 17 bp, Homo sapiens
cctcttcaaagcagagt

SEQ ID NO: 713881 - DNA, 13 bp, Homo sapiens
cctcttcaaatta

SEQ ID NO: 713882 - DNA, 17 bp, Homo sapiens
cctcttcaccccccact

SEQ ID NO: 713883 - DNA, 13 bp, Homo sapiens
cctcttcagaggc

SEQ ID NO: 713884 - DNA, 14 bp, Homo sapiens
cctcttcagaggcc

SEQ ID NO: 713885 - DNA, 21 bp, Homo sapiens
cctcttccagcttcttttgcc

SEQ ID NO: 713886 - DNA, 15 bp, Homo sapiens
cctcttccagtgaac

SEQ ID NO: 713887 - DNA, 21 bp, Homo sapiens
cctcttcccatgactgcaccc

SEQ ID NO: 713888 - DNA, 11 bp, Homo sapiens
cctcttcccca

SEQ ID NO: 713889 - DNA, 12 bp, Homo sapiens
cctcttccccac

SEQ ID NO: 713890 - DNA, 17 bp, Homo sapiens
cctcttccccttgccct

SEQ ID NO: 713891 - DNA, 14 bp, Homo sapiens
cctcttccctctga

SEQ ID NO: 713892 - DNA, 22 bp, Homo sapiens
cctcttccctctgatttttcct

SEQ ID NO: 713893 - DNA, 18 bp, Homo sapiens
cctcttcccttagcctct

SEQ ID NO: 713894 - DNA, 20 bp, Homo sapiens
cctcttcccttagcctctcc

SEQ ID NO: 713895 - DNA, 20 bp, Homo sapiens
cctcttccggagatgtagca

SEQ ID NO: 713896 - DNA, 14 bp, Homo sapiens
cctcttcctctgag

SEQ ID NO: 713897 - DNA, 15 bp, Homo sapiens
cctcttcctctgagg

SEQ ID NO: 713898 - DNA, 13 bp, Homo sapiens
cctcttcctctgg

SEQ ID NO: 713899 - DNA, 15 bp, Homo sapiens
cctcttcctctgggc

SEQ ID NO: 713900 - DNA, 17 bp, Homo sapiens
cctcttcctcttgaccc

SEQ ID NO: 713901 - DNA, 23 bp, Homo sapiens
cctcttcctcttgaccctgcacc

SEQ ID NO: 713902 - DNA, 14 bp, Homo sapiens
cctcttcctgccct

SEQ ID NO: 713903 - DNA, 15 bp, Homo sapiens
cctcttcctgccctt

SEQ ID NO: 713904 - DNA, 13 bp, Homo sapiens
cctcttcctgtga

SEQ ID NO: 713905 - DNA, 13 bp, Homo sapiens
cctcttccttccc

SEQ ID NO: 713906 - DNA, 13 bp, Homo sapiens
cctcttcggccct

SEQ ID NO: 713907 - DNA, 16 bp, Homo sapiens
cctcttcggccctcag

SEQ ID NO: 713908 - DNA, 20 bp, Homo sapiens
cctcttctacttgtaaaatg

SEQ ID NO: 713909 - DNA, 14 bp, Homo sapiens
cctcttctcaagtg

SEQ ID NO: 713910 - DNA, 18 bp, Homo sapiens
cctcttctcaagtgcctt

SEQ ID NO: 713911 - DNA, 13 bp, Homo sapiens
cctcttctctcct

SEQ ID NO: 713912 - DNA, 14 bp, Homo sapiens
cctcttctctcctc

SEQ ID NO: 713913 - DNA, 17 bp, Homo sapiens
cctcttctgacgtgcct

SEQ ID NO: 713914 - DNA, 20 bp, Homo sapiens
cctcttctgcttaggagaga

SEQ ID NO: 713915 - DNA, 16 bp, Homo sapiens
cctcttctgggcctga

SEQ ID NO: 713916 - DNA, 14 bp, Homo sapiens
cctcttgaccaggc

SEQ ID NO: 713917 - DNA, 14 bp, Homo sapiens
cctcttgagcagtg

SEQ ID NO: 713918 - DNA, 19 bp, Homo sapiens
cctcttgagcagtggctgg

SEQ ID NO: 713919 - DNA, 17 bp, Homo sapiens
cctcttgatctcaaagc

SEQ ID NO: 713920 - DNA, 14 bp, Homo sapiens
cctcttgccactgc

SEQ ID NO: 713921 - DNA, 11 bp, Homo sapiens
cctcttgccag

SEQ ID NO: 713922 - DNA, 13 bp, Homo sapiens
cctcttgccagcc

SEQ ID NO: 713923 - DNA, 14 bp, Homo sapiens
cctcttgccagcct

SEQ ID NO: 713924 - DNA, 17 bp, Homo sapiens
cctcttgccagcctcct

SEQ ID NO: 713925 - DNA, 16 bp, Homo sapiens
cctcttgccatcctga

SEQ ID NO: 713926 - DNA, 13 bp, Homo sapiens
cctcttgcccatc

SEQ ID NO: 713927 - DNA, 15 bp, Homo sapiens
cctcttgcctctctc

SEQ ID NO: 713928 - DNA, 14 bp, Homo sapiens
cctcttgctgccag

SEQ ID NO: 713929 - DNA, 14 bp, Homo sapiens
cctcttgctgtctc

SEQ ID NO: 713930 - DNA, 19 bp, Homo sapiens
cctcttgctgtctctgctc

SEQ ID NO: 713931 - DNA, 18 bp, Homo sapiens
cctcttggaattacaagc

SEQ ID NO: 713932 - DNA, 18 bp, Homo sapiens
cctcttggacctctgctc

SEQ ID NO: 713933 - DNA, 18 bp, Homo sapiens
cctcttggagaagtctca

SEQ ID NO: 713934 - DNA, 20 bp, Homo sapiens
cctcttggagaagtctcagc

SEQ ID NO: 713935 - DNA, 21 bp, Homo sapiens
cctcttggataccagctcagg

SEQ ID NO: 713936 - DNA, 23 bp, Homo sapiens
cctcttggcaagatgtttcttat

SEQ ID NO: 713937 - DNA, 13 bp, Homo sapiens
cctcttggcctga

SEQ ID NO: 713938 - DNA, 13 bp, Homo sapiens
cctcttggcttct

SEQ ID NO: 713939 - DNA, 20 bp, Homo sapiens
cctcttggcttctcagcccc

SEQ ID NO: 713940 - DNA, 22 bp, Homo sapiens
cctcttggcttctcagcccctt

SEQ ID NO: 713941 - DNA, 21 bp, Homo sapiens
cctcttggtgggtgtggccag

SEQ ID NO: 713942 - DNA, 23 bp, Homo sapiens
cctcttggtgggtgtggccagca

SEQ ID NO: 713943 - DNA, 23 bp, Homo sapiens
cctcttggtgtgattgcacagaa

SEQ ID NO: 713944 - DNA, 14 bp, Homo sapiens
cctcttgtaaataa

SEQ ID NO: 713945 - DNA, 16 bp, Homo sapiens
cctcttgtcccttggc

SEQ ID NO: 713946 - DNA, 19 bp, Homo sapiens
cctcttgtccctttcccta

SEQ ID NO: 713947 - DNA, 13 bp, Homo sapiens
cctcttgtcctgg

SEQ ID NO: 713948 - DNA, 12 bp, Homo sapiens
cctcttgtctcc

SEQ ID NO: 713949 - DNA, 14 bp, Homo sapiens
cctcttgtctcccc

SEQ ID NO: 713950 - DNA, 12 bp, Homo sapiens
cctcttgttgca

SEQ ID NO: 713951 - DNA, 23 bp, Homo sapiens
cctcttgtttctgggtccctgct

SEQ ID NO: 713952 - DNA, 12 bp, Homo sapiens
cctctttaagag

SEQ ID NO: 713953 - DNA, 17 bp, Homo sapiens
cctctttaatgctgtct

SEQ ID NO: 713954 - DNA, 21 bp, Homo sapiens
cctctttcccaccctccacct

SEQ ID NO: 713955 - DNA, 15 bp, Homo sapiens
cctctttccctgcga

SEQ ID NO: 713956 - DNA, 14 bp, Homo sapiens
cctctttctccagc

SEQ ID NO: 713957 - DNA, 15 bp, Homo sapiens
cctctttctctcccc

SEQ ID NO: 713958 - DNA, 18 bp, Homo sapiens
cctctttctctccccaac

SEQ ID NO: 713959 - DNA, 13 bp, Homo sapiens
cctctttctcttt

SEQ ID NO: 713960 - DNA, 18 bp, Homo sapiens
cctctttctctttcttcc

SEQ ID NO: 713961 - DNA, 12 bp, Homo sapiens
cctctttctgct

SEQ ID NO: 713962 - DNA, 17 bp, Homo sapiens
cctctttcttcccatga

SEQ ID NO: 713963 - DNA, 11 bp, Homo sapiens
cctctttgctt

SEQ ID NO: 713964 - DNA, 20 bp, Homo sapiens
cctctttggctcccctgtac

SEQ ID NO: 713965 - DNA, 16 bp, Homo sapiens
cctcttttccctctct

SEQ ID NO: 713966 - DNA, 12 bp, Homo sapiens
cctcttttcctg

SEQ ID NO: 713967 - DNA, 21 bp, Homo sapiens
cctcttttcctggcagctgct

SEQ ID NO: 713968 - DNA, 23 bp, Homo sapiens
cctcttttcctggcagctgctgt

SEQ ID NO: 713969 - DNA, 20 bp, Homo sapiens
cctcttttcttactcctcct

SEQ ID NO: 713970 - DNA, 22 bp, Homo sapiens
cctcttttcttactcctcctct

SEQ ID NO: 713971 - DNA, 14 bp, Homo sapiens
cctcttttgagact

SEQ ID NO: 713972 - DNA, 24 bp, Homo sapiens
cctcttttgcttgccaaagtacag

SEQ ID NO: 713973 - DNA, 15 bp, Homo sapiens
cctcttttggccttg

SEQ ID NO: 713974 - DNA, 16 bp, Homo sapiens
cctctttttcctcctg

SEQ ID NO: 713975 - DNA, 16 bp, Homo sapiens
cctctttttccttctt

SEQ ID NO: 713976 - DNA, 13 bp, Homo sapiens
cctcttttttcgt

SEQ ID NO: 713977 - DNA, 19 bp, Homo sapiens
cctcttttttcgtttgttt

SEQ ID NO: 713978 - DNA, 19 bp, Homo sapiens
cctgaaaacgaaggggccc

SEQ ID NO: 713979 - DNA, 20 bp, Homo sapiens
atttcttggtaagaagccgg

SEQ ID NO: 713980 - DNA, 13 bp, Homo sapiens
atttctttccaga

SEQ ID NO: 713981 - DNA, 14 bp, Homo sapiens
atttctttccagag

SEQ ID NO: 713982 - DNA, 14 bp, Homo sapiens
atttctttcttcca

SEQ ID NO: 713983 - DNA, 22 bp, Homo sapiens
atttctttcttgctggctctga

SEQ ID NO: 713984 - DNA, 17 bp, Homo sapiens
atttctttgtctttttc

SEQ ID NO: 713985 - DNA, 21 bp, Homo sapiens
atttctttgtttaacaaaaga

SEQ ID NO: 713986 - DNA, 16 bp, Homo sapiens
atttcttttactctgt

SEQ ID NO: 713987 - DNA, 16 bp, Homo sapiens
atttcttttatacctt

SEQ ID NO: 713988 - DNA, 24 bp, Homo sapiens
atttcttttccttcattcataggg

SEQ ID NO: 713989 - DNA, 20 bp, Homo sapiens
atttcttttgccgttattaa

SEQ ID NO: 713990 - DNA, 19 bp, Homo sapiens
atttcttttgttgtacttt

SEQ ID NO: 713991 - DNA, 14 bp, Homo sapiens
atttctttttaatt

SEQ ID NO: 713992 - DNA, 19 bp, Homo sapiens
atttctttttaattatttt

SEQ ID NO: 713993 - DNA, 22 bp, Homo sapiens
atttctttttaattattttaaa

SEQ ID NO: 713994 - DNA, 16 bp, Homo sapiens
atttctttttttcctt

SEQ ID NO: 713995 - DNA, 22 bp, Homo sapiens
atttgaaaacataatctgcaaa

SEQ ID NO: 713996 - DNA, 17 bp, Homo sapiens
atttgaaaataattgtt

SEQ ID NO: 713997 - DNA, 14 bp, Homo sapiens
atttgaaaatgtcc

SEQ ID NO: 713998 - DNA, 11 bp, Homo sapiens
atttgaaattt

SEQ ID NO: 713999 - DNA, 13 bp, Homo sapiens
atttgaacactgg

SEQ ID NO: 714000 - DNA, 16 bp, Homo sapiens
atttgaagaacatgtg

SEQ ID NO: 714001 - DNA, 17 bp, Homo sapiens
atttgaagacttcaaaa

SEQ ID NO: 714002 - DNA, 23 bp, Homo sapiens
atttgaagctgcagtgagctgtg

SEQ ID NO: 714003 - DNA, 15 bp, Homo sapiens
atttgaataaaaatc

SEQ ID NO: 714004 - DNA, 14 bp, Homo sapiens
atttgaatgaaaaa

SEQ ID NO: 714005 - DNA, 19 bp, Homo sapiens
atttgaatgaaaaatttaa

SEQ ID NO: 714006 - DNA, 17 bp, Homo sapiens
atttgaatgatttttct

SEQ ID NO: 714007 - DNA, 17 bp, Homo sapiens
atttgaatgggtccatt

SEQ ID NO: 714008 - DNA, 17 bp, Homo sapiens
atttgaattatttctgt

SEQ ID NO: 714009 - DNA, 15 bp, Homo sapiens
atttgaattgacagg

SEQ ID NO: 714010 - DNA, 16 bp, Homo sapiens
atttgaattgggtccc

SEQ ID NO: 714011 - DNA, 22 bp, Homo sapiens
atttgaatttagggtgatttta

SEQ ID NO: 714012 - DNA, 18 bp, Homo sapiens
atttgaattttaaatcta

SEQ ID NO: 714013 - DNA, 12 bp, Homo sapiens
atttgactaatt

SEQ ID NO: 714014 - DNA, 17 bp, Homo sapiens
atttgactaattttaca

SEQ ID NO: 714015 - DNA, 16 bp, Homo sapiens
atttgactctttcaaa

SEQ ID NO: 714016 - DNA, 18 bp, Homo sapiens
atttgactctttcaaaga

SEQ ID NO: 714017 - DNA, 15 bp, Homo sapiens
atttgacttgtggtt

SEQ ID NO: 714018 - DNA, 22 bp, Homo sapiens
atttgacttttctgtaattcag

SEQ ID NO: 714019 - DNA, 18 bp, Homo sapiens
atttgagaaaatataata

SEQ ID NO: 714020 - DNA, 15 bp, Homo sapiens
atttgagaattattc

SEQ ID NO: 714021 - DNA, 15 bp, Homo sapiens
atttgagactgaaat

SEQ ID NO: 714022 - DNA, 16 bp, Homo sapiens
atttgagactgaaatt

SEQ ID NO: 714023 - DNA, 18 bp, Homo sapiens
atttgagactgaaattta

SEQ ID NO: 714024 - DNA, 22 bp, Homo sapiens
atttgaggacaaccattccaga

SEQ ID NO: 714025 - DNA, 14 bp, Homo sapiens
atttgaggagacga

SEQ ID NO: 714026 - DNA, 20 bp, Homo sapiens
atttgaggagtgttaagatt

SEQ ID NO: 714027 - DNA, 14 bp, Homo sapiens
atttgaggctcaga

SEQ ID NO: 714028 - DNA, 17 bp, Homo sapiens
atttgaggggaaaacac

SEQ ID NO: 714029 - DNA, 15 bp, Homo sapiens
atttgaggggccagg

SEQ ID NO: 714030 - DNA, 18 bp, Homo sapiens
atttgaggtctgttcttt

SEQ ID NO: 714031 - DNA, 14 bp, Homo sapiens
atttgagtgctctg

SEQ ID NO: 714032 - DNA, 17 bp, Homo sapiens
atttgataaaaacccaa

SEQ ID NO: 714033 - DNA, 14 bp, Homo sapiens
atttgatacataat

SEQ ID NO: 714034 - DNA, 16 bp, Homo sapiens
atttgatattatctac

SEQ ID NO: 714035 - DNA, 20 bp, Homo sapiens
atttgatctttgtttaaatg

SEQ ID NO: 714036 - DNA, 21 bp, Homo sapiens
atttgatctttgtttaaatgc

SEQ ID NO: 714037 - DNA, 22 bp, Homo sapiens
atttgatctttgtttaaatgcc

SEQ ID NO: 714038 - DNA, 16 bp, Homo sapiens
atttgatgaaagctga

SEQ ID NO: 714039 - DNA, 15 bp, Homo sapiens
atttgatgccaggac

SEQ ID NO: 714040 - DNA, 14 bp, Homo sapiens
atttgatgctaaat

SEQ ID NO: 714041 - DNA, 16 bp, Homo sapiens
atttgatgctggagag

SEQ ID NO: 714042 - DNA, 16 bp, Homo sapiens
atttgatgctgtttga

SEQ ID NO: 714043 - DNA, 17 bp, Homo sapiens
atttgatggtatttctt

SEQ ID NO: 714044 - DNA, 22 bp, Homo sapiens
atttgatggtatttctttctcg

SEQ ID NO: 714045 - DNA, 15 bp, Homo sapiens
atttgatgtacatgt

SEQ ID NO: 714046 - DNA, 16 bp, Homo sapiens
atttgatgtacatgtg

SEQ ID NO: 714047 - DNA, 14 bp, Homo sapiens
atttgattaacatt

SEQ ID NO: 714048 - DNA, 19 bp, Homo sapiens
atttgattatttaagacta

SEQ ID NO: 714049 - DNA, 20 bp, Homo sapiens
atttgattcaaaatatttaa

SEQ ID NO: 714050 - DNA, 18 bp, Homo sapiens
atttgattcattttcctg

SEQ ID NO: 714051 - DNA, 19 bp, Homo sapiens
atttgattcattttcctgt

SEQ ID NO: 714052 - DNA, 22 bp, Homo sapiens
atttgattcattttcctgttca

SEQ ID NO: 714053 - DNA, 18 bp, Homo sapiens
atttgattcgtatgatca

SEQ ID NO: 714054 - DNA, 21 bp, Homo sapiens
atttgattgctttgctgcaca

SEQ ID NO: 714055 - DNA, 13 bp, Homo sapiens
atttgatttctaa

SEQ ID NO: 714056 - DNA, 21 bp, Homo sapiens
atttgatttctaattgtaagt

SEQ ID NO: 714057 - DNA, 17 bp, Homo sapiens
atttgatttctattcaa

SEQ ID NO: 714058 - DNA, 22 bp, Homo sapiens
atttgcaaaccctttgtattat

SEQ ID NO: 714059 - DNA, 20 bp, Homo sapiens
atttgcaattcatgtaacag

SEQ ID NO: 714060 - DNA, 21 bp, Homo sapiens
atttgcaattcatgtaacagt

SEQ ID NO: 714061 - DNA, 14 bp, Homo sapiens
atttgcacaatatt

SEQ ID NO: 714062 - DNA, 23 bp, Homo sapiens
atttgcacaatatttcttttgtt

SEQ ID NO: 714063 - DNA, 16 bp, Homo sapiens
atttgcacggtttgtg

SEQ ID NO: 714064 - DNA, 17 bp, Homo sapiens
atttgcactaatgtgtt

SEQ ID NO: 714065 - DNA, 19 bp, Homo sapiens
atttgcagaagctgtgagt

SEQ ID NO: 714066 - DNA, 22 bp, Homo sapiens
atttgcagagacaggacctgac

SEQ ID NO: 714067 - DNA, 22 bp, Homo sapiens
atttgcaggattcccttctggg

SEQ ID NO: 714068 - DNA, 14 bp, Homo sapiens
atttgcagggtcct

SEQ ID NO: 714069 - DNA, 21 bp, Homo sapiens
atttgcataacaattcctcta

SEQ ID NO: 714070 - DNA, 22 bp, Homo sapiens
atttgcataacaattcctctac

SEQ ID NO: 714071 - DNA, 18 bp, Homo sapiens
atttgcatattctattgt

SEQ ID NO: 714072 - DNA, 21 bp, Homo sapiens
atttgcatatttttctaaaga

SEQ ID NO: 714073 - DNA, 21 bp, Homo sapiens
atttgcatggctccagaaatg

SEQ ID NO: 714074 - DNA, 22 bp, Homo sapiens
atttgcatgttatgtttaataa

SEQ ID NO: 714075 - DNA, 22 bp, Homo sapiens
atttgcattactctggtggatt

SEQ ID NO: 714076 - DNA, 12 bp, Homo sapiens
atttgcatttgt

SEQ ID NO: 714077 - DNA, 16 bp, Homo sapiens
atttgcatttgtttat

SEQ ID NO: 714078 - DNA, 21 bp, Homo sapiens
atttgccacttagtattttaa

SEQ ID NO: 714079 - DNA, 20 bp, Homo sapiens
atttgccagagccaaatttt

SEQ ID NO: 714080 - DNA, 21 bp, Homo sapiens
atttgccatgacatttcatct

SEQ ID NO: 714081 - DNA, 22 bp, Homo sapiens
atttgccatgacatttcatctg

SEQ ID NO: 714082 - DNA, 23 bp, Homo sapiens
atttgcccaattccaggtgtgca

SEQ ID NO: 714083 - DNA, 11 bp, Homo sapiens
atttgcctgta

SEQ ID NO: 714084 - DNA, 16 bp, Homo sapiens
atttgcctgtaacaag

SEQ ID NO: 714085 - DNA, 15 bp, Homo sapiens
atttgcctgtgccac

SEQ ID NO: 714086 - DNA, 21 bp, Homo sapiens
atttgcctgtttctgcttgct

SEQ ID NO: 714087 - DNA, 13 bp, Homo sapiens
atttgccttgcag

SEQ ID NO: 714088 - DNA, 23 bp, Homo sapiens
atttgctaaatgctgttcttaca

SEQ ID NO: 714089 - DNA, 21 bp, Homo sapiens
atttgctagcagtaaaagatg

SEQ ID NO: 714090 - DNA, 22 bp, Homo sapiens
atttgctagttctgctgccctc

SEQ ID NO: 714091 - DNA, 19 bp, Homo sapiens
atttgctgagtttcccttc

SEQ ID NO: 714092 - DNA, 21 bp, Homo sapiens
atttgctgagtttcccttcct

SEQ ID NO: 714093 - DNA, 19 bp, Homo sapiens
atttgctgccaaatgcgta

SEQ ID NO: 714094 - DNA, 13 bp, Homo sapiens
atttgctggggaa

SEQ ID NO: 714095 - DNA, 15 bp, Homo sapiens
atttgctttaattaa

SEQ ID NO: 714096 - DNA, 14 bp, Homo sapiens
atttgctttggaag

SEQ ID NO: 714097 - DNA, 13 bp, Homo sapiens
atttggaaagaga

SEQ ID NO: 714098 - DNA, 15 bp, Homo sapiens
atttggaaataaagt

SEQ ID NO: 714099 - DNA, 14 bp, Homo sapiens
atttggaaatccta

SEQ ID NO: 714100 - DNA, 15 bp, Homo sapiens
atttggaaccaaagt

SEQ ID NO: 714101 - DNA, 20 bp, Homo sapiens
atttggaagagaggcacctg

SEQ ID NO: 714102 - DNA, 21 bp, Homo sapiens
atttggaagagaggcacctgc

SEQ ID NO: 714103 - DNA, 22 bp, Homo sapiens
cctgaaaagtaacttggctttc

SEQ ID NO: 714104 - DNA, 23 bp, Homo sapiens
cctgaaaatgtttttctgccagg

SEQ ID NO: 714105 - DNA, 13 bp, Homo sapiens
cctgaaaattgta

SEQ ID NO: 714106 - DNA, 15 bp, Homo sapiens
cctgaaacactggac

SEQ ID NO: 714107 - DNA, 23 bp, Homo sapiens
cctgaaacccgccctcaggggcc

SEQ ID NO: 714108 - DNA, 19 bp, Homo sapiens
cctgaaacgctcctttgtg

SEQ ID NO: 714109 - DNA, 21 bp, Homo sapiens
cctgaaacgctcctttgtgtg

SEQ ID NO: 714110 - DNA, 19 bp, Homo sapiens
cctgaaagaggctgaggcc

SEQ ID NO: 714111 - DNA, 17 bp, Homo sapiens
cctgaaagcctgtctct

SEQ ID NO: 714112 - DNA, 17 bp, Homo sapiens
cctgaaaggaacactgg

SEQ ID NO: 714113 - DNA, 18 bp, Homo sapiens
cctgaaaggaacactggc

SEQ ID NO: 714114 - DNA, 19 bp, Homo sapiens
cctgaaaggaacactggct

SEQ ID NO: 714115 - DNA, 14 bp, Homo sapiens
cctgaaagggcact

SEQ ID NO: 714116 - DNA, 18 bp, Homo sapiens
cctgaaagggcccttccc

SEQ ID NO: 714117 - DNA, 21 bp, Homo sapiens
cctgaaatataaactgtagcg

SEQ ID NO: 714118 - DNA, 20 bp, Homo sapiens
cctgaaatgccaagtgcctg

SEQ ID NO: 714119 - DNA, 19 bp, Homo sapiens
cctgaaattaatttgtgaa

SEQ ID NO: 714120 - DNA, 14 bp, Homo sapiens
cctgaaatttcaga

SEQ ID NO: 714121 - DNA, 18 bp, Homo sapiens
cctgaacatccttccttc

SEQ ID NO: 714122 - DNA, 20 bp, Homo sapiens
cctgaaccacgaggctgccc

SEQ ID NO: 714123 - DNA, 23 bp, Homo sapiens
cctgaaccacgaggctgccccca

SEQ ID NO: 714124 - DNA, 14 bp, Homo sapiens
cctgaaccatgtgg

SEQ ID NO: 714125 - DNA, 19 bp, Homo sapiens
cctgaaccccatgggcttg

SEQ ID NO: 714126 - DNA, 20 bp, Homo sapiens
cctgaaccccatgggcttgg

SEQ ID NO: 714127 - DNA, 14 bp, Homo sapiens
cctgaacccctggc

SEQ ID NO: 714128 - DNA, 19 bp, Homo sapiens
cctgaacccctggccagct

SEQ ID NO: 714129 - DNA, 22 bp, Homo sapiens
cctgaacccctggccagctctg

SEQ ID NO: 714130 - DNA, 16 bp, Homo sapiens
cctgaaccgcacagct

SEQ ID NO: 714131 - DNA, 22 bp, Homo sapiens
cctgaaccgcacagctcaggag

SEQ ID NO: 714132 - DNA, 13 bp, Homo sapiens
cctgaacctagga

SEQ ID NO: 714133 - DNA, 17 bp, Homo sapiens
cctgaaccttgagcaaa

SEQ ID NO: 714134 - DNA, 18 bp, Homo sapiens
cctgaaccttgagcaaat

SEQ ID NO: 714135 - DNA, 17 bp, Homo sapiens
cctgaacgttttcttct

SEQ ID NO: 714136 - DNA, 14 bp, Homo sapiens
cctgaactcctggc

SEQ ID NO: 714137 - DNA, 16 bp, Homo sapiens
cctgaactgaggcctt

SEQ ID NO: 714138 - DNA, 19 bp, Homo sapiens
cctgaactttctccctcat

SEQ ID NO: 714139 - DNA, 14 bp, Homo sapiens
cctgaagaaatcct

SEQ ID NO: 714140 - DNA, 14 bp, Homo sapiens
cctgaagaacagta

SEQ ID NO: 714141 - DNA, 21 bp, Homo sapiens
cctgaagagcgctcctctgcc

SEQ ID NO: 714142 - DNA, 21 bp, Homo sapiens
cctgaagaggcgggccagcca

SEQ ID NO: 714143 - DNA, 21 bp, Homo sapiens
cctgaagagtcctctgaatga

SEQ ID NO: 714144 - DNA, 21 bp, Homo sapiens
actcagagaaaaatgctcccc

SEQ ID NO: 714145 - DNA, 13 bp, Homo sapiens
actcagaggcccc

SEQ ID NO: 714146 - DNA, 17 bp, Homo sapiens
actcagaggcccccagt

SEQ ID NO: 714147 - DNA, 22 bp, Homo sapiens
actcagaggcccccagtgggga

SEQ ID NO: 714148 - DNA, 19 bp, Homo sapiens
actcagattgactaaataa

SEQ ID NO: 714149 - DNA, 13 bp, Homo sapiens
actcagcaccaca

SEQ ID NO: 714150 - DNA, 21 bp, Homo sapiens
actcagcaccacattgcctca

SEQ ID NO: 714151 - DNA, 13 bp, Homo sapiens
actcagcagaggc

SEQ ID NO: 714152 - DNA, 15 bp, Homo sapiens
actcagcagaggcag

SEQ ID NO: 714153 - DNA, 14 bp, Homo sapiens
actcagcagccctc

SEQ ID NO: 714154 - DNA, 17 bp, Homo sapiens
actcagcagccctcctc

SEQ ID NO: 714155 - DNA, 20 bp, Homo sapiens
actcagcagccctcctcacc

SEQ ID NO: 714156 - DNA, 21 bp, Homo sapiens
actcagcagccctcctcaccc

SEQ ID NO: 714157 - DNA, 22 bp, Homo sapiens
actcagcatttgattaacattt

SEQ ID NO: 714158 - DNA, 17 bp, Homo sapiens
actcagccaccctgagt

SEQ ID NO: 714159 - DNA, 23 bp, Homo sapiens
actcagccatttccccctcctca

SEQ ID NO: 714160 - DNA, 11 bp, Homo sapiens
actcagccctg

SEQ ID NO: 714161 - DNA, 12 bp, Homo sapiens
actcagccctgg

SEQ ID NO: 714162 - DNA, 15 bp, Homo sapiens
actcagccctgggcc

SEQ ID NO: 714163 - DNA, 21 bp, Homo sapiens
actcagccctgggccccacca

SEQ ID NO: 714164 - DNA, 14 bp, Homo sapiens
actcagctccagaa

SEQ ID NO: 714165 - DNA, 11 bp, Homo sapiens
actcagctctg

SEQ ID NO: 714166 - DNA, 22 bp, Homo sapiens
actcagctcttggctccactgg

SEQ ID NO: 714167 - DNA, 14 bp, Homo sapiens
actcagctgtcctg

SEQ ID NO: 714168 - DNA, 18 bp, Homo sapiens
actcagcttaattctcct

SEQ ID NO: 714169 - DNA, 19 bp, Homo sapiens
actcagcttcggggccggt

SEQ ID NO: 714170 - DNA, 23 bp, Homo sapiens
actcaggaactatggcaaggaac

SEQ ID NO: 714171 - DNA, 19 bp, Homo sapiens
actcaggaggctgaggcag

SEQ ID NO: 714172 - DNA, 17 bp, Homo sapiens
actcaggagtctgccac

SEQ ID NO: 714173 - DNA, 14 bp, Homo sapiens
actcaggccacagt

SEQ ID NO: 714174 - DNA, 23 bp, Homo sapiens
actcaggctttcactatttcctt

SEQ ID NO: 714175 - DNA, 13 bp, Homo sapiens
actcagggacaga

SEQ ID NO: 714176 - DNA, 23 bp, Homo sapiens
actcagggaccggtgctgcagga

SEQ ID NO: 714177 - DNA, 13 bp, Homo sapiens
actcagggcagct

SEQ ID NO: 714178 - DNA, 18 bp, Homo sapiens
actcagggcagctgcctg

SEQ ID NO: 714179 - DNA, 14 bp, Homo sapiens
actcagggccccag

SEQ ID NO: 714180 - DNA, 19 bp, Homo sapiens
actcagggctcctcccagc

SEQ ID NO: 714181 - DNA, 20 bp, Homo sapiens
actcagggctcctcccagct

SEQ ID NO: 714182 - DNA, 16 bp, Homo sapiens
actcaggggatgttta

SEQ ID NO: 714183 - DNA, 23 bp, Homo sapiens
actcaggtctgtaactgcccagc

SEQ ID NO: 714184 - DNA, 13 bp, Homo sapiens
actcaggtgcaca

SEQ ID NO: 714185 - DNA, 22 bp, Homo sapiens
actcaggtgcacacatcaccag

SEQ ID NO: 714186 - DNA, 23 bp, Homo sapiens
actcaggttccagaacagccctc

SEQ ID NO: 714187 - DNA, 20 bp, Homo sapiens
actcaggttgtagtaaagaa

SEQ ID NO: 714188 - DNA, 23 bp, Homo sapiens
actcaggttgtagtaaagaaatt

SEQ ID NO: 714189 - DNA, 16 bp, Homo sapiens
actcagtccactgttg

SEQ ID NO: 714190 - DNA, 23 bp, Homo sapiens
actcagtcccccaccacactgaa

SEQ ID NO: 714191 - DNA, 23 bp, Homo sapiens
actcagtctctcttctctccagc

SEQ ID NO: 714192 - DNA, 16 bp, Homo sapiens
actcagtctcttccac

SEQ ID NO: 714193 - DNA, 22 bp, Homo sapiens
actcagtgactgttgtagcatt

SEQ ID NO: 714194 - DNA, 11 bp, Homo sapiens
actcagtgagc

SEQ ID NO: 714195 - DNA, 13 bp, Homo sapiens
actcagtgcctcc

SEQ ID NO: 714196 - DNA, 21 bp, Homo sapiens
actcagtgtctgcctttaaat

SEQ ID NO: 714197 - DNA, 23 bp, Homo sapiens
actcagtgtgtgatccggtttct

SEQ ID NO: 714198 - DNA, 13 bp, Homo sapiens
actcagtttgtca

SEQ ID NO: 714199 - DNA, 19 bp, Homo sapiens
actcagtttgtcagacttt

SEQ ID NO: 714200 - DNA, 22 bp, Homo sapiens
actcagtttgtcagactttaaa

SEQ ID NO: 714201 - DNA, 15 bp, Homo sapiens
actcagttttaacta

SEQ ID NO: 714202 - DNA, 12 bp, Homo sapiens
actcatcataaa

SEQ ID NO: 714203 - DNA, 15 bp, Homo sapiens
actcatcataaaata

SEQ ID NO: 714204 - DNA, 16 bp, Homo sapiens
actcatcataaaataa

SEQ ID NO: 714205 - DNA, 13 bp, Homo sapiens
actcatcatttgt

SEQ ID NO: 714206 - DNA, 18 bp, Homo sapiens
actcatcatttttataca

SEQ ID NO: 714207 - DNA, 18 bp, Homo sapiens
actcatcgggcccaggga

SEQ ID NO: 714208 - DNA, 22 bp, Homo sapiens
actcatcttagtgcctgagagt

SEQ ID NO: 714209 - DNA, 12 bp, Homo sapiens
actcatgaatga

SEQ ID NO: 714210 - DNA, 23 bp, Homo sapiens
actcatgaatgaaaatacatctt

SEQ ID NO: 714211 - DNA, 15 bp, Homo sapiens
actcatgatcttgtg

SEQ ID NO: 714212 - DNA, 22 bp, Homo sapiens
actcatgcaaactgctttattt

SEQ ID NO: 714213 - DNA, 22 bp, Homo sapiens
actcatggcagctgtttctcat

SEQ ID NO: 714214 - DNA, 17 bp, Homo sapiens
actcattagaattacca

SEQ ID NO: 714215 - DNA, 14 bp, Homo sapiens
actcattagactgg

SEQ ID NO: 714216 - DNA, 13 bp, Homo sapiens
actcattcaaaag

SEQ ID NO: 714217 - DNA, 13 bp, Homo sapiens
actcattcattag

SEQ ID NO: 714218 - DNA, 13 bp, Homo sapiens
actcattcctgta

SEQ ID NO: 714219 - DNA, 15 bp, Homo sapiens
actcattccttcact

SEQ ID NO: 714220 - DNA, 18 bp, Homo sapiens
actcattgctgagcctct

SEQ ID NO: 714221 - DNA, 23 bp, Homo sapiens
actcattgctgagcctctgctcc

SEQ ID NO: 714222 - DNA, 16 bp, Homo sapiens
actcatttcctatgta

SEQ ID NO: 714223 - DNA, 19 bp, Homo sapiens
actcatttttcatgataat

SEQ ID NO: 714224 - DNA, 20 bp, Homo sapiens
actcatttttcatgataatg

SEQ ID NO: 714225 - DNA, 16 bp, Homo sapiens
actcatttttttaatt

SEQ ID NO: 714226 - DNA, 18 bp, Homo sapiens
actccaacctctcggccc

SEQ ID NO: 714227 - DNA, 18 bp, Homo sapiens
actccaagaccaccaggg

SEQ ID NO: 714228 - DNA, 23 bp, Homo sapiens
actccaagcagactccagcccct

SEQ ID NO: 714229 - DNA, 17 bp, Homo sapiens
actccaaggtttataaa

SEQ ID NO: 714230 - DNA, 20 bp, Homo sapiens
actccaaggtttataaagca

SEQ ID NO: 714231 - DNA, 21 bp, Homo sapiens
actccaaggtttataaagcag

SEQ ID NO: 714232 - DNA, 21 bp, Homo sapiens
actccaatgtctgctgaggag

SEQ ID NO: 714233 - DNA, 14 bp, Homo sapiens
actccacataagtc

SEQ ID NO: 714234 - DNA, 14 bp, Homo sapiens
actccacatctgcc

SEQ ID NO: 714235 - DNA, 19 bp, Homo sapiens
actccaccagatagcagag

SEQ ID NO: 714236 - DNA, 22 bp, Homo sapiens
actccacccagagtagagccag

SEQ ID NO: 714237 - DNA, 14 bp, Homo sapiens
actccaccctgtta

SEQ ID NO: 714238 - DNA, 15 bp, Homo sapiens
actccaccctgttag

SEQ ID NO: 714239 - DNA, 16 bp, Homo sapiens
actccaccctgttagt

SEQ ID NO: 714240 - DNA, 19 bp, Homo sapiens
actccaccgaccaactgcc

SEQ ID NO: 714241 - DNA, 20 bp, Homo sapiens
actccaccgaccaactgccc

SEQ ID NO: 714242 - DNA, 12 bp, Homo sapiens
actccacctcaa

SEQ ID NO: 714243 - DNA, 14 bp, Homo sapiens
actccactctcctt

SEQ ID NO: 714244 - DNA, 13 bp, Homo sapiens
actccactgccct

SEQ ID NO: 714245 - DNA, 21 bp, Homo sapiens
actccagacccctggcttttc

SEQ ID NO: 714246 - DNA, 11 bp, Homo sapiens
actccagagaa

SEQ ID NO: 714247 - DNA, 15 bp, Homo sapiens
actccagagcccctt

SEQ ID NO: 714248 - DNA, 18 bp, Homo sapiens
actccagagtctgagccc

SEQ ID NO: 714249 - DNA, 15 bp, Homo sapiens
actccagatagagaa

SEQ ID NO: 714250 - DNA, 14 bp, Homo sapiens
actccagccaaaga

SEQ ID NO: 714251 - DNA, 17 bp, Homo sapiens
actccagccagcgcctc

SEQ ID NO: 714252 - DNA, 22 bp, Homo sapiens
actccagccagcgcctccctcc

SEQ ID NO: 714253 - DNA, 14 bp, Homo sapiens
actccagcccaaca

SEQ ID NO: 714254 - DNA, 15 bp, Homo sapiens
actccagcccctgga

SEQ ID NO: 714255 - DNA, 12 bp, Homo sapiens
actccagcccgc

SEQ ID NO: 714256 - DNA, 19 bp, Homo sapiens
actccagcctgagcaacag

SEQ ID NO: 714257 - DNA, 20 bp, Homo sapiens
actccagcctgagcaacaga

SEQ ID NO: 714258 - DNA, 12 bp, Homo sapiens
actccagcctgg

SEQ ID NO: 714259 - DNA, 18 bp, Homo sapiens
actccagcctgggcaaca

SEQ ID NO: 714260 - DNA, 15 bp, Homo sapiens
actccagcctgggtg

SEQ ID NO: 714261 - DNA, 22 bp, Homo sapiens
actccaggaaagagcagtcaga

SEQ ID NO: 714262 - DNA, 18 bp, Homo sapiens
actccaggacgaggagga

SEQ ID NO: 714263 - DNA, 24 bp, Homo sapiens
actccaggatggaattcttcctcc

SEQ ID NO: 714264 - DNA, 16 bp, Homo sapiens
actccaggatttataa

SEQ ID NO: 714265 - DNA, 17 bp, Homo sapiens
actccaggatttataaa

SEQ ID NO: 714266 - DNA, 20 bp, Homo sapiens
actccaggcagcagacacat

SEQ ID NO: 714267 - DNA, 22 bp, Homo sapiens
actccaggcagcagacacatgc

SEQ ID NO: 714268 - DNA, 21 bp, Homo sapiens
atataactgtcttgtttcagt

SEQ ID NO: 714269 - DNA, 21 bp, Homo sapiens
atataacttatattgtaagaa

SEQ ID NO: 714270 - DNA, 21 bp, Homo sapiens
atataagaaaagtaatgaaga

SEQ ID NO: 714271 - DNA, 14 bp, Homo sapiens
atataagaataaaa

SEQ ID NO: 714272 - DNA, 16 bp, Homo sapiens
atataagacatttgtt

SEQ ID NO: 714273 - DNA, 18 bp, Homo sapiens
atataagaccactacagt

SEQ ID NO: 714274 - DNA, 16 bp, Homo sapiens
aatcacatcctggcct

SEQ ID NO: 714275 - DNA, 18 bp, Homo sapiens
aatcaccatagggctggg

SEQ ID NO: 714276 - DNA, 15 bp, Homo sapiens
aatcaccatgtaagc

SEQ ID NO: 714277 - DNA, 16 bp, Homo sapiens
aatcaccatgtaagca

SEQ ID NO: 714278 - DNA, 19 bp, Homo sapiens
aatcaccatgtaagcactc

SEQ ID NO: 714279 - DNA, 13 bp, Homo sapiens
aatcaccctccta

SEQ ID NO: 714280 - DNA, 18 bp, Homo sapiens
aatcacgagatcttcctt

SEQ ID NO: 714281 - DNA, 19 bp, Homo sapiens
aatcacgagatcttccttc

SEQ ID NO: 714282 - DNA, 20 bp, Homo sapiens
aatcacgagatcttccttcc

SEQ ID NO: 714283 - DNA, 21 bp, Homo sapiens
aatcacgtaaagctagaaatg

SEQ ID NO: 714284 - DNA, 14 bp, Homo sapiens
aatcactaaacttt

SEQ ID NO: 714285 - DNA, 16 bp, Homo sapiens
aatcactaggtaactt

SEQ ID NO: 714286 - DNA, 23 bp, Homo sapiens
aatcactattcttaagcactttg

SEQ ID NO: 714287 - DNA, 17 bp, Homo sapiens
aatcactattgaaaaat

SEQ ID NO: 714288 - DNA, 18 bp, Homo sapiens
aatcactctaattaattg

SEQ ID NO: 714289 - DNA, 21 bp, Homo sapiens
aatcactctaattaattgtaa

SEQ ID NO: 714290 - DNA, 13 bp, Homo sapiens
aatcactgctccc

SEQ ID NO: 714291 - DNA, 11 bp, Homo sapiens
aatcactgttt

SEQ ID NO: 714292 - DNA, 19 bp, Homo sapiens
aatcactgtttagaacaca

SEQ ID NO: 714293 - DNA, 12 bp, Homo sapiens
aatcacttcaga

SEQ ID NO: 714294 - DNA, 14 bp, Homo sapiens
aatcacttcagatc

SEQ ID NO: 714295 - DNA, 15 bp, Homo sapiens
aatcacttcagatct

SEQ ID NO: 714296 - DNA, 16 bp, Homo sapiens
aatcacttcagatctc

SEQ ID NO: 714297 - DNA, 12 bp, Homo sapiens
aatcacttgggg

SEQ ID NO: 714298 - DNA, 15 bp, Homo sapiens
aatcactttcataat

SEQ ID NO: 714299 - DNA, 15 bp, Homo sapiens
aatcacttttctaga

SEQ ID NO: 714300 - DNA, 14 bp, Homo sapiens
aatcagaaaagcta

SEQ ID NO: 714301 - DNA, 19 bp, Homo sapiens
aatcagaaaagtaattttg

SEQ ID NO: 714302 - DNA, 13 bp, Homo sapiens
aatcagacaaagt

SEQ ID NO: 714303 - DNA, 13 bp, Homo sapiens
aatcagagacaaa

SEQ ID NO: 714304 - DNA, 16 bp, Homo sapiens
aatcagagctccagtt

SEQ ID NO: 714305 - DNA, 23 bp, Homo sapiens
aatcagagctccagtttgcattt

SEQ ID NO: 714306 - DNA, 22 bp, Homo sapiens
aatcagatgatggccatttcta

SEQ ID NO: 714307 - DNA, 18 bp, Homo sapiens
aatcagatgcctcagagg

SEQ ID NO: 714308 - DNA, 15 bp, Homo sapiens
aatcagcatgacaaa

SEQ ID NO: 714309 - DNA, 16 bp, Homo sapiens
aatcagcatgacaaaa

SEQ ID NO: 714310 - DNA, 12 bp, Homo sapiens
aatcagcattct

SEQ ID NO: 714311 - DNA, 18 bp, Homo sapiens
aatcagcattctcactcc

SEQ ID NO: 714312 - DNA, 18 bp, Homo sapiens
aatcagccaagttttata

SEQ ID NO: 714313 - DNA, 12 bp, Homo sapiens
aatcagccccca

SEQ ID NO: 714314 - DNA, 12 bp, Homo sapiens
aatcagcctctt

SEQ ID NO: 714315 - DNA, 13 bp, Homo sapiens
aatcagcctgctc

SEQ ID NO: 714316 - DNA, 19 bp, Homo sapiens
aatcagcctgctccagctg

SEQ ID NO: 714317 - DNA, 23 bp, Homo sapiens
aatcagctatttactgccaaagg

SEQ ID NO: 714318 - DNA, 16 bp, Homo sapiens
aatcagctattttgtg

SEQ ID NO: 714319 - DNA, 17 bp, Homo sapiens
aatcagctattttgtga

SEQ ID NO: 714320 - DNA, 16 bp, Homo sapiens
aatcagctctcctggc

SEQ ID NO: 714321 - DNA, 18 bp, Homo sapiens
aatcagctctcctggctc

SEQ ID NO: 714322 - DNA, 19 bp, Homo sapiens
aatcagctctcctggctcc

SEQ ID NO: 714323 - DNA, 12 bp, Homo sapiens
aatcaggaaaaa

SEQ ID NO: 714324 - DNA, 17 bp, Homo sapiens
aatcaggaaaggctgta

SEQ ID NO: 714325 - DNA, 15 bp, Homo sapiens
aatcaggcttttgtt

SEQ ID NO: 714326 - DNA, 13 bp, Homo sapiens
aatcaggggccag

SEQ ID NO: 714327 - DNA, 22 bp, Homo sapiens
aatcaggtagaccatattctaa

SEQ ID NO: 714328 - DNA, 15 bp, Homo sapiens
aatcaggtagacttt

SEQ ID NO: 714329 - DNA, 18 bp, Homo sapiens
aatcaggttttcttttaa

SEQ ID NO: 714330 - DNA, 21 bp, Homo sapiens
aatcaggttttcttttaagaa

SEQ ID NO: 714331 - DNA, 19 bp, Homo sapiens
aatcagtatcagaatactt

SEQ ID NO: 714332 - DNA, 16 bp, Homo sapiens
aatcagtatttccttc

SEQ ID NO: 714333 - DNA, 17 bp, Homo sapiens
aatcagtcccctcccat

SEQ ID NO: 714334 - DNA, 18 bp, Homo sapiens
aatcagtcccctcccatc

SEQ ID NO: 714335 - DNA, 21 bp, Homo sapiens
aatcagtgactgaaaccattt

SEQ ID NO: 714336 - DNA, 16 bp, Homo sapiens
aatcagtgaggtgaga

SEQ ID NO: 714337 - DNA, 12 bp, Homo sapiens
aatcagtgcagt

SEQ ID NO: 714338 - DNA, 21 bp, Homo sapiens
aatcagtgcctggtgttctga

SEQ ID NO: 714339 - DNA, 17 bp, Homo sapiens
aatcagtgtttggtgta

SEQ ID NO: 714340 - DNA, 20 bp, Homo sapiens
aatcagttcattagaaatat

SEQ ID NO: 714341 - DNA, 23 bp, Homo sapiens
aatcagttcattagaaatatttt

SEQ ID NO: 714342 - DNA, 12 bp, Homo sapiens
aatcagtttatc

SEQ ID NO: 714343 - DNA, 19 bp, Homo sapiens
aatcagttttggaatctaa

SEQ ID NO: 714344 - DNA, 22 bp, Homo sapiens
aatcagttttggaatctaagct

SEQ ID NO: 714345 - DNA, 14 bp, Homo sapiens
aatcagtttttcat

SEQ ID NO: 714346 - DNA, 20 bp, Homo sapiens
aatcatacaaactctcacca

SEQ ID NO: 714347 - DNA, 19 bp, Homo sapiens
aatcatactgcctactgtt

SEQ ID NO: 714348 - DNA, 19 bp, Homo sapiens
aatcatagtactctttgta

SEQ ID NO: 714349 - DNA, 15 bp, Homo sapiens
aatcatatgtgtctt

SEQ ID NO: 714350 - DNA, 22 bp, Homo sapiens
aatcatatgtgtctttatagat

SEQ ID NO: 714351 - DNA, 14 bp, Homo sapiens
aatcatcaaaaagt

SEQ ID NO: 714352 - DNA, 18 bp, Homo sapiens
aatcatcaagaagggctg

SEQ ID NO: 714353 - DNA, 12 bp, Homo sapiens
aatcatcaagta

SEQ ID NO: 714354 - DNA, 18 bp, Homo sapiens
aatcatccctccttgcct

SEQ ID NO: 714355 - DNA, 18 bp, Homo sapiens
aatcatctgcattcctga

SEQ ID NO: 714356 - DNA, 18 bp, Homo sapiens
aatcatctgtgtgaaaat

SEQ ID NO: 714357 - DNA, 16 bp, Homo sapiens
aatcatgaaatatgca

SEQ ID NO: 714358 - DNA, 22 bp, Homo sapiens
aatcatgagaaaaactgttctt

SEQ ID NO: 714359 - DNA, 16 bp, Homo sapiens
aatcatgagcctgctg

SEQ ID NO: 714360 - DNA, 12 bp, Homo sapiens
aatcatgctcat

SEQ ID NO: 714361 - DNA, 23 bp, Homo sapiens
aatcatggctcactgcagccttg

SEQ ID NO: 714362 - DNA, 12 bp, Homo sapiens
aatcatgtaaat

SEQ ID NO: 714363 - DNA, 15 bp, Homo sapiens
aatcatgtaaatgct

SEQ ID NO: 714364 - DNA, 23 bp, Homo sapiens
aatcatgtatgttatgatattgt

SEQ ID NO: 714365 - DNA, 19 bp, Homo sapiens
aatcatgtccatacacttt

SEQ ID NO: 714366 - DNA, 16 bp, Homo sapiens
aatcatgtgaacccgg

SEQ ID NO: 714367 - DNA, 15 bp, Homo sapiens
aatcatgttgaaaca

SEQ ID NO: 714368 - DNA, 17 bp, Homo sapiens
aatcattaagacaactg

SEQ ID NO: 714369 - DNA, 20 bp, Homo sapiens
aatcattaatttcaaaattt

SEQ ID NO: 714370 - DNA, 17 bp, Homo sapiens
aatcattaggtgtgact

SEQ ID NO: 714371 - DNA, 15 bp, Homo sapiens
aatcattagttttag

SEQ ID NO: 714372 - DNA, 14 bp, Homo sapiens
aatcattatgtttc

SEQ ID NO: 714373 - DNA, 20 bp, Homo sapiens
aatcattccagtgctagaaa

SEQ ID NO: 714374 - DNA, 14 bp, Homo sapiens
aatcattccttaga

SEQ ID NO: 714375 - DNA, 23 bp, Homo sapiens
aatcattctttcccctcagagct

SEQ ID NO: 714376 - DNA, 22 bp, Homo sapiens
aatcattgaagtatattcttat

SEQ ID NO: 714377 - DNA, 23 bp, Homo sapiens
aatcattgaagtatattcttatt

SEQ ID NO: 714378 - DNA, 19 bp, Homo sapiens
aatcattgctttgaagcag

SEQ ID NO: 714379 - DNA, 21 bp, Homo sapiens
aatcattgctttgaagcagtt

SEQ ID NO: 714380 - DNA, 13 bp, Homo sapiens
aatcattgtagaa

SEQ ID NO: 714381 - DNA, 14 bp, Homo sapiens
aatcattgtatgtg

SEQ ID NO: 714382 - DNA, 21 bp, Homo sapiens
aatcatttcagtatcatctcc

SEQ ID NO: 714383 - DNA, 22 bp, Homo sapiens
aatcatttcttgggccctcctg

SEQ ID NO: 714384 - DNA, 14 bp, Homo sapiens
aatcatttgtttac

SEQ ID NO: 714385 - DNA, 13 bp, Homo sapiens
aatcattttaaga

SEQ ID NO: 714386 - DNA, 16 bp, Homo sapiens
aatcattttaattatt

SEQ ID NO: 714387 - DNA, 23 bp, Homo sapiens
aatcattttatatgtcaaagcag

SEQ ID NO: 714388 - DNA, 13 bp, Homo sapiens
aatcattttcatt

SEQ ID NO: 714389 - DNA, 20 bp, Homo sapiens
aatccaaaaagctctgaaaa

SEQ ID NO: 714390 - DNA, 18 bp, Homo sapiens
aatcttagtatagtagaa

SEQ ID NO: 714391 - DNA, 21 bp, Homo sapiens
aatcttagtgtatgattactg

SEQ ID NO: 714392 - DNA, 14 bp, Homo sapiens
aatcttataaaaag

SEQ ID NO: 714393 - DNA, 14 bp, Homo sapiens
aatcttataattgt

SEQ ID NO: 714394 - DNA, 14 bp, Homo sapiens
aatcttatacaaca

SEQ ID NO: 714395 - DNA, 20 bp, Homo sapiens
aatcttattagggagaaaat

SEQ ID NO: 714396 - DNA, 21 bp, Homo sapiens
aatcttattccgagcattcca

SEQ ID NO: 714397 - DNA, 22 bp, Homo sapiens
aatcttattccgagcattccag

SEQ ID NO: 714398 - DNA, 18 bp, Homo sapiens
aatcttattttatcttct

SEQ ID NO: 714399 - DNA, 14 bp, Homo sapiens
aatcttcacctcag

SEQ ID NO: 714400 - DNA, 20 bp, Homo sapiens
aatcttcagttttatcttta

SEQ ID NO: 714401 - DNA, 21 bp, Homo sapiens
aatcttcatggaattcacaaa

SEQ ID NO: 714402 - DNA, 16 bp, Homo sapiens
aatcttccatctgcat

SEQ ID NO: 714403 - DNA, 12 bp, Homo sapiens
aatcttctactt

SEQ ID NO: 714404 - DNA, 20 bp, Homo sapiens
aatcttctcccttgtcctgc

SEQ ID NO: 714405 - DNA, 17 bp, Homo sapiens
aatcttgaaattaagaa

SEQ ID NO: 714406 - DNA, 16 bp, Homo sapiens
aatcttgaatttctgc

SEQ ID NO: 714407 - DNA, 14 bp, Homo sapiens
aatcttgcccactg

SEQ ID NO: 714408 - DNA, 19 bp, Homo sapiens
aatcttgcccactggccgc

SEQ ID NO: 714409 - DNA, 14 bp, Homo sapiens
aatcttgctttctt

SEQ ID NO: 714410 - DNA, 16 bp, Homo sapiens
atatctgaaaatgtat

SEQ ID NO: 714411 - DNA, 17 bp, Homo sapiens
atatctgaaaatgtatg

SEQ ID NO: 714412 - DNA, 20 bp, Homo sapiens
atatctgaaaatgtatgtgt

SEQ ID NO: 714413 - DNA, 14 bp, Homo sapiens
atatctgattgttg

SEQ ID NO: 714414 - DNA, 16 bp, Homo sapiens
atatctgcatgtgtca

SEQ ID NO: 714415 - DNA, 19 bp, Homo sapiens
atatctgccccagtagtca

SEQ ID NO: 714416 - DNA, 15 bp, Homo sapiens
atatctgcctcccct

SEQ ID NO: 714417 - DNA, 15 bp, Homo sapiens
atatctggacaagcc

SEQ ID NO: 714418 - DNA, 13 bp, Homo sapiens
atatctggcctct

SEQ ID NO: 714419 - DNA, 19 bp, Homo sapiens
atatctggcctctgctttc

SEQ ID NO: 714420 - DNA, 16 bp, Homo sapiens
atatctggctcaacat

SEQ ID NO: 714421 - DNA, 15 bp, Homo sapiens
atatctggtatatgt

SEQ ID NO: 714422 - DNA, 19 bp, Homo sapiens
atatctggtatatgtcatt

SEQ ID NO: 714423 - DNA, 15 bp, Homo sapiens
atatctgtaatggta

SEQ ID NO: 714424 - DNA, 16 bp, Homo sapiens
atatctgtaatggtac

SEQ ID NO: 714425 - DNA, 13 bp, Homo sapiens
atatctgtacaga

SEQ ID NO: 714426 - DNA, 22 bp, Homo sapiens
atatctgtttgtatatttgcaa

SEQ ID NO: 714427 - DNA, 16 bp, Homo sapiens
atatcttaaagaaaca

SEQ ID NO: 714428 - DNA, 19 bp, Homo sapiens
atatcttaaagaaacagct

SEQ ID NO: 714429 - DNA, 20 bp, Homo sapiens
atatcttaattctttgttct

SEQ ID NO: 714430 - DNA, 16 bp, Homo sapiens
atatcttataactgtt

SEQ ID NO: 714431 - DNA, 19 bp, Homo sapiens
atatcttataactgtttta

SEQ ID NO: 714432 - DNA, 20 bp, Homo sapiens
atatcttcaagcctgggcgt

SEQ ID NO: 714433 - DNA, 20 bp, Homo sapiens
atatcttcagctctttttgt

SEQ ID NO: 714434 - DNA, 21 bp, Homo sapiens
atatcttcccatttaacattg

SEQ ID NO: 714435 - DNA, 13 bp, Homo sapiens
atatcttcctttg

SEQ ID NO: 714436 - DNA, 23 bp, Homo sapiens
atatcttcgttagtaatctgtat

SEQ ID NO: 714437 - DNA, 20 bp, Homo sapiens
atatcttctatatctgaaga

SEQ ID NO: 714438 - DNA, 19 bp, Homo sapiens
atatcttctgatttgtccc

SEQ ID NO: 714439 - DNA, 22 bp, Homo sapiens
atatcttgctggattaatgttt

SEQ ID NO: 714440 - DNA, 15 bp, Homo sapiens
atatcttgttattaa

SEQ ID NO: 714441 - DNA, 13 bp, Homo sapiens
atatcttgtttac

SEQ ID NO: 714442 - DNA, 21 bp, Homo sapiens
atatcttgtttacaataaaga

SEQ ID NO: 714443 - DNA, 20 bp, Homo sapiens
atatctttctcttacctgtt

SEQ ID NO: 714444 - DNA, 12 bp, Homo sapiens
atatctttctgc

SEQ ID NO: 714445 - DNA, 20 bp, Homo sapiens
atatgaaaaaaatgcatttt

SEQ ID NO: 714446 - DNA, 18 bp, Homo sapiens
atatgaaaaatgtaaata

SEQ ID NO: 714447 - DNA, 23 bp, Homo sapiens
atatgaacacagacaaagtgcta

SEQ ID NO: 714448 - DNA, 22 bp, Homo sapiens
atatgaacagggcccaggcctg

SEQ ID NO: 714449 - DNA, 22 bp, Homo sapiens
atatgaacctattttcatttgt

SEQ ID NO: 714450 - DNA, 16 bp, Homo sapiens
atatgaagacataaac

SEQ ID NO: 714451 - DNA, 15 bp, Homo sapiens
atatgaagagttttt

SEQ ID NO: 714452 - DNA, 13 bp, Homo sapiens
atatgaagccttt

SEQ ID NO: 714453 - DNA, 16 bp, Homo sapiens
atatgaatatatagtg

SEQ ID NO: 714454 - DNA, 13 bp, Homo sapiens
atatgaatgtcac

SEQ ID NO: 714455 - DNA, 16 bp, Homo sapiens
atatgacatttaaatg

SEQ ID NO: 714456 - DNA, 12 bp, Homo sapiens
atatgaccagaa

SEQ ID NO: 714457 - DNA, 20 bp, Homo sapiens
atatgaccagaagccttgga

SEQ ID NO: 714458 - DNA, 16 bp, Homo sapiens
atatgacccacactgc

SEQ ID NO: 714459 - DNA, 20 bp, Homo sapiens
atatgacggaagaacataga

SEQ ID NO: 714460 - DNA, 22 bp, Homo sapiens
atatgagaaataagaaactttt

SEQ ID NO: 714461 - DNA, 18 bp, Homo sapiens
atatgagcttcaatataa

SEQ ID NO: 714462 - DNA, 22 bp, Homo sapiens
atatgatagcgggaaaaggaga

SEQ ID NO: 714463 - DNA, 16 bp, Homo sapiens
atatgatatgtaaaca

SEQ ID NO: 714464 - DNA, 16 bp, Homo sapiens
atatgatccagagcag

SEQ ID NO: 714465 - DNA, 17 bp, Homo sapiens
atatgatctgtctgtgg

SEQ ID NO: 714466 - DNA, 14 bp, Homo sapiens
atatgatgccactt

SEQ ID NO: 714467 - DNA, 15 bp, Homo sapiens
atatgatgtggacat

SEQ ID NO: 714468 - DNA, 20 bp, Homo sapiens
atatgattctagtacataat

SEQ ID NO: 714469 - DNA, 14 bp, Homo sapiens
atatgatttatagt

SEQ ID NO: 714470 - DNA, 16 bp, Homo sapiens
atatgatttcttgctt

SEQ ID NO: 714471 - DNA, 19 bp, Homo sapiens
atatgattttatttgacaa

SEQ ID NO: 714472 - DNA, 22 bp, Homo sapiens
atatgattttatttgacaaaat

SEQ ID NO: 714473 - DNA, 13 bp, Homo sapiens
atatgcaagcagc

SEQ ID NO: 714474 - DNA, 14 bp, Homo sapiens
atatgcaagcagct

SEQ ID NO: 714475 - DNA, 17 bp, Homo sapiens
atatgcaagcagctttt

SEQ ID NO: 714476 - DNA, 23 bp, Homo sapiens
atatgcacaaaactacttttcta

SEQ ID NO: 714477 - DNA, 19 bp, Homo sapiens
atatgcacacagtgctttc

SEQ ID NO: 714478 - DNA, 14 bp, Homo sapiens
atatgcacacattt

SEQ ID NO: 714479 - DNA, 15 bp, Homo sapiens
atatgcacacatttt

SEQ ID NO: 714480 - DNA, 22 bp, Homo sapiens
atatgcacacattttttaaatg

SEQ ID NO: 714481 - DNA, 13 bp, Homo sapiens
atatgcactttcc

SEQ ID NO: 714482 - DNA, 18 bp, Homo sapiens
atatgcactttccctaga

SEQ ID NO: 714483 - DNA, 11 bp, Homo sapiens
atatgcatact

SEQ ID NO: 714484 - DNA, 22 bp, Homo sapiens
atatgcatactaatttttgctt

SEQ ID NO: 714485 - DNA, 23 bp, Homo sapiens
atatgcatactaatttttgctta

SEQ ID NO: 714486 - DNA, 15 bp, Homo sapiens
atatgcatgccaggc

SEQ ID NO: 714487 - DNA, 14 bp, Homo sapiens
atatgcctacagcc

SEQ ID NO: 714488 - DNA, 20 bp, Homo sapiens
atatgctaattaaataatac

SEQ ID NO: 714489 - DNA, 23 bp, Homo sapiens
atatgctctgcttttagttcata

SEQ ID NO: 714490 - DNA, 17 bp, Homo sapiens
atatgctgatcttttaa

SEQ ID NO: 714491 - DNA, 23 bp, Homo sapiens
atatgctgtacatgacatcaaaa

SEQ ID NO: 714492 - DNA, 18 bp, Homo sapiens
atatgcttactaaatctt

SEQ ID NO: 714493 - DNA, 16 bp, Homo sapiens
atatgcttttggaagt

SEQ ID NO: 714494 - DNA, 19 bp, Homo sapiens
atatgcttttggaagttaa

SEQ ID NO: 714495 - DNA, 19 bp, Homo sapiens
atatggaattttgcaaaga

SEQ ID NO: 714496 - DNA, 20 bp, Homo sapiens
atatggacacttaatactac

SEQ ID NO: 714497 - DNA, 11 bp, Homo sapiens
atatggaccta

SEQ ID NO: 714498 - DNA, 15 bp, Homo sapiens
atatggaggattctt

SEQ ID NO: 714499 - DNA, 21 bp, Homo sapiens
atatggagtgagtcacctgct

SEQ ID NO: 714500 - DNA, 14 bp, Homo sapiens
atatggatcagagg

SEQ ID NO: 714501 - DNA, 18 bp, Homo sapiens
atatggatgattcagaaa

SEQ ID NO: 714502 - DNA, 23 bp, Homo sapiens
atatggatgttactctcttgcac

SEQ ID NO: 714503 - DNA, 23 bp, Homo sapiens
atatggattttctattgttactc

SEQ ID NO: 714504 - DNA, 13 bp, Homo sapiens
atatggcaagaaa

SEQ ID NO: 714505 - DNA, 19 bp, Homo sapiens
atatggcaagaaagctggt

SEQ ID NO: 714506 - DNA, 16 bp, Homo sapiens
atatggcagagttgta

SEQ ID NO: 714507 - DNA, 19 bp, Homo sapiens
atatggcagagttgtaaat

SEQ ID NO: 714508 - DNA, 13 bp, Homo sapiens
atatggcaggact

SEQ ID NO: 714509 - DNA, 12 bp, Homo sapiens
atatggctgccc

SEQ ID NO: 714510 - DNA, 14 bp, Homo sapiens
atatggctgcccag

SEQ ID NO: 714511 - DNA, 17 bp, Homo sapiens
atatggctgcccaggag

SEQ ID NO: 714512 - DNA, 14 bp, Homo sapiens
tctctttaaactat

SEQ ID NO: 714513 - DNA, 20 bp, Homo sapiens
tctctttaatcttcagtttt

SEQ ID NO: 714514 - DNA, 21 bp, Homo sapiens
tctctttaattttaactgatt

SEQ ID NO: 714515 - DNA, 16 bp, Homo sapiens
tctctttatacagctg

SEQ ID NO: 714516 - DNA, 19 bp, Homo sapiens
tctctttatgtctgtggat

SEQ ID NO: 714517 - DNA, 23 bp, Homo sapiens
tctctttctccttagtcttctca

SEQ ID NO: 714518 - DNA, 13 bp, Homo sapiens
tctctttctctct

SEQ ID NO: 714519 - DNA, 19 bp, Homo sapiens
tctctttctctcttccctc

SEQ ID NO: 714520 - DNA, 15 bp, Homo sapiens
tctctttcttccttt

SEQ ID NO: 714521 - DNA, 20 bp, Homo sapiens
tctctttgaattttctgtgt

SEQ ID NO: 714522 - DNA, 12 bp, Homo sapiens
tctctttgactt

SEQ ID NO: 714523 - DNA, 18 bp, Homo sapiens
tctctttgattatttgca

SEQ ID NO: 714524 - DNA, 22 bp, Homo sapiens
tctcttttcccctttcctgtcc

SEQ ID NO: 714525 - DNA, 17 bp, Homo sapiens
tctcttttcctcgcaga

SEQ ID NO: 714526 - DNA, 16 bp, Homo sapiens
tctcttttcctctctg

SEQ ID NO: 714527 - DNA, 19 bp, Homo sapiens
tctcttttcctctctgtct

SEQ ID NO: 714528 - DNA, 20 bp, Homo sapiens
tctcttttcctctctgtctg

SEQ ID NO: 714529 - DNA, 18 bp, Homo sapiens
tctcttttgaaagtagag

SEQ ID NO: 714530 - DNA, 23 bp, Homo sapiens
tctcttttgaatccatgcttggg

SEQ ID NO: 714531 - DNA, 22 bp, Homo sapiens
tctcttttggtttctgcttctc

SEQ ID NO: 714532 - DNA, 22 bp, Homo sapiens
tctctttttggtaataacaaac

SEQ ID NO: 714533 - DNA, 23 bp, Homo sapiens
tctgaaaaattcctttgtgtttc

SEQ ID NO: 714534 - DNA, 13 bp, Homo sapiens
tctgaaaatataa

SEQ ID NO: 714535 - DNA, 18 bp, Homo sapiens
tctgaaaatataaccagc

SEQ ID NO: 714536 - DNA, 14 bp, Homo sapiens
tctgaaaattctgg

SEQ ID NO: 714537 - DNA, 20 bp, Homo sapiens
tctgaaacatttcataattt

SEQ ID NO: 714538 - DNA, 17 bp, Homo sapiens
tctgaaagacagaatgt

SEQ ID NO: 714539 - DNA, 19 bp, Homo sapiens
tctgaaagacagaatgtca

SEQ ID NO: 714540 - DNA, 21 bp, Homo sapiens
tctgaaaggctatcctgctga

SEQ ID NO: 714541 - DNA, 17 bp, Homo sapiens
tctgaaagtaaaacaat

SEQ ID NO: 714542 - DNA, 14 bp, Homo sapiens
tctgaaatgaaaca

SEQ ID NO: 714543 - DNA, 12 bp, Homo sapiens
tctgaaattaaa

SEQ ID NO: 714544 - DNA, 14 bp, Homo sapiens
tctgaaatttttct

SEQ ID NO: 714545 - DNA, 15 bp, Homo sapiens
tctgaaatttttctt

SEQ ID NO: 714546 - DNA, 13 bp, Homo sapiens
tctgaacaaacac

SEQ ID NO: 714547 - DNA, 21 bp, Homo sapiens
tctgaacaaacactgaatcat

SEQ ID NO: 714548 - DNA, 19 bp, Homo sapiens
tctgaacacacacgccagc

SEQ ID NO: 714549 - DNA, 13 bp, Homo sapiens
tctgaacacattg

SEQ ID NO: 714550 - DNA, 12 bp, Homo sapiens
tctgaacacttt

SEQ ID NO: 714551 - DNA, 22 bp, Homo sapiens
tctgaacccttgtgcttggtgg

SEQ ID NO: 714552 - DNA, 13 bp, Homo sapiens
tctgaactctcaa

SEQ ID NO: 714553 - DNA, 14 bp, Homo sapiens
tctgaactctcaaa

SEQ ID NO: 714554 - DNA, 18 bp, Homo sapiens
tctgaagaaagttattct

SEQ ID NO: 714555 - DNA, 19 bp, Homo sapiens
tctgaagagcctgaagctg

SEQ ID NO: 714556 - DNA, 22 bp, Homo sapiens
tctgaagagtatccttccttca

SEQ ID NO: 714557 - DNA, 18 bp, Homo sapiens
tctgaagatatatttcac

SEQ ID NO: 714558 - DNA, 22 bp, Homo sapiens
tctgaagatatatttcactttt

SEQ ID NO: 714559 - DNA, 19 bp, Homo sapiens
tctgaagatcaatttctcc

SEQ ID NO: 714560 - DNA, 21 bp, Homo sapiens
tctgaagctttaccagctgaa

SEQ ID NO: 714561 - DNA, 19 bp, Homo sapiens
tctgaaggaagagaagaca

SEQ ID NO: 714562 - DNA, 17 bp, Homo sapiens
tctgaaggaccccaggt

SEQ ID NO: 714563 - DNA, 13 bp, Homo sapiens
tctgaaggactgg

SEQ ID NO: 714564 - DNA, 20 bp, Homo sapiens
tctgaaggagccccattcct

SEQ ID NO: 714565 - DNA, 18 bp, Homo sapiens
tctgaaggcaaatataag

SEQ ID NO: 714566 - DNA, 16 bp, Homo sapiens
tctgaagtacaaacat

SEQ ID NO: 714567 - DNA, 18 bp, Homo sapiens
tctgaagtcactgcacag

SEQ ID NO: 714568 - DNA, 20 bp, Homo sapiens
tctgaagtgggaaaaaatag

SEQ ID NO: 714569 - DNA, 20 bp, Homo sapiens
tctgaagtgtcctaaatatt

SEQ ID NO: 714570 - DNA, 20 bp, Homo sapiens
tctgaagtgtgtccatcctg

SEQ ID NO: 714571 - DNA, 18 bp, Homo sapiens
tctgaagtttcatttatg

SEQ ID NO: 714572 - DNA, 15 bp, Homo sapiens
tctgaataaaaaaga

SEQ ID NO: 714573 - DNA, 17 bp, Homo sapiens
tctgaataaaaaagatt

SEQ ID NO: 714574 - DNA, 20 bp, Homo sapiens
tctgaataaaaaagattcta

SEQ ID NO: 714575 - DNA, 18 bp, Homo sapiens
tctgaataaagtgtaaca

SEQ ID NO: 714576 - DNA, 14 bp, Homo sapiens
tctgaataacttga

SEQ ID NO: 714577 - DNA, 14 bp, Homo sapiens
tctgaatattttgt

SEQ ID NO: 714578 - DNA, 20 bp, Homo sapiens
tctgaatcaagcacactgta

SEQ ID NO: 714579 - DNA, 21 bp, Homo sapiens
tctgaatcaagcacactgtat

SEQ ID NO: 714580 - DNA, 15 bp, Homo sapiens
tctgaatctgtacat

SEQ ID NO: 714581 - DNA, 16 bp, Homo sapiens
tctgaatctgtacatg

SEQ ID NO: 714582 - DNA, 17 bp, Homo sapiens
tctgaatgatcttgtgt

SEQ ID NO: 714583 - DNA, 13 bp, Homo sapiens
tctgaatgctgct

SEQ ID NO: 714584 - DNA, 13 bp, Homo sapiens
tctgaatgcttct

SEQ ID NO: 714585 - DNA, 14 bp, Homo sapiens
tctgaatgttctga

SEQ ID NO: 714586 - DNA, 19 bp, Homo sapiens
tctgaatgttctgacatta

SEQ ID NO: 714587 - DNA, 22 bp, Homo sapiens
tctgaatgttctgacattaaca

SEQ ID NO: 714588 - DNA, 23 bp, Homo sapiens
tctgaatgttctgacattaacag

SEQ ID NO: 714589 - DNA, 22 bp, Homo sapiens
tctgaattttggggattttcaa

SEQ ID NO: 714590 - DNA, 15 bp, Homo sapiens
tctgaatttttaaac

SEQ ID NO: 714591 - DNA, 16 bp, Homo sapiens
tctgaatttttaaaca

SEQ ID NO: 714592 - DNA, 16 bp, Homo sapiens
tctgacagcagcctgt

SEQ ID NO: 714593 - DNA, 17 bp, Homo sapiens
tctgacagcagcctgtg

SEQ ID NO: 714594 - DNA, 22 bp, Homo sapiens
tctgacagcaggccactagtga

SEQ ID NO: 714595 - DNA, 13 bp, Homo sapiens
tctgacagtcctt

SEQ ID NO: 714596 - DNA, 19 bp, Homo sapiens
tctgacagtccttggggtt

SEQ ID NO: 714597 - DNA, 17 bp, Homo sapiens
tctgacagtttttctgt

SEQ ID NO: 714598 - DNA, 16 bp, Homo sapiens
tctgacatcaaaactt

SEQ ID NO: 714599 - DNA, 13 bp, Homo sapiens
tctgacatccctt

SEQ ID NO: 714600 - DNA, 11 bp, Homo sapiens
tctctccatct

SEQ ID NO: 714601 - DNA, 19 bp, Homo sapiens
tctctcccaccccggcctc

SEQ ID NO: 714602 - DNA, 19 bp, Homo sapiens
tctctcccaccctaagggc

SEQ ID NO: 714603 - DNA, 22 bp, Homo sapiens
tctctcccaccctaagggcagc

SEQ ID NO: 714604 - DNA, 17 bp, Homo sapiens
tctctcccatcctgggg

SEQ ID NO: 714605 - DNA, 20 bp, Homo sapiens
tctctcccatttcaggaatt

SEQ ID NO: 714606 - DNA, 15 bp, Homo sapiens
tctctccccctctgt

SEQ ID NO: 714607 - DNA, 16 bp, Homo sapiens
tctctccccctctgtc

SEQ ID NO: 714608 - DNA, 15 bp, Homo sapiens
tctctccctacctcc

SEQ ID NO: 714609 - DNA, 22 bp, Homo sapiens
tctctccctacctccctcctca

SEQ ID NO: 714610 - DNA, 15 bp, Homo sapiens
tctctccctctgtct

SEQ ID NO: 714611 - DNA, 16 bp, Homo sapiens
tctctccctctgtctt

SEQ ID NO: 714612 - DNA, 14 bp, Homo sapiens
tctctccctgcctt

SEQ ID NO: 714613 - DNA, 15 bp, Homo sapiens
tctctccctgccttt

SEQ ID NO: 714614 - DNA, 19 bp, Homo sapiens
tctctccctgtcacacact

SEQ ID NO: 714615 - DNA, 20 bp, Homo sapiens
tctctccctgtcacacactg

SEQ ID NO: 714616 - DNA, 23 bp, Homo sapiens
tctctccctgtcacacactggac

SEQ ID NO: 714617 - DNA, 14 bp, Homo sapiens
tctctcctagcccc

SEQ ID NO: 714618 - DNA, 22 bp, Homo sapiens
tctctcctagcccctctctcac

SEQ ID NO: 714619 - DNA, 18 bp, Homo sapiens
tctctcctcaggaccctc

SEQ ID NO: 714620 - DNA, 14 bp, Homo sapiens
tctctcctctctgc

SEQ ID NO: 714621 - DNA, 21 bp, Homo sapiens
tctctcctctctgcttcataa

SEQ ID NO: 714622 - DNA, 19 bp, Homo sapiens
tctctcctgctctcataat

SEQ ID NO: 714623 - DNA, 14 bp, Homo sapiens
tctctcctggctcg

SEQ ID NO: 714624 - DNA, 22 bp, Homo sapiens
tctctcctgtacctcttgagcc

SEQ ID NO: 714625 - DNA, 13 bp, Homo sapiens
tctctcctgtcca

SEQ ID NO: 714626 - DNA, 13 bp, Homo sapiens
tctctccttgccc

SEQ ID NO: 714627 - DNA, 18 bp, Homo sapiens
tctctcctttctccctgc

SEQ ID NO: 714628 - DNA, 14 bp, Homo sapiens
tctctcctttcttt

SEQ ID NO: 714629 - DNA, 14 bp, Homo sapiens
tctctcctttgctg

SEQ ID NO: 714630 - DNA, 13 bp, Homo sapiens
tctctcggccccc

SEQ ID NO: 714631 - DNA, 20 bp, Homo sapiens
tctctcggctccccatgtgt

SEQ ID NO: 714632 - DNA, 20 bp, Homo sapiens
tctctcgtaactggtttcat

SEQ ID NO: 714633 - DNA, 15 bp, Homo sapiens
tctctctacagtgcc

SEQ ID NO: 714634 - DNA, 13 bp, Homo sapiens
tctctctacctcc

SEQ ID NO: 714635 - DNA, 22 bp, Homo sapiens
tctctctactcctacctcagcc

SEQ ID NO: 714636 - DNA, 17 bp, Homo sapiens
tctctctcaatttttgg

SEQ ID NO: 714637 - DNA, 12 bp, Homo sapiens
tctctctccagg

SEQ ID NO: 714638 - DNA, 14 bp, Homo sapiens
tctctctccagggt

SEQ ID NO: 714639 - DNA, 13 bp, Homo sapiens
tctctctccctac

SEQ ID NO: 714640 - DNA, 22 bp, Homo sapiens
tctctctccctacctccctcct

SEQ ID NO: 714641 - DNA, 14 bp, Homo sapiens
tctctctccctctg

SEQ ID NO: 714642 - DNA, 13 bp, Homo sapiens
tctctctccctgc

SEQ ID NO: 714643 - DNA, 11 bp, Homo sapiens
tctctctcctc

SEQ ID NO: 714644 - DNA, 12 bp, Homo sapiens
tctctctcctgg

SEQ ID NO: 714645 - DNA, 22 bp, Homo sapiens
tctctctcctgtactttttcca

SEQ ID NO: 714646 - DNA, 16 bp, Homo sapiens
tctctctctctcctca

SEQ ID NO: 714647 - DNA, 12 bp, Homo sapiens
tctctctctgct

SEQ ID NO: 714648 - DNA, 14 bp, Homo sapiens
tctctctgcagctg

SEQ ID NO: 714649 - DNA, 11 bp, Homo sapiens
tctctctgccc

SEQ ID NO: 714650 - DNA, 15 bp, Homo sapiens
tctctctgcccactc

SEQ ID NO: 714651 - DNA, 20 bp, Homo sapiens
tctctctgccctctccctgt

SEQ ID NO: 714652 - DNA, 14 bp, Homo sapiens
tctctctggagccc

SEQ ID NO: 714653 - DNA, 13 bp, Homo sapiens
tctctctggcttc

SEQ ID NO: 714654 - DNA, 17 bp, Homo sapiens
tctctctgggcccaggg

SEQ ID NO: 714655 - DNA, 12 bp, Homo sapiens
tctctctgtgaa

SEQ ID NO: 714656 - DNA, 11 bp, Homo sapiens
tctctctgtgg

SEQ ID NO: 714657 - DNA, 12 bp, Homo sapiens
tctctcttcaat

SEQ ID NO: 714658 - DNA, 16 bp, Homo sapiens
tctctcttctcagagt

SEQ ID NO: 714659 - DNA, 11 bp, Homo sapiens
tctctcttctg

SEQ ID NO: 714660 - DNA, 16 bp, Homo sapiens
tctctcttctgctcca

SEQ ID NO: 714661 - DNA, 16 bp, Homo sapiens
tctctctttatacagc

SEQ ID NO: 714662 - DNA, 17 bp, Homo sapiens
tctctctttatacagct

SEQ ID NO: 714663 - DNA, 20 bp, Homo sapiens
tctctctttgcatggatttc

SEQ ID NO: 714664 - DNA, 23 bp, Homo sapiens
tctctctttgtgggttggccagg

SEQ ID NO: 714665 - DNA, 15 bp, Homo sapiens
tctctgaaaattctg

SEQ ID NO: 714666 - DNA, 22 bp, Homo sapiens
tctctgaaaattctggaaggaa

SEQ ID NO: 714667 - DNA, 11 bp, Homo sapiens
tctctgaaccc

SEQ ID NO: 714668 - DNA, 22 bp, Homo sapiens
tctctgaagagtgggtttcaca

SEQ ID NO: 714669 - DNA, 23 bp, Homo sapiens
tctctgaagagtgggtttcacaa

SEQ ID NO: 714670 - DNA, 14 bp, Homo sapiens
tctctgaagcatgt

SEQ ID NO: 714671 - DNA, 21 bp, Homo sapiens
tctctgaagcatgtttcatgt

SEQ ID NO: 714672 - DNA, 17 bp, Homo sapiens
tctctgaatacacagta

SEQ ID NO: 714673 - DNA, 15 bp, Homo sapiens
tctctgaatcagaaa

SEQ ID NO: 714674 - DNA, 14 bp, Homo sapiens
tctctgaatcctaa

SEQ ID NO: 714675 - DNA, 15 bp, Homo sapiens
tctctgaatgcccca

SEQ ID NO: 714676 - DNA, 23 bp, Homo sapiens
tctctgacccggttgcagtcact

SEQ ID NO: 714677 - DNA, 24 bp, Homo sapiens
tctctgacccggttgcagtcactg

SEQ ID NO: 714678 - DNA, 13 bp, Homo sapiens
tctctgacttctg

SEQ ID NO: 714679 - DNA, 15 bp, Homo sapiens
tctctgagctgtgca

SEQ ID NO: 714680 - DNA, 16 bp, Homo sapiens
tctctgagctgtgcag

SEQ ID NO: 714681 - DNA, 22 bp, Homo sapiens
tctctgaggggctaccaggaaa

SEQ ID NO: 714682 - DNA, 23 bp, Homo sapiens
tctctgaggggctaccaggaaag

SEQ ID NO: 714683 - DNA, 22 bp, Homo sapiens
tctctgagtggaggaagcccac

SEQ ID NO: 714684 - DNA, 22 bp, Homo sapiens
tctctgagttctgtgtattttc

SEQ ID NO: 714685 - DNA, 15 bp, Homo sapiens
tctctgatacacagt

SEQ ID NO: 714686 - DNA, 14 bp, Homo sapiens
tctctgatgcagaa

SEQ ID NO: 714687 - DNA, 16 bp, Homo sapiens
tctctgatgtcccagt

SEQ ID NO: 714688 - DNA, 22 bp, Homo sapiens
tctctgcaatttgtttaaagaa

SEQ ID NO: 714689 - DNA, 20 bp, Homo sapiens
tctctgcagacttcccagct

SEQ ID NO: 714690 - DNA, 11 bp, Homo sapiens
tctctgcagcc

SEQ ID NO: 714691 - DNA, 15 bp, Homo sapiens
tctctgcagccagcc

SEQ ID NO: 714692 - DNA, 17 bp, Homo sapiens
tctctgcagccagccca

SEQ ID NO: 714693 - DNA, 18 bp, Homo sapiens
tctctgcagccagcccag

SEQ ID NO: 714694 - DNA, 20 bp, Homo sapiens
tctctgcagccagcccagcc

SEQ ID NO: 714695 - DNA, 13 bp, Homo sapiens
tctctgcagccca

SEQ ID NO: 714696 - DNA, 13 bp, Homo sapiens
tctctgcagctgc

SEQ ID NO: 714697 - DNA, 18 bp, Homo sapiens
tctctgcatctactccca

SEQ ID NO: 714698 - DNA, 12 bp, Homo sapiens
tgtgtgttctgt

SEQ ID NO: 714699 - DNA, 13 bp, Homo sapiens
tgtgtgttctgta

SEQ ID NO: 714700 - DNA, 14 bp, Homo sapiens
tgtgtgttgacact

SEQ ID NO: 714701 - DNA, 22 bp, Homo sapiens
tgtgtgttgatcccaagacaat

SEQ ID NO: 714702 - DNA, 15 bp, Homo sapiens
tgtgtgtttaaagaa

SEQ ID NO: 714703 - DNA, 18 bp, Homo sapiens
tgtgtgtttaaataaagt

SEQ ID NO: 714704 - DNA, 21 bp, Homo sapiens
tgtgtgtttaacattcacagc

SEQ ID NO: 714705 - DNA, 10 bp, Homo sapiens
tgtgtgtttg

SEQ ID NO: 714706 - DNA, 20 bp, Homo sapiens
tgtgtgttttcccaaagcac

SEQ ID NO: 714707 - DNA, 21 bp, Homo sapiens
tgtgttacccaggctggtctc

SEQ ID NO: 714708 - DNA, 18 bp, Homo sapiens
tgtgttagtgtctgtcca

SEQ ID NO: 714709 - DNA, 13 bp, Homo sapiens
tgtgttatattcc

SEQ ID NO: 714710 - DNA, 15 bp, Homo sapiens
tgtgttatattccaa

SEQ ID NO: 714711 - DNA, 22 bp, Homo sapiens
tgtgttatcacccagaagaaaa

SEQ ID NO: 714712 - DNA, 14 bp, Homo sapiens
tgtgttattcgtga

SEQ ID NO: 714713 - DNA, 22 bp, Homo sapiens
tgtgttattcgtgaatagtctt

SEQ ID NO: 714714 - DNA, 13 bp, Homo sapiens
tgtgttatttaaa

SEQ ID NO: 714715 - DNA, 14 bp, Homo sapiens
tgtgttatttaaat

SEQ ID NO: 714716 - DNA, 20 bp, Homo sapiens
tgtgttcaatatttagaaaa

SEQ ID NO: 714717 - DNA, 20 bp, Homo sapiens
tgtgttcagctctttccaaa

SEQ ID NO: 714718 - DNA, 19 bp, Homo sapiens
tgtgttcattaatgtttat

SEQ ID NO: 714719 - DNA, 16 bp, Homo sapiens
tgtgttccaaccactg

SEQ ID NO: 714720 - DNA, 15 bp, Homo sapiens
tgtgttcccagaggc

SEQ ID NO: 714721 - DNA, 16 bp, Homo sapiens
tgtgttcccagaggca

SEQ ID NO: 714722 - DNA, 16 bp, Homo sapiens
tgtgttcccatttcag

SEQ ID NO: 714723 - DNA, 19 bp, Homo sapiens
tgtgttcccatttcagctg

SEQ ID NO: 714724 - DNA, 16 bp, Homo sapiens
tgtgttcctccatttt

SEQ ID NO: 714725 - DNA, 12 bp, Homo sapiens
tgtgttcctggc

SEQ ID NO: 714726 - DNA, 24 bp, Homo sapiens
tgtgttcctggcaatagtgtgttc

SEQ ID NO: 714727 - DNA, 22 bp, Homo sapiens
tgtgttcctggcccactctgta

SEQ ID NO: 714728 - DNA, 18 bp, Homo sapiens
tgtgttctgggctggggc

SEQ ID NO: 714729 - DNA, 22 bp, Homo sapiens
tgtgttctgggctggggccacc

SEQ ID NO: 714730 - DNA, 13 bp, Homo sapiens
tgtgttgaacaca

SEQ ID NO: 714731 - DNA, 15 bp, Homo sapiens
tgtgttgaaggaact

SEQ ID NO: 714732 - DNA, 15 bp, Homo sapiens
tgtgttgactttata

SEQ ID NO: 714733 - DNA, 13 bp, Homo sapiens
tgtgttgccaagc

SEQ ID NO: 714734 - DNA, 15 bp, Homo sapiens
gttgatacaaaccac

SEQ ID NO: 714735 - DNA, 19 bp, Homo sapiens
gttgatataaaactctggg

SEQ ID NO: 714736 - DNA, 20 bp, Homo sapiens
gttgatataaaactctgggt

SEQ ID NO: 714737 - DNA, 23 bp, Homo sapiens
gttgatctgcatatttctgtata

SEQ ID NO: 714738 - DNA, 15 bp, Homo sapiens
gttgatgaggcctct

SEQ ID NO: 714739 - DNA, 23 bp, Homo sapiens
gttgattcggtatccccccatct

SEQ ID NO: 714740 - DNA, 19 bp, Homo sapiens
gttgattttgaacttttta

SEQ ID NO: 714741 - DNA, 15 bp, Homo sapiens
gttgcaagatgtgaa

SEQ ID NO: 714742 - DNA, 18 bp, Homo sapiens
gttgcaagatgtgaatta

SEQ ID NO: 714743 - DNA, 16 bp, Homo sapiens
gttgcaaggccgctgt

SEQ ID NO: 714744 - DNA, 19 bp, Homo sapiens
gttgcaccatctgcttggt

SEQ ID NO: 714745 - DNA, 14 bp, Homo sapiens
gttgcactgatatt

SEQ ID NO: 714746 - DNA, 17 bp, Homo sapiens
gttgcactgccccctgc

SEQ ID NO: 714747 - DNA, 14 bp, Homo sapiens
gttgcactttagac

SEQ ID NO: 714748 - DNA, 22 bp, Homo sapiens
gttgcactttagacatttttgt

SEQ ID NO: 714749 - DNA, 15 bp, Homo sapiens
gttgcagtcactgtg

SEQ ID NO: 714750 - DNA, 15 bp, Homo sapiens
gttgcagtgagcagg

SEQ ID NO: 714751 - DNA, 18 bp, Homo sapiens
gttgcagtgagcagggtg

SEQ ID NO: 714752 - DNA, 20 bp, Homo sapiens
gttgcagtgagcagggtggg

SEQ ID NO: 714753 - DNA, 18 bp, Homo sapiens
gttgcatagcagtatatg

SEQ ID NO: 714754 - DNA, 20 bp, Homo sapiens
gttgcatgtagtaacactaa

SEQ ID NO: 714755 - DNA, 19 bp, Homo sapiens
gttgccaaagctggtctca

SEQ ID NO: 714756 - DNA, 19 bp, Homo sapiens
gttgccaaatatgtcctgg

SEQ ID NO: 714757 - DNA, 13 bp, Homo sapiens
gttgccaagacaa

SEQ ID NO: 714758 - DNA, 17 bp, Homo sapiens
gttgccaagacaaatca

SEQ ID NO: 714759 - DNA, 20 bp, Homo sapiens
gttgccaagacaaatcaaca

SEQ ID NO: 714760 - DNA, 21 bp, Homo sapiens
gttgccacaccaatcagagag

SEQ ID NO: 714761 - DNA, 21 bp, Homo sapiens
gttgccaccacctctgtggca

SEQ ID NO: 714762 - DNA, 12 bp, Homo sapiens
gttgccagcaga

SEQ ID NO: 714763 - DNA, 14 bp, Homo sapiens
gttgccagtcagca

SEQ ID NO: 714764 - DNA, 15 bp, Homo sapiens
gttgccagtcagcaa

SEQ ID NO: 714765 - DNA, 22 bp, Homo sapiens
gttgccatggagatctgaaggg

SEQ ID NO: 714766 - DNA, 20 bp, Homo sapiens
gttgcccgaaactaagccag

SEQ ID NO: 714767 - DNA, 19 bp, Homo sapiens
gttgccctagcccagactc

SEQ ID NO: 714768 - DNA, 22 bp, Homo sapiens
gttgccgcagcggtgggaagga

SEQ ID NO: 714769 - DNA, 20 bp, Homo sapiens
gttgcctcctcccatccagc

SEQ ID NO: 714770 - DNA, 23 bp, Homo sapiens
gttgcctctcttgccccttgtcc

SEQ ID NO: 714771 - DNA, 19 bp, Homo sapiens
gttgccttgaaccacttcc

SEQ ID NO: 714772 - DNA, 20 bp, Homo sapiens
gttgcggatggatggaaggt

SEQ ID NO: 714773 - DNA, 13 bp, Homo sapiens
gttgcgggacaga

SEQ ID NO: 714774 - DNA, 18 bp, Homo sapiens
gttgcgtctgaggcctgc

SEQ ID NO: 714775 - DNA, 20 bp, Homo sapiens
gttgctagggagagggaaga

SEQ ID NO: 714776 - DNA, 15 bp, Homo sapiens
gttgctattgtaagg

SEQ ID NO: 714777 - DNA, 20 bp, Homo sapiens
gttgctccggcctgcgtctc

SEQ ID NO: 714778 - DNA, 20 bp, Homo sapiens
gttgctctaggaagacattt

SEQ ID NO: 714779 - DNA, 16 bp, Homo sapiens
gttgctgaagatgcct

SEQ ID NO: 714780 - DNA, 19 bp, Homo sapiens
gttgctgaagatgccttga

SEQ ID NO: 714781 - DNA, 23 bp, Homo sapiens
gttgctgactactactctgccaa

SEQ ID NO: 714782 - DNA, 23 bp, Homo sapiens
gttgctgatgaactcttaatcaa

SEQ ID NO: 714783 - DNA, 21 bp, Homo sapiens
gttgctgatgggtagtacctg

SEQ ID NO: 714784 - DNA, 16 bp, Homo sapiens
gttgctgatgtttata

SEQ ID NO: 714785 - DNA, 13 bp, Homo sapiens
gttgctgcctttc

SEQ ID NO: 714786 - DNA, 13 bp, Homo sapiens
gttgctgctgtga

SEQ ID NO: 714787 - DNA, 17 bp, Homo sapiens
gttgctgtttttcttgt

SEQ ID NO: 714788 - DNA, 16 bp, Homo sapiens
gttgcttctgaatcac

SEQ ID NO: 714789 - DNA, 17 bp, Homo sapiens
gttgcttctgaatcact

SEQ ID NO: 714790 - DNA, 17 bp, Homo sapiens
gttgcttgaaattactg

SEQ ID NO: 714791 - DNA, 24 bp, Homo sapiens
gttgcttggtgcacagattgctga

SEQ ID NO: 714792 - DNA, 14 bp, Homo sapiens
gttgctttgccaga

SEQ ID NO: 714793 - DNA, 17 bp, Homo sapiens
gttgctttgccagagca

SEQ ID NO: 714794 - DNA, 18 bp, Homo sapiens
gttgcttttgcacctacg

SEQ ID NO: 714795 - DNA, 15 bp, Homo sapiens
gttggaaaaaatttg

SEQ ID NO: 714796 - DNA, 20 bp, Homo sapiens
gttggaaaagaatacagaaa

SEQ ID NO: 714797 - DNA, 23 bp, Homo sapiens
gttggaaatagaaatttccagag

SEQ ID NO: 714798 - DNA, 18 bp, Homo sapiens
gttggaaatattcatgct

SEQ ID NO: 714799 - DNA, 17 bp, Homo sapiens
gttggaaatgtgttttt

SEQ ID NO: 714800 - DNA, 22 bp, Homo sapiens
gttggaactttagggggtggga

SEQ ID NO: 714801 - DNA, 15 bp, Homo sapiens
gttggaagaggaaca

SEQ ID NO: 714802 - DNA, 22 bp, Homo sapiens
gttggaagctaccagagctcta

SEQ ID NO: 714803 - DNA, 20 bp, Homo sapiens
gttggaagcttgttttccag

SEQ ID NO: 714804 - DNA, 19 bp, Homo sapiens
gttggacagcaaaaccatt

SEQ ID NO: 714805 - DNA, 15 bp, Homo sapiens
gttggacagccccct

SEQ ID NO: 714806 - DNA, 20 bp, Homo sapiens
gttggacatttttttcgaat

SEQ ID NO: 714807 - DNA, 20 bp, Homo sapiens
gttggacccgctctggacca

SEQ ID NO: 714808 - DNA, 14 bp, Homo sapiens
gttggagagccctg

SEQ ID NO: 714809 - DNA, 15 bp, Homo sapiens
gttggagagccctgg

SEQ ID NO: 714810 - DNA, 20 bp, Homo sapiens
gttggagccactcctgtccc

SEQ ID NO: 714811 - DNA, 19 bp, Homo sapiens
gttggagcctgcagggtgg

SEQ ID NO: 714812 - DNA, 22 bp, Homo sapiens
gttggaggaccccgagggctga

SEQ ID NO: 714813 - DNA, 16 bp, Homo sapiens
gttggagggaaccacc

SEQ ID NO: 714814 - DNA, 13 bp, Homo sapiens
gttggatcttcaa

SEQ ID NO: 714815 - DNA, 22 bp, Homo sapiens
gttggatggatgggtggatggc

SEQ ID NO: 714816 - DNA, 18 bp, Homo sapiens
gttggatgggagtgggca

SEQ ID NO: 714817 - DNA, 20 bp, Homo sapiens
gttggatttaaaaatgccaa

SEQ ID NO: 714818 - DNA, 14 bp, Homo sapiens
gttggatttttgtc

SEQ ID NO: 714819 - DNA, 17 bp, Homo sapiens
gttgttctgtggtcaca

SEQ ID NO: 714820 - DNA, 14 bp, Homo sapiens
gttgttctgttaac

SEQ ID NO: 714821 - DNA, 15 bp, Homo sapiens
gttgttgactgtgat

SEQ ID NO: 714822 - DNA, 20 bp, Homo sapiens
gttgttgatattgtttgctg

SEQ ID NO: 714823 - DNA, 21 bp, Homo sapiens
gttgttgatattgtttgctgt

SEQ ID NO: 714824 - DNA, 22 bp, Homo sapiens
gttgttgtcattgtccagctgg

SEQ ID NO: 714825 - DNA, 21 bp, Homo sapiens
gttgttgtgtgtatatgtatt

SEQ ID NO: 714826 - DNA, 22 bp, Homo sapiens
gttgttgtgtgtatatgtattt

SEQ ID NO: 714827 - DNA, 13 bp, Homo sapiens
gttgttgttcttt

SEQ ID NO: 714828 - DNA, 20 bp, Homo sapiens
gttgtttaacacttctgtat

SEQ ID NO: 714829 - DNA, 16 bp, Homo sapiens
gttgtttataataaaa

SEQ ID NO: 714830 - DNA, 22 bp, Homo sapiens
gttgtttgatgcattaaaagaa

SEQ ID NO: 714831 - DNA, 13 bp, Homo sapiens
gttgtttgtaaat

SEQ ID NO: 714832 - DNA, 15 bp, Homo sapiens
gttgtttgtaaataa

SEQ ID NO: 714833 - DNA, 17 bp, Homo sapiens
gttgtttgtatgtataa

SEQ ID NO: 714834 - DNA, 13 bp, Homo sapiens
gttgtttgtgcct

SEQ ID NO: 714835 - DNA, 22 bp, Homo sapiens
gttgttttttcatagtgccttt

SEQ ID NO: 714836 - DNA, 20 bp, Homo sapiens
gttgttttttcctttgctct

SEQ ID NO: 714837 - DNA, 22 bp, Homo sapiens
gtttaaaaacattttttaagga

SEQ ID NO: 714838 - DNA, 19 bp, Homo sapiens
gtttaaaaaccgaataaat

SEQ ID NO: 714839 - DNA, 12 bp, Homo sapiens
gtttaaaaatgg

SEQ ID NO: 714840 - DNA, 22 bp, Homo sapiens
gtttaaaactcagaatataaca

SEQ ID NO: 714841 - DNA, 13 bp, Homo sapiens
gtttaaaagaaaa

SEQ ID NO: 714842 - DNA, 14 bp, Homo sapiens
gtttaaaagaaaaa

SEQ ID NO: 714843 - DNA, 15 bp, Homo sapiens
gtttaaaagccatgt

SEQ ID NO: 714844 - DNA, 19 bp, Homo sapiens
gtttaaaagttgtgcatgt

SEQ ID NO: 714845 - DNA, 21 bp, Homo sapiens
gtttaaaagttgtgcatgtat

SEQ ID NO: 714846 - DNA, 21 bp, Homo sapiens
gtttaaaataaaatgaaaatt

SEQ ID NO: 714847 - DNA, 11 bp, Homo sapiens
gtttaaaattc

SEQ ID NO: 714848 - DNA, 14 bp, Homo sapiens
gtttaaaattcagt

SEQ ID NO: 714849 - DNA, 16 bp, Homo sapiens
gtttaaagaaagtgta

SEQ ID NO: 714850 - DNA, 16 bp, Homo sapiens
gtttaaagagaggtta

SEQ ID NO: 714851 - DNA, 12 bp, Homo sapiens
gtttaaagcatt

SEQ ID NO: 714852 - DNA, 19 bp, Homo sapiens
gtttaaagcttttattcgt

SEQ ID NO: 714853 - DNA, 20 bp, Homo sapiens
gtttaaagtgcagtcatttg

SEQ ID NO: 714854 - DNA, 15 bp, Homo sapiens
gtttaaataaagtat

SEQ ID NO: 714855 - DNA, 14 bp, Homo sapiens
gtttaaattgtaaa

SEQ ID NO: 714856 - DNA, 23 bp, Homo sapiens
gtttaacacttctgtatgcatca

SEQ ID NO: 714857 - DNA, 19 bp, Homo sapiens
gtttaacattcacagccca

SEQ ID NO: 714858 - DNA, 22 bp, Homo sapiens
gtttaacgtttctcattaaaat

SEQ ID NO: 714859 - DNA, 14 bp, Homo sapiens
gtttaactggcatg

SEQ ID NO: 714860 - DNA, 22 bp, Homo sapiens
gtttaagccagagtgtattaca

SEQ ID NO: 714861 - DNA, 17 bp, Homo sapiens
gtttaagggtggaaaaa

SEQ ID NO: 714862 - DNA, 16 bp, Homo sapiens
gtttaatacaggaaat

SEQ ID NO: 714863 - DNA, 17 bp, Homo sapiens
tgttagagagaaagaga

SEQ ID NO: 714864 - DNA, 23 bp, Homo sapiens
tgttagagaggtagcgagctgct

SEQ ID NO: 714865 - DNA, 21 bp, Homo sapiens
tgttagaggttttaaagtgat

SEQ ID NO: 714866 - DNA, 15 bp, Homo sapiens
tgttagcaaagatta

SEQ ID NO: 714867 - DNA, 22 bp, Homo sapiens
tgttagcactgatagtcctttt

SEQ ID NO: 714868 - DNA, 15 bp, Homo sapiens
tgttagcactgttga

SEQ ID NO: 714869 - DNA, 22 bp, Homo sapiens
tgttagcactgttgatgtatct

SEQ ID NO: 714870 - DNA, 14 bp, Homo sapiens
tgttagcagacagg

SEQ ID NO: 714871 - DNA, 14 bp, Homo sapiens
tgttagcagagtct

SEQ ID NO: 714872 - DNA, 21 bp, Homo sapiens
tgttagcccaaggttaaaaag

SEQ ID NO: 714873 - DNA, 20 bp, Homo sapiens
tgttagcccttcagattgtt

SEQ ID NO: 714874 - DNA, 14 bp, Homo sapiens
tgttagccttagac

SEQ ID NO: 714875 - DNA, 18 bp, Homo sapiens
tgttaggcatgtcccacc

SEQ ID NO: 714876 - DNA, 20 bp, Homo sapiens
tgttaggcatgtcccaccca

SEQ ID NO: 714877 - DNA, 22 bp, Homo sapiens
tgttagggagatgagttgcagt

SEQ ID NO: 714878 - DNA, 13 bp, Homo sapiens
tgttagggctgct

SEQ ID NO: 714879 - DNA, 13 bp, Homo sapiens
tgttagggtcagc

SEQ ID NO: 714880 - DNA, 19 bp, Homo sapiens
tgttagggttatgttttta

SEQ ID NO: 714881 - DNA, 15 bp, Homo sapiens
tgttaggtccatttt

SEQ ID NO: 714882 - DNA, 21 bp, Homo sapiens
tgttaggttggggataggttt

SEQ ID NO: 714883 - DNA, 13 bp, Homo sapiens
tgttagtaaagga

SEQ ID NO: 714884 - DNA, 14 bp, Homo sapiens
tgttagtagaaatt

SEQ ID NO: 714885 - DNA, 15 bp, Homo sapiens
tgttagtcatttgct

SEQ ID NO: 714886 - DNA, 15 bp, Homo sapiens
tgttagtctccccac

SEQ ID NO: 714887 - DNA, 21 bp, Homo sapiens
tgttagtgctggtcagagaga

SEQ ID NO: 714888 - DNA, 13 bp, Homo sapiens
tgttagtggaaaa

SEQ ID NO: 714889 - DNA, 12 bp, Homo sapiens
tgttagtgtctg

SEQ ID NO: 714890 - DNA, 17 bp, Homo sapiens
tgttagtgtgtgtgcat

SEQ ID NO: 714891 - DNA, 21 bp, Homo sapiens
tgttagtgtgtgtgcatgtgt

SEQ ID NO: 714892 - DNA, 20 bp, Homo sapiens
tgttagttaccttatagtta

SEQ ID NO: 714893 - DNA, 16 bp, Homo sapiens
tgttagtttagtgtgt

SEQ ID NO: 714894 - DNA, 13 bp, Homo sapiens
tgttataaataaa

SEQ ID NO: 714895 - DNA, 23 bp, Homo sapiens
tgttataactctgcactactcct

SEQ ID NO: 714896 - DNA, 14 bp, Homo sapiens
tgttatacttcaaa

SEQ ID NO: 714897 - DNA, 20 bp, Homo sapiens
tgttatagaacttcatggat

SEQ ID NO: 714898 - DNA, 16 bp, Homo sapiens
tgttatagattgtctt

SEQ ID NO: 714899 - DNA, 18 bp, Homo sapiens
tgttatagattgtcttaa

SEQ ID NO: 714900 - DNA, 12 bp, Homo sapiens
tgttatataatt

SEQ ID NO: 714901 - DNA, 17 bp, Homo sapiens
tgttatatcatatgtat

SEQ ID NO: 714902 - DNA, 17 bp, Homo sapiens
tgttatattccaaggaa

SEQ ID NO: 714903 - DNA, 18 bp, Homo sapiens
tgttatattccaaggaaa

SEQ ID NO: 714904 - DNA, 13 bp, Homo sapiens
tgttatcaaactt

SEQ ID NO: 714905 - DNA, 20 bp, Homo sapiens
tgttatcccaagaccctgcc

SEQ ID NO: 714906 - DNA, 19 bp, Homo sapiens
tgttatcctcttgtatact

SEQ ID NO: 714907 - DNA, 22 bp, Homo sapiens
tgttatcctgctagctgtagaa

SEQ ID NO: 714908 - DNA, 19 bp, Homo sapiens
tgttatcttatactgtaca

SEQ ID NO: 714909 - DNA, 13 bp, Homo sapiens
tgttatgaacagc

SEQ ID NO: 714910 - DNA, 14 bp, Homo sapiens
tgttatgaacagct

SEQ ID NO: 714911 - DNA, 15 bp, Homo sapiens
tgttatgaacagctg

SEQ ID NO: 714912 - DNA, 17 bp, Homo sapiens
tgttatgaacagctgtg

SEQ ID NO: 714913 - DNA, 13 bp, Homo sapiens
tgttatgaacatc

SEQ ID NO: 714914 - DNA, 14 bp, Homo sapiens
tgttatgacagtga

SEQ ID NO: 714915 - DNA, 18 bp, Homo sapiens
tgttatgactatgtaaac

SEQ ID NO: 714916 - DNA, 15 bp, Homo sapiens
tgttatgatattgtt

SEQ ID NO: 714917 - DNA, 21 bp, Homo sapiens
tgttatgatttccttcaatgt

SEQ ID NO: 714918 - DNA, 19 bp, Homo sapiens
tgttatgcactgtggtttc

SEQ ID NO: 714919 - DNA, 18 bp, Homo sapiens
tgttatggcttaatgaca

SEQ ID NO: 714920 - DNA, 13 bp, Homo sapiens
tgttatgtatttc

SEQ ID NO: 714921 - DNA, 20 bp, Homo sapiens
tgttattaaacgtatgcatg

SEQ ID NO: 714922 - DNA, 17 bp, Homo sapiens
tgttattaatgtttctt

SEQ ID NO: 714923 - DNA, 12 bp, Homo sapiens
tgttattatgaa

SEQ ID NO: 714924 - DNA, 13 bp, Homo sapiens
tgttattatgaag

SEQ ID NO: 714925 - DNA, 19 bp, Homo sapiens
tgttattatgaaggaattt

SEQ ID NO: 714926 - DNA, 22 bp, Homo sapiens
tgttattattaccagcatttgt

SEQ ID NO: 714927 - DNA, 13 bp, Homo sapiens
tgttattcctagt

SEQ ID NO: 714928 - DNA, 14 bp, Homo sapiens
tgttattgaagtgt

SEQ ID NO: 714929 - DNA, 12 bp, Homo sapiens
tgttattgtgaa

SEQ ID NO: 714930 - DNA, 15 bp, Homo sapiens
tgttattgtggaaga

SEQ ID NO: 714931 - DNA, 14 bp, Homo sapiens
tgttatttaaagaa

SEQ ID NO: 714932 - DNA, 16 bp, Homo sapiens
tgttatttacactggt

SEQ ID NO: 714933 - DNA, 18 bp, Homo sapiens
tgttatttcctaatcaaa

SEQ ID NO: 714934 - DNA, 21 bp, Homo sapiens
tgttatttttgtttcttccaa

SEQ ID NO: 714935 - DNA, 19 bp, Homo sapiens
tgttcaaaaaaacactagt

SEQ ID NO: 714936 - DNA, 22 bp, Homo sapiens
tgttcaaaacaaaatgaaacaa

SEQ ID NO: 714937 - DNA, 15 bp, Homo sapiens
tgttcaaagctgcct

SEQ ID NO: 714938 - DNA, 15 bp, Homo sapiens
tgttcaaatgcattt

SEQ ID NO: 714939 - DNA, 22 bp, Homo sapiens
tgttcaacaatcagtcatcatg

SEQ ID NO: 714940 - DNA, 16 bp, Homo sapiens
tgttcaatgcaaagta

SEQ ID NO: 714941 - DNA, 18 bp, Homo sapiens
aaaccaccctctggggac

SEQ ID NO: 714942 - DNA, 20 bp, Homo sapiens
aaaccacctcagaaaggatt

SEQ ID NO: 714943 - DNA, 16 bp, Homo sapiens
aaaccactagaactct

SEQ ID NO: 714944 - DNA, 12 bp, Homo sapiens
aaaccactgaaa

SEQ ID NO: 714945 - DNA, 15 bp, Homo sapiens
aaaccactgtgaaca

SEQ ID NO: 714946 - DNA, 17 bp, Homo sapiens
aaaccacttctctgctg

SEQ ID NO: 714947 - DNA, 21 bp, Homo sapiens
aaaccacttctctgctgcctc

SEQ ID NO: 714948 - DNA, 23 bp, Homo sapiens
aaaccacttctctgctgcctctg

SEQ ID NO: 714949 - DNA, 12 bp, Homo sapiens
aaaccacttgcc

SEQ ID NO: 714950 - DNA, 16 bp, Homo sapiens
aaaccagaaaagcaat

SEQ ID NO: 714951 - DNA, 22 bp, Homo sapiens
aaaccagagaatcttaaggtct

SEQ ID NO: 714952 - DNA, 19 bp, Homo sapiens
aaaccagatctgtctccaa

SEQ ID NO: 714953 - DNA, 16 bp, Homo sapiens
aaaccaggaccctgtc

SEQ ID NO: 714954 - DNA, 20 bp, Homo sapiens
aaaccaggtcaccatcctca

SEQ ID NO: 714955 - DNA, 13 bp, Homo sapiens
aaaccatgactgt

SEQ ID NO: 714956 - DNA, 16 bp, Homo sapiens
aaaccatgagaatttg

SEQ ID NO: 714957 - DNA, 15 bp, Homo sapiens
aaaccatgcctggta

SEQ ID NO: 714958 - DNA, 13 bp, Homo sapiens
aaaccatgtagaa

SEQ ID NO: 714959 - DNA, 21 bp, Homo sapiens
aaaccatgttgcgttcaaaga

SEQ ID NO: 714960 - DNA, 17 bp, Homo sapiens
aaaccattactgagggg

SEQ ID NO: 714961 - DNA, 16 bp, Homo sapiens
aaaccattgatgttta

SEQ ID NO: 714962 - DNA, 12 bp, Homo sapiens
aaaccattgctt

SEQ ID NO: 714963 - DNA, 15 bp, Homo sapiens
aaaccattgcttcac

SEQ ID NO: 714964 - DNA, 23 bp, Homo sapiens
aaaccatttttgttactctcttc

SEQ ID NO: 714965 - DNA, 13 bp, Homo sapiens
aaacccaactaag

SEQ ID NO: 714966 - DNA, 16 bp, Homo sapiens
aaacccaactaagcca

SEQ ID NO: 714967 - DNA, 23 bp, Homo sapiens
aaacccaagtttatttctctctt

SEQ ID NO: 714968 - DNA, 19 bp, Homo sapiens
aaacccaatacttttgtcc

SEQ ID NO: 714969 - DNA, 22 bp, Homo sapiens
aaacccaatacttttgtccaat

SEQ ID NO: 714970 - DNA, 15 bp, Homo sapiens
aaacccaatccaaat

SEQ ID NO: 714971 - DNA, 12 bp, Homo sapiens
aaacccagagag

SEQ ID NO: 714972 - DNA, 10 bp, Homo sapiens
aaacccagcc

SEQ ID NO: 714973 - DNA, 23 bp, Homo sapiens
aaacccatacaatgtatgtacaa

SEQ ID NO: 714974 - DNA, 13 bp, Homo sapiens
aaacccatgtgtt

SEQ ID NO: 714975 - DNA, 19 bp, Homo sapiens
aaacccatgtgttaaaata

SEQ ID NO: 714976 - DNA, 11 bp, Homo sapiens
aaaccccagcc

SEQ ID NO: 714977 - DNA, 12 bp, Homo sapiens
aaaccccagccc

SEQ ID NO: 714978 - DNA, 17 bp, Homo sapiens
aaaccccatctctacaa

SEQ ID NO: 714979 - DNA, 13 bp, Homo sapiens
aaacccctgtccc

SEQ ID NO: 714980 - DNA, 15 bp, Homo sapiens
aaaccctagccttgc

SEQ ID NO: 714981 - DNA, 21 bp, Homo sapiens
aaaccctcccagaaacatctc

SEQ ID NO: 714982 - DNA, 16 bp, Homo sapiens
aaaccctggagccatc

SEQ ID NO: 714983 - DNA, 17 bp, Homo sapiens
aaaccctggcttgcttg

SEQ ID NO: 714984 - DNA, 16 bp, Homo sapiens
aaacccttaactgaca

SEQ ID NO: 714985 - DNA, 15 bp, Homo sapiens
aaacccttcaactcc

SEQ ID NO: 714986 - DNA, 17 bp, Homo sapiens
aaaccctttagtgcttt

SEQ ID NO: 714987 - DNA, 19 bp, Homo sapiens
aaaccctttgtattataat

SEQ ID NO: 714988 - DNA, 17 bp, Homo sapiens
aaaccgagataggggag

SEQ ID NO: 714989 - DNA, 16 bp, Homo sapiens
aaaccgccaaggctgg

SEQ ID NO: 714990 - DNA, 14 bp, Homo sapiens
aaaccgctaaaaga

SEQ ID NO: 714991 - DNA, 19 bp, Homo sapiens
aaacctaaaaaagatatat

SEQ ID NO: 714992 - DNA, 19 bp, Homo sapiens
aaacctaagtcctttatgt

SEQ ID NO: 714993 - DNA, 15 bp, Homo sapiens
aaacctagcttttaa

SEQ ID NO: 714994 - DNA, 23 bp, Homo sapiens
aaacctagcttttaaaaaatatt

SEQ ID NO: 714995 - DNA, 17 bp, Homo sapiens
aaacctatcctcactgc

SEQ ID NO: 714996 - DNA, 12 bp, Homo sapiens
aaacctcaccct

SEQ ID NO: 714997 - DNA, 16 bp, Homo sapiens
aaacctcactgggcct

SEQ ID NO: 714998 - DNA, 11 bp, Homo sapiens
aaacctctcct

SEQ ID NO: 714999 - DNA, 21 bp, Homo sapiens
aaacctcttttgttgtccttg

SEQ ID NO: 715000 - DNA, 12 bp, Homo sapiens
aaacctgaagac

SEQ ID NO: 715001 - DNA, 15 bp, Homo sapiens
aaacctgaagactga

SEQ ID NO: 715002 - DNA, 15 bp, Homo sapiens
aaacctgcctttgta

SEQ ID NO: 715003 - DNA, 21 bp, Homo sapiens
aaacctgggattcaggaatgt

SEQ ID NO: 715004 - DNA, 18 bp, Homo sapiens
aaacctggggtgaatact

SEQ ID NO: 715005 - DNA, 21 bp, Homo sapiens
aaacctgggtatgttcctaag

SEQ ID NO: 715006 - DNA, 14 bp, Homo sapiens
aaacctgtgccagg

SEQ ID NO: 715007 - DNA, 14 bp, Homo sapiens
ataaattttgtttc

SEQ ID NO: 715008 - DNA, 16 bp, Homo sapiens
ataaattttgtttcag

SEQ ID NO: 715009 - DNA, 15 bp, Homo sapiens
ataaattttttataa

SEQ ID NO: 715010 - DNA, 14 bp, Homo sapiens
ataacaaagcacat

SEQ ID NO: 715011 - DNA, 15 bp, Homo sapiens
ataacaacaacagtt

SEQ ID NO: 715012 - DNA, 18 bp, Homo sapiens
ataacaagagttttaaca

SEQ ID NO: 715013 - DNA, 21 bp, Homo sapiens
ataacaaggagctcaccctgc

SEQ ID NO: 715014 - DNA, 14 bp, Homo sapiens
ataacactaaatgc

SEQ ID NO: 715015 - DNA, 23 bp, Homo sapiens
ataacactctaggatgtatattt

SEQ ID NO: 715016 - DNA, 20 bp, Homo sapiens
ataacactgttggcacttat

SEQ ID NO: 715017 - DNA, 22 bp, Homo sapiens
ataacacttaaaattgtaacct

SEQ ID NO: 715018 - DNA, 21 bp, Homo sapiens
ataacagaagaaaatagaatt

SEQ ID NO: 715019 - DNA, 16 bp, Homo sapiens
ataacagatacatttc

SEQ ID NO: 715020 - DNA, 22 bp, Homo sapiens
ataacagatggtgctgctaatt

SEQ ID NO: 715021 - DNA, 13 bp, Homo sapiens
ataacagctcctt

SEQ ID NO: 715022 - DNA, 15 bp, Homo sapiens
ataacagctccttta

SEQ ID NO: 715023 - DNA, 13 bp, Homo sapiens
ataacagctgcaa

SEQ ID NO: 715024 - DNA, 14 bp, Homo sapiens
ataacagttatatt

SEQ ID NO: 715025 - DNA, 19 bp, Homo sapiens
ataacagttatatttttgt

SEQ ID NO: 715026 - DNA, 22 bp, Homo sapiens
ataacagttttgagtaattcaa

SEQ ID NO: 715027 - DNA, 19 bp, Homo sapiens
ataacatacaatgaccaca

SEQ ID NO: 715028 - DNA, 18 bp, Homo sapiens
ataacatctttattgaaa

SEQ ID NO: 715029 - DNA, 19 bp, Homo sapiens
ataacatgtgaaaagaata

SEQ ID NO: 715030 - DNA, 24 bp, Homo sapiens
ataacattgcactttataaacact

SEQ ID NO: 715031 - DNA, 14 bp, Homo sapiens
ataacatttaaaga

SEQ ID NO: 715032 - DNA, 15 bp, Homo sapiens
ataacatttaaagag

SEQ ID NO: 715033 - DNA, 20 bp, Homo sapiens
ataacatttaaagagatttc

SEQ ID NO: 715034 - DNA, 13 bp, Homo sapiens
ataacattttcta

SEQ ID NO: 715035 - DNA, 15 bp, Homo sapiens
ataacattttctata

SEQ ID NO: 715036 - DNA, 14 bp, Homo sapiens
ataaccaagtgtgc

SEQ ID NO: 715037 - DNA, 23 bp, Homo sapiens
ataaccacaaagcacagtttgaa

SEQ ID NO: 715038 - DNA, 13 bp, Homo sapiens
ataaccacttaaa

SEQ ID NO: 715039 - DNA, 22 bp, Homo sapiens
ataaccacttaaaaaatgtcca

SEQ ID NO: 715040 - DNA, 16 bp, Homo sapiens
ataaccattacatgtt

SEQ ID NO: 715041 - DNA, 23 bp, Homo sapiens
ataaccatttaaagaaagaatgc

SEQ ID NO: 715042 - DNA, 14 bp, Homo sapiens
ataacccagttact

SEQ ID NO: 715043 - DNA, 14 bp, Homo sapiens
ataaccccagcctg

SEQ ID NO: 715044 - DNA, 15 bp, Homo sapiens
ataaccccagcctga

SEQ ID NO: 715045 - DNA, 16 bp, Homo sapiens
ataaccccagcctgac

SEQ ID NO: 715046 - DNA, 20 bp, Homo sapiens
ataaccccagctccctagga

SEQ ID NO: 715047 - DNA, 13 bp, Homo sapiens
ataaccctgccag

SEQ ID NO: 715048 - DNA, 13 bp, Homo sapiens
ataacctatatga

SEQ ID NO: 715049 - DNA, 11 bp, Homo sapiens
ataacctctgg

SEQ ID NO: 715050 - DNA, 14 bp, Homo sapiens
ataacctctggccc

SEQ ID NO: 715051 - DNA, 16 bp, Homo sapiens
ataacctctggccctt

SEQ ID NO: 715052 - DNA, 17 bp, Homo sapiens
ataacctctggcccttg

SEQ ID NO: 715053 - DNA, 19 bp, Homo sapiens
ataacctctggcccttgga

SEQ ID NO: 715054 - DNA, 22 bp, Homo sapiens
ataacctgtctcacctggactt

SEQ ID NO: 715055 - DNA, 20 bp, Homo sapiens
ataaccttcatttttaagac

SEQ ID NO: 715056 - DNA, 23 bp, Homo sapiens
ataaccttcatttttaagactgt

SEQ ID NO: 715057 - DNA, 17 bp, Homo sapiens
ataacctttacactcct

SEQ ID NO: 715058 - DNA, 17 bp, Homo sapiens
ataacgtttaagccaaa

SEQ ID NO: 715059 - DNA, 22 bp, Homo sapiens
ataacgtttaagccaaaacaat

SEQ ID NO: 715060 - DNA, 16 bp, Homo sapiens
ataactaaaaggtatg

SEQ ID NO: 715061 - DNA, 15 bp, Homo sapiens
ataactaaaatgtat

SEQ ID NO: 715062 - DNA, 19 bp, Homo sapiens
ataactactccggagacag

SEQ ID NO: 715063 - DNA, 13 bp, Homo sapiens
ataactactgtgt

SEQ ID NO: 715064 - DNA, 15 bp, Homo sapiens
ataactactgtgttc

SEQ ID NO: 715065 - DNA, 19 bp, Homo sapiens
ataactagacatctgctgt

SEQ ID NO: 715066 - DNA, 13 bp, Homo sapiens
ataactagccaga

SEQ ID NO: 715067 - DNA, 23 bp, Homo sapiens
ataactagccagacaaaatttga

SEQ ID NO: 715068 - DNA, 18 bp, Homo sapiens
ataactatctcacttcca

SEQ ID NO: 715069 - DNA, 20 bp, Homo sapiens
ataactatctcacttccaga

SEQ ID NO: 715070 - DNA, 24 bp, Homo sapiens
ataactattttgttttaatctact

SEQ ID NO: 715071 - DNA, 14 bp, Homo sapiens
ataactcagaatat

SEQ ID NO: 715072 - DNA, 20 bp, Homo sapiens
ataactcagaatattgtctg

SEQ ID NO: 715073 - DNA, 14 bp, Homo sapiens
ataactccaagcag

SEQ ID NO: 715074 - DNA, 20 bp, Homo sapiens
ataactccttcttgtagtag

SEQ ID NO: 715075 - DNA, 16 bp, Homo sapiens
ataactctctttcctt

SEQ ID NO: 715076 - DNA, 20 bp, Homo sapiens
ataactctctttccttgagc

SEQ ID NO: 715077 - DNA, 21 bp, Homo sapiens
ataactctgcactactcctct

SEQ ID NO: 715078 - DNA, 21 bp, Homo sapiens
ataactctgtaaaaacactga

SEQ ID NO: 715079 - DNA, 13 bp, Homo sapiens
ataactgaaaatg

SEQ ID NO: 715080 - DNA, 15 bp, Homo sapiens
ataactgaaaatgtg

SEQ ID NO: 715081 - DNA, 20 bp, Homo sapiens
ataactgaaaattatttaaa

SEQ ID NO: 715082 - DNA, 13 bp, Homo sapiens
ataactgaactgt

SEQ ID NO: 715083 - DNA, 14 bp, Homo sapiens
ataactgaactgtt

SEQ ID NO: 715084 - DNA, 15 bp, Homo sapiens
ataactgaactgttt

SEQ ID NO: 715085 - DNA, 14 bp, Homo sapiens
ataactgaaggaga

SEQ ID NO: 715086 - DNA, 16 bp, Homo sapiens
ataactgagcttagag

SEQ ID NO: 715087 - DNA, 21 bp, Homo sapiens
ataactggaaaacagaacact

SEQ ID NO: 715088 - DNA, 22 bp, Homo sapiens
ataactggaaaacagaacactt

SEQ ID NO: 715089 - DNA, 23 bp, Homo sapiens
ataactggaaaacagaacactta

SEQ ID NO: 715090 - DNA, 20 bp, Homo sapiens
ataactgtaaatgtgacatt

SEQ ID NO: 715091 - DNA, 12 bp, Homo sapiens
ataactgtcttg

SEQ ID NO: 715092 - DNA, 14 bp, Homo sapiens
ataactgtcttgtt

SEQ ID NO: 715093 - DNA, 15 bp, Homo sapiens
ataactgtcttgttt

SEQ ID NO: 715094 - DNA, 17 bp, Homo sapiens
ataactgtcttgtttca

SEQ ID NO: 715095 - DNA, 22 bp, Homo sapiens
ataactgtcttgtttcagtgag

SEQ ID NO: 715096 - DNA, 14 bp, Homo sapiens
ataactgttttaga

SEQ ID NO: 715097 - DNA, 16 bp, Homo sapiens
ataacttaaaaaaatg

SEQ ID NO: 715098 - DNA, 16 bp, Homo sapiens
ataacttactgtatat

SEQ ID NO: 715099 - DNA, 19 bp, Homo sapiens
ataacttactgtatatgta

SEQ ID NO: 715100 - DNA, 22 bp, Homo sapiens
ataacttactgtatatgtattc

SEQ ID NO: 715101 - DNA, 15 bp, Homo sapiens
ataacttatattgta

SEQ ID NO: 715102 - DNA, 22 bp, Homo sapiens
ataacttatattgtaagaaata

SEQ ID NO: 715103 - DNA, 16 bp, Homo sapiens
ataacttcaagcaaac

SEQ ID NO: 715104 - DNA, 12 bp, Homo sapiens
ataacttcagtc

SEQ ID NO: 715105 - DNA, 14 bp, Homo sapiens
ataacttcagtcct

SEQ ID NO: 715106 - DNA, 12 bp, Homo sapiens
ataacttcctgt

SEQ ID NO: 715107 - DNA, 13 bp, Homo sapiens
ataacttctatat

SEQ ID NO: 715108 - DNA, 20 bp, Homo sapiens
ataacttctatgttggtttc

SEQ ID NO: 715109 - DNA, 15 bp, Homo sapiens
ataacttcttgaaaa

SEQ ID NO: 715110 - DNA, 19 bp, Homo sapiens
ataacttgagacctaatct

SEQ ID NO: 715111 - DNA, 14 bp, Homo sapiens
ataacttgctttct

SEQ ID NO: 715112 - DNA, 18 bp, Homo sapiens
ataacttgctttcttctt

SEQ ID NO: 715113 - DNA, 16 bp, Homo sapiens
ataactttagaaataa

SEQ ID NO: 715114 - DNA, 12 bp, Homo sapiens
ataactttattg

SEQ ID NO: 715115 - DNA, 16 bp, Homo sapiens
ataactttattgcata

SEQ ID NO: 715116 - DNA, 22 bp, Homo sapiens
ataactttattgcatatagatt

SEQ ID NO: 715117 - DNA, 17 bp, Homo sapiens
ataactttgactttctt

SEQ ID NO: 715118 - DNA, 20 bp, Homo sapiens
ataacttttcaccaatgagc

SEQ ID NO: 715119 - DNA, 19 bp, Homo sapiens
ataagaaaaaattctttca

SEQ ID NO: 715120 - DNA, 14 bp, Homo sapiens
ataagaaaaacttt

SEQ ID NO: 715121 - DNA, 11 bp, Homo sapiens
ataagaaaaga

SEQ ID NO: 715122 - DNA, 14 bp, Homo sapiens
ataagaaacttttt

SEQ ID NO: 715123 - DNA, 18 bp, Homo sapiens
ataagaaagcctaaaatt

SEQ ID NO: 715124 - DNA, 20 bp, Homo sapiens
ataagaaagcctaaaattga

SEQ ID NO: 715125 - DNA, 22 bp, Homo sapiens
ataagaaagtgcgagtcctcca

SEQ ID NO: 715126 - DNA, 15 bp, Homo sapiens
ataagaaatgaacaa

SEQ ID NO: 715127 - DNA, 18 bp, Homo sapiens
ataagaaatgaacaaaag

SEQ ID NO: 715128 - DNA, 14 bp, Homo sapiens
ataagaacagatca

SEQ ID NO: 715129 - DNA, 15 bp, Homo sapiens
ataagaagaatgctt

SEQ ID NO: 715130 - DNA, 23 bp, Homo sapiens
ataagaagcaatctttgaaataa

SEQ ID NO: 715131 - DNA, 13 bp, Homo sapiens
ataagaaggcaat

SEQ ID NO: 715132 - DNA, 15 bp, Homo sapiens
ataagaaggcaattt

SEQ ID NO: 715133 - DNA, 18 bp, Homo sapiens
ataagaaggcaattttag

SEQ ID NO: 715134 - DNA, 24 bp, Homo sapiens
ataagaagggggagtgaaacagag

SEQ ID NO: 715135 - DNA, 16 bp, Homo sapiens
ataagaatgctggttt

SEQ ID NO: 715136 - DNA, 22 bp, Homo sapiens
ataagaatgctggttttcctaa

SEQ ID NO: 715137 - DNA, 17 bp, Homo sapiens
ataagaatggtttgtaa

SEQ ID NO: 715138 - DNA, 12 bp, Homo sapiens
ataagaatttgc

SEQ ID NO: 715139 - DNA, 20 bp, Homo sapiens
ataagacatgcttacttttt

SEQ ID NO: 715140 - DNA, 14 bp, Homo sapiens
ataagacatttgtt

SEQ ID NO: 715141 - DNA, 18 bp, Homo sapiens
ataagacatttgtttgct

SEQ ID NO: 715142 - DNA, 23 bp, Homo sapiens
ataagactgtttttaagtaactt

SEQ ID NO: 715143 - DNA, 14 bp, Homo sapiens
ataagagaaagaaa

SEQ ID NO: 715144 - DNA, 18 bp, Homo sapiens
ataagagaagtctcattc

SEQ ID NO: 715145 - DNA, 12 bp, Homo sapiens
ataagagatttg

SEQ ID NO: 715146 - DNA, 17 bp, Homo sapiens
ataagagcatgatttga

SEQ ID NO: 715147 - DNA, 19 bp, Homo sapiens
ataagagcatgatttgaaa

SEQ ID NO: 715148 - DNA, 21 bp, Homo sapiens
ataagagcatgatttgaaaaa

SEQ ID NO: 715149 - DNA, 22 bp, Homo sapiens
ataagagggctttttaaatttg

SEQ ID NO: 715150 - DNA, 17 bp, Homo sapiens
ataagataaatgtgctg

SEQ ID NO: 715151 - DNA, 14 bp, Homo sapiens
ataagatggctgtg

SEQ ID NO: 715152 - DNA, 16 bp, Homo sapiens
ataagattaaaggaag

SEQ ID NO: 715153 - DNA, 19 bp, Homo sapiens
ataagattaaaggaaggaa

SEQ ID NO: 715154 - DNA, 15 bp, Homo sapiens
ataagattagttgga

SEQ ID NO: 715155 - DNA, 12 bp, Homo sapiens
ataagattccaa

SEQ ID NO: 715156 - DNA, 19 bp, Homo sapiens
ataagattccaaaaagcac

SEQ ID NO: 715157 - DNA, 15 bp, Homo sapiens
ataagatttttgaaa

SEQ ID NO: 715158 - DNA, 23 bp, Homo sapiens
ataagcaaagggagcactgggtt

SEQ ID NO: 715159 - DNA, 21 bp, Homo sapiens
ataagcaagaaggcaaaaata

SEQ ID NO: 715160 - DNA, 12 bp, Homo sapiens
ataagcaagaga

SEQ ID NO: 715161 - DNA, 14 bp, Homo sapiens
ataagcaagagaga

SEQ ID NO: 715162 - DNA, 17 bp, Homo sapiens
ataagcaatcaaggtta

SEQ ID NO: 715163 - DNA, 15 bp, Homo sapiens
ataagcacttgcctg

SEQ ID NO: 715164 - DNA, 16 bp, Homo sapiens
ataagcacttgcctgg

SEQ ID NO: 715165 - DNA, 19 bp, Homo sapiens
ataagcacttgcctggaat

SEQ ID NO: 715166 - DNA, 16 bp, Homo sapiens
ataagcagatttaaca

SEQ ID NO: 715167 - DNA, 22 bp, Homo sapiens
ataagcaggtggatctatttca

SEQ ID NO: 715168 - DNA, 19 bp, Homo sapiens
ataagccaaaactgagcat

SEQ ID NO: 715169 - DNA, 18 bp, Homo sapiens
ataagcggcgtaagttta

SEQ ID NO: 715170 - DNA, 16 bp, Homo sapiens
ataagctaaagaggct

SEQ ID NO: 715171 - DNA, 21 bp, Homo sapiens
ataagctaacaccagacagac

SEQ ID NO: 715172 - DNA, 17 bp, Homo sapiens
ataagctactagcaaaa

SEQ ID NO: 715173 - DNA, 15 bp, Homo sapiens
ataagctcagaatcc

SEQ ID NO: 715174 - DNA, 16 bp, Homo sapiens
ataagctcagaatcca

SEQ ID NO: 715175 - DNA, 13 bp, Homo sapiens
ataagctttctca

SEQ ID NO: 715176 - DNA, 11 bp, Homo sapiens
ataaggaaact

SEQ ID NO: 715177 - DNA, 14 bp, Homo sapiens
ataaggaagttatt

SEQ ID NO: 715178 - DNA, 18 bp, Homo sapiens
ataaggaatttcctccca

SEQ ID NO: 715179 - DNA, 15 bp, Homo sapiens
ataaggataataatc

SEQ ID NO: 715180 - DNA, 13 bp, Homo sapiens
ataaggatgactt

SEQ ID NO: 715181 - DNA, 20 bp, Homo sapiens
ataaggcatgcgaaatgttc

SEQ ID NO: 715182 - DNA, 16 bp, Homo sapiens
ataaggcctactatac

SEQ ID NO: 715183 - DNA, 13 bp, Homo sapiens
ataaggggccttg

SEQ ID NO: 715184 - DNA, 19 bp, Homo sapiens
ataagtaagaaaatatttt

SEQ ID NO: 715185 - DNA, 19 bp, Homo sapiens
ataagtactgtgtacagaa

SEQ ID NO: 715186 - DNA, 22 bp, Homo sapiens
ataagtagtaaatcagaaagta

SEQ ID NO: 715187 - DNA, 19 bp, Homo sapiens
ataagtagttggtttgtat

SEQ ID NO: 715188 - DNA, 22 bp, Homo sapiens
ataagtagttggtttgtatgag

SEQ ID NO: 715189 - DNA, 18 bp, Homo sapiens
ataagtatttcaaattgg

SEQ ID NO: 715190 - DNA, 16 bp, Homo sapiens
ataagtcaacagtaaa

SEQ ID NO: 715191 - DNA, 18 bp, Homo sapiens
ataagtcaacagtaaacc

SEQ ID NO: 715192 - DNA, 16 bp, Homo sapiens
ataagtcaagcacatg

SEQ ID NO: 715193 - DNA, 18 bp, Homo sapiens
ataagtccattaactgct

SEQ ID NO: 715194 - DNA, 22 bp, Homo sapiens
ataagtccattttttaaaaatg

SEQ ID NO: 715195 - DNA, 20 bp, Homo sapiens
ataagtctacattaaacaat

SEQ ID NO: 715196 - DNA, 14 bp, Homo sapiens
ataagtctgattct

SEQ ID NO: 715197 - DNA, 17 bp, Homo sapiens
ataagtctgattctctt

SEQ ID NO: 715198 - DNA, 14 bp, Homo sapiens
ataagtgaaaatct

SEQ ID NO: 715199 - DNA, 21 bp, Homo sapiens
ataagtgaaatggatactaca

SEQ ID NO: 715200 - DNA, 22 bp, Homo sapiens
ataagtgaaatggatactacat

SEQ ID NO: 715201 - DNA, 18 bp, Homo sapiens
ataagtggaggcacttta

SEQ ID NO: 715202 - DNA, 19 bp, Homo sapiens
ataagtggaggcactttag

SEQ ID NO: 715203 - DNA, 16 bp, Homo sapiens
ataagtggcatacttt

SEQ ID NO: 715204 - DNA, 17 bp, Homo sapiens
ataagtggtgcttagaa

SEQ ID NO: 715205 - DNA, 16 bp, Homo sapiens
ataagtgtaaatagaa

SEQ ID NO: 715206 - DNA, 14 bp, Homo sapiens
ataagtgtacatat

SEQ ID NO: 715207 - DNA, 21 bp, Homo sapiens
ataagtgtattttgaaattgt

SEQ ID NO: 715208 - DNA, 16 bp, Homo sapiens
ataagtgtctttctgg

SEQ ID NO: 715209 - DNA, 13 bp, Homo sapiens
ataagttaaaaca

SEQ ID NO: 715210 - DNA, 22 bp, Homo sapiens
ataagttaaaacaaaggaacta

SEQ ID NO: 715211 - DNA, 17 bp, Homo sapiens
ataagttaacttccaat

SEQ ID NO: 715212 - DNA, 20 bp, Homo sapiens
ataagttattgcagtttatc

SEQ ID NO: 715213 - DNA, 13 bp, Homo sapiens
ataagttgctgta

SEQ ID NO: 715214 - DNA, 14 bp, Homo sapiens
ataagttgctgtgt

SEQ ID NO: 715215 - DNA, 14 bp, Homo sapiens
ataagttgtaccaa

SEQ ID NO: 715216 - DNA, 18 bp, Homo sapiens
ataagttgtaccaaaaca

SEQ ID NO: 715217 - DNA, 19 bp, Homo sapiens
ataagttgtaccaaaacat

SEQ ID NO: 715218 - DNA, 23 bp, Homo sapiens
ataagttgtataggctaaatgtt

SEQ ID NO: 715219 - DNA, 21 bp, Homo sapiens
ataagtttaactttaaaactg

SEQ ID NO: 715220 - DNA, 15 bp, Homo sapiens
ataagtttgaaggaa

SEQ ID NO: 715221 - DNA, 21 bp, Homo sapiens
ataagtttgaaggaaacagtt

SEQ ID NO: 715222 - DNA, 21 bp, Homo sapiens
ataagttttgatataatcttg

SEQ ID NO: 715223 - DNA, 19 bp, Homo sapiens
ataagtttttctttaatat

SEQ ID NO: 715224 - DNA, 17 bp, Homo sapiens
ataataaaaaaagaaag

SEQ ID NO: 715225 - DNA, 11 bp, Homo sapiens
ataataaaaat

SEQ ID NO: 715226 - DNA, 13 bp, Homo sapiens
ataataaaaatat

SEQ ID NO: 715227 - DNA, 19 bp, Homo sapiens
ataataaaaatatattttc

SEQ ID NO: 715228 - DNA, 14 bp, Homo sapiens
ataataaaaattgt

SEQ ID NO: 715229 - DNA, 21 bp, Homo sapiens
ataataaaaattgtagctttt

SEQ ID NO: 715230 - DNA, 13 bp, Homo sapiens
ataataaaacatg

SEQ ID NO: 715231 - DNA, 11 bp, Homo sapiens
ataataaaaga

SEQ ID NO: 715232 - DNA, 16 bp, Homo sapiens
ataataaaatgcaaat

SEQ ID NO: 715233 - DNA, 19 bp, Homo sapiens
ataataaacttttttgaaa

SEQ ID NO: 715234 - DNA, 13 bp, Homo sapiens
ataataaagaata

SEQ ID NO: 715235 - DNA, 18 bp, Homo sapiens
ataataaaggactgtaat

SEQ ID NO: 715236 - DNA, 14 bp, Homo sapiens
ataataaaggttga

SEQ ID NO: 715237 - DNA, 13 bp, Homo sapiens
ataataaagtagc

SEQ ID NO: 715238 - DNA, 12 bp, Homo sapiens
ataataaagtat

SEQ ID NO: 715239 - DNA, 13 bp, Homo sapiens
ataataaagtatt

SEQ ID NO: 715240 - DNA, 21 bp, Homo sapiens
ccctttgctctgatttccttc

SEQ ID NO: 715241 - DNA, 16 bp, Homo sapiens
ccctttgggaggctga

SEQ ID NO: 715242 - DNA, 20 bp, Homo sapiens
ccctttgggggttgaatagg

SEQ ID NO: 715243 - DNA, 18 bp, Homo sapiens
ccctttgtattataattg

SEQ ID NO: 715244 - DNA, 21 bp, Homo sapiens
ccctttgtattataattgttg

SEQ ID NO: 715245 - DNA, 23 bp, Homo sapiens
ccctttgtctgtcaatcacagtc

SEQ ID NO: 715246 - DNA, 17 bp, Homo sapiens
cccttttacattctgtg

SEQ ID NO: 715247 - DNA, 15 bp, Homo sapiens
cccttttaccactcc

SEQ ID NO: 715248 - DNA, 17 bp, Homo sapiens
cccttttaccactccca

SEQ ID NO: 715249 - DNA, 12 bp, Homo sapiens
cccttttacttt

SEQ ID NO: 715250 - DNA, 23 bp, Homo sapiens
cccttttagtttgatcagacagc

SEQ ID NO: 715251 - DNA, 16 bp, Homo sapiens
cccttttccagcctca

SEQ ID NO: 715252 - DNA, 19 bp, Homo sapiens
cccttttccatcctccaaa

SEQ ID NO: 715253 - DNA, 12 bp, Homo sapiens
cccttttctcag

SEQ ID NO: 715254 - DNA, 19 bp, Homo sapiens
cccttttctctgctcttgt

SEQ ID NO: 715255 - DNA, 13 bp, Homo sapiens
cccttttctgttc

SEQ ID NO: 715256 - DNA, 17 bp, Homo sapiens
cccttttgcctggctgt

SEQ ID NO: 715257 - DNA, 20 bp, Homo sapiens
cccttttggcccccgagctg

SEQ ID NO: 715258 - DNA, 22 bp, Homo sapiens
cccttttggcccccgagctggg

SEQ ID NO: 715259 - DNA, 15 bp, Homo sapiens
ccctttttaaaaaat

SEQ ID NO: 715260 - DNA, 16 bp, Homo sapiens
ccctttttactcccct

SEQ ID NO: 715261 - DNA, 15 bp, Homo sapiens
ccctttttctccagc

SEQ ID NO: 715262 - DNA, 23 bp, Homo sapiens
ccctttttgaagtgtaggcagac

SEQ ID NO: 715263 - DNA, 18 bp, Homo sapiens
cccttttttgtcccccaa

SEQ ID NO: 715264 - DNA, 18 bp, Homo sapiens
ccctttttttacatttca

SEQ ID NO: 715265 - DNA, 22 bp, Homo sapiens
ccgaaaaatcctcttcctctga

SEQ ID NO: 715266 - DNA, 21 bp, Homo sapiens
ccgaaagcatcactgccttgg

SEQ ID NO: 715267 - DNA, 21 bp, Homo sapiens
ccgaaatcagcccccagcctt

SEQ ID NO: 715268 - DNA, 19 bp, Homo sapiens
ccgaacatatcatttgtga

SEQ ID NO: 715269 - DNA, 21 bp, Homo sapiens
ccgaacatatcatttgtgaag

SEQ ID NO: 715270 - DNA, 16 bp, Homo sapiens
ccgaacattaggaatt

SEQ ID NO: 715271 - DNA, 12 bp, Homo sapiens
ccgaaccccggg

SEQ ID NO: 715272 - DNA, 17 bp, Homo sapiens
ccgaactgttgtataaa

SEQ ID NO: 715273 - DNA, 23 bp, Homo sapiens
ccgaagatggtggccacagactg

SEQ ID NO: 715274 - DNA, 17 bp, Homo sapiens
ccgaagccatcacttct

SEQ ID NO: 715275 - DNA, 18 bp, Homo sapiens
ccgaagccgcctgtggac

SEQ ID NO: 715276 - DNA, 16 bp, Homo sapiens
ccgaagctctggctga

SEQ ID NO: 715277 - DNA, 19 bp, Homo sapiens
ccgaagctctggctgaacc

SEQ ID NO: 715278 - DNA, 19 bp, Homo sapiens
ctcttctgctccacccttg

SEQ ID NO: 715279 - DNA, 20 bp, Homo sapiens
ctcttctgctccacccttgg

SEQ ID NO: 715280 - DNA, 16 bp, Homo sapiens
ctcttctgctccttag

SEQ ID NO: 715281 - DNA, 14 bp, Homo sapiens
ctcttctggctcaa

SEQ ID NO: 715282 - DNA, 17 bp, Homo sapiens
ctcttctgggcagagcc

SEQ ID NO: 715283 - DNA, 21 bp, Homo sapiens
ctcttctgggcagagcctgtc

SEQ ID NO: 715284 - DNA, 15 bp, Homo sapiens
ctcttctgggcctga

SEQ ID NO: 715285 - DNA, 17 bp, Homo sapiens
ctcttcttcttcagaag

SEQ ID NO: 715286 - DNA, 18 bp, Homo sapiens
ctcttcttcttcagaaga

SEQ ID NO: 715287 - DNA, 17 bp, Homo sapiens
ctcttcttcttttctat

SEQ ID NO: 715288 - DNA, 15 bp, Homo sapiens
ctcttcttgaaattt

SEQ ID NO: 715289 - DNA, 17 bp, Homo sapiens
ctcttcttgagcagacc

SEQ ID NO: 715290 - DNA, 12 bp, Homo sapiens
ctcttcttgttg

SEQ ID NO: 715291 - DNA, 19 bp, Homo sapiens
ctcttctttaagccataga

SEQ ID NO: 715292 - DNA, 12 bp, Homo sapiens
ctcttctttaga

SEQ ID NO: 715293 - DNA, 24 bp, Homo sapiens
ctcttctttatactgtaatttagt

SEQ ID NO: 715294 - DNA, 15 bp, Homo sapiens
ctcttctttattgca

SEQ ID NO: 715295 - DNA, 15 bp, Homo sapiens
ctcttctttctgaag

SEQ ID NO: 715296 - DNA, 16 bp, Homo sapiens
ctcttctttctgagag

SEQ ID NO: 715297 - DNA, 19 bp, Homo sapiens
ctcttcttttggcttccat

SEQ ID NO: 715298 - DNA, 22 bp, Homo sapiens
ctcttgaaatataggaacttaa

SEQ ID NO: 715299 - DNA, 14 bp, Homo sapiens
ctcttgaaatgtag

SEQ ID NO: 715300 - DNA, 12 bp, Homo sapiens
ctcttgaacatt

SEQ ID NO: 715301 - DNA, 15 bp, Homo sapiens
ctcttgaagtggatt

SEQ ID NO: 715302 - DNA, 14 bp, Homo sapiens
ctcttgacagtctg

SEQ ID NO: 715303 - DNA, 15 bp, Homo sapiens
ctcttgacagtctga

SEQ ID NO: 715304 - DNA, 14 bp, Homo sapiens
ctcttgaccaggct

SEQ ID NO: 715305 - DNA, 19 bp, Homo sapiens
ctcttgaccaggctgcctc

SEQ ID NO: 715306 - DNA, 14 bp, Homo sapiens
ctcttgaccctgca

SEQ ID NO: 715307 - DNA, 16 bp, Homo sapiens
ctcttgaccctgcacc

SEQ ID NO: 715308 - DNA, 18 bp, Homo sapiens
ctcttgaccctgcaccct

SEQ ID NO: 715309 - DNA, 15 bp, Homo sapiens
ctcttgagcatcaat

SEQ ID NO: 715310 - DNA, 13 bp, Homo sapiens
ctcttgagcctgg

SEQ ID NO: 715311 - DNA, 16 bp, Homo sapiens
ctcttgagccttgaac

SEQ ID NO: 715312 - DNA, 14 bp, Homo sapiens
ctcttgagctggcc

SEQ ID NO: 715313 - DNA, 17 bp, Homo sapiens
ctcttgaggccaggagt

SEQ ID NO: 715314 - DNA, 15 bp, Homo sapiens
ctcttgaggcctgtg

SEQ ID NO: 715315 - DNA, 20 bp, Homo sapiens
ctcttgaggcctgtgctctg

SEQ ID NO: 715316 - DNA, 14 bp, Homo sapiens
ctcttgagggagct

SEQ ID NO: 715317 - DNA, 15 bp, Homo sapiens
ctcttgagggagctt

SEQ ID NO: 715318 - DNA, 18 bp, Homo sapiens
ctcttgatacccccctct

SEQ ID NO: 715319 - DNA, 14 bp, Homo sapiens
ctcttgatgtgaag

SEQ ID NO: 715320 - DNA, 16 bp, Homo sapiens
ctcttgatgtgaagat

SEQ ID NO: 715321 - DNA, 23 bp, Homo sapiens
ctcttgcacacacggttttggca

SEQ ID NO: 715322 - DNA, 20 bp, Homo sapiens
ctcttgcacagtcactgctc

SEQ ID NO: 715323 - DNA, 14 bp, Homo sapiens
ctcttgcacccgcc

SEQ ID NO: 715324 - DNA, 15 bp, Homo sapiens
ctcttgcacccgcct

SEQ ID NO: 715325 - DNA, 19 bp, Homo sapiens
ctcttgcacccgcctctcc

SEQ ID NO: 715326 - DNA, 20 bp, Homo sapiens
ctcttgcacccgcctctccc

SEQ ID NO: 715327 - DNA, 17 bp, Homo sapiens
ctcttgcaggctgagtc

SEQ ID NO: 715328 - DNA, 19 bp, Homo sapiens
ctcttgccactgcctcttc

SEQ ID NO: 715329 - DNA, 12 bp, Homo sapiens
ctcttgccagcc

SEQ ID NO: 715330 - DNA, 12 bp, Homo sapiens
ctcttgccatcc

SEQ ID NO: 715331 - DNA, 15 bp, Homo sapiens
ctcttgccatcctga

SEQ ID NO: 715332 - DNA, 21 bp, Homo sapiens
ctcttgccatttgtagctttg

SEQ ID NO: 715333 - DNA, 15 bp, Homo sapiens
ctcttgcccatcctg

SEQ ID NO: 715334 - DNA, 16 bp, Homo sapiens
ctcttgcccatcctga

SEQ ID NO: 715335 - DNA, 16 bp, Homo sapiens
ctcttgccccccaccc

SEQ ID NO: 715336 - DNA, 15 bp, Homo sapiens
ctcttgcccttccct

SEQ ID NO: 715337 - DNA, 19 bp, Homo sapiens
ctcttgcccttcctactcc

SEQ ID NO: 715338 - DNA, 14 bp, Homo sapiens
ctcttgcctctctc

SEQ ID NO: 715339 - DNA, 14 bp, Homo sapiens
ctcttgctctcttg

SEQ ID NO: 715340 - DNA, 16 bp, Homo sapiens
ctcttgctctcttgtg

SEQ ID NO: 715341 - DNA, 17 bp, Homo sapiens
ctcttggacaacagctc

SEQ ID NO: 715342 - DNA, 19 bp, Homo sapiens
ctcttggacaacagctctc

SEQ ID NO: 715343 - DNA, 18 bp, Homo sapiens
ctcttggacctctgctct

SEQ ID NO: 715344 - DNA, 19 bp, Homo sapiens
ctcttggacctctgctctg

SEQ ID NO: 715345 - DNA, 21 bp, Homo sapiens
ctcttggagaagtctcagcta

SEQ ID NO: 715346 - DNA, 19 bp, Homo sapiens
ctcttggagcctctttttc

SEQ ID NO: 715347 - DNA, 21 bp, Homo sapiens
ctcttggataccagctcaggg

SEQ ID NO: 715348 - DNA, 16 bp, Homo sapiens
ctcttggcaagatgtt

SEQ ID NO: 715349 - DNA, 23 bp, Homo sapiens
ctcttggcaagatgtttcttata

SEQ ID NO: 715350 - DNA, 16 bp, Homo sapiens
ctcttggcctgatcag

SEQ ID NO: 715351 - DNA, 14 bp, Homo sapiens
ctcttggctgaccc

SEQ ID NO: 715352 - DNA, 16 bp, Homo sapiens
ctcttggctgacccct

SEQ ID NO: 715353 - DNA, 19 bp, Homo sapiens
ctcttggctgacccctctg

SEQ ID NO: 715354 - DNA, 15 bp, Homo sapiens
ctcttggcttccaga

SEQ ID NO: 715355 - DNA, 19 bp, Homo sapiens
ctcttggcttctcagcccc

SEQ ID NO: 715356 - DNA, 18 bp, Homo sapiens
ctcttgggcccaagtgat

SEQ ID NO: 715357 - DNA, 16 bp, Homo sapiens
ctcttgggctgagact

SEQ ID NO: 715358 - DNA, 13 bp, Homo sapiens
tgggccagggtct

SEQ ID NO: 715359 - DNA, 15 bp, Homo sapiens
tgggccatctggggt

SEQ ID NO: 715360 - DNA, 18 bp, Homo sapiens
tgggccatgcgaggggcc

SEQ ID NO: 715361 - DNA, 14 bp, Homo sapiens
tgggccatgtccaa

SEQ ID NO: 715362 - DNA, 17 bp, Homo sapiens
tgggccatgtccaaaga

SEQ ID NO: 715363 - DNA, 18 bp, Homo sapiens
tgggccatgtccaaagag

SEQ ID NO: 715364 - DNA, 24 bp, Homo sapiens
tgggccatgtccaaagaggctgcc

SEQ ID NO: 715365 - DNA, 13 bp, Homo sapiens
tgggccattaccc

SEQ ID NO: 715366 - DNA, 17 bp, Homo sapiens
tgggcccaaaggcccag

SEQ ID NO: 715367 - DNA, 19 bp, Homo sapiens
tgggcccaaaggcccaggg

SEQ ID NO: 715368 - DNA, 20 bp, Homo sapiens
tgggcccaagaactgcagat

SEQ ID NO: 715369 - DNA, 22 bp, Homo sapiens
tgggcccaagacagatgcccca

SEQ ID NO: 715370 - DNA, 23 bp, Homo sapiens
tgggcccaagacagatgccccag

SEQ ID NO: 715371 - DNA, 13 bp, Homo sapiens
tgggcccaagtga

SEQ ID NO: 715372 - DNA, 18 bp, Homo sapiens
tgggcccacagagcctgg

SEQ ID NO: 715373 - DNA, 12 bp, Homo sapiens
tgggcccagctg

SEQ ID NO: 715374 - DNA, 16 bp, Homo sapiens
tgggcccagctgggct

SEQ ID NO: 715375 - DNA, 15 bp, Homo sapiens
tgggcccaggaccag

SEQ ID NO: 715376 - DNA, 21 bp, Homo sapiens
tgggcccaggaccagctgggg

SEQ ID NO: 715377 - DNA, 17 bp, Homo sapiens
tgggcccaggcaggtct

SEQ ID NO: 715378 - DNA, 15 bp, Homo sapiens
tgggcccaggggctg

SEQ ID NO: 715379 - DNA, 22 bp, Homo sapiens
tgggcccataatagttagccct

SEQ ID NO: 715380 - DNA, 19 bp, Homo sapiens
tgggcccatctccctgctt

SEQ ID NO: 715381 - DNA, 18 bp, Homo sapiens
tgggccccaccacctagg

SEQ ID NO: 715382 - DNA, 14 bp, Homo sapiens
tgggccccactgga

SEQ ID NO: 715383 - DNA, 14 bp, Homo sapiens
tgggccccatgctc

SEQ ID NO: 715384 - DNA, 17 bp, Homo sapiens
tgggccccatgctctgc

SEQ ID NO: 715385 - DNA, 18 bp, Homo sapiens
tgggccccatgctctgcc

SEQ ID NO: 715386 - DNA, 18 bp, Homo sapiens
tgggcccccagcctggcc

SEQ ID NO: 715387 - DNA, 18 bp, Homo sapiens
tgggcccctcccctcaga

SEQ ID NO: 715388 - DNA, 20 bp, Homo sapiens
tgggcccctcccctcagagc

SEQ ID NO: 715389 - DNA, 23 bp, Homo sapiens
tgggcccctggccccgcctgcct

SEQ ID NO: 715390 - DNA, 13 bp, Homo sapiens
tgggcccctgggg

SEQ ID NO: 715391 - DNA, 16 bp, Homo sapiens
tgggcccctgtcccca

SEQ ID NO: 715392 - DNA, 17 bp, Homo sapiens
tgggcccctgtccccag

SEQ ID NO: 715393 - DNA, 19 bp, Homo sapiens
tgggcccctgtccccagtc

SEQ ID NO: 715394 - DNA, 17 bp, Homo sapiens
tgggcccgctgcctctt

SEQ ID NO: 715395 - DNA, 21 bp, Homo sapiens
tgggcccgctgcctcttggct

SEQ ID NO: 715396 - DNA, 18 bp, Homo sapiens
tgggccctctctctgggc

SEQ ID NO: 715397 - DNA, 19 bp, Homo sapiens
tgggccctctttccctgcg

SEQ ID NO: 715398 - DNA, 13 bp, Homo sapiens
tgggccctgcagg

SEQ ID NO: 715399 - DNA, 22 bp, Homo sapiens
tgggccctgcaggctgcaggag

SEQ ID NO: 715400 - DNA, 15 bp, Homo sapiens
tgggccctgggctga

SEQ ID NO: 715401 - DNA, 16 bp, Homo sapiens
tgggcccttgtgctcc

SEQ ID NO: 715402 - DNA, 21 bp, Homo sapiens
tgggccgcaagggcctggacg

SEQ ID NO: 715403 - DNA, 14 bp, Homo sapiens
tgggccgcccctgg

SEQ ID NO: 715404 - DNA, 17 bp, Homo sapiens
tgggccggcgagggggc

SEQ ID NO: 715405 - DNA, 19 bp, Homo sapiens
tgggccgtcccctctcccc

SEQ ID NO: 715406 - DNA, 17 bp, Homo sapiens
tgggccgtggcttgggc

SEQ ID NO: 715407 - DNA, 23 bp, Homo sapiens
tgggcctaaaacagtattctgta

SEQ ID NO: 715408 - DNA, 22 bp, Homo sapiens
tgggcctcacctgcccctctgt

SEQ ID NO: 715409 - DNA, 13 bp, Homo sapiens
tgggcctcaggcg

SEQ ID NO: 715410 - DNA, 18 bp, Homo sapiens
tgggcctccatgccccag

SEQ ID NO: 715411 - DNA, 23 bp, Homo sapiens
tgggcctccatgccccagctctg

SEQ ID NO: 715412 - DNA, 18 bp, Homo sapiens
tgggcctccctggcactg

SEQ ID NO: 715413 - DNA, 16 bp, Homo sapiens
tgggcctcccttgggc

SEQ ID NO: 715414 - DNA, 22 bp, Homo sapiens
tgggcctcccttgggctggaag

SEQ ID NO: 715415 - DNA, 20 bp, Homo sapiens
tgggcctctcctgccctctg

SEQ ID NO: 715416 - DNA, 15 bp, Homo sapiens
tgggcctctctgggg

SEQ ID NO: 715417 - DNA, 17 bp, Homo sapiens
tgggcctctctggggga

SEQ ID NO: 715418 - DNA, 18 bp, Homo sapiens
tgggcctctttttgccct

SEQ ID NO: 715419 - DNA, 20 bp, Homo sapiens
tgggcctgcccaatgctttg

SEQ ID NO: 715420 - DNA, 19 bp, Homo sapiens
tgggcctgccgggctgagg

SEQ ID NO: 715421 - DNA, 14 bp, Homo sapiens
tttccattccagaa

SEQ ID NO: 715422 - DNA, 16 bp, Homo sapiens
tttccattcttcttgc

SEQ ID NO: 715423 - DNA, 14 bp, Homo sapiens
tttccattgtttga

SEQ ID NO: 715424 - DNA, 17 bp, Homo sapiens
tttccatttacttaaga

SEQ ID NO: 715425 - DNA, 13 bp, Homo sapiens
tttccatttattg

SEQ ID NO: 715426 - DNA, 22 bp, Homo sapiens
tttccatttattgtttgaaatg

SEQ ID NO: 715427 - DNA, 19 bp, Homo sapiens
tttccatttcttcagaggg

SEQ ID NO: 715428 - DNA, 21 bp, Homo sapiens
tttccatttgcatttgtttat

SEQ ID NO: 715429 - DNA, 15 bp, Homo sapiens
tttcccaaatgtatt

SEQ ID NO: 715430 - DNA, 12 bp, Homo sapiens
tttcccaactct

SEQ ID NO: 715431 - DNA, 23 bp, Homo sapiens
tttcccaatctctacccctttct

SEQ ID NO: 715432 - DNA, 15 bp, Homo sapiens
tttcccaattaggaa

SEQ ID NO: 715433 - DNA, 15 bp, Homo sapiens
tttcccaattcacat

SEQ ID NO: 715434 - DNA, 14 bp, Homo sapiens
tttcccacatcttt

SEQ ID NO: 715435 - DNA, 15 bp, Homo sapiens
tttcccacatctttc

SEQ ID NO: 715436 - DNA, 21 bp, Homo sapiens
tttcccaccattcctgccttt

SEQ ID NO: 715437 - DNA, 21 bp, Homo sapiens
tttcccactgtttaaggagtt

SEQ ID NO: 715438 - DNA, 14 bp, Homo sapiens
tttcccaggaatat

SEQ ID NO: 715439 - DNA, 16 bp, Homo sapiens
tttcccaggttctgtt

SEQ ID NO: 715440 - DNA, 12 bp, Homo sapiens
tttcccataatt

SEQ ID NO: 715441 - DNA, 17 bp, Homo sapiens
tttcccatcatcctttg

SEQ ID NO: 715442 - DNA, 16 bp, Homo sapiens
tttcccatggggaggg

SEQ ID NO: 715443 - DNA, 21 bp, Homo sapiens
tttcccatttgtgccagagga

SEQ ID NO: 715444 - DNA, 19 bp, Homo sapiens
tttccccaggggaaaatga

SEQ ID NO: 715445 - DNA, 21 bp, Homo sapiens
tttccccatctctgtctgggg

SEQ ID NO: 715446 - DNA, 23 bp, Homo sapiens
tttccccatctctgtctggggct

SEQ ID NO: 715447 - DNA, 23 bp, Homo sapiens
tttcccccagcaacgcccctcca

SEQ ID NO: 715448 - DNA, 13 bp, Homo sapiens
tttccccccactc

SEQ ID NO: 715449 - DNA, 19 bp, Homo sapiens
tttccccccactctcccca

SEQ ID NO: 715450 - DNA, 18 bp, Homo sapiens
tttcccccctccttctgc

SEQ ID NO: 715451 - DNA, 22 bp, Homo sapiens
tttccccctgtttttagagctt

SEQ ID NO: 715452 - DNA, 23 bp, Homo sapiens
tttcccccttgaggattgtggaa

SEQ ID NO: 715453 - DNA, 18 bp, Homo sapiens
tttccccggtcccttgag

SEQ ID NO: 715454 - DNA, 16 bp, Homo sapiens
tttcccctccctgggt

SEQ ID NO: 715455 - DNA, 13 bp, Homo sapiens
tttcccctctcgg

SEQ ID NO: 715456 - DNA, 12 bp, Homo sapiens
tttcccctggcc

SEQ ID NO: 715457 - DNA, 14 bp, Homo sapiens
tttcccctgtcctg

SEQ ID NO: 715458 - DNA, 12 bp, Homo sapiens
tttccccttgga

SEQ ID NO: 715459 - DNA, 15 bp, Homo sapiens
tttcccctttcctgt

SEQ ID NO: 715460 - DNA, 20 bp, Homo sapiens
tttccctactgaaccctgcc

SEQ ID NO: 715461 - DNA, 17 bp, Homo sapiens
tttccctagaaagccat

SEQ ID NO: 715462 - DNA, 16 bp, Homo sapiens
tttccctcccagtttt

SEQ ID NO: 715463 - DNA, 20 bp, Homo sapiens
tttccctcctgacaaatatt

SEQ ID NO: 715464 - DNA, 22 bp, Homo sapiens
tttccctctcccagtccatttc

SEQ ID NO: 715465 - DNA, 13 bp, Homo sapiens
tttccctgacctc

SEQ ID NO: 715466 - DNA, 22 bp, Homo sapiens
tttcccttaaatacagataatt

SEQ ID NO: 715467 - DNA, 15 bp, Homo sapiens
tttcccttattgcct

SEQ ID NO: 715468 - DNA, 16 bp, Homo sapiens
tttcccttcagtaccc

SEQ ID NO: 715469 - DNA, 19 bp, Homo sapiens
tttcccttcagtaccctct

SEQ ID NO: 715470 - DNA, 20 bp, Homo sapiens
tttcccttctggacactgag

SEQ ID NO: 715471 - DNA, 18 bp, Homo sapiens
tttccctttttaaaaaat

SEQ ID NO: 715472 - DNA, 13 bp, Homo sapiens
tttccggctgctg

SEQ ID NO: 715473 - DNA, 20 bp, Homo sapiens
tttccgtccccccccaggcc

SEQ ID NO: 715474 - DNA, 16 bp, Homo sapiens
tttccgtggcactgca

SEQ ID NO: 715475 - DNA, 13 bp, Homo sapiens
tttcctaaagcca

SEQ ID NO: 715476 - DNA, 15 bp, Homo sapiens
tttcctaaatgcagt

SEQ ID NO: 715477 - DNA, 17 bp, Homo sapiens
tttcctaaatgcagtga

SEQ ID NO: 715478 - DNA, 14 bp, Homo sapiens
tttcctaaggcatg

SEQ ID NO: 715479 - DNA, 17 bp, Homo sapiens
tttcctaaggctgcaag

SEQ ID NO: 715480 - DNA, 21 bp, Homo sapiens
tttcctaataaagttctgtac

SEQ ID NO: 715481 - DNA, 24 bp, Homo sapiens
tttcctaataaagttctgtactca

SEQ ID NO: 715482 - DNA, 12 bp, Homo sapiens
tttcctaatact

SEQ ID NO: 715483 - DNA, 23 bp, Homo sapiens
tttcctacagaaatactgctctg

SEQ ID NO: 715484 - DNA, 24 bp, Homo sapiens
tttcctactctcaggatcaagaaa

SEQ ID NO: 715485 - DNA, 14 bp, Homo sapiens
tttcctactgtcct

SEQ ID NO: 715486 - DNA, 20 bp, Homo sapiens
tttcctagtgaggaaagcct

SEQ ID NO: 715487 - DNA, 21 bp, Homo sapiens
tttcctatctagcatttattt

SEQ ID NO: 715488 - DNA, 15 bp, Homo sapiens
tttcctcaagcaata

SEQ ID NO: 715489 - DNA, 21 bp, Homo sapiens
tttcctcaagcaataattgtt

SEQ ID NO: 715490 - DNA, 19 bp, Homo sapiens
tttcctcacgtgcaggaca

SEQ ID NO: 715491 - DNA, 16 bp, Homo sapiens
tttcctcactgcctgg

SEQ ID NO: 715492 - DNA, 13 bp, Homo sapiens
tttcctcagaaca

SEQ ID NO: 715493 - DNA, 16 bp, Homo sapiens
tttcctcagaacatga

SEQ ID NO: 715494 - DNA, 18 bp, Homo sapiens
tttcctcagaacatgaga

SEQ ID NO: 715495 - DNA, 19 bp, Homo sapiens
tttcctcagggtgtcctga

SEQ ID NO: 715496 - DNA, 18 bp, Homo sapiens
tttcctcatcctttccct

SEQ ID NO: 715497 - DNA, 16 bp, Homo sapiens
tttcctcatgtaacat

SEQ ID NO: 715498 - DNA, 18 bp, Homo sapiens
tttcctcatgtaacattg

SEQ ID NO: 715499 - DNA, 21 bp, Homo sapiens
tttcctcattaatagctgcct

SEQ ID NO: 715500 - DNA, 13 bp, Homo sapiens
tttcctcccagtg

SEQ ID NO: 715501 - DNA, 20 bp, Homo sapiens
tttcctccccatacacacac

SEQ ID NO: 715502 - DNA, 13 bp, Homo sapiens
tttcctccctcag

SEQ ID NO: 715503 - DNA, 22 bp, Homo sapiens
tttcctccctggtttgcagctg

SEQ ID NO: 715504 - DNA, 11 bp, Homo sapiens
tttcctccctt

SEQ ID NO: 715505 - DNA, 15 bp, Homo sapiens
tttcctcccttgggt

SEQ ID NO: 715506 - DNA, 16 bp, Homo sapiens
tttcctcctacctttt

SEQ ID NO: 715507 - DNA, 13 bp, Homo sapiens
tttcctcctctgc

SEQ ID NO: 715508 - DNA, 21 bp, Homo sapiens
tttcctcctgaggctttggat

SEQ ID NO: 715509 - DNA, 18 bp, Homo sapiens
tttcctcggtctcccttc

SEQ ID NO: 715510 - DNA, 15 bp, Homo sapiens
tttcctctaaagaaa

SEQ ID NO: 715511 - DNA, 17 bp, Homo sapiens
tttcctctaaagaaact

SEQ ID NO: 715512 - DNA, 20 bp, Homo sapiens
tttcctctattgatgtacag

SEQ ID NO: 715513 - DNA, 23 bp, Homo sapiens
tttcctctccctcaggggcaggt

SEQ ID NO: 715514 - DNA, 14 bp, Homo sapiens
tttcctctctgtct

SEQ ID NO: 715515 - DNA, 17 bp, Homo sapiens
tttcctcttagaagaat

SEQ ID NO: 715516 - DNA, 18 bp, Homo sapiens
tttcctcttgtcctggcc

SEQ ID NO: 715517 - DNA, 12 bp, Homo sapiens
tttcctcttgtg

SEQ ID NO: 715518 - DNA, 13 bp, Homo sapiens
tttcctcttgtga

SEQ ID NO: 715519 - DNA, 12 bp, Homo sapiens
tttcctgaaata

SEQ ID NO: 715520 - DNA, 13 bp, Homo sapiens
tttcctgagcttg

SEQ ID NO: 715521 - DNA, 18 bp, Homo sapiens
tttcctgagcttggccag

SEQ ID NO: 715522 - DNA, 20 bp, Homo sapiens
tttcctgagggttttctcat

SEQ ID NO: 715523 - DNA, 16 bp, Homo sapiens
tttcctgatgcccctg

SEQ ID NO: 715524 - DNA, 22 bp, Homo sapiens
tttcctgccataaaagctatga

SEQ ID NO: 715525 - DNA, 15 bp, Homo sapiens
tttcctgccctgtcc

SEQ ID NO: 715526 - DNA, 17 bp, Homo sapiens
tttcctgcccttcctca

SEQ ID NO: 715527 - DNA, 11 bp, Homo sapiens
tttcctggaaa

SEQ ID NO: 715528 - DNA, 20 bp, Homo sapiens
tttcctggacactcagacct

SEQ ID NO: 715529 - DNA, 19 bp, Homo sapiens
tttcctggacttaaagaaa

SEQ ID NO: 715530 - DNA, 20 bp, Homo sapiens
tttcctggacttaaagaaaa

SEQ ID NO: 715531 - DNA, 16 bp, Homo sapiens
tttcctggagtgccct

SEQ ID NO: 715532 - DNA, 17 bp, Homo sapiens
tttcctggagtgccctg

SEQ ID NO: 715533 - DNA, 15 bp, Homo sapiens
tttcctggcagctgc

SEQ ID NO: 715534 - DNA, 16 bp, Homo sapiens
tttcctggcagctgct

SEQ ID NO: 715535 - DNA, 12 bp, Homo sapiens
tttcctgggcct

SEQ ID NO: 715536 - DNA, 14 bp, Homo sapiens
tttcctggtgccaa

SEQ ID NO: 715537 - DNA, 22 bp, Homo sapiens
tttcctgtggttttattacaaa

SEQ ID NO: 715538 - DNA, 16 bp, Homo sapiens
tttcctgtttactgat

SEQ ID NO: 715539 - DNA, 13 bp, Homo sapiens
tttcctgtttgaa

SEQ ID NO: 715540 - DNA, 22 bp, Homo sapiens
tttcctgtttgaaatatcatgt

SEQ ID NO: 715541 - DNA, 19 bp, Homo sapiens
tttccttagtgccaggagg

SEQ ID NO: 715542 - DNA, 23 bp, Homo sapiens
tttctccatctttatagaaggaa

SEQ ID NO: 715543 - DNA, 11 bp, Homo sapiens
tttctccatgt

SEQ ID NO: 715544 - DNA, 20 bp, Homo sapiens
tttctccccatccccttcct

SEQ ID NO: 715545 - DNA, 15 bp, Homo sapiens
tttctcccctatttt

SEQ ID NO: 715546 - DNA, 17 bp, Homo sapiens
tttctccctaaactgta

SEQ ID NO: 715547 - DNA, 13 bp, Homo sapiens
tttctccctcacc

SEQ ID NO: 715548 - DNA, 11 bp, Homo sapiens
tttctccctct

SEQ ID NO: 715549 - DNA, 21 bp, Homo sapiens
tttctccctctcatgtccctc

SEQ ID NO: 715550 - DNA, 18 bp, Homo sapiens
tgaaagttaactcttcaa

SEQ ID NO: 715551 - DNA, 13 bp, Homo sapiens
tgaaagttttcca

SEQ ID NO: 715552 - DNA, 14 bp, Homo sapiens
tgaaagttttccag

SEQ ID NO: 715553 - DNA, 17 bp, Homo sapiens
tgaaagttttccagtat

SEQ ID NO: 715554 - DNA, 23 bp, Homo sapiens
tgaaagttttccagtattgaaaa

SEQ ID NO: 715555 - DNA, 17 bp, Homo sapiens
tgaaagttttgtaaaag

SEQ ID NO: 715556 - DNA, 17 bp, Homo sapiens
tgaaataaaaaaagatt

SEQ ID NO: 715557 - DNA, 18 bp, Homo sapiens
tgaaataaaaaaagattt

SEQ ID NO: 715558 - DNA, 19 bp, Homo sapiens
tgaaataaaactggctttg

SEQ ID NO: 715559 - DNA, 14 bp, Homo sapiens
tgaaataaaatata

SEQ ID NO: 715560 - DNA, 18 bp, Homo sapiens
tgaaataaacctgcactg

SEQ ID NO: 715561 - DNA, 20 bp, Homo sapiens
tgaaataaagaaattgcaat

SEQ ID NO: 715562 - DNA, 14 bp, Homo sapiens
tgaaataaatgttt

SEQ ID NO: 715563 - DNA, 23 bp, Homo sapiens
tgaaataaattctgacttatgaa

SEQ ID NO: 715564 - DNA, 15 bp, Homo sapiens
tgaaataagaattca

SEQ ID NO: 715565 - DNA, 16 bp, Homo sapiens
tgaaataataaaatgc

SEQ ID NO: 715566 - DNA, 17 bp, Homo sapiens
tgaaataataaaatgca

SEQ ID NO: 715567 - DNA, 23 bp, Homo sapiens
tgaaataataaaatgcaaatgaa

SEQ ID NO: 715568 - DNA, 19 bp, Homo sapiens
tgaaataatatatttcttc

SEQ ID NO: 715569 - DNA, 21 bp, Homo sapiens
tgaaataatatatttcttctt

SEQ ID NO: 715570 - DNA, 17 bp, Homo sapiens
tgaaataatttttaact

SEQ ID NO: 715571 - DNA, 14 bp, Homo sapiens
tgaaatactccagc

SEQ ID NO: 715572 - DNA, 18 bp, Homo sapiens
tgaaatacttttgagtat

SEQ ID NO: 715573 - DNA, 20 bp, Homo sapiens
tgaaatactttttaacaaaa

SEQ ID NO: 715574 - DNA, 17 bp, Homo sapiens
tgaaatataaactgtag

SEQ ID NO: 715575 - DNA, 12 bp, Homo sapiens
tgaaatataatt

SEQ ID NO: 715576 - DNA, 18 bp, Homo sapiens
tgaaatatatattgtaaa

SEQ ID NO: 715577 - DNA, 19 bp, Homo sapiens
tgaaatatatgtgaaagga

SEQ ID NO: 715578 - DNA, 13 bp, Homo sapiens
tgaaatatcatgt

SEQ ID NO: 715579 - DNA, 14 bp, Homo sapiens
tgaaatatcatgtt

SEQ ID NO: 715580 - DNA, 17 bp, Homo sapiens
tgaaatatccacccagc

SEQ ID NO: 715581 - DNA, 18 bp, Homo sapiens
tgaaatatccacccagca

SEQ ID NO: 715582 - DNA, 20 bp, Homo sapiens
tgaaatatgcatactaattt

SEQ ID NO: 715583 - DNA, 16 bp, Homo sapiens
tgaaatattaaaatca

SEQ ID NO: 715584 - DNA, 17 bp, Homo sapiens
tgaaatattaaaatcac

SEQ ID NO: 715585 - DNA, 19 bp, Homo sapiens
tgaaatattaaaatcactg

SEQ ID NO: 715586 - DNA, 15 bp, Homo sapiens
tgaaatattcagaaa

SEQ ID NO: 715587 - DNA, 17 bp, Homo sapiens
tgaaatattcagaaatt

SEQ ID NO: 715588 - DNA, 11 bp, Homo sapiens
tgaaatatttt

SEQ ID NO: 715589 - DNA, 16 bp, Homo sapiens
tgaaatattttacagt

SEQ ID NO: 715590 - DNA, 19 bp, Homo sapiens
tgaaatcagcatgacaaaa

SEQ ID NO: 715591 - DNA, 15 bp, Homo sapiens
tgaaatcagtgaggt

SEQ ID NO: 715592 - DNA, 20 bp, Homo sapiens
tgaaatcccatctctacaaa

SEQ ID NO: 715593 - DNA, 14 bp, Homo sapiens
tgaaatcctgcttc

SEQ ID NO: 715594 - DNA, 22 bp, Homo sapiens
tgaaatcctgggttttcttaac

SEQ ID NO: 715595 - DNA, 17 bp, Homo sapiens
tgaaatccttgactgga

SEQ ID NO: 715596 - DNA, 18 bp, Homo sapiens
tgaaatccttgactggac

SEQ ID NO: 715597 - DNA, 17 bp, Homo sapiens
tgaaatctaatatttct

SEQ ID NO: 715598 - DNA, 18 bp, Homo sapiens
tgaaatctaggaaaatta

SEQ ID NO: 715599 - DNA, 19 bp, Homo sapiens
tgaaatctaggaaaattat

SEQ ID NO: 715600 - DNA, 21 bp, Homo sapiens
tgaaatctcagaatttatctc

SEQ ID NO: 715601 - DNA, 18 bp, Homo sapiens
tgaaatctgctagaaagt

SEQ ID NO: 715602 - DNA, 13 bp, Homo sapiens
tgaaatctttctt

SEQ ID NO: 715603 - DNA, 13 bp, Homo sapiens
tgaaatgaaaaca

SEQ ID NO: 715604 - DNA, 14 bp, Homo sapiens
tgaaatgaaaacat

SEQ ID NO: 715605 - DNA, 21 bp, Homo sapiens
tgaaatgaaacaaataatcac

SEQ ID NO: 715606 - DNA, 19 bp, Homo sapiens
tgaaatgaggtctgtttaa

SEQ ID NO: 715607 - DNA, 23 bp, Homo sapiens
tgaaatgaggtctgtttaaagtg

SEQ ID NO: 715608 - DNA, 19 bp, Homo sapiens
tgaaatgataaagactttt

SEQ ID NO: 715609 - DNA, 23 bp, Homo sapiens
tgaaatgccaagtgcctgcttag

SEQ ID NO: 715610 - DNA, 22 bp, Homo sapiens
tgaaatgccctcctaaatgtca

SEQ ID NO: 715611 - DNA, 17 bp, Homo sapiens
tgaaatgcctgctttga

SEQ ID NO: 715612 - DNA, 13 bp, Homo sapiens
tgaaatgctgcat

SEQ ID NO: 715613 - DNA, 15 bp, Homo sapiens
tgaaatgctgcattt

SEQ ID NO: 715614 - DNA, 16 bp, Homo sapiens
tgaaatgctggcattt

SEQ ID NO: 715615 - DNA, 13 bp, Homo sapiens
tgaaatgctttta

SEQ ID NO: 715616 - DNA, 21 bp, Homo sapiens
tgaaatgcttttatattctaa

SEQ ID NO: 715617 - DNA, 17 bp, Homo sapiens
tgaaatggatactacat

SEQ ID NO: 715618 - DNA, 17 bp, Homo sapiens
tgaaatggatacttata

SEQ ID NO: 715619 - DNA, 15 bp, Homo sapiens
tgaaatgggagatgg

SEQ ID NO: 715620 - DNA, 12 bp, Homo sapiens
tgaaatgtaagg

SEQ ID NO: 715621 - DNA, 20 bp, Homo sapiens
tgaaatgtaaggctgtgtaa

SEQ ID NO: 715622 - DNA, 17 bp, Homo sapiens
tgaaatgtcagttctga

SEQ ID NO: 715623 - DNA, 17 bp, Homo sapiens
tgaaatgtcgatcaaga

SEQ ID NO: 715624 - DNA, 18 bp, Homo sapiens
tgaaatgtcgatcaagag

SEQ ID NO: 715625 - DNA, 21 bp, Homo sapiens
tgaaatgttagtcattgttat

SEQ ID NO: 715626 - DNA, 22 bp, Homo sapiens
tgaaatgtttactaagtggact

SEQ ID NO: 715627 - DNA, 13 bp, Homo sapiens
tgaaattaaaaat

SEQ ID NO: 715628 - DNA, 13 bp, Homo sapiens
tgaaattaaagaa

SEQ ID NO: 715629 - DNA, 15 bp, Homo sapiens
tgaaattaaagaaat

SEQ ID NO: 715630 - DNA, 22 bp, Homo sapiens
tgaaattaactgggtaatgaaa

SEQ ID NO: 715631 - DNA, 23 bp, Homo sapiens
tgaaattaagaaggcaaaaatgt

SEQ ID NO: 715632 - DNA, 13 bp, Homo sapiens
tgaaattaagcat

SEQ ID NO: 715633 - DNA, 17 bp, Homo sapiens
tgaaattaatttgtgaa

SEQ ID NO: 715634 - DNA, 18 bp, Homo sapiens
tgaaattaatttgtgaat

SEQ ID NO: 715635 - DNA, 16 bp, Homo sapiens
tgaaattactgtgtaa

SEQ ID NO: 715636 - DNA, 21 bp, Homo sapiens
tgaaattatgtatgtttacat

SEQ ID NO: 715637 - DNA, 22 bp, Homo sapiens
tgaaattatgtgacattttaca

SEQ ID NO: 715638 - DNA, 16 bp, Homo sapiens
tgaaattcaaaatgct

SEQ ID NO: 715639 - DNA, 14 bp, Homo sapiens
tgaaattccagcaa

SEQ ID NO: 715640 - DNA, 22 bp, Homo sapiens
tgaaattgtagtgcaaaatggt

SEQ ID NO: 715641 - DNA, 18 bp, Homo sapiens
tgaaattgtttaagtgtt

SEQ ID NO: 715642 - DNA, 21 bp, Homo sapiens
tgaaattgttttaccagctcc

SEQ ID NO: 715643 - DNA, 21 bp, Homo sapiens
tgaaatttaaataatagacat

SEQ ID NO: 715644 - DNA, 22 bp, Homo sapiens
tgaaatttattagttaatatat

SEQ ID NO: 715645 - DNA, 18 bp, Homo sapiens
tgaaatttattcacatat

SEQ ID NO: 715646 - DNA, 21 bp, Homo sapiens
tgaaatttattcacatatatc

SEQ ID NO: 715647 - DNA, 14 bp, Homo sapiens
tgaaatttatttaa

SEQ ID NO: 715648 - DNA, 21 bp, Homo sapiens
tgaaatttatttaatgtgagt

SEQ ID NO: 715649 - DNA, 12 bp, Homo sapiens
tgaaatttcaga

SEQ ID NO: 715650 - DNA, 22 bp, Homo sapiens
tgaaatttcagattcccagagc

SEQ ID NO: 715651 - DNA, 17 bp, Homo sapiens
tgaaatttgcctctgtc

SEQ ID NO: 715652 - DNA, 21 bp, Homo sapiens
tgaaatttgttatacttcaaa

SEQ ID NO: 715653 - DNA, 17 bp, Homo sapiens
tgaaattttaaactata

SEQ ID NO: 715654 - DNA, 14 bp, Homo sapiens
tgaaattttagaaa

SEQ ID NO: 715655 - DNA, 16 bp, Homo sapiens
tgaaattttagaaata

SEQ ID NO: 715656 - DNA, 18 bp, Homo sapiens
tgaaattttatatgctta

SEQ ID NO: 715657 - DNA, 18 bp, Homo sapiens
tgaaattttctagacttt

SEQ ID NO: 715658 - DNA, 21 bp, Homo sapiens
tgaaattttttagtatgttca

SEQ ID NO: 715659 - DNA, 21 bp, Homo sapiens
tgaacaaaaatgtttccactg

SEQ ID NO: 715660 - DNA, 18 bp, Homo sapiens
tgaacaaaacctacacac

SEQ ID NO: 715661 - DNA, 13 bp, Homo sapiens
tgaacaaaattat

SEQ ID NO: 715662 - DNA, 15 bp, Homo sapiens
tgaacaaaattattt

SEQ ID NO: 715663 - DNA, 17 bp, Homo sapiens
tgaacaaacactgaatc

SEQ ID NO: 715664 - DNA, 16 bp, Homo sapiens
tgaacaaagcagccac

SEQ ID NO: 715665 - DNA, 20 bp, Homo sapiens
tgaacaaagctcaaagtatg

SEQ ID NO: 715666 - DNA, 15 bp, Homo sapiens
tgaacaaatggcctt

SEQ ID NO: 715667 - DNA, 12 bp, Homo sapiens
tgaacaacagta

SEQ ID NO: 715668 - DNA, 12 bp, Homo sapiens
tgaacaagaatt

SEQ ID NO: 715669 - DNA, 20 bp, Homo sapiens
tgaacaagttgtttcattga

SEQ ID NO: 715670 - DNA, 22 bp, Homo sapiens
tgaacaagttgtttcattgact

SEQ ID NO: 715671 - DNA, 23 bp, Homo sapiens
tgaacacaattgatacttcaggt

SEQ ID NO: 715672 - DNA, 16 bp, Homo sapiens
tgaacacacacgccag

SEQ ID NO: 715673 - DNA, 19 bp, Homo sapiens
tgaacacacacgccagctc

SEQ ID NO: 715674 - DNA, 13 bp, Homo sapiens
taaagcagtattt

SEQ ID NO: 715675 - DNA, 19 bp, Homo sapiens
taaagcagtggacaccagg

SEQ ID NO: 715676 - DNA, 20 bp, Homo sapiens
taaagcatttaacccccctg

SEQ ID NO: 715677 - DNA, 17 bp, Homo sapiens
taaagcattttttaaaa

SEQ ID NO: 715678 - DNA, 22 bp, Homo sapiens
taaagccaaagtttctgttgaa

SEQ ID NO: 715679 - DNA, 17 bp, Homo sapiens
taaagccagcctgacct

SEQ ID NO: 715680 - DNA, 18 bp, Homo sapiens
taaagccatgctaaaatt

SEQ ID NO: 715681 - DNA, 20 bp, Homo sapiens
taaagccatgttaaatgact

SEQ ID NO: 715682 - DNA, 21 bp, Homo sapiens
taaagcctaccctattctatc

SEQ ID NO: 715683 - DNA, 15 bp, Homo sapiens
taaagcctatttttc

SEQ ID NO: 715684 - DNA, 17 bp, Homo sapiens
taaagcctatttttcaa

SEQ ID NO: 715685 - DNA, 11 bp, Homo sapiens
taaagccttta

SEQ ID NO: 715686 - DNA, 18 bp, Homo sapiens
taaagcctttaaaaccag

SEQ ID NO: 715687 - DNA, 17 bp, Homo sapiens
taaagccttttaaatca

SEQ ID NO: 715688 - DNA, 15 bp, Homo sapiens
taaagcgtttgcaca

SEQ ID NO: 715689 - DNA, 15 bp, Homo sapiens
taaagctaaaataaa

SEQ ID NO: 715690 - DNA, 16 bp, Homo sapiens
taaagctaaattttgt

SEQ ID NO: 715691 - DNA, 15 bp, Homo sapiens
taaagctagaaatga

SEQ ID NO: 715692 - DNA, 14 bp, Homo sapiens
taaagctatgttac

SEQ ID NO: 715693 - DNA, 14 bp, Homo sapiens
taaagctcaaatga

SEQ ID NO: 715694 - DNA, 15 bp, Homo sapiens
taaagctcaaatgaa

SEQ ID NO: 715695 - DNA, 20 bp, Homo sapiens
taaagctcaaatgaaatgta

SEQ ID NO: 715696 - DNA, 23 bp, Homo sapiens
taaagctgcctgtagttaggaaa

SEQ ID NO: 715697 - DNA, 13 bp, Homo sapiens
taaagctggaaca

SEQ ID NO: 715698 - DNA, 22 bp, Homo sapiens
taaagctggaacatttgatatt

SEQ ID NO: 715699 - DNA, 23 bp, Homo sapiens
taaagctggaacatttgatattt

SEQ ID NO: 715700 - DNA, 19 bp, Homo sapiens
taaagctggtttaatgttt

SEQ ID NO: 715701 - DNA, 12 bp, Homo sapiens
taaagctttatc

SEQ ID NO: 715702 - DNA, 19 bp, Homo sapiens
taaagctttatctttgtgt

SEQ ID NO: 715703 - DNA, 19 bp, Homo sapiens
taaagctttcaacatgtac

SEQ ID NO: 715704 - DNA, 14 bp, Homo sapiens
taaaggactgtaat

SEQ ID NO: 715705 - DNA, 14 bp, Homo sapiens
taaaggataaagaa

SEQ ID NO: 715706 - DNA, 16 bp, Homo sapiens
taaaggatccagagag

SEQ ID NO: 715707 - DNA, 16 bp, Homo sapiens
taaaggatggaaaaat

SEQ ID NO: 715708 - DNA, 19 bp, Homo sapiens
taaaggcaccatctaatag

SEQ ID NO: 715709 - DNA, 13 bp, Homo sapiens
taaaggcagctgc

SEQ ID NO: 715710 - DNA, 14 bp, Homo sapiens
taaaggcagctgcc

SEQ ID NO: 715711 - DNA, 15 bp, Homo sapiens
taaaggcagctgcct

SEQ ID NO: 715712 - DNA, 16 bp, Homo sapiens
taaaggcagctgcctc

SEQ ID NO: 715713 - DNA, 17 bp, Homo sapiens
taaaggcagctgcctct

SEQ ID NO: 715714 - DNA, 18 bp, Homo sapiens
taaaggcagctgcctctg

SEQ ID NO: 715715 - DNA, 20 bp, Homo sapiens
taaaggcatccttgtctttt

SEQ ID NO: 715716 - DNA, 16 bp, Homo sapiens
taaaggcccagcccct

SEQ ID NO: 715717 - DNA, 19 bp, Homo sapiens
taaaggcctggaaccaggg

SEQ ID NO: 715718 - DNA, 17 bp, Homo sapiens
taaaggcgctaatttat

SEQ ID NO: 715719 - DNA, 21 bp, Homo sapiens
taaaggctacctttgtattct

SEQ ID NO: 715720 - DNA, 17 bp, Homo sapiens
taaaggctcgattttgt

SEQ ID NO: 715721 - DNA, 20 bp, Homo sapiens
taaagggaccatctgctgca

SEQ ID NO: 715722 - DNA, 14 bp, Homo sapiens
taaagggagaagga

SEQ ID NO: 715723 - DNA, 17 bp, Homo sapiens
taaagggataaagaaat

SEQ ID NO: 715724 - DNA, 21 bp, Homo sapiens
taaagggcccaatgaattatt

SEQ ID NO: 715725 - DNA, 15 bp, Homo sapiens
taaagggcctgcctg

SEQ ID NO: 715726 - DNA, 18 bp, Homo sapiens
taaagggtgtacttatat

SEQ ID NO: 715727 - DNA, 19 bp, Homo sapiens
taaagggttaatagccaga

SEQ ID NO: 715728 - DNA, 20 bp, Homo sapiens
taaaggtaccaaacaaggaa

SEQ ID NO: 715729 - DNA, 21 bp, Homo sapiens
taaaggtgacatcggaaaaat

SEQ ID NO: 715730 - DNA, 22 bp, Homo sapiens
taaaggttacaagcctgcacaa

SEQ ID NO: 715731 - DNA, 13 bp, Homo sapiens
taaaggttatgaa

SEQ ID NO: 715732 - DNA, 22 bp, Homo sapiens
taaaggttatgaaacatatcat

SEQ ID NO: 715733 - DNA, 21 bp, Homo sapiens
taaaggtttatttttctgtta

SEQ ID NO: 715734 - DNA, 16 bp, Homo sapiens
taaagtaaacttgtgt

SEQ ID NO: 715735 - DNA, 13 bp, Homo sapiens
taaagtaaagcta

SEQ ID NO: 715736 - DNA, 13 bp, Homo sapiens
taaagtaaattat

SEQ ID NO: 715737 - DNA, 13 bp, Homo sapiens
taaagtaataatg

SEQ ID NO: 715738 - DNA, 17 bp, Homo sapiens
taaagtaataatgtgca

SEQ ID NO: 715739 - DNA, 15 bp, Homo sapiens
taaagtaatgatgaa

SEQ ID NO: 715740 - DNA, 16 bp, Homo sapiens
taaagtaattcataca

SEQ ID NO: 715741 - DNA, 13 bp, Homo sapiens
taaagtacaaatg

SEQ ID NO: 715742 - DNA, 15 bp, Homo sapiens
taaagtacctgtagt

SEQ ID NO: 715743 - DNA, 17 bp, Homo sapiens
taaagtacctttatgtt

SEQ ID NO: 715744 - DNA, 15 bp, Homo sapiens
taaagtataatgttt

SEQ ID NO: 715745 - DNA, 15 bp, Homo sapiens
taaagtatagaaata

SEQ ID NO: 715746 - DNA, 19 bp, Homo sapiens
taaagtatatatagaatct

SEQ ID NO: 715747 - DNA, 14 bp, Homo sapiens
taaagtatatattt

SEQ ID NO: 715748 - DNA, 18 bp, Homo sapiens
taaagtatcacttttctg

SEQ ID NO: 715749 - DNA, 15 bp, Homo sapiens
taaagtatgtaaaca

SEQ ID NO: 715750 - DNA, 16 bp, Homo sapiens
taaagtatgtaaacag

SEQ ID NO: 715751 - DNA, 23 bp, Homo sapiens
taaagtatgtgagtagtcttatg

SEQ ID NO: 715752 - DNA, 17 bp, Homo sapiens
taaagtatgtttttaca

SEQ ID NO: 715753 - DNA, 18 bp, Homo sapiens
taaagtatgtttttacat

SEQ ID NO: 715754 - DNA, 20 bp, Homo sapiens
taaagtattccaccttaaat

SEQ ID NO: 715755 - DNA, 19 bp, Homo sapiens
taaagtattctccatcctc

SEQ ID NO: 715756 - DNA, 10 bp, Homo sapiens
taaagtattt

SEQ ID NO: 715757 - DNA, 15 bp, Homo sapiens
taaagtatttataaa

SEQ ID NO: 715758 - DNA, 24 bp, Homo sapiens
taaagtatttataaaaatataaat

SEQ ID NO: 715759 - DNA, 17 bp, Homo sapiens
taaagtcacatccctgt

SEQ ID NO: 715760 - DNA, 15 bp, Homo sapiens
taaagtcagatggaa

SEQ ID NO: 715761 - DNA, 15 bp, Homo sapiens
taaagtctattcaaa

SEQ ID NO: 715762 - DNA, 15 bp, Homo sapiens
taaagtctgagaaat

SEQ ID NO: 715763 - DNA, 16 bp, Homo sapiens
taaagtctgagaaata

SEQ ID NO: 715764 - DNA, 18 bp, Homo sapiens
taaagtgaaggaaataaa

SEQ ID NO: 715765 - DNA, 14 bp, Homo sapiens
taaagtgatgtttg

SEQ ID NO: 715766 - DNA, 21 bp, Homo sapiens
taaagtgatgtttgtgtgttt

SEQ ID NO: 715767 - DNA, 11 bp, Homo sapiens
taaagtgatta

SEQ ID NO: 715768 - DNA, 16 bp, Homo sapiens
taaagtgattaaacgt

SEQ ID NO: 715769 - DNA, 17 bp, Homo sapiens
tctttttcttcttccct

SEQ ID NO: 715770 - DNA, 14 bp, Homo sapiens
tctttttctttctt

SEQ ID NO: 715771 - DNA, 13 bp, Homo sapiens
tctttttgtataa

SEQ ID NO: 715772 - DNA, 15 bp, Homo sapiens
tctttttgttgtaaa

SEQ ID NO: 715773 - DNA, 16 bp, Homo sapiens
tctttttgttgtaaaa

SEQ ID NO: 715774 - DNA, 19 bp, Homo sapiens
tcttttttaataaactact

SEQ ID NO: 715775 - DNA, 18 bp, Homo sapiens
tcttttttatgttaaaaa

SEQ ID NO: 715776 - DNA, 22 bp, Homo sapiens
tcttttttatgttaaaaagaaa

SEQ ID NO: 715777 - DNA, 20 bp, Homo sapiens
tcttttttcagttattttga

SEQ ID NO: 715778 - DNA, 13 bp, Homo sapiens
tcttttttcgttt

SEQ ID NO: 715779 - DNA, 19 bp, Homo sapiens
tcttttttctatctgccaa

SEQ ID NO: 715780 - DNA, 15 bp, Homo sapiens
tcttttttgctttct

SEQ ID NO: 715781 - DNA, 17 bp, Homo sapiens
tctttttttccttcctt

SEQ ID NO: 715782 - DNA, 13 bp, Homo sapiens
tctttttttctgt

SEQ ID NO: 715783 - DNA, 17 bp, Homo sapiens
tctttttttgagtgaca

SEQ ID NO: 715784 - DNA, 20 bp, Homo sapiens
tctttttttgagtgacagct

SEQ ID NO: 715785 - DNA, 17 bp, Homo sapiens
tctttttttggtaaatt

SEQ ID NO: 715786 - DNA, 18 bp, Homo sapiens
tctttttttgtatagtta

SEQ ID NO: 715787 - DNA, 14 bp, Homo sapiens
tctttttttgtgat

SEQ ID NO: 715788 - DNA, 20 bp, Homo sapiens
tcttttttttatataaatat

SEQ ID NO: 715789 - DNA, 18 bp, Homo sapiens
tcttttttttttccaaat

SEQ ID NO: 715790 - DNA, 16 bp, Homo sapiens
tgaaaaaaaataaatt

SEQ ID NO: 715791 - DNA, 16 bp, Homo sapiens
tgaaaaaaacttcatt

SEQ ID NO: 715792 - DNA, 12 bp, Homo sapiens
tgaaaaaaagaa

SEQ ID NO: 715793 - DNA, 16 bp, Homo sapiens
tgaaaaaaagtttaca

SEQ ID NO: 715794 - DNA, 13 bp, Homo sapiens
tgaaaaaatacta

SEQ ID NO: 715795 - DNA, 18 bp, Homo sapiens
tgaaaaaatgtatatgca

SEQ ID NO: 715796 - DNA, 14 bp, Homo sapiens
tgaaaaacaaacaa

SEQ ID NO: 715797 - DNA, 17 bp, Homo sapiens
tgaaaaacaacaacaca

SEQ ID NO: 715798 - DNA, 17 bp, Homo sapiens
tgaaaaacacggcagct

SEQ ID NO: 715799 - DNA, 22 bp, Homo sapiens
tgaaaaacacggcagctgtagc

SEQ ID NO: 715800 - DNA, 21 bp, Homo sapiens
tgaaaaacatcccaaacttta

SEQ ID NO: 715801 - DNA, 16 bp, Homo sapiens
tgaaaaagctgcttct

SEQ ID NO: 715802 - DNA, 18 bp, Homo sapiens
tgaaaaaggaaatattct

SEQ ID NO: 715803 - DNA, 16 bp, Homo sapiens
tgaaaaagtaaagtgt

SEQ ID NO: 715804 - DNA, 20 bp, Homo sapiens
tgaaaaagttccatagaaaa

SEQ ID NO: 715805 - DNA, 11 bp, Homo sapiens
tgaaaaatatt

SEQ ID NO: 715806 - DNA, 20 bp, Homo sapiens
tgaaaaatattccaagcttc

SEQ ID NO: 715807 - DNA, 16 bp, Homo sapiens
tgaaaaatattgctaa

SEQ ID NO: 715808 - DNA, 19 bp, Homo sapiens
tgaaaaatattgctaaaag

SEQ ID NO: 715809 - DNA, 12 bp, Homo sapiens
tgaaaaatgtca

SEQ ID NO: 715810 - DNA, 19 bp, Homo sapiens
tgaaaaattcctttgtgtt

SEQ ID NO: 715811 - DNA, 13 bp, Homo sapiens
tgaaaaattctca

SEQ ID NO: 715812 - DNA, 18 bp, Homo sapiens
tgaaaaatttaagcattg

SEQ ID NO: 715813 - DNA, 19 bp, Homo sapiens
tgaaaaatttaagcattgt

SEQ ID NO: 715814 - DNA, 18 bp, Homo sapiens
tgaaaacaattcagtggt

SEQ ID NO: 715815 - DNA, 13 bp, Homo sapiens
tgaaaacacattt

SEQ ID NO: 715816 - DNA, 15 bp, Homo sapiens
tgaaaacacattttt

SEQ ID NO: 715817 - DNA, 20 bp, Homo sapiens
tgaaaacacatttttcttag

SEQ ID NO: 715818 - DNA, 18 bp, Homo sapiens
tgaaaacactgtgcacat

SEQ ID NO: 715819 - DNA, 13 bp, Homo sapiens
tgaaaacatctgg

SEQ ID NO: 715820 - DNA, 19 bp, Homo sapiens
tgaaaacatggtagaattg

SEQ ID NO: 715821 - DNA, 19 bp, Homo sapiens
tgaaaacatttcaaagctg

SEQ ID NO: 715822 - DNA, 16 bp, Homo sapiens
tgaaaacgttttattg

SEQ ID NO: 715823 - DNA, 19 bp, Homo sapiens
tgaaaactcattacttttc

SEQ ID NO: 715824 - DNA, 16 bp, Homo sapiens
tgaaaactgaatgtca

SEQ ID NO: 715825 - DNA, 21 bp, Homo sapiens
tgaaaactgctgataaaatat

SEQ ID NO: 715826 - DNA, 17 bp, Homo sapiens
tgaaaacttagccagag

SEQ ID NO: 715827 - DNA, 12 bp, Homo sapiens
tgaaaacttcaa

SEQ ID NO: 715828 - DNA, 20 bp, Homo sapiens
tgaaaacttcaaagctgaat

SEQ ID NO: 715829 - DNA, 23 bp, Homo sapiens
tgaaaacttcaaagctgaatatt

SEQ ID NO: 715830 - DNA, 18 bp, Homo sapiens
tgaaaatttttacattca

SEQ ID NO: 715831 - DNA, 20 bp, Homo sapiens
tgaaacaaaccgaaaatgga

SEQ ID NO: 715832 - DNA, 14 bp, Homo sapiens
tgaaacaaagaagg

SEQ ID NO: 715833 - DNA, 19 bp, Homo sapiens
tgaaacaaagtactcttta

SEQ ID NO: 715834 - DNA, 19 bp, Homo sapiens
tgaaacaaataatcacatt

SEQ ID NO: 715835 - DNA, 20 bp, Homo sapiens
tgaaacaactccttttactg

SEQ ID NO: 715836 - DNA, 17 bp, Homo sapiens
tgaaacaagaagccaca

SEQ ID NO: 715837 - DNA, 11 bp, Homo sapiens
tgaaacaatgt

SEQ ID NO: 715838 - DNA, 17 bp, Homo sapiens
tgaaacacaccaggctg

SEQ ID NO: 715839 - DNA, 19 bp, Homo sapiens
tgaaacacaccaggctgtg

SEQ ID NO: 715840 - DNA, 13 bp, Homo sapiens
tgaaacacacgag

SEQ ID NO: 715841 - DNA, 21 bp, Homo sapiens
tgaaacacacgagcaaaccca

SEQ ID NO: 715842 - DNA, 16 bp, Homo sapiens
tgaaacaccttctctg

SEQ ID NO: 715843 - DNA, 15 bp, Homo sapiens
tgaaacacgaaactt

SEQ ID NO: 715844 - DNA, 19 bp, Homo sapiens
tgaaacacgaaacttgtta

SEQ ID NO: 715845 - DNA, 12 bp, Homo sapiens
tgaaacactgga

SEQ ID NO: 715846 - DNA, 14 bp, Homo sapiens
tgaaacactggacc

SEQ ID NO: 715847 - DNA, 16 bp, Homo sapiens
tgaaacactggacctg

SEQ ID NO: 715848 - DNA, 16 bp, Homo sapiens
tgaaacacttctcatc

SEQ ID NO: 715849 - DNA, 16 bp, Homo sapiens
tgaaacagagaaagaa

SEQ ID NO: 715850 - DNA, 23 bp, Homo sapiens
tgaaacagagaaagaaaaggcaa

SEQ ID NO: 715851 - DNA, 18 bp, Homo sapiens
tgaaacagatgataaata

SEQ ID NO: 715852 - DNA, 13 bp, Homo sapiens
tgaaacagcctgg

SEQ ID NO: 715853 - DNA, 17 bp, Homo sapiens
tgaaacagcctgggtga

SEQ ID NO: 715854 - DNA, 16 bp, Homo sapiens
tgaaacagttgctgtg

SEQ ID NO: 715855 - DNA, 17 bp, Homo sapiens
tgaaacagttgctgtga

SEQ ID NO: 715856 - DNA, 22 bp, Homo sapiens
tgaaacatatctcttatcttac

SEQ ID NO: 715857 - DNA, 21 bp, Homo sapiens
tgaaacattcacacagggctc

SEQ ID NO: 715858 - DNA, 19 bp, Homo sapiens
tgaaacatttcagaaggta

SEQ ID NO: 715859 - DNA, 11 bp, Homo sapiens
tgaaaccaaaa

SEQ ID NO: 715860 - DNA, 22 bp, Homo sapiens
tgaaaccaaaacataaaaacca

SEQ ID NO: 715861 - DNA, 13 bp, Homo sapiens
tgaaaccagaaga

SEQ ID NO: 715862 - DNA, 19 bp, Homo sapiens
tgaaacccaaagccctggt

SEQ ID NO: 715863 - DNA, 22 bp, Homo sapiens
tgaaacccacagatgtctctgg

SEQ ID NO: 715864 - DNA, 20 bp, Homo sapiens
tgaaacccctgtaggcctca

SEQ ID NO: 715865 - DNA, 17 bp, Homo sapiens
tgaaacccgccctcagg

SEQ ID NO: 715866 - DNA, 16 bp, Homo sapiens
tgaaacctacacactg

SEQ ID NO: 715867 - DNA, 20 bp, Homo sapiens
tgaaacctacacactgtcat

SEQ ID NO: 715868 - DNA, 19 bp, Homo sapiens
tgaaacctagtactgcccc

SEQ ID NO: 715869 - DNA, 18 bp, Homo sapiens
tgaaacctgttaaaacaa

SEQ ID NO: 715870 - DNA, 18 bp, Homo sapiens
tgaaaccttattttttcc

SEQ ID NO: 715871 - DNA, 20 bp, Homo sapiens
tgaaacctttagggcagctt

SEQ ID NO: 715872 - DNA, 21 bp, Homo sapiens
tgaaacctttagggcagcttg

SEQ ID NO: 715873 - DNA, 18 bp, Homo sapiens
tgaaacgactcaaaatga

SEQ ID NO: 715874 - DNA, 14 bp, Homo sapiens
tgaaacgccttgca

SEQ ID NO: 715875 - DNA, 17 bp, Homo sapiens
tgaaacgtattcagagt

SEQ ID NO: 715876 - DNA, 22 bp, Homo sapiens
tgaaacgtggatacagagccac

SEQ ID NO: 715877 - DNA, 19 bp, Homo sapiens
tgaaactaggcttctgtaa

SEQ ID NO: 715878 - DNA, 20 bp, Homo sapiens
tgaaactaggcttctgtaat

SEQ ID NO: 715879 - DNA, 17 bp, Homo sapiens
tgaaactccagatgcca

SEQ ID NO: 715880 - DNA, 18 bp, Homo sapiens
tgaaactccagatgccac

SEQ ID NO: 715881 - DNA, 22 bp, Homo sapiens
tgaaactcctgattttgtagtt

SEQ ID NO: 715882 - DNA, 23 bp, Homo sapiens
tgaaactcgcgagtgtaactttc

SEQ ID NO: 715883 - DNA, 13 bp, Homo sapiens
tgaaactctttca

SEQ ID NO: 715884 - DNA, 15 bp, Homo sapiens
tgaaactgcatttgt

SEQ ID NO: 715885 - DNA, 14 bp, Homo sapiens
agccagggccaggg

SEQ ID NO: 715886 - DNA, 18 bp, Homo sapiens
agccagggcccagagccc

SEQ ID NO: 715887 - DNA, 19 bp, Homo sapiens
agccagggcccagagccct

SEQ ID NO: 715888 - DNA, 20 bp, Homo sapiens
agccagggcccagagccctt

SEQ ID NO: 715889 - DNA, 11 bp, Homo sapiens
agccagggcct

SEQ ID NO: 715890 - DNA, 10 bp, Homo sapiens
agccagggct

SEQ ID NO: 715891 - DNA, 20 bp, Homo sapiens
agccagggcttacctgtaca

SEQ ID NO: 715892 - DNA, 16 bp, Homo sapiens
agccagggtagagcaa

SEQ ID NO: 715893 - DNA, 18 bp, Homo sapiens
agccagggtctctccctc

SEQ ID NO: 715894 - DNA, 15 bp, Homo sapiens
agccaggtacaggag

SEQ ID NO: 715895 - DNA, 21 bp, Homo sapiens
agccaggtacaggagaggcag

SEQ ID NO: 715896 - DNA, 21 bp, Homo sapiens
agccaggttctcattaggttt

SEQ ID NO: 715897 - DNA, 22 bp, Homo sapiens
agccagtaaatgggggtgcatt

SEQ ID NO: 715898 - DNA, 14 bp, Homo sapiens
agccagtaacttat

SEQ ID NO: 715899 - DNA, 14 bp, Homo sapiens
agccagtcccaggg

SEQ ID NO: 715900 - DNA, 14 bp, Homo sapiens
agccagtctcagag

SEQ ID NO: 715901 - DNA, 16 bp, Homo sapiens
agccagtctcagagac

SEQ ID NO: 715902 - DNA, 17 bp, Homo sapiens
agccagtctcagagacc

SEQ ID NO: 715903 - DNA, 16 bp, Homo sapiens
agccagtgacctttga

SEQ ID NO: 715904 - DNA, 18 bp, Homo sapiens
agccagtggagctggtct

SEQ ID NO: 715905 - DNA, 18 bp, Homo sapiens
agccagtggcacaggaga

SEQ ID NO: 715906 - DNA, 14 bp, Homo sapiens
agccagtgtgccca

SEQ ID NO: 715907 - DNA, 20 bp, Homo sapiens
agccagtgtgcccaaaagcc

SEQ ID NO: 715908 - DNA, 23 bp, Homo sapiens
agccagtttgggtaaaatacttt

SEQ ID NO: 715909 - DNA, 16 bp, Homo sapiens
agccagttttcatttt

SEQ ID NO: 715910 - DNA, 15 bp, Homo sapiens
agccataacgtgccc

SEQ ID NO: 715911 - DNA, 17 bp, Homo sapiens
agccataacgtgccccc

SEQ ID NO: 715912 - DNA, 19 bp, Homo sapiens
agccataacgtgcccccag

SEQ ID NO: 715913 - DNA, 22 bp, Homo sapiens
agccataacgtgcccccagagt

SEQ ID NO: 715914 - DNA, 14 bp, Homo sapiens
agccataacttgaa

SEQ ID NO: 715915 - DNA, 17 bp, Homo sapiens
agccataattttgcata

SEQ ID NO: 715916 - DNA, 22 bp, Homo sapiens
agccataattttgcatactgaa

SEQ ID NO: 715917 - DNA, 18 bp, Homo sapiens
agccatacataaaagaaa

SEQ ID NO: 715918 - DNA, 21 bp, Homo sapiens
agccatagaccctgaggccct

SEQ ID NO: 715919 - DNA, 15 bp, Homo sapiens
agccatagggggctg

SEQ ID NO: 715920 - DNA, 17 bp, Homo sapiens
agccatagggggctgca

SEQ ID NO: 715921 - DNA, 20 bp, Homo sapiens
agccatagggggctgcacgg

SEQ ID NO: 715922 - DNA, 23 bp, Homo sapiens
agccatattaattgcctgttaaa

SEQ ID NO: 715923 - DNA, 17 bp, Homo sapiens
agccatattcacacctc

SEQ ID NO: 715924 - DNA, 14 bp, Homo sapiens
agccatcaaaatgc

SEQ ID NO: 715925 - DNA, 15 bp, Homo sapiens
agccatcaaaatgct

SEQ ID NO: 715926 - DNA, 12 bp, Homo sapiens
agccatcaccct

SEQ ID NO: 715927 - DNA, 14 bp, Homo sapiens
agccatcaccctca

SEQ ID NO: 715928 - DNA, 16 bp, Homo sapiens
agccatcaccctcacc

SEQ ID NO: 715929 - DNA, 20 bp, Homo sapiens
agccatcacttctccccgca

SEQ ID NO: 715930 - DNA, 19 bp, Homo sapiens
agccatcagccatggccct

SEQ ID NO: 715931 - DNA, 19 bp, Homo sapiens
agccatcccatgaacacac

SEQ ID NO: 715932 - DNA, 18 bp, Homo sapiens
agccatcccgcttagcct

SEQ ID NO: 715933 - DNA, 16 bp, Homo sapiens
agccatcccttgggga

SEQ ID NO: 715934 - DNA, 15 bp, Homo sapiens
agccatcgactcctg

SEQ ID NO: 715935 - DNA, 19 bp, Homo sapiens
agccatctaatgcttgttt

SEQ ID NO: 715936 - DNA, 17 bp, Homo sapiens
agccatctcagattctg

SEQ ID NO: 715937 - DNA, 21 bp, Homo sapiens
agccatctcatgaggggagag

SEQ ID NO: 715938 - DNA, 21 bp, Homo sapiens
agccatgagatgatacatcca

SEQ ID NO: 715939 - DNA, 18 bp, Homo sapiens
agccatgattttctaaaa

SEQ ID NO: 715940 - DNA, 15 bp, Homo sapiens
agccatgccaataaa

SEQ ID NO: 715941 - DNA, 17 bp, Homo sapiens
agccatgccagctggcc

SEQ ID NO: 715942 - DNA, 14 bp, Homo sapiens
agccatgccaggct

SEQ ID NO: 715943 - DNA, 13 bp, Homo sapiens
agccatgcctccc

SEQ ID NO: 715944 - DNA, 14 bp, Homo sapiens
agccatgcctccct

SEQ ID NO: 715945 - DNA, 15 bp, Homo sapiens
agccatgcctccctg

SEQ ID NO: 715946 - DNA, 18 bp, Homo sapiens
agccatgcctccctgggc

SEQ ID NO: 715947 - DNA, 13 bp, Homo sapiens
agccatgcgtggc

SEQ ID NO: 715948 - DNA, 16 bp, Homo sapiens
agccatgctacagtta

SEQ ID NO: 715949 - DNA, 19 bp, Homo sapiens
agccatgctacagttagtc

SEQ ID NO: 715950 - DNA, 15 bp, Homo sapiens
agccatgctgggaag

SEQ ID NO: 715951 - DNA, 12 bp, Homo sapiens
agccatggaagg

SEQ ID NO: 715952 - DNA, 17 bp, Homo sapiens
agccatggaaggtgcca

SEQ ID NO: 715953 - DNA, 20 bp, Homo sapiens
agccatggaaggtgccagaa

SEQ ID NO: 715954 - DNA, 18 bp, Homo sapiens
agccatggactctacact

SEQ ID NO: 715955 - DNA, 16 bp, Homo sapiens
agccatggctcaggca

SEQ ID NO: 715956 - DNA, 22 bp, Homo sapiens
agccatggctcaggcaagcccc

SEQ ID NO: 715957 - DNA, 17 bp, Homo sapiens
agccatgggacctcctc

SEQ ID NO: 715958 - DNA, 20 bp, Homo sapiens
agccatgggacctcctccct

SEQ ID NO: 715959 - DNA, 22 bp, Homo sapiens
agccatgggcctgggcctgctt

SEQ ID NO: 715960 - DNA, 22 bp, Homo sapiens
agccatggggtccatccccttc

SEQ ID NO: 715961 - DNA, 16 bp, Homo sapiens
agccatgtagccaccc

SEQ ID NO: 715962 - DNA, 19 bp, Homo sapiens
agccatgtatttcagggac

SEQ ID NO: 715963 - DNA, 21 bp, Homo sapiens
agccatgtccaagttcttcac

SEQ ID NO: 715964 - DNA, 15 bp, Homo sapiens
agccatgtctgcatt

SEQ ID NO: 715965 - DNA, 15 bp, Homo sapiens
agccattaaaataaa

SEQ ID NO: 715966 - DNA, 19 bp, Homo sapiens
agccattaaaataaaacaa

SEQ ID NO: 715967 - DNA, 20 bp, Homo sapiens
agccattaaaataaaacaag

SEQ ID NO: 715968 - DNA, 20 bp, Homo sapiens
agccattaccatggagacaa

SEQ ID NO: 715969 - DNA, 12 bp, Homo sapiens
agccattcctgg

SEQ ID NO: 715970 - DNA, 15 bp, Homo sapiens
agccattgaacagct

SEQ ID NO: 715971 - DNA, 19 bp, Homo sapiens
agccattgaacagctgtga

SEQ ID NO: 715972 - DNA, 21 bp, Homo sapiens
agccattggctatttaaaact

SEQ ID NO: 715973 - DNA, 14 bp, Homo sapiens
agccattgtccctc

SEQ ID NO: 715974 - DNA, 23 bp, Homo sapiens
agccatttatacctttgaaatat

SEQ ID NO: 715975 - DNA, 13 bp, Homo sapiens
agccatttccccc

SEQ ID NO: 715976 - DNA, 16 bp, Homo sapiens
agccatttctccatgg

SEQ ID NO: 715977 - DNA, 12 bp, Homo sapiens
agccatttgaga

SEQ ID NO: 715978 - DNA, 18 bp, Homo sapiens
agccatttgttggggcag

SEQ ID NO: 715979 - DNA, 16 bp, Homo sapiens
agccatttttcaaagc

SEQ ID NO: 715980 - DNA, 14 bp, Homo sapiens
agcccaaaccttgg

SEQ ID NO: 715981 - DNA, 21 bp, Homo sapiens
agcccaaattcatataaaagt

SEQ ID NO: 715982 - DNA, 17 bp, Homo sapiens
agcccaaccaggccctg

SEQ ID NO: 715983 - DNA, 16 bp, Homo sapiens
agcccaacccggccca

SEQ ID NO: 715984 - DNA, 17 bp, Homo sapiens
agcccaacttcttaccc

SEQ ID NO: 715985 - DNA, 18 bp, Homo sapiens
agcccaacttcttacccg

SEQ ID NO: 715986 - DNA, 18 bp, Homo sapiens
agcccaagaggtctgagc

SEQ ID NO: 715987 - DNA, 19 bp, Homo sapiens
agcccaagaggtctgagcc

SEQ ID NO: 715988 - DNA, 19 bp, Homo sapiens
agcccaagcttaatagccc

SEQ ID NO: 715989 - DNA, 19 bp, Homo sapiens
agcccaagcttccctccat

SEQ ID NO: 715990 - DNA, 18 bp, Homo sapiens
agcccaaggtcagggagg

SEQ ID NO: 715991 - DNA, 16 bp, Homo sapiens
agcccaatattataat

SEQ ID NO: 715992 - DNA, 16 bp, Homo sapiens
agcccaatgaaatgaa

SEQ ID NO: 715993 - DNA, 21 bp, Homo sapiens
agcccacagatgatgaagaaa

SEQ ID NO: 715994 - DNA, 15 bp, Homo sapiens
agcccacagcgagcc

SEQ ID NO: 715995 - DNA, 17 bp, Homo sapiens
agcccacagcgagcctg

SEQ ID NO: 715996 - DNA, 18 bp, Homo sapiens
agcccacagcgagcctgt

SEQ ID NO: 715997 - DNA, 18 bp, Homo sapiens
agcccacaggcctgttcc

SEQ ID NO: 715998 - DNA, 19 bp, Homo sapiens
agcccacagtatattttat

SEQ ID NO: 715999 - DNA, 23 bp, Homo sapiens
agcccacattggattcatcagca

SEQ ID NO: 716000 - DNA, 18 bp, Homo sapiens
agcccaccagccagccct

SEQ ID NO: 716001 - DNA, 15 bp, Homo sapiens
agcccaccaggagca

SEQ ID NO: 716002 - DNA, 10 bp, Homo sapiens
agcccacctg

SEQ ID NO: 716003 - DNA, 14 bp, Homo sapiens
agcccacctgaaag

SEQ ID NO: 716004 - DNA, 20 bp, Homo sapiens
agcccacctgggctgggcgc

SEQ ID NO: 716005 - DNA, 20 bp, Homo sapiens
agcccacggggatcacagcg

SEQ ID NO: 716006 - DNA, 12 bp, Homo sapiens
agcccactccct

SEQ ID NO: 716007 - DNA, 15 bp, Homo sapiens
ccagtcctgctacct

SEQ ID NO: 716008 - DNA, 19 bp, Homo sapiens
ccagtcctggtcctggctg

SEQ ID NO: 716009 - DNA, 23 bp, Homo sapiens
ccagtcctggtcctggctgcact

SEQ ID NO: 716010 - DNA, 20 bp, Homo sapiens
ccagtcgtcatcagatgctt

SEQ ID NO: 716011 - DNA, 13 bp, Homo sapiens
ccagtctatttcc

SEQ ID NO: 716012 - DNA, 22 bp, Homo sapiens
ccagtctcagacactaaatgca

SEQ ID NO: 716013 - DNA, 17 bp, Homo sapiens
ccagtctcagagaccag

SEQ ID NO: 716014 - DNA, 18 bp, Homo sapiens
ccagtctcagagaccagc

SEQ ID NO: 716015 - DNA, 19 bp, Homo sapiens
ccagtctcagagaccagca

SEQ ID NO: 716016 - DNA, 23 bp, Homo sapiens
ccagtctcatctcctgaccctcc

SEQ ID NO: 716017 - DNA, 13 bp, Homo sapiens
ccagtctcccagg

SEQ ID NO: 716018 - DNA, 22 bp, Homo sapiens
ccagtctcccaggccccctgca

SEQ ID NO: 716019 - DNA, 12 bp, Homo sapiens
ccagtctcctca

SEQ ID NO: 716020 - DNA, 22 bp, Homo sapiens
ccagtctcctcactctgtccct

SEQ ID NO: 716021 - DNA, 13 bp, Homo sapiens
ccagtctcctccc

SEQ ID NO: 716022 - DNA, 16 bp, Homo sapiens
ccagtctctcttaaag

SEQ ID NO: 716023 - DNA, 20 bp, Homo sapiens
ccagtctgaagtttcattta

SEQ ID NO: 716024 - DNA, 21 bp, Homo sapiens
ccagtctgccttcccccaacc

SEQ ID NO: 716025 - DNA, 16 bp, Homo sapiens
ccagtctgctgccctc

SEQ ID NO: 716026 - DNA, 18 bp, Homo sapiens
ccagtctgctgccctcca

SEQ ID NO: 716027 - DNA, 18 bp, Homo sapiens
ccagtctgggctgccggg

SEQ ID NO: 716028 - DNA, 17 bp, Homo sapiens
ccagtctgggtctgggt

SEQ ID NO: 716029 - DNA, 14 bp, Homo sapiens
ccagtctgtctact

SEQ ID NO: 716030 - DNA, 15 bp, Homo sapiens
ccagtctgtctactg

SEQ ID NO: 716031 - DNA, 13 bp, Homo sapiens
ccagtctgtggat

SEQ ID NO: 716032 - DNA, 17 bp, Homo sapiens
ccagtcttcctgacact

SEQ ID NO: 716033 - DNA, 17 bp, Homo sapiens
ccagtcttccttgtctc

SEQ ID NO: 716034 - DNA, 13 bp, Homo sapiens
ccagtcttttgtc

SEQ ID NO: 716035 - DNA, 15 bp, Homo sapiens
ccagtcttttgtcct

SEQ ID NO: 716036 - DNA, 14 bp, Homo sapiens
ccagtctttttaaa

SEQ ID NO: 716037 - DNA, 15 bp, Homo sapiens
ccagtgaacattccc

SEQ ID NO: 716038 - DNA, 21 bp, Homo sapiens
ccagtgaacattcccagccca

SEQ ID NO: 716039 - DNA, 22 bp, Homo sapiens
ccagtgaacattcccagcccag

SEQ ID NO: 716040 - DNA, 15 bp, Homo sapiens
ccagtgaaccaaaga

SEQ ID NO: 716041 - DNA, 14 bp, Homo sapiens
ccagtgaactcctg

SEQ ID NO: 716042 - DNA, 22 bp, Homo sapiens
ccagtgaactcctgccaggcac

SEQ ID NO: 716043 - DNA, 16 bp, Homo sapiens
ccagtgaatctgtttc

SEQ ID NO: 716044 - DNA, 22 bp, Homo sapiens
ccagtgacaaagactcctctgg

SEQ ID NO: 716045 - DNA, 23 bp, Homo sapiens
ccagtgacaaagactcctctggg

SEQ ID NO: 716046 - DNA, 12 bp, Homo sapiens
ccagtgacagct

SEQ ID NO: 716047 - DNA, 22 bp, Homo sapiens
ccagtgacctgctgggtaaact

SEQ ID NO: 716048 - DNA, 17 bp, Homo sapiens
ccagtgacttgttctga

SEQ ID NO: 716049 - DNA, 20 bp, Homo sapiens
ccagtgagaactctctccct

SEQ ID NO: 716050 - DNA, 21 bp, Homo sapiens
ccagtgagaagctgaggccta

SEQ ID NO: 716051 - DNA, 19 bp, Homo sapiens
ccagtgagactgccccacg

SEQ ID NO: 716052 - DNA, 17 bp, Homo sapiens
ccagtgaggatgacagt

SEQ ID NO: 716053 - DNA, 15 bp, Homo sapiens
ccagtgagggctggg

SEQ ID NO: 716054 - DNA, 20 bp, Homo sapiens
ccagtgagtgtaaataattt

SEQ ID NO: 716055 - DNA, 14 bp, Homo sapiens
ccagtgatgatgtt

SEQ ID NO: 716056 - DNA, 15 bp, Homo sapiens
ccagtgcaacagcac

SEQ ID NO: 716057 - DNA, 21 bp, Homo sapiens
ccagtgcactccggtcccaaa

SEQ ID NO: 716058 - DNA, 13 bp, Homo sapiens
ccagtgcagccac

SEQ ID NO: 716059 - DNA, 16 bp, Homo sapiens
ccagtgcagccactgg

SEQ ID NO: 716060 - DNA, 15 bp, Homo sapiens
ccagtgcagggctgg

SEQ ID NO: 716061 - DNA, 11 bp, Homo sapiens
ccagtgcagtc

SEQ ID NO: 716062 - DNA, 15 bp, Homo sapiens
ccagtgccagctcca

SEQ ID NO: 716063 - DNA, 17 bp, Homo sapiens
ccagtgccagctccagt

SEQ ID NO: 716064 - DNA, 23 bp, Homo sapiens
ccagtgccagggtgggctgggga

SEQ ID NO: 716065 - DNA, 15 bp, Homo sapiens
ccagtgccgctcctg

SEQ ID NO: 716066 - DNA, 19 bp, Homo sapiens
ccagtgccgctcctgcttc

SEQ ID NO: 716067 - DNA, 20 bp, Homo sapiens
ccagtgccgctcctgcttcc

SEQ ID NO: 716068 - DNA, 14 bp, Homo sapiens
ccagtgcctgccac

SEQ ID NO: 716069 - DNA, 17 bp, Homo sapiens
ccagtgcctgccactct

SEQ ID NO: 716070 - DNA, 18 bp, Homo sapiens
ccagtgcctgccactctc

SEQ ID NO: 716071 - DNA, 17 bp, Homo sapiens
ccagtgccttacctcct

SEQ ID NO: 716072 - DNA, 18 bp, Homo sapiens
ccagtgccttacctcctg

SEQ ID NO: 716073 - DNA, 21 bp, Homo sapiens
ccagtgccttacctcctgccc

SEQ ID NO: 716074 - DNA, 22 bp, Homo sapiens
ccagtgccttacctcctgccca

SEQ ID NO: 716075 - DNA, 23 bp, Homo sapiens
ccagtgcggacccttcccagccc

SEQ ID NO: 716076 - DNA, 17 bp, Homo sapiens
ccagtgctctgcctcag

SEQ ID NO: 716077 - DNA, 17 bp, Homo sapiens
ccagtgctgccatgcca

SEQ ID NO: 716078 - DNA, 20 bp, Homo sapiens
ccagtgctgccatgccactg

SEQ ID NO: 716079 - DNA, 13 bp, Homo sapiens
ccagtgctgctgt

SEQ ID NO: 716080 - DNA, 15 bp, Homo sapiens
ccagtgctgcttctt

SEQ ID NO: 716081 - DNA, 13 bp, Homo sapiens
ccagtgctggaag

SEQ ID NO: 716082 - DNA, 18 bp, Homo sapiens
ccagtggaagttcttcaa

SEQ ID NO: 716083 - DNA, 19 bp, Homo sapiens
ccagtggaagttcttcaag

SEQ ID NO: 716084 - DNA, 15 bp, Homo sapiens
ccagtggacctagcc

SEQ ID NO: 716085 - DNA, 14 bp, Homo sapiens
ccagtggattccca

SEQ ID NO: 716086 - DNA, 15 bp, Homo sapiens
ccagtggcactgaag

SEQ ID NO: 716087 - DNA, 20 bp, Homo sapiens
ccagtggcccccgggcctgc

SEQ ID NO: 716088 - DNA, 21 bp, Homo sapiens
ccagtggcccccgggcctgca

SEQ ID NO: 716089 - DNA, 22 bp, Homo sapiens
ccagtggcccccgggcctgcac

SEQ ID NO: 716090 - DNA, 17 bp, Homo sapiens
ccagtggcctcaaccct

SEQ ID NO: 716091 - DNA, 17 bp, Homo sapiens
ccagtgggacagaggag

SEQ ID NO: 716092 - DNA, 16 bp, Homo sapiens
ccagtgggagatgtta

SEQ ID NO: 716093 - DNA, 14 bp, Homo sapiens
ccagtgggaggggc

SEQ ID NO: 716094 - DNA, 17 bp, Homo sapiens
ccagtgggaggggcagg

SEQ ID NO: 716095 - DNA, 18 bp, Homo sapiens
ccagtgggaggggcaggc

SEQ ID NO: 716096 - DNA, 21 bp, Homo sapiens
ccagtgggaggggcaggctga

SEQ ID NO: 716097 - DNA, 12 bp, Homo sapiens
ccagtgggctgt

SEQ ID NO: 716098 - DNA, 14 bp, Homo sapiens
ccagtggggacagg

SEQ ID NO: 716099 - DNA, 18 bp, Homo sapiens
ccagtggggacagggagg

SEQ ID NO: 716100 - DNA, 14 bp, Homo sapiens
ccagtggggcctgt

SEQ ID NO: 716101 - DNA, 18 bp, Homo sapiens
ccagtggtctggaaacag

SEQ ID NO: 716102 - DNA, 22 bp, Homo sapiens
ccagtgtagcatcttcctctgc

SEQ ID NO: 716103 - DNA, 22 bp, Homo sapiens
ccagtgtcaagttgtgcttgtt

SEQ ID NO: 716104 - DNA, 22 bp, Homo sapiens
ccagtgtcccctccactgtcac

SEQ ID NO: 716105 - DNA, 23 bp, Homo sapiens
ccagtgtgcacgcctgcaggctg

SEQ ID NO: 716106 - DNA, 17 bp, Homo sapiens
ccagtgtgcccaaaagc

SEQ ID NO: 716107 - DNA, 19 bp, Homo sapiens
ccagtgtgcccaaaagcca

SEQ ID NO: 716108 - DNA, 12 bp, Homo sapiens
ccagtgtggaac

SEQ ID NO: 716109 - DNA, 22 bp, Homo sapiens
ccagtgttcctgaagctgctgt

SEQ ID NO: 716110 - DNA, 18 bp, Homo sapiens
ccagtgttctatgaacaa

SEQ ID NO: 716111 - DNA, 23 bp, Homo sapiens
ccagtgttggctgtgtgacagaa

SEQ ID NO: 716112 - DNA, 15 bp, Homo sapiens
ccagtgttgtttgta

SEQ ID NO: 716113 - DNA, 21 bp, Homo sapiens
ccagtgttgtttgtaaataag

SEQ ID NO: 716114 - DNA, 13 bp, Homo sapiens
ccagtgtttaaaa

SEQ ID NO: 716115 - DNA, 13 bp, Homo sapiens
ccagttaaggaaa

SEQ ID NO: 716116 - DNA, 22 bp, Homo sapiens
ccagttaatactccagagacag

SEQ ID NO: 716117 - DNA, 18 bp, Homo sapiens
ccagttaatttttccaac

SEQ ID NO: 716118 - DNA, 17 bp, Homo sapiens
ccagttatgtgaatgat

SEQ ID NO: 716119 - DNA, 19 bp, Homo sapiens
ccagttcaatctcccgctg

SEQ ID NO: 716120 - DNA, 19 bp, Homo sapiens
ccagttcatcaccatttcc

SEQ ID NO: 716121 - DNA, 12 bp, Homo sapiens
ccagttcatctt

SEQ ID NO: 716122 - DNA, 13 bp, Homo sapiens
ccagttcctatga

SEQ ID NO: 716123 - DNA, 15 bp, Homo sapiens
ccagttcctcttttg

SEQ ID NO: 716124 - DNA, 12 bp, Homo sapiens
ccagttcctgct

SEQ ID NO: 716125 - DNA, 16 bp, Homo sapiens
ccagttcctgctctct

SEQ ID NO: 716126 - DNA, 22 bp, Homo sapiens
ccagttcctgctctctgctcat

SEQ ID NO: 716127 - DNA, 11 bp, Homo sapiens
ccagttcctgt

SEQ ID NO: 716128 - DNA, 12 bp, Homo sapiens
ccagttcctgta

SEQ ID NO: 716129 - DNA, 18 bp, Homo sapiens
ccatgcaggaagaggccc

SEQ ID NO: 716130 - DNA, 21 bp, Homo sapiens
ccatgcaggaagaggcccact

SEQ ID NO: 716131 - DNA, 14 bp, Homo sapiens
ccatgcaggaggtg

SEQ ID NO: 716132 - DNA, 19 bp, Homo sapiens
ccatgcagggggctcctgg

SEQ ID NO: 716133 - DNA, 23 bp, Homo sapiens
ccatgcaggtggtgtcgggccct

SEQ ID NO: 716134 - DNA, 18 bp, Homo sapiens
ccatgccaataaagtgat

SEQ ID NO: 716135 - DNA, 12 bp, Homo sapiens
ccatgccactgc

SEQ ID NO: 716136 - DNA, 17 bp, Homo sapiens
ccatgccactgccaggc

SEQ ID NO: 716137 - DNA, 20 bp, Homo sapiens
ccatgccactgccaggcacc

SEQ ID NO: 716138 - DNA, 20 bp, Homo sapiens
ccatgccagacccactgaaa

SEQ ID NO: 716139 - DNA, 14 bp, Homo sapiens
ccatgccagagagg

SEQ ID NO: 716140 - DNA, 20 bp, Homo sapiens
ccatgccagattctgcctct

SEQ ID NO: 716141 - DNA, 23 bp, Homo sapiens
ccatgccagattctgcctctctg

SEQ ID NO: 716142 - DNA, 12 bp, Homo sapiens
ccatgccaggct

SEQ ID NO: 716143 - DNA, 13 bp, Homo sapiens
ccatgcccacctg

SEQ ID NO: 716144 - DNA, 18 bp, Homo sapiens
ccatgcccacctgcccat

SEQ ID NO: 716145 - DNA, 17 bp, Homo sapiens
ccatgccccacccccct

SEQ ID NO: 716146 - DNA, 20 bp, Homo sapiens
ccatgccccacccccctcct

SEQ ID NO: 716147 - DNA, 17 bp, Homo sapiens
ccatgccccagctctgg

SEQ ID NO: 716148 - DNA, 21 bp, Homo sapiens
ccatgccccagctctggatga

SEQ ID NO: 716149 - DNA, 13 bp, Homo sapiens
ccatgccccagtc

SEQ ID NO: 716150 - DNA, 13 bp, Homo sapiens
ccatgcccccttc

SEQ ID NO: 716151 - DNA, 14 bp, Homo sapiens
ccatgcccccttcg

SEQ ID NO: 716152 - DNA, 18 bp, Homo sapiens
ccatgcccccttcgctcc

SEQ ID NO: 716153 - DNA, 19 bp, Homo sapiens
ccatgcccccttcgctcct

SEQ ID NO: 716154 - DNA, 15 bp, Homo sapiens
ccatgccctagaccc

SEQ ID NO: 716155 - DNA, 13 bp, Homo sapiens
ccatgccctggga

SEQ ID NO: 716156 - DNA, 22 bp, Homo sapiens
ccatgccctgggatgcctcacc

SEQ ID NO: 716157 - DNA, 13 bp, Homo sapiens
ccatgcctcatgc

SEQ ID NO: 716158 - DNA, 14 bp, Homo sapiens
ccatgcctcatgcc

SEQ ID NO: 716159 - DNA, 18 bp, Homo sapiens
ccatgcctcatgccacac

SEQ ID NO: 716160 - DNA, 22 bp, Homo sapiens
ccatgcctccctgggccacctc

SEQ ID NO: 716161 - DNA, 17 bp, Homo sapiens
ccatgcctgagggtgga

SEQ ID NO: 716162 - DNA, 19 bp, Homo sapiens
ccatgcctggtcccaagac

SEQ ID NO: 716163 - DNA, 15 bp, Homo sapiens
ccatgcctgtctctg

SEQ ID NO: 716164 - DNA, 16 bp, Homo sapiens
ccatgccttaaaccta

SEQ ID NO: 716165 - DNA, 16 bp, Homo sapiens
ccatgcgctcagggcc

SEQ ID NO: 716166 - DNA, 22 bp, Homo sapiens
ccatgcgctcagggccatgctg

SEQ ID NO: 716167 - DNA, 20 bp, Homo sapiens
ccatgcgtgtttctgactct

SEQ ID NO: 716168 - DNA, 22 bp, Homo sapiens
ccatgctcaacccccctcccag

SEQ ID NO: 716169 - DNA, 20 bp, Homo sapiens
ccatgctcatctgctggtcc

SEQ ID NO: 716170 - DNA, 15 bp, Homo sapiens
ccatgctcctcacct

SEQ ID NO: 716171 - DNA, 16 bp, Homo sapiens
ccatgctcctcacctg

SEQ ID NO: 716172 - DNA, 15 bp, Homo sapiens
ccatgctcctggccc

SEQ ID NO: 716173 - DNA, 18 bp, Homo sapiens
ccatgctcctggcccact

SEQ ID NO: 716174 - DNA, 15 bp, Homo sapiens
ccatgctctgcccca

SEQ ID NO: 716175 - DNA, 19 bp, Homo sapiens
ccatgctctgccccaagcc

SEQ ID NO: 716176 - DNA, 16 bp, Homo sapiens
ccatgctgaggcctgg

SEQ ID NO: 716177 - DNA, 18 bp, Homo sapiens
ccatgctgaggcctgggc

SEQ ID NO: 716178 - DNA, 20 bp, Homo sapiens
ccatgctgcaaaggagaagc

SEQ ID NO: 716179 - DNA, 19 bp, Homo sapiens
ccatgctgccttcagggag

SEQ ID NO: 716180 - DNA, 20 bp, Homo sapiens
ccatgctgctttttggcaca

SEQ ID NO: 716181 - DNA, 21 bp, Homo sapiens
ccatgctggcggcgcagaggg

SEQ ID NO: 716182 - DNA, 20 bp, Homo sapiens
ccatgctgtgcgcccagggc

SEQ ID NO: 716183 - DNA, 17 bp, Homo sapiens
ccatgcttgcctgaagc

SEQ ID NO: 716184 - DNA, 19 bp, Homo sapiens
ccatgcttgcctgaagctt

SEQ ID NO: 716185 - DNA, 15 bp, Homo sapiens
ccatggaaataaaaa

SEQ ID NO: 716186 - DNA, 14 bp, Homo sapiens
ccatggaaggtgcc

SEQ ID NO: 716187 - DNA, 17 bp, Homo sapiens
ccatggaaggtgccaga

SEQ ID NO: 716188 - DNA, 14 bp, Homo sapiens
ccatggacactcca

SEQ ID NO: 716189 - DNA, 15 bp, Homo sapiens
ccatggacactccag

SEQ ID NO: 716190 - DNA, 17 bp, Homo sapiens
ccatggacactccagtg

SEQ ID NO: 716191 - DNA, 22 bp, Homo sapiens
ccatggacgaatatgaatgtca

SEQ ID NO: 716192 - DNA, 22 bp, Homo sapiens
ccatggatctgatctgtaccat

SEQ ID NO: 716193 - DNA, 23 bp, Homo sapiens
ccatggcaattttgtaaattgac

SEQ ID NO: 716194 - DNA, 21 bp, Homo sapiens
ccatggcaccagccccctgga

SEQ ID NO: 716195 - DNA, 21 bp, Homo sapiens
ccatggccaccccgtgccacc

SEQ ID NO: 716196 - DNA, 12 bp, Homo sapiens
ccatggccccca

SEQ ID NO: 716197 - DNA, 21 bp, Homo sapiens
ccatggcccccaataaaggca

SEQ ID NO: 716198 - DNA, 23 bp, Homo sapiens
ccatggcccccaataaaggcagc

SEQ ID NO: 716199 - DNA, 18 bp, Homo sapiens
ccatggccctgtcccagg

SEQ ID NO: 716200 - DNA, 19 bp, Homo sapiens
ccatggcgtgtccctctcg

SEQ ID NO: 716201 - DNA, 17 bp, Homo sapiens
ccatggctcaggcaagc

SEQ ID NO: 716202 - DNA, 18 bp, Homo sapiens
ccatggctgaagctggag

SEQ ID NO: 716203 - DNA, 20 bp, Homo sapiens
ccatggctgaagctggagca

SEQ ID NO: 716204 - DNA, 17 bp, Homo sapiens
ccatggcttcctgagaa

SEQ ID NO: 716205 - DNA, 19 bp, Homo sapiens
ccatggcttgttctctgga

SEQ ID NO: 716206 - DNA, 17 bp, Homo sapiens
ccatggctttcatcctg

SEQ ID NO: 716207 - DNA, 21 bp, Homo sapiens
ccatggctttcatcctgtgtc

SEQ ID NO: 716208 - DNA, 22 bp, Homo sapiens
ccatggctttcatcctgtgtcc

SEQ ID NO: 716209 - DNA, 17 bp, Homo sapiens
ccatgggaacctcatat

SEQ ID NO: 716210 - DNA, 12 bp, Homo sapiens
ccatgggacctc

SEQ ID NO: 716211 - DNA, 13 bp, Homo sapiens
ccatgggagccag

SEQ ID NO: 716212 - DNA, 21 bp, Homo sapiens
ccatgggagccagctgctttt

SEQ ID NO: 716213 - DNA, 14 bp, Homo sapiens
ccatgggatatgtg

SEQ ID NO: 716214 - DNA, 17 bp, Homo sapiens
ccatgggatatgtggtg

SEQ ID NO: 716215 - DNA, 16 bp, Homo sapiens
ccatgggcacagtggt

SEQ ID NO: 716216 - DNA, 16 bp, Homo sapiens
ccatgggcagagccca

SEQ ID NO: 716217 - DNA, 17 bp, Homo sapiens
ccatgggcagagcccaa

SEQ ID NO: 716218 - DNA, 21 bp, Homo sapiens
ccatgggccaccgcccagctc

SEQ ID NO: 716219 - DNA, 20 bp, Homo sapiens
ccatgggcccgctgcctctt

SEQ ID NO: 716220 - DNA, 15 bp, Homo sapiens
ccatgggcctgctgc

SEQ ID NO: 716221 - DNA, 14 bp, Homo sapiens
ccatgggcctgggc

SEQ ID NO: 716222 - DNA, 15 bp, Homo sapiens
ccatgggcctgggcc

SEQ ID NO: 716223 - DNA, 17 bp, Homo sapiens
ccatgggcctgggcctg

SEQ ID NO: 716224 - DNA, 19 bp, Homo sapiens
ccatgggcctgggcctgct

SEQ ID NO: 716225 - DNA, 11 bp, Homo sapiens
ccatgggcttg

SEQ ID NO: 716226 - DNA, 23 bp, Homo sapiens
ccatggggaaaccctggagccat

SEQ ID NO: 716227 - DNA, 22 bp, Homo sapiens
ccatggggaggagacctttgat

SEQ ID NO: 716228 - DNA, 18 bp, Homo sapiens
ccatggggagggattctg

SEQ ID NO: 716229 - DNA, 20 bp, Homo sapiens
ccatgggggctgtctttgca

SEQ ID NO: 716230 - DNA, 18 bp, Homo sapiens
ccatgggggtgagaccct

SEQ ID NO: 716231 - DNA, 19 bp, Homo sapiens
ccatggggtcggctcctga

SEQ ID NO: 716232 - DNA, 11 bp, Homo sapiens
ccatgggtatg

SEQ ID NO: 716233 - DNA, 16 bp, Homo sapiens
ccatggtactgtagca

SEQ ID NO: 716234 - DNA, 19 bp, Homo sapiens
ccatggtcctgtctgtcct

SEQ ID NO: 716235 - DNA, 20 bp, Homo sapiens
ccatggtcctgtctgtcctt

SEQ ID NO: 716236 - DNA, 17 bp, Homo sapiens
ccatggtgactgccaca

SEQ ID NO: 716237 - DNA, 15 bp, Homo sapiens
ccatggtggagggca

SEQ ID NO: 716238 - DNA, 22 bp, Homo sapiens
ccatggtggagggcacttcagg

SEQ ID NO: 716239 - DNA, 13 bp, Homo sapiens
ccatggtggcctc

SEQ ID NO: 716240 - DNA, 14 bp, Homo sapiens
ccatggttgagaaa

SEQ ID NO: 716241 - DNA, 14 bp, Homo sapiens
ccatggttttggct

SEQ ID NO: 716242 - DNA, 22 bp, Homo sapiens
ccatggttttggctctcccacc

SEQ ID NO: 716243 - DNA, 15 bp, Homo sapiens
ccatgtaagcactct

SEQ ID NO: 716244 - DNA, 21 bp, Homo sapiens
ccatgtaaggttgtgcagggt

SEQ ID NO: 716245 - DNA, 22 bp, Homo sapiens
ccatgtaataagcacttgcctg

SEQ ID NO: 716246 - DNA, 17 bp, Homo sapiens
ccatgtacctcccctgc

SEQ ID NO: 716247 - DNA, 13 bp, Homo sapiens
ccatgtactgtag

SEQ ID NO: 716248 - DNA, 22 bp, Homo sapiens
ccatgtactgtagtttttcttc

SEQ ID NO: 716249 - DNA, 16 bp, Homo sapiens
ccatgtagaaaatttg

SEQ ID NO: 716250 - DNA, 13 bp, Homo sapiens
gattttgaaggaa

SEQ ID NO: 716251 - DNA, 15 bp, Homo sapiens
gattttgctgtatat

SEQ ID NO: 716252 - DNA, 18 bp, Homo sapiens
gattttgctgtatatttg

SEQ ID NO: 716253 - DNA, 16 bp, Homo sapiens
gattttgtaacccaga

SEQ ID NO: 716254 - DNA, 22 bp, Homo sapiens
gattttgtgtcttttaaactgg

SEQ ID NO: 716255 - DNA, 21 bp, Homo sapiens
gattttgttgatacctctgct

SEQ ID NO: 716256 - DNA, 17 bp, Homo sapiens
gatttttaaaaaatatt

SEQ ID NO: 716257 - DNA, 14 bp, Homo sapiens
gatttttaaattat

SEQ ID NO: 716258 - DNA, 13 bp, Homo sapiens
gatttttaagaac

SEQ ID NO: 716259 - DNA, 16 bp, Homo sapiens
gatttttacactaata

SEQ ID NO: 716260 - DNA, 16 bp, Homo sapiens
gatttttccatgtgtg

SEQ ID NO: 716261 - DNA, 15 bp, Homo sapiens
gatttttctcttcat

SEQ ID NO: 716262 - DNA, 22 bp, Homo sapiens
gatttttcttcaggtaacacta

SEQ ID NO: 716263 - DNA, 23 bp, Homo sapiens
gatttttcttcaggtaacactac

SEQ ID NO: 716264 - DNA, 13 bp, Homo sapiens
gatttttctttaa

SEQ ID NO: 716265 - DNA, 18 bp, Homo sapiens
gatttttgatatctcaat

SEQ ID NO: 716266 - DNA, 15 bp, Homo sapiens
gatttttgtcttgtg

SEQ ID NO: 716267 - DNA, 17 bp, Homo sapiens
gattttttaataattta

SEQ ID NO: 716268 - DNA, 22 bp, Homo sapiens
gattttttatgtacaaccctga

SEQ ID NO: 716269 - DNA, 11 bp, Homo sapiens
gattttttcca

SEQ ID NO: 716270 - DNA, 13 bp, Homo sapiens
gattttttccaaa

SEQ ID NO: 716271 - DNA, 14 bp, Homo sapiens
gattttttccaaaa

SEQ ID NO: 716272 - DNA, 22 bp, Homo sapiens
gattttttccattatgttcatc

SEQ ID NO: 716273 - DNA, 19 bp, Homo sapiens
gattttttgcattcctgac

SEQ ID NO: 716274 - DNA, 19 bp, Homo sapiens
gattttttttttaagtgac

SEQ ID NO: 716275 - DNA, 20 bp, Homo sapiens
gatttttttttttttttcct

SEQ ID NO: 716276 - DNA, 16 bp, Homo sapiens
gcaaaaaaaattagcc

SEQ ID NO: 716277 - DNA, 22 bp, Homo sapiens
gcaaaaaactcttaatctgtgt

SEQ ID NO: 716278 - DNA, 23 bp, Homo sapiens
gcaaaaaactcttaatctgtgtg

SEQ ID NO: 716279 - DNA, 18 bp, Homo sapiens
gcaaaaaagaaaaccttt

SEQ ID NO: 716280 - DNA, 21 bp, Homo sapiens
gcaaaaaagtccaattttaat

SEQ ID NO: 716281 - DNA, 11 bp, Homo sapiens
gcaaaaaatac

SEQ ID NO: 716282 - DNA, 21 bp, Homo sapiens
gcaaaaaatactttttctaat

SEQ ID NO: 716283 - DNA, 22 bp, Homo sapiens
gcaaaaaattctttagagatta

SEQ ID NO: 716284 - DNA, 15 bp, Homo sapiens
gcaaaaacatgtatg

SEQ ID NO: 716285 - DNA, 14 bp, Homo sapiens
gcaaaaactgtggg

SEQ ID NO: 716286 - DNA, 15 bp, Homo sapiens
gcaaaaacttccttt

SEQ ID NO: 716287 - DNA, 13 bp, Homo sapiens
gcaaaaagcaaaa

SEQ ID NO: 716288 - DNA, 14 bp, Homo sapiens
gcaaaaaggcagga

SEQ ID NO: 716289 - DNA, 16 bp, Homo sapiens
gcaaaacatcacattc

SEQ ID NO: 716290 - DNA, 16 bp, Homo sapiens
gcaaaacatctctgca

SEQ ID NO: 716291 - DNA, 12 bp, Homo sapiens
gcaaaaccagaa

SEQ ID NO: 716292 - DNA, 18 bp, Homo sapiens
gcaaaaccattgcttcac

SEQ ID NO: 716293 - DNA, 16 bp, Homo sapiens
gcaaaaccttttactg

SEQ ID NO: 716294 - DNA, 17 bp, Homo sapiens
gcaaaaccttttactgg

SEQ ID NO: 716295 - DNA, 15 bp, Homo sapiens
gcaaaagaagaagtt

SEQ ID NO: 716296 - DNA, 16 bp, Homo sapiens
gcaaaagactaattta

SEQ ID NO: 716297 - DNA, 22 bp, Homo sapiens
gcaaaagagctactcagaaatg

SEQ ID NO: 716298 - DNA, 21 bp, Homo sapiens
gcaaaagcccattgaagaaga

SEQ ID NO: 716299 - DNA, 16 bp, Homo sapiens
gcaaaagcctcagaaa

SEQ ID NO: 716300 - DNA, 13 bp, Homo sapiens
gcaaaaggcctct

SEQ ID NO: 716301 - DNA, 17 bp, Homo sapiens
gcaaaagggcagctgtg

SEQ ID NO: 716302 - DNA, 18 bp, Homo sapiens
gcaaaagggcagctgtga

SEQ ID NO: 716303 - DNA, 19 bp, Homo sapiens
gcaaaagggcagctgtgat

SEQ ID NO: 716304 - DNA, 20 bp, Homo sapiens
gcaaaaggttcactaaagca

SEQ ID NO: 716305 - DNA, 21 bp, Homo sapiens
gcaaaagtacaagggctgaga

SEQ ID NO: 716306 - DNA, 18 bp, Homo sapiens
gcaaaagttctgacttga

SEQ ID NO: 716307 - DNA, 12 bp, Homo sapiens
gcaaaataaaga

SEQ ID NO: 716308 - DNA, 13 bp, Homo sapiens
gcaaaatagcatt

SEQ ID NO: 716309 - DNA, 13 bp, Homo sapiens
gcaaaatatgttt

SEQ ID NO: 716310 - DNA, 21 bp, Homo sapiens
gcaaaatcaacatgactggtg

SEQ ID NO: 716311 - DNA, 20 bp, Homo sapiens
gcaaaatcaggaaaggctgt

SEQ ID NO: 716312 - DNA, 17 bp, Homo sapiens
gcaaaatcgccataggc

SEQ ID NO: 716313 - DNA, 20 bp, Homo sapiens
gcaaaatcttgttaatgtca

SEQ ID NO: 716314 - DNA, 17 bp, Homo sapiens
gcaaaatgaggaatgta

SEQ ID NO: 716315 - DNA, 15 bp, Homo sapiens
gcaaaattaaatcta

SEQ ID NO: 716316 - DNA, 14 bp, Homo sapiens
gcaaaattcctgtg

SEQ ID NO: 716317 - DNA, 13 bp, Homo sapiens
gcaaaattgcaaa

SEQ ID NO: 716318 - DNA, 17 bp, Homo sapiens
gcaaaattgcaaatctt

SEQ ID NO: 716319 - DNA, 22 bp, Homo sapiens
gcaaaattgttttcacttgtat

SEQ ID NO: 716320 - DNA, 10 bp, Homo sapiens
gcaaaatttc

SEQ ID NO: 716321 - DNA, 13 bp, Homo sapiens
gcaaacaacatta

SEQ ID NO: 716322 - DNA, 14 bp, Homo sapiens
gcaaacaacctgaa

SEQ ID NO: 716323 - DNA, 17 bp, Homo sapiens
gcaaacaacctgaatct

SEQ ID NO: 716324 - DNA, 20 bp, Homo sapiens
gcaaacaacctgaatctttt

SEQ ID NO: 716325 - DNA, 21 bp, Homo sapiens
gcaaacaatcccaatctttct

SEQ ID NO: 716326 - DNA, 17 bp, Homo sapiens
gcaaacacaagaaatca

SEQ ID NO: 716327 - DNA, 14 bp, Homo sapiens
gcaaacactccacc

SEQ ID NO: 716328 - DNA, 15 bp, Homo sapiens
gcaaacactccaccc

SEQ ID NO: 716329 - DNA, 12 bp, Homo sapiens
gcaaacacttaa

SEQ ID NO: 716330 - DNA, 15 bp, Homo sapiens
gcaaacagaacaggg

SEQ ID NO: 716331 - DNA, 16 bp, Homo sapiens
gcaaacagaacagggt

SEQ ID NO: 716332 - DNA, 12 bp, Homo sapiens
gcaaacagctga

SEQ ID NO: 716333 - DNA, 19 bp, Homo sapiens
gcaaacagctgaaagagga

SEQ ID NO: 716334 - DNA, 15 bp, Homo sapiens
gcaaacatcaaataa

SEQ ID NO: 716335 - DNA, 21 bp, Homo sapiens
gcaaacatggggttggctggg

SEQ ID NO: 716336 - DNA, 21 bp, Homo sapiens
gcaaaccaatacagaattgac

SEQ ID NO: 716337 - DNA, 16 bp, Homo sapiens
gcaaaccaatggtgat

SEQ ID NO: 716338 - DNA, 18 bp, Homo sapiens
gcaaaccacactggactc

SEQ ID NO: 716339 - DNA, 20 bp, Homo sapiens
gcaaacccagaggtggatgt

SEQ ID NO: 716340 - DNA, 22 bp, Homo sapiens
gcaaacccagaggtggatgtta

SEQ ID NO: 716341 - DNA, 19 bp, Homo sapiens
gcaaaccctggtggtattt

SEQ ID NO: 716342 - DNA, 23 bp, Homo sapiens
gcaaaccctggtggtattttatt

SEQ ID NO: 716343 - DNA, 19 bp, Homo sapiens
gcaaacctgacccctgctc

SEQ ID NO: 716344 - DNA, 21 bp, Homo sapiens
gcaaaccttcctgggaggaca

SEQ ID NO: 716345 - DNA, 19 bp, Homo sapiens
gcaaactaagcccccgctg

SEQ ID NO: 716346 - DNA, 19 bp, Homo sapiens
gcaaactcactgctcaaga

SEQ ID NO: 716347 - DNA, 14 bp, Homo sapiens
gcaaactctctaaa

SEQ ID NO: 716348 - DNA, 13 bp, Homo sapiens
gcaaactctgctg

SEQ ID NO: 716349 - DNA, 18 bp, Homo sapiens
gcaaagaaggagctgaga

SEQ ID NO: 716350 - DNA, 14 bp, Homo sapiens
gcaaagaattgact

SEQ ID NO: 716351 - DNA, 16 bp, Homo sapiens
gcaaagacaaaagaaa

SEQ ID NO: 716352 - DNA, 18 bp, Homo sapiens
gcaaagacaaaagaaact

SEQ ID NO: 716353 - DNA, 12 bp, Homo sapiens
gcaaagaccacc

SEQ ID NO: 716354 - DNA, 15 bp, Homo sapiens
gcaaagaccacctcc

SEQ ID NO: 716355 - DNA, 12 bp, Homo sapiens
gcaaagactctg

SEQ ID NO: 716356 - DNA, 16 bp, Homo sapiens
gcaaagactctgagcc

SEQ ID NO: 716357 - DNA, 14 bp, Homo sapiens
gcaaagaggggcgc

SEQ ID NO: 716358 - DNA, 16 bp, Homo sapiens
gcaaagaggggcgctg

SEQ ID NO: 716359 - DNA, 23 bp, Homo sapiens
gcaaagaggggcgctgtcctgcg

SEQ ID NO: 716360 - DNA, 14 bp, Homo sapiens
gcaaagatcaaaat

SEQ ID NO: 716361 - DNA, 16 bp, Homo sapiens
gcaaagatttaatctg

SEQ ID NO: 716362 - DNA, 15 bp, Homo sapiens
gcaaagatttcagta

SEQ ID NO: 716363 - DNA, 23 bp, Homo sapiens
gcaaagcaccagcttctccaggc

SEQ ID NO: 716364 - DNA, 21 bp, Homo sapiens
gcaaagcacccatttcaatgt

SEQ ID NO: 716365 - DNA, 13 bp, Homo sapiens
gcaaagcccagct

SEQ ID NO: 716366 - DNA, 17 bp, Homo sapiens
gcaaagcgcccacccag

SEQ ID NO: 716367 - DNA, 19 bp, Homo sapiens
gcaaagcgcccacccaggt

SEQ ID NO: 716368 - DNA, 16 bp, Homo sapiens
gcaaagctacaggact

SEQ ID NO: 716369 - DNA, 15 bp, Homo sapiens
gcaaaggaaggtgga

SEQ ID NO: 716370 - DNA, 20 bp, Homo sapiens
gcaaaggactgttttttcct

SEQ ID NO: 716371 - DNA, 20 bp, Homo sapiens
gcaaaggagaagcacagctc

SEQ ID NO: 716372 - DNA, 21 bp, Homo sapiens
gcaaaggagacaaagcaggag

SEQ ID NO: 716373 - DNA, 23 bp, Homo sapiens
gcaataatggtcccatccaggca

SEQ ID NO: 716374 - DNA, 13 bp, Homo sapiens
gcaataattgttt

SEQ ID NO: 716375 - DNA, 16 bp, Homo sapiens
gcaataattgtttcca

SEQ ID NO: 716376 - DNA, 13 bp, Homo sapiens
gcaataatttgta

SEQ ID NO: 716377 - DNA, 19 bp, Homo sapiens
gcaataatttgtacaatgg

SEQ ID NO: 716378 - DNA, 13 bp, Homo sapiens
gcaatacatttga

SEQ ID NO: 716379 - DNA, 21 bp, Homo sapiens
gcaatacgggagtgacccagc

SEQ ID NO: 716380 - DNA, 23 bp, Homo sapiens
gcaatacgggagtgacccagcta

SEQ ID NO: 716381 - DNA, 16 bp, Homo sapiens
gcaatactcatcagag

SEQ ID NO: 716382 - DNA, 20 bp, Homo sapiens
gcaatactcatcagagcagc

SEQ ID NO: 716383 - DNA, 15 bp, Homo sapiens
gcaatagagactgta

SEQ ID NO: 716384 - DNA, 17 bp, Homo sapiens
gcaatagagactgtaga

SEQ ID NO: 716385 - DNA, 17 bp, Homo sapiens
gcaatagtgtgttctga

SEQ ID NO: 716386 - DNA, 20 bp, Homo sapiens
gcaatagtgtgttctgatta

SEQ ID NO: 716387 - DNA, 18 bp, Homo sapiens
gcaatatttgaattttaa

SEQ ID NO: 716388 - DNA, 15 bp, Homo sapiens
gcaatcaaatctgct

SEQ ID NO: 716389 - DNA, 19 bp, Homo sapiens
gcaatcaagcaccaggaag

SEQ ID NO: 716390 - DNA, 14 bp, Homo sapiens
gcaatcacaggaaa

SEQ ID NO: 716391 - DNA, 20 bp, Homo sapiens
gcaatcattttatgctgttt

SEQ ID NO: 716392 - DNA, 15 bp, Homo sapiens
gcaatcctcctgcct

SEQ ID NO: 716393 - DNA, 20 bp, Homo sapiens
gcaatcctcctgcctcagcc

SEQ ID NO: 716394 - DNA, 14 bp, Homo sapiens
gcaatcctgtcttt

SEQ ID NO: 716395 - DNA, 23 bp, Homo sapiens
gcaatctcttcattattctctgc

SEQ ID NO: 716396 - DNA, 14 bp, Homo sapiens
gcaatcttctactt

SEQ ID NO: 716397 - DNA, 16 bp, Homo sapiens
gcaatcttggctcact

SEQ ID NO: 716398 - DNA, 18 bp, Homo sapiens
gcaatcttggctcactgc

SEQ ID NO: 716399 - DNA, 13 bp, Homo sapiens
gcaatctttgaaa

SEQ ID NO: 716400 - DNA, 16 bp, Homo sapiens
gcaatgaaaaattctc

SEQ ID NO: 716401 - DNA, 18 bp, Homo sapiens
gcaatgaaaggtactata

SEQ ID NO: 716402 - DNA, 17 bp, Homo sapiens
gcaatgatgtccagaag

SEQ ID NO: 716403 - DNA, 18 bp, Homo sapiens
gcaatgccatcagcccct

SEQ ID NO: 716404 - DNA, 19 bp, Homo sapiens
gcaatgccatcagcccctg

SEQ ID NO: 716405 - DNA, 15 bp, Homo sapiens
gcaatgccatcatct

SEQ ID NO: 716406 - DNA, 16 bp, Homo sapiens
gcaatgctgtactttt

SEQ ID NO: 716407 - DNA, 18 bp, Homo sapiens
gcaatggccagagcctct

SEQ ID NO: 716408 - DNA, 19 bp, Homo sapiens
gcaatgggagctgaggcca

SEQ ID NO: 716409 - DNA, 23 bp, Homo sapiens
gcaatgggcagctatccagtgac

SEQ ID NO: 716410 - DNA, 19 bp, Homo sapiens
gcaatgggggcctccgctt

SEQ ID NO: 716411 - DNA, 19 bp, Homo sapiens
gcaatgggtcactcattaa

SEQ ID NO: 716412 - DNA, 22 bp, Homo sapiens
gcaatggtgtcagtatccaggc

SEQ ID NO: 716413 - DNA, 18 bp, Homo sapiens
gcaatggtttgtgtcaaa

SEQ ID NO: 716414 - DNA, 18 bp, Homo sapiens
gcaatgtcacaacctctc

SEQ ID NO: 716415 - DNA, 19 bp, Homo sapiens
gcaatgtcttaaataaaac

SEQ ID NO: 716416 - DNA, 18 bp, Homo sapiens
gcaatgtgccttgattga

SEQ ID NO: 716417 - DNA, 23 bp, Homo sapiens
gcaatgtggagcagcagccactg

SEQ ID NO: 716418 - DNA, 19 bp, Homo sapiens
gcaatgtggtgacacctcc

SEQ ID NO: 716419 - DNA, 15 bp, Homo sapiens
gcaatgtgttttttc

SEQ ID NO: 716420 - DNA, 15 bp, Homo sapiens
gcaatgtttatttca

SEQ ID NO: 716421 - DNA, 21 bp, Homo sapiens
gcaattaaagtgatactgaaa

SEQ ID NO: 716422 - DNA, 19 bp, Homo sapiens
gcaattaggtttttcctta

SEQ ID NO: 716423 - DNA, 14 bp, Homo sapiens
gcaattcataaaaa

SEQ ID NO: 716424 - DNA, 18 bp, Homo sapiens
gcaattccaagaaaatat

SEQ ID NO: 716425 - DNA, 19 bp, Homo sapiens
gcaattccaagaaaatatc

SEQ ID NO: 716426 - DNA, 15 bp, Homo sapiens
gcaattccgcattta

SEQ ID NO: 716427 - DNA, 23 bp, Homo sapiens
gcaattctcctgcctcagcctcc

SEQ ID NO: 716428 - DNA, 14 bp, Homo sapiens
gcaattctggaagc

SEQ ID NO: 716429 - DNA, 18 bp, Homo sapiens
gcaattgaattaaattag

SEQ ID NO: 716430 - DNA, 13 bp, Homo sapiens
gcaattgccctgt

SEQ ID NO: 716431 - DNA, 14 bp, Homo sapiens
gcaatttagacaaa

SEQ ID NO: 716432 - DNA, 18 bp, Homo sapiens
gcaatttccttttttgtt

SEQ ID NO: 716433 - DNA, 17 bp, Homo sapiens
gcaatttctaattttta

SEQ ID NO: 716434 - DNA, 18 bp, Homo sapiens
gcaatttgtttaaagaat

SEQ ID NO: 716435 - DNA, 18 bp, Homo sapiens
gcaattttaatcccctgc

SEQ ID NO: 716436 - DNA, 13 bp, Homo sapiens
gcaattttagtgt

SEQ ID NO: 716437 - DNA, 20 bp, Homo sapiens
gcaattttagtgtattaatc

SEQ ID NO: 716438 - DNA, 22 bp, Homo sapiens
gcaattttatcagtaatttgac

SEQ ID NO: 716439 - DNA, 17 bp, Homo sapiens
gcaattttctttgtttc

SEQ ID NO: 716440 - DNA, 14 bp, Homo sapiens
gcaattttgtaacg

SEQ ID NO: 716441 - DNA, 12 bp, Homo sapiens
gcaattttgtgg

SEQ ID NO: 716442 - DNA, 14 bp, Homo sapiens
gcaattttgtggtt

SEQ ID NO: 716443 - DNA, 13 bp, Homo sapiens
gcacaaaacccag

SEQ ID NO: 716444 - DNA, 14 bp, Homo sapiens
gcacaaaagcagat

SEQ ID NO: 716445 - DNA, 15 bp, Homo sapiens
gcacaaacattgctg

SEQ ID NO: 716446 - DNA, 21 bp, Homo sapiens
gcacaaacattgctgcctttg

SEQ ID NO: 716447 - DNA, 15 bp, Homo sapiens
gcacaaactgcagct

SEQ ID NO: 716448 - DNA, 17 bp, Homo sapiens
gcacaaactgcagctgt

SEQ ID NO: 716449 - DNA, 20 bp, Homo sapiens
gcacaaacttcagaaacccg

SEQ ID NO: 716450 - DNA, 15 bp, Homo sapiens
gcacaaagttctcag

SEQ ID NO: 716451 - DNA, 18 bp, Homo sapiens
gcacaaagttctcagagc

SEQ ID NO: 716452 - DNA, 15 bp, Homo sapiens
gcacaacagccctgc

SEQ ID NO: 716453 - DNA, 19 bp, Homo sapiens
gcacaacagccctgcctga

SEQ ID NO: 716454 - DNA, 23 bp, Homo sapiens
gcacaaccggtcccttccatgcc

SEQ ID NO: 716455 - DNA, 19 bp, Homo sapiens
gcacaactttaagaggaca

SEQ ID NO: 716456 - DNA, 21 bp, Homo sapiens
gcacaagaggaagagagagac

SEQ ID NO: 716457 - DNA, 22 bp, Homo sapiens
gcacaagctcagaatagatctg

SEQ ID NO: 716458 - DNA, 17 bp, Homo sapiens
gcacaataaaaatgttt

SEQ ID NO: 716459 - DNA, 15 bp, Homo sapiens
gcacaatatttcttt

SEQ ID NO: 716460 - DNA, 19 bp, Homo sapiens
gcacaatatttcttttgtt

SEQ ID NO: 716461 - DNA, 21 bp, Homo sapiens
gcacaatcactaaactttatt

SEQ ID NO: 716462 - DNA, 22 bp, Homo sapiens
gcacaatcactaaactttattt

SEQ ID NO: 716463 - DNA, 16 bp, Homo sapiens
gcacaatcagtttatc

SEQ ID NO: 716464 - DNA, 24 bp, Homo sapiens
gcacaatcatggctgattgcagcc

SEQ ID NO: 716465 - DNA, 10 bp, Homo sapiens
gcacaatgaa

SEQ ID NO: 716466 - DNA, 15 bp, Homo sapiens
gcacaatgaatgtat

SEQ ID NO: 716467 - DNA, 14 bp, Homo sapiens
gcacaatgcatgtg

SEQ ID NO: 716468 - DNA, 14 bp, Homo sapiens
gcacaatttgcact

SEQ ID NO: 716469 - DNA, 19 bp, Homo sapiens
gcacaatttgcactaaatc

SEQ ID NO: 716470 - DNA, 21 bp, Homo sapiens
gcacacaaggggcccttggag

SEQ ID NO: 716471 - DNA, 21 bp, Homo sapiens
gcacacacaaacctactgccc

SEQ ID NO: 716472 - DNA, 12 bp, Homo sapiens
gcacacacacaa

SEQ ID NO: 716473 - DNA, 15 bp, Homo sapiens
gcacacacacataca

SEQ ID NO: 716474 - DNA, 15 bp, Homo sapiens
gcacacacagcccct

SEQ ID NO: 716475 - DNA, 14 bp, Homo sapiens
gcacacacagctcc

SEQ ID NO: 716476 - DNA, 13 bp, Homo sapiens
gcacacacatctg

SEQ ID NO: 716477 - DNA, 21 bp, Homo sapiens
gcacacacatctggccctgac

SEQ ID NO: 716478 - DNA, 18 bp, Homo sapiens
gcacacacggttttggca

SEQ ID NO: 716479 - DNA, 15 bp, Homo sapiens
gcacacactcagtgc

SEQ ID NO: 716480 - DNA, 14 bp, Homo sapiens
gcacacactgtgcc

SEQ ID NO: 716481 - DNA, 18 bp, Homo sapiens
gcacacagaatgctcagg

SEQ ID NO: 716482 - DNA, 19 bp, Homo sapiens
gcacacagaatgctcaggg

SEQ ID NO: 716483 - DNA, 19 bp, Homo sapiens
gcacacagacggcctaggg

SEQ ID NO: 716484 - DNA, 20 bp, Homo sapiens
gcacacagacggcctagggg

SEQ ID NO: 716485 - DNA, 15 bp, Homo sapiens
gcacacagcagcccc

SEQ ID NO: 716486 - DNA, 19 bp, Homo sapiens
gcacacagcagccccccag

SEQ ID NO: 716487 - DNA, 20 bp, Homo sapiens
gcacacagcagccccccagc

SEQ ID NO: 716488 - DNA, 18 bp, Homo sapiens
gcacacagctactctccc

SEQ ID NO: 716489 - DNA, 15 bp, Homo sapiens
gcacacagctgagca

SEQ ID NO: 716490 - DNA, 18 bp, Homo sapiens
gcacacagctgagcactt

SEQ ID NO: 716491 - DNA, 13 bp, Homo sapiens
gcacacaggacag

SEQ ID NO: 716492 - DNA, 13 bp, Homo sapiens
gcacacagggccc

SEQ ID NO: 716493 - DNA, 19 bp, Homo sapiens
gcacacagggcccggccac

SEQ ID NO: 716494 - DNA, 20 bp, Homo sapiens
gcacacagggcccggccaca

SEQ ID NO: 716495 - DNA, 23 bp, Homo sapiens
tccacccccatgtggcagcccat

SEQ ID NO: 716496 - DNA, 14 bp, Homo sapiens
tccaccccccactc

SEQ ID NO: 716497 - DNA, 17 bp, Homo sapiens
tccaccccccactcagt

SEQ ID NO: 716498 - DNA, 12 bp, Homo sapiens
tccaccccctcc

SEQ ID NO: 716499 - DNA, 20 bp, Homo sapiens
tccaccccctccctggcctg

SEQ ID NO: 716500 - DNA, 22 bp, Homo sapiens
tccacccctttctagaccaata

SEQ ID NO: 716501 - DNA, 16 bp, Homo sapiens
tccacccgtcctccct

SEQ ID NO: 716502 - DNA, 22 bp, Homo sapiens
tccacccgtcctccctcagcct

SEQ ID NO: 716503 - DNA, 18 bp, Homo sapiens
tccaccctccaccttcca

SEQ ID NO: 716504 - DNA, 22 bp, Homo sapiens
tccaccctcctctagccatccc

SEQ ID NO: 716505 - DNA, 22 bp, Homo sapiens
tccaccctgcattttcctcttg

SEQ ID NO: 716506 - DNA, 13 bp, Homo sapiens
tccaccctgccaa

SEQ ID NO: 716507 - DNA, 17 bp, Homo sapiens
tccaccctgtcccccag

SEQ ID NO: 716508 - DNA, 18 bp, Homo sapiens
tccaccctgtcccccagc

SEQ ID NO: 716509 - DNA, 20 bp, Homo sapiens
tccaccctgtcccccagctc

SEQ ID NO: 716510 - DNA, 20 bp, Homo sapiens
tccacccttggcctgtctca

SEQ ID NO: 716511 - DNA, 14 bp, Homo sapiens
tccaccggcccctg

SEQ ID NO: 716512 - DNA, 17 bp, Homo sapiens
tccacctcagccttgga

SEQ ID NO: 716513 - DNA, 15 bp, Homo sapiens
tccacctcatcactg

SEQ ID NO: 716514 - DNA, 19 bp, Homo sapiens
tccacctcatcactggact

SEQ ID NO: 716515 - DNA, 23 bp, Homo sapiens
tccacctcatggattgccacagc

SEQ ID NO: 716516 - DNA, 22 bp, Homo sapiens
tccacctccaccacatctgcca

SEQ ID NO: 716517 - DNA, 18 bp, Homo sapiens
tccacctgagaccctggg

SEQ ID NO: 716518 - DNA, 13 bp, Homo sapiens
tccacctgccttg

SEQ ID NO: 716519 - DNA, 18 bp, Homo sapiens
tccacctgccttggcctc

SEQ ID NO: 716520 - DNA, 21 bp, Homo sapiens
tccacctgccttggcctccca

SEQ ID NO: 716521 - DNA, 13 bp, Homo sapiens
tccacctggcccc

SEQ ID NO: 716522 - DNA, 17 bp, Homo sapiens
tccacctgtctcagcct

SEQ ID NO: 716523 - DNA, 20 bp, Homo sapiens
tccacctgtctcagcctccc

SEQ ID NO: 716524 - DNA, 22 bp, Homo sapiens
tccaccttaaattaaacaattt

SEQ ID NO: 716525 - DNA, 19 bp, Homo sapiens
tccaccttcccatgccctg

SEQ ID NO: 716526 - DNA, 15 bp, Homo sapiens
tccaccttgctcttc

SEQ ID NO: 716527 - DNA, 21 bp, Homo sapiens
tccaccttgctcttctttctg

SEQ ID NO: 716528 - DNA, 15 bp, Homo sapiens
tccacgactgtctcc

SEQ ID NO: 716529 - DNA, 16 bp, Homo sapiens
tccacgactgtctcca

SEQ ID NO: 716530 - DNA, 18 bp, Homo sapiens
tccacgactgtctccatg

SEQ ID NO: 716531 - DNA, 22 bp, Homo sapiens
tccacgagctgtttactaggga

SEQ ID NO: 716532 - DNA, 14 bp, Homo sapiens
tccacgcagcaccc

SEQ ID NO: 716533 - DNA, 14 bp, Homo sapiens
tccacgcctcctgg

SEQ ID NO: 716534 - DNA, 18 bp, Homo sapiens
tccacgcctcctggccag

SEQ ID NO: 716535 - DNA, 12 bp, Homo sapiens
tccacgctgtct

SEQ ID NO: 716536 - DNA, 15 bp, Homo sapiens
tccacgctgtctcca

SEQ ID NO: 716537 - DNA, 18 bp, Homo sapiens
tccacgctgtctccagac

SEQ ID NO: 716538 - DNA, 19 bp, Homo sapiens
tccacgctgtctccagacc

SEQ ID NO: 716539 - DNA, 17 bp, Homo sapiens
tccacggaaacagaact

SEQ ID NO: 716540 - DNA, 20 bp, Homo sapiens
tccacggagccactcctctg

SEQ ID NO: 716541 - DNA, 22 bp, Homo sapiens
tccacggcatcgcatccgtcct

SEQ ID NO: 716542 - DNA, 19 bp, Homo sapiens
tccacggtccgcggcctgc

SEQ ID NO: 716543 - DNA, 16 bp, Homo sapiens
tccacggtctgttctt

SEQ ID NO: 716544 - DNA, 16 bp, Homo sapiens
tccacggtgcgtggct

SEQ ID NO: 716545 - DNA, 20 bp, Homo sapiens
tccacggtgcgtggctgtgg

SEQ ID NO: 716546 - DNA, 18 bp, Homo sapiens
tccacgtccccctggggc

SEQ ID NO: 716547 - DNA, 14 bp, Homo sapiens
tccacgtctttcct

SEQ ID NO: 716548 - DNA, 15 bp, Homo sapiens
tccacgtctttcctg

SEQ ID NO: 716549 - DNA, 13 bp, Homo sapiens
tccacgtggcctc

SEQ ID NO: 716550 - DNA, 20 bp, Homo sapiens
tccacgttctgctcatcatt

SEQ ID NO: 716551 - DNA, 17 bp, Homo sapiens
tccactaaaaatattgt

SEQ ID NO: 716552 - DNA, 15 bp, Homo sapiens
tccactacacctggc

SEQ ID NO: 716553 - DNA, 16 bp, Homo sapiens
tccactacacctggct

SEQ ID NO: 716554 - DNA, 18 bp, Homo sapiens
tccactcaaaatatgtca

SEQ ID NO: 716555 - DNA, 13 bp, Homo sapiens
tccactcactcca

SEQ ID NO: 716556 - DNA, 17 bp, Homo sapiens
tccactccacctccacc

SEQ ID NO: 716557 - DNA, 16 bp, Homo sapiens
tccactccatatttat

SEQ ID NO: 716558 - DNA, 23 bp, Homo sapiens
tccactccatatttatttaaaca

SEQ ID NO: 716559 - DNA, 17 bp, Homo sapiens
tccactcccccacctga

SEQ ID NO: 716560 - DNA, 16 bp, Homo sapiens
tccactccctgctcca

SEQ ID NO: 716561 - DNA, 12 bp, Homo sapiens
tccactcctcca

SEQ ID NO: 716562 - DNA, 21 bp, Homo sapiens
tccactcctcctcactaaaaa

SEQ ID NO: 716563 - DNA, 12 bp, Homo sapiens
tccactccttct

SEQ ID NO: 716564 - DNA, 15 bp, Homo sapiens
tccactccttctctc

SEQ ID NO: 716565 - DNA, 18 bp, Homo sapiens
tccactcgacccagaatg

SEQ ID NO: 716566 - DNA, 19 bp, Homo sapiens
tccactcgatgatgcttct

SEQ ID NO: 716567 - DNA, 18 bp, Homo sapiens
tccactctaccctcccac

SEQ ID NO: 716568 - DNA, 21 bp, Homo sapiens
tccactctaccctcccacccc

SEQ ID NO: 716569 - DNA, 23 bp, Homo sapiens
tccactctaccctcccaccccct

SEQ ID NO: 716570 - DNA, 19 bp, Homo sapiens
tccactctagttctagatg

SEQ ID NO: 716571 - DNA, 23 bp, Homo sapiens
tccactctccttcgtgtctctcc

SEQ ID NO: 716572 - DNA, 12 bp, Homo sapiens
tccactctgatt

SEQ ID NO: 716573 - DNA, 20 bp, Homo sapiens
tccactctgcttctctgact

SEQ ID NO: 716574 - DNA, 21 bp, Homo sapiens
tccactctgcttctctgactt

SEQ ID NO: 716575 - DNA, 19 bp, Homo sapiens
tccactctgtatctatgca

SEQ ID NO: 716576 - DNA, 12 bp, Homo sapiens
tccactcttctc

SEQ ID NO: 716577 - DNA, 19 bp, Homo sapiens
tccactgaaaatttaacag

SEQ ID NO: 716578 - DNA, 14 bp, Homo sapiens
tccactgaacaaaa

SEQ ID NO: 716579 - DNA, 13 bp, Homo sapiens
tccactgagctcc

SEQ ID NO: 716580 - DNA, 19 bp, Homo sapiens
tccactgccctggcagcag

SEQ ID NO: 716581 - DNA, 20 bp, Homo sapiens
tccactgccctggcagcagc

SEQ ID NO: 716582 - DNA, 15 bp, Homo sapiens
tccactgcgcttact

SEQ ID NO: 716583 - DNA, 12 bp, Homo sapiens
tccactgctgga

SEQ ID NO: 716584 - DNA, 21 bp, Homo sapiens
tccactggggaatgctcccag

SEQ ID NO: 716585 - DNA, 20 bp, Homo sapiens
tccactgggtgtaaacacat

SEQ ID NO: 716586 - DNA, 12 bp, Homo sapiens
tccactgtagct

SEQ ID NO: 716587 - DNA, 13 bp, Homo sapiens
tccactgtagcta

SEQ ID NO: 716588 - DNA, 18 bp, Homo sapiens
tccactgtatatttttta

SEQ ID NO: 716589 - DNA, 12 bp, Homo sapiens
tccactgtcacc

SEQ ID NO: 716590 - DNA, 17 bp, Homo sapiens
tccactgtcaccctcca

SEQ ID NO: 716591 - DNA, 19 bp, Homo sapiens
tccactgtcaccctccacc

SEQ ID NO: 716592 - DNA, 13 bp, Homo sapiens
tccactgtggcaa

SEQ ID NO: 716593 - DNA, 23 bp, Homo sapiens
tccactgttgagccccagtgctg

SEQ ID NO: 716594 - DNA, 14 bp, Homo sapiens
tccacttcttcctt

SEQ ID NO: 716595 - DNA, 18 bp, Homo sapiens
tccacttcttcctttctc

SEQ ID NO: 716596 - DNA, 19 bp, Homo sapiens
tccacttcttggttcctgg

SEQ ID NO: 716597 - DNA, 22 bp, Homo sapiens
tccacttcttggttcctgggat

SEQ ID NO: 716598 - DNA, 22 bp, Homo sapiens
tccacttgccctgttctcttca

SEQ ID NO: 716599 - DNA, 20 bp, Homo sapiens
tccactttgttggaaagcag

SEQ ID NO: 716600 - DNA, 22 bp, Homo sapiens
tccactttgttggcccttccag

SEQ ID NO: 716601 - DNA, 18 bp, Homo sapiens
tccactttgtttcgtggg

SEQ ID NO: 716602 - DNA, 19 bp, Homo sapiens
tccactttgtttcgtgggg

SEQ ID NO: 716603 - DNA, 23 bp, Homo sapiens
tccactttgtttcgtggggaggt

SEQ ID NO: 716604 - DNA, 14 bp, Homo sapiens
tccacttttcttct

SEQ ID NO: 716605 - DNA, 23 bp, Homo sapiens
tccagaaaacctctcctgacccc

SEQ ID NO: 716606 - DNA, 17 bp, Homo sapiens
tccagaaacagctgctt

SEQ ID NO: 716607 - DNA, 18 bp, Homo sapiens
tccagaaacagctgcttc

SEQ ID NO: 716608 - DNA, 23 bp, Homo sapiens
tccagaaaggatatttaagaaaa

SEQ ID NO: 716609 - DNA, 14 bp, Homo sapiens
tccagaaataaaac

SEQ ID NO: 716610 - DNA, 20 bp, Homo sapiens
tccagaaatacctgtctagg

SEQ ID NO: 716611 - DNA, 15 bp, Homo sapiens
tccagaacagccctc

SEQ ID NO: 716612 - DNA, 23 bp, Homo sapiens
tccagaacagccctcggcctccg

SEQ ID NO: 716613 - DNA, 18 bp, Homo sapiens
tccagaagaagagaagct

SEQ ID NO: 716614 - DNA, 22 bp, Homo sapiens
tccagaagaagagaagctgctg

SEQ ID NO: 716615 - DNA, 20 bp, Homo sapiens
tccagaagaatattcaggac

SEQ ID NO: 716616 - DNA, 15 bp, Homo sapiens
tcccacgtctggcca

SEQ ID NO: 716617 - DNA, 17 bp, Homo sapiens
tcccacgtgtcttccac

SEQ ID NO: 716618 - DNA, 16 bp, Homo sapiens
tcccactatggtggga

SEQ ID NO: 716619 - DNA, 21 bp, Homo sapiens
tcccactcaccagccctagct

SEQ ID NO: 716620 - DNA, 15 bp, Homo sapiens
tcccactcccatctc

SEQ ID NO: 716621 - DNA, 19 bp, Homo sapiens
tcccactgcaacttgtgaa

SEQ ID NO: 716622 - DNA, 12 bp, Homo sapiens
tcccactgccag

SEQ ID NO: 716623 - DNA, 13 bp, Homo sapiens
tcccactggaaga

SEQ ID NO: 716624 - DNA, 11 bp, Homo sapiens
tcccactggga

SEQ ID NO: 716625 - DNA, 21 bp, Homo sapiens
tcccactgggactcccagcag

SEQ ID NO: 716626 - DNA, 22 bp, Homo sapiens
tcccactggggtccagggagca

SEQ ID NO: 716627 - DNA, 13 bp, Homo sapiens
tcccactgtatga

SEQ ID NO: 716628 - DNA, 18 bp, Homo sapiens
tcccactgtatgatttat

SEQ ID NO: 716629 - DNA, 14 bp, Homo sapiens
tcccacttcactgt

SEQ ID NO: 716630 - DNA, 18 bp, Homo sapiens
tcccacttcactgtgagg

SEQ ID NO: 716631 - DNA, 17 bp, Homo sapiens
tcccacttcctcctacc

SEQ ID NO: 716632 - DNA, 18 bp, Homo sapiens
tcccacttcctcctacct

SEQ ID NO: 716633 - DNA, 21 bp, Homo sapiens
tcccacttcctcctacctggg

SEQ ID NO: 716634 - DNA, 14 bp, Homo sapiens
tcccacttcctttc

SEQ ID NO: 716635 - DNA, 12 bp, Homo sapiens
tcccacttgtca

SEQ ID NO: 716636 - DNA, 21 bp, Homo sapiens
tcccactttctgttccttcct

SEQ ID NO: 716637 - DNA, 15 bp, Homo sapiens
tcccactttgtctgt

SEQ ID NO: 716638 - DNA, 22 bp, Homo sapiens
tcccactttgtctgtacatact

SEQ ID NO: 716639 - DNA, 19 bp, Homo sapiens
tcccagaaaaactggctct

SEQ ID NO: 716640 - DNA, 20 bp, Homo sapiens
tcccagaaaaactggctctg

SEQ ID NO: 716641 - DNA, 12 bp, Homo sapiens
tcccagaaatta

SEQ ID NO: 716642 - DNA, 16 bp, Homo sapiens
tcccagaatcccagcc

SEQ ID NO: 716643 - DNA, 22 bp, Homo sapiens
tcccagacaggccctccctgtc

SEQ ID NO: 716644 - DNA, 21 bp, Homo sapiens
tcccagacagtggatatgacc

SEQ ID NO: 716645 - DNA, 13 bp, Homo sapiens
tcccagaccagcc

SEQ ID NO: 716646 - DNA, 19 bp, Homo sapiens
tcccagaccttaagacact

SEQ ID NO: 716647 - DNA, 20 bp, Homo sapiens
tcccagaccttaagacactg

SEQ ID NO: 716648 - DNA, 17 bp, Homo sapiens
tcccagagacaggaaaa

SEQ ID NO: 716649 - DNA, 16 bp, Homo sapiens
tcccagagcaaaataa

SEQ ID NO: 716650 - DNA, 18 bp, Homo sapiens
tcccagagcaggaggccc

SEQ ID NO: 716651 - DNA, 12 bp, Homo sapiens
tcccagagccct

SEQ ID NO: 716652 - DNA, 23 bp, Homo sapiens
tcccagaggagccaccagttctc

SEQ ID NO: 716653 - DNA, 14 bp, Homo sapiens
tcccagaggcaggc

SEQ ID NO: 716654 - DNA, 18 bp, Homo sapiens
tcccagaggtccagccca

SEQ ID NO: 716655 - DNA, 17 bp, Homo sapiens
tcccagagtcagaggag

SEQ ID NO: 716656 - DNA, 20 bp, Homo sapiens
tcccagagtcagaggagaag

SEQ ID NO: 716657 - DNA, 22 bp, Homo sapiens
tcccagagtcagaggagaagag

SEQ ID NO: 716658 - DNA, 15 bp, Homo sapiens
tcccagagtgctggg

SEQ ID NO: 716659 - DNA, 20 bp, Homo sapiens
tcccagagtgctgggattac

SEQ ID NO: 716660 - DNA, 15 bp, Homo sapiens
tcccagatgctgtca

SEQ ID NO: 716661 - DNA, 23 bp, Homo sapiens
tcccagcacatgaaaccttattt

SEQ ID NO: 716662 - DNA, 15 bp, Homo sapiens
tcccagcacctgcct

SEQ ID NO: 716663 - DNA, 19 bp, Homo sapiens
tcccagcactgcctcctgt

SEQ ID NO: 716664 - DNA, 22 bp, Homo sapiens
tcccagcactgcctcctgtttt

SEQ ID NO: 716665 - DNA, 23 bp, Homo sapiens
tcccagcactttgggaggctgag

SEQ ID NO: 716666 - DNA, 16 bp, Homo sapiens
tcccagcagagcccac

SEQ ID NO: 716667 - DNA, 21 bp, Homo sapiens
tcccagcaggaatttcttttt

SEQ ID NO: 716668 - DNA, 17 bp, Homo sapiens
tcccagcatccctggag

SEQ ID NO: 716669 - DNA, 13 bp, Homo sapiens
tcccagccacccc

SEQ ID NO: 716670 - DNA, 22 bp, Homo sapiens
tcccagccactcgggaggctga

SEQ ID NO: 716671 - DNA, 12 bp, Homo sapiens
tcccagccccag

SEQ ID NO: 716672 - DNA, 15 bp, Homo sapiens
tcccagccctatgga

SEQ ID NO: 716673 - DNA, 18 bp, Homo sapiens
tcccagccctatggatgt

SEQ ID NO: 716674 - DNA, 12 bp, Homo sapiens
tcccagccctca

SEQ ID NO: 716675 - DNA, 22 bp, Homo sapiens
tcccagccctttgggaggctga

SEQ ID NO: 716676 - DNA, 19 bp, Homo sapiens
tcccagccggccaatggaa

SEQ ID NO: 716677 - DNA, 22 bp, Homo sapiens
tcccagcctgctgagagccccc

SEQ ID NO: 716678 - DNA, 22 bp, Homo sapiens
tcccagcctggggctccctctc

SEQ ID NO: 716679 - DNA, 10 bp, Homo sapiens
tcccagcctt

SEQ ID NO: 716680 - DNA, 18 bp, Homo sapiens
tcccagccttgagatgct

SEQ ID NO: 716681 - DNA, 17 bp, Homo sapiens
tcccagcgagccacagg

SEQ ID NO: 716682 - DNA, 14 bp, Homo sapiens
tcccagctactcag

SEQ ID NO: 716683 - DNA, 19 bp, Homo sapiens
tcccagctactcagaagcc

SEQ ID NO: 716684 - DNA, 20 bp, Homo sapiens
tcccagctactcaggaggct

SEQ ID NO: 716685 - DNA, 18 bp, Homo sapiens
tcccagctacttgggagc

SEQ ID NO: 716686 - DNA, 22 bp, Homo sapiens
tcccagctacttgggagcctga

SEQ ID NO: 716687 - DNA, 10 bp, Homo sapiens
tcccagctcc

SEQ ID NO: 716688 - DNA, 20 bp, Homo sapiens
tcccagctccccccgcccac

SEQ ID NO: 716689 - DNA, 12 bp, Homo sapiens
tcccagctcctt

SEQ ID NO: 716690 - DNA, 15 bp, Homo sapiens
tcccagctcctttct

SEQ ID NO: 716691 - DNA, 20 bp, Homo sapiens
tcccagctcctttctcctgt

SEQ ID NO: 716692 - DNA, 21 bp, Homo sapiens
tcccagctcctttctcctgtg

SEQ ID NO: 716693 - DNA, 21 bp, Homo sapiens
tcccagctctagacaaccctg

SEQ ID NO: 716694 - DNA, 14 bp, Homo sapiens
tcccagctctccct

SEQ ID NO: 716695 - DNA, 16 bp, Homo sapiens
tcccagctctccctct

SEQ ID NO: 716696 - DNA, 19 bp, Homo sapiens
tcccagctctccctctggc

SEQ ID NO: 716697 - DNA, 23 bp, Homo sapiens
tcccagctctccctctggccctg

SEQ ID NO: 716698 - DNA, 10 bp, Homo sapiens
tcccagctgc

SEQ ID NO: 716699 - DNA, 13 bp, Homo sapiens
tcccagctgcact

SEQ ID NO: 716700 - DNA, 15 bp, Homo sapiens
tcccagcttgccccc

SEQ ID NO: 716701 - DNA, 18 bp, Homo sapiens
tcccagcttgtaggagct

SEQ ID NO: 716702 - DNA, 11 bp, Homo sapiens
tcccaggaagc

SEQ ID NO: 716703 - DNA, 18 bp, Homo sapiens
tcccaggaatatcccaaa

SEQ ID NO: 716704 - DNA, 18 bp, Homo sapiens
tcccaggacccctcagct

SEQ ID NO: 716705 - DNA, 23 bp, Homo sapiens
tcccaggaccctccactcactgc

SEQ ID NO: 716706 - DNA, 19 bp, Homo sapiens
tcccaggagatgggtccag

SEQ ID NO: 716707 - DNA, 16 bp, Homo sapiens
tcccaggcatgcagct

SEQ ID NO: 716708 - DNA, 17 bp, Homo sapiens
tcccaggcatgcagctg

SEQ ID NO: 716709 - DNA, 19 bp, Homo sapiens
tcccaggcatgcagctgcc

SEQ ID NO: 716710 - DNA, 22 bp, Homo sapiens
tcccaggcatgcagctgcctgg

SEQ ID NO: 716711 - DNA, 19 bp, Homo sapiens
tcccaggccccctgcatct

SEQ ID NO: 716712 - DNA, 20 bp, Homo sapiens
tcccaggcctttggagggga

SEQ ID NO: 716713 - DNA, 15 bp, Homo sapiens
tcccaggcttcaccc

SEQ ID NO: 716714 - DNA, 18 bp, Homo sapiens
tcccaggcttcaccctga

SEQ ID NO: 716715 - DNA, 22 bp, Homo sapiens
tcccaggcttcaccctgaatgg

SEQ ID NO: 716716 - DNA, 12 bp, Homo sapiens
tcccagggagtg

SEQ ID NO: 716717 - DNA, 15 bp, Homo sapiens
tcccagggagtgagc

SEQ ID NO: 716718 - DNA, 23 bp, Homo sapiens
tcccagggagtgagcagctactg

SEQ ID NO: 716719 - DNA, 21 bp, Homo sapiens
tcccagggccagggccctgca

SEQ ID NO: 716720 - DNA, 23 bp, Homo sapiens
tcccagggccagggccctgcaga

SEQ ID NO: 716721 - DNA, 18 bp, Homo sapiens
tcccagggcctcctgggg

SEQ ID NO: 716722 - DNA, 10 bp, Homo sapiens
tcccagggct

SEQ ID NO: 716723 - DNA, 18 bp, Homo sapiens
tcccaggggaccacacct

SEQ ID NO: 716724 - DNA, 16 bp, Homo sapiens
tcccaggggagccagc

SEQ ID NO: 716725 - DNA, 20 bp, Homo sapiens
tcccaggggagccagctgct

SEQ ID NO: 716726 - DNA, 17 bp, Homo sapiens
tcccaggggtctccctg

SEQ ID NO: 716727 - DNA, 18 bp, Homo sapiens
tcccaggggtctccctgg

SEQ ID NO: 716728 - DNA, 20 bp, Homo sapiens
tcccaggggtctccctggct

SEQ ID NO: 716729 - DNA, 21 bp, Homo sapiens
tcccaggggtctccctggctc

SEQ ID NO: 716730 - DNA, 14 bp, Homo sapiens
tcccagggtcccac

SEQ ID NO: 716731 - DNA, 21 bp, Homo sapiens
tcccagggtcccacccccaac

SEQ ID NO: 716732 - DNA, 17 bp, Homo sapiens
tcccaggtaatttaaat

SEQ ID NO: 716733 - DNA, 18 bp, Homo sapiens
tcccaggtaatttaaatt

SEQ ID NO: 716734 - DNA, 19 bp, Homo sapiens
tcccaggtaatttaaattg

SEQ ID NO: 716735 - DNA, 17 bp, Homo sapiens
tcccaggtaccagctgc

SEQ ID NO: 716736 - DNA, 18 bp, Homo sapiens
tcccaggtaccagctgcg

SEQ ID NO: 716737 - DNA, 16 bp, Homo sapiens
tcccaggttcccccag

SEQ ID NO: 716738 - DNA, 23 bp, Homo sapiens
aaaaagaaaggctgttaaataca

SEQ ID NO: 716739 - DNA, 18 bp, Homo sapiens
aaaaagaagcaacctcag

SEQ ID NO: 716740 - DNA, 17 bp, Homo sapiens
aaaaagaatgaagcctc

SEQ ID NO: 716741 - DNA, 17 bp, Homo sapiens
aaatttaatgctgcctt

SEQ ID NO: 716742 - DNA, 18 bp, Homo sapiens
aaatttaattcatgtttc

SEQ ID NO: 716743 - DNA, 13 bp, Homo sapiens
aaatttagaaact

SEQ ID NO: 716744 - DNA, 12 bp, Homo sapiens
aactacaaatat

SEQ ID NO: 716745 - DNA, 13 bp, Homo sapiens
aactacaaatcaa

SEQ ID NO: 716746 - DNA, 22 bp, Homo sapiens
aactacaaccaagctctctgca

SEQ ID NO: 716747 - DNA, 14 bp, Homo sapiens
aactacagtctaaa

SEQ ID NO: 716748 - DNA, 13 bp, Homo sapiens
aactacctctgga

SEQ ID NO: 716749 - DNA, 15 bp, Homo sapiens
aactacctgagctaa

SEQ ID NO: 716750 - DNA, 19 bp, Homo sapiens
aactacgcttgctcatttt

SEQ ID NO: 716751 - DNA, 17 bp, Homo sapiens
aactactaatagaataa

SEQ ID NO: 716752 - DNA, 17 bp, Homo sapiens
aactactgcctttagaa

SEQ ID NO: 716753 - DNA, 13 bp, Homo sapiens
aactactgtacat

SEQ ID NO: 716754 - DNA, 14 bp, Homo sapiens
aactactgtacatt

SEQ ID NO: 716755 - DNA, 15 bp, Homo sapiens
aactactgtactttg

SEQ ID NO: 716756 - DNA, 13 bp, Homo sapiens
aactactgtgttc

SEQ ID NO: 716757 - DNA, 14 bp, Homo sapiens
aactactgtgttcc

SEQ ID NO: 716758 - DNA, 17 bp, Homo sapiens
aactactgtgttcctgg

SEQ ID NO: 716759 - DNA, 14 bp, Homo sapiens
aactacttcatttt

SEQ ID NO: 716760 - DNA, 15 bp, Homo sapiens
aactacttcattttc

SEQ ID NO: 716761 - DNA, 23 bp, Homo sapiens
aactactttgaaaacaattcagt

SEQ ID NO: 716762 - DNA, 18 bp, Homo sapiens
aactacttttctaaaatc

SEQ ID NO: 716763 - DNA, 15 bp, Homo sapiens
aactactttttatac

SEQ ID NO: 716764 - DNA, 17 bp, Homo sapiens
aactactttttatactc

SEQ ID NO: 716765 - DNA, 20 bp, Homo sapiens
aactagaaggcttctctcca

SEQ ID NO: 716766 - DNA, 19 bp, Homo sapiens
aactagaatttattcaatt

SEQ ID NO: 716767 - DNA, 15 bp, Homo sapiens
aactagatttgtcct

SEQ ID NO: 716768 - DNA, 18 bp, Homo sapiens
aactagccagacaaaatt

SEQ ID NO: 716769 - DNA, 23 bp, Homo sapiens
aactagccagacaaaatttgaga

SEQ ID NO: 716770 - DNA, 14 bp, Homo sapiens
aactagctgggact

SEQ ID NO: 716771 - DNA, 22 bp, Homo sapiens
aactaggtctgatattcaaatg

SEQ ID NO: 716772 - DNA, 14 bp, Homo sapiens
aactatagtaactt

SEQ ID NO: 716773 - DNA, 24 bp, Homo sapiens
aactatatataatcatcaagtaat

SEQ ID NO: 716774 - DNA, 23 bp, Homo sapiens
aactatatgtacagctctcccct

SEQ ID NO: 716775 - DNA, 13 bp, Homo sapiens
aactatattttct

SEQ ID NO: 716776 - DNA, 16 bp, Homo sapiens
aactatattttcttta

SEQ ID NO: 716777 - DNA, 18 bp, Homo sapiens
aactatctcacttccaga

SEQ ID NO: 716778 - DNA, 11 bp, Homo sapiens
aactatcttgg

SEQ ID NO: 716779 - DNA, 16 bp, Homo sapiens
aactatgaacactgtc

SEQ ID NO: 716780 - DNA, 18 bp, Homo sapiens
aactatgatatggtaaaa

SEQ ID NO: 716781 - DNA, 16 bp, Homo sapiens
aactatggttcccaat

SEQ ID NO: 716782 - DNA, 20 bp, Homo sapiens
aactatggttcccaataaaa

SEQ ID NO: 716783 - DNA, 20 bp, Homo sapiens
aactatgtgtttttctcata

SEQ ID NO: 716784 - DNA, 16 bp, Homo sapiens
aactatgttcctaaca

SEQ ID NO: 716785 - DNA, 20 bp, Homo sapiens
aactatgttcctaacaaaat

SEQ ID NO: 716786 - DNA, 21 bp, Homo sapiens
aactatgttcctaacaaaatg

SEQ ID NO: 716787 - DNA, 20 bp, Homo sapiens
aactattaaccttttttgtc

SEQ ID NO: 716788 - DNA, 18 bp, Homo sapiens
aactattatgattattta

SEQ ID NO: 716789 - DNA, 19 bp, Homo sapiens
aactattcattttgcttct

SEQ ID NO: 716790 - DNA, 19 bp, Homo sapiens
aactattctgggggcccga

SEQ ID NO: 716791 - DNA, 16 bp, Homo sapiens
aactattgagccttgc

SEQ ID NO: 716792 - DNA, 16 bp, Homo sapiens
aactattgcatttata

SEQ ID NO: 716793 - DNA, 22 bp, Homo sapiens
aactattgggtgaatatggtgg

SEQ ID NO: 716794 - DNA, 24 bp, Homo sapiens
aactattgtgctcagagacactgt

SEQ ID NO: 716795 - DNA, 20 bp, Homo sapiens
aactatttaaaataaagagg

SEQ ID NO: 716796 - DNA, 18 bp, Homo sapiens
aactatttaaaattggca

SEQ ID NO: 716797 - DNA, 19 bp, Homo sapiens
aactatttaaaattggcac

SEQ ID NO: 716798 - DNA, 17 bp, Homo sapiens
aactattttcaaagact

SEQ ID NO: 716799 - DNA, 16 bp, Homo sapiens
aactattttgttttaa

SEQ ID NO: 716800 - DNA, 20 bp, Homo sapiens
aactattttgttttaatcta

SEQ ID NO: 716801 - DNA, 19 bp, Homo sapiens
aacttccaggtgttactgt

SEQ ID NO: 716802 - DNA, 20 bp, Homo sapiens
aacttcctctgccatgtttt

SEQ ID NO: 716803 - DNA, 12 bp, Homo sapiens
aacttcctgctg

SEQ ID NO: 716804 - DNA, 10 bp, Homo sapiens
aacttccttt

SEQ ID NO: 716805 - DNA, 11 bp, Homo sapiens
aacttccttta

SEQ ID NO: 716806 - DNA, 16 bp, Homo sapiens
aacttctaatatattt

SEQ ID NO: 716807 - DNA, 17 bp, Homo sapiens
aacttctcccacccctt

SEQ ID NO: 716808 - DNA, 14 bp, Homo sapiens
aacttctctcagac

SEQ ID NO: 716809 - DNA, 15 bp, Homo sapiens
aacttctctggaaag

SEQ ID NO: 716810 - DNA, 19 bp, Homo sapiens
aacttctcttgctttctat

SEQ ID NO: 716811 - DNA, 14 bp, Homo sapiens
aacttctgaagact

SEQ ID NO: 716812 - DNA, 18 bp, Homo sapiens
aacttcttagaaaattaa

SEQ ID NO: 716813 - DNA, 17 bp, Homo sapiens
aacttcttatggaattg

SEQ ID NO: 716814 - DNA, 13 bp, Homo sapiens
aacttcttgaaaa

SEQ ID NO: 716815 - DNA, 16 bp, Homo sapiens
aacttgaaaagaaaac

SEQ ID NO: 716816 - DNA, 22 bp, Homo sapiens
aacttgaaaattttttatactg

SEQ ID NO: 716817 - DNA, 12 bp, Homo sapiens
aacttgaaatat

SEQ ID NO: 716818 - DNA, 16 bp, Homo sapiens
aacttgaaatatataa

SEQ ID NO: 716819 - DNA, 18 bp, Homo sapiens
aacttgaaatatataata

SEQ ID NO: 716820 - DNA, 12 bp, Homo sapiens
aacttgaactcc

SEQ ID NO: 716821 - DNA, 14 bp, Homo sapiens
aacttgaagcagtc

SEQ ID NO: 716822 - DNA, 16 bp, Homo sapiens
aacttgactccatttc

SEQ ID NO: 716823 - DNA, 21 bp, Homo sapiens
aacttgactgggtgagaccca

SEQ ID NO: 716824 - DNA, 19 bp, Homo sapiens
aacttgagatctgtataaa

SEQ ID NO: 716825 - DNA, 12 bp, Homo sapiens
aacttgagccca

SEQ ID NO: 716826 - DNA, 22 bp, Homo sapiens
aacttgagcgtgaatctgtatc

SEQ ID NO: 716827 - DNA, 20 bp, Homo sapiens
aacttgagctctgtaactta

SEQ ID NO: 716828 - DNA, 22 bp, Homo sapiens
aacttgagggcccagagcagga

SEQ ID NO: 716829 - DNA, 12 bp, Homo sapiens
aacttgatgttc

SEQ ID NO: 716830 - DNA, 14 bp, Homo sapiens
aacttgatttgcat

SEQ ID NO: 716831 - DNA, 20 bp, Homo sapiens
aacttgctacttatcatttt

SEQ ID NO: 716832 - DNA, 23 bp, Homo sapiens
aacttgctacttatcatttttgt

SEQ ID NO: 716833 - DNA, 20 bp, Homo sapiens
aacttgctgaatttcaggca

SEQ ID NO: 716834 - DNA, 14 bp, Homo sapiens
aacttgctgctgtc

SEQ ID NO: 716835 - DNA, 15 bp, Homo sapiens
aacttgcttaaattt

SEQ ID NO: 716836 - DNA, 18 bp, Homo sapiens
aacttgcttaaatttctt

SEQ ID NO: 716837 - DNA, 14 bp, Homo sapiens
aacttggaatcaag

SEQ ID NO: 716838 - DNA, 19 bp, Homo sapiens
aacttggaatcaaggtaag

SEQ ID NO: 716839 - DNA, 16 bp, Homo sapiens
aacttggccagtttgt

SEQ ID NO: 716840 - DNA, 21 bp, Homo sapiens
aacttggctcgaatctctgtg

SEQ ID NO: 716841 - DNA, 13 bp, Homo sapiens
aacttggggaggc

SEQ ID NO: 716842 - DNA, 15 bp, Homo sapiens
aacttggggaggcaa

SEQ ID NO: 716843 - DNA, 22 bp, Homo sapiens
aacttgggttcttctcagcggg

SEQ ID NO: 716844 - DNA, 17 bp, Homo sapiens
aacttggtgcttattga

SEQ ID NO: 716845 - DNA, 20 bp, Homo sapiens
aacttggtgcttattgatat

SEQ ID NO: 716846 - DNA, 17 bp, Homo sapiens
aacttggttctgcttca

SEQ ID NO: 716847 - DNA, 16 bp, Homo sapiens
aacttggttttgctac

SEQ ID NO: 716848 - DNA, 21 bp, Homo sapiens
aacttggttttgctacataat

SEQ ID NO: 716849 - DNA, 22 bp, Homo sapiens
aacttggttttgctacataatt

SEQ ID NO: 716850 - DNA, 13 bp, Homo sapiens
aacttgtaaaaag

SEQ ID NO: 716851 - DNA, 22 bp, Homo sapiens
aacttgtaaaaagggggctgca

SEQ ID NO: 716852 - DNA, 15 bp, Homo sapiens
aacttgtaaatacac

SEQ ID NO: 716853 - DNA, 18 bp, Homo sapiens
aacttgtaaatgctgtca

SEQ ID NO: 716854 - DNA, 15 bp, Homo sapiens
aacttgtactatgtt

SEQ ID NO: 716855 - DNA, 19 bp, Homo sapiens
aacttgtatattccaccat

SEQ ID NO: 716856 - DNA, 21 bp, Homo sapiens
aacttgtcctatgtcaatttg

SEQ ID NO: 716857 - DNA, 11 bp, Homo sapiens
aacttgtgaac

SEQ ID NO: 716858 - DNA, 20 bp, Homo sapiens
aacttgtgaactccatcatt

SEQ ID NO: 716859 - DNA, 21 bp, Homo sapiens
aacttgtgaactccatcattc

SEQ ID NO: 716860 - DNA, 15 bp, Homo sapiens
aacttgtgctatagt

SEQ ID NO: 716861 - DNA, 15 bp, Homo sapiens
aacttgttattgtga

SEQ ID NO: 716862 - DNA, 17 bp, Homo sapiens
aacttgttattgtgaat

SEQ ID NO: 716863 - DNA, 11 bp, Homo sapiens
aacttgttcat

SEQ ID NO: 716864 - DNA, 15 bp, Homo sapiens
aactttaaaaggcaa

SEQ ID NO: 716865 - DNA, 16 bp, Homo sapiens
aactttaaaaggcaac

SEQ ID NO: 716866 - DNA, 13 bp, Homo sapiens
aactttaaacctg

SEQ ID NO: 716867 - DNA, 18 bp, Homo sapiens
aactttaagtttcaggat

SEQ ID NO: 716868 - DNA, 21 bp, Homo sapiens
aactttaagtttcaggataca

SEQ ID NO: 716869 - DNA, 21 bp, Homo sapiens
aactttaattctctttcaaag

SEQ ID NO: 716870 - DNA, 15 bp, Homo sapiens
aactttaccataaag

SEQ ID NO: 716871 - DNA, 18 bp, Homo sapiens
aactttaccataaagcct

SEQ ID NO: 716872 - DNA, 12 bp, Homo sapiens
aactttaccatg

SEQ ID NO: 716873 - DNA, 20 bp, Homo sapiens
aactttacccaaaaactaaa

SEQ ID NO: 716874 - DNA, 21 bp, Homo sapiens
aactttaccttttttatacat

SEQ ID NO: 716875 - DNA, 16 bp, Homo sapiens
aactttactctgtgtt

SEQ ID NO: 716876 - DNA, 14 bp, Homo sapiens
aactttagacttcc

SEQ ID NO: 716877 - DNA, 16 bp, Homo sapiens
aactttagcatcagaa

SEQ ID NO: 716878 - DNA, 19 bp, Homo sapiens
aactttagggggtgggagg

SEQ ID NO: 716879 - DNA, 20 bp, Homo sapiens
aactttagtttgcctgcagt

SEQ ID NO: 716880 - DNA, 21 bp, Homo sapiens
aactttagtttgcctgcagtt

SEQ ID NO: 716881 - DNA, 15 bp, Homo sapiens
aactttataaagata

SEQ ID NO: 716882 - DNA, 18 bp, Homo sapiens
aactttatacacttggat

SEQ ID NO: 716883 - DNA, 21 bp, Homo sapiens
aactttatcacattatttgca

SEQ ID NO: 716884 - DNA, 15 bp, Homo sapiens
aactttatgtactgc

SEQ ID NO: 716885 - DNA, 21 bp, Homo sapiens
aactttattaaatacaaaact

SEQ ID NO: 716886 - DNA, 13 bp, Homo sapiens
aactttattgcat

SEQ ID NO: 716887 - DNA, 17 bp, Homo sapiens
aactttattgcatatag

SEQ ID NO: 716888 - DNA, 15 bp, Homo sapiens
aactttatttaaatg

SEQ ID NO: 716889 - DNA, 16 bp, Homo sapiens
aactttatttaaatgc

SEQ ID NO: 716890 - DNA, 18 bp, Homo sapiens
aactttatttaaatgcat

SEQ ID NO: 716891 - DNA, 12 bp, Homo sapiens
aactttcagtgg

SEQ ID NO: 716892 - DNA, 14 bp, Homo sapiens
aactttctgctttg

SEQ ID NO: 716893 - DNA, 13 bp, Homo sapiens
aactttgaaagtt

SEQ ID NO: 716894 - DNA, 15 bp, Homo sapiens
aactttgaagttagc

SEQ ID NO: 716895 - DNA, 17 bp, Homo sapiens
aactttgatctctgctt

SEQ ID NO: 716896 - DNA, 16 bp, Homo sapiens
aactttgcaaattatt

SEQ ID NO: 716897 - DNA, 18 bp, Homo sapiens
aactttgcaaattattta

SEQ ID NO: 716898 - DNA, 15 bp, Homo sapiens
aactttggaaccaga

SEQ ID NO: 716899 - DNA, 24 bp, Homo sapiens
aactttggaaccagactcttgcct

SEQ ID NO: 716900 - DNA, 18 bp, Homo sapiens
aactttggagtcccctca

SEQ ID NO: 716901 - DNA, 16 bp, Homo sapiens
aactttgtgcctttga

SEQ ID NO: 716902 - DNA, 15 bp, Homo sapiens
aactttgtggtctaa

SEQ ID NO: 716903 - DNA, 15 bp, Homo sapiens
aacttttaaagctca

SEQ ID NO: 716904 - DNA, 19 bp, Homo sapiens
aacttttacagaatgcatt

SEQ ID NO: 716905 - DNA, 15 bp, Homo sapiens
aacttttataaactt

SEQ ID NO: 716906 - DNA, 19 bp, Homo sapiens
aacttttataaactttacc

SEQ ID NO: 716907 - DNA, 22 bp, Homo sapiens
aacttttcaatgtgattcttct

SEQ ID NO: 716908 - DNA, 18 bp, Homo sapiens
aacttttcccctgtcctg

SEQ ID NO: 716909 - DNA, 13 bp, Homo sapiens
aacttttctcttt

SEQ ID NO: 716910 - DNA, 23 bp, Homo sapiens
aacttttgactaagaattttgtt

SEQ ID NO: 716911 - DNA, 21 bp, Homo sapiens
aacttttggctaacagaaatt

SEQ ID NO: 716912 - DNA, 13 bp, Homo sapiens
aacttttgggagc

SEQ ID NO: 716913 - DNA, 11 bp, Homo sapiens
aacttttgtaa

SEQ ID NO: 716914 - DNA, 14 bp, Homo sapiens
aacttttgtaaata

SEQ ID NO: 716915 - DNA, 17 bp, Homo sapiens
aacttttgtaaattatt

SEQ ID NO: 716916 - DNA, 14 bp, Homo sapiens
aacttttgtaattt

SEQ ID NO: 716917 - DNA, 11 bp, Homo sapiens
aacttttgtac

SEQ ID NO: 716918 - DNA, 13 bp, Homo sapiens
aacttttgtgaat

SEQ ID NO: 716919 - DNA, 23 bp, Homo sapiens
aacttttgtttttttttgtttgt

SEQ ID NO: 716920 - DNA, 14 bp, Homo sapiens
aactttttccagca

SEQ ID NO: 716921 - DNA, 19 bp, Homo sapiens
aacttttttcattttgaaa

SEQ ID NO: 716922 - DNA, 20 bp, Homo sapiens
aacttttttcattttgaaaa

SEQ ID NO: 716923 - DNA, 12 bp, Homo sapiens
aacttttttggt

SEQ ID NO: 716924 - DNA, 19 bp, Homo sapiens
aacttttttgtgtatgtac

SEQ ID NO: 716925 - DNA, 14 bp, Homo sapiens
aactttttttcagt

SEQ ID NO: 716926 - DNA, 15 bp, Homo sapiens
aactttttttcagtt

SEQ ID NO: 716927 - DNA, 18 bp, Homo sapiens
aactgtaaataaaatgtg

SEQ ID NO: 716928 - DNA, 20 bp, Homo sapiens
aactgtaaataaaatgtgta

SEQ ID NO: 716929 - DNA, 17 bp, Homo sapiens
aactgtacagtgtcttt

SEQ ID NO: 716930 - DNA, 14 bp, Homo sapiens
aactgtacattgtg

SEQ ID NO: 716931 - DNA, 18 bp, Homo sapiens
aactgtacatttaaaatt

SEQ ID NO: 716932 - DNA, 15 bp, Homo sapiens
aactgtactgtctgt

SEQ ID NO: 716933 - DNA, 14 bp, Homo sapiens
aactgtagaaatga

SEQ ID NO: 716934 - DNA, 16 bp, Homo sapiens
aactgtagaaatgatg

SEQ ID NO: 716935 - DNA, 17 bp, Homo sapiens
aactgtagcgaccccag

SEQ ID NO: 716936 - DNA, 21 bp, Homo sapiens
aactgtagcgaccccagactg

SEQ ID NO: 716937 - DNA, 17 bp, Homo sapiens
aactgtatcaaatctgt

SEQ ID NO: 716938 - DNA, 19 bp, Homo sapiens
aactgtattctagtggctg

SEQ ID NO: 716939 - DNA, 14 bp, Homo sapiens
aactgtatttcagt

SEQ ID NO: 716940 - DNA, 19 bp, Homo sapiens
aactgtatttttgaagact

SEQ ID NO: 716941 - DNA, 17 bp, Homo sapiens
aactgtcccatccccag

SEQ ID NO: 716942 - DNA, 19 bp, Homo sapiens
aactgtcccatccccaggt

SEQ ID NO: 716943 - DNA, 11 bp, Homo sapiens
aactgtcctgt

SEQ ID NO: 716944 - DNA, 13 bp, Homo sapiens
aactgtcctgtcc

SEQ ID NO: 716945 - DNA, 22 bp, Homo sapiens
aactgtctctcttctcagagtg

SEQ ID NO: 716946 - DNA, 15 bp, Homo sapiens
aactgtcttcctcaa

SEQ ID NO: 716947 - DNA, 16 bp, Homo sapiens
aactgtcttcctcaaa

SEQ ID NO: 716948 - DNA, 16 bp, Homo sapiens
aactgtcttgtttcag

SEQ ID NO: 716949 - DNA, 17 bp, Homo sapiens
aactgtctttgtcacca

SEQ ID NO: 716950 - DNA, 19 bp, Homo sapiens
aactgtgaataataaatac

SEQ ID NO: 716951 - DNA, 20 bp, Homo sapiens
aactgtgaataataaataca

SEQ ID NO: 716952 - DNA, 21 bp, Homo sapiens
aactgtgaatacttgaactct

SEQ ID NO: 716953 - DNA, 17 bp, Homo sapiens
aactgtgcaaagggctg

SEQ ID NO: 716954 - DNA, 22 bp, Homo sapiens
aactgtgcaaagggctgccttg

SEQ ID NO: 716955 - DNA, 22 bp, Homo sapiens
aactgtgcatcaaccaggaaga

SEQ ID NO: 716956 - DNA, 13 bp, Homo sapiens
aactgtggaattt

SEQ ID NO: 716957 - DNA, 12 bp, Homo sapiens
aactgtgggaag

SEQ ID NO: 716958 - DNA, 12 bp, Homo sapiens
aactgtgtaaac

SEQ ID NO: 716959 - DNA, 20 bp, Homo sapiens
aactgtgtacataactgaaa

SEQ ID NO: 716960 - DNA, 20 bp, Homo sapiens
aactgtgtatcattaaaata

SEQ ID NO: 716961 - DNA, 21 bp, Homo sapiens
aactgtgtatcattaaaatat

SEQ ID NO: 716962 - DNA, 23 bp, Homo sapiens
aactgtgtatttatttaaaactc

SEQ ID NO: 716963 - DNA, 15 bp, Homo sapiens
aactgtgttgtatta

SEQ ID NO: 716964 - DNA, 17 bp, Homo sapiens
aactgtgttgtattaac

SEQ ID NO: 716965 - DNA, 22 bp, Homo sapiens
aactgtgtttcaagttcaatcc

SEQ ID NO: 716966 - DNA, 15 bp, Homo sapiens
aactgttacagtaat

SEQ ID NO: 716967 - DNA, 15 bp, Homo sapiens
aactgttagatgctg

SEQ ID NO: 716968 - DNA, 15 bp, Homo sapiens
aactgttagcactgt

SEQ ID NO: 716969 - DNA, 17 bp, Homo sapiens
aactgttagcactgttg

SEQ ID NO: 716970 - DNA, 16 bp, Homo sapiens
aactgttatgaaataa

SEQ ID NO: 716971 - DNA, 23 bp, Homo sapiens
aactgttcctcatgttgctgaat

SEQ ID NO: 716972 - DNA, 18 bp, Homo sapiens
aactgttcttttgcattt

SEQ ID NO: 716973 - DNA, 19 bp, Homo sapiens
aactgttggaatggatttt

SEQ ID NO: 716974 - DNA, 18 bp, Homo sapiens
aactgttggattcagaaa

SEQ ID NO: 716975 - DNA, 22 bp, Homo sapiens
aactgtttgaaaacttcagaag

SEQ ID NO: 716976 - DNA, 20 bp, Homo sapiens
aactgttttagaaattggta

SEQ ID NO: 716977 - DNA, 21 bp, Homo sapiens
aacttaaaaatgtaaatattc

SEQ ID NO: 716978 - DNA, 15 bp, Homo sapiens
aacttaaatgttatt

SEQ ID NO: 716979 - DNA, 21 bp, Homo sapiens
aacttaaatgttattatctgg

SEQ ID NO: 716980 - DNA, 14 bp, Homo sapiens
aacttaacatattt

SEQ ID NO: 716981 - DNA, 16 bp, Homo sapiens
aacttaacatatttac

SEQ ID NO: 716982 - DNA, 13 bp, Homo sapiens
aacttaactgaaa

SEQ ID NO: 716983 - DNA, 15 bp, Homo sapiens
aacttaagtatattt

SEQ ID NO: 716984 - DNA, 15 bp, Homo sapiens
aacttaatctaaatg

SEQ ID NO: 716985 - DNA, 13 bp, Homo sapiens
aacttaatgaaaa

SEQ ID NO: 716986 - DNA, 18 bp, Homo sapiens
aacttacaaaaacacttc

SEQ ID NO: 716987 - DNA, 23 bp, Homo sapiens
aacttacattgtgaaacttctgt

SEQ ID NO: 716988 - DNA, 22 bp, Homo sapiens
aacttacattgttcaattagaa

SEQ ID NO: 716989 - DNA, 15 bp, Homo sapiens
aacttaccaattgat

SEQ ID NO: 716990 - DNA, 15 bp, Homo sapiens
aacttactgattatt

SEQ ID NO: 716991 - DNA, 17 bp, Homo sapiens
aacttactgtatatgta

SEQ ID NO: 716992 - DNA, 16 bp, Homo sapiens
aacttagaggaaaagg

SEQ ID NO: 716993 - DNA, 15 bp, Homo sapiens
aacttagaggaaaat

SEQ ID NO: 716994 - DNA, 13 bp, Homo sapiens
aacttagatgtta

SEQ ID NO: 716995 - DNA, 18 bp, Homo sapiens
aacttagatgttaaatgt

SEQ ID NO: 716996 - DNA, 21 bp, Homo sapiens
aacttagccatttttcaaagc

SEQ ID NO: 716997 - DNA, 22 bp, Homo sapiens
aacttagccatttttcaaagca

SEQ ID NO: 716998 - DNA, 19 bp, Homo sapiens
aacttagctcaggtgcctt

SEQ ID NO: 716999 - DNA, 14 bp, Homo sapiens
aacttagctttatt

SEQ ID NO: 717000 - DNA, 16 bp, Homo sapiens
aacttaggtggcaagc

SEQ ID NO: 717001 - DNA, 23 bp, Homo sapiens
aacttagtgcggacaagttttaa

SEQ ID NO: 717002 - DNA, 12 bp, Homo sapiens
aacttatattga

SEQ ID NO: 717003 - DNA, 13 bp, Homo sapiens
aacttatattgaa

SEQ ID NO: 717004 - DNA, 22 bp, Homo sapiens
aacttattcaaagagaaaacat

SEQ ID NO: 717005 - DNA, 17 bp, Homo sapiens
aacttatttaaaaatat

SEQ ID NO: 717006 - DNA, 18 bp, Homo sapiens
aacttatttaaaaatatt

SEQ ID NO: 717007 - DNA, 13 bp, Homo sapiens
aacttatttagag

SEQ ID NO: 717008 - DNA, 14 bp, Homo sapiens
aacttattttatcc

SEQ ID NO: 717009 - DNA, 13 bp, Homo sapiens
aacttcaaagctg

SEQ ID NO: 717010 - DNA, 16 bp, Homo sapiens
aacttcacattaaaaa

SEQ ID NO: 717011 - DNA, 21 bp, Homo sapiens
aacttcaccaccccctgtccc

SEQ ID NO: 717012 - DNA, 11 bp, Homo sapiens
aacttcagcag

SEQ ID NO: 717013 - DNA, 21 bp, Homo sapiens
aacttcaggataataaagtgt

SEQ ID NO: 717014 - DNA, 14 bp, Homo sapiens
aacttcagtaggat

SEQ ID NO: 717015 - DNA, 19 bp, Homo sapiens
aacttcagtttcacagaaa

SEQ ID NO: 717016 - DNA, 17 bp, Homo sapiens
aacttcattctaaacca

SEQ ID NO: 717017 - DNA, 21 bp, Homo sapiens
aacttcattctaaaccaaaac

SEQ ID NO: 717018 - DNA, 14 bp, Homo sapiens
aacttcatttgaca

SEQ ID NO: 717019 - DNA, 14 bp, Homo sapiens
aacttccaaagctt

SEQ ID NO: 717020 - DNA, 16 bp, Homo sapiens
aacttccaaataaata

SEQ ID NO: 717021 - DNA, 16 bp, Homo sapiens
aacttccaaggccctg

SEQ ID NO: 717022 - DNA, 13 bp, Homo sapiens
aacttccaattta

SEQ ID NO: 717023 - DNA, 18 bp, Homo sapiens
aacttccactaatccatt

SEQ ID NO: 717024 - DNA, 23 bp, Homo sapiens
aacttccactaatccattatcct

SEQ ID NO: 717025 - DNA, 21 bp, Homo sapiens
aacttccagaggacagctctg

SEQ ID NO: 717026 - DNA, 22 bp, Homo sapiens
aacttccagaggacagctctgg

SEQ ID NO: 717027 - DNA, 19 bp, Homo sapiens
aacttttttttttttaaca

SEQ ID NO: 717028 - DNA, 14 bp, Homo sapiens
aagaaaaaaaaaga

SEQ ID NO: 717029 - DNA, 18 bp, Homo sapiens
aagaaaaaaaaagaaaaa

SEQ ID NO: 717030 - DNA, 20 bp, Homo sapiens
aagaaaaaaaataacacaga

SEQ ID NO: 717031 - DNA, 13 bp, Homo sapiens
aagaaaaaaagaa

SEQ ID NO: 717032 - DNA, 16 bp, Homo sapiens
aagaaaaaaagaaaaa

SEQ ID NO: 717033 - DNA, 19 bp, Homo sapiens
aagaaaaaaattgaaatgt

SEQ ID NO: 717034 - DNA, 20 bp, Homo sapiens
aagaaaaaagagaaaagaaa

SEQ ID NO: 717035 - DNA, 13 bp, Homo sapiens
aagaaaaaagctt

SEQ ID NO: 717036 - DNA, 14 bp, Homo sapiens
aagaaaaacaaagt

SEQ ID NO: 717037 - DNA, 13 bp, Homo sapiens
aagaaaaagaaaa

SEQ ID NO: 717038 - DNA, 12 bp, Homo sapiens
aagaaaaagcaa

SEQ ID NO: 717039 - DNA, 15 bp, Homo sapiens
aagaaaaaggatgca

SEQ ID NO: 717040 - DNA, 18 bp, Homo sapiens
aagaaaaaggatgcacag

SEQ ID NO: 717041 - DNA, 19 bp, Homo sapiens
aagaaaaataaaatttcct

SEQ ID NO: 717042 - DNA, 23 bp, Homo sapiens
aagaaaaataccatgtctctaag

SEQ ID NO: 717043 - DNA, 19 bp, Homo sapiens
aagaaaaatcatgtttgct

SEQ ID NO: 717044 - DNA, 22 bp, Homo sapiens
aagaaaaatcatgtttgctctc

SEQ ID NO: 717045 - DNA, 21 bp, Homo sapiens
aagaaaaatgcctgtctctag

SEQ ID NO: 717046 - DNA, 12 bp, Homo sapiens
aagaaaacaaaa

SEQ ID NO: 717047 - DNA, 18 bp, Homo sapiens
aagaaaacatttaacata

SEQ ID NO: 717048 - DNA, 13 bp, Homo sapiens
aagaaaacccgag

SEQ ID NO: 717049 - DNA, 16 bp, Homo sapiens
aagaaaacggaaatgt

SEQ ID NO: 717050 - DNA, 22 bp, Homo sapiens
aagaaaacggaaatgtgtggtc

SEQ ID NO: 717051 - DNA, 12 bp, Homo sapiens
aagaaaactgcg

SEQ ID NO: 717052 - DNA, 12 bp, Homo sapiens
aagaaaagaatc

SEQ ID NO: 717053 - DNA, 20 bp, Homo sapiens
aagaaaagaatccctgttca

SEQ ID NO: 717054 - DNA, 11 bp, Homo sapiens
aagaaaagata

SEQ ID NO: 717055 - DNA, 12 bp, Homo sapiens
aagaaaagattt

SEQ ID NO: 717056 - DNA, 22 bp, Homo sapiens
aagaaaagattttaatcaagtt

SEQ ID NO: 717057 - DNA, 23 bp, Homo sapiens
aagaaaaggttcttcttgggagt

SEQ ID NO: 717058 - DNA, 15 bp, Homo sapiens
aagaaaagtgcatat

SEQ ID NO: 717059 - DNA, 22 bp, Homo sapiens
aagaaaagtgcatatttatcca

SEQ ID NO: 717060 - DNA, 15 bp, Homo sapiens
aagaaaagtgggcca

SEQ ID NO: 717061 - DNA, 23 bp, Homo sapiens
aagaaaataaaaaaaagaaaaaa

SEQ ID NO: 717062 - DNA, 19 bp, Homo sapiens
aagaaaatacataagacca

SEQ ID NO: 717063 - DNA, 15 bp, Homo sapiens
aagaaaatagtggtg

SEQ ID NO: 717064 - DNA, 11 bp, Homo sapiens
aagaaaatatt

SEQ ID NO: 717065 - DNA, 14 bp, Homo sapiens
aagaaaatattttg

SEQ ID NO: 717066 - DNA, 18 bp, Homo sapiens
aagaaaatggctaataaa

SEQ ID NO: 717067 - DNA, 14 bp, Homo sapiens
aagaaaatgtcttt

SEQ ID NO: 717068 - DNA, 22 bp, Homo sapiens
aagaaaatttttgtagtagcgt

SEQ ID NO: 717069 - DNA, 13 bp, Homo sapiens
aagaaacaaaccc

SEQ ID NO: 717070 - DNA, 16 bp, Homo sapiens
aagaaacaaacccgtt

SEQ ID NO: 717071 - DNA, 12 bp, Homo sapiens
aagaaacactga

SEQ ID NO: 717072 - DNA, 14 bp, Homo sapiens
aagaaacagccagc

SEQ ID NO: 717073 - DNA, 17 bp, Homo sapiens
aagaaactatacatcat

SEQ ID NO: 717074 - DNA, 11 bp, Homo sapiens
aagaaactttc

SEQ ID NO: 717075 - DNA, 14 bp, Homo sapiens
aagaaactttttta

SEQ ID NO: 717076 - DNA, 11 bp, Homo sapiens
aagaaagaaag

SEQ ID NO: 717077 - DNA, 14 bp, Homo sapiens
aagaaagaaggaag

SEQ ID NO: 717078 - DNA, 20 bp, Homo sapiens
aagaaagactatctaaatgt

SEQ ID NO: 717079 - DNA, 17 bp, Homo sapiens
aagaaagatgtatatag

SEQ ID NO: 717080 - DNA, 12 bp, Homo sapiens
aagaaagatttg

SEQ ID NO: 717081 - DNA, 18 bp, Homo sapiens
aagaaagcacctgttttt

SEQ ID NO: 717082 - DNA, 15 bp, Homo sapiens
aagaaagccagacaa

SEQ ID NO: 717083 - DNA, 18 bp, Homo sapiens
aagaaagccagacaactt

SEQ ID NO: 717084 - DNA, 19 bp, Homo sapiens
aagaaagccagacaacttc

SEQ ID NO: 717085 - DNA, 17 bp, Homo sapiens
aagaaagcctaaaattg

SEQ ID NO: 717086 - DNA, 23 bp, Homo sapiens
aagaaaggaagcattgtaaaata

SEQ ID NO: 717087 - DNA, 11 bp, Homo sapiens
aagaaaggagg

SEQ ID NO: 717088 - DNA, 19 bp, Homo sapiens
aagaaaggatataaaagga

SEQ ID NO: 717089 - DNA, 20 bp, Homo sapiens
aagaaaggctgttaaataca

SEQ ID NO: 717090 - DNA, 13 bp, Homo sapiens
aagaaagtccacc

SEQ ID NO: 717091 - DNA, 17 bp, Homo sapiens
aagaaagtgggaggtca

SEQ ID NO: 717092 - DNA, 13 bp, Homo sapiens
aagaaagtggtct

SEQ ID NO: 717093 - DNA, 15 bp, Homo sapiens
aagaaagtgtatttg

SEQ ID NO: 717094 - DNA, 19 bp, Homo sapiens
aagaaagttattcttggta

SEQ ID NO: 717095 - DNA, 23 bp, Homo sapiens
aagaaataaaaggaagccaaaga

SEQ ID NO: 717096 - DNA, 13 bp, Homo sapiens
aagaaataaatga

SEQ ID NO: 717097 - DNA, 23 bp, Homo sapiens
aagaaataaatgaaacttggcca

SEQ ID NO: 717098 - DNA, 15 bp, Homo sapiens
aagaaataagttttt

SEQ ID NO: 717099 - DNA, 17 bp, Homo sapiens
aagaaatactcatgtgc

SEQ ID NO: 717100 - DNA, 22 bp, Homo sapiens
aagaaatagagccaactgattt

SEQ ID NO: 717101 - DNA, 22 bp, Homo sapiens
aagaaatatacagtttgacttt

SEQ ID NO: 717102 - DNA, 15 bp, Homo sapiens
aagaaatatattttt

SEQ ID NO: 717103 - DNA, 12 bp, Homo sapiens
aagaaatatctg

SEQ ID NO: 717104 - DNA, 18 bp, Homo sapiens
aagaaatatctgtgaaat

SEQ ID NO: 717105 - DNA, 15 bp, Homo sapiens
aagaaatatttacct

SEQ ID NO: 717106 - DNA, 14 bp, Homo sapiens
aagaaatcacagaa

SEQ ID NO: 717107 - DNA, 16 bp, Homo sapiens
aagaaatcatgtccat

SEQ ID NO: 717108 - DNA, 23 bp, Homo sapiens
aagaaatcatgtccatacacttt

SEQ ID NO: 717109 - DNA, 14 bp, Homo sapiens
aagaaatccctgtt

SEQ ID NO: 717110 - DNA, 19 bp, Homo sapiens
aagaaatccggagaagctg

SEQ ID NO: 717111 - DNA, 16 bp, Homo sapiens
aagaaatcttgtctta

SEQ ID NO: 717112 - DNA, 23 bp, Homo sapiens
aagaaatggaatgaatctccaag

SEQ ID NO: 717113 - DNA, 18 bp, Homo sapiens
aagaaatggattctattt

SEQ ID NO: 717114 - DNA, 17 bp, Homo sapiens
aagaaatggctatgaac

SEQ ID NO: 717115 - DNA, 16 bp, Homo sapiens
aagaaatgggcctgcc

SEQ ID NO: 717116 - DNA, 12 bp, Homo sapiens
aagaaatgtacc

SEQ ID NO: 717117 - DNA, 12 bp, Homo sapiens
aagaaattcagg

SEQ ID NO: 717118 - DNA, 13 bp, Homo sapiens
aagaaattgcaat

SEQ ID NO: 717119 - DNA, 17 bp, Homo sapiens
aagaaattgtttttaac

SEQ ID NO: 717120 - DNA, 17 bp, Homo sapiens
aagaaatttaaaagaca

SEQ ID NO: 717121 - DNA, 21 bp, Homo sapiens
aagaacaaaaaaatctgcaga

SEQ ID NO: 717122 - DNA, 14 bp, Homo sapiens
aagaacaaacaaaa

SEQ ID NO: 717123 - DNA, 12 bp, Homo sapiens
aagaacaaacac

SEQ ID NO: 717124 - DNA, 14 bp, Homo sapiens
aagaacaacggcaa

SEQ ID NO: 717125 - DNA, 22 bp, Homo sapiens
aagaacaactttagcatcagaa

SEQ ID NO: 717126 - DNA, 14 bp, Homo sapiens
aagaacaagaaatg

SEQ ID NO: 717127 - DNA, 14 bp, Homo sapiens
aagaacaagaattt

SEQ ID NO: 717128 - DNA, 15 bp, Homo sapiens
aagaacacagcatgt

SEQ ID NO: 717129 - DNA, 19 bp, Homo sapiens
aagaacacagcatgtgcca

SEQ ID NO: 717130 - DNA, 21 bp, Homo sapiens
aagaacaccctatattttgca

SEQ ID NO: 717131 - DNA, 20 bp, Homo sapiens
aagaacacttttaataaact

SEQ ID NO: 717132 - DNA, 18 bp, Homo sapiens
aagaacagaattgctcct

SEQ ID NO: 717133 - DNA, 18 bp, Homo sapiens
aagaacatccaaggagaa

SEQ ID NO: 717134 - DNA, 23 bp, Homo sapiens
aagaacatccctgtcttaactgg

SEQ ID NO: 717135 - DNA, 15 bp, Homo sapiens
aagaacatctgcact

SEQ ID NO: 717136 - DNA, 18 bp, Homo sapiens
aagaacatggacttgtat

SEQ ID NO: 717137 - DNA, 21 bp, Homo sapiens
aagaacatggacttgtatatt

SEQ ID NO: 717138 - DNA, 17 bp, Homo sapiens
aagaaccaaaacttcca

SEQ ID NO: 717139 - DNA, 22 bp, Homo sapiens
aagaaccaaaagttttcctgag

SEQ ID NO: 717140 - DNA, 17 bp, Homo sapiens
aagaaccaaatacctca

SEQ ID NO: 717141 - DNA, 18 bp, Homo sapiens
aagaacccagggtggaga

SEQ ID NO: 717142 - DNA, 14 bp, Homo sapiens
aagaacccctctgc

SEQ ID NO: 717143 - DNA, 17 bp, Homo sapiens
aagaacccctctgcttt

SEQ ID NO: 717144 - DNA, 18 bp, Homo sapiens
aagaaccggacaaataag

SEQ ID NO: 717145 - DNA, 20 bp, Homo sapiens
aagaacgcgacttccacaaa

SEQ ID NO: 717146 - DNA, 21 bp, Homo sapiens
aagaacgttttttcctcagtg

SEQ ID NO: 717147 - DNA, 16 bp, Homo sapiens
aagaactccttatttt

SEQ ID NO: 717148 - DNA, 12 bp, Homo sapiens
aagaactgcact

SEQ ID NO: 717149 - DNA, 11 bp, Homo sapiens
aagaactgcag

SEQ ID NO: 717150 - DNA, 18 bp, Homo sapiens
aagaactgcaggccctgg

SEQ ID NO: 717151 - DNA, 11 bp, Homo sapiens
aagaactgcat

SEQ ID NO: 717152 - DNA, 15 bp, Homo sapiens
aagaacttactgatt

SEQ ID NO: 717153 - DNA, 23 bp, Homo sapiens
aagaacttgatttgcatggattt

SEQ ID NO: 717154 - DNA, 24 bp, Homo sapiens
aagaactttaaagctcaggagggt

SEQ ID NO: 717155 - DNA, 16 bp, Homo sapiens
aagaagaaacgtctat

SEQ ID NO: 717156 - DNA, 17 bp, Homo sapiens
aagaagaaccagcccag

SEQ ID NO: 717157 - DNA, 21 bp, Homo sapiens
aagaagaaccagcccagcctg

SEQ ID NO: 717158 - DNA, 15 bp, Homo sapiens
aagaagacaaacttt

SEQ ID NO: 717159 - DNA, 16 bp, Homo sapiens
aagaagacaaactttg

SEQ ID NO: 717160 - DNA, 11 bp, Homo sapiens
aagaagacata

SEQ ID NO: 717161 - DNA, 13 bp, Homo sapiens
aagaagacatttt

SEQ ID NO: 717162 - DNA, 16 bp, Homo sapiens
aagaagacattttgtt

SEQ ID NO: 717163 - DNA, 14 bp, Homo sapiens
aagaagagaagctg

SEQ ID NO: 717164 - DNA, 18 bp, Homo sapiens
aagaagagaagctgctga

SEQ ID NO: 717165 - DNA, 10 bp, Homo sapiens
aagaagagac

SEQ ID NO: 717166 - DNA, 11 bp, Homo sapiens
aagaagagaca

SEQ ID NO: 717167 - DNA, 23 bp, Homo sapiens
aagaagagcgagagatcaaagat

SEQ ID NO: 717168 - DNA, 12 bp, Homo sapiens
aagaagatgagc

SEQ ID NO: 717169 - DNA, 16 bp, Homo sapiens
aagaagattcccaccc

SEQ ID NO: 717170 - DNA, 17 bp, Homo sapiens
aagaagattcccacccc

SEQ ID NO: 717171 - DNA, 17 bp, Homo sapiens
aagaagcaatctttgaa

SEQ ID NO: 717172 - DNA, 20 bp, Homo sapiens
aagaagcaatctttgaaata

SEQ ID NO: 717173 - DNA, 22 bp, Homo sapiens
aagaagcccagtggtgaggaaa

SEQ ID NO: 717174 - DNA, 17 bp, Homo sapiens
aagaagccgggaacaga

SEQ ID NO: 717175 - DNA, 17 bp, Homo sapiens
aagaagcctgcaggaga

SEQ ID NO: 717176 - DNA, 20 bp, Homo sapiens
aagaagcgcggctaacttat

SEQ ID NO: 717177 - DNA, 12 bp, Homo sapiens
aagaagctctcc

SEQ ID NO: 717178 - DNA, 13 bp, Homo sapiens
aagaagctggcta

SEQ ID NO: 717179 - DNA, 21 bp, Homo sapiens
aagaagctttaatatttaaat

SEQ ID NO: 717180 - DNA, 16 bp, Homo sapiens
aagaagctttatttct

SEQ ID NO: 717181 - DNA, 16 bp, Homo sapiens
aagaaggaaaatgatc

SEQ ID NO: 717182 - DNA, 21 bp, Homo sapiens
aagaaggagaccttttcacaa

SEQ ID NO: 717183 - DNA, 14 bp, Homo sapiens
aagaaggcaatatt

SEQ ID NO: 717184 - DNA, 17 bp, Homo sapiens
aagaagggactgagaga

SEQ ID NO: 717185 - DNA, 11 bp, Homo sapiens
aagaagggctg

SEQ ID NO: 717186 - DNA, 16 bp, Homo sapiens
aagaagggctgcatga

SEQ ID NO: 717187 - DNA, 15 bp, Homo sapiens
aagaaggggagaagt

SEQ ID NO: 717188 - DNA, 22 bp, Homo sapiens
aagaagggggagtgaaacagag

SEQ ID NO: 717189 - DNA, 23 bp, Homo sapiens
aagaagggggagtgaaacagaga

SEQ ID NO: 717190 - DNA, 15 bp, Homo sapiens
aagaagtaggcatga

SEQ ID NO: 717191 - DNA, 19 bp, Homo sapiens
aagaagtcactgaacaaaa

SEQ ID NO: 717192 - DNA, 23 bp, Homo sapiens
aagaagtcttctctgcctgtaag

SEQ ID NO: 717193 - DNA, 12 bp, Homo sapiens
aagaagtcttga

SEQ ID NO: 717194 - DNA, 12 bp, Homo sapiens
aagaagtgattc

SEQ ID NO: 717195 - DNA, 14 bp, Homo sapiens
aagaagtggagaca

SEQ ID NO: 717196 - DNA, 20 bp, Homo sapiens
aagaagtggctgccacaccc

SEQ ID NO: 717197 - DNA, 18 bp, Homo sapiens
aagaagtgggagcagctt

SEQ ID NO: 717198 - DNA, 20 bp, Homo sapiens
aagaagtgggagcagcttct

SEQ ID NO: 717199 - DNA, 18 bp, Homo sapiens
aagaagtgtccgagaact

SEQ ID NO: 717200 - DNA, 23 bp, Homo sapiens
aagaagttattttcttgtttaac

SEQ ID NO: 717201 - DNA, 14 bp, Homo sapiens
aagaagtttaagga

SEQ ID NO: 717202 - DNA, 17 bp, Homo sapiens
aagaagtttaaggaata

SEQ ID NO: 717203 - DNA, 12 bp, Homo sapiens
aagaagtttatt

SEQ ID NO: 717204 - DNA, 18 bp, Homo sapiens
aagaagtttcatcatttt

SEQ ID NO: 717205 - DNA, 18 bp, Homo sapiens
aagaagttttaaaaagcc

SEQ ID NO: 717206 - DNA, 23 bp, Homo sapiens
aagaagttttaaaaagccagttt

SEQ ID NO: 717207 - DNA, 13 bp, Homo sapiens
aagaataaattct

SEQ ID NO: 717208 - DNA, 17 bp, Homo sapiens
aagaataacaagaagcc

SEQ ID NO: 717209 - DNA, 12 bp, Homo sapiens
aagaatacttga

SEQ ID NO: 717210 - DNA, 11 bp, Homo sapiens
aagaatagaac

SEQ ID NO: 717211 - DNA, 19 bp, Homo sapiens
aagaataggcattaacaca

SEQ ID NO: 717212 - DNA, 13 bp, Homo sapiens
aagaatatcaaat

SEQ ID NO: 717213 - DNA, 17 bp, Homo sapiens
aagaatatcaaataata

SEQ ID NO: 717214 - DNA, 16 bp, Homo sapiens
aagaatatctggcaaa

SEQ ID NO: 717215 - DNA, 17 bp, Homo sapiens
aagaatatctgtaatgg

SEQ ID NO: 717216 - DNA, 14 bp, Homo sapiens
aagaatatgacttt

SEQ ID NO: 717217 - DNA, 18 bp, Homo sapiens
aagaatatgtttccttgt

SEQ ID NO: 717218 - DNA, 14 bp, Homo sapiens
aagaatattgcaaa

SEQ ID NO: 717219 - DNA, 23 bp, Homo sapiens
aagaatattgcaaaatacatgaa

SEQ ID NO: 717220 - DNA, 12 bp, Homo sapiens
aagaatattgta

SEQ ID NO: 717221 - DNA, 14 bp, Homo sapiens
aagaatattttgat

SEQ ID NO: 717222 - DNA, 17 bp, Homo sapiens
aagaatattttgatgca

SEQ ID NO: 717223 - DNA, 19 bp, Homo sapiens
aagaatcacctcaaattgt

SEQ ID NO: 717224 - DNA, 15 bp, Homo sapiens
aagaatccctgttca

SEQ ID NO: 717225 - DNA, 21 bp, Homo sapiens
aagaatccttagatgcctaaa

SEQ ID NO: 717226 - DNA, 14 bp, Homo sapiens
aagaatctagaaga

SEQ ID NO: 717227 - DNA, 18 bp, Homo sapiens
aagaatctagaagatgtg

SEQ ID NO: 717228 - DNA, 19 bp, Homo sapiens
aagaatctagaagatgtgt

SEQ ID NO: 717229 - DNA, 21 bp, Homo sapiens
aagaatctagaagatgtgtaa

SEQ ID NO: 717230 - DNA, 12 bp, Homo sapiens
aagaatctcatc

SEQ ID NO: 717231 - DNA, 13 bp, Homo sapiens
aagaatctgcccc

SEQ ID NO: 717232 - DNA, 14 bp, Homo sapiens
aagaatcttagata

SEQ ID NO: 717233 - DNA, 13 bp, Homo sapiens
aagaatgaaaaat

SEQ ID NO: 717234 - DNA, 22 bp, Homo sapiens
aagaatgaaaaatataatgttg

SEQ ID NO: 717235 - DNA, 15 bp, Homo sapiens
aagaatgagaaacat

SEQ ID NO: 717236 - DNA, 19 bp, Homo sapiens
aagaatgcacaagaatgga

SEQ ID NO: 717237 - DNA, 22 bp, Homo sapiens
aagaatgcacaagaatggatca

SEQ ID NO: 717238 - DNA, 23 bp, Homo sapiens
aagaatgcagattcctgggcctg

SEQ ID NO: 717239 - DNA, 19 bp, Homo sapiens
aagaatgctggttttccta

SEQ ID NO: 717240 - DNA, 17 bp, Homo sapiens
aagaatggcagaaaagt

SEQ ID NO: 717241 - DNA, 13 bp, Homo sapiens
aagaatggccaac

SEQ ID NO: 717242 - DNA, 15 bp, Homo sapiens
aagaatggctttcaa

SEQ ID NO: 717243 - DNA, 17 bp, Homo sapiens
aagaatgtcgattaaaa

SEQ ID NO: 717244 - DNA, 12 bp, Homo sapiens
aagaatgttaag

SEQ ID NO: 717245 - DNA, 19 bp, Homo sapiens
aagaatgttactgccttaa

SEQ ID NO: 717246 - DNA, 11 bp, Homo sapiens
aagaatgttag

SEQ ID NO: 717247 - DNA, 16 bp, Homo sapiens
aagaatgttagagtaa

SEQ ID NO: 717248 - DNA, 20 bp, Homo sapiens
aagaatgttagagtaatgaa

SEQ ID NO: 717249 - DNA, 15 bp, Homo sapiens
aagaattaaaactga

SEQ ID NO: 717250 - DNA, 20 bp, Homo sapiens
aagaattaaacccacaagct

SEQ ID NO: 717251 - DNA, 19 bp, Homo sapiens
aagaattaagatacaaatt

SEQ ID NO: 717252 - DNA, 19 bp, Homo sapiens
aagaattatgtaatatatt

SEQ ID NO: 717253 - DNA, 19 bp, Homo sapiens
aagaattattcagtgaatt

SEQ ID NO: 717254 - DNA, 21 bp, Homo sapiens
aagaattattcagtgaatttg

SEQ ID NO: 717255 - DNA, 23 bp, Homo sapiens
aagaattattcagtgaatttgtc

SEQ ID NO: 717256 - DNA, 19 bp, Homo sapiens
aagaattctccaaaacaat

SEQ ID NO: 717257 - DNA, 19 bp, Homo sapiens
aagaattctggtgtttaca

SEQ ID NO: 717258 - DNA, 17 bp, Homo sapiens
aagaattcttatgctta

SEQ ID NO: 717259 - DNA, 17 bp, Homo sapiens
aagaattgccagtcttt

SEQ ID NO: 717260 - DNA, 16 bp, Homo sapiens
aagaattgtctctggg

SEQ ID NO: 717261 - DNA, 16 bp, Homo sapiens
aagaatttaatggact

SEQ ID NO: 717262 - DNA, 18 bp, Homo sapiens
aagaatttaatggactgt

SEQ ID NO: 717263 - DNA, 22 bp, Homo sapiens
aagaatttaatggactgtgaat

SEQ ID NO: 717264 - DNA, 15 bp, Homo sapiens
aagaatttagggaga

SEQ ID NO: 717265 - DNA, 17 bp, Homo sapiens
aagaatttgaagacttc

SEQ ID NO: 717266 - DNA, 13 bp, Homo sapiens
aagaatttgtttt

SEQ ID NO: 717267 - DNA, 22 bp, Homo sapiens
aagaattttcagaccccagcgg

SEQ ID NO: 717268 - DNA, 19 bp, Homo sapiens
aagaattttgagtgaatta

SEQ ID NO: 717269 - DNA, 20 bp, Homo sapiens
aagaatttttcattctcaga

SEQ ID NO: 717270 - DNA, 15 bp, Homo sapiens
aagaatttttttaat

SEQ ID NO: 717271 - DNA, 14 bp, Homo sapiens
aagaatttttttgt

SEQ ID NO: 717272 - DNA, 15 bp, Homo sapiens
aagaatttttttgtc

SEQ ID NO: 717273 - DNA, 14 bp, Homo sapiens
aagacaaaaatcaa

SEQ ID NO: 717274 - DNA, 22 bp, Homo sapiens
aagacaaaagtctgtctttcct

SEQ ID NO: 717275 - DNA, 16 bp, Homo sapiens
aagacaaaataaatgt

SEQ ID NO: 717276 - DNA, 18 bp, Homo sapiens
aagacaaactttgcatct

SEQ ID NO: 717277 - DNA, 22 bp, Homo sapiens
aagacaaatcaacagaagcatt

SEQ ID NO: 717278 - DNA, 22 bp, Homo sapiens
aagacaagaactcccctttttt

SEQ ID NO: 717279 - DNA, 12 bp, Homo sapiens
aagacaaggctg

SEQ ID NO: 717280 - DNA, 18 bp, Homo sapiens
aagacaagtatgaatatt

SEQ ID NO: 717281 - DNA, 19 bp, Homo sapiens
aagacaatttgatacataa

SEQ ID NO: 717282 - DNA, 16 bp, Homo sapiens
aagacacagcctcccc

SEQ ID NO: 717283 - DNA, 20 bp, Homo sapiens
aagacacatgctgaggtttt

SEQ ID NO: 717284 - DNA, 18 bp, Homo sapiens
aagacaccgttcattcag

SEQ ID NO: 717285 - DNA, 14 bp, Homo sapiens
aagacacttcagat

SEQ ID NO: 717286 - DNA, 15 bp, Homo sapiens
aagacagaatggtgg

SEQ ID NO: 717287 - DNA, 12 bp, Homo sapiens
aagacagaatgt

SEQ ID NO: 717288 - DNA, 16 bp, Homo sapiens
aagacagagacgcagg

SEQ ID NO: 717289 - DNA, 21 bp, Homo sapiens
aagacagagacgcaggaatgg

SEQ ID NO: 717290 - DNA, 20 bp, Homo sapiens
aagacagatgccccagagct

SEQ ID NO: 717291 - DNA, 23 bp, Homo sapiens
aagacaggacagtgcttcagcct

SEQ ID NO: 717292 - DNA, 18 bp, Homo sapiens
aagacaggagacaaaaga

SEQ ID NO: 717293 - DNA, 22 bp, Homo sapiens
aagacaggagagattatttaca

SEQ ID NO: 717294 - DNA, 16 bp, Homo sapiens
aagacagggtcttgct

SEQ ID NO: 717295 - DNA, 18 bp, Homo sapiens
aagacagtgcccatgaat

SEQ ID NO: 717296 - DNA, 14 bp, Homo sapiens
aagacagtggttct

SEQ ID NO: 717297 - DNA, 13 bp, Homo sapiens
aagacagtgtaca

SEQ ID NO: 717298 - DNA, 15 bp, Homo sapiens
aagacagtgtacaaa

SEQ ID NO: 717299 - DNA, 23 bp, Homo sapiens
aagacagtgtacaaaactgtaaa

SEQ ID NO: 717300 - DNA, 21 bp, Homo sapiens
aagacagtgtggggataaaga

SEQ ID NO: 717301 - DNA, 14 bp, Homo sapiens
aagacataaaactt

SEQ ID NO: 717302 - DNA, 18 bp, Homo sapiens
aagacataaaactttaaa

SEQ ID NO: 717303 - DNA, 22 bp, Homo sapiens
aagacatcatgtatcgcatatt

SEQ ID NO: 717304 - DNA, 17 bp, Homo sapiens
aagacatccataaagaa

SEQ ID NO: 717305 - DNA, 14 bp, Homo sapiens
aagacatctgcctg

SEQ ID NO: 717306 - DNA, 20 bp, Homo sapiens
aagacatctgcctgtaatta

SEQ ID NO: 717307 - DNA, 13 bp, Homo sapiens
aagacatgaacca

SEQ ID NO: 717308 - DNA, 14 bp, Homo sapiens
aagacatgatttcc

SEQ ID NO: 717309 - DNA, 16 bp, Homo sapiens
aagacatgtaggtgtt

SEQ ID NO: 717310 - DNA, 17 bp, Homo sapiens
aagacatgtctgttcta

SEQ ID NO: 717311 - DNA, 19 bp, Homo sapiens
aagacatgtctgttctaca

SEQ ID NO: 717312 - DNA, 13 bp, Homo sapiens
aagacattgtcaa

SEQ ID NO: 717313 - DNA, 12 bp, Homo sapiens
aagacatttgta

SEQ ID NO: 717314 - DNA, 18 bp, Homo sapiens
aagacatttgtatattgt

SEQ ID NO: 717315 - DNA, 19 bp, Homo sapiens
aagacattttaagtttgta

SEQ ID NO: 717316 - DNA, 19 bp, Homo sapiens
aagaccaaaatgacaatga

SEQ ID NO: 717317 - DNA, 23 bp, Homo sapiens
aagaccaaggcctcggcagaact

SEQ ID NO: 717318 - DNA, 14 bp, Homo sapiens
aagaccaatttatg

SEQ ID NO: 717319 - DNA, 19 bp, Homo sapiens
aagaccaatttatgggaga

SEQ ID NO: 717320 - DNA, 20 bp, Homo sapiens
aagaccaatttatgggagaa

SEQ ID NO: 717321 - DNA, 12 bp, Homo sapiens
aagaccacctcc

SEQ ID NO: 717322 - DNA, 23 bp, Homo sapiens
aagaccagaattcccttgaattg

SEQ ID NO: 717323 - DNA, 13 bp, Homo sapiens
aagaccagcctgg

SEQ ID NO: 717324 - DNA, 21 bp, Homo sapiens
aagaccagggcttttcccagg

SEQ ID NO: 717325 - DNA, 14 bp, Homo sapiens
aagaccattctgtg

SEQ ID NO: 717326 - DNA, 20 bp, Homo sapiens
aagacccccatttgtcccag

SEQ ID NO: 717327 - DNA, 15 bp, Homo sapiens
aagacccctgactca

SEQ ID NO: 717328 - DNA, 13 bp, Homo sapiens
aagaccctccccg

SEQ ID NO: 717329 - DNA, 13 bp, Homo sapiens
aagaccctgagac

SEQ ID NO: 717330 - DNA, 14 bp, Homo sapiens
aagaccctgagact

SEQ ID NO: 717331 - DNA, 15 bp, Homo sapiens
aagaccctgagactc

SEQ ID NO: 717332 - DNA, 15 bp, Homo sapiens
aagaccctggtctga

SEQ ID NO: 717333 - DNA, 14 bp, Homo sapiens
aagaccgccccagg

SEQ ID NO: 717334 - DNA, 16 bp, Homo sapiens
aagaccgccccagggc

SEQ ID NO: 717335 - DNA, 16 bp, Homo sapiens
aagacctcacctagaa

SEQ ID NO: 717336 - DNA, 22 bp, Homo sapiens
aagacctcatctgtggagctgc

SEQ ID NO: 717337 - DNA, 15 bp, Homo sapiens
aagacctgagaatgt

SEQ ID NO: 717338 - DNA, 16 bp, Homo sapiens
aagacctggcctttca

SEQ ID NO: 717339 - DNA, 21 bp, Homo sapiens
aagaccttctagtgagcctgg

SEQ ID NO: 717340 - DNA, 20 bp, Homo sapiens
aagaccttctccccattctg

SEQ ID NO: 717341 - DNA, 14 bp, Homo sapiens
aagacgcctgagct

SEQ ID NO: 717342 - DNA, 13 bp, Homo sapiens
aagacgccttcat

SEQ ID NO: 717343 - DNA, 16 bp, Homo sapiens
aagacggatggcagga

SEQ ID NO: 717344 - DNA, 19 bp, Homo sapiens
aagacggattctaaggact

SEQ ID NO: 717345 - DNA, 20 bp, Homo sapiens
aagacgtggactcctcttgg

SEQ ID NO: 717346 - DNA, 16 bp, Homo sapiens
aagacgtgtttgtgtt

SEQ ID NO: 717347 - DNA, 21 bp, Homo sapiens
aagacgtttttgtgctgtggg

SEQ ID NO: 717348 - DNA, 19 bp, Homo sapiens
aagactaatttaaaaaata

SEQ ID NO: 717349 - DNA, 21 bp, Homo sapiens
aagactagaaaattagactgt

SEQ ID NO: 717350 - DNA, 23 bp, Homo sapiens
aagactagactactcaatattaa

SEQ ID NO: 717351 - DNA, 22 bp, Homo sapiens
aagactagaggccagggcagca

SEQ ID NO: 717352 - DNA, 17 bp, Homo sapiens
aagactatctacaaaaa

SEQ ID NO: 717353 - DNA, 22 bp, Homo sapiens
aagactatcttactatttcaca

SEQ ID NO: 717354 - DNA, 13 bp, Homo sapiens
aagactcaggagt

SEQ ID NO: 717355 - DNA, 18 bp, Homo sapiens
aagactcctcctgggggc

SEQ ID NO: 717356 - DNA, 13 bp, Homo sapiens
aagactcctctgg

SEQ ID NO: 717357 - DNA, 17 bp, Homo sapiens
aagactctgcagccctc

SEQ ID NO: 717358 - DNA, 13 bp, Homo sapiens
aagactgaacatg

SEQ ID NO: 717359 - DNA, 13 bp, Homo sapiens
aagactgaatgtt

SEQ ID NO: 717360 - DNA, 15 bp, Homo sapiens
aagactgaatgtttt

SEQ ID NO: 717361 - DNA, 18 bp, Homo sapiens
aagactgcaaactttttt

SEQ ID NO: 717362 - DNA, 13 bp, Homo sapiens
aagactgcagctg

SEQ ID NO: 717363 - DNA, 15 bp, Homo sapiens
aagactgccaggtgg

SEQ ID NO: 717364 - DNA, 15 bp, Homo sapiens
aagactgcctccctc

SEQ ID NO: 717365 - DNA, 12 bp, Homo sapiens
aagactgccttc

SEQ ID NO: 717366 - DNA, 23 bp, Homo sapiens
aagactggcttttattaatgcac

SEQ ID NO: 717367 - DNA, 12 bp, Homo sapiens
aagactggtttg

SEQ ID NO: 717368 - DNA, 18 bp, Homo sapiens
aagactggtttgtttgct

SEQ ID NO: 717369 - DNA, 17 bp, Homo sapiens
aagactggttttctgcc

SEQ ID NO: 717370 - DNA, 16 bp, Homo sapiens
aagactgtacaaagta

SEQ ID NO: 717371 - DNA, 17 bp, Homo sapiens
aagactgtacaaagtag

SEQ ID NO: 717372 - DNA, 11 bp, Homo sapiens
aagactgtact

SEQ ID NO: 717373 - DNA, 13 bp, Homo sapiens
aagactgtactgg

SEQ ID NO: 717374 - DNA, 19 bp, Homo sapiens
aagactgtcaaatgaactt

SEQ ID NO: 717375 - DNA, 15 bp, Homo sapiens
aagactgtggctgct

SEQ ID NO: 717376 - DNA, 16 bp, Homo sapiens
aagactgttgctcaaa

SEQ ID NO: 717377 - DNA, 24 bp, Homo sapiens
aagactgttgctcaaatctattca

SEQ ID NO: 717378 - DNA, 20 bp, Homo sapiens
aagactgtttttaagtaact

SEQ ID NO: 717379 - DNA, 21 bp, Homo sapiens
aagactgtttttaagtaactt

SEQ ID NO: 717380 - DNA, 22 bp, Homo sapiens
aagacttaaagggcccaatgaa

SEQ ID NO: 717381 - DNA, 21 bp, Homo sapiens
aagacttcaaaatattgagca

SEQ ID NO: 717382 - DNA, 18 bp, Homo sapiens
aagacttcagtatgttgt

SEQ ID NO: 717383 - DNA, 20 bp, Homo sapiens
aagacttcagtatgttgtca

SEQ ID NO: 717384 - DNA, 21 bp, Homo sapiens
aagacttcagtatgttgtcaa

SEQ ID NO: 717385 - DNA, 15 bp, Homo sapiens
aagacttcctctcta

SEQ ID NO: 717386 - DNA, 23 bp, Homo sapiens
aagacttcctctctaccccccac

SEQ ID NO: 717387 - DNA, 20 bp, Homo sapiens
aagacttcggggaagataca

SEQ ID NO: 717388 - DNA, 13 bp, Homo sapiens
aagacttgacagt

SEQ ID NO: 717389 - DNA, 13 bp, Homo sapiens
aagacttgagaag

SEQ ID NO: 717390 - DNA, 21 bp, Homo sapiens
aagacttgagacaatgttttc

SEQ ID NO: 717391 - DNA, 23 bp, Homo sapiens
aagacttggttggtagggtggga

SEQ ID NO: 717392 - DNA, 21 bp, Homo sapiens
aagactttgatccttggaaac

SEQ ID NO: 717393 - DNA, 22 bp, Homo sapiens
aagactttgatccttggaaacc

SEQ ID NO: 717394 - DNA, 21 bp, Homo sapiens
aagacttttatgtgagatttc

SEQ ID NO: 717395 - DNA, 22 bp, Homo sapiens
aagacttttatgtgagatttcc

SEQ ID NO: 717396 - DNA, 18 bp, Homo sapiens
aagagaaaacatctcatc

SEQ ID NO: 717397 - DNA, 13 bp, Homo sapiens
aagagaaaagaaa

SEQ ID NO: 717398 - DNA, 14 bp, Homo sapiens
aagagaaaagaaaa

SEQ ID NO: 717399 - DNA, 16 bp, Homo sapiens
aagagaaaagaaaaaa

SEQ ID NO: 717400 - DNA, 11 bp, Homo sapiens
aagagaaactt

SEQ ID NO: 717401 - DNA, 18 bp, Homo sapiens
aagagaaagtgatttcta

SEQ ID NO: 717402 - DNA, 17 bp, Homo sapiens
aagagaaatacagctgg

SEQ ID NO: 717403 - DNA, 17 bp, Homo sapiens
aagaggcgggccagcca

SEQ ID NO: 717404 - DNA, 16 bp, Homo sapiens
aagaggctgaaagagg

SEQ ID NO: 717405 - DNA, 12 bp, Homo sapiens
aagaggctggtt

SEQ ID NO: 717406 - DNA, 16 bp, Homo sapiens
aagaggctgtgtggcc

SEQ ID NO: 717407 - DNA, 23 bp, Homo sapiens
aagaggctgtgtggccaaccagg

SEQ ID NO: 717408 - DNA, 11 bp, Homo sapiens
aagagggacag

SEQ ID NO: 717409 - DNA, 17 bp, Homo sapiens
aagagggacgcctgggg

SEQ ID NO: 717410 - DNA, 18 bp, Homo sapiens
aagagggagatggagact

SEQ ID NO: 717411 - DNA, 14 bp, Homo sapiens
aagagggcccagcc

SEQ ID NO: 717412 - DNA, 12 bp, Homo sapiens
aagagggcctgt

SEQ ID NO: 717413 - DNA, 13 bp, Homo sapiens
aagaggggcagcc

SEQ ID NO: 717414 - DNA, 16 bp, Homo sapiens
aagaggggcgggctca

SEQ ID NO: 717415 - DNA, 20 bp, Homo sapiens
aagaggggcgggctcagagc

SEQ ID NO: 717416 - DNA, 15 bp, Homo sapiens
aagaggggctggggc

SEQ ID NO: 717417 - DNA, 13 bp, Homo sapiens
aagagggggtgga

SEQ ID NO: 717418 - DNA, 16 bp, Homo sapiens
aagagggggtggaggg

SEQ ID NO: 717419 - DNA, 21 bp, Homo sapiens
aagaggggtgcagaggctgtg

SEQ ID NO: 717420 - DNA, 17 bp, Homo sapiens
aagagggtcccagggct

SEQ ID NO: 717421 - DNA, 20 bp, Homo sapiens
aagagggtctctttgttcaa

SEQ ID NO: 717422 - DNA, 17 bp, Homo sapiens
aagaggtgttatttgga

SEQ ID NO: 717423 - DNA, 12 bp, Homo sapiens
aagaggttttat

SEQ ID NO: 717424 - DNA, 14 bp, Homo sapiens
aagagtaactttac

SEQ ID NO: 717425 - DNA, 23 bp, Homo sapiens
aagagtaactttactctgtgttt

SEQ ID NO: 717426 - DNA, 20 bp, Homo sapiens
aagagtagaaactgcaggga

SEQ ID NO: 717427 - DNA, 13 bp, Homo sapiens
aagagtcagccct

SEQ ID NO: 717428 - DNA, 16 bp, Homo sapiens
aagagtccctttgaag

SEQ ID NO: 717429 - DNA, 19 bp, Homo sapiens
aagagtccggatttctaac

SEQ ID NO: 717430 - DNA, 14 bp, Homo sapiens
aagagtctgggacc

SEQ ID NO: 717431 - DNA, 16 bp, Homo sapiens
aagagtgacttatttt

SEQ ID NO: 717432 - DNA, 22 bp, Homo sapiens
aagagtgacttattttgtctta

SEQ ID NO: 717433 - DNA, 23 bp, Homo sapiens
aagagtgatagtcttttgctttt

SEQ ID NO: 717434 - DNA, 13 bp, Homo sapiens
aagagtgattgca

SEQ ID NO: 717435 - DNA, 15 bp, Homo sapiens
aagagtggaggtgga

SEQ ID NO: 717436 - DNA, 19 bp, Homo sapiens
aagagtgggggagagcagg

SEQ ID NO: 717437 - DNA, 20 bp, Homo sapiens
aagagtgggggagagcaggc

SEQ ID NO: 717438 - DNA, 17 bp, Homo sapiens
aagagtgtgaaatctca

SEQ ID NO: 717439 - DNA, 17 bp, Homo sapiens
aagagttattcaaatga

SEQ ID NO: 717440 - DNA, 17 bp, Homo sapiens
aagagttctatccccaa

SEQ ID NO: 717441 - DNA, 21 bp, Homo sapiens
aagagttctatccccaagctg

SEQ ID NO: 717442 - DNA, 21 bp, Homo sapiens
aagagttgctttgccagagca

SEQ ID NO: 717443 - DNA, 14 bp, Homo sapiens
aagagtttaaaagc

SEQ ID NO: 717444 - DNA, 15 bp, Homo sapiens
aagagtttaaagaga

SEQ ID NO: 717445 - DNA, 23 bp, Homo sapiens
aagagtttgttctgttctggggg

SEQ ID NO: 717446 - DNA, 23 bp, Homo sapiens
aagagttttagagaaaataaatt

SEQ ID NO: 717447 - DNA, 17 bp, Homo sapiens
aagataaaaataataat

SEQ ID NO: 717448 - DNA, 17 bp, Homo sapiens
aagataaagccagaagc

SEQ ID NO: 717449 - DNA, 14 bp, Homo sapiens
aagataaatgagct

SEQ ID NO: 717450 - DNA, 14 bp, Homo sapiens
aagataaatgtgct

SEQ ID NO: 717451 - DNA, 14 bp, Homo sapiens
aagataacttactg

SEQ ID NO: 717452 - DNA, 17 bp, Homo sapiens
aagataacttactgtat

SEQ ID NO: 717453 - DNA, 18 bp, Homo sapiens
aagataacttactgtata

SEQ ID NO: 717454 - DNA, 13 bp, Homo sapiens
aagataagatttc

SEQ ID NO: 717455 - DNA, 18 bp, Homo sapiens
aagataataaattgattt

SEQ ID NO: 717456 - DNA, 19 bp, Homo sapiens
aagataatattaaggaaga

SEQ ID NO: 717457 - DNA, 16 bp, Homo sapiens
aagataatcattgctt

SEQ ID NO: 717458 - DNA, 17 bp, Homo sapiens
aagataatcattgctta

SEQ ID NO: 717459 - DNA, 18 bp, Homo sapiens
aagataatcctagagtct

SEQ ID NO: 717460 - DNA, 23 bp, Homo sapiens
aagataatgttctttaatgttgt

SEQ ID NO: 717461 - DNA, 15 bp, Homo sapiens
aagataatttgcata

SEQ ID NO: 717462 - DNA, 16 bp, Homo sapiens
aagatacactgcactt

SEQ ID NO: 717463 - DNA, 23 bp, Homo sapiens
aagatacactgcactttgtttag

SEQ ID NO: 717464 - DNA, 23 bp, Homo sapiens
aagatacagttactcagaattct

SEQ ID NO: 717465 - DNA, 15 bp, Homo sapiens
aagatacccaaattt

SEQ ID NO: 717466 - DNA, 22 bp, Homo sapiens
aagataccggtgcttctggaaa

SEQ ID NO: 717467 - DNA, 15 bp, Homo sapiens
aagatacgactttat

SEQ ID NO: 717468 - DNA, 18 bp, Homo sapiens
aagatacgactttatttt

SEQ ID NO: 717469 - DNA, 17 bp, Homo sapiens
aagatacttaagtgctg

SEQ ID NO: 717470 - DNA, 14 bp, Homo sapiens
aagataggctctgc

SEQ ID NO: 717471 - DNA, 15 bp, Homo sapiens
aagataggctctgca

SEQ ID NO: 717472 - DNA, 21 bp, Homo sapiens
aagatatatacacaggatcct

SEQ ID NO: 717473 - DNA, 12 bp, Homo sapiens
aagatatataga

SEQ ID NO: 717474 - DNA, 15 bp, Homo sapiens
aagatatattaaaaa

SEQ ID NO: 717475 - DNA, 19 bp, Homo sapiens
aagatatattaaaaatata

SEQ ID NO: 717476 - DNA, 16 bp, Homo sapiens
aagatatggcacttct

SEQ ID NO: 717477 - DNA, 19 bp, Homo sapiens
aagatattgatcaaatata

SEQ ID NO: 717478 - DNA, 17 bp, Homo sapiens
aagatattgtacataaa

SEQ ID NO: 717479 - DNA, 15 bp, Homo sapiens
aagatatttatatat

SEQ ID NO: 717480 - DNA, 15 bp, Homo sapiens
aagatattttgcttt

SEQ ID NO: 717481 - DNA, 15 bp, Homo sapiens
aagatcaaaataaaa

SEQ ID NO: 717482 - DNA, 17 bp, Homo sapiens
aagatcaaaataaaaag

SEQ ID NO: 717483 - DNA, 21 bp, Homo sapiens
aagatcacttgttgttttact

SEQ ID NO: 717484 - DNA, 23 bp, Homo sapiens
aagatcactttctcagttttcat

SEQ ID NO: 717485 - DNA, 23 bp, Homo sapiens
aagatccaccctcaaatgtcaga

SEQ ID NO: 717486 - DNA, 23 bp, Homo sapiens
aagatccgagtgtgatttgaatt

SEQ ID NO: 717487 - DNA, 15 bp, Homo sapiens
aagatcctaaactct

SEQ ID NO: 717488 - DNA, 19 bp, Homo sapiens
aagatcctaaactctctag

SEQ ID NO: 717489 - DNA, 21 bp, Homo sapiens
aagatcctaaactctctagct

SEQ ID NO: 717490 - DNA, 21 bp, Homo sapiens
aagatcctagggcacttctag

SEQ ID NO: 717491 - DNA, 20 bp, Homo sapiens
aagatcctagtgaccaaatt

SEQ ID NO: 717492 - DNA, 20 bp, Homo sapiens
aagatcgcgccactgcactc

SEQ ID NO: 717493 - DNA, 16 bp, Homo sapiens
aagatcgttctctgcc

SEQ ID NO: 717494 - DNA, 23 bp, Homo sapiens
aagatctacatacaaacaatgca

SEQ ID NO: 717495 - DNA, 20 bp, Homo sapiens
aagatctaccccagggagaa

SEQ ID NO: 717496 - DNA, 12 bp, Homo sapiens
aagatctgactg

SEQ ID NO: 717497 - DNA, 13 bp, Homo sapiens
aagatctgttaaa

SEQ ID NO: 717498 - DNA, 20 bp, Homo sapiens
aagatctgttttgaaggcaa

SEQ ID NO: 717499 - DNA, 23 bp, Homo sapiens
aagatcttggcttaatttaatgt

SEQ ID NO: 717500 - DNA, 15 bp, Homo sapiens
aagatgaaattgcca

SEQ ID NO: 717501 - DNA, 16 bp, Homo sapiens
aagatgaaattgccaa

SEQ ID NO: 717502 - DNA, 23 bp, Homo sapiens
aagatgaaggagaggcaacatcc

SEQ ID NO: 717503 - DNA, 19 bp, Homo sapiens
aagatgaatacattttgtt

SEQ ID NO: 717504 - DNA, 22 bp, Homo sapiens
aagatgaatggtctggcaatat

SEQ ID NO: 717505 - DNA, 12 bp, Homo sapiens
aagatgaatttg

SEQ ID NO: 717506 - DNA, 14 bp, Homo sapiens
aagatgactctgag

SEQ ID NO: 717507 - DNA, 18 bp, Homo sapiens
aagatgagagaactggag

SEQ ID NO: 717508 - DNA, 20 bp, Homo sapiens
aagatgagattggcatggct

SEQ ID NO: 717509 - DNA, 18 bp, Homo sapiens
aagatgagatttgccagc

SEQ ID NO: 717510 - DNA, 19 bp, Homo sapiens
aagatgagatttgccagca

SEQ ID NO: 717511 - DNA, 19 bp, Homo sapiens
aagatgagccttgcagata

SEQ ID NO: 717512 - DNA, 14 bp, Homo sapiens
aagatgagctgtgc

SEQ ID NO: 717513 - DNA, 12 bp, Homo sapiens
aagatgagttgg

SEQ ID NO: 717514 - DNA, 14 bp, Homo sapiens
aagatgatcatttg

SEQ ID NO: 717515 - DNA, 19 bp, Homo sapiens
aagatgatggaaacgcact

SEQ ID NO: 717516 - DNA, 12 bp, Homo sapiens
aagatgcactga

SEQ ID NO: 717517 - DNA, 15 bp, Homo sapiens
aagatgccagcttct

SEQ ID NO: 717518 - DNA, 21 bp, Homo sapiens
aagatgccagcttctctctcc

SEQ ID NO: 717519 - DNA, 14 bp, Homo sapiens
aagatgcccctgct

SEQ ID NO: 717520 - DNA, 16 bp, Homo sapiens
aagatgcccctgctcc

SEQ ID NO: 717521 - DNA, 18 bp, Homo sapiens
aagatgcgtttgcctcct

SEQ ID NO: 717522 - DNA, 19 bp, Homo sapiens
aagatgcgtttgcctcctg

SEQ ID NO: 717523 - DNA, 21 bp, Homo sapiens
aagatgcgtttgcctcctgga

SEQ ID NO: 717524 - DNA, 15 bp, Homo sapiens
aagatgctcttttaa

SEQ ID NO: 717525 - DNA, 17 bp, Homo sapiens
aagccctcatcttctct

SEQ ID NO: 717526 - DNA, 11 bp, Homo sapiens
aagccctcctt

SEQ ID NO: 717527 - DNA, 13 bp, Homo sapiens
aagccctccttcc

SEQ ID NO: 717528 - DNA, 14 bp, Homo sapiens
aagccctccttcca

SEQ ID NO: 717529 - DNA, 19 bp, Homo sapiens
aagccctgaatttcttctt

SEQ ID NO: 717530 - DNA, 22 bp, Homo sapiens
aagccctgaatttcttcttttc

SEQ ID NO: 717531 - DNA, 19 bp, Homo sapiens
aagccctgcataatgttaa

SEQ ID NO: 717532 - DNA, 14 bp, Homo sapiens
aagccctgcctctg

SEQ ID NO: 717533 - DNA, 15 bp, Homo sapiens
aagccctgcctctgt

SEQ ID NO: 717534 - DNA, 19 bp, Homo sapiens
aagccctgcctctgtgtag

SEQ ID NO: 717535 - DNA, 22 bp, Homo sapiens
aagccctgttgacacaggtctt

SEQ ID NO: 717536 - DNA, 15 bp, Homo sapiens
aagcccttccatgtc

SEQ ID NO: 717537 - DNA, 15 bp, Homo sapiens
aagccctttgctctg

SEQ ID NO: 717538 - DNA, 15 bp, Homo sapiens
aagccgaccttccct

SEQ ID NO: 717539 - DNA, 14 bp, Homo sapiens
aagccgactctggc

SEQ ID NO: 717540 - DNA, 16 bp, Homo sapiens
aagccgactctggccc

SEQ ID NO: 717541 - DNA, 18 bp, Homo sapiens
aagccgactctggccctg

SEQ ID NO: 717542 - DNA, 18 bp, Homo sapiens
aagccgccagttcatctt

SEQ ID NO: 717543 - DNA, 12 bp, Homo sapiens
aagccggcggcc

SEQ ID NO: 717544 - DNA, 15 bp, Homo sapiens
aagccgggggagggg

SEQ ID NO: 717545 - DNA, 21 bp, Homo sapiens
aagccgggggaggggccctca

SEQ ID NO: 717546 - DNA, 17 bp, Homo sapiens
aagccggtgtccctgga

SEQ ID NO: 717547 - DNA, 19 bp, Homo sapiens
aagccggtgtccctggatg

SEQ ID NO: 717548 - DNA, 18 bp, Homo sapiens
aagccgtctgactccaga

SEQ ID NO: 717549 - DNA, 22 bp, Homo sapiens
aagccgtgctcgccccagcagg

SEQ ID NO: 717550 - DNA, 14 bp, Homo sapiens
aagccgtggcttcc

SEQ ID NO: 717551 - DNA, 18 bp, Homo sapiens
aagccgttgaatctggga

SEQ ID NO: 717552 - DNA, 20 bp, Homo sapiens
aagccgttgaatctgggagg

SEQ ID NO: 717553 - DNA, 22 bp, Homo sapiens
aagccgttgaatctgggaggga

SEQ ID NO: 717554 - DNA, 23 bp, Homo sapiens
aagcctaaaagtgggcttgattc

SEQ ID NO: 717555 - DNA, 14 bp, Homo sapiens
aagcctaaaattga

SEQ ID NO: 717556 - DNA, 22 bp, Homo sapiens
aagcctaagggatcctgcctgc

SEQ ID NO: 717557 - DNA, 23 bp, Homo sapiens
aagcctacattctccagttgatt

SEQ ID NO: 717558 - DNA, 23 bp, Homo sapiens
aagcctaggtgttgtcagcaggc

SEQ ID NO: 717559 - DNA, 23 bp, Homo sapiens
aagcctatacgtttctgtggagt

SEQ ID NO: 717560 - DNA, 22 bp, Homo sapiens
aagcctcaaagagagaaagttt

SEQ ID NO: 717561 - DNA, 14 bp, Homo sapiens
aagcctcatattta

SEQ ID NO: 717562 - DNA, 20 bp, Homo sapiens
aagcctcatatttaaagaca

SEQ ID NO: 717563 - DNA, 18 bp, Homo sapiens
aagcctccaagcacagag

SEQ ID NO: 717564 - DNA, 23 bp, Homo sapiens
aagcctccacagcgagggcagct

SEQ ID NO: 717565 - DNA, 22 bp, Homo sapiens
aagcctccatttagttctttgt

SEQ ID NO: 717566 - DNA, 16 bp, Homo sapiens
aagcctcctgccccct

SEQ ID NO: 717567 - DNA, 22 bp, Homo sapiens
aagcctctgccctgcctccctt

SEQ ID NO: 717568 - DNA, 13 bp, Homo sapiens
aagcctctggaaa

SEQ ID NO: 717569 - DNA, 14 bp, Homo sapiens
aagcctctggctag

SEQ ID NO: 717570 - DNA, 21 bp, Homo sapiens
aagcctcttattccaggagaa

SEQ ID NO: 717571 - DNA, 21 bp, Homo sapiens
aagcctgaaggggcgtctgtt

SEQ ID NO: 717572 - DNA, 15 bp, Homo sapiens
aagcctgatgctgac

SEQ ID NO: 717573 - DNA, 21 bp, Homo sapiens
aagcctgcacaataaaaatgt

SEQ ID NO: 717574 - DNA, 12 bp, Homo sapiens
aagcctgcattc

SEQ ID NO: 717575 - DNA, 23 bp, Homo sapiens
aagcctgcctaggaattcccagc

SEQ ID NO: 717576 - DNA, 21 bp, Homo sapiens
aagcctgcgttggtccagagc

SEQ ID NO: 717577 - DNA, 12 bp, Homo sapiens
aagcctgctggc

SEQ ID NO: 717578 - DNA, 22 bp, Homo sapiens
aagcctgctggctgcggccccc

SEQ ID NO: 717579 - DNA, 21 bp, Homo sapiens
aagcctgctgtgtccttcctc

SEQ ID NO: 717580 - DNA, 16 bp, Homo sapiens
aagcctggaagccatc

SEQ ID NO: 717581 - DNA, 16 bp, Homo sapiens
aagcctggactctgcc

SEQ ID NO: 717582 - DNA, 13 bp, Homo sapiens
aagcctggcaccc

SEQ ID NO: 717583 - DNA, 17 bp, Homo sapiens
aagcctggcacccaccg

SEQ ID NO: 717584 - DNA, 15 bp, Homo sapiens
aagcctggtttttct

SEQ ID NO: 717585 - DNA, 16 bp, Homo sapiens
aagcctgtccccagac

SEQ ID NO: 717586 - DNA, 11 bp, Homo sapiens
aagcctgtcct

SEQ ID NO: 717587 - DNA, 13 bp, Homo sapiens
aagcctgtctctt

SEQ ID NO: 717588 - DNA, 13 bp, Homo sapiens
aagcctgtgcaaa

SEQ ID NO: 717589 - DNA, 16 bp, Homo sapiens
aagcctgtgcaaaaaa

SEQ ID NO: 717590 - DNA, 17 bp, Homo sapiens
aagcctgtgcaaaaaaa

SEQ ID NO: 717591 - DNA, 20 bp, Homo sapiens
aagcctgttcccctcactgg

SEQ ID NO: 717592 - DNA, 14 bp, Homo sapiens
aagccttaaaatgc

SEQ ID NO: 717593 - DNA, 21 bp, Homo sapiens
aagccttaagccataggccca

SEQ ID NO: 717594 - DNA, 14 bp, Homo sapiens
aagccttagggaag

SEQ ID NO: 717595 - DNA, 19 bp, Homo sapiens
aagccttcagctccaggga

SEQ ID NO: 717596 - DNA, 15 bp, Homo sapiens
aagccttcatttgca

SEQ ID NO: 717597 - DNA, 11 bp, Homo sapiens
aagccttccta

SEQ ID NO: 717598 - DNA, 22 bp, Homo sapiens
aagccttggctcgttctcttct

SEQ ID NO: 717599 - DNA, 12 bp, Homo sapiens
aaggaaccttcc

SEQ ID NO: 717600 - DNA, 22 bp, Homo sapiens
aaggaactctggcttccaggta

SEQ ID NO: 717601 - DNA, 13 bp, Homo sapiens
aaggaagaaaacg

SEQ ID NO: 717602 - DNA, 15 bp, Homo sapiens
aaggaagaaaacgga

SEQ ID NO: 717603 - DNA, 13 bp, Homo sapiens
aaggaagagaaga

SEQ ID NO: 717604 - DNA, 22 bp, Homo sapiens
aaggaagcattgtaaaataatt

SEQ ID NO: 717605 - DNA, 22 bp, Homo sapiens
aaggaagccttgctcattcttg

SEQ ID NO: 717606 - DNA, 16 bp, Homo sapiens
aaggaagctccactgt

SEQ ID NO: 717607 - DNA, 13 bp, Homo sapiens
aaggaagctcctt

SEQ ID NO: 717608 - DNA, 22 bp, Homo sapiens
aaggaaggagactcacctctgc

SEQ ID NO: 717609 - DNA, 12 bp, Homo sapiens
aaggaaggagcc

SEQ ID NO: 717610 - DNA, 13 bp, Homo sapiens
aaggaaggaggca

SEQ ID NO: 717611 - DNA, 12 bp, Homo sapiens
aaggaagggcag

SEQ ID NO: 717612 - DNA, 12 bp, Homo sapiens
aaggaaggtgga

SEQ ID NO: 717613 - DNA, 17 bp, Homo sapiens
aaggaaggtggatggcc

SEQ ID NO: 717614 - DNA, 15 bp, Homo sapiens
aaggaaggttcatgt

SEQ ID NO: 717615 - DNA, 14 bp, Homo sapiens
aaggaagtgaagag

SEQ ID NO: 717616 - DNA, 18 bp, Homo sapiens
aaggaagtggggacagat

SEQ ID NO: 717617 - DNA, 23 bp, Homo sapiens
aaggaagttattaacgggcatgt

SEQ ID NO: 717618 - DNA, 15 bp, Homo sapiens
aaggaagtttgattt

SEQ ID NO: 717619 - DNA, 18 bp, Homo sapiens
aaggaatatatggcagag

SEQ ID NO: 717620 - DNA, 21 bp, Homo sapiens
aaggaatatgggagaaatagt

SEQ ID NO: 717621 - DNA, 19 bp, Homo sapiens
aaggaatcacgttagagga

SEQ ID NO: 717622 - DNA, 16 bp, Homo sapiens
aaggaatcattccagt

SEQ ID NO: 717623 - DNA, 18 bp, Homo sapiens
aaggaatcattccagtgc

SEQ ID NO: 717624 - DNA, 17 bp, Homo sapiens
aaggaatctccagtttt

SEQ ID NO: 717625 - DNA, 21 bp, Homo sapiens
aaggaatctccagttttcagt

SEQ ID NO: 717626 - DNA, 13 bp, Homo sapiens
aaggaatctggca

SEQ ID NO: 717627 - DNA, 17 bp, Homo sapiens
aaggaatgtgtccaaga

SEQ ID NO: 717628 - DNA, 22 bp, Homo sapiens
aaggaatttccctgtgtggatg

SEQ ID NO: 717629 - DNA, 14 bp, Homo sapiens
aaggaatttcttaa

SEQ ID NO: 717630 - DNA, 17 bp, Homo sapiens
aaggaatttcttaactt

SEQ ID NO: 717631 - DNA, 19 bp, Homo sapiens
aaggaatttcttaacttct

SEQ ID NO: 717632 - DNA, 20 bp, Homo sapiens
aaggaatttcttaacttctt

SEQ ID NO: 717633 - DNA, 14 bp, Homo sapiens
aaggaatttgatga

SEQ ID NO: 717634 - DNA, 15 bp, Homo sapiens
aaggaatttgtactt

SEQ ID NO: 717635 - DNA, 17 bp, Homo sapiens
aaggacaaaaatgaact

SEQ ID NO: 717636 - DNA, 20 bp, Homo sapiens
aaggacaaattagcatgcaa

SEQ ID NO: 717637 - DNA, 13 bp, Homo sapiens
aaggacaacagtt

SEQ ID NO: 717638 - DNA, 13 bp, Homo sapiens
aaggacacagcag

SEQ ID NO: 717639 - DNA, 16 bp, Homo sapiens
aaggacacttcctgcc

SEQ ID NO: 717640 - DNA, 15 bp, Homo sapiens
aaggacaggagcctg

SEQ ID NO: 717641 - DNA, 15 bp, Homo sapiens
aaggacatcagcaaa

SEQ ID NO: 717642 - DNA, 23 bp, Homo sapiens
aaggaccacattttatatttatt

SEQ ID NO: 717643 - DNA, 13 bp, Homo sapiens
aaggaccagcttt

SEQ ID NO: 717644 - DNA, 13 bp, Homo sapiens
aaggacccaccca

SEQ ID NO: 717645 - DNA, 18 bp, Homo sapiens
aaggacccacccatcttc

SEQ ID NO: 717646 - DNA, 15 bp, Homo sapiens
aaggacccctcacct

SEQ ID NO: 717647 - DNA, 21 bp, Homo sapiens
aaggacccggaggggcctggc

SEQ ID NO: 717648 - DNA, 21 bp, Homo sapiens
aaggactacgttaagggaagg

SEQ ID NO: 717649 - DNA, 16 bp, Homo sapiens
aaggactcagctgtgg

SEQ ID NO: 717650 - DNA, 15 bp, Homo sapiens
aaggactccaatgtc

SEQ ID NO: 717651 - DNA, 15 bp, Homo sapiens
aaggactgagggcag

SEQ ID NO: 717652 - DNA, 22 bp, Homo sapiens
aaggactgcagacaggctctga

SEQ ID NO: 717653 - DNA, 23 bp, Homo sapiens
aaggactgttttttcctgagctt

SEQ ID NO: 717654 - DNA, 16 bp, Homo sapiens
aaggacttcaggaaca

SEQ ID NO: 717655 - DNA, 15 bp, Homo sapiens
aaggactttgtacat

SEQ ID NO: 717656 - DNA, 19 bp, Homo sapiens
aaggagaagagtattttta

SEQ ID NO: 717657 - DNA, 16 bp, Homo sapiens
aaggagactcacctct

SEQ ID NO: 717658 - DNA, 22 bp, Homo sapiens
aaggagactcacctctgcctca

SEQ ID NO: 717659 - DNA, 13 bp, Homo sapiens
aaggagagcctgc

SEQ ID NO: 717660 - DNA, 11 bp, Homo sapiens
aaggagagcta

SEQ ID NO: 717661 - DNA, 22 bp, Homo sapiens
aaggagaggaaaatgtttcctt

SEQ ID NO: 717662 - DNA, 15 bp, Homo sapiens
aaggagattgggaga

SEQ ID NO: 717663 - DNA, 14 bp, Homo sapiens
aaggagatttacaa

SEQ ID NO: 717664 - DNA, 21 bp, Homo sapiens
aaggagcacaggtcccacctc

SEQ ID NO: 717665 - DNA, 12 bp, Homo sapiens
aaggagcccctg

SEQ ID NO: 717666 - DNA, 22 bp, Homo sapiens
aaggagccttgataatacttga

SEQ ID NO: 717667 - DNA, 19 bp, Homo sapiens
aaggagcgctagtgccttg

SEQ ID NO: 717668 - DNA, 15 bp, Homo sapiens
aaggagcgggcaggg

SEQ ID NO: 717669 - DNA, 19 bp, Homo sapiens
aaggagctcaccctgcccg

SEQ ID NO: 717670 - DNA, 21 bp, Homo sapiens
aaggagctcaccctgcccgct

SEQ ID NO: 717671 - DNA, 19 bp, Homo sapiens
aaggagctgatttccaggc

SEQ ID NO: 717672 - DNA, 21 bp, Homo sapiens
aaggagctgatttccaggccc

SEQ ID NO: 717673 - DNA, 18 bp, Homo sapiens
aaggagctgctatagcct

SEQ ID NO: 717674 - DNA, 21 bp, Homo sapiens
aaggagctgctatagcctggg

SEQ ID NO: 717675 - DNA, 14 bp, Homo sapiens
aaggagctttctca

SEQ ID NO: 717676 - DNA, 21 bp, Homo sapiens
aaggaggaaataactaagaga

SEQ ID NO: 717677 - DNA, 20 bp, Homo sapiens
aaggaggaagagaaaaaata

SEQ ID NO: 717678 - DNA, 16 bp, Homo sapiens
aaagcccaacctcctg

SEQ ID NO: 717679 - DNA, 20 bp, Homo sapiens
aaagcccacaggcctgttcc

SEQ ID NO: 717680 - DNA, 13 bp, Homo sapiens
aaagcccagcatc

SEQ ID NO: 717681 - DNA, 23 bp, Homo sapiens
aaagcccattttcaactgctttg

SEQ ID NO: 717682 - DNA, 12 bp, Homo sapiens
aaagccctgcct

SEQ ID NO: 717683 - DNA, 13 bp, Homo sapiens
aaagccctgcctc

SEQ ID NO: 717684 - DNA, 15 bp, Homo sapiens
aaagccgggggaggg

SEQ ID NO: 717685 - DNA, 18 bp, Homo sapiens
aaagcctagacaaccttt

SEQ ID NO: 717686 - DNA, 16 bp, Homo sapiens
aaagcctcctccagcc

SEQ ID NO: 717687 - DNA, 13 bp, Homo sapiens
aaagcctctctct

SEQ ID NO: 717688 - DNA, 17 bp, Homo sapiens
aaagcctctctctccct

SEQ ID NO: 717689 - DNA, 16 bp, Homo sapiens
aaagcctctgctgcca

SEQ ID NO: 717690 - DNA, 22 bp, Homo sapiens
aaagcctgtaagcctgcaagcc

SEQ ID NO: 717691 - DNA, 16 bp, Homo sapiens
aaagcctgttgtttaa

SEQ ID NO: 717692 - DNA, 22 bp, Homo sapiens
aaagccttaagcaaattttgta

SEQ ID NO: 717693 - DNA, 10 bp, Homo sapiens
aaagccttcc

SEQ ID NO: 717694 - DNA, 18 bp, Homo sapiens
aaagccttttaaatcatc

SEQ ID NO: 717695 - DNA, 20 bp, Homo sapiens
aaagccttttgctttatgct

SEQ ID NO: 717696 - DNA, 16 bp, Homo sapiens
aaagcgaaaaaatcag

SEQ ID NO: 717697 - DNA, 14 bp, Homo sapiens
aaagcgacagattc

SEQ ID NO: 717698 - DNA, 23 bp, Homo sapiens
aaagcgacagattcataaagtaa

SEQ ID NO: 717699 - DNA, 18 bp, Homo sapiens
aaagcgcccacccaggtc

SEQ ID NO: 717700 - DNA, 19 bp, Homo sapiens
aaagcggacatcagctggt

SEQ ID NO: 717701 - DNA, 16 bp, Homo sapiens
aaagcgggcagccccg

SEQ ID NO: 717702 - DNA, 16 bp, Homo sapiens
aaagcggggggagggt

SEQ ID NO: 717703 - DNA, 14 bp, Homo sapiens
aaagcggtccctgt

SEQ ID NO: 717704 - DNA, 23 bp, Homo sapiens
aaagcgtgagcttaaaatacaag

SEQ ID NO: 717705 - DNA, 16 bp, Homo sapiens
aaagctaaaataaaga

SEQ ID NO: 717706 - DNA, 17 bp, Homo sapiens
aaagctaaaatgatttt

SEQ ID NO: 717707 - DNA, 13 bp, Homo sapiens
aaagctaaactga

SEQ ID NO: 717708 - DNA, 14 bp, Homo sapiens
aaagctaacatctt

SEQ ID NO: 717709 - DNA, 17 bp, Homo sapiens
aaagctaacatctttac

SEQ ID NO: 717710 - DNA, 14 bp, Homo sapiens
aaagctaatgtgca

SEQ ID NO: 717711 - DNA, 16 bp, Homo sapiens
aaagctaatgtgcagg

SEQ ID NO: 717712 - DNA, 20 bp, Homo sapiens
aaagctacctgtggtgatgt

SEQ ID NO: 717713 - DNA, 20 bp, Homo sapiens
aaagctataaagcagtattt

SEQ ID NO: 717714 - DNA, 22 bp, Homo sapiens
aaagctatggtgagatgcagct

SEQ ID NO: 717715 - DNA, 14 bp, Homo sapiens
aaagctatgttaca

SEQ ID NO: 717716 - DNA, 19 bp, Homo sapiens
aaagctcaaatgaaatgta

SEQ ID NO: 717717 - DNA, 14 bp, Homo sapiens
aaagctcagatgac

SEQ ID NO: 717718 - DNA, 20 bp, Homo sapiens
aaagctcatgcatttcaagc

SEQ ID NO: 717719 - DNA, 14 bp, Homo sapiens
aaagctcccttgaa

SEQ ID NO: 717720 - DNA, 14 bp, Homo sapiens
aaagctctgaaaac

SEQ ID NO: 717721 - DNA, 23 bp, Homo sapiens
aaagctgatgatgtctcttgtag

SEQ ID NO: 717722 - DNA, 14 bp, Homo sapiens
aaagctgatttttt

SEQ ID NO: 717723 - DNA, 17 bp, Homo sapiens
aaagctgccatttccct

SEQ ID NO: 717724 - DNA, 17 bp, Homo sapiens
aaagctgcctgtagtta

SEQ ID NO: 717725 - DNA, 13 bp, Homo sapiens
aaagctgcctgtg

SEQ ID NO: 717726 - DNA, 22 bp, Homo sapiens
aaagctgcctgtgccatgccca

SEQ ID NO: 717727 - DNA, 16 bp, Homo sapiens
aaagctggaacatttg

SEQ ID NO: 717728 - DNA, 15 bp, Homo sapiens
aaagctggtttaatg

SEQ ID NO: 717729 - DNA, 16 bp, Homo sapiens
aaagctgtaaattact

SEQ ID NO: 717730 - DNA, 13 bp, Homo sapiens
aaagctgtacacc

SEQ ID NO: 717731 - DNA, 23 bp, Homo sapiens
aaagctgtggccagcttgttatt

SEQ ID NO: 717732 - DNA, 14 bp, Homo sapiens
aaagctgtgtttat

SEQ ID NO: 717733 - DNA, 14 bp, Homo sapiens
aaagctgttaaact

SEQ ID NO: 717734 - DNA, 14 bp, Homo sapiens
aaagcttaaaaaaa

SEQ ID NO: 717735 - DNA, 14 bp, Homo sapiens
aaagcttaaaactt

SEQ ID NO: 717736 - DNA, 15 bp, Homo sapiens
aaagcttaaaacttt

SEQ ID NO: 717737 - DNA, 19 bp, Homo sapiens
aaagcttaaaactttgaag

SEQ ID NO: 717738 - DNA, 19 bp, Homo sapiens
aaagcttaaattgcttttg

SEQ ID NO: 717739 - DNA, 19 bp, Homo sapiens
aaagcttactgtttttgat

SEQ ID NO: 717740 - DNA, 14 bp, Homo sapiens
aaagcttatagaat

SEQ ID NO: 717741 - DNA, 16 bp, Homo sapiens
aaagcttatttttatg

SEQ ID NO: 717742 - DNA, 18 bp, Homo sapiens
aaagcttccatgattcta

SEQ ID NO: 717743 - DNA, 11 bp, Homo sapiens
aaagcttcccc

SEQ ID NO: 717744 - DNA, 21 bp, Homo sapiens
aaagcttctatcccaggaggt

SEQ ID NO: 717745 - DNA, 20 bp, Homo sapiens
aaagcttgaagatcgttagt

SEQ ID NO: 717746 - DNA, 19 bp, Homo sapiens
aaagcttggattaaataca

SEQ ID NO: 717747 - DNA, 18 bp, Homo sapiens
aaagcttggttctgtgaa

SEQ ID NO: 717748 - DNA, 23 bp, Homo sapiens
aaagcttgtggccccttttactt

SEQ ID NO: 717749 - DNA, 14 bp, Homo sapiens
aaagctttatcttt

SEQ ID NO: 717750 - DNA, 15 bp, Homo sapiens
aaagctttatctttg

SEQ ID NO: 717751 - DNA, 19 bp, Homo sapiens
aaagctttatctttgtgta

SEQ ID NO: 717752 - DNA, 18 bp, Homo sapiens
aaagctttattaccagtg

SEQ ID NO: 717753 - DNA, 23 bp, Homo sapiens
aaagctttcatgtcccagaactt

SEQ ID NO: 717754 - DNA, 14 bp, Homo sapiens
aaagctttcctgcc

SEQ ID NO: 717755 - DNA, 13 bp, Homo sapiens
aaagctttgctac

SEQ ID NO: 717756 - DNA, 22 bp, Homo sapiens
aaagctttgctacaaatttatg

SEQ ID NO: 717757 - DNA, 18 bp, Homo sapiens
aaagctttggctgagacc

SEQ ID NO: 717758 - DNA, 15 bp, Homo sapiens
aaagcttttattcct

SEQ ID NO: 717759 - DNA, 16 bp, Homo sapiens
aaagcttttgtctaca

SEQ ID NO: 717760 - DNA, 20 bp, Homo sapiens
aaaggaaaaaaaaacagcca

SEQ ID NO: 717761 - DNA, 14 bp, Homo sapiens
aaaggaaaaaaaac

SEQ ID NO: 717762 - DNA, 14 bp, Homo sapiens
aaaggaaaaataat

SEQ ID NO: 717763 - DNA, 22 bp, Homo sapiens
aaaggaaaacaattcaagctga

SEQ ID NO: 717764 - DNA, 16 bp, Homo sapiens
aaaggaaaatgtctgt

SEQ ID NO: 717765 - DNA, 16 bp, Homo sapiens
aaaggaaagaaaacat

SEQ ID NO: 717766 - DNA, 18 bp, Homo sapiens
aaaggaaagctgtgttta

SEQ ID NO: 717767 - DNA, 17 bp, Homo sapiens
aaaggaaatctcacccc

SEQ ID NO: 717768 - DNA, 12 bp, Homo sapiens
aaaggaaatttg

SEQ ID NO: 717769 - DNA, 13 bp, Homo sapiens
aaaggaaatttgt

SEQ ID NO: 717770 - DNA, 12 bp, Homo sapiens
aaaggaactaga

SEQ ID NO: 717771 - DNA, 13 bp, Homo sapiens
aaaggaaggaaaa

SEQ ID NO: 717772 - DNA, 15 bp, Homo sapiens
aaaggaaggagagat

SEQ ID NO: 717773 - DNA, 21 bp, Homo sapiens
aaaggaagtggggacagattc

SEQ ID NO: 717774 - DNA, 13 bp, Homo sapiens
aaaggaatataag

SEQ ID NO: 717775 - DNA, 17 bp, Homo sapiens
aaaggaatcatttctat

SEQ ID NO: 717776 - DNA, 13 bp, Homo sapiens
aaaggaatgagaa

SEQ ID NO: 717777 - DNA, 22 bp, Homo sapiens
aaaggaatgtgaaatttaaata

SEQ ID NO: 717778 - DNA, 19 bp, Homo sapiens
aaaggacagagtatgaaca

SEQ ID NO: 717779 - DNA, 21 bp, Homo sapiens
aaaggacatgaacagacactt

SEQ ID NO: 717780 - DNA, 15 bp, Homo sapiens
aaaggaccctgtttc

SEQ ID NO: 717781 - DNA, 19 bp, Homo sapiens
aaaggaccctgtttctgta

SEQ ID NO: 717782 - DNA, 19 bp, Homo sapiens
aaaggacgcctgcaggaga

SEQ ID NO: 717783 - DNA, 13 bp, Homo sapiens
aaaggactgtaat

SEQ ID NO: 717784 - DNA, 16 bp, Homo sapiens
aaaagcattttgtaat

SEQ ID NO: 717785 - DNA, 21 bp, Homo sapiens
aaaagcatttttcaatatatt

SEQ ID NO: 717786 - DNA, 12 bp, Homo sapiens
aaaagccagggc

SEQ ID NO: 717787 - DNA, 18 bp, Homo sapiens
aaaagccagggctggaga

SEQ ID NO: 717788 - DNA, 14 bp, Homo sapiens
aaaagccatgtata

SEQ ID NO: 717789 - DNA, 22 bp, Homo sapiens
aaaagccatgtatttcagggac

SEQ ID NO: 717790 - DNA, 15 bp, Homo sapiens
aaaagcctggttttt

SEQ ID NO: 717791 - DNA, 15 bp, Homo sapiens
aaaagccttattcta

SEQ ID NO: 717792 - DNA, 20 bp, Homo sapiens
aaaagcgacccattcagaga

SEQ ID NO: 717793 - DNA, 22 bp, Homo sapiens
aaaagcggaaagttagtgcttg

SEQ ID NO: 717794 - DNA, 17 bp, Homo sapiens
aaaagcgtgagcttaaa

SEQ ID NO: 717795 - DNA, 23 bp, Homo sapiens
aaaagcgtgagcttaaaatacaa

SEQ ID NO: 717796 - DNA, 19 bp, Homo sapiens
aaaggagaaattttggttt

SEQ ID NO: 717797 - DNA, 20 bp, Homo sapiens
aaaggagaattgaattctgg

SEQ ID NO: 717798 - DNA, 16 bp, Homo sapiens
aaaggagacaaagcag

SEQ ID NO: 717799 - DNA, 20 bp, Homo sapiens
aaaggagagaacgggcgtca

SEQ ID NO: 717800 - DNA, 12 bp, Homo sapiens
aaaggagagaag

SEQ ID NO: 717801 - DNA, 16 bp, Homo sapiens
aaaggagagaagaaag

SEQ ID NO: 717802 - DNA, 17 bp, Homo sapiens
aaaggagagctagcagc

SEQ ID NO: 717803 - DNA, 16 bp, Homo sapiens
aaaggagcgggcaggg

SEQ ID NO: 717804 - DNA, 21 bp, Homo sapiens
aaaggagctttctcaatgtct

SEQ ID NO: 717805 - DNA, 21 bp, Homo sapiens
aaaggaggggaaacaatgaaa

SEQ ID NO: 717806 - DNA, 14 bp, Homo sapiens
aaaggataactctg

SEQ ID NO: 717807 - DNA, 22 bp, Homo sapiens
aaaggataattatccaataaaa

SEQ ID NO: 717808 - DNA, 18 bp, Homo sapiens
aaaggtttatgaaaaaga

SEQ ID NO: 717809 - DNA, 22 bp, Homo sapiens
aaaggtttatgaaaaagaagaa

SEQ ID NO: 717810 - DNA, 19 bp, Homo sapiens
aaaggtttgcattctcaca

SEQ ID NO: 717811 - DNA, 14 bp, Homo sapiens
aaaggttttgtatt

SEQ ID NO: 717812 - DNA, 17 bp, Homo sapiens
aaaggttttgtattttt

SEQ ID NO: 717813 - DNA, 14 bp, Homo sapiens
aaataagaaacttt

SEQ ID NO: 717814 - DNA, 15 bp, Homo sapiens
aaataagaaactttt

SEQ ID NO: 717815 - DNA, 14 bp, Homo sapiens
aaataagaatagaa

SEQ ID NO: 717816 - DNA, 22 bp, Homo sapiens
aaataagagcatgatttgaaaa

SEQ ID NO: 717817 - DNA, 13 bp, Homo sapiens
aaataagcaggtg

SEQ ID NO: 717818 - DNA, 23 bp, Homo sapiens
aaatagcctaaatgatggtgctt

SEQ ID NO: 717819 - DNA, 21 bp, Homo sapiens
aaatagcggtacaagttctgg

SEQ ID NO: 717820 - DNA, 17 bp, Homo sapiens
aaatagcgttcttgtaa

SEQ ID NO: 717821 - DNA, 12 bp, Homo sapiens
aaatagctatat

SEQ ID NO: 717822 - DNA, 19 bp, Homo sapiens
aaatagctatatccatgta

SEQ ID NO: 717823 - DNA, 18 bp, Homo sapiens
aaatagcttattatagaa

SEQ ID NO: 717824 - DNA, 15 bp, Homo sapiens
aaatagcttctgttt

SEQ ID NO: 717825 - DNA, 18 bp, Homo sapiens
aaataggagtgagtgtat

SEQ ID NO: 717826 - DNA, 16 bp, Homo sapiens
aaataggcagaatgga

SEQ ID NO: 717827 - DNA, 15 bp, Homo sapiens
aaatagggtatattt

SEQ ID NO: 717828 - DNA, 16 bp, Homo sapiens
aaatagggtctaactc

SEQ ID NO: 717829 - DNA, 17 bp, Homo sapiens
aaataggtatcaaaata

SEQ ID NO: 717830 - DNA, 12 bp, Homo sapiens
aaatagtaaaca

SEQ ID NO: 717831 - DNA, 16 bp, Homo sapiens
aaatagtatgaaaatg

SEQ ID NO: 717832 - DNA, 12 bp, Homo sapiens
aaattaaatgcc

SEQ ID NO: 717833 - DNA, 18 bp, Homo sapiens
aaattaacagtcctaact

SEQ ID NO: 717834 - DNA, 20 bp, Homo sapiens
aaattaaccgagacacttta

SEQ ID NO: 717835 - DNA, 18 bp, Homo sapiens
aaattaactgctccaaat

SEQ ID NO: 717836 - DNA, 21 bp, Homo sapiens
aaattaactgctccaaattta

SEQ ID NO: 717837 - DNA, 21 bp, Homo sapiens
aaattaactgggtaatgaaac

SEQ ID NO: 717838 - DNA, 13 bp, Homo sapiens
aaattaactgtat

SEQ ID NO: 717839 - DNA, 14 bp, Homo sapiens
aaattaactgtatg

SEQ ID NO: 717840 - DNA, 14 bp, Homo sapiens
aaattaacttttat

SEQ ID NO: 717841 - DNA, 19 bp, Homo sapiens
aaattaacttttataaact

SEQ ID NO: 717842 - DNA, 23 bp, Homo sapiens
aaattaacttttttgtggcaatt

SEQ ID NO: 717843 - DNA, 14 bp, Homo sapiens
aaattaagaagaaa

SEQ ID NO: 717844 - DNA, 13 bp, Homo sapiens
aaattaagaagag

SEQ ID NO: 717845 - DNA, 15 bp, Homo sapiens
aaattaagaaggcaa

SEQ ID NO: 717846 - DNA, 13 bp, Homo sapiens
aaattaagacttt

SEQ ID NO: 717847 - DNA, 13 bp, Homo sapiens
aaattaagatcct

SEQ ID NO: 717848 - DNA, 19 bp, Homo sapiens
aaattaagatcctaaactc

SEQ ID NO: 717849 - DNA, 17 bp, Homo sapiens
aaattaagatgttcaga

SEQ ID NO: 717850 - DNA, 14 bp, Homo sapiens
aaattaagtagaac

SEQ ID NO: 717851 - DNA, 15 bp, Homo sapiens
aaattaagttgaaaa

SEQ ID NO: 717852 - DNA, 22 bp, Homo sapiens
aaattaataaatcatgttttga

SEQ ID NO: 717853 - DNA, 14 bp, Homo sapiens
aaattaatagcttt

SEQ ID NO: 717854 - DNA, 14 bp, Homo sapiens
aaattaatatcttt

SEQ ID NO: 717855 - DNA, 20 bp, Homo sapiens
aaattaatcagccccagagt

SEQ ID NO: 717856 - DNA, 16 bp, Homo sapiens
aaattaatcatagtca

SEQ ID NO: 717857 - DNA, 19 bp, Homo sapiens
aaattaattatatttctac

SEQ ID NO: 717858 - DNA, 12 bp, Homo sapiens
aaattaatttgt

SEQ ID NO: 717859 - DNA, 16 bp, Homo sapiens
aaattaatttgtgaat

SEQ ID NO: 717860 - DNA, 13 bp, Homo sapiens
aaattacaatttt

SEQ ID NO: 717861 - DNA, 15 bp, Homo sapiens
aaattacaattttat

SEQ ID NO: 717862 - DNA, 18 bp, Homo sapiens
aaattacacaataaagca

SEQ ID NO: 717863 - DNA, 23 bp, Homo sapiens
aaattacacaataaagcagtcct

SEQ ID NO: 717864 - DNA, 16 bp, Homo sapiens
aaattacacccaaaga

SEQ ID NO: 717865 - DNA, 14 bp, Homo sapiens
aaattacatgtttt

SEQ ID NO: 717866 - DNA, 12 bp, Homo sapiens
aaattacatttt

SEQ ID NO: 717867 - DNA, 15 bp, Homo sapiens
aaattacctgtggat

SEQ ID NO: 717868 - DNA, 13 bp, Homo sapiens
aaattacctttaa

SEQ ID NO: 717869 - DNA, 18 bp, Homo sapiens
aaattactaataaattga

SEQ ID NO: 717870 - DNA, 22 bp, Homo sapiens
aaattactaattttacacatta

SEQ ID NO: 717871 - DNA, 20 bp, Homo sapiens
aaattactatctgttgaaaa

SEQ ID NO: 717872 - DNA, 14 bp, Homo sapiens
aaattactattctt

SEQ ID NO: 717873 - DNA, 11 bp, Homo sapiens
aaattagaaaa

SEQ ID NO: 717874 - DNA, 12 bp, Homo sapiens
aaattagaaaaa

SEQ ID NO: 717875 - DNA, 19 bp, Homo sapiens
aaattagaaaaaaattact

SEQ ID NO: 717876 - DNA, 20 bp, Homo sapiens
aaattagaaacaccattcat

SEQ ID NO: 717877 - DNA, 23 bp, Homo sapiens
aaattagaaaccttaatatgtgg

SEQ ID NO: 717878 - DNA, 19 bp, Homo sapiens
aaattagaaaggacaacag

SEQ ID NO: 717879 - DNA, 20 bp, Homo sapiens
aaattagactgtgattcaga

SEQ ID NO: 717880 - DNA, 18 bp, Homo sapiens
aaattagataaattgtag

SEQ ID NO: 717881 - DNA, 20 bp, Homo sapiens
aaattagatcctaagatgtg

SEQ ID NO: 717882 - DNA, 15 bp, Homo sapiens
aaattagccgggcgt

SEQ ID NO: 717883 - DNA, 19 bp, Homo sapiens
aaattagctgtgtgaaata

SEQ ID NO: 717884 - DNA, 19 bp, Homo sapiens
aaattaggatttcatgatt

SEQ ID NO: 717885 - DNA, 18 bp, Homo sapiens
aaattaggggttaaagca

SEQ ID NO: 717886 - DNA, 14 bp, Homo sapiens
aaattaggttgaaa

SEQ ID NO: 717887 - DNA, 16 bp, Homo sapiens
aaattaggttgaaaca

SEQ ID NO: 717888 - DNA, 15 bp, Homo sapiens
aaattagtcttttgt

SEQ ID NO: 717889 - DNA, 22 bp, Homo sapiens
aaattagtcttttgtaatatca

SEQ ID NO: 717890 - DNA, 19 bp, Homo sapiens
aaattataaagccttcaga

SEQ ID NO: 717891 - DNA, 19 bp, Homo sapiens
aaattataacttaaaatat

SEQ ID NO: 717892 - DNA, 20 bp, Homo sapiens
aaattataagggccctgccc

SEQ ID NO: 717893 - DNA, 15 bp, Homo sapiens
aaattcccttcctgt

SEQ ID NO: 717894 - DNA, 21 bp, Homo sapiens
aaattcccttttcaccttttc

SEQ ID NO: 717895 - DNA, 19 bp, Homo sapiens
aaattccgattagaccttt

SEQ ID NO: 717896 - DNA, 14 bp, Homo sapiens
aaattcctctttgc

SEQ ID NO: 717897 - DNA, 18 bp, Homo sapiens
aaattcctctttgctttg

SEQ ID NO: 717898 - DNA, 23 bp, Homo sapiens
aaattcctgtgttcaatatttag

SEQ ID NO: 717899 - DNA, 15 bp, Homo sapiens
aaattcgtgtgtttt

SEQ ID NO: 717900 - DNA, 14 bp, Homo sapiens
aaattctaaatgta

SEQ ID NO: 717901 - DNA, 15 bp, Homo sapiens
aaattctacaacaca

SEQ ID NO: 717902 - DNA, 22 bp, Homo sapiens
aaattctataggaacatatgaa

SEQ ID NO: 717903 - DNA, 13 bp, Homo sapiens
aaattctcctgga

SEQ ID NO: 717904 - DNA, 17 bp, Homo sapiens
aaattctcttaaataaa

SEQ ID NO: 717905 - DNA, 15 bp, Homo sapiens
aaattctgaattttg

SEQ ID NO: 717906 - DNA, 14 bp, Homo sapiens
aaattctgccccca

SEQ ID NO: 717907 - DNA, 16 bp, Homo sapiens
aaattctgtgccttgt

SEQ ID NO: 717908 - DNA, 22 bp, Homo sapiens
aaattctgtgccttgttttttg

SEQ ID NO: 717909 - DNA, 14 bp, Homo sapiens
aaattctgtttctt

SEQ ID NO: 717910 - DNA, 15 bp, Homo sapiens
aaattctgtttcttg

SEQ ID NO: 717911 - DNA, 21 bp, Homo sapiens
aaattcttgcaaagtatccct

SEQ ID NO: 717912 - DNA, 15 bp, Homo sapiens
aaattcttttataaa

SEQ ID NO: 717913 - DNA, 11 bp, Homo sapiens
aaattcttttg

SEQ ID NO: 717914 - DNA, 20 bp, Homo sapiens
aaattgaaaggcattctctg

SEQ ID NO: 717915 - DNA, 22 bp, Homo sapiens
aaattgaaaggcattctctgaa

SEQ ID NO: 717916 - DNA, 18 bp, Homo sapiens
aaattgaaagtattcaga

SEQ ID NO: 717917 - DNA, 16 bp, Homo sapiens
aaattgaactgtaaac

SEQ ID NO: 717918 - DNA, 19 bp, Homo sapiens
aaattgaagtgtcttctgt

SEQ ID NO: 717919 - DNA, 22 bp, Homo sapiens
aaattgaagtgtcttctgttcc

SEQ ID NO: 717920 - DNA, 23 bp, Homo sapiens
aaattgaatcagtataaacaaag

SEQ ID NO: 717921 - DNA, 18 bp, Homo sapiens
aaattgaccctagccaga

SEQ ID NO: 717922 - DNA, 13 bp, Homo sapiens
aaattgactgtac

SEQ ID NO: 717923 - DNA, 14 bp, Homo sapiens
aaattgactgtact

SEQ ID NO: 717924 - DNA, 15 bp, Homo sapiens
aaattgactgtcacg

SEQ ID NO: 717925 - DNA, 20 bp, Homo sapiens
aaattgataatgctttcaca

SEQ ID NO: 717926 - DNA, 12 bp, Homo sapiens
aaattgatttct

SEQ ID NO: 717927 - DNA, 11 bp, Homo sapiens
aaattgatttt

SEQ ID NO: 717928 - DNA, 19 bp, Homo sapiens
aaattgatttttctcttca

SEQ ID NO: 717929 - DNA, 20 bp, Homo sapiens
aaattgatttttctcttcat

SEQ ID NO: 717930 - DNA, 13 bp, Homo sapiens
aaattgcaaatct

SEQ ID NO: 717931 - DNA, 14 bp, Homo sapiens
aaattgcaaatctt

SEQ ID NO: 717932 - DNA, 20 bp, Homo sapiens
aaattgcacacactcagtgc

SEQ ID NO: 717933 - DNA, 14 bp, Homo sapiens
aaattgcacagagc

SEQ ID NO: 717934 - DNA, 18 bp, Homo sapiens
aaattgcagtttcatgta

SEQ ID NO: 717935 - DNA, 21 bp, Homo sapiens
aaattgcagtttcatgtatgt

SEQ ID NO: 717936 - DNA, 17 bp, Homo sapiens
aaattgcatgaaactag

SEQ ID NO: 717937 - DNA, 18 bp, Homo sapiens
aaattgcctataatactt

SEQ ID NO: 717938 - DNA, 22 bp, Homo sapiens
aaattgcctataatacttgcaa

SEQ ID NO: 717939 - DNA, 19 bp, Homo sapiens
aaattgctattttatttgt

SEQ ID NO: 717940 - DNA, 20 bp, Homo sapiens
aaattgctattttatttgta

SEQ ID NO: 717941 - DNA, 22 bp, Homo sapiens
aaattgctgtgcctcccaaaat

SEQ ID NO: 717942 - DNA, 12 bp, Homo sapiens
aaattgcttttt

SEQ ID NO: 717943 - DNA, 16 bp, Homo sapiens
aaattggaaacatttt

SEQ ID NO: 717944 - DNA, 16 bp, Homo sapiens
aaattggaatggaact

SEQ ID NO: 717945 - DNA, 16 bp, Homo sapiens
aaattgggatctgtct

SEQ ID NO: 717946 - DNA, 21 bp, Homo sapiens
aaattgggcttgtgatttcca

SEQ ID NO: 717947 - DNA, 23 bp, Homo sapiens
aaattgggcttgtgatttccatt

SEQ ID NO: 717948 - DNA, 19 bp, Homo sapiens
aaattggggaggagggggc

SEQ ID NO: 717949 - DNA, 20 bp, Homo sapiens
aaattggtatcaagaaagtc

SEQ ID NO: 717950 - DNA, 18 bp, Homo sapiens
aaattgtacattttgtaa

SEQ ID NO: 717951 - DNA, 19 bp, Homo sapiens
aaattgtatacattttgtt

SEQ ID NO: 717952 - DNA, 22 bp, Homo sapiens
aaattgtataccaatgtgtttt

SEQ ID NO: 717953 - DNA, 15 bp, Homo sapiens
aaattgtatattgta

SEQ ID NO: 717954 - DNA, 15 bp, Homo sapiens
aaattgtatctcagt

SEQ ID NO: 717955 - DNA, 13 bp, Homo sapiens
aaattgtatgaaa

SEQ ID NO: 717956 - DNA, 21 bp, Homo sapiens
aaattgtattgaaaacactta

SEQ ID NO: 717957 - DNA, 16 bp, Homo sapiens
aaattgtcagatcgtt

SEQ ID NO: 717958 - DNA, 23 bp, Homo sapiens
aaattgtccgtgttcatacattt

SEQ ID NO: 717959 - DNA, 18 bp, Homo sapiens
aaattgtcgggggagaga

SEQ ID NO: 717960 - DNA, 18 bp, Homo sapiens
aaattgtcgtttttattc

SEQ ID NO: 717961 - DNA, 12 bp, Homo sapiens
aaattgtcttta

SEQ ID NO: 717962 - DNA, 20 bp, Homo sapiens
aaattgtctttaaaaactgt

SEQ ID NO: 717963 - DNA, 18 bp, Homo sapiens
aaattgtgatgttttgtt

SEQ ID NO: 717964 - DNA, 20 bp, Homo sapiens
aaattgtgtatatatcttat

SEQ ID NO: 717965 - DNA, 23 bp, Homo sapiens
aaattgtttcatatctggtcaag

SEQ ID NO: 717966 - DNA, 20 bp, Homo sapiens
aaattgtttcttgacaagct

SEQ ID NO: 717967 - DNA, 12 bp, Homo sapiens
aaattgtttgta

SEQ ID NO: 717968 - DNA, 17 bp, Homo sapiens
aaattgttttcacttgt

SEQ ID NO: 717969 - DNA, 24 bp, Homo sapiens
aacaaacactgaatcatgttaata

SEQ ID NO: 717970 - DNA, 20 bp, Homo sapiens
aacaaacatggatacttcct

SEQ ID NO: 717971 - DNA, 20 bp, Homo sapiens
aacaaactcgttttttacaa

SEQ ID NO: 717972 - DNA, 11 bp, Homo sapiens
aacaaagaaac

SEQ ID NO: 717973 - DNA, 19 bp, Homo sapiens
aacaaagagaaaaaataca

SEQ ID NO: 717974 - DNA, 17 bp, Homo sapiens
aacaaagagttcaagaa

SEQ ID NO: 717975 - DNA, 17 bp, Homo sapiens
aacaaagcacagtgtta

SEQ ID NO: 717976 - DNA, 14 bp, Homo sapiens
aacaaagcagccac

SEQ ID NO: 717977 - DNA, 15 bp, Homo sapiens
aacaaagcagccacg

SEQ ID NO: 717978 - DNA, 13 bp, Homo sapiens
aacaaagccaaac

SEQ ID NO: 717979 - DNA, 21 bp, Homo sapiens
aacaaagccaaacaaaactga

SEQ ID NO: 717980 - DNA, 19 bp, Homo sapiens
aacaaagctgttaaactgt

SEQ ID NO: 717981 - DNA, 22 bp, Homo sapiens
aacaaaggcctaattctatgcc

SEQ ID NO: 717982 - DNA, 17 bp, Homo sapiens
aacaaagtcacagtcgt

SEQ ID NO: 717983 - DNA, 20 bp, Homo sapiens
aacaaagtgactgtttggct

SEQ ID NO: 717984 - DNA, 20 bp, Homo sapiens
aacaaagtttacattgtcct

SEQ ID NO: 717985 - DNA, 19 bp, Homo sapiens
aacaaataaaaaagctctt

SEQ ID NO: 717986 - DNA, 14 bp, Homo sapiens
aacaaataaaagtt

SEQ ID NO: 717987 - DNA, 17 bp, Homo sapiens
aacaaataatatattaa

SEQ ID NO: 717988 - DNA, 16 bp, Homo sapiens
aacaaataatcacatt

SEQ ID NO: 717989 - DNA, 21 bp, Homo sapiens
aacacagcctccctgagcctg

SEQ ID NO: 717990 - DNA, 14 bp, Homo sapiens
aacacagccttcct

SEQ ID NO: 717991 - DNA, 15 bp, Homo sapiens
aacacaggcaaaatc

SEQ ID NO: 717992 - DNA, 18 bp, Homo sapiens
aacacaggtagcacagat

SEQ ID NO: 717993 - DNA, 22 bp, Homo sapiens
aacacagtcattctaggatgtg

SEQ ID NO: 717994 - DNA, 17 bp, Homo sapiens
aacacagtgtttcaatt

SEQ ID NO: 717995 - DNA, 13 bp, Homo sapiens
aacacagtttagt

SEQ ID NO: 717996 - DNA, 16 bp, Homo sapiens
aacacatacaaaagaa

SEQ ID NO: 717997 - DNA, 18 bp, Homo sapiens
aacacatagattcacctg

SEQ ID NO: 717998 - DNA, 22 bp, Homo sapiens
aacacatagattcacctgtaaa

SEQ ID NO: 717999 - DNA, 20 bp, Homo sapiens
aacacatcataaggttttat

SEQ ID NO: 718000 - DNA, 14 bp, Homo sapiens
aacacatctggctg

SEQ ID NO: 718001 - DNA, 17 bp, Homo sapiens
aacacatctttcctgtc

SEQ ID NO: 718002 - DNA, 18 bp, Homo sapiens
aacacatttgattctgtg

SEQ ID NO: 718003 - DNA, 18 bp, Homo sapiens
aacaccaagcacagcagc

SEQ ID NO: 718004 - DNA, 21 bp, Homo sapiens
aacaccaagcacagcagcctg

SEQ ID NO: 718005 - DNA, 14 bp, Homo sapiens
aacaccacagacac

SEQ ID NO: 718006 - DNA, 19 bp, Homo sapiens
aacaccacagacacacaca

SEQ ID NO: 718007 - DNA, 19 bp, Homo sapiens
aacaccattgaaggcttaa

SEQ ID NO: 718008 - DNA, 13 bp, Homo sapiens
aacacccctctgt

SEQ ID NO: 718009 - DNA, 19 bp, Homo sapiens
aacacccgccccccccatg

SEQ ID NO: 718010 - DNA, 23 bp, Homo sapiens
aacaccctgcttctcccggggac

SEQ ID NO: 718011 - DNA, 14 bp, Homo sapiens
aacacccttagaaa

SEQ ID NO: 718012 - DNA, 22 bp, Homo sapiens
aacaccctttcatctcagagtc

SEQ ID NO: 718013 - DNA, 22 bp, Homo sapiens
aacacctgccttctaccctctg

SEQ ID NO: 718014 - DNA, 11 bp, Homo sapiens
aacacctgctg

SEQ ID NO: 718015 - DNA, 13 bp, Homo sapiens
aacacctgctgcg

SEQ ID NO: 718016 - DNA, 15 bp, Homo sapiens
aacaccttaatatgc

SEQ ID NO: 718017 - DNA, 15 bp, Homo sapiens
aacaccttcctcctg

SEQ ID NO: 718018 - DNA, 16 bp, Homo sapiens
aacaccttcctcctgc

SEQ ID NO: 718019 - DNA, 14 bp, Homo sapiens
aacacgaaacttgt

SEQ ID NO: 718020 - DNA, 15 bp, Homo sapiens
aacacgaaacttgtt

SEQ ID NO: 718021 - DNA, 16 bp, Homo sapiens
aacacgaaacttgtta

SEQ ID NO: 718022 - DNA, 20 bp, Homo sapiens
aacacgaaacttgttattgt

SEQ ID NO: 718023 - DNA, 14 bp, Homo sapiens
aacacgcacctgcc

SEQ ID NO: 718024 - DNA, 19 bp, Homo sapiens
aacacgcacctgcctcagg

SEQ ID NO: 718025 - DNA, 16 bp, Homo sapiens
aacacgcgtatttaca

SEQ ID NO: 718026 - DNA, 21 bp, Homo sapiens
aacacggccacatcaaagagg

SEQ ID NO: 718027 - DNA, 16 bp, Homo sapiens
aacacgtgtctataat

SEQ ID NO: 718028 - DNA, 20 bp, Homo sapiens
aacactaaagatccaagaag

SEQ ID NO: 718029 - DNA, 18 bp, Homo sapiens
aacactaactcaccagcc

SEQ ID NO: 718030 - DNA, 17 bp, Homo sapiens
aacactaaggctgcttc

SEQ ID NO: 718031 - DNA, 20 bp, Homo sapiens
aacactaatatatttaaaaa

SEQ ID NO: 718032 - DNA, 14 bp, Homo sapiens
aacactagccagac

SEQ ID NO: 718033 - DNA, 22 bp, Homo sapiens
aacactatatttatttttgggt

SEQ ID NO: 718034 - DNA, 12 bp, Homo sapiens
aacactcagtcc

SEQ ID NO: 718035 - DNA, 17 bp, Homo sapiens
aacactcagtccactgt

SEQ ID NO: 718036 - DNA, 17 bp, Homo sapiens
aacactcagtggcccat

SEQ ID NO: 718037 - DNA, 17 bp, Homo sapiens
aacactccacagtgttt

SEQ ID NO: 718038 - DNA, 15 bp, Homo sapiens
aacactcctgaatgc

SEQ ID NO: 718039 - DNA, 13 bp, Homo sapiens
aacactctatatt

SEQ ID NO: 718040 - DNA, 15 bp, Homo sapiens
aacactgaaaaaata

SEQ ID NO: 718041 - DNA, 17 bp, Homo sapiens
aacactgaaaaaatact

SEQ ID NO: 718042 - DNA, 17 bp, Homo sapiens
aacactgaatcatgtta

SEQ ID NO: 718043 - DNA, 23 bp, Homo sapiens
aacactgcctgccctctgtctgt

SEQ ID NO: 718044 - DNA, 21 bp, Homo sapiens
aacactgcttctcggccagcc

SEQ ID NO: 718045 - DNA, 23 bp, Homo sapiens
aacactgcttctcggccagcccg

SEQ ID NO: 718046 - DNA, 12 bp, Homo sapiens
aacactggacct

SEQ ID NO: 718047 - DNA, 13 bp, Homo sapiens
aacactggacctg

SEQ ID NO: 718048 - DNA, 14 bp, Homo sapiens
aacactggacctgg

SEQ ID NO: 718049 - DNA, 19 bp, Homo sapiens
aacactggcaacaacaaag

SEQ ID NO: 718050 - DNA, 12 bp, Homo sapiens
aacactggcccc

SEQ ID NO: 718051 - DNA, 13 bp, Homo sapiens
aacactggcccct

SEQ ID NO: 718052 - DNA, 16 bp, Homo sapiens
aacactgtaatcttaa

SEQ ID NO: 718053 - DNA, 22 bp, Homo sapiens
aacactgtgcacatctgtgtct

SEQ ID NO: 718054 - DNA, 16 bp, Homo sapiens
aacactgtgccctggt

SEQ ID NO: 718055 - DNA, 21 bp, Homo sapiens
aacactgtgccctggtggaga

SEQ ID NO: 718056 - DNA, 14 bp, Homo sapiens
aacacttaaatttc

SEQ ID NO: 718057 - DNA, 15 bp, Homo sapiens
aacacttaaatttct

SEQ ID NO: 718058 - DNA, 22 bp, Homo sapiens
aacacttaagggttttagaaaa

SEQ ID NO: 718059 - DNA, 14 bp, Homo sapiens
aacacttaatagca

SEQ ID NO: 718060 - DNA, 18 bp, Homo sapiens
aacacttaatagcaacag

SEQ ID NO: 718061 - DNA, 18 bp, Homo sapiens
aacacttcagacacagga

SEQ ID NO: 718062 - DNA, 17 bp, Homo sapiens
aacacttctgtatgcat

SEQ ID NO: 718063 - DNA, 23 bp, Homo sapiens
aacacttgcaggggtccctgcta

SEQ ID NO: 718064 - DNA, 23 bp, Homo sapiens
aacacttggcatacaaaatattt

SEQ ID NO: 718065 - DNA, 11 bp, Homo sapiens
aacactttgta

SEQ ID NO: 718066 - DNA, 19 bp, Homo sapiens
aacactttttatgacaaaa

SEQ ID NO: 718067 - DNA, 14 bp, Homo sapiens
aacagaaaaacaat

SEQ ID NO: 718068 - DNA, 16 bp, Homo sapiens
aacagaaaacaacaaa

SEQ ID NO: 718069 - DNA, 22 bp, Homo sapiens
aacagaaagcctgggtgacatt

SEQ ID NO: 718070 - DNA, 12 bp, Homo sapiens
aacagaaatgta

SEQ ID NO: 718071 - DNA, 14 bp, Homo sapiens
aacagaaatgtaca

SEQ ID NO: 718072 - DNA, 12 bp, Homo sapiens
aacagaacactt

SEQ ID NO: 718073 - DNA, 13 bp, Homo sapiens
aacagaacactta

SEQ ID NO: 718074 - DNA, 18 bp, Homo sapiens
aacagaacatagacagaa

SEQ ID NO: 718075 - DNA, 22 bp, Homo sapiens
aacagaagcagacttttcagaa

SEQ ID NO: 718076 - DNA, 14 bp, Homo sapiens
aacagaagcttcca

SEQ ID NO: 718077 - DNA, 16 bp, Homo sapiens
aacagaagcttccatt

SEQ ID NO: 718078 - DNA, 17 bp, Homo sapiens
aacagaatagagaattt

SEQ ID NO: 718079 - DNA, 17 bp, Homo sapiens
aacagaatcttctgggt

SEQ ID NO: 718080 - DNA, 18 bp, Homo sapiens
aacagacaaaaacagcct

SEQ ID NO: 718081 - DNA, 17 bp, Homo sapiens
aacagacaagtgactgt

SEQ ID NO: 718082 - DNA, 21 bp, Homo sapiens
aacagacaggaatttagaaaa

SEQ ID NO: 718083 - DNA, 13 bp, Homo sapiens
aacagactcaggt

SEQ ID NO: 718084 - DNA, 19 bp, Homo sapiens
aacagactcgattcatatt

SEQ ID NO: 718085 - DNA, 23 bp, Homo sapiens
aacagactgaattttaaatgttc

SEQ ID NO: 718086 - DNA, 13 bp, Homo sapiens
aacagagaaagaa

SEQ ID NO: 718087 - DNA, 14 bp, Homo sapiens
aacagagaaataga

SEQ ID NO: 718088 - DNA, 16 bp, Homo sapiens
aacagagaaggcagga

SEQ ID NO: 718089 - DNA, 19 bp, Homo sapiens
aacagagactgaatagata

SEQ ID NO: 718090 - DNA, 13 bp, Homo sapiens
aacagagatgtga

SEQ ID NO: 718091 - DNA, 13 bp, Homo sapiens
aacagaggcagga

SEQ ID NO: 718092 - DNA, 15 bp, Homo sapiens
aacagaggcatttaa

SEQ ID NO: 718093 - DNA, 23 bp, Homo sapiens
aacagagggaccaaattgcttct

SEQ ID NO: 718094 - DNA, 18 bp, Homo sapiens
aacagagggccagagcta

SEQ ID NO: 718095 - DNA, 19 bp, Homo sapiens
aacagagggctgcattcga

SEQ ID NO: 718096 - DNA, 14 bp, Homo sapiens
aacagagtgcctgc

SEQ ID NO: 718097 - DNA, 18 bp, Homo sapiens
aacagagtggcctccctg

SEQ ID NO: 718098 - DNA, 19 bp, Homo sapiens
aacagagtggcctccctgc

SEQ ID NO: 718099 - DNA, 21 bp, Homo sapiens
aacagagtggcctccctgctg

SEQ ID NO: 718100 - DNA, 18 bp, Homo sapiens
aacagataagcaagagag

SEQ ID NO: 718101 - DNA, 19 bp, Homo sapiens
aacagataagcaagagaga

SEQ ID NO: 718102 - DNA, 23 bp, Homo sapiens
aacagatactggaagttttgcat

SEQ ID NO: 718103 - DNA, 20 bp, Homo sapiens
aacagatagttgtgttttta

SEQ ID NO: 718104 - DNA, 14 bp, Homo sapiens
aacagatcagtaaa

SEQ ID NO: 718105 - DNA, 20 bp, Homo sapiens
aacagatgaccgtgtacaat

SEQ ID NO: 718106 - DNA, 18 bp, Homo sapiens
aacagatgataaatattt

SEQ ID NO: 718107 - DNA, 23 bp, Homo sapiens
aacagatgcaatgtgctactgat

SEQ ID NO: 718108 - DNA, 15 bp, Homo sapiens
aacagatgctaggaa

SEQ ID NO: 718109 - DNA, 22 bp, Homo sapiens
aacagatggggtctgtgactgg

SEQ ID NO: 718110 - DNA, 18 bp, Homo sapiens
aacatttaaagagatttc

SEQ ID NO: 718111 - DNA, 14 bp, Homo sapiens
aacatttaaattcc

SEQ ID NO: 718112 - DNA, 24 bp, Homo sapiens
aacatttacaataaatattctgca

SEQ ID NO: 718113 - DNA, 15 bp, Homo sapiens
aacatttatatgtag

SEQ ID NO: 718114 - DNA, 19 bp, Homo sapiens
aacatttattttgacataa

SEQ ID NO: 718115 - DNA, 22 bp, Homo sapiens
aacatttattttttttaaagaa

SEQ ID NO: 718116 - DNA, 12 bp, Homo sapiens
aacatttcagaa

SEQ ID NO: 718117 - DNA, 23 bp, Homo sapiens
aacatttctaactctattaatga

SEQ ID NO: 718118 - DNA, 17 bp, Homo sapiens
aacatttcttaaaacag

SEQ ID NO: 718119 - DNA, 23 bp, Homo sapiens
aacatttctttcttgctggctct

SEQ ID NO: 718120 - DNA, 19 bp, Homo sapiens
aacatttgatatttttcca

SEQ ID NO: 718121 - DNA, 21 bp, Homo sapiens
aacatttgatatttttccatt

SEQ ID NO: 718122 - DNA, 18 bp, Homo sapiens
aacatttgccttgcagaa

SEQ ID NO: 718123 - DNA, 20 bp, Homo sapiens
aacatttgccttgcagaact

SEQ ID NO: 718124 - DNA, 15 bp, Homo sapiens
aacatttgttcctgg

SEQ ID NO: 718125 - DNA, 17 bp, Homo sapiens
aacatttgttcctggag

SEQ ID NO: 718126 - DNA, 18 bp, Homo sapiens
aaatctcatctctacaaa

SEQ ID NO: 718127 - DNA, 22 bp, Homo sapiens
aaatctcatctctacaaaaagt

SEQ ID NO: 718128 - DNA, 21 bp, Homo sapiens
aaatctccaagacctggtgtg

SEQ ID NO: 718129 - DNA, 16 bp, Homo sapiens
aaatctcccattttgg

SEQ ID NO: 718130 - DNA, 15 bp, Homo sapiens
aaatctctaatatgg

SEQ ID NO: 718131 - DNA, 14 bp, Homo sapiens
aaatctcttgatta

SEQ ID NO: 718132 - DNA, 19 bp, Homo sapiens
aaatctcttgattataaat

SEQ ID NO: 718133 - DNA, 20 bp, Homo sapiens
aaatctcttgattataaatg

SEQ ID NO: 718134 - DNA, 13 bp, Homo sapiens
aaatctgaacatt

SEQ ID NO: 718135 - DNA, 16 bp, Homo sapiens
aaatctgaacattctc

SEQ ID NO: 718136 - DNA, 20 bp, Homo sapiens
aaatctgagggaaatgtttt

SEQ ID NO: 718137 - DNA, 22 bp, Homo sapiens
aaatctgagggaaatgttttgt

SEQ ID NO: 718138 - DNA, 13 bp, Homo sapiens
aaatctgcagagg

SEQ ID NO: 718139 - DNA, 11 bp, Homo sapiens
aaatctgccac

SEQ ID NO: 718140 - DNA, 16 bp, Homo sapiens
aaatctgcctatgtca

SEQ ID NO: 718141 - DNA, 17 bp, Homo sapiens
aaatctgctagaaagtt

SEQ ID NO: 718142 - DNA, 22 bp, Homo sapiens
aaatctgctggagtttcatgta

SEQ ID NO: 718143 - DNA, 13 bp, Homo sapiens
aaatctggaaatc

SEQ ID NO: 718144 - DNA, 16 bp, Homo sapiens
aaatctggaaatctgt

SEQ ID NO: 718145 - DNA, 23 bp, Homo sapiens
aaatctggtctaatttattaatc

SEQ ID NO: 718146 - DNA, 16 bp, Homo sapiens
aaatctgtaaagccag

SEQ ID NO: 718147 - DNA, 19 bp, Homo sapiens
aaatctgtatatgttgtaa

SEQ ID NO: 718148 - DNA, 19 bp, Homo sapiens
aaatctgtattctgtttgc

SEQ ID NO: 718149 - DNA, 22 bp, Homo sapiens
aaatctgtccaaaggaggctgg

SEQ ID NO: 718150 - DNA, 16 bp, Homo sapiens
aaatctgtcctctgta

SEQ ID NO: 718151 - DNA, 18 bp, Homo sapiens
aaatctgtgctctttcat

SEQ ID NO: 718152 - DNA, 15 bp, Homo sapiens
aaatctgttctaaca

SEQ ID NO: 718153 - DNA, 18 bp, Homo sapiens
aaatctgtttgatccctg

SEQ ID NO: 718154 - DNA, 16 bp, Homo sapiens
aaatctgtttttctca

SEQ ID NO: 718155 - DNA, 17 bp, Homo sapiens
aaatctgtttttctcat

SEQ ID NO: 718156 - DNA, 16 bp, Homo sapiens
aaatcttaaacaatgt

SEQ ID NO: 718157 - DNA, 16 bp, Homo sapiens
aaatcttcatggaatt

SEQ ID NO: 718158 - DNA, 20 bp, Homo sapiens
aaatcttcatggaattcaca

SEQ ID NO: 718159 - DNA, 16 bp, Homo sapiens
aaatcttctagcatgt

SEQ ID NO: 718160 - DNA, 13 bp, Homo sapiens
aaatcttgaaatt

SEQ ID NO: 718161 - DNA, 13 bp, Homo sapiens
aaatcttgcttca

SEQ ID NO: 718162 - DNA, 20 bp, Homo sapiens
aaatcttgtgctagaatact

SEQ ID NO: 718163 - DNA, 19 bp, Homo sapiens
aaatcttgttaatgtcatt

SEQ ID NO: 718164 - DNA, 22 bp, Homo sapiens
aaatcttgttaatgtcattgct

SEQ ID NO: 718165 - DNA, 13 bp, Homo sapiens
aaatctttaagaa

SEQ ID NO: 718166 - DNA, 20 bp, Homo sapiens
aaatctttaagaatagttct

SEQ ID NO: 718167 - DNA, 20 bp, Homo sapiens
aaatctttctgtaaacagaa

SEQ ID NO: 718168 - DNA, 17 bp, Homo sapiens
aaatcttttacattttt

SEQ ID NO: 718169 - DNA, 14 bp, Homo sapiens
aaatctttttgata

SEQ ID NO: 718170 - DNA, 21 bp, Homo sapiens
aaatctttttgcttctacttt

SEQ ID NO: 718171 - DNA, 23 bp, Homo sapiens
aaatgaaaaacacaattctttat

SEQ ID NO: 718172 - DNA, 15 bp, Homo sapiens
aaatgaaaatgaata

SEQ ID NO: 718173 - DNA, 12 bp, Homo sapiens
aaatgaaaattg

SEQ ID NO: 718174 - DNA, 13 bp, Homo sapiens
aaatgaaaattgt

SEQ ID NO: 718175 - DNA, 14 bp, Homo sapiens
aaatgaaacaaaaa

SEQ ID NO: 718176 - DNA, 21 bp, Homo sapiens
aaatgaaacaaataatcacat

SEQ ID NO: 718177 - DNA, 16 bp, Homo sapiens
aaatgaaacaatgaaa

SEQ ID NO: 718178 - DNA, 12 bp, Homo sapiens
aaatgaaagaaa

SEQ ID NO: 718179 - DNA, 15 bp, Homo sapiens
aaatgaaagaaaatg

SEQ ID NO: 718180 - DNA, 20 bp, Homo sapiens
aaatgaaagtataactgagt

SEQ ID NO: 718181 - DNA, 17 bp, Homo sapiens
aaatgaacctgatcact

SEQ ID NO: 718182 - DNA, 19 bp, Homo sapiens
aaatgaacgatatgtagca

SEQ ID NO: 718183 - DNA, 22 bp, Homo sapiens
aaatgaacttgcacttgttata

SEQ ID NO: 718184 - DNA, 13 bp, Homo sapiens
aaatgaactttta

SEQ ID NO: 718185 - DNA, 19 bp, Homo sapiens
aaatgaacttttacagaat

SEQ ID NO: 718186 - DNA, 20 bp, Homo sapiens
aaatgaacttttacagaatg

SEQ ID NO: 718187 - DNA, 14 bp, Homo sapiens
aaatgaagaaagtc

SEQ ID NO: 718188 - DNA, 14 bp, Homo sapiens
aaatgaaggtcttt

SEQ ID NO: 718189 - DNA, 16 bp, Homo sapiens
aaatgaataatttatt

SEQ ID NO: 718190 - DNA, 17 bp, Homo sapiens
aaatgaataatttatta

SEQ ID NO: 718191 - DNA, 17 bp, Homo sapiens
aaatgaatatctattaa

SEQ ID NO: 718192 - DNA, 12 bp, Homo sapiens
aaatgaatcatt

SEQ ID NO: 718193 - DNA, 15 bp, Homo sapiens
aaatgaatgagccaa

SEQ ID NO: 718194 - DNA, 20 bp, Homo sapiens
aaatgaatgagccaaaatga

SEQ ID NO: 718195 - DNA, 22 bp, Homo sapiens
aaatgaatgagccaaaatgact

SEQ ID NO: 718196 - DNA, 14 bp, Homo sapiens
aaatgaatgtcact

SEQ ID NO: 718197 - DNA, 19 bp, Homo sapiens
aaatgaatgtcacttctgg

SEQ ID NO: 718198 - DNA, 14 bp, Homo sapiens
aaatgaatttggga

SEQ ID NO: 718199 - DNA, 19 bp, Homo sapiens
aaatgacaaagccattctt

SEQ ID NO: 718200 - DNA, 20 bp, Homo sapiens
aaatgacaacagaaaaacaa

SEQ ID NO: 718201 - DNA, 14 bp, Homo sapiens
aaatgacagaccta

SEQ ID NO: 718202 - DNA, 14 bp, Homo sapiens
aaatgacagatgtt

SEQ ID NO: 718203 - DNA, 18 bp, Homo sapiens
aaatgacatgttccttta

SEQ ID NO: 718204 - DNA, 22 bp, Homo sapiens
aaatgactaaaaaacaaagaag

SEQ ID NO: 718205 - DNA, 15 bp, Homo sapiens
aaatgacttgattgt

SEQ ID NO: 718206 - DNA, 14 bp, Homo sapiens
aaatgactttatac

SEQ ID NO: 718207 - DNA, 15 bp, Homo sapiens
aaccatcctgtttga

SEQ ID NO: 718208 - DNA, 17 bp, Homo sapiens
aaccatccttaaattat

SEQ ID NO: 718209 - DNA, 15 bp, Homo sapiens
aaccatcggtccaca

SEQ ID NO: 718210 - DNA, 12 bp, Homo sapiens
aaccatctcaga

SEQ ID NO: 718211 - DNA, 17 bp, Homo sapiens
aaccatgaagacaggat

SEQ ID NO: 718212 - DNA, 13 bp, Homo sapiens
aaccatgacaaac

SEQ ID NO: 718213 - DNA, 17 bp, Homo sapiens
aaccatgagaatttgca

SEQ ID NO: 718214 - DNA, 19 bp, Homo sapiens
aaccatgcaaatgctatga

SEQ ID NO: 718215 - DNA, 23 bp, Homo sapiens
aaccatgctggtatatggcttca

SEQ ID NO: 718216 - DNA, 16 bp, Homo sapiens
aaccatggtgcttgtt

SEQ ID NO: 718217 - DNA, 21 bp, Homo sapiens
aaccatgtcagcaaaaagcaa

SEQ ID NO: 718218 - DNA, 17 bp, Homo sapiens
aaccatgtcatttcaga

SEQ ID NO: 718219 - DNA, 20 bp, Homo sapiens
aaccatgtgttatgttttcg

SEQ ID NO: 718220 - DNA, 14 bp, Homo sapiens
aaccattacctgta

SEQ ID NO: 718221 - DNA, 12 bp, Homo sapiens
aaccattcaaat

SEQ ID NO: 718222 - DNA, 19 bp, Homo sapiens
aaccattccctagtcattt

SEQ ID NO: 718223 - DNA, 15 bp, Homo sapiens
aaccattgcttcact

SEQ ID NO: 718224 - DNA, 16 bp, Homo sapiens
aaccattgcttcacta

SEQ ID NO: 718225 - DNA, 23 bp, Homo sapiens
aaccattgcttcactacccatcg

SEQ ID NO: 718226 - DNA, 19 bp, Homo sapiens
aaccattggacagatttca

SEQ ID NO: 718227 - DNA, 22 bp, Homo sapiens
aaccattggacagatttcagta

SEQ ID NO: 718228 - DNA, 21 bp, Homo sapiens
aaccattgtaactattaacct

SEQ ID NO: 718229 - DNA, 23 bp, Homo sapiens
aaccattgtaactattaaccttt

SEQ ID NO: 718230 - DNA, 13 bp, Homo sapiens
aaccattgtattt

SEQ ID NO: 718231 - DNA, 18 bp, Homo sapiens
aaccatttaagagactct

SEQ ID NO: 718232 - DNA, 21 bp, Homo sapiens
aaccatttaataaagaaatat

SEQ ID NO: 718233 - DNA, 19 bp, Homo sapiens
aaccatttgaaacccctgt

SEQ ID NO: 718234 - DNA, 14 bp, Homo sapiens
aaccattttcatta

SEQ ID NO: 718235 - DNA, 13 bp, Homo sapiens
aacccaaaccatg

SEQ ID NO: 718236 - DNA, 21 bp, Homo sapiens
aacccaaagagacagctcttc

SEQ ID NO: 718237 - DNA, 21 bp, Homo sapiens
aacccaaattgggacaacagt

SEQ ID NO: 718238 - DNA, 15 bp, Homo sapiens
aacccaagctcctcc

SEQ ID NO: 718239 - DNA, 13 bp, Homo sapiens
aacccaaggagca

SEQ ID NO: 718240 - DNA, 19 bp, Homo sapiens
aacccaagtgctgcacaaa

SEQ ID NO: 718241 - DNA, 21 bp, Homo sapiens
aacccacttctggcctccagc

SEQ ID NO: 718242 - DNA, 22 bp, Homo sapiens
aacccacttctggcctccagcc

SEQ ID NO: 718243 - DNA, 23 bp, Homo sapiens
aacccagacctgttagcagacag

SEQ ID NO: 718244 - DNA, 22 bp, Homo sapiens
aacccagaggtggatgttatga

SEQ ID NO: 718245 - DNA, 21 bp, Homo sapiens
aacccagattttgctgtatat

SEQ ID NO: 718246 - DNA, 23 bp, Homo sapiens
aacccagcaacagaaaaatggag

SEQ ID NO: 718247 - DNA, 12 bp, Homo sapiens
aacccaggaggt

SEQ ID NO: 718248 - DNA, 14 bp, Homo sapiens
aacccagttacttt

SEQ ID NO: 718249 - DNA, 15 bp, Homo sapiens
aacccatacaatgta

SEQ ID NO: 718250 - DNA, 14 bp, Homo sapiens
aacccatagggagc

SEQ ID NO: 718251 - DNA, 15 bp, Homo sapiens
aacccatcagaagga

SEQ ID NO: 718252 - DNA, 17 bp, Homo sapiens
aacccatcttccccgga

SEQ ID NO: 718253 - DNA, 19 bp, Homo sapiens
aaccccaaggactgagggc

SEQ ID NO: 718254 - DNA, 12 bp, Homo sapiens
aaccccacccag

SEQ ID NO: 718255 - DNA, 17 bp, Homo sapiens
aaccccacccagctcca

SEQ ID NO: 718256 - DNA, 13 bp, Homo sapiens
aaccccagcccca

SEQ ID NO: 718257 - DNA, 18 bp, Homo sapiens
aaccccagcctgacctga

SEQ ID NO: 718258 - DNA, 12 bp, Homo sapiens
aaccccagctcc

SEQ ID NO: 718259 - DNA, 13 bp, Homo sapiens
aaccccagttctg

SEQ ID NO: 718260 - DNA, 19 bp, Homo sapiens
aaccccagttctgctcctc

SEQ ID NO: 718261 - DNA, 22 bp, Homo sapiens
aaccccagttctgctcctctcc

SEQ ID NO: 718262 - DNA, 23 bp, Homo sapiens
aaccccagttctgctcctctcca

SEQ ID NO: 718263 - DNA, 10 bp, Homo sapiens
aacccccacc

SEQ ID NO: 718264 - DNA, 17 bp, Homo sapiens
aacccccaccccacact

SEQ ID NO: 718265 - DNA, 11 bp, Homo sapiens
aacccccagag

SEQ ID NO: 718266 - DNA, 19 bp, Homo sapiens
aacccccagcccacagagc

SEQ ID NO: 718267 - DNA, 23 bp, Homo sapiens
aacccccagtcctcactgtcctg

SEQ ID NO: 718268 - DNA, 13 bp, Homo sapiens
aaccccccaggcc

SEQ ID NO: 718269 - DNA, 12 bp, Homo sapiens
aacccccctccc

SEQ ID NO: 718270 - DNA, 13 bp, Homo sapiens
aacccccctccca

SEQ ID NO: 718271 - DNA, 19 bp, Homo sapiens
aacccccctcctgctcctc

SEQ ID NO: 718272 - DNA, 23 bp, Homo sapiens
aacccccctcctgctcctccctg

SEQ ID NO: 718273 - DNA, 20 bp, Homo sapiens
aacccccgccacctcagggc

SEQ ID NO: 718274 - DNA, 20 bp, Homo sapiens
aaccccctccctgtcccagg

SEQ ID NO: 718275 - DNA, 16 bp, Homo sapiens
aaccccctcggagcct

SEQ ID NO: 718276 - DNA, 18 bp, Homo sapiens
aaccccgcggtgctctgg

SEQ ID NO: 718277 - DNA, 22 bp, Homo sapiens
aaccccgcggtgctctggcggc

SEQ ID NO: 718278 - DNA, 14 bp, Homo sapiens
aaccccgggcccgg

SEQ ID NO: 718279 - DNA, 20 bp, Homo sapiens
aacccctccctcttctgccc

SEQ ID NO: 718280 - DNA, 17 bp, Homo sapiens
aacccctgtacccagct

SEQ ID NO: 718281 - DNA, 23 bp, Homo sapiens
aacccctgtcccatgcaggccct

SEQ ID NO: 718282 - DNA, 10 bp, Homo sapiens
aacccctgtg

SEQ ID NO: 718283 - DNA, 12 bp, Homo sapiens
aaccccttccca

SEQ ID NO: 718284 - DNA, 21 bp, Homo sapiens
aaccccttcccacgacaaaaa

SEQ ID NO: 718285 - DNA, 22 bp, Homo sapiens
aacccgaggctgagaatcagac

SEQ ID NO: 718286 - DNA, 21 bp, Homo sapiens
aacccgtccattcagaaagct

SEQ ID NO: 718287 - DNA, 15 bp, Homo sapiens
aacccgtctggccca

SEQ ID NO: 718288 - DNA, 22 bp, Homo sapiens
aaccctaaagcaaatctgccac

SEQ ID NO: 718289 - DNA, 13 bp, Homo sapiens
aaccctagccttg

SEQ ID NO: 718290 - DNA, 22 bp, Homo sapiens
aaccctatctcctgacagaagg

SEQ ID NO: 718291 - DNA, 12 bp, Homo sapiens
aaccctcagagc

SEQ ID NO: 718292 - DNA, 16 bp, Homo sapiens
aaccctcattgctgtc

SEQ ID NO: 718293 - DNA, 14 bp, Homo sapiens
aaccctccctcagc

SEQ ID NO: 718294 - DNA, 16 bp, Homo sapiens
aaccctcctccttttt

SEQ ID NO: 718295 - DNA, 18 bp, Homo sapiens
aaccctcctcctttttaa

SEQ ID NO: 718296 - DNA, 19 bp, Homo sapiens
aaccctcctgggcccaagt

SEQ ID NO: 718297 - DNA, 17 bp, Homo sapiens
aaccctcttgccatcct

SEQ ID NO: 718298 - DNA, 19 bp, Homo sapiens
aaccctcttgccatcctga

SEQ ID NO: 718299 - DNA, 21 bp, Homo sapiens
aaccctcttgccatcctgatg

SEQ ID NO: 718300 - DNA, 18 bp, Homo sapiens
aacctgaagatgtctcct

SEQ ID NO: 718301 - DNA, 22 bp, Homo sapiens
aacctgagctattttcctctgg

SEQ ID NO: 718302 - DNA, 21 bp, Homo sapiens
aacctgcaaaaaatacttttt

SEQ ID NO: 718303 - DNA, 16 bp, Homo sapiens
aacctgcaaaatctgt

SEQ ID NO: 718304 - DNA, 21 bp, Homo sapiens
aacctgcagagtagttagaga

SEQ ID NO: 718305 - DNA, 17 bp, Homo sapiens
aacctgcagttcctgag

SEQ ID NO: 718306 - DNA, 10 bp, Homo sapiens
aacctgccct

SEQ ID NO: 718307 - DNA, 17 bp, Homo sapiens
aacctgccctgcctgag

SEQ ID NO: 718308 - DNA, 19 bp, Homo sapiens
aacctgcctgacatttgga

SEQ ID NO: 718309 - DNA, 18 bp, Homo sapiens
aacctgcctttgtatgtg

SEQ ID NO: 718310 - DNA, 20 bp, Homo sapiens
aacctgcctttgtatgtgga

SEQ ID NO: 718311 - DNA, 11 bp, Homo sapiens
aacctgctctc

SEQ ID NO: 718312 - DNA, 21 bp, Homo sapiens
aacctgctggatgggactcca

SEQ ID NO: 718313 - DNA, 12 bp, Homo sapiens
aacctgcttcct

SEQ ID NO: 718314 - DNA, 14 bp, Homo sapiens
aacctggagatatt

SEQ ID NO: 718315 - DNA, 23 bp, Homo sapiens
aacctggccactgtccctgtcct

SEQ ID NO: 718316 - DNA, 24 bp, Homo sapiens
aacctggccactgtccctgtcctt

SEQ ID NO: 718317 - DNA, 15 bp, Homo sapiens
aacctgggaggcaga

SEQ ID NO: 718318 - DNA, 20 bp, Homo sapiens
aacctgggattcaggaatgt

SEQ ID NO: 718319 - DNA, 21 bp, Homo sapiens
aacctggggtgaatacttatt

SEQ ID NO: 718320 - DNA, 22 bp, Homo sapiens
aacctggggtgaatacttattt

SEQ ID NO: 718321 - DNA, 21 bp, Homo sapiens
aacctggtggcaccagatgca

SEQ ID NO: 718322 - DNA, 17 bp, Homo sapiens
aacctgtagaatcaatt

SEQ ID NO: 718323 - DNA, 17 bp, Homo sapiens
aacctgtcattgtattc

SEQ ID NO: 718324 - DNA, 22 bp, Homo sapiens
aacctgtctccactgtgccttt

SEQ ID NO: 718325 - DNA, 24 bp, Homo sapiens
aacctgtctccactgtgcctttgc

SEQ ID NO: 718326 - DNA, 22 bp, Homo sapiens
aacctgtgaccagtctgaccct

SEQ ID NO: 718327 - DNA, 14 bp, Homo sapiens
aacctgtgccaggc

SEQ ID NO: 718328 - DNA, 24 bp, Homo sapiens
aacctgttacctactttgactttt

SEQ ID NO: 718329 - DNA, 19 bp, Homo sapiens
aacctgttcttagagtgta

SEQ ID NO: 718330 - DNA, 12 bp, Homo sapiens
aacctgttttgt

SEQ ID NO: 718331 - DNA, 15 bp, Homo sapiens
aacctgttttgttaa

SEQ ID NO: 718332 - DNA, 16 bp, Homo sapiens
aacctgttttgttaat

SEQ ID NO: 718333 - DNA, 12 bp, Homo sapiens
aaccttaatatt

SEQ ID NO: 718334 - DNA, 15 bp, Homo sapiens
aaccttattgtacct

SEQ ID NO: 718335 - DNA, 17 bp, Homo sapiens
aaccttattgtacctct

SEQ ID NO: 718336 - DNA, 19 bp, Homo sapiens
aaccttattgtacctctct

SEQ ID NO: 718337 - DNA, 13 bp, Homo sapiens
aaccttccctcca

SEQ ID NO: 718338 - DNA, 18 bp, Homo sapiens
aaccttctcccttcttgg

SEQ ID NO: 718339 - DNA, 17 bp, Homo sapiens
aaccttgaaaaaaaaca

SEQ ID NO: 718340 - DNA, 16 bp, Homo sapiens
aaccttgaatgctgcc

SEQ ID NO: 718341 - DNA, 17 bp, Homo sapiens
aaccttgaatgctgcca

SEQ ID NO: 718342 - DNA, 18 bp, Homo sapiens
aaccttgaatgctgccag

SEQ ID NO: 718343 - DNA, 23 bp, Homo sapiens
aaccttgagtcagaaaacagaga

SEQ ID NO: 718344 - DNA, 21 bp, Homo sapiens
aaccttggagaggagagtggc

SEQ ID NO: 718345 - DNA, 14 bp, Homo sapiens
aaccttgggccctg

SEQ ID NO: 718346 - DNA, 15 bp, Homo sapiens
aaccttgggccctgg

SEQ ID NO: 718347 - DNA, 13 bp, Homo sapiens
aaccttgtcccag

SEQ ID NO: 718348 - DNA, 16 bp, Homo sapiens
aaccttgtcccagcca

SEQ ID NO: 718349 - DNA, 18 bp, Homo sapiens
aaggaggaatttactttc

SEQ ID NO: 718350 - DNA, 21 bp, Homo sapiens
aaggaggacccaggacaggat

SEQ ID NO: 718351 - DNA, 9 bp, Homo sapiens
aaggaggag

SEQ ID NO: 718352 - DNA, 10 bp, Homo sapiens
aaggaggaga

SEQ ID NO: 718353 - DNA, 20 bp, Homo sapiens
aaggaggccctgttccctgg

SEQ ID NO: 718354 - DNA, 21 bp, Homo sapiens
aaggaggccctgttccctgga

SEQ ID NO: 718355 - DNA, 14 bp, Homo sapiens
aaggaggctggcag

SEQ ID NO: 718356 - DNA, 14 bp, Homo sapiens
aaggagggcagagc

SEQ ID NO: 718357 - DNA, 19 bp, Homo sapiens
aaggagggcagagccatgg

SEQ ID NO: 718358 - DNA, 20 bp, Homo sapiens
aaggaggggaaaaaaatgtt

SEQ ID NO: 718359 - DNA, 16 bp, Homo sapiens
aaggaggggaaacaat

SEQ ID NO: 718360 - DNA, 20 bp, Homo sapiens
aaggaggggaaacaatgaaa

SEQ ID NO: 718361 - DNA, 19 bp, Homo sapiens
aaggagggttagggagggg

SEQ ID NO: 718362 - DNA, 15 bp, Homo sapiens
aaggaggtagagagg

SEQ ID NO: 718363 - DNA, 19 bp, Homo sapiens
aaggagtaatctgtgtaca

SEQ ID NO: 718364 - DNA, 17 bp, Homo sapiens
aaggagtacaaaacaat

SEQ ID NO: 718365 - DNA, 17 bp, Homo sapiens
aaggagtcactgagacc

SEQ ID NO: 718366 - DNA, 17 bp, Homo sapiens
aaggagtgtaaaatgta

SEQ ID NO: 718367 - DNA, 22 bp, Homo sapiens
aaggagtgtatgagtgtgagtg

SEQ ID NO: 718368 - DNA, 20 bp, Homo sapiens
aaggagttccatgaagacca

SEQ ID NO: 718369 - DNA, 14 bp, Homo sapiens
aaggagttggtgta

SEQ ID NO: 718370 - DNA, 22 bp, Homo sapiens
aaggagtttattacaatgtatc

SEQ ID NO: 718371 - DNA, 12 bp, Homo sapiens
aaggataaagaa

SEQ ID NO: 718372 - DNA, 13 bp, Homo sapiens
aaggataaagaag

SEQ ID NO: 718373 - DNA, 19 bp, Homo sapiens
aaggataatgaaataatca

SEQ ID NO: 718374 - DNA, 17 bp, Homo sapiens
aaggataccttcttatt

SEQ ID NO: 718375 - DNA, 19 bp, Homo sapiens
aaggataccttcttattta

SEQ ID NO: 718376 - DNA, 17 bp, Homo sapiens
aaggatagaagctgcag

SEQ ID NO: 718377 - DNA, 22 bp, Homo sapiens
aaggataggccttcattaacaa

SEQ ID NO: 718378 - DNA, 14 bp, Homo sapiens
aaggatatactgca

SEQ ID NO: 718379 - DNA, 17 bp, Homo sapiens
aagctgaggcgggagaa

SEQ ID NO: 718380 - DNA, 21 bp, Homo sapiens
aagctgagttacttgtctgag

SEQ ID NO: 718381 - DNA, 13 bp, Homo sapiens
aagctgagtttcc

SEQ ID NO: 718382 - DNA, 19 bp, Homo sapiens
aagctgatattatttcttc

SEQ ID NO: 718383 - DNA, 23 bp, Homo sapiens
aagctgatattatttcttctctt

SEQ ID NO: 718384 - DNA, 13 bp, Homo sapiens
aagctgatcctgc

SEQ ID NO: 718385 - DNA, 21 bp, Homo sapiens
aagctgatgatgtctcttgta

SEQ ID NO: 718386 - DNA, 14 bp, Homo sapiens
aagctgattaaaac

SEQ ID NO: 718387 - DNA, 17 bp, Homo sapiens
aagctgattaaaacaca

SEQ ID NO: 718388 - DNA, 22 bp, Homo sapiens
aagctgattactgtcaataaac

SEQ ID NO: 718389 - DNA, 13 bp, Homo sapiens
aagctgcaccctc

SEQ ID NO: 718390 - DNA, 19 bp, Homo sapiens
aagctgcaccctcaggcag

SEQ ID NO: 718391 - DNA, 21 bp, Homo sapiens
aagctgcaccctcaggcaggt

SEQ ID NO: 718392 - DNA, 22 bp, Homo sapiens
aagctgcaccctcaggcaggtg

SEQ ID NO: 718393 - DNA, 12 bp, Homo sapiens
aagctgcactgt

SEQ ID NO: 718394 - DNA, 16 bp, Homo sapiens
aagctgcactgtgaac

SEQ ID NO: 718395 - DNA, 13 bp, Homo sapiens
aagctgcaggttt

SEQ ID NO: 718396 - DNA, 19 bp, Homo sapiens
aagctgcctgtagttagga

SEQ ID NO: 718397 - DNA, 17 bp, Homo sapiens
aagctgctccaggcctg

SEQ ID NO: 718398 - DNA, 20 bp, Homo sapiens
aagctgctctgagccacagt

SEQ ID NO: 718399 - DNA, 13 bp, Homo sapiens
aagctgctgacca

SEQ ID NO: 718400 - DNA, 14 bp, Homo sapiens
aagctgctttattc

SEQ ID NO: 718401 - DNA, 14 bp, Homo sapiens
aagctggaacattt

SEQ ID NO: 718402 - DNA, 16 bp, Homo sapiens
aagctggagctcttgg

SEQ ID NO: 718403 - DNA, 14 bp, Homo sapiens
aagctggcctgaga

SEQ ID NO: 718404 - DNA, 17 bp, Homo sapiens
aagctggctctgtttga

SEQ ID NO: 718405 - DNA, 13 bp, Homo sapiens
aagctgggcaggt

SEQ ID NO: 718406 - DNA, 11 bp, Homo sapiens
aagctgggccc

SEQ ID NO: 718407 - DNA, 22 bp, Homo sapiens
aagctgggcccaaaggcccagg

SEQ ID NO: 718408 - DNA, 13 bp, Homo sapiens
aagctgggctctt

SEQ ID NO: 718409 - DNA, 16 bp, Homo sapiens
aagctgggctgtctct

SEQ ID NO: 718410 - DNA, 13 bp, Homo sapiens
aagctggggagga

SEQ ID NO: 718411 - DNA, 19 bp, Homo sapiens
aagctgggggaagggtggt

SEQ ID NO: 718412 - DNA, 11 bp, Homo sapiens
aagctgtacac

SEQ ID NO: 718413 - DNA, 19 bp, Homo sapiens
aagctgtactcagagcaga

SEQ ID NO: 718414 - DNA, 22 bp, Homo sapiens
aagctgtagtagccctttctgt

SEQ ID NO: 718415 - DNA, 20 bp, Homo sapiens
aagctgtcaggctgggacag

SEQ ID NO: 718416 - DNA, 23 bp, Homo sapiens
aagctgtctactggacaatctta

SEQ ID NO: 718417 - DNA, 22 bp, Homo sapiens
aagctgtgagacagtgggaaat

SEQ ID NO: 718418 - DNA, 13 bp, Homo sapiens
aagctgtggccag

SEQ ID NO: 718419 - DNA, 21 bp, Homo sapiens
aagctgtgtctgcccaatgaa

SEQ ID NO: 718420 - DNA, 13 bp, Homo sapiens
aagctgttcctgt

SEQ ID NO: 718421 - DNA, 15 bp, Homo sapiens
aagctgtttccatag

SEQ ID NO: 718422 - DNA, 23 bp, Homo sapiens
aagctgtttccatagggtgacac

SEQ ID NO: 718423 - DNA, 21 bp, Homo sapiens
aagctgtttgccaagctgaag

SEQ ID NO: 718424 - DNA, 19 bp, Homo sapiens
aagcttaaagtatctacct

SEQ ID NO: 718425 - DNA, 14 bp, Homo sapiens
aagcttaaatagga

SEQ ID NO: 718426 - DNA, 22 bp, Homo sapiens
aagcttaaataggaaagtttct

SEQ ID NO: 718427 - DNA, 22 bp, Homo sapiens
aagcttaaattgcttttgttgt

SEQ ID NO: 718428 - DNA, 14 bp, Homo sapiens
aagcttaatgattc

SEQ ID NO: 718429 - DNA, 10 bp, Homo sapiens
aagcttagaa

SEQ ID NO: 718430 - DNA, 20 bp, Homo sapiens
aagcttccatgattctattt

SEQ ID NO: 718431 - DNA, 23 bp, Homo sapiens
aagcttcccacggcctttctagc

SEQ ID NO: 718432 - DNA, 12 bp, Homo sapiens
aagcttcctgtg

SEQ ID NO: 718433 - DNA, 13 bp, Homo sapiens
aagcttcctgtgc

SEQ ID NO: 718434 - DNA, 22 bp, Homo sapiens
aagcttcgaggcccagcgacct

SEQ ID NO: 718435 - DNA, 17 bp, Homo sapiens
aagcttcgttagaatgt

SEQ ID NO: 718436 - DNA, 22 bp, Homo sapiens
aagcttgatttgatctttgttt

SEQ ID NO: 718437 - DNA, 14 bp, Homo sapiens
aagcttggcagccg

SEQ ID NO: 718438 - DNA, 16 bp, Homo sapiens
aagcttggtcaaactt

SEQ ID NO: 718439 - DNA, 23 bp, Homo sapiens
aagcttggtcaaactttttccag

SEQ ID NO: 718440 - DNA, 16 bp, Homo sapiens
aagcttggttctgtga

SEQ ID NO: 718441 - DNA, 17 bp, Homo sapiens
aagcttggttctgtgaa

SEQ ID NO: 718442 - DNA, 23 bp, Homo sapiens
aagcttgtggccccttttacttt

SEQ ID NO: 718443 - DNA, 13 bp, Homo sapiens
aagctttaaatta

SEQ ID NO: 718444 - DNA, 19 bp, Homo sapiens
aagctttactactgtggaa

SEQ ID NO: 718445 - DNA, 15 bp, Homo sapiens
aagctttatctttgt

SEQ ID NO: 718446 - DNA, 17 bp, Homo sapiens
aagctttatctttgtgt

SEQ ID NO: 718447 - DNA, 17 bp, Homo sapiens
aagctttatttgcatat

SEQ ID NO: 718448 - DNA, 22 bp, Homo sapiens
aagctttcatgtaaactgtgca

SEQ ID NO: 718449 - DNA, 16 bp, Homo sapiens
aagctttcctgcccca

SEQ ID NO: 718450 - DNA, 15 bp, Homo sapiens
aataatttgtaaatt

SEQ ID NO: 718451 - DNA, 15 bp, Homo sapiens
aataatttgtacaat

SEQ ID NO: 718452 - DNA, 17 bp, Homo sapiens
aataattttaaataacc

SEQ ID NO: 718453 - DNA, 17 bp, Homo sapiens
aataattttaatattct

SEQ ID NO: 718454 - DNA, 23 bp, Homo sapiens
aataattttaatattcttttgtt

SEQ ID NO: 718455 - DNA, 14 bp, Homo sapiens
aataattttccaag

SEQ ID NO: 718456 - DNA, 15 bp, Homo sapiens
aataattttctaaga

SEQ ID NO: 718457 - DNA, 14 bp, Homo sapiens
aatatctattaata

SEQ ID NO: 718458 - DNA, 15 bp, Homo sapiens
aatatctctatttaa

SEQ ID NO: 718459 - DNA, 16 bp, Homo sapiens
aatatctctatttaat

SEQ ID NO: 718460 - DNA, 18 bp, Homo sapiens
aatatctctgagttctgt

SEQ ID NO: 718461 - DNA, 18 bp, Homo sapiens
aatatctgaaaatgtatg

SEQ ID NO: 718462 - DNA, 20 bp, Homo sapiens
aatatctgaaaatgtatgtg

SEQ ID NO: 718463 - DNA, 18 bp, Homo sapiens
aatatcttaattctttgt

SEQ ID NO: 718464 - DNA, 15 bp, Homo sapiens
aatatctttctctta

SEQ ID NO: 718465 - DNA, 16 bp, Homo sapiens
aatatgaaaaatgtaa

SEQ ID NO: 718466 - DNA, 16 bp, Homo sapiens
aatatgaacctatttt

SEQ ID NO: 718467 - DNA, 14 bp, Homo sapiens
aatatgaagccttt

SEQ ID NO: 718468 - DNA, 14 bp, Homo sapiens
aatatgaatctata

SEQ ID NO: 718469 - DNA, 15 bp, Homo sapiens
aatatgaatgtcaca

SEQ ID NO: 718470 - DNA, 16 bp, Homo sapiens
aatatgaatgtcacat

SEQ ID NO: 718471 - DNA, 18 bp, Homo sapiens
aatatgaatgtcacattt

SEQ ID NO: 718472 - DNA, 22 bp, Homo sapiens
aatatgaatgtcacatttgaat

SEQ ID NO: 718473 - DNA, 19 bp, Homo sapiens
aatatgacggaagaacata

SEQ ID NO: 718474 - DNA, 21 bp, Homo sapiens
aatatgacggaagaacataga

SEQ ID NO: 718475 - DNA, 13 bp, Homo sapiens
aatatgagcttca

SEQ ID NO: 718476 - DNA, 14 bp, Homo sapiens
aatatgagcttcaa

SEQ ID NO: 718477 - DNA, 20 bp, Homo sapiens
aatatgagcttcaatataag

SEQ ID NO: 718478 - DNA, 14 bp, Homo sapiens
aatatgagttactg

SEQ ID NO: 718479 - DNA, 12 bp, Homo sapiens
aatatgatttta

SEQ ID NO: 718480 - DNA, 13 bp, Homo sapiens
aatatgcaagcag

SEQ ID NO: 718481 - DNA, 17 bp, Homo sapiens
aatatgcaagcagcttt

SEQ ID NO: 718482 - DNA, 17 bp, Homo sapiens
aatatgcacacattttt

SEQ ID NO: 718483 - DNA, 22 bp, Homo sapiens
aatatgcacacattttttaaat

SEQ ID NO: 718484 - DNA, 12 bp, Homo sapiens
aatatgcacttt

SEQ ID NO: 718485 - DNA, 15 bp, Homo sapiens
aatatgcatactaat

SEQ ID NO: 718486 - DNA, 16 bp, Homo sapiens
aatatgcttaaaataa

SEQ ID NO: 718487 - DNA, 18 bp, Homo sapiens
aatatggaaccttccctc

SEQ ID NO: 718488 - DNA, 14 bp, Homo sapiens
aatatggaacttac

SEQ ID NO: 718489 - DNA, 17 bp, Homo sapiens
aatatggaacttacatt

SEQ ID NO: 718490 - DNA, 17 bp, Homo sapiens
aatatggaacttctaat

SEQ ID NO: 718491 - DNA, 13 bp, Homo sapiens
aatatgggagaaa

SEQ ID NO: 718492 - DNA, 22 bp, Homo sapiens
aatatggttggagagccctgga

SEQ ID NO: 718493 - DNA, 15 bp, Homo sapiens
aatatgtaatttcaa

SEQ ID NO: 718494 - DNA, 17 bp, Homo sapiens
aatatgtatatgacatt

SEQ ID NO: 718495 - DNA, 13 bp, Homo sapiens
aatatgtatgtct

SEQ ID NO: 718496 - DNA, 14 bp, Homo sapiens
aatatgtattgtaa

SEQ ID NO: 718497 - DNA, 21 bp, Homo sapiens
aatatgtatttaccaaaaatt

SEQ ID NO: 718498 - DNA, 12 bp, Homo sapiens
aatatgtcctgg

SEQ ID NO: 718499 - DNA, 15 bp, Homo sapiens
aatatgtgaagtttt

SEQ ID NO: 718500 - DNA, 20 bp, Homo sapiens
aatcctttttctttataaac

SEQ ID NO: 718501 - DNA, 18 bp, Homo sapiens
aatcgaagtgtttatgta

SEQ ID NO: 718502 - DNA, 15 bp, Homo sapiens
aatcgatgaatgtaa

SEQ ID NO: 718503 - DNA, 13 bp, Homo sapiens
aatcgattggctt

SEQ ID NO: 718504 - DNA, 17 bp, Homo sapiens
aatcgccataggccaag

SEQ ID NO: 718505 - DNA, 14 bp, Homo sapiens
aatcgcttaaagat

SEQ ID NO: 718506 - DNA, 21 bp, Homo sapiens
aatcgcttaaagatgttccta

SEQ ID NO: 718507 - DNA, 21 bp, Homo sapiens
aatcgcttgaacctgggaagt

SEQ ID NO: 718508 - DNA, 11 bp, Homo sapiens
aatcggactgc

SEQ ID NO: 718509 - DNA, 23 bp, Homo sapiens
aatcggatctggggctctgggat

SEQ ID NO: 718510 - DNA, 23 bp, Homo sapiens
aatcgggtccagagaccacacca

SEQ ID NO: 718511 - DNA, 15 bp, Homo sapiens
aatcggtttaaacat

SEQ ID NO: 718512 - DNA, 21 bp, Homo sapiens
aatcgtggcacgtattgctgt

SEQ ID NO: 718513 - DNA, 13 bp, Homo sapiens
aatctaaaatgat

SEQ ID NO: 718514 - DNA, 19 bp, Homo sapiens
aatctaaaatttcataatt

SEQ ID NO: 718515 - DNA, 20 bp, Homo sapiens
aatctaaaccttacatgtgt

SEQ ID NO: 718516 - DNA, 14 bp, Homo sapiens
aatctaaatctatt

SEQ ID NO: 718517 - DNA, 15 bp, Homo sapiens
aatctaaatctattt

SEQ ID NO: 718518 - DNA, 13 bp, Homo sapiens
aatctaaatggaa

SEQ ID NO: 718519 - DNA, 15 bp, Homo sapiens
aatctaaatggaacc

SEQ ID NO: 718520 - DNA, 17 bp, Homo sapiens
aatctaacacatttcat

SEQ ID NO: 718521 - DNA, 20 bp, Homo sapiens
aatctaatattaaaaatatg

SEQ ID NO: 718522 - DNA, 22 bp, Homo sapiens
aatctaatgtgagtgtgaagct

SEQ ID NO: 718523 - DNA, 17 bp, Homo sapiens
aatctacccaaaggata

SEQ ID NO: 718524 - DNA, 16 bp, Homo sapiens
aatctactcaaagcat

SEQ ID NO: 718525 - DNA, 17 bp, Homo sapiens
aatctactcaaagcatg

SEQ ID NO: 718526 - DNA, 12 bp, Homo sapiens
aatctacttttt

SEQ ID NO: 718527 - DNA, 14 bp, Homo sapiens
aatctagaagatgt

SEQ ID NO: 718528 - DNA, 15 bp, Homo sapiens
aatctagaagatgtg

SEQ ID NO: 718529 - DNA, 18 bp, Homo sapiens
aatctagaagatgtgtaa

SEQ ID NO: 718530 - DNA, 13 bp, Homo sapiens
aatctagacaata

SEQ ID NO: 718531 - DNA, 16 bp, Homo sapiens
aatctagacaatatac

SEQ ID NO: 718532 - DNA, 16 bp, Homo sapiens
aatctagacattcttt

SEQ ID NO: 718533 - DNA, 20 bp, Homo sapiens
aatctagacattcttttaat

SEQ ID NO: 718534 - DNA, 21 bp, Homo sapiens
aatctagaggaaaagaaagaa

SEQ ID NO: 718535 - DNA, 14 bp, Homo sapiens
aatggattctattt

SEQ ID NO: 718536 - DNA, 19 bp, Homo sapiens
aatggatttttaaattata

SEQ ID NO: 718537 - DNA, 13 bp, Homo sapiens
aatggatttttct

SEQ ID NO: 718538 - DNA, 13 bp, Homo sapiens
aatggcacctctg

SEQ ID NO: 718539 - DNA, 21 bp, Homo sapiens
aatggcacctctgcccttccc

SEQ ID NO: 718540 - DNA, 17 bp, Homo sapiens
aatggcactgagaaaca

SEQ ID NO: 718541 - DNA, 19 bp, Homo sapiens
aatggcactgttgcaaact

SEQ ID NO: 718542 - DNA, 18 bp, Homo sapiens
aatggcagcattcccacc

SEQ ID NO: 718543 - DNA, 13 bp, Homo sapiens
aatggcagctagt

SEQ ID NO: 718544 - DNA, 21 bp, Homo sapiens
aatggcagtttgaagtcaaat

SEQ ID NO: 718545 - DNA, 18 bp, Homo sapiens
aatggccagagcctctgg

SEQ ID NO: 718546 - DNA, 18 bp, Homo sapiens
aatggccagtgctgcttc

SEQ ID NO: 718547 - DNA, 21 bp, Homo sapiens
aatggccatgcaggaggtgga

SEQ ID NO: 718548 - DNA, 23 bp, Homo sapiens
aatggccatgcaggaggtggaga

SEQ ID NO: 718549 - DNA, 17 bp, Homo sapiens
aatggccatttgctttt

SEQ ID NO: 718550 - DNA, 14 bp, Homo sapiens
aatggccattttaa

SEQ ID NO: 718551 - DNA, 20 bp, Homo sapiens
aatggcctgccttgaagcca

SEQ ID NO: 718552 - DNA, 14 bp, Homo sapiens
aatggcgtctgctc

SEQ ID NO: 718553 - DNA, 23 bp, Homo sapiens
aatggcgtctgctctggtggctt

SEQ ID NO: 718554 - DNA, 20 bp, Homo sapiens
aatggcgtctggaagtccaa

SEQ ID NO: 718555 - DNA, 18 bp, Homo sapiens
aatggctaataaactgta

SEQ ID NO: 718556 - DNA, 20 bp, Homo sapiens
aatggctaataaactgtatt

SEQ ID NO: 718557 - DNA, 23 bp, Homo sapiens
aatggctaataaactgtattaaa

SEQ ID NO: 718558 - DNA, 16 bp, Homo sapiens
aatggctagtactgta

SEQ ID NO: 718559 - DNA, 19 bp, Homo sapiens
aatggctagtactgtattg

SEQ ID NO: 718560 - DNA, 15 bp, Homo sapiens
aatggctatgaacag

SEQ ID NO: 718561 - DNA, 16 bp, Homo sapiens
aatggctatgaacaga

SEQ ID NO: 718562 - DNA, 14 bp, Homo sapiens
aatggctatgtttt

SEQ ID NO: 718563 - DNA, 14 bp, Homo sapiens
aatggctattaaca

SEQ ID NO: 718564 - DNA, 15 bp, Homo sapiens
aatggctgataattt

SEQ ID NO: 718565 - DNA, 16 bp, Homo sapiens
aatggctgataatttt

SEQ ID NO: 718566 - DNA, 20 bp, Homo sapiens
aatggctgcacctttttgca

SEQ ID NO: 718567 - DNA, 15 bp, Homo sapiens
aatggctgggtcagg

SEQ ID NO: 718568 - DNA, 14 bp, Homo sapiens
aatggcttgttcat

SEQ ID NO: 718569 - DNA, 15 bp, Homo sapiens
aatgggaagactcag

SEQ ID NO: 718570 - DNA, 16 bp, Homo sapiens
aatgggaagcagggaa

SEQ ID NO: 718571 - DNA, 16 bp, Homo sapiens
aatgggaatattttat

SEQ ID NO: 718572 - DNA, 16 bp, Homo sapiens
aatgggagctgagcag

SEQ ID NO: 718573 - DNA, 22 bp, Homo sapiens
aatgggatggtcggatctcaca

SEQ ID NO: 718574 - DNA, 15 bp, Homo sapiens
aatgggcaattccag

SEQ ID NO: 718575 - DNA, 23 bp, Homo sapiens
aatgggcactgggatgagccgct

SEQ ID NO: 718576 - DNA, 20 bp, Homo sapiens
aatgggcagctccatcctct

SEQ ID NO: 718577 - DNA, 17 bp, Homo sapiens
aatgggcagttctccca

SEQ ID NO: 718578 - DNA, 20 bp, Homo sapiens
aatgggccactgaaatctgt

SEQ ID NO: 718579 - DNA, 11 bp, Homo sapiens
aatgggcctgc

SEQ ID NO: 718580 - DNA, 14 bp, Homo sapiens
aatgggcctgcctg

SEQ ID NO: 718581 - DNA, 15 bp, Homo sapiens
aatgggcctgcctgc

SEQ ID NO: 718582 - DNA, 23 bp, Homo sapiens
aatgggcctgcctgcctccaccc

SEQ ID NO: 718583 - DNA, 18 bp, Homo sapiens
aatgggcgcccccccctc

SEQ ID NO: 718584 - DNA, 19 bp, Homo sapiens
aatgggctctccggggcca

SEQ ID NO: 718585 - DNA, 16 bp, Homo sapiens
aatgggggcctccgct

SEQ ID NO: 718586 - DNA, 23 bp, Homo sapiens
aatgggggctttcggggagggcg

SEQ ID NO: 718587 - DNA, 20 bp, Homo sapiens
aatggggggcgggccagggt

SEQ ID NO: 718588 - DNA, 22 bp, Homo sapiens
aatggggggcgggccagggtgg

SEQ ID NO: 718589 - DNA, 14 bp, Homo sapiens
aatgggggtcagaa

SEQ ID NO: 718590 - DNA, 21 bp, Homo sapiens
aatggtactctaatcagtcct

SEQ ID NO: 718591 - DNA, 16 bp, Homo sapiens
aatggtagcattttaa

SEQ ID NO: 718592 - DNA, 21 bp, Homo sapiens
aatggtagcattttaaacaaa

SEQ ID NO: 718593 - DNA, 17 bp, Homo sapiens
aatggtaggcatttcct

SEQ ID NO: 718594 - DNA, 16 bp, Homo sapiens
aatggtataaatttca

SEQ ID NO: 718595 - DNA, 19 bp, Homo sapiens
aatggtatcctactgagca

SEQ ID NO: 718596 - DNA, 14 bp, Homo sapiens
aatggtccaggaga

SEQ ID NO: 718597 - DNA, 14 bp, Homo sapiens
aatggtccagggtt

SEQ ID NO: 718598 - DNA, 16 bp, Homo sapiens
aatggtccagggttga

SEQ ID NO: 718599 - DNA, 21 bp, Homo sapiens
aatggtcccaattaagaaatt

SEQ ID NO: 718600 - DNA, 15 bp, Homo sapiens
aatggtctggcaata

SEQ ID NO: 718601 - DNA, 18 bp, Homo sapiens
aatggtctttgctccaga

SEQ ID NO: 718602 - DNA, 23 bp, Homo sapiens
aatggtctttgctccagataact

SEQ ID NO: 718603 - DNA, 17 bp, Homo sapiens
aatggtgatcctctatt

SEQ ID NO: 718604 - DNA, 19 bp, Homo sapiens
aatggtgatcctctatttt

SEQ ID NO: 718605 - DNA, 19 bp, Homo sapiens
aatggtgcaaaaaaaaact

SEQ ID NO: 718606 - DNA, 19 bp, Homo sapiens
aatggtgcattgtatagat

SEQ ID NO: 718607 - DNA, 13 bp, Homo sapiens
aatggtgctgttt

SEQ ID NO: 718608 - DNA, 13 bp, Homo sapiens
aatggtgcttccc

SEQ ID NO: 718609 - DNA, 13 bp, Homo sapiens
aatggtgtacata

SEQ ID NO: 718610 - DNA, 15 bp, Homo sapiens
aatggtgtagaacac

SEQ ID NO: 718611 - DNA, 20 bp, Homo sapiens
aatggtgtcagtatccaggc

SEQ ID NO: 718612 - DNA, 22 bp, Homo sapiens
aatggtgtgaacccgggagcgg

SEQ ID NO: 718613 - DNA, 15 bp, Homo sapiens
aatggttaaatttta

SEQ ID NO: 718614 - DNA, 18 bp, Homo sapiens
aatggttatgtgcattat

SEQ ID NO: 718615 - DNA, 15 bp, Homo sapiens
aatggttcagaatta

SEQ ID NO: 718616 - DNA, 14 bp, Homo sapiens
aatggttccatgcc

SEQ ID NO: 718617 - DNA, 16 bp, Homo sapiens
aatggttgatggaaaa

SEQ ID NO: 718618 - DNA, 22 bp, Homo sapiens
aatggttgggacaatggcaata

SEQ ID NO: 718619 - DNA, 12 bp, Homo sapiens
aatggttgtgaa

SEQ ID NO: 718620 - DNA, 21 bp, Homo sapiens
aatggttgtgaaatgtaacat

SEQ ID NO: 718621 - DNA, 17 bp, Homo sapiens
aatggtttcctctggat

SEQ ID NO: 718622 - DNA, 22 bp, Homo sapiens
aatggtttctcattaaactcta

SEQ ID NO: 718623 - DNA, 22 bp, Homo sapiens
aatggtttgtaaaatccacagc

SEQ ID NO: 718624 - DNA, 16 bp, Homo sapiens
aatggtttgtcctgat

SEQ ID NO: 718625 - DNA, 20 bp, Homo sapiens
aatggtttgtgtcaaaactg

SEQ ID NO: 718626 - DNA, 14 bp, Homo sapiens
aatggttttcaaaa

SEQ ID NO: 718627 - DNA, 16 bp, Homo sapiens
aatggttttcaaaata

SEQ ID NO: 718628 - DNA, 19 bp, Homo sapiens
aatgtaaaaaagaaaaaca

SEQ ID NO: 718629 - DNA, 15 bp, Homo sapiens
aatgtaaaacacata

SEQ ID NO: 718630 - DNA, 17 bp, Homo sapiens
aatgtaaaatgttgaat

SEQ ID NO: 718631 - DNA, 15 bp, Homo sapiens
aatgtaaaccacatg

SEQ ID NO: 718632 - DNA, 16 bp, Homo sapiens
aatgtaaactgccata

SEQ ID NO: 718633 - DNA, 22 bp, Homo sapiens
aatgtaaactttgtcatggttt

SEQ ID NO: 718634 - DNA, 21 bp, Homo sapiens
aatgtaaatactcatgaatga

SEQ ID NO: 718635 - DNA, 12 bp, Homo sapiens
aatgtaaatatt

SEQ ID NO: 718636 - DNA, 16 bp, Homo sapiens
aatgtaaatattttaa

SEQ ID NO: 718637 - DNA, 17 bp, Homo sapiens
aatgtaaatttactgag

SEQ ID NO: 718638 - DNA, 22 bp, Homo sapiens
aatgtaacatcataattacatt

SEQ ID NO: 718639 - DNA, 16 bp, Homo sapiens
aatgtaacatgaagca

SEQ ID NO: 718640 - DNA, 20 bp, Homo sapiens
aatgtaactgtccgtagtat

SEQ ID NO: 718641 - DNA, 16 bp, Homo sapiens
aatgtaacttattcca

SEQ ID NO: 718642 - DNA, 12 bp, Homo sapiens
aatgtaagaaaa

SEQ ID NO: 718643 - DNA, 16 bp, Homo sapiens
aatgtaagaaaacaaa

SEQ ID NO: 718644 - DNA, 21 bp, Homo sapiens
aatgtaagaaaacaaaatcta

SEQ ID NO: 718645 - DNA, 18 bp, Homo sapiens
aatgtaagaaaagctgat

SEQ ID NO: 718646 - DNA, 16 bp, Homo sapiens
aatgtaagcatacttt

SEQ ID NO: 718647 - DNA, 18 bp, Homo sapiens
aatgtaaggctgtgtaag

SEQ ID NO: 718648 - DNA, 22 bp, Homo sapiens
aatgtaaggctgtgtaagattt

SEQ ID NO: 718649 - DNA, 20 bp, Homo sapiens
aatgtaatactggaataatt

SEQ ID NO: 718650 - DNA, 16 bp, Homo sapiens
aatgtaatagggaaaa

SEQ ID NO: 718651 - DNA, 15 bp, Homo sapiens
aatgtaatgtcagac

SEQ ID NO: 718652 - DNA, 16 bp, Homo sapiens
aatgtaatgtcagact

SEQ ID NO: 718653 - DNA, 18 bp, Homo sapiens
aatgtaattaaactgtta

SEQ ID NO: 718654 - DNA, 16 bp, Homo sapiens
aatgtaatttagaaac

SEQ ID NO: 718655 - DNA, 20 bp, Homo sapiens
aatgtacaagttttgtataa

SEQ ID NO: 718656 - DNA, 20 bp, Homo sapiens
aatgtacaattatgtctctt

SEQ ID NO: 718657 - DNA, 17 bp, Homo sapiens
aatgtacagacatattt

SEQ ID NO: 718658 - DNA, 21 bp, Homo sapiens
aatgtacagacatatttaact

SEQ ID NO: 718659 - DNA, 14 bp, Homo sapiens
aatgtccccactcc

SEQ ID NO: 718660 - DNA, 17 bp, Homo sapiens
aatgtcctccagaagcc

SEQ ID NO: 718661 - DNA, 23 bp, Homo sapiens
aatgtcctccagaagcctctggc

SEQ ID NO: 718662 - DNA, 16 bp, Homo sapiens
aatgtcctgcctttta

SEQ ID NO: 718663 - DNA, 17 bp, Homo sapiens
aatgtcgaaacctacaa

SEQ ID NO: 718664 - DNA, 17 bp, Homo sapiens
aatgtcgaactcttctt

SEQ ID NO: 718665 - DNA, 16 bp, Homo sapiens
aatgtcggggttgggg

SEQ ID NO: 718666 - DNA, 23 bp, Homo sapiens
aatgtcggggttggggtgggagg

SEQ ID NO: 718667 - DNA, 12 bp, Homo sapiens
aatgtctaaatg

SEQ ID NO: 718668 - DNA, 15 bp, Homo sapiens
aatgtctaaatgctg

SEQ ID NO: 718669 - DNA, 17 bp, Homo sapiens
aatgtctaaatgctgaa

SEQ ID NO: 718670 - DNA, 13 bp, Homo sapiens
aatgtctcccaca

SEQ ID NO: 718671 - DNA, 16 bp, Homo sapiens
aatgtctcccacaccc

SEQ ID NO: 718672 - DNA, 21 bp, Homo sapiens
aatgtctcccacacccaccct

SEQ ID NO: 718673 - DNA, 13 bp, Homo sapiens
aatgtctcctccc

SEQ ID NO: 718674 - DNA, 20 bp, Homo sapiens
aatgtctcttcctctgttct

SEQ ID NO: 718675 - DNA, 20 bp, Homo sapiens
aatgtctgaagtacaaacat

SEQ ID NO: 718676 - DNA, 12 bp, Homo sapiens
aatgtctgctgg

SEQ ID NO: 718677 - DNA, 21 bp, Homo sapiens
aatgtctgctggtatttctaa

SEQ ID NO: 718678 - DNA, 13 bp, Homo sapiens
aatgtctgtgcta

SEQ ID NO: 718679 - DNA, 17 bp, Homo sapiens
aatgtctgttaacttaa

SEQ ID NO: 718680 - DNA, 23 bp, Homo sapiens
aatgtcttaaataaaactattta

SEQ ID NO: 718681 - DNA, 23 bp, Homo sapiens
aatgtcttcagtggaacacaaat

SEQ ID NO: 718682 - DNA, 17 bp, Homo sapiens
aatgtcttcatttcatt

SEQ ID NO: 718683 - DNA, 19 bp, Homo sapiens
aatgtcttgctgttgacat

SEQ ID NO: 718684 - DNA, 22 bp, Homo sapiens
aatgtcttgctgttgacatatt

SEQ ID NO: 718685 - DNA, 15 bp, Homo sapiens
aatgtctttccaaat

SEQ ID NO: 718686 - DNA, 18 bp, Homo sapiens
aatgtctttgttggaaaa

SEQ ID NO: 718687 - DNA, 12 bp, Homo sapiens
aatgtcttttga

SEQ ID NO: 718688 - DNA, 19 bp, Homo sapiens
aatgtgaaaagaaaaatga

SEQ ID NO: 718689 - DNA, 22 bp, Homo sapiens
aatgtgaaaatggtccaggaga

SEQ ID NO: 718690 - DNA, 14 bp, Homo sapiens
aatgtgaaactgga

SEQ ID NO: 718691 - DNA, 13 bp, Homo sapiens
aatgtgaaatgct

SEQ ID NO: 718692 - DNA, 16 bp, Homo sapiens
aatgtgaaatgctttt

SEQ ID NO: 718693 - DNA, 16 bp, Homo sapiens
aatgtgaaatgtaact

SEQ ID NO: 718694 - DNA, 15 bp, Homo sapiens
aatgtgaagacattt

SEQ ID NO: 718695 - DNA, 23 bp, Homo sapiens
aatgtgaatcagaccctacccca

SEQ ID NO: 718696 - DNA, 19 bp, Homo sapiens
aatgtgaatttcaactttt

SEQ ID NO: 718697 - DNA, 21 bp, Homo sapiens
aatgtgaatttttgcctatct

SEQ ID NO: 718698 - DNA, 16 bp, Homo sapiens
aatgtgacctttaaga

SEQ ID NO: 718699 - DNA, 18 bp, Homo sapiens
aatgtgaggaactcacat

SEQ ID NO: 718700 - DNA, 16 bp, Homo sapiens
aatgtgatcatatgag

SEQ ID NO: 718701 - DNA, 21 bp, Homo sapiens
aatgtgatggatggcacaatg

SEQ ID NO: 718702 - DNA, 17 bp, Homo sapiens
aatgtgattccttttga

SEQ ID NO: 718703 - DNA, 19 bp, Homo sapiens
aatgtgattctaatgtctt

SEQ ID NO: 718704 - DNA, 14 bp, Homo sapiens
aatgtgattcttct

SEQ ID NO: 718705 - DNA, 18 bp, Homo sapiens
aatgtgattcttctaaag

SEQ ID NO: 718706 - DNA, 14 bp, Homo sapiens
aatgtgattggtaa

SEQ ID NO: 718707 - DNA, 12 bp, Homo sapiens
aatgtgcaaatt

SEQ ID NO: 718708 - DNA, 21 bp, Homo sapiens
aatgtgcataatgataaaata

SEQ ID NO: 718709 - DNA, 13 bp, Homo sapiens
aatgtgccacctg

SEQ ID NO: 718710 - DNA, 18 bp, Homo sapiens
aatgtgctatactgcata

SEQ ID NO: 718711 - DNA, 23 bp, Homo sapiens
aatgtgctggtgaacactgtgac

SEQ ID NO: 718712 - DNA, 18 bp, Homo sapiens
aatgtggaaggaaaatat

SEQ ID NO: 718713 - DNA, 20 bp, Homo sapiens
aatgtggataaaactgtgta

SEQ ID NO: 718714 - DNA, 22 bp, Homo sapiens
aatgtggcaaggaaaaacaggt

SEQ ID NO: 718715 - DNA, 14 bp, Homo sapiens
aatgtggctcctgg

SEQ ID NO: 718716 - DNA, 12 bp, Homo sapiens
aatgtggcttga

SEQ ID NO: 718717 - DNA, 21 bp, Homo sapiens
aatgtggcttgagaaatatgg

SEQ ID NO: 718718 - DNA, 21 bp, Homo sapiens
aatgtgggaagaaacaaaccc

SEQ ID NO: 718719 - DNA, 22 bp, Homo sapiens
aatgtgggctgcccctcgcaca

SEQ ID NO: 718720 - DNA, 19 bp, Homo sapiens
aatgtgggtagtcattctt

SEQ ID NO: 718721 - DNA, 19 bp, Homo sapiens
aatgtgggttatcctcctc

SEQ ID NO: 718722 - DNA, 16 bp, Homo sapiens
aatgtggtctcaggat

SEQ ID NO: 718723 - DNA, 17 bp, Homo sapiens
aatgtggtgacacctcc

SEQ ID NO: 718724 - DNA, 21 bp, Homo sapiens
aatgtggttatttctctgatt

SEQ ID NO: 718725 - DNA, 18 bp, Homo sapiens
aatgtggttgcttaattc

SEQ ID NO: 718726 - DNA, 19 bp, Homo sapiens
aatgtgtaattttgttcta

SEQ ID NO: 718727 - DNA, 18 bp, Homo sapiens
aatgtgtacagtgaattg

SEQ ID NO: 718728 - DNA, 16 bp, Homo sapiens
aatgtgtataaattgt

SEQ ID NO: 718729 - DNA, 19 bp, Homo sapiens
aatgtgtcaaattataaga

SEQ ID NO: 718730 - DNA, 13 bp, Homo sapiens
aatgtgtcagaat

SEQ ID NO: 718731 - DNA, 20 bp, Homo sapiens
aatgtgtcagaataggaaaa

SEQ ID NO: 718732 - DNA, 14 bp, Homo sapiens
aatgtgtcattgga

SEQ ID NO: 718733 - DNA, 15 bp, Homo sapiens
aatgtgtccaagaca

SEQ ID NO: 718734 - DNA, 16 bp, Homo sapiens
aatgtgtctctgcttt

SEQ ID NO: 718735 - DNA, 12 bp, Homo sapiens
aatgtgtcttta

SEQ ID NO: 718736 - DNA, 13 bp, Homo sapiens
aatgtgtctttag

SEQ ID NO: 718737 - DNA, 17 bp, Homo sapiens
aatgtgtctttagatag

SEQ ID NO: 718738 - DNA, 19 bp, Homo sapiens
aatgtgtgccatagagttt

SEQ ID NO: 718739 - DNA, 20 bp, Homo sapiens
aatgtgtgctttattgaatt

SEQ ID NO: 718740 - DNA, 21 bp, Homo sapiens
aatgtgtgtgtgtggcagggg

SEQ ID NO: 718741 - DNA, 16 bp, Homo sapiens
aatgtgtgttgtgtga

SEQ ID NO: 718742 - DNA, 17 bp, Homo sapiens
aatgtgttatgagaaat

SEQ ID NO: 718743 - DNA, 22 bp, Homo sapiens
aatgtgttcttttctcctttac

SEQ ID NO: 718744 - DNA, 14 bp, Homo sapiens
aatgtgtttttccc

SEQ ID NO: 718745 - DNA, 15 bp, Homo sapiens
aatgttaaagtcagt

SEQ ID NO: 718746 - DNA, 19 bp, Homo sapiens
aatgttaagacttgacagt

SEQ ID NO: 718747 - DNA, 15 bp, Homo sapiens
aatgttaagctttat

SEQ ID NO: 718748 - DNA, 23 bp, Homo sapiens
aatgttaattcagcactgatttc

SEQ ID NO: 718749 - DNA, 20 bp, Homo sapiens
aatgttaatttattttgctc

SEQ ID NO: 718750 - DNA, 13 bp, Homo sapiens
aatgttactgatc

SEQ ID NO: 718751 - DNA, 20 bp, Homo sapiens
aatgttactgatcatgcatt

SEQ ID NO: 718752 - DNA, 13 bp, Homo sapiens
aatgttactgcct

SEQ ID NO: 718753 - DNA, 17 bp, Homo sapiens
aatgttagaggttttaa

SEQ ID NO: 718754 - DNA, 22 bp, Homo sapiens
aatgttagaggttttaaagtga

SEQ ID NO: 718755 - DNA, 12 bp, Homo sapiens
aatgttagagta

SEQ ID NO: 718756 - DNA, 20 bp, Homo sapiens
aatgttagagtaatgaaatg

SEQ ID NO: 718757 - DNA, 19 bp, Homo sapiens
aatgttatgactatgtaaa

SEQ ID NO: 718758 - DNA, 20 bp, Homo sapiens
aatgttattttttaattatt

SEQ ID NO: 718759 - DNA, 21 bp, Homo sapiens
aatgttcatcccatgatgtag

SEQ ID NO: 718760 - DNA, 22 bp, Homo sapiens
aatgttcattgtaatgttactg

SEQ ID NO: 718761 - DNA, 24 bp, Homo sapiens
aatgttcattgtaatgttactgat

SEQ ID NO: 718762 - DNA, 20 bp, Homo sapiens
aatgttcattttctctgtat

SEQ ID NO: 718763 - DNA, 14 bp, Homo sapiens
aatgttccctgcac

SEQ ID NO: 718764 - DNA, 15 bp, Homo sapiens
aatgttccctgcacc

SEQ ID NO: 718765 - DNA, 20 bp, Homo sapiens
aatgttccctgcaccctgga

SEQ ID NO: 718766 - DNA, 14 bp, Homo sapiens
aatgttctcaaata

SEQ ID NO: 718767 - DNA, 12 bp, Homo sapiens
aatgttctgaca

SEQ ID NO: 718768 - DNA, 14 bp, Homo sapiens
aatgttctgacatt

SEQ ID NO: 718769 - DNA, 17 bp, Homo sapiens
aatgttctgacattaac

SEQ ID NO: 718770 - DNA, 20 bp, Homo sapiens
aatgttctgacattaacagt

SEQ ID NO: 718771 - DNA, 15 bp, Homo sapiens
aatgttctttaatgt

SEQ ID NO: 718772 - DNA, 13 bp, Homo sapiens
aatgttgaaaagt

SEQ ID NO: 718773 - DNA, 19 bp, Homo sapiens
aatgttgaaaagtcaaact

SEQ ID NO: 718774 - DNA, 22 bp, Homo sapiens
aatgttgaaatatgatgttaaa

SEQ ID NO: 718775 - DNA, 20 bp, Homo sapiens
aatgttgacctttgaggtct

SEQ ID NO: 718776 - DNA, 14 bp, Homo sapiens
aatgttgagaagtt

SEQ ID NO: 718777 - DNA, 18 bp, Homo sapiens
aatgttgagaatcccaaa

SEQ ID NO: 718778 - DNA, 20 bp, Homo sapiens
aatgttgcttaggatgtgtg

SEQ ID NO: 718779 - DNA, 22 bp, Homo sapiens
aatgttggacagacactgttgc

SEQ ID NO: 718780 - DNA, 17 bp, Homo sapiens
aatgttggataaggaat

SEQ ID NO: 718781 - DNA, 22 bp, Homo sapiens
aatgttggatttataaatgcta

SEQ ID NO: 718782 - DNA, 17 bp, Homo sapiens
aatgttgtattcagtga

SEQ ID NO: 718783 - DNA, 12 bp, Homo sapiens
aatgtttaaatc

SEQ ID NO: 718784 - DNA, 20 bp, Homo sapiens
aatgtttaaatcatgtatgt

SEQ ID NO: 718785 - DNA, 20 bp, Homo sapiens
aatgtttacactctttgtaa

SEQ ID NO: 718786 - DNA, 22 bp, Homo sapiens
aatgtttacagatccccaagcc

SEQ ID NO: 718787 - DNA, 14 bp, Homo sapiens
aatgtttataactc

SEQ ID NO: 718788 - DNA, 16 bp, Homo sapiens
aatgtttatactgtat

SEQ ID NO: 718789 - DNA, 23 bp, Homo sapiens
aatgtttatactgtatttctaag

SEQ ID NO: 718790 - DNA, 22 bp, Homo sapiens
aatgtttatgcaaggaaggaaa

SEQ ID NO: 718791 - DNA, 17 bp, Homo sapiens
aatgtttattatttaca

SEQ ID NO: 718792 - DNA, 14 bp, Homo sapiens
aatgtttccactgg

SEQ ID NO: 718793 - DNA, 19 bp, Homo sapiens
aatgtttccttaaacatga

SEQ ID NO: 718794 - DNA, 13 bp, Homo sapiens
aatgtttccttta

SEQ ID NO: 718795 - DNA, 12 bp, Homo sapiens
aatgtttcttag

SEQ ID NO: 718796 - DNA, 21 bp, Homo sapiens
aatgtttcttcatttctctgc

SEQ ID NO: 718797 - DNA, 18 bp, Homo sapiens
aatgtttcttttccctta

SEQ ID NO: 718798 - DNA, 12 bp, Homo sapiens
aatgtttgagca

SEQ ID NO: 718799 - DNA, 12 bp, Homo sapiens
aatgtttgctat

SEQ ID NO: 718800 - DNA, 22 bp, Homo sapiens
aatgtttgtgatattaaatttc

SEQ ID NO: 718801 - DNA, 17 bp, Homo sapiens
aatgttttaaatgtaca

SEQ ID NO: 718802 - DNA, 13 bp, Homo sapiens
aatgttttaaatt

SEQ ID NO: 718803 - DNA, 17 bp, Homo sapiens
aatgttttacattccat

SEQ ID NO: 718804 - DNA, 17 bp, Homo sapiens
aatgttttatactgttt

SEQ ID NO: 718805 - DNA, 15 bp, Homo sapiens
aatgttttcattatg

SEQ ID NO: 718806 - DNA, 10 bp, Homo sapiens
aatgttttct

SEQ ID NO: 718807 - DNA, 12 bp, Homo sapiens
aatgttttgctt

SEQ ID NO: 718808 - DNA, 16 bp, Homo sapiens
aatgttttgtaaacat

SEQ ID NO: 718809 - DNA, 20 bp, Homo sapiens
aatgttttgtaaacatttat

SEQ ID NO: 718810 - DNA, 14 bp, Homo sapiens
aatgttttgtacaa

SEQ ID NO: 718811 - DNA, 17 bp, Homo sapiens
aatgttttgtacaatta

SEQ ID NO: 718812 - DNA, 18 bp, Homo sapiens
aatgttttgtacaattac

SEQ ID NO: 718813 - DNA, 16 bp, Homo sapiens
aatgtttttccctccc

SEQ ID NO: 718814 - DNA, 18 bp, Homo sapiens
aatgtttttccctcccca

SEQ ID NO: 718815 - DNA, 21 bp, Homo sapiens
aatgtttttctgccagggagc

SEQ ID NO: 718816 - DNA, 15 bp, Homo sapiens
aatgttttttgccac

SEQ ID NO: 718817 - DNA, 21 bp, Homo sapiens
aatgttttttggaaattcaga

SEQ ID NO: 718818 - DNA, 16 bp, Homo sapiens
aattaaaaactttaaa

SEQ ID NO: 718819 - DNA, 17 bp, Homo sapiens
aattaaaaatgaaaatt

SEQ ID NO: 718820 - DNA, 13 bp, Homo sapiens
aattaaaacaaat

SEQ ID NO: 718821 - DNA, 19 bp, Homo sapiens
aattaaaacaaatatacat

SEQ ID NO: 718822 - DNA, 21 bp, Homo sapiens
aattaaaacaaatatacattt

SEQ ID NO: 718823 - DNA, 14 bp, Homo sapiens
aattaaaacacttt

SEQ ID NO: 718824 - DNA, 16 bp, Homo sapiens
aattacatacagattt

SEQ ID NO: 718825 - DNA, 17 bp, Homo sapiens
aattacatgtaaaacat

SEQ ID NO: 718826 - DNA, 12 bp, Homo sapiens
aattacatgttt

SEQ ID NO: 718827 - DNA, 13 bp, Homo sapiens
aattacattccta

SEQ ID NO: 718828 - DNA, 23 bp, Homo sapiens
aattacattcctaactagaatta

SEQ ID NO: 718829 - DNA, 17 bp, Homo sapiens
aattacattttatatgt

SEQ ID NO: 718830 - DNA, 15 bp, Homo sapiens
aattaccaacctgtt

SEQ ID NO: 718831 - DNA, 16 bp, Homo sapiens
aattaccagaaagata

SEQ ID NO: 718832 - DNA, 17 bp, Homo sapiens
aattaccattaattaca

SEQ ID NO: 718833 - DNA, 18 bp, Homo sapiens
aattaccatttgttaata

SEQ ID NO: 718834 - DNA, 14 bp, Homo sapiens
aattacctgtggat

SEQ ID NO: 718835 - DNA, 20 bp, Homo sapiens
aattacctttaattttaatg

SEQ ID NO: 718836 - DNA, 14 bp, Homo sapiens
aattacgtgctctg

SEQ ID NO: 718837 - DNA, 18 bp, Homo sapiens
aattacgtttaaagtgca

SEQ ID NO: 718838 - DNA, 19 bp, Homo sapiens
aattacgtttgttattcct

SEQ ID NO: 718839 - DNA, 15 bp, Homo sapiens
aattactaataaatt

SEQ ID NO: 718840 - DNA, 15 bp, Homo sapiens
aattactaattttac

SEQ ID NO: 718841 - DNA, 13 bp, Homo sapiens
aattactatctgt

SEQ ID NO: 718842 - DNA, 19 bp, Homo sapiens
aattactatctgttgaaaa

SEQ ID NO: 718843 - DNA, 18 bp, Homo sapiens
aattactgtatataaact

SEQ ID NO: 718844 - DNA, 16 bp, Homo sapiens
aattagaaaatattct

SEQ ID NO: 718845 - DNA, 22 bp, Homo sapiens
aattagaaaatgttatttaaca

SEQ ID NO: 718846 - DNA, 15 bp, Homo sapiens
aattagaaaattagt

SEQ ID NO: 718847 - DNA, 19 bp, Homo sapiens
aattagaaacaccattcat

SEQ ID NO: 718848 - DNA, 14 bp, Homo sapiens
aattagaagacatt

SEQ ID NO: 718849 - DNA, 13 bp, Homo sapiens
aattagaccttta

SEQ ID NO: 718850 - DNA, 17 bp, Homo sapiens
aattagacctttatttt

SEQ ID NO: 718851 - DNA, 17 bp, Homo sapiens
aattagatccattaatt

SEQ ID NO: 718852 - DNA, 20 bp, Homo sapiens
aattagatccattaatttaa

SEQ ID NO: 718853 - DNA, 21 bp, Homo sapiens
aattagatccattaatttaaa

SEQ ID NO: 718854 - DNA, 23 bp, Homo sapiens
aattagatccattaatttaaatg

SEQ ID NO: 718855 - DNA, 23 bp, Homo sapiens
aattagatcctgaaaattcacta

SEQ ID NO: 718856 - DNA, 23 bp, Homo sapiens
aattagatgattatatattgttg

SEQ ID NO: 718857 - DNA, 17 bp, Homo sapiens
aattagatgcaagtaaa

SEQ ID NO: 718858 - DNA, 17 bp, Homo sapiens
aattagattatttctgt

SEQ ID NO: 718859 - DNA, 16 bp, Homo sapiens
aattagcatgcaagct

SEQ ID NO: 718860 - DNA, 17 bp, Homo sapiens
aattagcatgcaagctt

SEQ ID NO: 718861 - DNA, 14 bp, Homo sapiens
aattagccgggcgt

SEQ ID NO: 718862 - DNA, 16 bp, Homo sapiens
aattagctgtgtgaaa

SEQ ID NO: 718863 - DNA, 22 bp, Homo sapiens
aattaggaagtgtaacagctga

SEQ ID NO: 718864 - DNA, 19 bp, Homo sapiens
aattaggctgtaactactt

SEQ ID NO: 718865 - DNA, 17 bp, Homo sapiens
aattaggggttaaagca

SEQ ID NO: 718866 - DNA, 17 bp, Homo sapiens
aattaggggttgctaag

SEQ ID NO: 718867 - DNA, 14 bp, Homo sapiens
aattaggttgaaac

SEQ ID NO: 718868 - DNA, 22 bp, Homo sapiens
aattaggttgaaacatatctct

SEQ ID NO: 718869 - DNA, 17 bp, Homo sapiens
aattaggtttttcctta

SEQ ID NO: 718870 - DNA, 18 bp, Homo sapiens
aattaggtttttccttat

SEQ ID NO: 718871 - DNA, 21 bp, Homo sapiens
aattaggtttttccttatttg

SEQ ID NO: 718872 - DNA, 17 bp, Homo sapiens
aattagtaacatgtgtt

SEQ ID NO: 718873 - DNA, 15 bp, Homo sapiens
aattagtctatcaaa

SEQ ID NO: 718874 - DNA, 17 bp, Homo sapiens
aattagtgaccattatt

SEQ ID NO: 718875 - DNA, 23 bp, Homo sapiens
aattagtgaccattattcacagg

SEQ ID NO: 718876 - DNA, 16 bp, Homo sapiens
aattagtgatatagtg

SEQ ID NO: 718877 - DNA, 18 bp, Homo sapiens
aattagtgatatagtgct

SEQ ID NO: 718878 - DNA, 17 bp, Homo sapiens
aattagtgccacttaat

SEQ ID NO: 718879 - DNA, 17 bp, Homo sapiens
aattagtggtcataaaa

SEQ ID NO: 718880 - DNA, 21 bp, Homo sapiens
aattagtggtcataaaataga

SEQ ID NO: 718881 - DNA, 12 bp, Homo sapiens
aattagttcagc

SEQ ID NO: 718882 - DNA, 20 bp, Homo sapiens
aattagtttatattactctc

SEQ ID NO: 718883 - DNA, 17 bp, Homo sapiens
aattataacttaaaata

SEQ ID NO: 718884 - DNA, 22 bp, Homo sapiens
aattataagggccctgccctgt

SEQ ID NO: 718885 - DNA, 22 bp, Homo sapiens
aattatagtgatgtaatcttga

SEQ ID NO: 718886 - DNA, 14 bp, Homo sapiens
aattatataactgt

SEQ ID NO: 718887 - DNA, 19 bp, Homo sapiens
aattatataactgtatttg

SEQ ID NO: 718888 - DNA, 22 bp, Homo sapiens
aattatatcagtcctctttcaa

SEQ ID NO: 718889 - DNA, 15 bp, Homo sapiens
aattatccagagttt

SEQ ID NO: 718890 - DNA, 12 bp, Homo sapiens
aattatccatta

SEQ ID NO: 718891 - DNA, 14 bp, Homo sapiens
aattatccattacg

SEQ ID NO: 718892 - DNA, 22 bp, Homo sapiens
aattatccattacgtgcattta

SEQ ID NO: 718893 - DNA, 21 bp, Homo sapiens
aattatcggaagcagtgcctt

SEQ ID NO: 718894 - DNA, 15 bp, Homo sapiens
aattatctaatttat

SEQ ID NO: 718895 - DNA, 15 bp, Homo sapiens
aattatctatagcta

SEQ ID NO: 718896 - DNA, 19 bp, Homo sapiens
aattatctgattaagcatt

SEQ ID NO: 718897 - DNA, 19 bp, Homo sapiens
aattatcttgatacattca

SEQ ID NO: 718898 - DNA, 13 bp, Homo sapiens
aattatgaaaata

SEQ ID NO: 718899 - DNA, 22 bp, Homo sapiens
aattatgggaataattgctttt

SEQ ID NO: 718900 - DNA, 16 bp, Homo sapiens
aattatgtaatatatt

SEQ ID NO: 718901 - DNA, 18 bp, Homo sapiens
aattatgtaatgcaaaat

SEQ ID NO: 718902 - DNA, 20 bp, Homo sapiens
aattatgtctcttgagcatc

SEQ ID NO: 718903 - DNA, 16 bp, Homo sapiens
aattatgtgaaatgct

SEQ ID NO: 718904 - DNA, 11 bp, Homo sapiens
aattatgtgac

SEQ ID NO: 718905 - DNA, 22 bp, Homo sapiens
aattatgtgacattttacatta

SEQ ID NO: 718906 - DNA, 12 bp, Homo sapiens
aattatgtgcaa

SEQ ID NO: 718907 - DNA, 22 bp, Homo sapiens
aattatgtttgccactttgcaa

SEQ ID NO: 718908 - DNA, 18 bp, Homo sapiens
aattatgttttaaacaca

SEQ ID NO: 718909 - DNA, 14 bp, Homo sapiens
aattattaattgtc

SEQ ID NO: 718910 - DNA, 19 bp, Homo sapiens
aattattaattgtcctgtg

SEQ ID NO: 718911 - DNA, 18 bp, Homo sapiens
aattattacagtgtttat

SEQ ID NO: 718912 - DNA, 19 bp, Homo sapiens
aattattaccagttatttg

SEQ ID NO: 718913 - DNA, 13 bp, Homo sapiens
aattattagaaca

SEQ ID NO: 718914 - DNA, 13 bp, Homo sapiens
aattattataaaa

SEQ ID NO: 718915 - DNA, 13 bp, Homo sapiens
aattattattctt

SEQ ID NO: 718916 - DNA, 18 bp, Homo sapiens
aattattatttatatatg

SEQ ID NO: 718917 - DNA, 15 bp, Homo sapiens
aattattatttgtgt

SEQ ID NO: 718918 - DNA, 14 bp, Homo sapiens
aattattcaattta

SEQ ID NO: 718919 - DNA, 17 bp, Homo sapiens
aattattccaaaccaaa

SEQ ID NO: 718920 - DNA, 23 bp, Homo sapiens
aattattctataatttccattta

SEQ ID NO: 718921 - DNA, 16 bp, Homo sapiens
aattattgacactgaa

SEQ ID NO: 718922 - DNA, 19 bp, Homo sapiens
aattattgatgattttgta

SEQ ID NO: 718923 - DNA, 17 bp, Homo sapiens
aattattgggctctttt

SEQ ID NO: 718924 - DNA, 21 bp, Homo sapiens
aattattggttggtgtgaaga

SEQ ID NO: 718925 - DNA, 23 bp, Homo sapiens
aattattggttggtgtgaagaaa

SEQ ID NO: 718926 - DNA, 14 bp, Homo sapiens
aattattgtaaact

SEQ ID NO: 718927 - DNA, 19 bp, Homo sapiens
aattattgtaaactttttc

SEQ ID NO: 718928 - DNA, 21 bp, Homo sapiens
aattattgtaaactttttcaa

SEQ ID NO: 718929 - DNA, 14 bp, Homo sapiens
aattattgtagaca

SEQ ID NO: 718930 - DNA, 22 bp, Homo sapiens
aattatttaaaccgctaaaaga

SEQ ID NO: 718931 - DNA, 21 bp, Homo sapiens
aattatttaaataaaatcacc

SEQ ID NO: 718932 - DNA, 13 bp, Homo sapiens
aattatttaagat

SEQ ID NO: 718933 - DNA, 19 bp, Homo sapiens
aattatttaagatttcttt

SEQ ID NO: 718934 - DNA, 22 bp, Homo sapiens
aattatttatatttcctgtatt

SEQ ID NO: 718935 - DNA, 15 bp, Homo sapiens
aattatttattactt

SEQ ID NO: 718936 - DNA, 19 bp, Homo sapiens
aattatttatttaataaca

SEQ ID NO: 718937 - DNA, 21 bp, Homo sapiens
aattatttgactttaatttat

SEQ ID NO: 718938 - DNA, 14 bp, Homo sapiens
aattatttgattat

SEQ ID NO: 718939 - DNA, 18 bp, Homo sapiens
aattattttaaaatattt

SEQ ID NO: 718940 - DNA, 19 bp, Homo sapiens
aattattttaaaatattta

SEQ ID NO: 718941 - DNA, 14 bp, Homo sapiens
aattattttaaaca

SEQ ID NO: 718942 - DNA, 18 bp, Homo sapiens
aattattttaaacaaaat

SEQ ID NO: 718943 - DNA, 19 bp, Homo sapiens
aattattttaatattttgt

SEQ ID NO: 718944 - DNA, 23 bp, Homo sapiens
aattattttatatcatacagttt

SEQ ID NO: 718945 - DNA, 11 bp, Homo sapiens
aattattttgg

SEQ ID NO: 718946 - DNA, 21 bp, Homo sapiens
aattattttgttagtggaaaa

SEQ ID NO: 718947 - DNA, 12 bp, Homo sapiens
aattatttttgt

SEQ ID NO: 718948 - DNA, 16 bp, Homo sapiens
aattattttttctatg

SEQ ID NO: 718949 - DNA, 15 bp, Homo sapiens
aattcaaaagtattg

SEQ ID NO: 718950 - DNA, 19 bp, Homo sapiens
aattcaaaagtgattatct

SEQ ID NO: 718951 - DNA, 19 bp, Homo sapiens
aattcaacatcaaaactta

SEQ ID NO: 718952 - DNA, 22 bp, Homo sapiens
aattcaacatcaaaacttaaga

SEQ ID NO: 718953 - DNA, 19 bp, Homo sapiens
aattcaagaaaataaaact

SEQ ID NO: 718954 - DNA, 13 bp, Homo sapiens
aattcaaggcctt

SEQ ID NO: 718955 - DNA, 21 bp, Homo sapiens
aattcaatgaatccccgaccc

SEQ ID NO: 718956 - DNA, 21 bp, Homo sapiens
aattcaatgtgaacactggca

SEQ ID NO: 718957 - DNA, 13 bp, Homo sapiens
aattcaattcaaa

SEQ ID NO: 718958 - DNA, 17 bp, Homo sapiens
aattcaattgtaaattg

SEQ ID NO: 718959 - DNA, 23 bp, Homo sapiens
aattcaattgtaaattgaatcag

SEQ ID NO: 718960 - DNA, 13 bp, Homo sapiens
aattcacaaactt

SEQ ID NO: 718961 - DNA, 18 bp, Homo sapiens
aattcacaagctaacttc

SEQ ID NO: 718962 - DNA, 22 bp, Homo sapiens
aattcacatctaacctcatctt

SEQ ID NO: 718963 - DNA, 17 bp, Homo sapiens
aattcacctcagcctgg

SEQ ID NO: 718964 - DNA, 18 bp, Homo sapiens
aattcacctcagcctgga

SEQ ID NO: 718965 - DNA, 16 bp, Homo sapiens
aattcactttcatttt

SEQ ID NO: 718966 - DNA, 21 bp, Homo sapiens
aattcagacatctgaggtttt

SEQ ID NO: 718967 - DNA, 22 bp, Homo sapiens
aattcagacatctgaggtttta

SEQ ID NO: 718968 - DNA, 14 bp, Homo sapiens
aattcagagtcctt

SEQ ID NO: 718969 - DNA, 16 bp, Homo sapiens
aattcagattgtcttg

SEQ ID NO: 718970 - DNA, 18 bp, Homo sapiens
aattcagattgtcttgca

SEQ ID NO: 718971 - DNA, 12 bp, Homo sapiens
aattcagcaccc

SEQ ID NO: 718972 - DNA, 18 bp, Homo sapiens
aattcagcaccctgggtg

SEQ ID NO: 718973 - DNA, 23 bp, Homo sapiens
aattcagcactgatttcacaaca

SEQ ID NO: 718974 - DNA, 20 bp, Homo sapiens
aattcagctcagcttcttcc

SEQ ID NO: 718975 - DNA, 13 bp, Homo sapiens
aattcagtacaac

SEQ ID NO: 718976 - DNA, 15 bp, Homo sapiens
aattcagtattttgc

SEQ ID NO: 718977 - DNA, 18 bp, Homo sapiens
aattcagttataaagtca

SEQ ID NO: 718978 - DNA, 16 bp, Homo sapiens
aattcagtttcataaa

SEQ ID NO: 718979 - DNA, 12 bp, Homo sapiens
aattcagttttt

SEQ ID NO: 718980 - DNA, 19 bp, Homo sapiens
aattcagtttttgtatctt

SEQ ID NO: 718981 - DNA, 19 bp, Homo sapiens
aattcatgtaacagttgtg

SEQ ID NO: 718982 - DNA, 12 bp, Homo sapiens
aattcatttgta

SEQ ID NO: 718983 - DNA, 13 bp, Homo sapiens
aattcatttgtat

SEQ ID NO: 718984 - DNA, 19 bp, Homo sapiens
aattcatttgtattgctta

SEQ ID NO: 718985 - DNA, 14 bp, Homo sapiens
aattccaaaatcca

SEQ ID NO: 718986 - DNA, 13 bp, Homo sapiens
aattccaaagcaa

SEQ ID NO: 718987 - DNA, 14 bp, Homo sapiens
aattccaaaggaat

SEQ ID NO: 718988 - DNA, 17 bp, Homo sapiens
aattccaactcctgatg

SEQ ID NO: 718989 - DNA, 12 bp, Homo sapiens
aattccacagct

SEQ ID NO: 718990 - DNA, 21 bp, Homo sapiens
aattccactggacttgagctt

SEQ ID NO: 718991 - DNA, 14 bp, Homo sapiens
aattccactgtcaa

SEQ ID NO: 718992 - DNA, 22 bp, Homo sapiens
aattccactgtcaagaaagagc

SEQ ID NO: 718993 - DNA, 19 bp, Homo sapiens
aattccagaggactctgct

SEQ ID NO: 718994 - DNA, 13 bp, Homo sapiens
aattccagcaata

SEQ ID NO: 718995 - DNA, 17 bp, Homo sapiens
aattccagcaataagaa

SEQ ID NO: 718996 - DNA, 22 bp, Homo sapiens
aattccaggtgtgcacagaaaa

SEQ ID NO: 718997 - DNA, 17 bp, Homo sapiens
aattccatacttctctc

SEQ ID NO: 718998 - DNA, 24 bp, Homo sapiens
aattccatagtggaccacttggaa

SEQ ID NO: 718999 - DNA, 16 bp, Homo sapiens
aattccatcttgtaaa

SEQ ID NO: 719000 - DNA, 23 bp, Homo sapiens
aattccatgtcagataagtgtaa

SEQ ID NO: 719001 - DNA, 16 bp, Homo sapiens
aattcccattttgcaa

SEQ ID NO: 719002 - DNA, 12 bp, Homo sapiens
aattccccctta

SEQ ID NO: 719003 - DNA, 18 bp, Homo sapiens
aattcccccttaaacttc

SEQ ID NO: 719004 - DNA, 20 bp, Homo sapiens
aattcccgttttgtcacttt

SEQ ID NO: 719005 - DNA, 10 bp, Homo sapiens
aattccctat

SEQ ID NO: 719006 - DNA, 13 bp, Homo sapiens
aattccctccccc

SEQ ID NO: 719007 - DNA, 22 bp, Homo sapiens
aatttgtaaagttggttggata

SEQ ID NO: 719008 - DNA, 12 bp, Homo sapiens
aatttgtaaatg

SEQ ID NO: 719009 - DNA, 16 bp, Homo sapiens
aatttgtaaatgattt

SEQ ID NO: 719010 - DNA, 15 bp, Homo sapiens
aatttgtaacctcag

SEQ ID NO: 719011 - DNA, 16 bp, Homo sapiens
aatttgtaacctcagc

SEQ ID NO: 719012 - DNA, 20 bp, Homo sapiens
aatttgtaagcaacttgctt

SEQ ID NO: 719013 - DNA, 22 bp, Homo sapiens
aatttgtaagcaacttgcttct

SEQ ID NO: 719014 - DNA, 15 bp, Homo sapiens
aatttgtaattgctt

SEQ ID NO: 719015 - DNA, 14 bp, Homo sapiens
aatttgtacaatgg

SEQ ID NO: 719016 - DNA, 19 bp, Homo sapiens
aatttgtacaatggtttat

SEQ ID NO: 719017 - DNA, 12 bp, Homo sapiens
aatttgtacttc

SEQ ID NO: 719018 - DNA, 14 bp, Homo sapiens
aatttgtataaaat

SEQ ID NO: 719019 - DNA, 15 bp, Homo sapiens
aatttgtataaaatg

SEQ ID NO: 719020 - DNA, 13 bp, Homo sapiens
aatttgtatatca

SEQ ID NO: 719021 - DNA, 16 bp, Homo sapiens
aatttgtatgctaaat

SEQ ID NO: 719022 - DNA, 15 bp, Homo sapiens
aatttgtattaaaaa

SEQ ID NO: 719023 - DNA, 16 bp, Homo sapiens
aatttgtcagcgttct

SEQ ID NO: 719024 - DNA, 14 bp, Homo sapiens
aatttgtcatgtta

SEQ ID NO: 719025 - DNA, 15 bp, Homo sapiens
aatttgtcatgttac

SEQ ID NO: 719026 - DNA, 20 bp, Homo sapiens
aatttgtcatgttactaaat

SEQ ID NO: 719027 - DNA, 18 bp, Homo sapiens
aatttgtctttttgtata

SEQ ID NO: 719028 - DNA, 12 bp, Homo sapiens
aatttgtgaatt

SEQ ID NO: 719029 - DNA, 14 bp, Homo sapiens
aatttgtgtaaatt

SEQ ID NO: 719030 - DNA, 17 bp, Homo sapiens
aatttgtgtaaatttgt

SEQ ID NO: 719031 - DNA, 19 bp, Homo sapiens
aatttgtgtaaatttgtat

SEQ ID NO: 719032 - DNA, 17 bp, Homo sapiens
aatttgtgtctgtgttt

SEQ ID NO: 719033 - DNA, 21 bp, Homo sapiens
aatttgtgtgtttttagctgt

SEQ ID NO: 719034 - DNA, 19 bp, Homo sapiens
aatttgtgttgaaggaact

SEQ ID NO: 719035 - DNA, 14 bp, Homo sapiens
aatttgttagacta

SEQ ID NO: 719036 - DNA, 16 bp, Homo sapiens
aatttgttataatgaa

SEQ ID NO: 719037 - DNA, 14 bp, Homo sapiens
aatttgttcttgta

SEQ ID NO: 719038 - DNA, 18 bp, Homo sapiens
aatttgtttaaaattctc

SEQ ID NO: 719039 - DNA, 15 bp, Homo sapiens
aatttgtttaaagaa

SEQ ID NO: 719040 - DNA, 21 bp, Homo sapiens
aatttgtttaaagaataaagt

SEQ ID NO: 719041 - DNA, 17 bp, Homo sapiens
aatttgtttaattaaat

SEQ ID NO: 719042 - DNA, 13 bp, Homo sapiens
aatttgtttgtat

SEQ ID NO: 719043 - DNA, 14 bp, Homo sapiens
aatttgtttttgca

SEQ ID NO: 719044 - DNA, 20 bp, Homo sapiens
aatttgtttttgcatttttg

SEQ ID NO: 719045 - DNA, 23 bp, Homo sapiens
aattttaaaaaagggagtttttg

SEQ ID NO: 719046 - DNA, 18 bp, Homo sapiens
aattttaaaaatacatat

SEQ ID NO: 719047 - DNA, 13 bp, Homo sapiens
aattttaaacata

SEQ ID NO: 719048 - DNA, 14 bp, Homo sapiens
aattttaaacatat

SEQ ID NO: 719049 - DNA, 13 bp, Homo sapiens
aattttaaagcca

SEQ ID NO: 719050 - DNA, 18 bp, Homo sapiens
aattttaaagtatgcatt

SEQ ID NO: 719051 - DNA, 15 bp, Homo sapiens
aattttaaagttctt

SEQ ID NO: 719052 - DNA, 16 bp, Homo sapiens
aattttaaagttctta

SEQ ID NO: 719053 - DNA, 22 bp, Homo sapiens
aattttaaataaaagtgatcaa

SEQ ID NO: 719054 - DNA, 17 bp, Homo sapiens
aattttaaataatttct

SEQ ID NO: 719055 - DNA, 22 bp, Homo sapiens
aattttaatattccagaagaac

SEQ ID NO: 719056 - DNA, 16 bp, Homo sapiens
aattttaatgaagaaa

SEQ ID NO: 719057 - DNA, 14 bp, Homo sapiens
aattttaatgctgt

SEQ ID NO: 719058 - DNA, 22 bp, Homo sapiens
aattttaatgtgaagacatttt

SEQ ID NO: 719059 - DNA, 12 bp, Homo sapiens
aattttaattta

SEQ ID NO: 719060 - DNA, 14 bp, Homo sapiens
aattttaatttagt

SEQ ID NO: 719061 - DNA, 16 bp, Homo sapiens
aattttaatttctaca

SEQ ID NO: 719062 - DNA, 19 bp, Homo sapiens
aattttacacgcttttgtg

SEQ ID NO: 719063 - DNA, 23 bp, Homo sapiens
aattttactccataaacagactg

SEQ ID NO: 719064 - DNA, 11 bp, Homo sapiens
aattttacttc

SEQ ID NO: 719065 - DNA, 16 bp, Homo sapiens
aattttagaaatattc

SEQ ID NO: 719066 - DNA, 14 bp, Homo sapiens
aattttagagcata

SEQ ID NO: 719067 - DNA, 15 bp, Homo sapiens
aattttagagcatac

SEQ ID NO: 719068 - DNA, 20 bp, Homo sapiens
aattttagtcactaagactt

SEQ ID NO: 719069 - DNA, 14 bp, Homo sapiens
aattttagtgtatt

SEQ ID NO: 719070 - DNA, 14 bp, Homo sapiens
aattttagtttttc

SEQ ID NO: 719071 - DNA, 18 bp, Homo sapiens
aattttagtttttcatta

SEQ ID NO: 719072 - DNA, 19 bp, Homo sapiens
aattttatagctcagttta

SEQ ID NO: 719073 - DNA, 16 bp, Homo sapiens
aattttatatgtaaat

SEQ ID NO: 719074 - DNA, 17 bp, Homo sapiens
aattttatatgtaaatg

SEQ ID NO: 719075 - DNA, 13 bp, Homo sapiens
aattttatattct

SEQ ID NO: 719076 - DNA, 19 bp, Homo sapiens
aattttatctgtttcctga

SEQ ID NO: 719077 - DNA, 13 bp, Homo sapiens
aattttattatta

SEQ ID NO: 719078 - DNA, 12 bp, Homo sapiens
aattttattcct

SEQ ID NO: 719079 - DNA, 16 bp, Homo sapiens
aattttattttgctga

SEQ ID NO: 719080 - DNA, 23 bp, Homo sapiens
aattttattttgctgagttgttc

SEQ ID NO: 719081 - DNA, 13 bp, Homo sapiens
aattttattttgt

SEQ ID NO: 719082 - DNA, 23 bp, Homo sapiens
aattttattttgtgctcatttaa

SEQ ID NO: 719083 - DNA, 14 bp, Homo sapiens
aattttatttttct

SEQ ID NO: 719084 - DNA, 22 bp, Homo sapiens
aattttcaactgtcttcctcaa

SEQ ID NO: 719085 - DNA, 19 bp, Homo sapiens
aattttcaagtaattgtga

SEQ ID NO: 719086 - DNA, 15 bp, Homo sapiens
aattttcactgctgc

SEQ ID NO: 719087 - DNA, 18 bp, Homo sapiens
aattttcacttttggcaa

SEQ ID NO: 719088 - DNA, 21 bp, Homo sapiens
aattttcattaaacttgaagc

SEQ ID NO: 719089 - DNA, 15 bp, Homo sapiens
aattttccaaccttt

SEQ ID NO: 719090 - DNA, 16 bp, Homo sapiens
aattttccaacctttg

SEQ ID NO: 719091 - DNA, 21 bp, Homo sapiens
aattttctaaaagctttcatg

SEQ ID NO: 719092 - DNA, 18 bp, Homo sapiens
aattttctagactttctg

SEQ ID NO: 719093 - DNA, 22 bp, Homo sapiens
aattttctccctttatgtatct

SEQ ID NO: 719094 - DNA, 13 bp, Homo sapiens
aattttcttcatg

SEQ ID NO: 719095 - DNA, 13 bp, Homo sapiens
aattttcttgttt

SEQ ID NO: 719096 - DNA, 13 bp, Homo sapiens
aattttctttatg

SEQ ID NO: 719097 - DNA, 17 bp, Homo sapiens
aattttctttgtttctt

SEQ ID NO: 719098 - DNA, 16 bp, Homo sapiens
aattttcttttaagca

SEQ ID NO: 719099 - DNA, 19 bp, Homo sapiens
aattttgaagtgctgttta

SEQ ID NO: 719100 - DNA, 14 bp, Homo sapiens
aattttgagtgaat

SEQ ID NO: 719101 - DNA, 17 bp, Homo sapiens
aattttgagttgccaca

SEQ ID NO: 719102 - DNA, 19 bp, Homo sapiens
aattttgatatacattgtg

SEQ ID NO: 719103 - DNA, 17 bp, Homo sapiens
aattttgatctttttat

SEQ ID NO: 719104 - DNA, 12 bp, Homo sapiens
aattttgcaatg

SEQ ID NO: 719105 - DNA, 11 bp, Homo sapiens
aattttgcata

SEQ ID NO: 719106 - DNA, 18 bp, Homo sapiens
aattttgcatactgaaaa

SEQ ID NO: 719107 - DNA, 21 bp, Homo sapiens
aattttgccaaaatcctgaac

SEQ ID NO: 719108 - DNA, 17 bp, Homo sapiens
aattttgcctttaacag

SEQ ID NO: 719109 - DNA, 18 bp, Homo sapiens
aattttgcttttaattaa

SEQ ID NO: 719110 - DNA, 22 bp, Homo sapiens
aattttggggattttcaaaaga

SEQ ID NO: 719111 - DNA, 15 bp, Homo sapiens
aattttgtaacgaag

SEQ ID NO: 719112 - DNA, 13 bp, Homo sapiens
aattttgtaatga

SEQ ID NO: 719113 - DNA, 15 bp, Homo sapiens
aattttgtgcattct

SEQ ID NO: 719114 - DNA, 15 bp, Homo sapiens
aattttgtgtaagaa

SEQ ID NO: 719115 - DNA, 18 bp, Homo sapiens
aattttgtgtaagaaata

SEQ ID NO: 719116 - DNA, 19 bp, Homo sapiens
aattttgttctagttttca

SEQ ID NO: 719117 - DNA, 14 bp, Homo sapiens
aattttgttctctg

SEQ ID NO: 719118 - DNA, 18 bp, Homo sapiens
aattttgttctctgggag

SEQ ID NO: 719119 - DNA, 23 bp, Homo sapiens
aattttgttctctgggagaaaat

SEQ ID NO: 719120 - DNA, 24 bp, Homo sapiens
aattttgttctctgggagaaaatc

SEQ ID NO: 719121 - DNA, 12 bp, Homo sapiens
aattttgtttca

SEQ ID NO: 719122 - DNA, 17 bp, Homo sapiens
aattttgttttactttt

SEQ ID NO: 719123 - DNA, 13 bp, Homo sapiens
aatttttaaacaa

SEQ ID NO: 719124 - DNA, 13 bp, Homo sapiens
aatttttaacttt

SEQ ID NO: 719125 - DNA, 12 bp, Homo sapiens
aatttttaagag

SEQ ID NO: 719126 - DNA, 13 bp, Homo sapiens
aatttttaagcaa

SEQ ID NO: 719127 - DNA, 18 bp, Homo sapiens
aatttttagccatttctc

SEQ ID NO: 719128 - DNA, 12 bp, Homo sapiens
aatttttataaa

SEQ ID NO: 719129 - DNA, 16 bp, Homo sapiens
aatttttatttttcta

SEQ ID NO: 719130 - DNA, 17 bp, Homo sapiens
aatttttatttttgaac

SEQ ID NO: 719131 - DNA, 22 bp, Homo sapiens
aatttttatttttgctgagact

SEQ ID NO: 719132 - DNA, 16 bp, Homo sapiens
aatttttcccagtatt

SEQ ID NO: 719133 - DNA, 15 bp, Homo sapiens
aattgggcactattt

SEQ ID NO: 719134 - DNA, 18 bp, Homo sapiens
aattgggcactatttatt

SEQ ID NO: 719135 - DNA, 20 bp, Homo sapiens
aattgggccagcttttcaaa

SEQ ID NO: 719136 - DNA, 23 bp, Homo sapiens
aattggggctgtcgggggctgtg

SEQ ID NO: 719137 - DNA, 17 bp, Homo sapiens
aattgggtgaagagctt

SEQ ID NO: 719138 - DNA, 17 bp, Homo sapiens
aattggtaaaaacagca

SEQ ID NO: 719139 - DNA, 23 bp, Homo sapiens
aattggtaaaaacagcagctcat

SEQ ID NO: 719140 - DNA, 23 bp, Homo sapiens
aattggtaaggcctctggactgg

SEQ ID NO: 719141 - DNA, 18 bp, Homo sapiens
aattggtgcttcagccct

SEQ ID NO: 719142 - DNA, 14 bp, Homo sapiens
aattggtgtatatc

SEQ ID NO: 719143 - DNA, 20 bp, Homo sapiens
aattggtgtatatcatgaag

SEQ ID NO: 719144 - DNA, 21 bp, Homo sapiens
aattgtaaagtaaaagctata

SEQ ID NO: 719145 - DNA, 24 bp, Homo sapiens
aattgtaaattgaatcagtataaa

SEQ ID NO: 719146 - DNA, 15 bp, Homo sapiens
aattgtaaattttag

SEQ ID NO: 719147 - DNA, 10 bp, Homo sapiens
aattgtaagt

SEQ ID NO: 719148 - DNA, 15 bp, Homo sapiens
aattgtaagtgaaat

SEQ ID NO: 719149 - DNA, 20 bp, Homo sapiens
aattgtaattccaaaatcca

SEQ ID NO: 719150 - DNA, 21 bp, Homo sapiens
aattgtacatatttgtggaat

SEQ ID NO: 719151 - DNA, 15 bp, Homo sapiens
aattgtacattttgt

SEQ ID NO: 719152 - DNA, 17 bp, Homo sapiens
aattgtacctatttctg

SEQ ID NO: 719153 - DNA, 23 bp, Homo sapiens
aattgtacctatttctgatgatg

SEQ ID NO: 719154 - DNA, 22 bp, Homo sapiens
aattgtaccttttttgtttttt

SEQ ID NO: 719155 - DNA, 18 bp, Homo sapiens
aattgtaggggtgtgtgt

SEQ ID NO: 719156 - DNA, 20 bp, Homo sapiens
aattgtagttctgtgtactt

SEQ ID NO: 719157 - DNA, 18 bp, Homo sapiens
aattgtataagtcaagca

SEQ ID NO: 719158 - DNA, 14 bp, Homo sapiens
aattgtatacattt

SEQ ID NO: 719159 - DNA, 18 bp, Homo sapiens
aattgtataccaatgtgt

SEQ ID NO: 719160 - DNA, 14 bp, Homo sapiens
aattgtatgaaaat

SEQ ID NO: 719161 - DNA, 18 bp, Homo sapiens
aattgtattgaaaacact

SEQ ID NO: 719162 - DNA, 19 bp, Homo sapiens
aattgtcactttttatgct

SEQ ID NO: 719163 - DNA, 20 bp, Homo sapiens
aattgtcattatttttgtta

SEQ ID NO: 719164 - DNA, 17 bp, Homo sapiens
aattgtccgtgttcata

SEQ ID NO: 719165 - DNA, 15 bp, Homo sapiens
aattgtcgtttttat

SEQ ID NO: 719166 - DNA, 17 bp, Homo sapiens
aattgtctaaaatgtca

SEQ ID NO: 719167 - DNA, 19 bp, Homo sapiens
aattgtctaaaatgtcagt

SEQ ID NO: 719168 - DNA, 16 bp, Homo sapiens
aattgtctctgggctg

SEQ ID NO: 719169 - DNA, 12 bp, Homo sapiens
aattgtctcttc

SEQ ID NO: 719170 - DNA, 17 bp, Homo sapiens
aattgtcttttagacaa

SEQ ID NO: 719171 - DNA, 14 bp, Homo sapiens
aattgtgagggaca

SEQ ID NO: 719172 - DNA, 21 bp, Homo sapiens
aattgtgattagacagaacac

SEQ ID NO: 719173 - DNA, 20 bp, Homo sapiens
aattgtgccgagaaaagcat

SEQ ID NO: 719174 - DNA, 15 bp, Homo sapiens
aattgtggattataa

SEQ ID NO: 719175 - DNA, 17 bp, Homo sapiens
aattgtggattataaaa

SEQ ID NO: 719176 - DNA, 20 bp, Homo sapiens
aattgtggattataaaaaat

SEQ ID NO: 719177 - DNA, 11 bp, Homo sapiens
aattgtggcta

SEQ ID NO: 719178 - DNA, 19 bp, Homo sapiens
aattgtggctatcctgatt

SEQ ID NO: 719179 - DNA, 23 bp, Homo sapiens
aattgtgtatatatcttataact

SEQ ID NO: 719180 - DNA, 18 bp, Homo sapiens
aattgtgtattgatgcaa

SEQ ID NO: 719181 - DNA, 23 bp, Homo sapiens
aattgtgtgtctggtaactggaa

SEQ ID NO: 719182 - DNA, 15 bp, Homo sapiens
aattgttaatgtgat

SEQ ID NO: 719183 - DNA, 17 bp, Homo sapiens
aattgttacaatagaat

SEQ ID NO: 719184 - DNA, 22 bp, Homo sapiens
aattgttgaacaggtgtttttc

SEQ ID NO: 719185 - DNA, 12 bp, Homo sapiens
aattgttgttct

SEQ ID NO: 719186 - DNA, 15 bp, Homo sapiens
aattgttgttctgtt

SEQ ID NO: 719187 - DNA, 17 bp, Homo sapiens
aattgttgttctgttaa

SEQ ID NO: 719188 - DNA, 23 bp, Homo sapiens
aattgttgttctgttaactgaat

SEQ ID NO: 719189 - DNA, 13 bp, Homo sapiens
aattgttgtttgt

SEQ ID NO: 719190 - DNA, 14 bp, Homo sapiens
aattgttgtttgta

SEQ ID NO: 719191 - DNA, 22 bp, Homo sapiens
aattgttgtttgtatgtataat

SEQ ID NO: 719192 - DNA, 14 bp, Homo sapiens
aattgtttataatg

SEQ ID NO: 719193 - DNA, 18 bp, Homo sapiens
aattgtttataatggcaa

SEQ ID NO: 719194 - DNA, 22 bp, Homo sapiens
aattgtttatgtgttatgaaca

SEQ ID NO: 719195 - DNA, 14 bp, Homo sapiens
aattgtttcagttt

SEQ ID NO: 719196 - DNA, 11 bp, Homo sapiens
aattgtttctt

SEQ ID NO: 719197 - DNA, 20 bp, Homo sapiens
aattgtttgtaagtgaagtg

SEQ ID NO: 719198 - DNA, 15 bp, Homo sapiens
aattgttttctttaa

SEQ ID NO: 719199 - DNA, 21 bp, Homo sapiens
aattgtttttgaatttaaata

SEQ ID NO: 719200 - DNA, 23 bp, Homo sapiens
aattgtttttgaatttaaataaa

SEQ ID NO: 719201 - DNA, 14 bp, Homo sapiens
aatttaaaaaataa

SEQ ID NO: 719202 - DNA, 16 bp, Homo sapiens
aatttaaaagtaaaat

SEQ ID NO: 719203 - DNA, 19 bp, Homo sapiens
aatttaaaattaagtagaa

SEQ ID NO: 719204 - DNA, 15 bp, Homo sapiens
aatttaaacacctcc

SEQ ID NO: 719205 - DNA, 20 bp, Homo sapiens
aatttaaacaggcccagcat

SEQ ID NO: 719206 - DNA, 11 bp, Homo sapiens
aatttaaagca

SEQ ID NO: 719207 - DNA, 15 bp, Homo sapiens
aatttaaagccacaa

SEQ ID NO: 719208 - DNA, 11 bp, Homo sapiens
aatttaaatga

SEQ ID NO: 719209 - DNA, 14 bp, Homo sapiens
aatttaaatgatat

SEQ ID NO: 719210 - DNA, 22 bp, Homo sapiens
aatttaaatggcttttgccaca

SEQ ID NO: 719211 - DNA, 11 bp, Homo sapiens
aatttaaatgt

SEQ ID NO: 719212 - DNA, 13 bp, Homo sapiens
aatttaacagtat

SEQ ID NO: 719213 - DNA, 17 bp, Homo sapiens
aatttaaccataaatca

SEQ ID NO: 719214 - DNA, 17 bp, Homo sapiens
aatttaacttcttcata

SEQ ID NO: 719215 - DNA, 19 bp, Homo sapiens
aatttaagaaaacaagtat

SEQ ID NO: 719216 - DNA, 16 bp, Homo sapiens
aatttaagcaaacgtc

SEQ ID NO: 719217 - DNA, 14 bp, Homo sapiens
aatttaagcattgt

SEQ ID NO: 719218 - DNA, 16 bp, Homo sapiens
aatttaagcattgttt

SEQ ID NO: 719219 - DNA, 15 bp, Homo sapiens
aatttaagcttaagc

SEQ ID NO: 719220 - DNA, 14 bp, Homo sapiens
aatttaaggcaaaa

SEQ ID NO: 719221 - DNA, 18 bp, Homo sapiens
aatttaagtgttggaaaa

SEQ ID NO: 719222 - DNA, 14 bp, Homo sapiens
aatttaatgctgcc

SEQ ID NO: 719223 - DNA, 23 bp, Homo sapiens
aatttaatggactgtgaatttca

SEQ ID NO: 719224 - DNA, 11 bp, Homo sapiens
aatttaatggg

SEQ ID NO: 719225 - DNA, 23 bp, Homo sapiens
aatttaatggggtctgtaaatac

SEQ ID NO: 719226 - DNA, 21 bp, Homo sapiens
aatttaattaggggttgctaa

SEQ ID NO: 719227 - DNA, 19 bp, Homo sapiens
aatttaattcatgtttctt

SEQ ID NO: 719228 - DNA, 16 bp, Homo sapiens
aatttacaaaatttat

SEQ ID NO: 719229 - DNA, 13 bp, Homo sapiens
aatttacaaagtg

SEQ ID NO: 719230 - DNA, 15 bp, Homo sapiens
aatttacaaagtgtg

SEQ ID NO: 719231 - DNA, 19 bp, Homo sapiens
aatttacaaagtgtgtatt

SEQ ID NO: 719232 - DNA, 19 bp, Homo sapiens
aatttacaggttcttaggc

SEQ ID NO: 719233 - DNA, 15 bp, Homo sapiens
aatttacatactctg

SEQ ID NO: 719234 - DNA, 19 bp, Homo sapiens
aatttacatactctgctta

SEQ ID NO: 719235 - DNA, 19 bp, Homo sapiens
aatttaccaaggatgaatt

SEQ ID NO: 719236 - DNA, 16 bp, Homo sapiens
aatttacctaagatta

SEQ ID NO: 719237 - DNA, 18 bp, Homo sapiens
aatttacctaagattaca

SEQ ID NO: 719238 - DNA, 16 bp, Homo sapiens
aatttacctgatttct

SEQ ID NO: 719239 - DNA, 13 bp, Homo sapiens
aatttactttctg

SEQ ID NO: 719240 - DNA, 17 bp, Homo sapiens
aatttactttctgcacc

SEQ ID NO: 719241 - DNA, 18 bp, Homo sapiens
aatttactttcttcacca

SEQ ID NO: 719242 - DNA, 15 bp, Homo sapiens
aatttagaaaaagtc

SEQ ID NO: 719243 - DNA, 16 bp, Homo sapiens
aatttagaaaaagtca

SEQ ID NO: 719244 - DNA, 15 bp, Homo sapiens
aatttagaaaacttt

SEQ ID NO: 719245 - DNA, 18 bp, Homo sapiens
aatttagaaactgatttc

SEQ ID NO: 719246 - DNA, 12 bp, Homo sapiens
aatttagaagaa

SEQ ID NO: 719247 - DNA, 17 bp, Homo sapiens
aatttagacttcaagca

SEQ ID NO: 719248 - DNA, 16 bp, Homo sapiens
aatttagacttggatt

SEQ ID NO: 719249 - DNA, 20 bp, Homo sapiens
aatttagacttggattcttt

SEQ ID NO: 719250 - DNA, 15 bp, Homo sapiens
aatttataaagtacc

SEQ ID NO: 719251 - DNA, 23 bp, Homo sapiens
aatttataacgtgttcaatattt

SEQ ID NO: 719252 - DNA, 19 bp, Homo sapiens
aatttatacaccagcaatt

SEQ ID NO: 719253 - DNA, 20 bp, Homo sapiens
aatttatatctaatatgaag

SEQ ID NO: 719254 - DNA, 15 bp, Homo sapiens
aatttatatgcttca

SEQ ID NO: 719255 - DNA, 17 bp, Homo sapiens
aatttatcacacttctg

SEQ ID NO: 719256 - DNA, 21 bp, Homo sapiens
aatttatcatgttttataatt

SEQ ID NO: 719257 - DNA, 21 bp, Homo sapiens
aatttatcctataagatgaca

SEQ ID NO: 719258 - DNA, 18 bp, Homo sapiens
aatttatcctgaaatttc

SEQ ID NO: 719259 - DNA, 19 bp, Homo sapiens
aatttatcctgaaatttca

SEQ ID NO: 719260 - DNA, 23 bp, Homo sapiens
aatttatcctgaaatttcagatt

SEQ ID NO: 719261 - DNA, 18 bp, Homo sapiens
aatttatctttaccaaaa

SEQ ID NO: 719262 - DNA, 19 bp, Homo sapiens
aatttatgaagcagattta

SEQ ID NO: 719263 - DNA, 23 bp, Homo sapiens
aatttatgaattgaattatcttg

SEQ ID NO: 719264 - DNA, 19 bp, Homo sapiens
aatttatgagtttttgata

SEQ ID NO: 719265 - DNA, 15 bp, Homo sapiens
aatttatgcatttca

SEQ ID NO: 719266 - DNA, 19 bp, Homo sapiens
aatttatgcatttcattca

SEQ ID NO: 719267 - DNA, 14 bp, Homo sapiens
aatttatgggagaa

SEQ ID NO: 719268 - DNA, 15 bp, Homo sapiens
aatttattaaaatga

SEQ ID NO: 719269 - DNA, 17 bp, Homo sapiens
aatttattaattgcttt

SEQ ID NO: 719270 - DNA, 13 bp, Homo sapiens
aatttattacaaa

SEQ ID NO: 719271 - DNA, 18 bp, Homo sapiens
aatttattagttaatata

SEQ ID NO: 719272 - DNA, 19 bp, Homo sapiens
aatttattatatatttaca

SEQ ID NO: 719273 - DNA, 17 bp, Homo sapiens
aatttattattgaaatt

SEQ ID NO: 719274 - DNA, 23 bp, Homo sapiens
aatttattctcaggtaatcattt

SEQ ID NO: 719275 - DNA, 20 bp, Homo sapiens
aatttatttatactatttag

SEQ ID NO: 719276 - DNA, 23 bp, Homo sapiens
aatttatttccaatgtttcaagc

SEQ ID NO: 719277 - DNA, 20 bp, Homo sapiens
aatttatttccactaaaaat

SEQ ID NO: 719278 - DNA, 18 bp, Homo sapiens
aatttatttcttaacctt

SEQ ID NO: 719279 - DNA, 23 bp, Homo sapiens
aatttatttgaatgatttttctt

SEQ ID NO: 719280 - DNA, 16 bp, Homo sapiens
aatttatttgtttccc

SEQ ID NO: 719281 - DNA, 17 bp, Homo sapiens
aatttattttataagaa

SEQ ID NO: 719282 - DNA, 21 bp, Homo sapiens
aatttattttataagaaaaac

SEQ ID NO: 719283 - DNA, 17 bp, Homo sapiens
aatttcaaaaatataac

SEQ ID NO: 719284 - DNA, 22 bp, Homo sapiens
aatttcaaaatacatttgtaag

SEQ ID NO: 719285 - DNA, 23 bp, Homo sapiens
aatttcaaaatacatttgtaagt

SEQ ID NO: 719286 - DNA, 21 bp, Homo sapiens
aatttcaccaccaaatgccaa

SEQ ID NO: 719287 - DNA, 19 bp, Homo sapiens
aatttcaggaatcagaaat

SEQ ID NO: 719288 - DNA, 16 bp, Homo sapiens
aatttcaggcattttg

SEQ ID NO: 719289 - DNA, 16 bp, Homo sapiens
aatttcagggtgcagc

SEQ ID NO: 719290 - DNA, 16 bp, Homo sapiens
aatttcagtataaaga

SEQ ID NO: 719291 - DNA, 19 bp, Homo sapiens
aatttcagtataaagatca

SEQ ID NO: 719292 - DNA, 14 bp, Homo sapiens
aatttccaaaataa

SEQ ID NO: 719293 - DNA, 18 bp, Homo sapiens
aatttccaaaataatcta

SEQ ID NO: 719294 - DNA, 11 bp, Homo sapiens
aatttccagag

SEQ ID NO: 719295 - DNA, 16 bp, Homo sapiens
aatttccatatagtct

SEQ ID NO: 719296 - DNA, 21 bp, Homo sapiens
aatttccatttacttaagact

SEQ ID NO: 719297 - DNA, 22 bp, Homo sapiens
aatttccatttacttaagactt

SEQ ID NO: 719298 - DNA, 19 bp, Homo sapiens
aatttcccaattaggaagt

SEQ ID NO: 719299 - DNA, 13 bp, Homo sapiens
aatttcccacccc

SEQ ID NO: 719300 - DNA, 18 bp, Homo sapiens
aatttcccacccccaccc

SEQ ID NO: 719301 - DNA, 17 bp, Homo sapiens
aatttcccagttaaaga

SEQ ID NO: 719302 - DNA, 17 bp, Homo sapiens
aatttcctctccactgc

SEQ ID NO: 719303 - DNA, 18 bp, Homo sapiens
aatttcctggtgtgaagg

SEQ ID NO: 719304 - DNA, 22 bp, Homo sapiens
aatttcctgtttgaaatatcat

SEQ ID NO: 719305 - DNA, 15 bp, Homo sapiens
aatttccttctgtta

SEQ ID NO: 719306 - DNA, 16 bp, Homo sapiens
aatttccttctgttaa

SEQ ID NO: 719307 - DNA, 17 bp, Homo sapiens
aatttccttctgttaag

SEQ ID NO: 719308 - DNA, 19 bp, Homo sapiens
aatttccttctgttaagaa

SEQ ID NO: 719309 - DNA, 16 bp, Homo sapiens
aatttcctttatattt

SEQ ID NO: 719310 - DNA, 14 bp, Homo sapiens
aatttcctttttga

SEQ ID NO: 719311 - DNA, 15 bp, Homo sapiens
aatttcctttttgac

SEQ ID NO: 719312 - DNA, 22 bp, Homo sapiens
aatttcctttttgacactgaaa

SEQ ID NO: 719313 - DNA, 18 bp, Homo sapiens
aatttcgccgttgaagag

SEQ ID NO: 719314 - DNA, 21 bp, Homo sapiens
aatttcgccgttgaagaggaa

SEQ ID NO: 719315 - DNA, 20 bp, Homo sapiens
aatttcggattttttccaaa

SEQ ID NO: 719316 - DNA, 21 bp, Homo sapiens
aatttcggattttttccaaaa

SEQ ID NO: 719317 - DNA, 22 bp, Homo sapiens
aatttctaagaagttacttttt

SEQ ID NO: 719318 - DNA, 18 bp, Homo sapiens
aatttctacaaaataaca

SEQ ID NO: 719319 - DNA, 20 bp, Homo sapiens
aatttctacaaaataacatt

SEQ ID NO: 719320 - DNA, 15 bp, Homo sapiens
aatttctactttgaa

SEQ ID NO: 719321 - DNA, 17 bp, Homo sapiens
aatttctactttgaagt

SEQ ID NO: 719322 - DNA, 22 bp, Homo sapiens
aatttctagacagtattgccac

SEQ ID NO: 719323 - DNA, 18 bp, Homo sapiens
aatttctataaatttaag

SEQ ID NO: 719324 - DNA, 23 bp, Homo sapiens
aatttctcatgttccttttgaaa

SEQ ID NO: 719325 - DNA, 22 bp, Homo sapiens
aatttctgataaagttccttaa

SEQ ID NO: 719326 - DNA, 18 bp, Homo sapiens
aatttctgccatttcatg

SEQ ID NO: 719327 - DNA, 22 bp, Homo sapiens
aatttctgctgtggtctataaa

SEQ ID NO: 719328 - DNA, 20 bp, Homo sapiens
aatttctgggatatttaact

SEQ ID NO: 719329 - DNA, 15 bp, Homo sapiens
aatttcttaacttct

SEQ ID NO: 719330 - DNA, 16 bp, Homo sapiens
aatttcttatgtgaca

SEQ ID NO: 719331 - DNA, 23 bp, Homo sapiens
aatttcttcatgtgatgtcatga

SEQ ID NO: 719332 - DNA, 19 bp, Homo sapiens
aatttcttcccccaaagcc

SEQ ID NO: 719333 - DNA, 22 bp, Homo sapiens
aatttcttctttagatgccaaa

SEQ ID NO: 719334 - DNA, 19 bp, Homo sapiens
aatttgaaaataattgttc

SEQ ID NO: 719335 - DNA, 17 bp, Homo sapiens
aatttgaagatgtggat

SEQ ID NO: 719336 - DNA, 21 bp, Homo sapiens
aatttgaagatgtggatccct

SEQ ID NO: 719337 - DNA, 14 bp, Homo sapiens
aatttgaagtaatg

SEQ ID NO: 719338 - DNA, 15 bp, Homo sapiens
aatttgaatctgagt

SEQ ID NO: 719339 - DNA, 12 bp, Homo sapiens
aatttgaatgaa

SEQ ID NO: 719340 - DNA, 15 bp, Homo sapiens
aatttgaatgaaaaa

SEQ ID NO: 719341 - DNA, 18 bp, Homo sapiens
aatttgacttttctgtaa

SEQ ID NO: 719342 - DNA, 21 bp, Homo sapiens
aatttgagaatacataaacaa

SEQ ID NO: 719343 - DNA, 21 bp, Homo sapiens
aatttgagactgaaatttagt

SEQ ID NO: 719344 - DNA, 20 bp, Homo sapiens
aatttgagagaaatatgaag

SEQ ID NO: 719345 - DNA, 15 bp, Homo sapiens
aatttgatacataat

SEQ ID NO: 719346 - DNA, 18 bp, Homo sapiens
aatttgatacataataaa

SEQ ID NO: 719347 - DNA, 20 bp, Homo sapiens
aatttgattgatttgaagaa

SEQ ID NO: 719348 - DNA, 12 bp, Homo sapiens
aatttgatttcc

SEQ ID NO: 719349 - DNA, 20 bp, Homo sapiens
aatttgcacaatatttcttt

SEQ ID NO: 719350 - DNA, 14 bp, Homo sapiens
aatttgcatactta

SEQ ID NO: 719351 - DNA, 21 bp, Homo sapiens
aatttgcattaaattcacaaa

SEQ ID NO: 719352 - DNA, 13 bp, Homo sapiens
aatttgcattact

SEQ ID NO: 719353 - DNA, 22 bp, Homo sapiens
aatttgccaccactagagctga

SEQ ID NO: 719354 - DNA, 13 bp, Homo sapiens
aatttgcctctgt

SEQ ID NO: 719355 - DNA, 14 bp, Homo sapiens
aatttgcctctgtc

SEQ ID NO: 719356 - DNA, 14 bp, Homo sapiens
aatttgctgccaaa

SEQ ID NO: 719357 - DNA, 14 bp, Homo sapiens
aatttggaaatcct

SEQ ID NO: 719358 - DNA, 18 bp, Homo sapiens
aatttggagcacaaaatt

SEQ ID NO: 719359 - DNA, 13 bp, Homo sapiens
aatttttcctatg

SEQ ID NO: 719360 - DNA, 20 bp, Homo sapiens
aatttttcctgcatgttctg

SEQ ID NO: 719361 - DNA, 22 bp, Homo sapiens
aatttttctctaactcagaaac

SEQ ID NO: 719362 - DNA, 14 bp, Homo sapiens
aatttttcttcttg

SEQ ID NO: 719363 - DNA, 11 bp, Homo sapiens
aatttttgaaa

SEQ ID NO: 719364 - DNA, 15 bp, Homo sapiens
aatttttgaaaaata

SEQ ID NO: 719365 - DNA, 16 bp, Homo sapiens
aatttttgaaaaatat

SEQ ID NO: 719366 - DNA, 23 bp, Homo sapiens
aatttttgaaaaatattgctaaa

SEQ ID NO: 719367 - DNA, 14 bp, Homo sapiens
aatttttgacactt

SEQ ID NO: 719368 - DNA, 13 bp, Homo sapiens
aatttttgctgaa

SEQ ID NO: 719369 - DNA, 18 bp, Homo sapiens
aatttttgcttttagaaa

SEQ ID NO: 719370 - DNA, 13 bp, Homo sapiens
aatttttgtacat

SEQ ID NO: 719371 - DNA, 13 bp, Homo sapiens
aatttttgtattt

SEQ ID NO: 719372 - DNA, 17 bp, Homo sapiens
aatttttgtctcagaag

SEQ ID NO: 719373 - DNA, 14 bp, Homo sapiens
aatttttgtttgga

SEQ ID NO: 719374 - DNA, 17 bp, Homo sapiens
aattttttataaaagtg

SEQ ID NO: 719375 - DNA, 20 bp, Homo sapiens
aattttttatcatgcatgtc

SEQ ID NO: 719376 - DNA, 11 bp, Homo sapiens
aattttttcct

SEQ ID NO: 719377 - DNA, 17 bp, Homo sapiens
aattttttgaaatgggc

SEQ ID NO: 719378 - DNA, 19 bp, Homo sapiens
aattttttgaaatgggcat

SEQ ID NO: 719379 - DNA, 23 bp, Homo sapiens
aattttttgaaatgggcatttat

SEQ ID NO: 719380 - DNA, 21 bp, Homo sapiens
aattttttggtacaaaaataa

SEQ ID NO: 719381 - DNA, 22 bp, Homo sapiens
aattttttgttgacattagtct

SEQ ID NO: 719382 - DNA, 20 bp, Homo sapiens
aatttttttaaatttcagtc

SEQ ID NO: 719383 - DNA, 20 bp, Homo sapiens
aatttttttcacctagattt

SEQ ID NO: 719384 - DNA, 20 bp, Homo sapiens
aatttttttccttacctttt

SEQ ID NO: 719385 - DNA, 19 bp, Homo sapiens
aattttttttaaaatagaa

SEQ ID NO: 719386 - DNA, 20 bp, Homo sapiens
aattttttttaaaatagaaa

SEQ ID NO: 719387 - DNA, 12 bp, Homo sapiens
aattttttttac

SEQ ID NO: 719388 - DNA, 22 bp, Homo sapiens
aattttttttattagtattgtt

SEQ ID NO: 719389 - DNA, 21 bp, Homo sapiens
aattttttttgttttttgtaa

SEQ ID NO: 719390 - DNA, 16 bp, Homo sapiens
aatttttttttctctt

SEQ ID NO: 719391 - DNA, 19 bp, Homo sapiens
acaaaaaaaaagttttatt

SEQ ID NO: 719392 - DNA, 12 bp, Homo sapiens
acaaaaaaagac

SEQ ID NO: 719393 - DNA, 22 bp, Homo sapiens
acaaaaaaatatcagacaagca

SEQ ID NO: 719394 - DNA, 18 bp, Homo sapiens
acaaaaaaatctgcagaa

SEQ ID NO: 719395 - DNA, 21 bp, Homo sapiens
acaaaaaagacttgagacaat

SEQ ID NO: 719396 - DNA, 20 bp, Homo sapiens
acaaaaacagaatttgagaa

SEQ ID NO: 719397 - DNA, 20 bp, Homo sapiens
acaaaaacaggtatatactt

SEQ ID NO: 719398 - DNA, 19 bp, Homo sapiens
acaaaaagaaatcttgtct

SEQ ID NO: 719399 - DNA, 16 bp, Homo sapiens
acaaaaagaacaaaaa

SEQ ID NO: 719400 - DNA, 15 bp, Homo sapiens
acaaaaagacaaaca

SEQ ID NO: 719401 - DNA, 16 bp, Homo sapiens
acaaaaagatgtctca

SEQ ID NO: 719402 - DNA, 20 bp, Homo sapiens
acaaaaagccacaatgaaca

SEQ ID NO: 719403 - DNA, 14 bp, Homo sapiens
acaaaaagcttccc

SEQ ID NO: 719404 - DNA, 20 bp, Homo sapiens
acaaaaaggagcgggcaggg

SEQ ID NO: 719405 - DNA, 12 bp, Homo sapiens
acaaaaaggcaa

SEQ ID NO: 719406 - DNA, 14 bp, Homo sapiens
acaaaaaggcaaat

SEQ ID NO: 719407 - DNA, 19 bp, Homo sapiens
acaaaaaggcaaatattga

SEQ ID NO: 719408 - DNA, 20 bp, Homo sapiens
acaaaaaggcaaatattgaa

SEQ ID NO: 719409 - DNA, 22 bp, Homo sapiens
acaaaaaggcaaatattgaagt

SEQ ID NO: 719410 - DNA, 15 bp, Homo sapiens
acaaaaagtaaaaat

SEQ ID NO: 719411 - DNA, 23 bp, Homo sapiens
acaaaaagtgcttcattctttgc

SEQ ID NO: 719412 - DNA, 10 bp, Homo sapiens
acaaaaataa

SEQ ID NO: 719413 - DNA, 20 bp, Homo sapiens
acaaaaataaatttatatga

SEQ ID NO: 719414 - DNA, 16 bp, Homo sapiens
acaaaaataacactgt

SEQ ID NO: 719415 - DNA, 13 bp, Homo sapiens
acaaaaatataaa

SEQ ID NO: 719416 - DNA, 22 bp, Homo sapiens
acaaaaatgaaagcatgtctca

SEQ ID NO: 719417 - DNA, 13 bp, Homo sapiens
acaaaacaaactc

SEQ ID NO: 719418 - DNA, 13 bp, Homo sapiens
acaaaacaaactt

SEQ ID NO: 719419 - DNA, 15 bp, Homo sapiens
acaaaacaacaaaaa

SEQ ID NO: 719420 - DNA, 21 bp, Homo sapiens
acaaaacctaacttgcgcaga

SEQ ID NO: 719421 - DNA, 23 bp, Homo sapiens
acaaaactacatgagaacaaaca

SEQ ID NO: 719422 - DNA, 19 bp, Homo sapiens
acaaaactgttcttttgca

SEQ ID NO: 719423 - DNA, 20 bp, Homo sapiens
acaaaacttaaaagtattca

SEQ ID NO: 719424 - DNA, 13 bp, Homo sapiens
acaaaacttcctg

SEQ ID NO: 719425 - DNA, 14 bp, Homo sapiens
acaaaacttgaaag

SEQ ID NO: 719426 - DNA, 14 bp, Homo sapiens
acaaaagaaactta

SEQ ID NO: 719427 - DNA, 21 bp, Homo sapiens
acaaaagaataacattttcta

SEQ ID NO: 719428 - DNA, 14 bp, Homo sapiens
acaaaagagagaat

SEQ ID NO: 719429 - DNA, 15 bp, Homo sapiens
acaaaagcagccctc

SEQ ID NO: 719430 - DNA, 17 bp, Homo sapiens
acaaaaggcatctgaac

SEQ ID NO: 719431 - DNA, 14 bp, Homo sapiens
acaaaagtacattg

SEQ ID NO: 719432 - DNA, 18 bp, Homo sapiens
acaaaagtacattgctta

SEQ ID NO: 719433 - DNA, 22 bp, Homo sapiens
acaaaagtgaaccatctcagac

SEQ ID NO: 719434 - DNA, 16 bp, Homo sapiens
acaaaataaaataata

SEQ ID NO: 719435 - DNA, 22 bp, Homo sapiens
acaaaataaccaatcctggaca

SEQ ID NO: 719436 - DNA, 16 bp, Homo sapiens
acaaaatatttcccat

SEQ ID NO: 719437 - DNA, 20 bp, Homo sapiens
acaaaatccagctatgaata

SEQ ID NO: 719438 - DNA, 23 bp, Homo sapiens
acaaaatccatgtgaccattctg

SEQ ID NO: 719439 - DNA, 18 bp, Homo sapiens
acaaaatctaaaacaaaa

SEQ ID NO: 719440 - DNA, 15 bp, Homo sapiens
acaaaatctgaactc

SEQ ID NO: 719441 - DNA, 22 bp, Homo sapiens
acaaaatggatacataaagact

SEQ ID NO: 719442 - DNA, 14 bp, Homo sapiens
acaaaatgggagga

SEQ ID NO: 719443 - DNA, 18 bp, Homo sapiens
acaaaatgggaggaggaa

SEQ ID NO: 719444 - DNA, 21 bp, Homo sapiens
acaaaatgtagaatattcaga

SEQ ID NO: 719445 - DNA, 22 bp, Homo sapiens
acaaaatgtagggttataataa

SEQ ID NO: 719446 - DNA, 19 bp, Homo sapiens
acaaaatttcacagttctg

SEQ ID NO: 719447 - DNA, 20 bp, Homo sapiens
acaaaatttgactaatttta

SEQ ID NO: 719448 - DNA, 13 bp, Homo sapiens
acaaaattttgtt

SEQ ID NO: 719449 - DNA, 23 bp, Homo sapiens
acaaaattttgtttaaaactcag

SEQ ID NO: 719450 - DNA, 11 bp, Homo sapiens
acaaacaaaaa

SEQ ID NO: 719451 - DNA, 16 bp, Homo sapiens
acaaacaaacaatgca

SEQ ID NO: 719452 - DNA, 21 bp, Homo sapiens
acaaacaaggcctgtcagcta

SEQ ID NO: 719453 - DNA, 13 bp, Homo sapiens
acaaacaatgaaa

SEQ ID NO: 719454 - DNA, 15 bp, Homo sapiens
acaaacacctcccag

SEQ ID NO: 719455 - DNA, 14 bp, Homo sapiens
acaaacatcactct

SEQ ID NO: 719456 - DNA, 14 bp, Homo sapiens
acaaacatgaaaaa

SEQ ID NO: 719457 - DNA, 17 bp, Homo sapiens
acaaacatggaaaacag

SEQ ID NO: 719458 - DNA, 19 bp, Homo sapiens
acaaacatggaaaacagag

SEQ ID NO: 719459 - DNA, 17 bp, Homo sapiens
acaaacattgctgcctt

SEQ ID NO: 719460 - DNA, 18 bp, Homo sapiens
acaaacattgctgccttt

SEQ ID NO: 719461 - DNA, 13 bp, Homo sapiens
acaaaccaacatc

SEQ ID NO: 719462 - DNA, 16 bp, Homo sapiens
acaaaccaacatcttt

SEQ ID NO: 719463 - DNA, 14 bp, Homo sapiens
acaaaccacagcag

SEQ ID NO: 719464 - DNA, 18 bp, Homo sapiens
acaaaccaccaggactga

SEQ ID NO: 719465 - DNA, 14 bp, Homo sapiens
acaaaccatgcaaa

SEQ ID NO: 719466 - DNA, 13 bp, Homo sapiens
acaaacctagctt

SEQ ID NO: 719467 - DNA, 19 bp, Homo sapiens
acaaacctagcttttaaaa

SEQ ID NO: 719468 - DNA, 17 bp, Homo sapiens
acaaacctgcatggtgt

SEQ ID NO: 719469 - DNA, 15 bp, Homo sapiens
acaaactacctctgg

SEQ ID NO: 719470 - DNA, 19 bp, Homo sapiens
acaaactcatcctctttta

SEQ ID NO: 719471 - DNA, 16 bp, Homo sapiens
acaaactctcaccatg

SEQ ID NO: 719472 - DNA, 14 bp, Homo sapiens
acaaactcttcagt

SEQ ID NO: 719473 - DNA, 13 bp, Homo sapiens
acaaactgcaata

SEQ ID NO: 719474 - DNA, 16 bp, Homo sapiens
acaaactgcaatagag

SEQ ID NO: 719475 - DNA, 15 bp, Homo sapiens
acaaactgcagctgt

SEQ ID NO: 719476 - DNA, 15 bp, Homo sapiens
acaaactgtgaaaat

SEQ ID NO: 719477 - DNA, 18 bp, Homo sapiens
acaaactgtgaaaatagt

SEQ ID NO: 719478 - DNA, 13 bp, Homo sapiens
acaaactttgcat

SEQ ID NO: 719479 - DNA, 18 bp, Homo sapiens
acaaagaagacaacatta

SEQ ID NO: 719480 - DNA, 14 bp, Homo sapiens
acaaagaattccaa

SEQ ID NO: 719481 - DNA, 17 bp, Homo sapiens
acaaagacaaaagtctg

SEQ ID NO: 719482 - DNA, 18 bp, Homo sapiens
acaaagacaaattctgtt

SEQ ID NO: 719483 - DNA, 17 bp, Homo sapiens
acaaagactcctctggg

SEQ ID NO: 719484 - DNA, 21 bp, Homo sapiens
acaatcatgaacagctctgag

SEQ ID NO: 719485 - DNA, 14 bp, Homo sapiens
acaatcattgctga

SEQ ID NO: 719486 - DNA, 22 bp, Homo sapiens
acaatccacgcttctccggatc

SEQ ID NO: 719487 - DNA, 18 bp, Homo sapiens
acaatcccaatctttcta

SEQ ID NO: 719488 - DNA, 21 bp, Homo sapiens
acaatcctgtttataatctga

SEQ ID NO: 719489 - DNA, 16 bp, Homo sapiens
acaatcgatggccttg

SEQ ID NO: 719490 - DNA, 18 bp, Homo sapiens
acaatctaattaaatggc

SEQ ID NO: 719491 - DNA, 22 bp, Homo sapiens
acaatctatggcttatttctat

SEQ ID NO: 719492 - DNA, 15 bp, Homo sapiens
acaatcttatgtttc

SEQ ID NO: 719493 - DNA, 21 bp, Homo sapiens
acaatgaaaactctttgctgc

SEQ ID NO: 719494 - DNA, 14 bp, Homo sapiens
acaatgaactgctt

SEQ ID NO: 719495 - DNA, 13 bp, Homo sapiens
acaatgaagggaa

SEQ ID NO: 719496 - DNA, 13 bp, Homo sapiens
acaatgaatcaga

SEQ ID NO: 719497 - DNA, 19 bp, Homo sapiens
acaatgacttactgtacat

SEQ ID NO: 719498 - DNA, 14 bp, Homo sapiens
acaatgagatgcat

SEQ ID NO: 719499 - DNA, 19 bp, Homo sapiens
acaatgagatgcatgattt

SEQ ID NO: 719500 - DNA, 21 bp, Homo sapiens
acaatgatcaccgactgaaaa

SEQ ID NO: 719501 - DNA, 18 bp, Homo sapiens
acaatgatgccgaacatt

SEQ ID NO: 719502 - DNA, 13 bp, Homo sapiens
acaatgcatgtgc

SEQ ID NO: 719503 - DNA, 18 bp, Homo sapiens
acaatgcatgtgctgtct

SEQ ID NO: 719504 - DNA, 16 bp, Homo sapiens
acaatgccctgctggc

SEQ ID NO: 719505 - DNA, 18 bp, Homo sapiens
acaatgccctgctggcct

SEQ ID NO: 719506 - DNA, 20 bp, Homo sapiens
acaatgcctattgtaatata

SEQ ID NO: 719507 - DNA, 20 bp, Homo sapiens
acaatggaaaacctggggga

SEQ ID NO: 719508 - DNA, 13 bp, Homo sapiens
acaatggaataaa

SEQ ID NO: 719509 - DNA, 20 bp, Homo sapiens
acaatggcacctctgccctt

SEQ ID NO: 719510 - DNA, 12 bp, Homo sapiens
acaatggcagct

SEQ ID NO: 719511 - DNA, 15 bp, Homo sapiens
acaatggccatggaa

SEQ ID NO: 719512 - DNA, 22 bp, Homo sapiens
acaatggtgtctcttttatgtt

SEQ ID NO: 719513 - DNA, 18 bp, Homo sapiens
acaatgtacaattatgtc

SEQ ID NO: 719514 - DNA, 12 bp, Homo sapiens
acaatgtataaa

SEQ ID NO: 719515 - DNA, 14 bp, Homo sapiens
acaatgtataaaga

SEQ ID NO: 719516 - DNA, 22 bp, Homo sapiens
acaatgtataaagattgtactt

SEQ ID NO: 719517 - DNA, 15 bp, Homo sapiens
acaatgtatgtacaa

SEQ ID NO: 719518 - DNA, 20 bp, Homo sapiens
acaatgtatgtacaatacaa

SEQ ID NO: 719519 - DNA, 22 bp, Homo sapiens
acaatgtatgtacaatacaatg

SEQ ID NO: 719520 - DNA, 17 bp, Homo sapiens
acaatgtgaactttatt

SEQ ID NO: 719521 - DNA, 21 bp, Homo sapiens
acaatgtggacgtgcactgac

SEQ ID NO: 719522 - DNA, 18 bp, Homo sapiens
acaatgtggatttgggga

SEQ ID NO: 719523 - DNA, 14 bp, Homo sapiens
acaatgttgagaag

SEQ ID NO: 719524 - DNA, 23 bp, Homo sapiens
acaatgtttcttcatttctctgc

SEQ ID NO: 719525 - DNA, 13 bp, Homo sapiens
acaatgtttgatg

SEQ ID NO: 719526 - DNA, 21 bp, Homo sapiens
acaattaaaaacctgatggaa

SEQ ID NO: 719527 - DNA, 15 bp, Homo sapiens
acaattactcaggtt

SEQ ID NO: 719528 - DNA, 13 bp, Homo sapiens
acaattagatttc

SEQ ID NO: 719529 - DNA, 17 bp, Homo sapiens
acaattagcagaatgga

SEQ ID NO: 719530 - DNA, 21 bp, Homo sapiens
acaattatttttacagttctc

SEQ ID NO: 719531 - DNA, 15 bp, Homo sapiens
acaattcaagctgag

SEQ ID NO: 719532 - DNA, 21 bp, Homo sapiens
acaattcccttctttttcatc

SEQ ID NO: 719533 - DNA, 22 bp, Homo sapiens
acaattcctctactaacaatca

SEQ ID NO: 719534 - DNA, 23 bp, Homo sapiens
acaattcctctactaacaatcag

SEQ ID NO: 719535 - DNA, 24 bp, Homo sapiens
acaattctaaaatgattgtagtaa

SEQ ID NO: 719536 - DNA, 14 bp, Homo sapiens
acaattctgcatgt

SEQ ID NO: 719537 - DNA, 16 bp, Homo sapiens
acaattgatacttcag

SEQ ID NO: 719538 - DNA, 21 bp, Homo sapiens
acaattgatacttcaggtgct

SEQ ID NO: 719539 - DNA, 22 bp, Homo sapiens
acaattgatacttcaggtgctt

SEQ ID NO: 719540 - DNA, 13 bp, Homo sapiens
acaattgtcttaa

SEQ ID NO: 719541 - DNA, 21 bp, Homo sapiens
acaattgtcttaaaaccagag

SEQ ID NO: 719542 - DNA, 17 bp, Homo sapiens
acaattgtgtagccttt

SEQ ID NO: 719543 - DNA, 18 bp, Homo sapiens
acaattgtgtagcctttt

SEQ ID NO: 719544 - DNA, 17 bp, Homo sapiens
acaatttaaaatatttc

SEQ ID NO: 719545 - DNA, 17 bp, Homo sapiens
acaatttacaaagtgtg

SEQ ID NO: 719546 - DNA, 15 bp, Homo sapiens
acaatttatatgctt

SEQ ID NO: 719547 - DNA, 13 bp, Homo sapiens
acaatttattatg

SEQ ID NO: 719548 - DNA, 15 bp, Homo sapiens
acaatttattatggc

SEQ ID NO: 719549 - DNA, 20 bp, Homo sapiens
acaatttcctttatatttag

SEQ ID NO: 719550 - DNA, 11 bp, Homo sapiens
acaatttctgt

SEQ ID NO: 719551 - DNA, 17 bp, Homo sapiens
acaatttgagactgaaa

SEQ ID NO: 719552 - DNA, 15 bp, Homo sapiens
acaatttgcacaata

SEQ ID NO: 719553 - DNA, 18 bp, Homo sapiens
acaatttggcaattttgt

SEQ ID NO: 719554 - DNA, 23 bp, Homo sapiens
acaatttgtttttgcatttttgt

SEQ ID NO: 719555 - DNA, 13 bp, Homo sapiens
acaattttaaagt

SEQ ID NO: 719556 - DNA, 15 bp, Homo sapiens
acaattttaatgatg

SEQ ID NO: 719557 - DNA, 23 bp, Homo sapiens
acaattttaatgatggtgttaaa

SEQ ID NO: 719558 - DNA, 13 bp, Homo sapiens
acaattttatagg

SEQ ID NO: 719559 - DNA, 17 bp, Homo sapiens
acaattttttttattag

SEQ ID NO: 719560 - DNA, 16 bp, Homo sapiens
acaattttttttttcc

SEQ ID NO: 719561 - DNA, 18 bp, Homo sapiens
acaattttttttttcctc

SEQ ID NO: 719562 - DNA, 14 bp, Homo sapiens
acacaaaaaaacaa

SEQ ID NO: 719563 - DNA, 20 bp, Homo sapiens
acacaaaaaaacaagtattt

SEQ ID NO: 719564 - DNA, 22 bp, Homo sapiens
acacaaaaaggagcgggcaggg

SEQ ID NO: 719565 - DNA, 18 bp, Homo sapiens
acacaaaacattcatgta

SEQ ID NO: 719566 - DNA, 14 bp, Homo sapiens
acacaaactgtaaa

SEQ ID NO: 719567 - DNA, 22 bp, Homo sapiens
acacaaaggtggaataaacatt

SEQ ID NO: 719568 - DNA, 12 bp, Homo sapiens
acacaaatgaaa

SEQ ID NO: 719569 - DNA, 20 bp, Homo sapiens
acacaaatgctcaaagaaat

SEQ ID NO: 719570 - DNA, 18 bp, Homo sapiens
acacaaattcagtctctg

SEQ ID NO: 719571 - DNA, 12 bp, Homo sapiens
acacaaattttc

SEQ ID NO: 719572 - DNA, 18 bp, Homo sapiens
acacaacccaataggagt

SEQ ID NO: 719573 - DNA, 13 bp, Homo sapiens
acacaactcactc

SEQ ID NO: 719574 - DNA, 15 bp, Homo sapiens
acacaactttgcaaa

SEQ ID NO: 719575 - DNA, 19 bp, Homo sapiens
acacaactttgcaaattat

SEQ ID NO: 719576 - DNA, 13 bp, Homo sapiens
acacaagaagtga

SEQ ID NO: 719577 - DNA, 17 bp, Homo sapiens
acacaagcaacaaacct

SEQ ID NO: 719578 - DNA, 17 bp, Homo sapiens
acacaagcactttaatg

SEQ ID NO: 719579 - DNA, 14 bp, Homo sapiens
acacaagccacaga

SEQ ID NO: 719580 - DNA, 15 bp, Homo sapiens
acacaagccacagaa

SEQ ID NO: 719581 - DNA, 14 bp, Homo sapiens
acacaagctggaag

SEQ ID NO: 719582 - DNA, 14 bp, Homo sapiens
acacaaggggccct

SEQ ID NO: 719583 - DNA, 13 bp, Homo sapiens
acacaagtaaaca

SEQ ID NO: 719584 - DNA, 16 bp, Homo sapiens
acacaagtcctgtgaa

SEQ ID NO: 719585 - DNA, 14 bp, Homo sapiens
acacaataaagcag

SEQ ID NO: 719586 - DNA, 15 bp, Homo sapiens
acacaataggtcttt

SEQ ID NO: 719587 - DNA, 15 bp, Homo sapiens
acacaatatacgaaa

SEQ ID NO: 719588 - DNA, 21 bp, Homo sapiens
acacaatatacgaaaagccag

SEQ ID NO: 719589 - DNA, 18 bp, Homo sapiens
acacaatatgtatgcttt

SEQ ID NO: 719590 - DNA, 18 bp, Homo sapiens
acacaatggcacctctgc

SEQ ID NO: 719591 - DNA, 16 bp, Homo sapiens
acacaatggtttttaa

SEQ ID NO: 719592 - DNA, 20 bp, Homo sapiens
acacaattaattcatccctt

SEQ ID NO: 719593 - DNA, 15 bp, Homo sapiens
acacaattaattgtc

SEQ ID NO: 719594 - DNA, 15 bp, Homo sapiens
acacaattagatttc

SEQ ID NO: 719595 - DNA, 20 bp, Homo sapiens
acacacaaacctactgccca

SEQ ID NO: 719596 - DNA, 14 bp, Homo sapiens
acacacaacaatta

SEQ ID NO: 719597 - DNA, 16 bp, Homo sapiens
acacacaataaagaac

SEQ ID NO: 719598 - DNA, 13 bp, Homo sapiens
acacacacaaacc

SEQ ID NO: 719599 - DNA, 10 bp, Homo sapiens
acacacacac

SEQ ID NO: 719600 - DNA, 15 bp, Homo sapiens
acacacacacaaacc

SEQ ID NO: 719601 - DNA, 12 bp, Homo sapiens
acacacacacac

SEQ ID NO: 719602 - DNA, 14 bp, Homo sapiens
acacacacacacag

SEQ ID NO: 719603 - DNA, 13 bp, Homo sapiens
acacacacacacg

SEQ ID NO: 719604 - DNA, 14 bp, Homo sapiens
acacacacacacga

SEQ ID NO: 719605 - DNA, 14 bp, Homo sapiens
acacacacacgatg

SEQ ID NO: 719606 - DNA, 15 bp, Homo sapiens
acacacacacgatgc

SEQ ID NO: 719607 - DNA, 16 bp, Homo sapiens
acacacacgatgcatt

SEQ ID NO: 719608 - DNA, 15 bp, Homo sapiens
acacacacgccagct

SEQ ID NO: 719609 - DNA, 13 bp, Homo sapiens
acacacagacaca

SEQ ID NO: 719610 - DNA, 17 bp, Homo sapiens
acacacagactttctgt

SEQ ID NO: 719611 - DNA, 22 bp, Homo sapiens
acacacagaggaagagcaggca

SEQ ID NO: 719612 - DNA, 15 bp, Homo sapiens
acacacagatacaca

SEQ ID NO: 719613 - DNA, 13 bp, Homo sapiens
acacacagatgac

SEQ ID NO: 719614 - DNA, 11 bp, Homo sapiens
acacacagctc

SEQ ID NO: 719615 - DNA, 13 bp, Homo sapiens
acacacagctcct

SEQ ID NO: 719616 - DNA, 13 bp, Homo sapiens
acacacaggcctt

SEQ ID NO: 719617 - DNA, 15 bp, Homo sapiens
acacacaggccttct

SEQ ID NO: 719618 - DNA, 12 bp, Homo sapiens
acacacagtacg

SEQ ID NO: 719619 - DNA, 12 bp, Homo sapiens
acacacatacag

SEQ ID NO: 719620 - DNA, 18 bp, Homo sapiens
acacacatatacatatat

SEQ ID NO: 719621 - DNA, 17 bp, Homo sapiens
acacacatgccctcctg

SEQ ID NO: 719622 - DNA, 15 bp, Homo sapiens
acacaccacacatac

SEQ ID NO: 719623 - DNA, 17 bp, Homo sapiens
acacaccaggcgctaat

SEQ ID NO: 719624 - DNA, 12 bp, Homo sapiens
acacaccaggct

SEQ ID NO: 719625 - DNA, 19 bp, Homo sapiens
acacaccagttttgagtgt

SEQ ID NO: 719626 - DNA, 17 bp, Homo sapiens
acacacccccagagaga

SEQ ID NO: 719627 - DNA, 14 bp, Homo sapiens
acacacccccccac

SEQ ID NO: 719628 - DNA, 15 bp, Homo sapiens
acacacccccccaca

SEQ ID NO: 719629 - DNA, 12 bp, Homo sapiens
acacacctctgc

SEQ ID NO: 719630 - DNA, 13 bp, Homo sapiens
acacacctctgct

SEQ ID NO: 719631 - DNA, 16 bp, Homo sapiens
acacacctctgctcca

SEQ ID NO: 719632 - DNA, 20 bp, Homo sapiens
acacacctgtagcacttact

SEQ ID NO: 719633 - DNA, 11 bp, Homo sapiens
acacacgatgc

SEQ ID NO: 719634 - DNA, 20 bp, Homo sapiens
acacacgatgcatttaataa

SEQ ID NO: 719635 - DNA, 23 bp, Homo sapiens
acacacgcacacacacacacagg

SEQ ID NO: 719636 - DNA, 18 bp, Homo sapiens
acacacgcacgcacacac

SEQ ID NO: 719637 - DNA, 21 bp, Homo sapiens
acacacgcaggaactcccagc

SEQ ID NO: 719638 - DNA, 14 bp, Homo sapiens
acacacgccagctc

SEQ ID NO: 719639 - DNA, 20 bp, Homo sapiens
acacacgccagctcctctct

SEQ ID NO: 719640 - DNA, 23 bp, Homo sapiens
acacacgtatttatatttggaaa

SEQ ID NO: 719641 - DNA, 20 bp, Homo sapiens
acacacgtgctgtgggcctc

SEQ ID NO: 719642 - DNA, 22 bp, Homo sapiens
acacacgttgacgggccgcagg

SEQ ID NO: 719643 - DNA, 18 bp, Homo sapiens
acacactcaccagtggcc

SEQ ID NO: 719644 - DNA, 21 bp, Homo sapiens
acacactgcatgtttgtgatt

SEQ ID NO: 719645 - DNA, 15 bp, Homo sapiens
acacactggacccca

SEQ ID NO: 719646 - DNA, 16 bp, Homo sapiens
acacactggtacttag

SEQ ID NO: 719647 - DNA, 17 bp, Homo sapiens
acacactgtgccccaca

SEQ ID NO: 719648 - DNA, 16 bp, Homo sapiens
acacactgtgtcctgg

SEQ ID NO: 719649 - DNA, 20 bp, Homo sapiens
acacactgtgtcctggtgct

SEQ ID NO: 719650 - DNA, 14 bp, Homo sapiens
acacacttactttt

SEQ ID NO: 719651 - DNA, 18 bp, Homo sapiens
acacagaaaatgttgaga

SEQ ID NO: 719652 - DNA, 13 bp, Homo sapiens
acacagaaacctt

SEQ ID NO: 719653 - DNA, 18 bp, Homo sapiens
acacagaaacctttttaa

SEQ ID NO: 719654 - DNA, 16 bp, Homo sapiens
acacagaaatgctgct

SEQ ID NO: 719655 - DNA, 17 bp, Homo sapiens
acacagaatgctcaggg

SEQ ID NO: 719656 - DNA, 21 bp, Homo sapiens
acacagacactaacgaaatat

SEQ ID NO: 719657 - DNA, 14 bp, Homo sapiens
acacagacccagga

SEQ ID NO: 719658 - DNA, 16 bp, Homo sapiens
acacagactggcaata

SEQ ID NO: 719659 - DNA, 18 bp, Homo sapiens
acacagactttctgtgac

SEQ ID NO: 719660 - DNA, 23 bp, Homo sapiens
acacagactttctgtgacgcaga

SEQ ID NO: 719661 - DNA, 15 bp, Homo sapiens
acacagagaaataca

SEQ ID NO: 719662 - DNA, 22 bp, Homo sapiens
acacagagaagcggatttccag

SEQ ID NO: 719663 - DNA, 19 bp, Homo sapiens
acacagagatttgagaacc

SEQ ID NO: 719664 - DNA, 17 bp, Homo sapiens
acacagaggaagagcag

SEQ ID NO: 719665 - DNA, 21 bp, Homo sapiens
acacagaggaagagcaggcac

SEQ ID NO: 719666 - DNA, 17 bp, Homo sapiens
acacagaggagtgcagc

SEQ ID NO: 719667 - DNA, 21 bp, Homo sapiens
acacagagtggtctttctgga

SEQ ID NO: 719668 - DNA, 14 bp, Homo sapiens
acacagatttttac

SEQ ID NO: 719669 - DNA, 22 bp, Homo sapiens
acacagatttttacactaatat

SEQ ID NO: 719670 - DNA, 14 bp, Homo sapiens
acacagcatgtgcc

SEQ ID NO: 719671 - DNA, 17 bp, Homo sapiens
acacagcattgtatatg

SEQ ID NO: 719672 - DNA, 18 bp, Homo sapiens
acacagcattgtatatgt

SEQ ID NO: 719673 - DNA, 19 bp, Homo sapiens
acacagccactaaaacaca

SEQ ID NO: 719674 - DNA, 23 bp, Homo sapiens
acacagcctaaagctaaaaatat

SEQ ID NO: 719675 - DNA, 14 bp, Homo sapiens
acacagcctccccc

SEQ ID NO: 719676 - DNA, 14 bp, Homo sapiens
acacagcctccctg

SEQ ID NO: 719677 - DNA, 18 bp, Homo sapiens
acacagcctccctgagcc

SEQ ID NO: 719678 - DNA, 19 bp, Homo sapiens
acacagcctccctgagcct

SEQ ID NO: 719679 - DNA, 20 bp, Homo sapiens
acaccccattggtggactac

SEQ ID NO: 719680 - DNA, 11 bp, Homo sapiens
acacccccagc

SEQ ID NO: 719681 - DNA, 17 bp, Homo sapiens
acacccccagctgactg

SEQ ID NO: 719682 - DNA, 21 bp, Homo sapiens
acaccccccgccccccacctt

SEQ ID NO: 719683 - DNA, 13 bp, Homo sapiens
acacccctgtgct

SEQ ID NO: 719684 - DNA, 22 bp, Homo sapiens
acacccctgtgctcccctgcca

SEQ ID NO: 719685 - DNA, 22 bp, Homo sapiens
acaccccttttccagttgctgt

SEQ ID NO: 719686 - DNA, 18 bp, Homo sapiens
acacccgaagtcctgtca

SEQ ID NO: 719687 - DNA, 21 bp, Homo sapiens
acacccgaagtcctgtcactg

SEQ ID NO: 719688 - DNA, 17 bp, Homo sapiens
acacccgactcctcaaa

SEQ ID NO: 719689 - DNA, 23 bp, Homo sapiens
acacccgtgtggtaccttcagcc

SEQ ID NO: 719690 - DNA, 17 bp, Homo sapiens
acaccctcaacctcttc

SEQ ID NO: 719691 - DNA, 18 bp, Homo sapiens
acaccctcaacctcttct

SEQ ID NO: 719692 - DNA, 14 bp, Homo sapiens
acaccctcccccgc

SEQ ID NO: 719693 - DNA, 13 bp, Homo sapiens
acaccctgcttct

SEQ ID NO: 719694 - DNA, 14 bp, Homo sapiens
acaccctgcttctc

SEQ ID NO: 719695 - DNA, 15 bp, Homo sapiens
acaccctgcttctcc

SEQ ID NO: 719696 - DNA, 19 bp, Homo sapiens
acaccctgcttctcccggg

SEQ ID NO: 719697 - DNA, 11 bp, Homo sapiens
acaccctggcc

SEQ ID NO: 719698 - DNA, 13 bp, Homo sapiens
acaccctgtactg

SEQ ID NO: 719699 - DNA, 15 bp, Homo sapiens
acacccttagaaaat

SEQ ID NO: 719700 - DNA, 20 bp, Homo sapiens
acacccttcacataccctcc

SEQ ID NO: 719701 - DNA, 19 bp, Homo sapiens
acaccggggtggtgggaac

SEQ ID NO: 719702 - DNA, 23 bp, Homo sapiens
acaccggttccctgaacccctct

SEQ ID NO: 719703 - DNA, 18 bp, Homo sapiens
acaccgtacatctgcaat

SEQ ID NO: 719704 - DNA, 20 bp, Homo sapiens
acaccgtccctcagtgatac

SEQ ID NO: 719705 - DNA, 15 bp, Homo sapiens
acaccgtcttccttc

SEQ ID NO: 719706 - DNA, 13 bp, Homo sapiens
acaccgtggcctg

SEQ ID NO: 719707 - DNA, 14 bp, Homo sapiens
acaccgtggggaag

SEQ ID NO: 719708 - DNA, 18 bp, Homo sapiens
acaccgttcattcaggca

SEQ ID NO: 719709 - DNA, 21 bp, Homo sapiens
acacctaaaggtgtatttaaa

SEQ ID NO: 719710 - DNA, 21 bp, Homo sapiens
acacctactctatcagagaaa

SEQ ID NO: 719711 - DNA, 13 bp, Homo sapiens
acacctagccagc

SEQ ID NO: 719712 - DNA, 22 bp, Homo sapiens
acacctagctttattcttcaga

SEQ ID NO: 719713 - DNA, 18 bp, Homo sapiens
acacctcagttcccttgg

SEQ ID NO: 719714 - DNA, 21 bp, Homo sapiens
acacctcagttcccttggcct

SEQ ID NO: 719715 - DNA, 13 bp, Homo sapiens
acacctcccaggg

SEQ ID NO: 719716 - DNA, 15 bp, Homo sapiens
acacctccccctacc

SEQ ID NO: 719717 - DNA, 18 bp, Homo sapiens
acacctccccctacccat

SEQ ID NO: 719718 - DNA, 13 bp, Homo sapiens
acacctccctgaa

SEQ ID NO: 719719 - DNA, 19 bp, Homo sapiens
acacctccgagaggcagcc

SEQ ID NO: 719720 - DNA, 23 bp, Homo sapiens
acacctccgagaggcagccagac

SEQ ID NO: 719721 - DNA, 19 bp, Homo sapiens
acacctctgcacaagctgc

SEQ ID NO: 719722 - DNA, 22 bp, Homo sapiens
acacctgagcgctgtggactgt

SEQ ID NO: 719723 - DNA, 11 bp, Homo sapiens
acacctgcacc

SEQ ID NO: 719724 - DNA, 12 bp, Homo sapiens
acacctgcacct

SEQ ID NO: 719725 - DNA, 24 bp, Homo sapiens
acacctgcacctccccccactgca

SEQ ID NO: 719726 - DNA, 14 bp, Homo sapiens
acacctgccctaaa

SEQ ID NO: 719727 - DNA, 16 bp, Homo sapiens
acacctgcctctgacc

SEQ ID NO: 719728 - DNA, 21 bp, Homo sapiens
acacctgcctctgaccccagc

SEQ ID NO: 719729 - DNA, 17 bp, Homo sapiens
acacctgccttctaccc

SEQ ID NO: 719730 - DNA, 14 bp, Homo sapiens
acacctgctgcgct

SEQ ID NO: 719731 - DNA, 12 bp, Homo sapiens
acacctggactg

SEQ ID NO: 719732 - DNA, 22 bp, Homo sapiens
acacctggagactgtcccgaca

SEQ ID NO: 719733 - DNA, 23 bp, Homo sapiens
acacctggcatggtgcagggaga

SEQ ID NO: 719734 - DNA, 15 bp, Homo sapiens
acacctggccgggtc

SEQ ID NO: 719735 - DNA, 20 bp, Homo sapiens
acacctggccgggtcaccct

SEQ ID NO: 719736 - DNA, 16 bp, Homo sapiens
acacctgggcccgggc

SEQ ID NO: 719737 - DNA, 23 bp, Homo sapiens
acacctgggcccgggcaggccag

SEQ ID NO: 719738 - DNA, 17 bp, Homo sapiens
acacctgggcttaagaa

SEQ ID NO: 719739 - DNA, 16 bp, Homo sapiens
acacctgtacattctt

SEQ ID NO: 719740 - DNA, 21 bp, Homo sapiens
acacctgtgtggcccagttct

SEQ ID NO: 719741 - DNA, 16 bp, Homo sapiens
acacctgttcacagaa

SEQ ID NO: 719742 - DNA, 17 bp, Homo sapiens
acaccttaggttgacat

SEQ ID NO: 719743 - DNA, 14 bp, Homo sapiens
acaccttcctcctg

SEQ ID NO: 719744 - DNA, 18 bp, Homo sapiens
acaccttcctcctgcaga

SEQ ID NO: 719745 - DNA, 18 bp, Homo sapiens
acaccttctgagtattct

SEQ ID NO: 719746 - DNA, 23 bp, Homo sapiens
acaccttggacatcctcctccca

SEQ ID NO: 719747 - DNA, 22 bp, Homo sapiens
acaccttggcttgttattgcct

SEQ ID NO: 719748 - DNA, 17 bp, Homo sapiens
acaccttttaactcacc

SEQ ID NO: 719749 - DNA, 14 bp, Homo sapiens
acacgaaacttgtt

SEQ ID NO: 719750 - DNA, 17 bp, Homo sapiens
acacgaaacttgttatt

SEQ ID NO: 719751 - DNA, 23 bp, Homo sapiens
acacgaaacttgttattgtgaat

SEQ ID NO: 719752 - DNA, 12 bp, Homo sapiens
acacgagatttc

SEQ ID NO: 719753 - DNA, 21 bp, Homo sapiens
acacgagatttcttttttatg

SEQ ID NO: 719754 - DNA, 20 bp, Homo sapiens
acacgagcaaacccagaggt

SEQ ID NO: 719755 - DNA, 13 bp, Homo sapiens
acacgatgcattt

SEQ ID NO: 719756 - DNA, 15 bp, Homo sapiens
acacgatgcatttaa

SEQ ID NO: 719757 - DNA, 24 bp, Homo sapiens
acacgatgcatttaataaagatga

SEQ ID NO: 719758 - DNA, 15 bp, Homo sapiens
acacgattgagaact

SEQ ID NO: 719759 - DNA, 16 bp, Homo sapiens
acacgcaagggcatca

SEQ ID NO: 719760 - DNA, 13 bp, Homo sapiens
acacgcacacaca

SEQ ID NO: 719761 - DNA, 23 bp, Homo sapiens
acacgcacacacacacacaggag

SEQ ID NO: 719762 - DNA, 14 bp, Homo sapiens
acacgcacctgcct

SEQ ID NO: 719763 - DNA, 16 bp, Homo sapiens
acacgcacctgcctca

SEQ ID NO: 719764 - DNA, 13 bp, Homo sapiens
acacgcacgcaca

SEQ ID NO: 719765 - DNA, 18 bp, Homo sapiens
acacgcacgcacacacac

SEQ ID NO: 719766 - DNA, 20 bp, Homo sapiens
acacgcacgcacacacacaa

SEQ ID NO: 719767 - DNA, 16 bp, Homo sapiens
acacgcaggcggccag

SEQ ID NO: 719768 - DNA, 16 bp, Homo sapiens
acacgcatgggcattg

SEQ ID NO: 719769 - DNA, 22 bp, Homo sapiens
acacgcatgggcattgcagcct

SEQ ID NO: 719770 - DNA, 14 bp, Homo sapiens
acacgccagctcct

SEQ ID NO: 719771 - DNA, 14 bp, Homo sapiens
acacgccctcttag

SEQ ID NO: 719772 - DNA, 19 bp, Homo sapiens
acacgccttgttcctgctc

SEQ ID NO: 719773 - DNA, 14 bp, Homo sapiens
acacgcgctctcca

SEQ ID NO: 719774 - DNA, 14 bp, Homo sapiens
acacgcgtgattga

SEQ ID NO: 719775 - DNA, 15 bp, Homo sapiens
acacggactgaggtg

SEQ ID NO: 719776 - DNA, 22 bp, Homo sapiens
acacggactgaggtgcctgctc

SEQ ID NO: 719777 - DNA, 20 bp, Homo sapiens
acacggagaggccactgtgg

SEQ ID NO: 719778 - DNA, 22 bp, Homo sapiens
acacggagcccagccctcccca

SEQ ID NO: 719779 - DNA, 17 bp, Homo sapiens
acacggatctgagaatc

SEQ ID NO: 719780 - DNA, 19 bp, Homo sapiens
acacggatctgctgggctc

SEQ ID NO: 719781 - DNA, 17 bp, Homo sapiens
acacagccttccttctg

SEQ ID NO: 719782 - DNA, 21 bp, Homo sapiens
acacagcgacgctcccctgag

SEQ ID NO: 719783 - DNA, 17 bp, Homo sapiens
acacagctactctcccc

SEQ ID NO: 719784 - DNA, 22 bp, Homo sapiens
acacagctcttccagggcagcg

SEQ ID NO: 719785 - DNA, 22 bp, Homo sapiens
acacagctgagagacttttaat

SEQ ID NO: 719786 - DNA, 17 bp, Homo sapiens
acacagctgagcactta

SEQ ID NO: 719787 - DNA, 13 bp, Homo sapiens
acacagctgccct

SEQ ID NO: 719788 - DNA, 16 bp, Homo sapiens
acacagctgccctagc

SEQ ID NO: 719789 - DNA, 18 bp, Homo sapiens
acacagctgccctagctg

SEQ ID NO: 719790 - DNA, 19 bp, Homo sapiens
acacagctgccctagctga

SEQ ID NO: 719791 - DNA, 13 bp, Homo sapiens
acacagctgggca

SEQ ID NO: 719792 - DNA, 14 bp, Homo sapiens
acacaggaaaaata

SEQ ID NO: 719793 - DNA, 14 bp, Homo sapiens
acacaggaggagaa

SEQ ID NO: 719794 - DNA, 23 bp, Homo sapiens
acacaggccttctgtggggctgg

SEQ ID NO: 719795 - DNA, 18 bp, Homo sapiens
acacagggacttgaagtt

SEQ ID NO: 719796 - DNA, 11 bp, Homo sapiens
acacagggcac

SEQ ID NO: 719797 - DNA, 11 bp, Homo sapiens
acacagggctc

SEQ ID NO: 719798 - DNA, 17 bp, Homo sapiens
acacagggctcacaggg

SEQ ID NO: 719799 - DNA, 20 bp, Homo sapiens
acacagggctcacagggcag

SEQ ID NO: 719800 - DNA, 16 bp, Homo sapiens
acacagggctctttga

SEQ ID NO: 719801 - DNA, 21 bp, Homo sapiens
acacaggggaggtgatagcat

SEQ ID NO: 719802 - DNA, 19 bp, Homo sapiens
acacaggggccctgtacag

SEQ ID NO: 719803 - DNA, 23 bp, Homo sapiens
acacagggtgacggtgacaaaga

SEQ ID NO: 719804 - DNA, 15 bp, Homo sapiens
acacagggttttgta

SEQ ID NO: 719805 - DNA, 18 bp, Homo sapiens
acacagtactttattgta

SEQ ID NO: 719806 - DNA, 19 bp, Homo sapiens
acacagtagctccaacact

SEQ ID NO: 719807 - DNA, 14 bp, Homo sapiens
acacagtattcaga

SEQ ID NO: 719808 - DNA, 23 bp, Homo sapiens
acacagtcaaaataattctaaat

SEQ ID NO: 719809 - DNA, 19 bp, Homo sapiens
acacagtcttggctcactg

SEQ ID NO: 719810 - DNA, 15 bp, Homo sapiens
acacagtgacttcct

SEQ ID NO: 719811 - DNA, 19 bp, Homo sapiens
acacagtgctcgaccttga

SEQ ID NO: 719812 - DNA, 22 bp, Homo sapiens
acacagtgctgaccagacagcc

SEQ ID NO: 719813 - DNA, 13 bp, Homo sapiens
acacagtggactt

SEQ ID NO: 719814 - DNA, 20 bp, Homo sapiens
acacagtgtctgttcagcaa

SEQ ID NO: 719815 - DNA, 22 bp, Homo sapiens
acacagtgttagtgctggtcag

SEQ ID NO: 719816 - DNA, 14 bp, Homo sapiens
acacagtgtttcaa

SEQ ID NO: 719817 - DNA, 16 bp, Homo sapiens
acacagtgtttcaatt

SEQ ID NO: 719818 - DNA, 14 bp, Homo sapiens
acacagttatcaaa

SEQ ID NO: 719819 - DNA, 16 bp, Homo sapiens
acacagttcctgggaa

SEQ ID NO: 719820 - DNA, 22 bp, Homo sapiens
acacagttgctgtcataagaat

SEQ ID NO: 719821 - DNA, 15 bp, Homo sapiens
acacagtttaaaaaa

SEQ ID NO: 719822 - DNA, 19 bp, Homo sapiens
acacataaaccaaaaccaa

SEQ ID NO: 719823 - DNA, 14 bp, Homo sapiens
acacataagcataa

SEQ ID NO: 719824 - DNA, 19 bp, Homo sapiens
acacataagccaaaactga

SEQ ID NO: 719825 - DNA, 19 bp, Homo sapiens
acacatacagaaagaagca

SEQ ID NO: 719826 - DNA, 22 bp, Homo sapiens
acacatacagagctctctgagg

SEQ ID NO: 719827 - DNA, 15 bp, Homo sapiens
acacatacatacaca

SEQ ID NO: 719828 - DNA, 18 bp, Homo sapiens
acacatacatacatacat

SEQ ID NO: 719829 - DNA, 17 bp, Homo sapiens
acacatagattcacctg

SEQ ID NO: 719830 - DNA, 20 bp, Homo sapiens
acacatagcgccgtgctgta

SEQ ID NO: 719831 - DNA, 19 bp, Homo sapiens
acacatagttaaaaaagaa

SEQ ID NO: 719832 - DNA, 14 bp, Homo sapiens
acacatataaacat

SEQ ID NO: 719833 - DNA, 22 bp, Homo sapiens
acacatataaacatcacacaca

SEQ ID NO: 719834 - DNA, 16 bp, Homo sapiens
acacatatacatatat

SEQ ID NO: 719835 - DNA, 13 bp, Homo sapiens
acacatatgaggg

SEQ ID NO: 719836 - DNA, 17 bp, Homo sapiens
acacatatgagggggaa

SEQ ID NO: 719837 - DNA, 21 bp, Homo sapiens
acacatcaagactatctacaa

SEQ ID NO: 719838 - DNA, 17 bp, Homo sapiens
acacatcccggcctctt

SEQ ID NO: 719839 - DNA, 19 bp, Homo sapiens
acacatccctaatgtgtgc

SEQ ID NO: 719840 - DNA, 12 bp, Homo sapiens
acacatctattg

SEQ ID NO: 719841 - DNA, 15 bp, Homo sapiens
acacatctggccctg

SEQ ID NO: 719842 - DNA, 22 bp, Homo sapiens
acacatctggctgcacaggctg

SEQ ID NO: 719843 - DNA, 20 bp, Homo sapiens
acacatctgggtgccctgaa

SEQ ID NO: 719844 - DNA, 13 bp, Homo sapiens
acacatcttccct

SEQ ID NO: 719845 - DNA, 15 bp, Homo sapiens
acacatcttccctag

SEQ ID NO: 719846 - DNA, 18 bp, Homo sapiens
acacatgcccctccccca

SEQ ID NO: 719847 - DNA, 18 bp, Homo sapiens
acacatgccctcctggac

SEQ ID NO: 719848 - DNA, 18 bp, Homo sapiens
acacatgccttaaatttg

SEQ ID NO: 719849 - DNA, 23 bp, Homo sapiens
acacatgccttaaatttgtttaa

SEQ ID NO: 719850 - DNA, 17 bp, Homo sapiens
acacatgctatgttctg

SEQ ID NO: 719851 - DNA, 20 bp, Homo sapiens
acacatgctgaggttttgaa

SEQ ID NO: 719852 - DNA, 13 bp, Homo sapiens
acacatgtaaaat

SEQ ID NO: 719853 - DNA, 18 bp, Homo sapiens
acacatgtgctgatgttt

SEQ ID NO: 719854 - DNA, 15 bp, Homo sapiens
acacattaatgataa

SEQ ID NO: 719855 - DNA, 23 bp, Homo sapiens
acacattatattctcttatgata

SEQ ID NO: 719856 - DNA, 20 bp, Homo sapiens
acacattatcgggagcagtg

SEQ ID NO: 719857 - DNA, 14 bp, Homo sapiens
acacattatcttct

SEQ ID NO: 719858 - DNA, 15 bp, Homo sapiens
acacattatcttctg

SEQ ID NO: 719859 - DNA, 16 bp, Homo sapiens
acacattattaagcac

SEQ ID NO: 719860 - DNA, 13 bp, Homo sapiens
acacattccagcc

SEQ ID NO: 719861 - DNA, 14 bp, Homo sapiens
acacattccagcca

SEQ ID NO: 719862 - DNA, 15 bp, Homo sapiens
acacattccagccag

SEQ ID NO: 719863 - DNA, 18 bp, Homo sapiens
acacattccagccaggcc

SEQ ID NO: 719864 - DNA, 16 bp, Homo sapiens
acacattccagggctg

SEQ ID NO: 719865 - DNA, 17 bp, Homo sapiens
acacattccagggctgg

SEQ ID NO: 719866 - DNA, 18 bp, Homo sapiens
acacattccagggctggg

SEQ ID NO: 719867 - DNA, 18 bp, Homo sapiens
acacattcggctccctgg

SEQ ID NO: 719868 - DNA, 21 bp, Homo sapiens
acacattctttataaaatgta

SEQ ID NO: 719869 - DNA, 22 bp, Homo sapiens
acacattgactcctttccaata

SEQ ID NO: 719870 - DNA, 19 bp, Homo sapiens
acacattggaatgccttgg

SEQ ID NO: 719871 - DNA, 18 bp, Homo sapiens
acacatttaaaacatttg

SEQ ID NO: 719872 - DNA, 14 bp, Homo sapiens
acacatttaccaaa

SEQ ID NO: 719873 - DNA, 21 bp, Homo sapiens
acacatttaccaaattgcttg

SEQ ID NO: 719874 - DNA, 13 bp, Homo sapiens
acacatttcatag

SEQ ID NO: 719875 - DNA, 19 bp, Homo sapiens
acacatttgcccaattcca

SEQ ID NO: 719876 - DNA, 21 bp, Homo sapiens
acacatttgggatgttccttt

SEQ ID NO: 719877 - DNA, 13 bp, Homo sapiens
acacatttttaaa

SEQ ID NO: 719878 - DNA, 20 bp, Homo sapiens
acacatttttaaagtctaaa

SEQ ID NO: 719879 - DNA, 14 bp, Homo sapiens
acacattttttaaa

SEQ ID NO: 719880 - DNA, 20 bp, Homo sapiens
acacattttttaaatgcacc

SEQ ID NO: 719881 - DNA, 14 bp, Homo sapiens
acaccaaataaata

SEQ ID NO: 719882 - DNA, 18 bp, Homo sapiens
acaccaacataaaaatga

SEQ ID NO: 719883 - DNA, 14 bp, Homo sapiens
acaccaaggaagct

SEQ ID NO: 719884 - DNA, 14 bp, Homo sapiens
acaccaagtggctg

SEQ ID NO: 719885 - DNA, 23 bp, Homo sapiens
acaccaagtggctgggtgccctc

SEQ ID NO: 719886 - DNA, 16 bp, Homo sapiens
acaccaatcagagagc

SEQ ID NO: 719887 - DNA, 21 bp, Homo sapiens
acaccacagacacacacacgc

SEQ ID NO: 719888 - DNA, 17 bp, Homo sapiens
acaccaccggccccctc

SEQ ID NO: 719889 - DNA, 18 bp, Homo sapiens
acaccacctcactcctgt

SEQ ID NO: 719890 - DNA, 18 bp, Homo sapiens
acaccacgtcctggtctt

SEQ ID NO: 719891 - DNA, 18 bp, Homo sapiens
acaccactaaccatcccc

SEQ ID NO: 719892 - DNA, 14 bp, Homo sapiens
acaccactacattc

SEQ ID NO: 719893 - DNA, 15 bp, Homo sapiens
acaccactacattct

SEQ ID NO: 719894 - DNA, 17 bp, Homo sapiens
acaccactacattctgt

SEQ ID NO: 719895 - DNA, 21 bp, Homo sapiens
acaccactacattctgttaat

SEQ ID NO: 719896 - DNA, 16 bp, Homo sapiens
acaccactatagtgta

SEQ ID NO: 719897 - DNA, 15 bp, Homo sapiens
acaccactgccctgc

SEQ ID NO: 719898 - DNA, 16 bp, Homo sapiens
acaccactgccctgcc

SEQ ID NO: 719899 - DNA, 17 bp, Homo sapiens
acaccactgccctgcct

SEQ ID NO: 719900 - DNA, 18 bp, Homo sapiens
acaccactgccctgcctg

SEQ ID NO: 719901 - DNA, 17 bp, Homo sapiens
acaccactgttgccttt

SEQ ID NO: 719902 - DNA, 22 bp, Homo sapiens
acaccagatgcttttgtgagaa

SEQ ID NO: 719903 - DNA, 15 bp, Homo sapiens
acaccagcccccagg

SEQ ID NO: 719904 - DNA, 20 bp, Homo sapiens
acaccagcccccaggaagac

SEQ ID NO: 719905 - DNA, 21 bp, Homo sapiens
acagagtggaataagacagag

SEQ ID NO: 719906 - DNA, 23 bp, Homo sapiens
acagagtggaataagacagagac

SEQ ID NO: 719907 - DNA, 19 bp, Homo sapiens
acagagtggcctccctgct

SEQ ID NO: 719908 - DNA, 18 bp, Homo sapiens
acagagtggtctttctgg

SEQ ID NO: 719909 - DNA, 15 bp, Homo sapiens
acagagttgttacat

SEQ ID NO: 719910 - DNA, 19 bp, Homo sapiens
acagataagcaagagagat

SEQ ID NO: 719911 - DNA, 20 bp, Homo sapiens
acagataagcaagagagatg

SEQ ID NO: 719912 - DNA, 17 bp, Homo sapiens
acagataattcatttgt

SEQ ID NO: 719913 - DNA, 19 bp, Homo sapiens
acagataccagacctcttc

SEQ ID NO: 719914 - DNA, 21 bp, Homo sapiens
acagatacctccaaccctgcc

SEQ ID NO: 719915 - DNA, 22 bp, Homo sapiens
acagatactggaagttttgcat

SEQ ID NO: 719916 - DNA, 21 bp, Homo sapiens
acagatagtatctagcaatca

SEQ ID NO: 719917 - DNA, 13 bp, Homo sapiens
acagatagttgtg

SEQ ID NO: 719918 - DNA, 18 bp, Homo sapiens
acagatattgttataaat

SEQ ID NO: 719919 - DNA, 22 bp, Homo sapiens
acagatatttaaagaatgagaa

SEQ ID NO: 719920 - DNA, 17 bp, Homo sapiens
acagatcagaacatgaa

SEQ ID NO: 719921 - DNA, 22 bp, Homo sapiens
acagatcaggaattctaaataa

SEQ ID NO: 719922 - DNA, 20 bp, Homo sapiens
acagatccagaatttattag

SEQ ID NO: 719923 - DNA, 23 bp, Homo sapiens
acagatcccactggaagatcccc

SEQ ID NO: 719924 - DNA, 23 bp, Homo sapiens
acagatcgaaccgttttgaagct

SEQ ID NO: 719925 - DNA, 22 bp, Homo sapiens
acagatctgcaccaccatgccc

SEQ ID NO: 719926 - DNA, 21 bp, Homo sapiens
acagccaacacgcacctgcct

SEQ ID NO: 719927 - DNA, 20 bp, Homo sapiens
acagccaactagcccctggg

SEQ ID NO: 719928 - DNA, 17 bp, Homo sapiens
acagccaagacccaaca

SEQ ID NO: 719929 - DNA, 21 bp, Homo sapiens
acagccacccgtggggtgctg

SEQ ID NO: 719930 - DNA, 23 bp, Homo sapiens
acagccacccgtggggtgctgcc

SEQ ID NO: 719931 - DNA, 12 bp, Homo sapiens
acagccacctcc

SEQ ID NO: 719932 - DNA, 15 bp, Homo sapiens
acagccacctccgcc

SEQ ID NO: 719933 - DNA, 21 bp, Homo sapiens
acagccagaaggggctgcttg

SEQ ID NO: 719934 - DNA, 14 bp, Homo sapiens
acagccagagctgg

SEQ ID NO: 719935 - DNA, 18 bp, Homo sapiens
acagccagaggagggcag

SEQ ID NO: 719936 - DNA, 15 bp, Homo sapiens
acagccatgcgtggc

SEQ ID NO: 719937 - DNA, 13 bp, Homo sapiens
acagcccaagagg

SEQ ID NO: 719938 - DNA, 22 bp, Homo sapiens
acagcccagaaccacagatgtg

SEQ ID NO: 719939 - DNA, 13 bp, Homo sapiens
acagcccagagcc

SEQ ID NO: 719940 - DNA, 15 bp, Homo sapiens
acagcccagagcctg

SEQ ID NO: 719941 - DNA, 21 bp, Homo sapiens
acagcccaggatactggcaca

SEQ ID NO: 719942 - DNA, 15 bp, Homo sapiens
acagcccagggcctg

SEQ ID NO: 719943 - DNA, 16 bp, Homo sapiens
acagcccatcacctct

SEQ ID NO: 719944 - DNA, 16 bp, Homo sapiens
acagcccgctctctgg

SEQ ID NO: 719945 - DNA, 16 bp, Homo sapiens
acagccctcggcctcc

SEQ ID NO: 719946 - DNA, 16 bp, Homo sapiens
acagccctgcctgaga

SEQ ID NO: 719947 - DNA, 13 bp, Homo sapiens
acagccctgtcag

SEQ ID NO: 719948 - DNA, 23 bp, Homo sapiens
acagccgctcctgtctgccagcc

SEQ ID NO: 719949 - DNA, 20 bp, Homo sapiens
acagccggtcagaggagcgc

SEQ ID NO: 719950 - DNA, 23 bp, Homo sapiens
acagccgtcccgcgttcaagact

SEQ ID NO: 719951 - DNA, 20 bp, Homo sapiens
acagcctaatcccgtgcccc

SEQ ID NO: 719952 - DNA, 14 bp, Homo sapiens
acagcctagggcag

SEQ ID NO: 719953 - DNA, 15 bp, Homo sapiens
acagcctagggcaga

SEQ ID NO: 719954 - DNA, 12 bp, Homo sapiens
acagcctccagg

SEQ ID NO: 719955 - DNA, 14 bp, Homo sapiens
acagcctccagggc

SEQ ID NO: 719956 - DNA, 15 bp, Homo sapiens
acagcctcccacccc

SEQ ID NO: 719957 - DNA, 19 bp, Homo sapiens
acagcctcccctgccaggg

SEQ ID NO: 719958 - DNA, 21 bp, Homo sapiens
acagcctccctgagcctgcat

SEQ ID NO: 719959 - DNA, 13 bp, Homo sapiens
acagcctcgggga

SEQ ID NO: 719960 - DNA, 22 bp, Homo sapiens
acagcctcggggatggggaggg

SEQ ID NO: 719961 - DNA, 17 bp, Homo sapiens
acagcctgacaacattt

SEQ ID NO: 719962 - DNA, 16 bp, Homo sapiens
acagcctgctggcagg

SEQ ID NO: 719963 - DNA, 17 bp, Homo sapiens
acagcctgctggcaggg

SEQ ID NO: 719964 - DNA, 21 bp, Homo sapiens
acagcctgctggcagggccag

SEQ ID NO: 719965 - DNA, 15 bp, Homo sapiens
acagcctggcacagg

SEQ ID NO: 719966 - DNA, 16 bp, Homo sapiens
acagccttagctgcca

SEQ ID NO: 719967 - DNA, 18 bp, Homo sapiens
acagccttagctgccagt

SEQ ID NO: 719968 - DNA, 21 bp, Homo sapiens
acagccttagctgccagtgct

SEQ ID NO: 719969 - DNA, 22 bp, Homo sapiens
acagccttagctgccagtgctg

SEQ ID NO: 719970 - DNA, 17 bp, Homo sapiens
acagccttccttctgct

SEQ ID NO: 719971 - DNA, 20 bp, Homo sapiens
acagcgacgctcccctgaga

SEQ ID NO: 719972 - DNA, 14 bp, Homo sapiens
acagcgagaggcag

SEQ ID NO: 719973 - DNA, 19 bp, Homo sapiens
acagcgagaggcagagaaa

SEQ ID NO: 719974 - DNA, 15 bp, Homo sapiens
acagcgagcctgtgc

SEQ ID NO: 719975 - DNA, 18 bp, Homo sapiens
acagcgagcctgtgcctt

SEQ ID NO: 719976 - DNA, 19 bp, Homo sapiens
acagcgagggcagctgcta

SEQ ID NO: 719977 - DNA, 17 bp, Homo sapiens
acagcgatggcaggcct

SEQ ID NO: 719978 - DNA, 18 bp, Homo sapiens
acagcgatggcaggcctg

SEQ ID NO: 719979 - DNA, 19 bp, Homo sapiens
acagcgatggcaggcctga

SEQ ID NO: 719980 - DNA, 20 bp, Homo sapiens
acagcgatggcaggcctgac

SEQ ID NO: 719981 - DNA, 23 bp, Homo sapiens
acagcgatggcaggcctgaccca

SEQ ID NO: 719982 - DNA, 19 bp, Homo sapiens
acagcgcggaggaggaggg

SEQ ID NO: 719983 - DNA, 17 bp, Homo sapiens
acagcggcagtgggcct

SEQ ID NO: 719984 - DNA, 23 bp, Homo sapiens
acagcggccttgaagacagagca

SEQ ID NO: 719985 - DNA, 13 bp, Homo sapiens
acagcgggctgtg

SEQ ID NO: 719986 - DNA, 15 bp, Homo sapiens
acagcgggctgtgcc

SEQ ID NO: 719987 - DNA, 16 bp, Homo sapiens
acagcggggccccagg

SEQ ID NO: 719988 - DNA, 14 bp, Homo sapiens
acagcgtccctggc

SEQ ID NO: 719989 - DNA, 13 bp, Homo sapiens
acagcgtgctggc

SEQ ID NO: 719990 - DNA, 14 bp, Homo sapiens
acagctaccaccct

SEQ ID NO: 719991 - DNA, 22 bp, Homo sapiens
acagctatatcctgatgctgga

SEQ ID NO: 719992 - DNA, 22 bp, Homo sapiens
acagctatcgaacttcacaact

SEQ ID NO: 719993 - DNA, 18 bp, Homo sapiens
acagctattatatcagct

SEQ ID NO: 719994 - DNA, 23 bp, Homo sapiens
acagctcaactcgggggcgcctg

SEQ ID NO: 719995 - DNA, 20 bp, Homo sapiens
acagctcaagtcttccctga

SEQ ID NO: 719996 - DNA, 17 bp, Homo sapiens
acagctcacctctgaag

SEQ ID NO: 719997 - DNA, 17 bp, Homo sapiens
acagctcactgcagcct

SEQ ID NO: 719998 - DNA, 21 bp, Homo sapiens
acagctcagttctagtctctc

SEQ ID NO: 719999 - DNA, 16 bp, Homo sapiens
acagctcattaaactt

SEQ ID NO: 720000 - DNA, 14 bp, Homo sapiens
acagctcccacccc

SEQ ID NO: 720001 - DNA, 23 bp, Homo sapiens
acagctcctcttaccgtagcctc

SEQ ID NO: 720002 - DNA, 13 bp, Homo sapiens
acagctcctgcca

SEQ ID NO: 720003 - DNA, 13 bp, Homo sapiens
acagctctcccct

SEQ ID NO: 720004 - DNA, 14 bp, Homo sapiens
acagctctgggcct

SEQ ID NO: 720005 - DNA, 22 bp, Homo sapiens
acagctctgggcctctttttgc

SEQ ID NO: 720006 - DNA, 20 bp, Homo sapiens
acagctcttggcattttcct

SEQ ID NO: 720007 - DNA, 17 bp, Homo sapiens
acagctgaagagcaagg

SEQ ID NO: 720008 - DNA, 15 bp, Homo sapiens
acagctgagagactt

SEQ ID NO: 720009 - DNA, 14 bp, Homo sapiens
acagctgagcactt

SEQ ID NO: 720010 - DNA, 16 bp, Homo sapiens
acagctgaggtctctt

SEQ ID NO: 720011 - DNA, 16 bp, Homo sapiens
acagctgatacttcat

SEQ ID NO: 720012 - DNA, 18 bp, Homo sapiens
acagctgcaattccctgg

SEQ ID NO: 720013 - DNA, 12 bp, Homo sapiens
acagctgcagct

SEQ ID NO: 720014 - DNA, 14 bp, Homo sapiens
acagctgcagctgg

SEQ ID NO: 720015 - DNA, 10 bp, Homo sapiens
acagctgccc

SEQ ID NO: 720016 - DNA, 17 bp, Homo sapiens
acagctgccctagctga

SEQ ID NO: 720017 - DNA, 13 bp, Homo sapiens
acagctgccctgc

SEQ ID NO: 720018 - DNA, 19 bp, Homo sapiens
acagctgccctgctgccac

SEQ ID NO: 720019 - DNA, 23 bp, Homo sapiens
acagctgccctgctgccacagca

SEQ ID NO: 720020 - DNA, 12 bp, Homo sapiens
acagctgcctgc

SEQ ID NO: 720021 - DNA, 16 bp, Homo sapiens
acagctgcctgcagta

SEQ ID NO: 720022 - DNA, 21 bp, Homo sapiens
acagctgctcaataaagtaca

SEQ ID NO: 720023 - DNA, 23 bp, Homo sapiens
acagctgctcctagagggagggg

SEQ ID NO: 720024 - DNA, 17 bp, Homo sapiens
acagctgctgttctcag

SEQ ID NO: 720025 - DNA, 22 bp, Homo sapiens
acagctgctgttctcaggacag

SEQ ID NO: 720026 - DNA, 21 bp, Homo sapiens
acagctgctttctgttgtcat

SEQ ID NO: 720027 - DNA, 21 bp, Homo sapiens
acagctggaccctgcttcacc

SEQ ID NO: 720028 - DNA, 22 bp, Homo sapiens
acagctggctagcattcctcag

SEQ ID NO: 720029 - DNA, 13 bp, Homo sapiens
acagctggctctg

SEQ ID NO: 720030 - DNA, 16 bp, Homo sapiens
acagctgggagcctgg

SEQ ID NO: 720031 - DNA, 17 bp, Homo sapiens
acagctgggagcctggt

SEQ ID NO: 720032 - DNA, 15 bp, Homo sapiens
acagctgggcaaagc

SEQ ID NO: 720033 - DNA, 17 bp, Homo sapiens
acagctgggcaaagcca

SEQ ID NO: 720034 - DNA, 17 bp, Homo sapiens
acagctgggcagggtga

SEQ ID NO: 720035 - DNA, 18 bp, Homo sapiens
acagggaaaggtcagccc

SEQ ID NO: 720036 - DNA, 18 bp, Homo sapiens
acagggaatgctgaggcc

SEQ ID NO: 720037 - DNA, 12 bp, Homo sapiens
acagggacccac

SEQ ID NO: 720038 - DNA, 23 bp, Homo sapiens
acagggagaaaatccaggtcatg

SEQ ID NO: 720039 - DNA, 16 bp, Homo sapiens
acagggagctgggaca

SEQ ID NO: 720040 - DNA, 23 bp, Homo sapiens
acagggagggccggcggctctga

SEQ ID NO: 720041 - DNA, 20 bp, Homo sapiens
acagggagggggacctgtcc

SEQ ID NO: 720042 - DNA, 19 bp, Homo sapiens
acagggatctgtttgaaca

SEQ ID NO: 720043 - DNA, 13 bp, Homo sapiens
acagggatgctgg

SEQ ID NO: 720044 - DNA, 15 bp, Homo sapiens
acagggcaaggacac

SEQ ID NO: 720045 - DNA, 17 bp, Homo sapiens
acagggcagcagtgggg

SEQ ID NO: 720046 - DNA, 13 bp, Homo sapiens
acagggcaggcct

SEQ ID NO: 720047 - DNA, 16 bp, Homo sapiens
acagggcaggccttgc

SEQ ID NO: 720048 - DNA, 21 bp, Homo sapiens
acagggcaggccttgctgggg

SEQ ID NO: 720049 - DNA, 22 bp, Homo sapiens
acagggcaggccttgctggggt

SEQ ID NO: 720050 - DNA, 15 bp, Homo sapiens
acagggccagggttg

SEQ ID NO: 720051 - DNA, 19 bp, Homo sapiens
acagggcccaggcctggag

SEQ ID NO: 720052 - DNA, 20 bp, Homo sapiens
acagggctcacagggcaggc

SEQ ID NO: 720053 - DNA, 12 bp, Homo sapiens
acagggctcttt

SEQ ID NO: 720054 - DNA, 14 bp, Homo sapiens
acaggggaggaaaa

SEQ ID NO: 720055 - DNA, 19 bp, Homo sapiens
acaggggaggaaaaaagaa

SEQ ID NO: 720056 - DNA, 13 bp, Homo sapiens
acagggggtggga

SEQ ID NO: 720057 - DNA, 17 bp, Homo sapiens
acaggggtagtttgttt

SEQ ID NO: 720058 - DNA, 16 bp, Homo sapiens
acagggtctcactctg

SEQ ID NO: 720059 - DNA, 19 bp, Homo sapiens
acagggtctctagtgctgt

SEQ ID NO: 720060 - DNA, 21 bp, Homo sapiens
acagggtctctagtgctgtga

SEQ ID NO: 720061 - DNA, 24 bp, Homo sapiens
acagggtctgctctttctctgcca

SEQ ID NO: 720062 - DNA, 14 bp, Homo sapiens
acagggtcttgcta

SEQ ID NO: 720063 - DNA, 20 bp, Homo sapiens
acagggtcttgctctgtccc

SEQ ID NO: 720064 - DNA, 9 bp, Homo sapiens
acagggtgc

SEQ ID NO: 720065 - DNA, 13 bp, Homo sapiens
acagggtgggctt

SEQ ID NO: 720066 - DNA, 18 bp, Homo sapiens
acagggtgggcttcctgc

SEQ ID NO: 720067 - DNA, 14 bp, Homo sapiens
acaggtaaaacagg

SEQ ID NO: 720068 - DNA, 15 bp, Homo sapiens
acaggtaaaacaggg

SEQ ID NO: 720069 - DNA, 22 bp, Homo sapiens
acaggtaaaacagggccacata

SEQ ID NO: 720070 - DNA, 18 bp, Homo sapiens
acaggtaaactatcttgg

SEQ ID NO: 720071 - DNA, 22 bp, Homo sapiens
acaggtagcacagattttgaat

SEQ ID NO: 720072 - DNA, 16 bp, Homo sapiens
acaggtatttttttaa

SEQ ID NO: 720073 - DNA, 14 bp, Homo sapiens
acaggtcagggctc

SEQ ID NO: 720074 - DNA, 16 bp, Homo sapiens
acaggtcagggctcag

SEQ ID NO: 720075 - DNA, 15 bp, Homo sapiens
acaggtcatcagatg

SEQ ID NO: 720076 - DNA, 21 bp, Homo sapiens
acaggtcatcagatgcctgct

SEQ ID NO: 720077 - DNA, 18 bp, Homo sapiens
acaggtcccacctccagc

SEQ ID NO: 720078 - DNA, 19 bp, Homo sapiens
acaggtctcctcttaaaaa

SEQ ID NO: 720079 - DNA, 21 bp, Homo sapiens
acaggtctttcctaaggctgc

SEQ ID NO: 720080 - DNA, 17 bp, Homo sapiens
acaggtgcgggaccatc

SEQ ID NO: 720081 - DNA, 16 bp, Homo sapiens
acaggtggacacacaa

SEQ ID NO: 720082 - DNA, 15 bp, Homo sapiens
acaggtggcaggacc

SEQ ID NO: 720083 - DNA, 21 bp, Homo sapiens
acaggtggcaggaccaggact

SEQ ID NO: 720084 - DNA, 12 bp, Homo sapiens
acaggtgggcct

SEQ ID NO: 720085 - DNA, 13 bp, Homo sapiens
acaggtgggcctg

SEQ ID NO: 720086 - DNA, 16 bp, Homo sapiens
acaggtgggcctggcg

SEQ ID NO: 720087 - DNA, 21 bp, Homo sapiens
acaggtgggcctggcggcctg

SEQ ID NO: 720088 - DNA, 20 bp, Homo sapiens
acaggtgtgagccactgcgc

SEQ ID NO: 720089 - DNA, 14 bp, Homo sapiens
acagtctagtgcaa

SEQ ID NO: 720090 - DNA, 21 bp, Homo sapiens
acagtctccctgatggaccct

SEQ ID NO: 720091 - DNA, 20 bp, Homo sapiens
acagtctctttaatcttcag

SEQ ID NO: 720092 - DNA, 15 bp, Homo sapiens
acagtctctttcttc

SEQ ID NO: 720093 - DNA, 17 bp, Homo sapiens
acagtctctttcttcct

SEQ ID NO: 720094 - DNA, 20 bp, Homo sapiens
acagtctctttcttcctttc

SEQ ID NO: 720095 - DNA, 17 bp, Homo sapiens
acagtctgaagctcgca

SEQ ID NO: 720096 - DNA, 21 bp, Homo sapiens
acagtcttccacaaagaaaat

SEQ ID NO: 720097 - DNA, 14 bp, Homo sapiens
acagtcttccattt

SEQ ID NO: 720098 - DNA, 14 bp, Homo sapiens
acagtcttgtatta

SEQ ID NO: 720099 - DNA, 18 bp, Homo sapiens
acagtcttgtattaagtt

SEQ ID NO: 720100 - DNA, 22 bp, Homo sapiens
acagtcttgtattaagttgtta

SEQ ID NO: 720101 - DNA, 16 bp, Homo sapiens
acagtgaatgtgtctg

SEQ ID NO: 720102 - DNA, 18 bp, Homo sapiens
acagtgaattgtctttta

SEQ ID NO: 720103 - DNA, 15 bp, Homo sapiens
acagtgacttctgag

SEQ ID NO: 720104 - DNA, 17 bp, Homo sapiens
acagtgacttctgagat

SEQ ID NO: 720105 - DNA, 23 bp, Homo sapiens
acagtgacttggccccagacgca

SEQ ID NO: 720106 - DNA, 22 bp, Homo sapiens
acagtgagacagtctggaaagt

SEQ ID NO: 720107 - DNA, 16 bp, Homo sapiens
acagtgagcatatctg

SEQ ID NO: 720108 - DNA, 12 bp, Homo sapiens
acagtgagccaa

SEQ ID NO: 720109 - DNA, 21 bp, Homo sapiens
acagtgaggactcggccactg

SEQ ID NO: 720110 - DNA, 21 bp, Homo sapiens
acagtgagttagactcaaggg

SEQ ID NO: 720111 - DNA, 14 bp, Homo sapiens
acagtgatctccat

SEQ ID NO: 720112 - DNA, 22 bp, Homo sapiens
acagtgatgccgggcgccagga

SEQ ID NO: 720113 - DNA, 13 bp, Homo sapiens
acagtgatgttgt

SEQ ID NO: 720114 - DNA, 22 bp, Homo sapiens
acagtgcagagccttctcagaa

SEQ ID NO: 720115 - DNA, 22 bp, Homo sapiens
acagtgcccaccgccctcctcc

SEQ ID NO: 720116 - DNA, 15 bp, Homo sapiens
acagtgcctcttcca

SEQ ID NO: 720117 - DNA, 17 bp, Homo sapiens
acagtgctcttttctcc

SEQ ID NO: 720118 - DNA, 21 bp, Homo sapiens
acagtgctcttttctcctcac

SEQ ID NO: 720119 - DNA, 14 bp, Homo sapiens
acagtgctgcccct

SEQ ID NO: 720120 - DNA, 14 bp, Homo sapiens
acagtgctgccctg

SEQ ID NO: 720121 - DNA, 15 bp, Homo sapiens
acagtgctgccctgc

SEQ ID NO: 720122 - DNA, 16 bp, Homo sapiens
acagtgctgccctgcg

SEQ ID NO: 720123 - DNA, 17 bp, Homo sapiens
acagtgcttcagcctga

SEQ ID NO: 720124 - DNA, 21 bp, Homo sapiens
acagtgcttcagcctgaggct

SEQ ID NO: 720125 - DNA, 22 bp, Homo sapiens
acagtgcttcagcctgaggctg

SEQ ID NO: 720126 - DNA, 13 bp, Homo sapiens
acagtgcttgcat

SEQ ID NO: 720127 - DNA, 20 bp, Homo sapiens
acagtgcttgcatcctattt

SEQ ID NO: 720128 - DNA, 18 bp, Homo sapiens
acagtggaatataaggaa

SEQ ID NO: 720129 - DNA, 18 bp, Homo sapiens
acagtggcacaaaaaaat

SEQ ID NO: 720130 - DNA, 22 bp, Homo sapiens
acagtggctgggtgggcccaga

SEQ ID NO: 720131 - DNA, 12 bp, Homo sapiens
acagtgggaaat

SEQ ID NO: 720132 - DNA, 15 bp, Homo sapiens
acagtgggtggtgga

SEQ ID NO: 720133 - DNA, 18 bp, Homo sapiens
acagtggtagagaggttt

SEQ ID NO: 720134 - DNA, 13 bp, Homo sapiens
acagtgtacagtc

SEQ ID NO: 720135 - DNA, 15 bp, Homo sapiens
acagtgtacagtctt

SEQ ID NO: 720136 - DNA, 17 bp, Homo sapiens
acagtgtacagtcttgt

SEQ ID NO: 720137 - DNA, 13 bp, Homo sapiens
acagtgtatgggg

SEQ ID NO: 720138 - DNA, 24 bp, Homo sapiens
acagtgtctgtatcggagacagtg

SEQ ID NO: 720139 - DNA, 12 bp, Homo sapiens
acagtgtctttt

SEQ ID NO: 720140 - DNA, 21 bp, Homo sapiens
acagtgtctttttttgtatag

SEQ ID NO: 720141 - DNA, 22 bp, Homo sapiens
acagtgtggtttgggaaagatg

SEQ ID NO: 720142 - DNA, 22 bp, Homo sapiens
acagtgtgtgaactgctttcaa

SEQ ID NO: 720143 - DNA, 23 bp, Homo sapiens
acagtgtgtgaactgctttcaag

SEQ ID NO: 720144 - DNA, 17 bp, Homo sapiens
acagtgttagtgctggt

SEQ ID NO: 720145 - DNA, 19 bp, Homo sapiens
acagtgttagtgctggtca

SEQ ID NO: 720146 - DNA, 16 bp, Homo sapiens
acagtgttattttctt

SEQ ID NO: 720147 - DNA, 13 bp, Homo sapiens
acagtgtttcaat

SEQ ID NO: 720148 - DNA, 19 bp, Homo sapiens
acagtgtttcaattctgta

SEQ ID NO: 720149 - DNA, 15 bp, Homo sapiens
acagtgtttcccata

SEQ ID NO: 720150 - DNA, 14 bp, Homo sapiens
acagtgttttcaga

SEQ ID NO: 720151 - DNA, 16 bp, Homo sapiens
acagtgttttcagaag

SEQ ID NO: 720152 - DNA, 14 bp, Homo sapiens
acagttaactttca

SEQ ID NO: 720153 - DNA, 16 bp, Homo sapiens
acagttaactttcaga

SEQ ID NO: 720154 - DNA, 17 bp, Homo sapiens
acagttagcagggatgt

SEQ ID NO: 720155 - DNA, 19 bp, Homo sapiens
acagttagggttttgcaat

SEQ ID NO: 720156 - DNA, 14 bp, Homo sapiens
acagttataaaatt

SEQ ID NO: 720157 - DNA, 19 bp, Homo sapiens
acagttataaaattaaaag

SEQ ID NO: 720158 - DNA, 11 bp, Homo sapiens
acagttatatt

SEQ ID NO: 720159 - DNA, 12 bp, Homo sapiens
acagttatctta

SEQ ID NO: 720160 - DNA, 16 bp, Homo sapiens
acagttatcttagctg

SEQ ID NO: 720161 - DNA, 22 bp, Homo sapiens
acagttcaaaattctaaatgta

SEQ ID NO: 720162 - DNA, 20 bp, Homo sapiens
acagttcatgtttgcttcat

SEQ ID NO: 720163 - DNA, 16 bp, Homo sapiens
acagttctcactggga

SEQ ID NO: 720164 - DNA, 14 bp, Homo sapiens
acagttctgagctg

SEQ ID NO: 720165 - DNA, 13 bp, Homo sapiens
acagttctgtaat

SEQ ID NO: 720166 - DNA, 12 bp, Homo sapiens
acagttctgtgg

SEQ ID NO: 720167 - DNA, 19 bp, Homo sapiens
acagttcttggtgactgtc

SEQ ID NO: 720168 - DNA, 16 bp, Homo sapiens
acagttctttcctctt

SEQ ID NO: 720169 - DNA, 16 bp, Homo sapiens
acagttgaaaaacagc

SEQ ID NO: 720170 - DNA, 20 bp, Homo sapiens
acagttgaaaaacagctgag

SEQ ID NO: 720171 - DNA, 18 bp, Homo sapiens
acagttgaaaacttgtaa

SEQ ID NO: 720172 - DNA, 22 bp, Homo sapiens
acagttgcatcaggcctgaacc

SEQ ID NO: 720173 - DNA, 20 bp, Homo sapiens
acagttgccaccacctctgt

SEQ ID NO: 720174 - DNA, 23 bp, Homo sapiens
acagttgccaccacctctgtggc

SEQ ID NO: 720175 - DNA, 21 bp, Homo sapiens
acagttgctgtcataagaatg

SEQ ID NO: 720176 - DNA, 22 bp, Homo sapiens
acagttgctgtcataagaatga

SEQ ID NO: 720177 - DNA, 15 bp, Homo sapiens
acagttggtaacttt

SEQ ID NO: 720178 - DNA, 16 bp, Homo sapiens
acagttggtaactttt

SEQ ID NO: 720179 - DNA, 13 bp, Homo sapiens
acagttgtcctga

SEQ ID NO: 720180 - DNA, 23 bp, Homo sapiens
acagttgtctattctgagccttg

SEQ ID NO: 720181 - DNA, 20 bp, Homo sapiens
acagttgtgtcataaattac

SEQ ID NO: 720182 - DNA, 23 bp, Homo sapiens
acagtttacctcaggtgtgcctg

SEQ ID NO: 720183 - DNA, 17 bp, Homo sapiens
acagtttataatagtaa

SEQ ID NO: 720184 - DNA, 13 bp, Homo sapiens
acagtttccaaat

SEQ ID NO: 720185 - DNA, 19 bp, Homo sapiens
acagtttcttgcttggaag

SEQ ID NO: 720186 - DNA, 14 bp, Homo sapiens
acagtttcttttgt

SEQ ID NO: 720187 - DNA, 21 bp, Homo sapiens
acagtttgtgttttaaaaaaa

SEQ ID NO: 720188 - DNA, 19 bp, Homo sapiens
acagttttaactgtggata

SEQ ID NO: 720189 - DNA, 14 bp, Homo sapiens
acagttttcagaaa

SEQ ID NO: 720190 - DNA, 22 bp, Homo sapiens
acagttttcattgattatatgg

SEQ ID NO: 720191 - DNA, 14 bp, Homo sapiens
acagttttccatga

SEQ ID NO: 720192 - DNA, 16 bp, Homo sapiens
acagttttccatgaaa

SEQ ID NO: 720193 - DNA, 13 bp, Homo sapiens
acagttttctagc

SEQ ID NO: 720194 - DNA, 20 bp, Homo sapiens
acagttttctagcaattttc

SEQ ID NO: 720195 - DNA, 21 bp, Homo sapiens
acagttttctggctggagcct

SEQ ID NO: 720196 - DNA, 15 bp, Homo sapiens
acagttttgaaagaa

SEQ ID NO: 720197 - DNA, 22 bp, Homo sapiens
acataaaaaggacatcagcaaa

SEQ ID NO: 720198 - DNA, 12 bp, Homo sapiens
acataaaacaaa

SEQ ID NO: 720199 - DNA, 15 bp, Homo sapiens
acataaaacaaaacc

SEQ ID NO: 720200 - DNA, 12 bp, Homo sapiens
acataaaacttt

SEQ ID NO: 720201 - DNA, 14 bp, Homo sapiens
acataaaactttaa

SEQ ID NO: 720202 - DNA, 21 bp, Homo sapiens
acataaaatccaatattgtaa

SEQ ID NO: 720203 - DNA, 13 bp, Homo sapiens
acataaactgact

SEQ ID NO: 720204 - DNA, 16 bp, Homo sapiens
acataaactgtcactc

SEQ ID NO: 720205 - DNA, 13 bp, Homo sapiens
acataaagcaaat

SEQ ID NO: 720206 - DNA, 21 bp, Homo sapiens
acataaagcaaatagacacag

SEQ ID NO: 720207 - DNA, 18 bp, Homo sapiens
acataacttgatatagaa

SEQ ID NO: 720208 - DNA, 22 bp, Homo sapiens
acataacttgatatagaaagct

SEQ ID NO: 720209 - DNA, 12 bp, Homo sapiens
acataagaaggc

SEQ ID NO: 720210 - DNA, 14 bp, Homo sapiens
acataagaaggcaa

SEQ ID NO: 720211 - DNA, 15 bp, Homo sapiens
acataagataaatgt

SEQ ID NO: 720212 - DNA, 16 bp, Homo sapiens
acataagtaactttta

SEQ ID NO: 720213 - DNA, 19 bp, Homo sapiens
acataagtttaggataaaa

SEQ ID NO: 720214 - DNA, 17 bp, Homo sapiens
acataataagtttcata

SEQ ID NO: 720215 - DNA, 20 bp, Homo sapiens
acataataccaccatttaaa

SEQ ID NO: 720216 - DNA, 16 bp, Homo sapiens
acataatcaaagctac

SEQ ID NO: 720217 - DNA, 21 bp, Homo sapiens
acataatgcgtgcataccact

SEQ ID NO: 720218 - DNA, 20 bp, Homo sapiens
acataatgggccactgaaat

SEQ ID NO: 720219 - DNA, 23 bp, Homo sapiens
acataatgggccactgaaatctg

SEQ ID NO: 720220 - DNA, 17 bp, Homo sapiens
acataatggggtcctgg

SEQ ID NO: 720221 - DNA, 20 bp, Homo sapiens
acataatggttgtgaaatgt

SEQ ID NO: 720222 - DNA, 17 bp, Homo sapiens
acataattatccaggaa

SEQ ID NO: 720223 - DNA, 23 bp, Homo sapiens
acataattatccaggaagggaat

SEQ ID NO: 720224 - DNA, 18 bp, Homo sapiens
acataattgattaaaatc

SEQ ID NO: 720225 - DNA, 22 bp, Homo sapiens
acataattgattaaaatctctt

SEQ ID NO: 720226 - DNA, 21 bp, Homo sapiens
acataatttagtttcatataa

SEQ ID NO: 720227 - DNA, 18 bp, Homo sapiens
acataattttttattcaa

SEQ ID NO: 720228 - DNA, 21 bp, Homo sapiens
acatacaaaaattagccgggc

SEQ ID NO: 720229 - DNA, 13 bp, Homo sapiens
acatacacataca

SEQ ID NO: 720230 - DNA, 17 bp, Homo sapiens
acatacagagctctctg

SEQ ID NO: 720231 - DNA, 20 bp, Homo sapiens
acatacaggaaggtagaaat

SEQ ID NO: 720232 - DNA, 16 bp, Homo sapiens
acatacatacatacat

SEQ ID NO: 720233 - DNA, 15 bp, Homo sapiens
acatacatacatata

SEQ ID NO: 720234 - DNA, 16 bp, Homo sapiens
acatacatacatatat

SEQ ID NO: 720235 - DNA, 14 bp, Homo sapiens
acatacatagacat

SEQ ID NO: 720236 - DNA, 12 bp, Homo sapiens
acatacatatat

SEQ ID NO: 720237 - DNA, 17 bp, Homo sapiens
acatacatatatatctg

SEQ ID NO: 720238 - DNA, 13 bp, Homo sapiens
acataccatctgt

SEQ ID NO: 720239 - DNA, 19 bp, Homo sapiens
acatacccacacattccag

SEQ ID NO: 720240 - DNA, 17 bp, Homo sapiens
acatacccgcctagctg

SEQ ID NO: 720241 - DNA, 21 bp, Homo sapiens
acatacccgcctagctgctgt

SEQ ID NO: 720242 - DNA, 20 bp, Homo sapiens
acatacgcaaaaacttcctt

SEQ ID NO: 720243 - DNA, 21 bp, Homo sapiens
acatacggtcaggtttaacat

SEQ ID NO: 720244 - DNA, 22 bp, Homo sapiens
acatacggtcaggtttaacatt

SEQ ID NO: 720245 - DNA, 24 bp, Homo sapiens
acatacgtgttaggaggctgcatg

SEQ ID NO: 720246 - DNA, 13 bp, Homo sapiens
acatactcatttt

SEQ ID NO: 720247 - DNA, 16 bp, Homo sapiens
acatactcatttttca

SEQ ID NO: 720248 - DNA, 24 bp, Homo sapiens
acatactccttccatcaaatagaa

SEQ ID NO: 720249 - DNA, 14 bp, Homo sapiens
acatactgcatgta

SEQ ID NO: 720250 - DNA, 15 bp, Homo sapiens
acatactgctggagt

SEQ ID NO: 720251 - DNA, 13 bp, Homo sapiens
acatactgcttga

SEQ ID NO: 720252 - DNA, 20 bp, Homo sapiens
acatactgcttgattttaat

SEQ ID NO: 720253 - DNA, 15 bp, Homo sapiens
acatactggcctctg

SEQ ID NO: 720254 - DNA, 16 bp, Homo sapiens
acatactggcctctgt

SEQ ID NO: 720255 - DNA, 17 bp, Homo sapiens
acatactgtgttccaat

SEQ ID NO: 720256 - DNA, 16 bp, Homo sapiens
acatacttacatttca

SEQ ID NO: 720257 - DNA, 17 bp, Homo sapiens
acatacttcaaaaatgt

SEQ ID NO: 720258 - DNA, 21 bp, Homo sapiens
acatagaacacttcagacaca

SEQ ID NO: 720259 - DNA, 12 bp, Homo sapiens
acatagacattt

SEQ ID NO: 720260 - DNA, 17 bp, Homo sapiens
acatagacatttcaaaa

SEQ ID NO: 720261 - DNA, 18 bp, Homo sapiens
acatagacatttcaaaat

SEQ ID NO: 720262 - DNA, 20 bp, Homo sapiens
acatagacatttcaaaatta

SEQ ID NO: 720263 - DNA, 15 bp, Homo sapiens
acatagagcttttta

SEQ ID NO: 720264 - DNA, 14 bp, Homo sapiens
acatagatcagcca

SEQ ID NO: 720265 - DNA, 18 bp, Homo sapiens
acatagatcagccattaa

SEQ ID NO: 720266 - DNA, 15 bp, Homo sapiens
acatagatgtccctt

SEQ ID NO: 720267 - DNA, 20 bp, Homo sapiens
acatagcaggggcaccttcc

SEQ ID NO: 720268 - DNA, 16 bp, Homo sapiens
acatagcatgcttcct

SEQ ID NO: 720269 - DNA, 20 bp, Homo sapiens
acatagcatgcttcctttct

SEQ ID NO: 720270 - DNA, 19 bp, Homo sapiens
acatagcatgtcaactttt

SEQ ID NO: 720271 - DNA, 20 bp, Homo sapiens
acatagccaatggacaagca

SEQ ID NO: 720272 - DNA, 16 bp, Homo sapiens
acatagcccacttaca

SEQ ID NO: 720273 - DNA, 15 bp, Homo sapiens
acatagcccctgccc

SEQ ID NO: 720274 - DNA, 20 bp, Homo sapiens
acatagccctggtgctcctg

SEQ ID NO: 720275 - DNA, 22 bp, Homo sapiens
acatagcgccgtgctgtaaata

SEQ ID NO: 720276 - DNA, 18 bp, Homo sapiens
acataggccaaggcccaa

SEQ ID NO: 720277 - DNA, 16 bp, Homo sapiens
acataggcttctatta

SEQ ID NO: 720278 - DNA, 16 bp, Homo sapiens
acatagtcctcagggc

SEQ ID NO: 720279 - DNA, 17 bp, Homo sapiens
acattaacagttttcca

SEQ ID NO: 720280 - DNA, 18 bp, Homo sapiens
acattaacagttttccat

SEQ ID NO: 720281 - DNA, 17 bp, Homo sapiens
acattaacggtgctaaa

SEQ ID NO: 720282 - DNA, 13 bp, Homo sapiens
acattaactcatt

SEQ ID NO: 720283 - DNA, 14 bp, Homo sapiens
acattaactcatta

SEQ ID NO: 720284 - DNA, 22 bp, Homo sapiens
acattaactccctccaccagcc

SEQ ID NO: 720285 - DNA, 12 bp, Homo sapiens
acattaagaaaa

SEQ ID NO: 720286 - DNA, 16 bp, Homo sapiens
acattaagaaaatcat

SEQ ID NO: 720287 - DNA, 21 bp, Homo sapiens
acattaagaaaatcatattgc

SEQ ID NO: 720288 - DNA, 15 bp, Homo sapiens
acattaagtggcttt

SEQ ID NO: 720289 - DNA, 17 bp, Homo sapiens
acattaattttgtgcat

SEQ ID NO: 720290 - DNA, 21 bp, Homo sapiens
acattaattttgtgcattctt

SEQ ID NO: 720291 - DNA, 19 bp, Homo sapiens
acattagattttattttac

SEQ ID NO: 720292 - DNA, 18 bp, Homo sapiens
acattagcagtttgcttt

SEQ ID NO: 720293 - DNA, 22 bp, Homo sapiens
acattaggaagtggcagttctt

SEQ ID NO: 720294 - DNA, 19 bp, Homo sapiens
acattaggcattgagactt

SEQ ID NO: 720295 - DNA, 16 bp, Homo sapiens
acattaggggaaccat

SEQ ID NO: 720296 - DNA, 19 bp, Homo sapiens
acattaggggattcttctt

SEQ ID NO: 720297 - DNA, 15 bp, Homo sapiens
acattagttttaatc

SEQ ID NO: 720298 - DNA, 19 bp, Homo sapiens
acattataaaccttcagaa

SEQ ID NO: 720299 - DNA, 15 bp, Homo sapiens
accacttcagggctt

SEQ ID NO: 720300 - DNA, 17 bp, Homo sapiens
accacttcattcttgaa

SEQ ID NO: 720301 - DNA, 17 bp, Homo sapiens
accacttccagagccag

SEQ ID NO: 720302 - DNA, 14 bp, Homo sapiens
accacttccagggg

SEQ ID NO: 720303 - DNA, 23 bp, Homo sapiens
accacttccaggggaacctgcca

SEQ ID NO: 720304 - DNA, 17 bp, Homo sapiens
accacttctctgctgcc

SEQ ID NO: 720305 - DNA, 23 bp, Homo sapiens
accacttctctgctgcctctgtg

SEQ ID NO: 720306 - DNA, 13 bp, Homo sapiens
accacttgctgca

SEQ ID NO: 720307 - DNA, 20 bp, Homo sapiens
accacttggaaataaaccat

SEQ ID NO: 720308 - DNA, 23 bp, Homo sapiens
accactttccactccctgcttag

SEQ ID NO: 720309 - DNA, 15 bp, Homo sapiens
accactttcttattt

SEQ ID NO: 720310 - DNA, 12 bp, Homo sapiens
accacttttaaa

SEQ ID NO: 720311 - DNA, 16 bp, Homo sapiens
accacttttgttcttg

SEQ ID NO: 720312 - DNA, 21 bp, Homo sapiens
accacttttgttcttggtttg

SEQ ID NO: 720313 - DNA, 17 bp, Homo sapiens
accagaaaagcccaagt

SEQ ID NO: 720314 - DNA, 17 bp, Homo sapiens
accagaaacacccctct

SEQ ID NO: 720315 - DNA, 16 bp, Homo sapiens
accagaaatcaaaaag

SEQ ID NO: 720316 - DNA, 14 bp, Homo sapiens
accagaattgtcct

SEQ ID NO: 720317 - DNA, 19 bp, Homo sapiens
accagacaaaaaaatttaa

SEQ ID NO: 720318 - DNA, 11 bp, Homo sapiens
accagacaggt

SEQ ID NO: 720319 - DNA, 18 bp, Homo sapiens
accagacccacctggagc

SEQ ID NO: 720320 - DNA, 21 bp, Homo sapiens
accagacccacctggagcccg

SEQ ID NO: 720321 - DNA, 23 bp, Homo sapiens
accagacccacctggagcccgct

SEQ ID NO: 720322 - DNA, 14 bp, Homo sapiens
accagacctcttct

SEQ ID NO: 720323 - DNA, 14 bp, Homo sapiens
accagacggggctg

SEQ ID NO: 720324 - DNA, 22 bp, Homo sapiens
accagactagatggacctgcct

SEQ ID NO: 720325 - DNA, 18 bp, Homo sapiens
accagactgtggagaaat

SEQ ID NO: 720326 - DNA, 21 bp, Homo sapiens
accagactgtggagaaataaa

SEQ ID NO: 720327 - DNA, 13 bp, Homo sapiens
accagactttgag

SEQ ID NO: 720328 - DNA, 20 bp, Homo sapiens
accagagataatatgagaat

SEQ ID NO: 720329 - DNA, 15 bp, Homo sapiens
accagagcagagagc

SEQ ID NO: 720330 - DNA, 14 bp, Homo sapiens
accagagccccaca

SEQ ID NO: 720331 - DNA, 17 bp, Homo sapiens
accagagccccacacgg

SEQ ID NO: 720332 - DNA, 14 bp, Homo sapiens
accagagccgggag

SEQ ID NO: 720333 - DNA, 17 bp, Homo sapiens
accagagccgggaggaa

SEQ ID NO: 720334 - DNA, 19 bp, Homo sapiens
accagagctctatccccat

SEQ ID NO: 720335 - DNA, 15 bp, Homo sapiens
accagaggaagttat

SEQ ID NO: 720336 - DNA, 15 bp, Homo sapiens
accagaggctgcaga

SEQ ID NO: 720337 - DNA, 16 bp, Homo sapiens
accagagggcatgctg

SEQ ID NO: 720338 - DNA, 15 bp, Homo sapiens
accagagggtgtggc

SEQ ID NO: 720339 - DNA, 22 bp, Homo sapiens
accagagtgctgaaggaatgga

SEQ ID NO: 720340 - DNA, 17 bp, Homo sapiens
accagataaatagaact

SEQ ID NO: 720341 - DNA, 21 bp, Homo sapiens
accagataagaatgctggttt

SEQ ID NO: 720342 - DNA, 14 bp, Homo sapiens
accagatctttctc

SEQ ID NO: 720343 - DNA, 17 bp, Homo sapiens
accagatctttctcttc

SEQ ID NO: 720344 - DNA, 20 bp, Homo sapiens
accagatctttctcttccct

SEQ ID NO: 720345 - DNA, 21 bp, Homo sapiens
accagatctttctcttccctg

SEQ ID NO: 720346 - DNA, 14 bp, Homo sapiens
accagcaaacagct

SEQ ID NO: 720347 - DNA, 16 bp, Homo sapiens
accagcaaacagctga

SEQ ID NO: 720348 - DNA, 19 bp, Homo sapiens
accagcaacatctcgagcc

SEQ ID NO: 720349 - DNA, 17 bp, Homo sapiens
accagcaattctctttc

SEQ ID NO: 720350 - DNA, 14 bp, Homo sapiens
accagcaatttaga

SEQ ID NO: 720351 - DNA, 22 bp, Homo sapiens
accagcaccttcaagcgctcca

SEQ ID NO: 720352 - DNA, 19 bp, Homo sapiens
accagcagacagagccagg

SEQ ID NO: 720353 - DNA, 20 bp, Homo sapiens
accagcagacagagccagga

SEQ ID NO: 720354 - DNA, 15 bp, Homo sapiens
accagcagcacaatt

SEQ ID NO: 720355 - DNA, 14 bp, Homo sapiens
accagcagcctgga

SEQ ID NO: 720356 - DNA, 17 bp, Homo sapiens
accagcagcgcctttcc

SEQ ID NO: 720357 - DNA, 13 bp, Homo sapiens
accagcaggtgtg

SEQ ID NO: 720358 - DNA, 23 bp, Homo sapiens
accagcaggtgtggtggctcatg

SEQ ID NO: 720359 - DNA, 16 bp, Homo sapiens
accagcatttgtcctt

SEQ ID NO: 720360 - DNA, 20 bp, Homo sapiens
accagcatttgtccttttgt

SEQ ID NO: 720361 - DNA, 12 bp, Homo sapiens
accagccagccc

SEQ ID NO: 720362 - DNA, 14 bp, Homo sapiens
accagccagccctg

SEQ ID NO: 720363 - DNA, 14 bp, Homo sapiens
accagccagcctca

SEQ ID NO: 720364 - DNA, 11 bp, Homo sapiens
accagccaggc

SEQ ID NO: 720365 - DNA, 11 bp, Homo sapiens
accagcccagc

SEQ ID NO: 720366 - DNA, 13 bp, Homo sapiens
accagcccagcct

SEQ ID NO: 720367 - DNA, 17 bp, Homo sapiens
accagcccagcctgccc

SEQ ID NO: 720368 - DNA, 18 bp, Homo sapiens
accagcccattggccgag

SEQ ID NO: 720369 - DNA, 19 bp, Homo sapiens
accagcccattggccgagc

SEQ ID NO: 720370 - DNA, 20 bp, Homo sapiens
accagccccactgccagcag

SEQ ID NO: 720371 - DNA, 23 bp, Homo sapiens
accagccccactgccagcagcag

SEQ ID NO: 720372 - DNA, 16 bp, Homo sapiens
accagccccacttctg

SEQ ID NO: 720373 - DNA, 20 bp, Homo sapiens
accagcccccgccccagagt

SEQ ID NO: 720374 - DNA, 17 bp, Homo sapiens
accagccccctggatgg

SEQ ID NO: 720375 - DNA, 19 bp, Homo sapiens
accagccccctggatgggc

SEQ ID NO: 720376 - DNA, 22 bp, Homo sapiens
accagccctagctgtcccatgg

SEQ ID NO: 720377 - DNA, 16 bp, Homo sapiens
accagccgccccagcc

SEQ ID NO: 720378 - DNA, 15 bp, Homo sapiens
accagccgctgcagg

SEQ ID NO: 720379 - DNA, 15 bp, Homo sapiens
accagccgtatttta

SEQ ID NO: 720380 - DNA, 14 bp, Homo sapiens
accagcctagcctg

SEQ ID NO: 720381 - DNA, 14 bp, Homo sapiens
accagcctccatgc

SEQ ID NO: 720382 - DNA, 14 bp, Homo sapiens
accagcctgaccaa

SEQ ID NO: 720383 - DNA, 17 bp, Homo sapiens
accagcctgctgacaga

SEQ ID NO: 720384 - DNA, 22 bp, Homo sapiens
accagcctgctgacagacacta

SEQ ID NO: 720385 - DNA, 11 bp, Homo sapiens
accagcctggc

SEQ ID NO: 720386 - DNA, 13 bp, Homo sapiens
accagcctgggca

SEQ ID NO: 720387 - DNA, 14 bp, Homo sapiens
accagcctgggcag

SEQ ID NO: 720388 - DNA, 23 bp, Homo sapiens
accagcctgtcacccagctcctc

SEQ ID NO: 720389 - DNA, 22 bp, Homo sapiens
accagcctttgggtcctgggca

SEQ ID NO: 720390 - DNA, 14 bp, Homo sapiens
accagcgcccccag

SEQ ID NO: 720391 - DNA, 20 bp, Homo sapiens
accagcgcccgctgggctga

SEQ ID NO: 720392 - DNA, 17 bp, Homo sapiens
accagcgttcccttctc

SEQ ID NO: 720393 - DNA, 20 bp, Homo sapiens
accagcgttcccttctcccc

SEQ ID NO: 720394 - DNA, 20 bp, Homo sapiens
accagctaaggagtccctgg

SEQ ID NO: 720395 - DNA, 19 bp, Homo sapiens
accagctatctgtcatctc

SEQ ID NO: 720396 - DNA, 20 bp, Homo sapiens
accagctcaggggacactgg

SEQ ID NO: 720397 - DNA, 15 bp, Homo sapiens
accagctcatctcca

SEQ ID NO: 720398 - DNA, 23 bp, Homo sapiens
accagctccacacattccagcca

SEQ ID NO: 720399 - DNA, 17 bp, Homo sapiens
accagctcctccagccc

SEQ ID NO: 720400 - DNA, 21 bp, Homo sapiens
accagctcgtttttcagcacc

SEQ ID NO: 720401 - DNA, 23 bp, Homo sapiens
accagctcgtttttcagcacccc

SEQ ID NO: 720402 - DNA, 12 bp, Homo sapiens
accagctctgtg

SEQ ID NO: 720403 - DNA, 15 bp, Homo sapiens
accagctctgtggcc

SEQ ID NO: 720404 - DNA, 17 bp, Homo sapiens
accagctctgtggcctg

SEQ ID NO: 720405 - DNA, 19 bp, Homo sapiens
accagctctgtggcctgtg

SEQ ID NO: 720406 - DNA, 14 bp, Homo sapiens
accagctgcctctt

SEQ ID NO: 720407 - DNA, 15 bp, Homo sapiens
accagctgcctcttc

SEQ ID NO: 720408 - DNA, 16 bp, Homo sapiens
accagctgcgcttgct

SEQ ID NO: 720409 - DNA, 20 bp, Homo sapiens
accagctgcgcttgcttttc

SEQ ID NO: 720410 - DNA, 13 bp, Homo sapiens
accagctgctctg

SEQ ID NO: 720411 - DNA, 15 bp, Homo sapiens
accagctgctctgcc

SEQ ID NO: 720412 - DNA, 10 bp, Homo sapiens
accagctggg

SEQ ID NO: 720413 - DNA, 11 bp, Homo sapiens
accagctgggg

SEQ ID NO: 720414 - DNA, 20 bp, Homo sapiens
accagcttagccaacatagt

SEQ ID NO: 720415 - DNA, 16 bp, Homo sapiens
accagcttctccaggc

SEQ ID NO: 720416 - DNA, 16 bp, Homo sapiens
accaggaagtgtttat

SEQ ID NO: 720417 - DNA, 15 bp, Homo sapiens
accaggacaggacca

SEQ ID NO: 720418 - DNA, 19 bp, Homo sapiens
accaggactatagcccagg

SEQ ID NO: 720419 - DNA, 16 bp, Homo sapiens
accaggactccctcct

SEQ ID NO: 720420 - DNA, 19 bp, Homo sapiens
accaggacttggggtcagg

SEQ ID NO: 720421 - DNA, 18 bp, Homo sapiens
accaggagaaccactaca

SEQ ID NO: 720422 - DNA, 18 bp, Homo sapiens
accaggagcacctggacc

SEQ ID NO: 720423 - DNA, 13 bp, Homo sapiens
accaggagcagca

SEQ ID NO: 720424 - DNA, 15 bp, Homo sapiens
accaggagcagcagc

SEQ ID NO: 720425 - DNA, 20 bp, Homo sapiens
accaggagcagcagccagca

SEQ ID NO: 720426 - DNA, 22 bp, Homo sapiens
accaggagcagcagccagcacc

SEQ ID NO: 720427 - DNA, 19 bp, Homo sapiens
accaggaggattgccttta

SEQ ID NO: 720428 - DNA, 14 bp, Homo sapiens
accaggatggccct

SEQ ID NO: 720429 - DNA, 19 bp, Homo sapiens
accaggcaccaaaagaagt

SEQ ID NO: 720430 - DNA, 21 bp, Homo sapiens
accaggcaccaaaagaagtaa

SEQ ID NO: 720431 - DNA, 16 bp, Homo sapiens
accaggcagctgagac

SEQ ID NO: 720432 - DNA, 22 bp, Homo sapiens
accaggcagctgagaccagggt

SEQ ID NO: 720433 - DNA, 14 bp, Homo sapiens
accaggccacctcc

SEQ ID NO: 720434 - DNA, 20 bp, Homo sapiens
accaggccgtcctcccgggc

SEQ ID NO: 720435 - DNA, 18 bp, Homo sapiens
accaggcctcactggctc

SEQ ID NO: 720436 - DNA, 20 bp, Homo sapiens
accaggcctcactggctcat

SEQ ID NO: 720437 - DNA, 14 bp, Homo sapiens
accaggcctggagg

SEQ ID NO: 720438 - DNA, 17 bp, Homo sapiens
accaggcctggagggca

SEQ ID NO: 720439 - DNA, 18 bp, Homo sapiens
accaggcctggagggcac

SEQ ID NO: 720440 - DNA, 17 bp, Homo sapiens
accaggctgcctccctt

SEQ ID NO: 720441 - DNA, 16 bp, Homo sapiens
accaggctggcgcagc

SEQ ID NO: 720442 - DNA, 19 bp, Homo sapiens
accagggagcttcctggct

SEQ ID NO: 720443 - DNA, 22 bp, Homo sapiens
accagggagcttcctggctctg

SEQ ID NO: 720444 - DNA, 22 bp, Homo sapiens
accagggatgctgggctgggcc

SEQ ID NO: 720445 - DNA, 17 bp, Homo sapiens
accagggccctgggcag

SEQ ID NO: 720446 - DNA, 15 bp, Homo sapiens
accagggcctccctg

SEQ ID NO: 720447 - DNA, 15 bp, Homo sapiens
accagggctccagcc

SEQ ID NO: 720448 - DNA, 22 bp, Homo sapiens
accaggggaaggaaggagggca

SEQ ID NO: 720449 - DNA, 16 bp, Homo sapiens
accaggggaggcagtg

SEQ ID NO: 720450 - DNA, 14 bp, Homo sapiens
accaggggtttctc

SEQ ID NO: 720451 - DNA, 20 bp, Homo sapiens
accagggtccgcaccagctg

SEQ ID NO: 720452 - DNA, 22 bp, Homo sapiens
accagggtccgcaccagctgct

SEQ ID NO: 720453 - DNA, 23 bp, Homo sapiens
accagggtggaccaggcctggag

SEQ ID NO: 720454 - DNA, 15 bp, Homo sapiens
accaggtcaccatcc

SEQ ID NO: 720455 - DNA, 20 bp, Homo sapiens
accaggtcaccatcctcaga

SEQ ID NO: 720456 - DNA, 20 bp, Homo sapiens
accaggtgatctattcattg

SEQ ID NO: 720457 - DNA, 17 bp, Homo sapiens
accaggtgcctttcaaa

SEQ ID NO: 720458 - DNA, 14 bp, Homo sapiens
accaggttaaaatt

SEQ ID NO: 720459 - DNA, 14 bp, Homo sapiens
accaggttgcagta

SEQ ID NO: 720460 - DNA, 23 bp, Homo sapiens
accagtattctaaagttttgcaa

SEQ ID NO: 720461 - DNA, 11 bp, Homo sapiens
accagtattta

SEQ ID NO: 720462 - DNA, 19 bp, Homo sapiens
accagtcccgtcgtgcagt

SEQ ID NO: 720463 - DNA, 20 bp, Homo sapiens
accagtcccgtcgtgcagtc

SEQ ID NO: 720464 - DNA, 18 bp, Homo sapiens
accagtcctatttttcaa

SEQ ID NO: 720465 - DNA, 11 bp, Homo sapiens
accagtctatt

SEQ ID NO: 720466 - DNA, 13 bp, Homo sapiens
accagtctcctca

SEQ ID NO: 720467 - DNA, 14 bp, Homo sapiens
accagtctcctcac

SEQ ID NO: 720468 - DNA, 14 bp, Homo sapiens
accagtctgtctac

SEQ ID NO: 720469 - DNA, 19 bp, Homo sapiens
accagtctgtctactgtgg

SEQ ID NO: 720470 - DNA, 14 bp, Homo sapiens
accagtgaaccaaa

SEQ ID NO: 720471 - DNA, 17 bp, Homo sapiens
accagtgaaccaaagag

SEQ ID NO: 720472 - DNA, 18 bp, Homo sapiens
accagtgaaccaaagaga

SEQ ID NO: 720473 - DNA, 14 bp, Homo sapiens
accagtgagcgctt

SEQ ID NO: 720474 - DNA, 22 bp, Homo sapiens
accagtgcccaaagtctgtgtg

SEQ ID NO: 720475 - DNA, 12 bp, Homo sapiens
accagtggacct

SEQ ID NO: 720476 - DNA, 19 bp, Homo sapiens
accagtggacctagcctgg

SEQ ID NO: 720477 - DNA, 14 bp, Homo sapiens
accagtggcctttc

SEQ ID NO: 720478 - DNA, 23 bp, Homo sapiens
accagtggcgttgttgcatgttt

SEQ ID NO: 720479 - DNA, 23 bp, Homo sapiens
accagtgggatgggctctacctc

SEQ ID NO: 720480 - DNA, 20 bp, Homo sapiens
accagtgtagcatcttcctc

SEQ ID NO: 720481 - DNA, 21 bp, Homo sapiens
accagtgtagccttgcccgga

SEQ ID NO: 720482 - DNA, 15 bp, Homo sapiens
accagtgttcctgaa

SEQ ID NO: 720483 - DNA, 17 bp, Homo sapiens
accagtgttgtggattt

SEQ ID NO: 720484 - DNA, 18 bp, Homo sapiens
accagtgttgtggattta

SEQ ID NO: 720485 - DNA, 15 bp, Homo sapiens
accagttaaagccac

SEQ ID NO: 720486 - DNA, 14 bp, Homo sapiens
accagttaattact

SEQ ID NO: 720487 - DNA, 14 bp, Homo sapiens
accagttaattttt

SEQ ID NO: 720488 - DNA, 24 bp, Homo sapiens
accagttgaataaaagtgcacacc

SEQ ID NO: 720489 - DNA, 20 bp, Homo sapiens
accagttgccctagcccaga

SEQ ID NO: 720490 - DNA, 15 bp, Homo sapiens
accagttgcctttta

SEQ ID NO: 720491 - DNA, 14 bp, Homo sapiens
accagtttattctg

SEQ ID NO: 720492 - DNA, 13 bp, Homo sapiens
accagtttgcatg

SEQ ID NO: 720493 - DNA, 14 bp, Homo sapiens
accagtttgcatga

SEQ ID NO: 720494 - DNA, 18 bp, Homo sapiens
accagttttgagtgtact

SEQ ID NO: 720495 - DNA, 21 bp, Homo sapiens
accagttttgagtgtactgtg

SEQ ID NO: 720496 - DNA, 18 bp, Homo sapiens
accataaagcctttaaaa

SEQ ID NO: 720497 - DNA, 19 bp, Homo sapiens
accataaagcctttaaaac

SEQ ID NO: 720498 - DNA, 13 bp, Homo sapiens
accataaatcaat

SEQ ID NO: 720499 - DNA, 22 bp, Homo sapiens
accataagtgacaccaataaat

SEQ ID NO: 720500 - DNA, 13 bp, Homo sapiens
accataatgttac

SEQ ID NO: 720501 - DNA, 15 bp, Homo sapiens
accataatgttacat

SEQ ID NO: 720502 - DNA, 18 bp, Homo sapiens
accataatgttacattat

SEQ ID NO: 720503 - DNA, 20 bp, Homo sapiens
accataccactttgacacgc

SEQ ID NO: 720504 - DNA, 15 bp, Homo sapiens
accataccttccttc

SEQ ID NO: 720505 - DNA, 16 bp, Homo sapiens
accataccttccttcc

SEQ ID NO: 720506 - DNA, 17 bp, Homo sapiens
accataccttccttccc

SEQ ID NO: 720507 - DNA, 16 bp, Homo sapiens
accatactcctctcct

SEQ ID NO: 720508 - DNA, 13 bp, Homo sapiens
accatactgtctc

SEQ ID NO: 720509 - DNA, 16 bp, Homo sapiens
accatagaaaaatgta

SEQ ID NO: 720510 - DNA, 22 bp, Homo sapiens
accataggaagacataaaactt

SEQ ID NO: 720511 - DNA, 14 bp, Homo sapiens
accatagggctggg

SEQ ID NO: 720512 - DNA, 16 bp, Homo sapiens
accatagggctgggga

SEQ ID NO: 720513 - DNA, 16 bp, Homo sapiens
accatattggtcacgt

SEQ ID NO: 720514 - DNA, 22 bp, Homo sapiens
accatcaaaggaatataagaaa

SEQ ID NO: 720515 - DNA, 12 bp, Homo sapiens
accatcaataaa

SEQ ID NO: 720516 - DNA, 13 bp, Homo sapiens
accatcaccaccg

SEQ ID NO: 720517 - DNA, 16 bp, Homo sapiens
accatcaccaccgcct

SEQ ID NO: 720518 - DNA, 20 bp, Homo sapiens
accatcaccaccgcctctgg

SEQ ID NO: 720519 - DNA, 19 bp, Homo sapiens
accatccaccttcccttct

SEQ ID NO: 720520 - DNA, 17 bp, Homo sapiens
accatccccaccccacc

SEQ ID NO: 720521 - DNA, 14 bp, Homo sapiens
accatccctgaaga

SEQ ID NO: 720522 - DNA, 21 bp, Homo sapiens
accatccctttttgaagtgta

SEQ ID NO: 720523 - DNA, 21 bp, Homo sapiens
accatcctcagaggctgagcc

SEQ ID NO: 720524 - DNA, 17 bp, Homo sapiens
accatcctgcagcctcc

SEQ ID NO: 720525 - DNA, 13 bp, Homo sapiens
accatcctggccc

SEQ ID NO: 720526 - DNA, 17 bp, Homo sapiens
accatcctggcccctcc

SEQ ID NO: 720527 - DNA, 12 bp, Homo sapiens
accatcctggct

SEQ ID NO: 720528 - DNA, 22 bp, Homo sapiens
accatcctggctaacatggtga

SEQ ID NO: 720529 - DNA, 19 bp, Homo sapiens
accatccttacaatgtaaa

SEQ ID NO: 720530 - DNA, 19 bp, Homo sapiens
accatcgcctctgtctcct

SEQ ID NO: 720531 - DNA, 18 bp, Homo sapiens
accatcgtccagccctcc

SEQ ID NO: 720532 - DNA, 21 bp, Homo sapiens
accatctcagacctttactga

SEQ ID NO: 720533 - DNA, 13 bp, Homo sapiens
accatctcaggcc

SEQ ID NO: 720534 - DNA, 14 bp, Homo sapiens
accatctcaggcca

SEQ ID NO: 720535 - DNA, 11 bp, Homo sapiens
accatctctgt

SEQ ID NO: 720536 - DNA, 12 bp, Homo sapiens
accatctgctgc

SEQ ID NO: 720537 - DNA, 15 bp, Homo sapiens
accatctgctgcagt

SEQ ID NO: 720538 - DNA, 19 bp, Homo sapiens
accatctgctgcagttacc

SEQ ID NO: 720539 - DNA, 14 bp, Homo sapiens
accatctgctttta

SEQ ID NO: 720540 - DNA, 18 bp, Homo sapiens
accatctgcttttattaa

SEQ ID NO: 720541 - DNA, 20 bp, Homo sapiens
accatctggggcacctgctt

SEQ ID NO: 720542 - DNA, 16 bp, Homo sapiens
accatctgtttgaaga

SEQ ID NO: 720543 - DNA, 18 bp, Homo sapiens
accatcttaaatgacagt

SEQ ID NO: 720544 - DNA, 18 bp, Homo sapiens
accatcttcataatttgc

SEQ ID NO: 720545 - DNA, 19 bp, Homo sapiens
accatcttttattcttttt

SEQ ID NO: 720546 - DNA, 23 bp, Homo sapiens
accatgaacagaaaacattctga

SEQ ID NO: 720547 - DNA, 12 bp, Homo sapiens
accatgaacttg

SEQ ID NO: 720548 - DNA, 23 bp, Homo sapiens
accatgaccccttctctctccag

SEQ ID NO: 720549 - DNA, 17 bp, Homo sapiens
accatgaccctacataa

SEQ ID NO: 720550 - DNA, 18 bp, Homo sapiens
accatgagaagagggcct

SEQ ID NO: 720551 - DNA, 20 bp, Homo sapiens
accatgagaagagggcctgt

SEQ ID NO: 720552 - DNA, 21 bp, Homo sapiens
accatgagaagagggcctgtg

SEQ ID NO: 720553 - DNA, 20 bp, Homo sapiens
accatgatcacttatcagtt

SEQ ID NO: 720554 - DNA, 23 bp, Homo sapiens
accatgattaaccacttcagctg

SEQ ID NO: 720555 - DNA, 21 bp, Homo sapiens
accatgcactatatttgtata

SEQ ID NO: 720556 - DNA, 14 bp, Homo sapiens
accatgcactgtaa

SEQ ID NO: 720557 - DNA, 16 bp, Homo sapiens
accatgcagcccctgg

SEQ ID NO: 720558 - DNA, 16 bp, Homo sapiens
accatgcatttaaagt

SEQ ID NO: 720559 - DNA, 18 bp, Homo sapiens
accatgcatttaaagtat

SEQ ID NO: 720560 - DNA, 20 bp, Homo sapiens
accatgccagattctgcctc

SEQ ID NO: 720561 - DNA, 19 bp, Homo sapiens
accatgccttttttttaag

SEQ ID NO: 720562 - DNA, 17 bp, Homo sapiens
accatgcgtcaggggcc

SEQ ID NO: 720563 - DNA, 20 bp, Homo sapiens
accatgctcatctgctggtc

SEQ ID NO: 720564 - DNA, 12 bp, Homo sapiens
accatgctgctt

SEQ ID NO: 720565 - DNA, 23 bp, Homo sapiens
accatgctgctttttggcacagt

SEQ ID NO: 720566 - DNA, 15 bp, Homo sapiens
accatggctgaagga

SEQ ID NO: 720567 - DNA, 12 bp, Homo sapiens
accatgggacca

SEQ ID NO: 720568 - DNA, 19 bp, Homo sapiens
accatgggaggtggggcct

SEQ ID NO: 720569 - DNA, 23 bp, Homo sapiens
accatggttttggctctcccacc

SEQ ID NO: 720570 - DNA, 11 bp, Homo sapiens
accatgtacat

SEQ ID NO: 720571 - DNA, 18 bp, Homo sapiens
accatgtcagcaaaaagc

SEQ ID NO: 720572 - DNA, 15 bp, Homo sapiens
accatgtcatttcag

SEQ ID NO: 720573 - DNA, 14 bp, Homo sapiens
accatgtctttctc

SEQ ID NO: 720574 - DNA, 16 bp, Homo sapiens
accatgtctttctctc

SEQ ID NO: 720575 - DNA, 14 bp, Homo sapiens
accatgtgcaataa

SEQ ID NO: 720576 - DNA, 23 bp, Homo sapiens
accatgtgcaataagattggtgt

SEQ ID NO: 720577 - DNA, 15 bp, Homo sapiens
accatgtgtcacttg

SEQ ID NO: 720578 - DNA, 14 bp, Homo sapiens
accatgttagcctt

SEQ ID NO: 720579 - DNA, 15 bp, Homo sapiens
accatgttagcctta

SEQ ID NO: 720580 - DNA, 16 bp, Homo sapiens
accatgttcattataa

SEQ ID NO: 720581 - DNA, 18 bp, Homo sapiens
accatgttcattataatc

SEQ ID NO: 720582 - DNA, 22 bp, Homo sapiens
accatgttggccaggctggtct

SEQ ID NO: 720583 - DNA, 22 bp, Homo sapiens
accatgttggtcaggctggtct

SEQ ID NO: 720584 - DNA, 12 bp, Homo sapiens
accatgtttgag

SEQ ID NO: 720585 - DNA, 19 bp, Homo sapiens
accattaaaactgcttttt

SEQ ID NO: 720586 - DNA, 15 bp, Homo sapiens
accattaaagtcaga

SEQ ID NO: 720587 - DNA, 15 bp, Homo sapiens
accattaacattttt

SEQ ID NO: 720588 - DNA, 22 bp, Homo sapiens
accattaattacatacagattt

SEQ ID NO: 720589 - DNA, 14 bp, Homo sapiens
accattacatgttt

SEQ ID NO: 720590 - DNA, 15 bp, Homo sapiens
accattactgagggg

SEQ ID NO: 720591 - DNA, 12 bp, Homo sapiens
accattattcac

SEQ ID NO: 720592 - DNA, 13 bp, Homo sapiens
accattcacattt

SEQ ID NO: 720593 - DNA, 23 bp, Homo sapiens
accattcagatcactgaatttat

SEQ ID NO: 720594 - DNA, 17 bp, Homo sapiens
accattcatctctaaca

SEQ ID NO: 720595 - DNA, 12 bp, Homo sapiens
accattccccat

SEQ ID NO: 720596 - DNA, 19 bp, Homo sapiens
accattcctgcctttaagc

SEQ ID NO: 720597 - DNA, 13 bp, Homo sapiens
accattcctgtcc

SEQ ID NO: 720598 - DNA, 15 bp, Homo sapiens
accattcctgtccct

SEQ ID NO: 720599 - DNA, 20 bp, Homo sapiens
accattcctgtccctttgtt

SEQ ID NO: 720600 - DNA, 15 bp, Homo sapiens
accattccttcaaat

SEQ ID NO: 720601 - DNA, 23 bp, Homo sapiens
accattctaggtgtttcaacaga

SEQ ID NO: 720602 - DNA, 13 bp, Homo sapiens
accattctgactc

SEQ ID NO: 720603 - DNA, 21 bp, Homo sapiens
accattctgactcggtttctc

SEQ ID NO: 720604 - DNA, 20 bp, Homo sapiens
accattctgcctctcctcag

SEQ ID NO: 720605 - DNA, 13 bp, Homo sapiens
accattgaaggct

SEQ ID NO: 720606 - DNA, 18 bp, Homo sapiens
accattgaattcttggtt

SEQ ID NO: 720607 - DNA, 18 bp, Homo sapiens
accattgacctcagctgc

SEQ ID NO: 720608 - DNA, 21 bp, Homo sapiens
accattgcactctagcctggc

SEQ ID NO: 720609 - DNA, 11 bp, Homo sapiens
accattgcttc

SEQ ID NO: 720610 - DNA, 16 bp, Homo sapiens
accattgcttcactac

SEQ ID NO: 720611 - DNA, 20 bp, Homo sapiens
accattgcttcactacccat

SEQ ID NO: 720612 - DNA, 17 bp, Homo sapiens
accattggctgcgctaa

SEQ ID NO: 720613 - DNA, 14 bp, Homo sapiens
accatttaaaaatg

SEQ ID NO: 720614 - DNA, 15 bp, Homo sapiens
accatttacatgcac

SEQ ID NO: 720615 - DNA, 22 bp, Homo sapiens
accatttatacaaattagaaaa

SEQ ID NO: 720616 - DNA, 23 bp, Homo sapiens
accatttatacaaattagaaaat

SEQ ID NO: 720617 - DNA, 18 bp, Homo sapiens
accatttatgaaggtttg

SEQ ID NO: 720618 - DNA, 11 bp, Homo sapiens
accatttcaga

SEQ ID NO: 720619 - DNA, 16 bp, Homo sapiens
accatttcttggcatt

SEQ ID NO: 720620 - DNA, 15 bp, Homo sapiens
accattttcaatttg

SEQ ID NO: 720621 - DNA, 14 bp, Homo sapiens
accattttcctttg

SEQ ID NO: 720622 - DNA, 15 bp, Homo sapiens
accatttttgttact

SEQ ID NO: 720623 - DNA, 13 bp, Homo sapiens
acccaaaaagaga

SEQ ID NO: 720624 - DNA, 18 bp, Homo sapiens
acccaaacacttctgctt

SEQ ID NO: 720625 - DNA, 14 bp, Homo sapiens
acccaaacccccaa

SEQ ID NO: 720626 - DNA, 15 bp, Homo sapiens
acccaaaccccttcc

SEQ ID NO: 720627 - DNA, 14 bp, Homo sapiens
acccaaagcacatg

SEQ ID NO: 720628 - DNA, 14 bp, Homo sapiens
acccaaagcaggat

SEQ ID NO: 720629 - DNA, 16 bp, Homo sapiens
acccaaagccctggta

SEQ ID NO: 720630 - DNA, 17 bp, Homo sapiens
acccaaagcggtccctg

SEQ ID NO: 720631 - DNA, 15 bp, Homo sapiens
acccaaatgtccctg

SEQ ID NO: 720632 - DNA, 12 bp, Homo sapiens
acccaacagttt

SEQ ID NO: 720633 - DNA, 15 bp, Homo sapiens
acccaacagtttatt

SEQ ID NO: 720634 - DNA, 12 bp, Homo sapiens
acccaaccactc

SEQ ID NO: 720635 - DNA, 18 bp, Homo sapiens
acccaaccctatctcctg

SEQ ID NO: 720636 - DNA, 23 bp, Homo sapiens
acccaacggccctgcagccagct

SEQ ID NO: 720637 - DNA, 16 bp, Homo sapiens
acccaagacatgacat

SEQ ID NO: 720638 - DNA, 15 bp, Homo sapiens
acccaagatgaatta

SEQ ID NO: 720639 - DNA, 21 bp, Homo sapiens
acccaagcctgatccagcctt

SEQ ID NO: 720640 - DNA, 16 bp, Homo sapiens
acccaagctctgggga

SEQ ID NO: 720641 - DNA, 20 bp, Homo sapiens
acccaagctgtggcagccgt

SEQ ID NO: 720642 - DNA, 16 bp, Homo sapiens
acccaaggagcacagg

SEQ ID NO: 720643 - DNA, 22 bp, Homo sapiens
acccaaggagcacaggtcccac

SEQ ID NO: 720644 - DNA, 16 bp, Homo sapiens
acccaagtgaaggttc

SEQ ID NO: 720645 - DNA, 23 bp, Homo sapiens
acccaagtgaaggttcccaagga

SEQ ID NO: 720646 - DNA, 15 bp, Homo sapiens
acccaatccctctcc

SEQ ID NO: 720647 - DNA, 18 bp, Homo sapiens
acccaatccctctccact

SEQ ID NO: 720648 - DNA, 15 bp, Homo sapiens
acccaatgcctgtga

SEQ ID NO: 720649 - DNA, 22 bp, Homo sapiens
acccaatgtctcccacacccac

SEQ ID NO: 720650 - DNA, 24 bp, Homo sapiens
acccgctggagcccacagcgagcc

SEQ ID NO: 720651 - DNA, 23 bp, Homo sapiens
acccggagctaacactggcccct

SEQ ID NO: 720652 - DNA, 16 bp, Homo sapiens
acccggagctaagtca

SEQ ID NO: 720653 - DNA, 18 bp, Homo sapiens
acccggaggggcctggca

SEQ ID NO: 720654 - DNA, 21 bp, Homo sapiens
acccggaggggcctggcagcc

SEQ ID NO: 720655 - DNA, 14 bp, Homo sapiens
acccggcccagaga

SEQ ID NO: 720656 - DNA, 22 bp, Homo sapiens
acccggctgggtcggccctgcc

SEQ ID NO: 720657 - DNA, 23 bp, Homo sapiens
acccggctgggtcggccctgccc

SEQ ID NO: 720658 - DNA, 21 bp, Homo sapiens
acccgggcaagggtcctcttt

SEQ ID NO: 720659 - DNA, 15 bp, Homo sapiens
acccggggccagaga

SEQ ID NO: 720660 - DNA, 16 bp, Homo sapiens
acccgggggagcccag

SEQ ID NO: 720661 - DNA, 20 bp, Homo sapiens
acccgggggagcccagtgaa

SEQ ID NO: 720662 - DNA, 19 bp, Homo sapiens
acccggggtctcctggacc

SEQ ID NO: 720663 - DNA, 19 bp, Homo sapiens
acccggtgctccctctgtc

SEQ ID NO: 720664 - DNA, 20 bp, Homo sapiens
acccggttattcgcccaccc

SEQ ID NO: 720665 - DNA, 21 bp, Homo sapiens
acccggttgcagtcactgtga

SEQ ID NO: 720666 - DNA, 19 bp, Homo sapiens
acccgtaggcagcctctct

SEQ ID NO: 720667 - DNA, 13 bp, Homo sapiens
acccgtccattca

SEQ ID NO: 720668 - DNA, 17 bp, Homo sapiens
acccgtccattcagaaa

SEQ ID NO: 720669 - DNA, 15 bp, Homo sapiens
acccgtccattcttc

SEQ ID NO: 720670 - DNA, 16 bp, Homo sapiens
acccgtcctccctcag

SEQ ID NO: 720671 - DNA, 17 bp, Homo sapiens
acccgtcctccctcagc

SEQ ID NO: 720672 - DNA, 22 bp, Homo sapiens
acccgtcctccctcagcctccc

SEQ ID NO: 720673 - DNA, 23 bp, Homo sapiens
acccgtcctccctcagcctcccc

SEQ ID NO: 720674 - DNA, 16 bp, Homo sapiens
acccgtgacagtggct

SEQ ID NO: 720675 - DNA, 23 bp, Homo sapiens
acccgtgcctgggcccctcccct

SEQ ID NO: 720676 - DNA, 18 bp, Homo sapiens
acccgttctgctggcctg

SEQ ID NO: 720677 - DNA, 23 bp, Homo sapiens
acccgttctgctggcctggatct

SEQ ID NO: 720678 - DNA, 20 bp, Homo sapiens
acccgtttcccggttcagga

SEQ ID NO: 720679 - DNA, 19 bp, Homo sapiens
accctaaaattctagggga

SEQ ID NO: 720680 - DNA, 15 bp, Homo sapiens
accctaaagggagaa

SEQ ID NO: 720681 - DNA, 16 bp, Homo sapiens
accctaagcctccttt

SEQ ID NO: 720682 - DNA, 15 bp, Homo sapiens
accctaagggcagcc

SEQ ID NO: 720683 - DNA, 19 bp, Homo sapiens
accctaagggcagccctcc

SEQ ID NO: 720684 - DNA, 16 bp, Homo sapiens
accctaccagctcctc

SEQ ID NO: 720685 - DNA, 14 bp, Homo sapiens
accctaccccacca

SEQ ID NO: 720686 - DNA, 20 bp, Homo sapiens
accctacgctcatctctgga

SEQ ID NO: 720687 - DNA, 14 bp, Homo sapiens
accctactctggat

SEQ ID NO: 720688 - DNA, 19 bp, Homo sapiens
accctactgaagtggctgg

SEQ ID NO: 720689 - DNA, 14 bp, Homo sapiens
accctactgtgggg

SEQ ID NO: 720690 - DNA, 18 bp, Homo sapiens
accctacttcttttgctc

SEQ ID NO: 720691 - DNA, 16 bp, Homo sapiens
accctactttgcttcc

SEQ ID NO: 720692 - DNA, 16 bp, Homo sapiens
accctagaagaaaacc

SEQ ID NO: 720693 - DNA, 16 bp, Homo sapiens
accctagccaatgtct

SEQ ID NO: 720694 - DNA, 19 bp, Homo sapiens
accctagccaatgtctcct

SEQ ID NO: 720695 - DNA, 19 bp, Homo sapiens
accctagccattcctggta

SEQ ID NO: 720696 - DNA, 23 bp, Homo sapiens
accctagccattcctggtaccca

SEQ ID NO: 720697 - DNA, 22 bp, Homo sapiens
accctagtcccttcccctccct

SEQ ID NO: 720698 - DNA, 16 bp, Homo sapiens
accctagtttccctga

SEQ ID NO: 720699 - DNA, 23 bp, Homo sapiens
accctatattttgcatagtacca

SEQ ID NO: 720700 - DNA, 13 bp, Homo sapiens
accctatccctgt

SEQ ID NO: 720701 - DNA, 23 bp, Homo sapiens
accctatgggtctaggacacagt

SEQ ID NO: 720702 - DNA, 21 bp, Homo sapiens
accctattctatccatctcct

SEQ ID NO: 720703 - DNA, 22 bp, Homo sapiens
accctattctatccatctcctg

SEQ ID NO: 720704 - DNA, 14 bp, Homo sapiens
accctattgctgct

SEQ ID NO: 720705 - DNA, 17 bp, Homo sapiens
accctcaaaccctgtgg

SEQ ID NO: 720706 - DNA, 19 bp, Homo sapiens
accctcacacacacagctg

SEQ ID NO: 720707 - DNA, 22 bp, Homo sapiens
accctcacacacacagctgggc

SEQ ID NO: 720708 - DNA, 22 bp, Homo sapiens
accctcacccactctggtggcc

SEQ ID NO: 720709 - DNA, 14 bp, Homo sapiens
accctcaccccctc

SEQ ID NO: 720710 - DNA, 21 bp, Homo sapiens
accctcaccccctcctggcaa

SEQ ID NO: 720711 - DNA, 22 bp, Homo sapiens
accctcactgctggggagtccc

SEQ ID NO: 720712 - DNA, 17 bp, Homo sapiens
accctcagcaccccttc

SEQ ID NO: 720713 - DNA, 19 bp, Homo sapiens
accctcagcaccccttcca

SEQ ID NO: 720714 - DNA, 22 bp, Homo sapiens
accctcagctgtcacctgctca

SEQ ID NO: 720715 - DNA, 23 bp, Homo sapiens
accctcaggcataggcctgggtg

SEQ ID NO: 720716 - DNA, 20 bp, Homo sapiens
accctcaggtgtagctgagc

SEQ ID NO: 720717 - DNA, 18 bp, Homo sapiens
accctcatacacagaaac

SEQ ID NO: 720718 - DNA, 13 bp, Homo sapiens
accctcatgaaaa

SEQ ID NO: 720719 - DNA, 14 bp, Homo sapiens
accctcatgttctt

SEQ ID NO: 720720 - DNA, 15 bp, Homo sapiens
accctcatgttctta

SEQ ID NO: 720721 - DNA, 17 bp, Homo sapiens
accctcattgctgtctt

SEQ ID NO: 720722 - DNA, 16 bp, Homo sapiens
accctccaaaggaagg

SEQ ID NO: 720723 - DNA, 11 bp, Homo sapiens
accctccaaat

SEQ ID NO: 720724 - DNA, 14 bp, Homo sapiens
accctccaccctgt

SEQ ID NO: 720725 - DNA, 16 bp, Homo sapiens
accctccaccctgtcc

SEQ ID NO: 720726 - DNA, 12 bp, Homo sapiens
accctccacctt

SEQ ID NO: 720727 - DNA, 17 bp, Homo sapiens
accctccactcactgct

SEQ ID NO: 720728 - DNA, 13 bp, Homo sapiens
accctccagagtg

SEQ ID NO: 720729 - DNA, 16 bp, Homo sapiens
accctccatgctcctc

SEQ ID NO: 720730 - DNA, 15 bp, Homo sapiens
accctcccactccca

SEQ ID NO: 720731 - DNA, 22 bp, Homo sapiens
accctcccagaaacatctctgg

SEQ ID NO: 720732 - DNA, 14 bp, Homo sapiens
accctcccagtctc

SEQ ID NO: 720733 - DNA, 16 bp, Homo sapiens
accctcccatggcacc

SEQ ID NO: 720734 - DNA, 13 bp, Homo sapiens
accctcccctctc

SEQ ID NO: 720735 - DNA, 14 bp, Homo sapiens
accctcccctctct

SEQ ID NO: 720736 - DNA, 19 bp, Homo sapiens
accctccccttttatgcac

SEQ ID NO: 720737 - DNA, 12 bp, Homo sapiens
accctccctcag

SEQ ID NO: 720738 - DNA, 17 bp, Homo sapiens
accctccctcagcccct

SEQ ID NO: 720739 - DNA, 20 bp, Homo sapiens
accctccctcagcccctctt

SEQ ID NO: 720740 - DNA, 22 bp, Homo sapiens
accctccctccgatccttcctc

SEQ ID NO: 720741 - DNA, 15 bp, Homo sapiens
accctccgttgacag

SEQ ID NO: 720742 - DNA, 14 bp, Homo sapiens
accctcctcacaga

SEQ ID NO: 720743 - DNA, 14 bp, Homo sapiens
accctcctccctcc

SEQ ID NO: 720744 - DNA, 17 bp, Homo sapiens
accctcctccctccaag

SEQ ID NO: 720745 - DNA, 21 bp, Homo sapiens
accctcctctagccatccctt

SEQ ID NO: 720746 - DNA, 12 bp, Homo sapiens
accctcctctgc

SEQ ID NO: 720747 - DNA, 17 bp, Homo sapiens
accctcctctgctggga

SEQ ID NO: 720748 - DNA, 15 bp, Homo sapiens
accctcctcttggaa

SEQ ID NO: 720749 - DNA, 11 bp, Homo sapiens
accctcctggc

SEQ ID NO: 720750 - DNA, 12 bp, Homo sapiens
accctcctggcc

SEQ ID NO: 720751 - DNA, 16 bp, Homo sapiens
accctcctggccttcc

SEQ ID NO: 720752 - DNA, 18 bp, Homo sapiens
accctcctggccttcctc

SEQ ID NO: 720753 - DNA, 21 bp, Homo sapiens
accctcctggccttcctcgtt

SEQ ID NO: 720754 - DNA, 13 bp, Homo sapiens
accctcctggctc

SEQ ID NO: 720755 - DNA, 17 bp, Homo sapiens
accctcctgtaaatggt

SEQ ID NO: 720756 - DNA, 13 bp, Homo sapiens
accctccttccac

SEQ ID NO: 720757 - DNA, 15 bp, Homo sapiens
accctctcactagtg

SEQ ID NO: 720758 - DNA, 21 bp, Homo sapiens
accctctcctgggggtggcag

SEQ ID NO: 720759 - DNA, 13 bp, Homo sapiens
accctctcttccc

SEQ ID NO: 720760 - DNA, 14 bp, Homo sapiens
accctctcttccct

SEQ ID NO: 720761 - DNA, 22 bp, Homo sapiens
accctctgaatggtccagggtt

SEQ ID NO: 720762 - DNA, 23 bp, Homo sapiens
accctctggaggggtgtggctcc

SEQ ID NO: 720763 - DNA, 20 bp, Homo sapiens
accctctggattctgaatct

SEQ ID NO: 720764 - DNA, 15 bp, Homo sapiens
accctctgggaacct

SEQ ID NO: 720765 - DNA, 22 bp, Homo sapiens
accctctgggaacctcccagag

SEQ ID NO: 720766 - DNA, 23 bp, Homo sapiens
accctctgggaacctcccagagg

SEQ ID NO: 720767 - DNA, 20 bp, Homo sapiens
accctctgggagtccccatc

SEQ ID NO: 720768 - DNA, 11 bp, Homo sapiens
accctctgggg

SEQ ID NO: 720769 - DNA, 12 bp, Homo sapiens
accctctgggga

SEQ ID NO: 720770 - DNA, 14 bp, Homo sapiens
accctctggtcctt

SEQ ID NO: 720771 - DNA, 17 bp, Homo sapiens
accctctggtccttctg

SEQ ID NO: 720772 - DNA, 11 bp, Homo sapiens
accctctgtcc

SEQ ID NO: 720773 - DNA, 13 bp, Homo sapiens
accctctgtcccc

SEQ ID NO: 720774 - DNA, 17 bp, Homo sapiens
accctctgtccccacga

SEQ ID NO: 720775 - DNA, 15 bp, Homo sapiens
accctcttcctgtga

SEQ ID NO: 720776 - DNA, 19 bp, Homo sapiens
accctcttcctgtgatcca

SEQ ID NO: 720777 - DNA, 12 bp, Homo sapiens
accctcttgcca

SEQ ID NO: 720778 - DNA, 18 bp, Homo sapiens
accctcttgcccatcctg

SEQ ID NO: 720779 - DNA, 22 bp, Homo sapiens
accctcttgcccatcctgactg

SEQ ID NO: 720780 - DNA, 23 bp, Homo sapiens
accctcttgcccatcctgactga

SEQ ID NO: 720781 - DNA, 16 bp, Homo sapiens
accctctttgctgcag

SEQ ID NO: 720782 - DNA, 20 bp, Homo sapiens
accctcttttaccaacttcc

SEQ ID NO: 720783 - DNA, 21 bp, Homo sapiens
accctcttttaccaacttcct

SEQ ID NO: 720784 - DNA, 16 bp, Homo sapiens
accctgaacccacacc

SEQ ID NO: 720785 - DNA, 17 bp, Homo sapiens
accctgaacccacacct

SEQ ID NO: 720786 - DNA, 19 bp, Homo sapiens
accctgaacccacacctgg

SEQ ID NO: 720787 - DNA, 15 bp, Homo sapiens
accctgagactccag

SEQ ID NO: 720788 - DNA, 22 bp, Homo sapiens
accctgagctgaggcagcagtg

SEQ ID NO: 720789 - DNA, 14 bp, Homo sapiens
accctgaggaggcc

SEQ ID NO: 720790 - DNA, 16 bp, Homo sapiens
accctgaggaggccgc

SEQ ID NO: 720791 - DNA, 17 bp, Homo sapiens
accctgaggccctgggc

SEQ ID NO: 720792 - DNA, 18 bp, Homo sapiens
accctgaggccctgggct

SEQ ID NO: 720793 - DNA, 20 bp, Homo sapiens
accctgaggccctgggctgg

SEQ ID NO: 720794 - DNA, 18 bp, Homo sapiens
accctgaggcctctggaa

SEQ ID NO: 720795 - DNA, 14 bp, Homo sapiens
accctgaggtcagg

SEQ ID NO: 720796 - DNA, 23 bp, Homo sapiens
accctgaggtcagggagtgctgg

SEQ ID NO: 720797 - DNA, 16 bp, Homo sapiens
accctgagttcatcca

SEQ ID NO: 720798 - DNA, 19 bp, Homo sapiens
accctgagttgcttttcag

SEQ ID NO: 720799 - DNA, 17 bp, Homo sapiens
accctgagttttgtttt

SEQ ID NO: 720800 - DNA, 14 bp, Homo sapiens
accctgatctggac

SEQ ID NO: 720801 - DNA, 15 bp, Homo sapiens
accctgatctggacc

SEQ ID NO: 720802 - DNA, 14 bp, Homo sapiens
accctgatgaaaac

SEQ ID NO: 720803 - DNA, 14 bp, Homo sapiens
accctgattcttga

SEQ ID NO: 720804 - DNA, 19 bp, Homo sapiens
accctgcaaacagaacagg

SEQ ID NO: 720805 - DNA, 13 bp, Homo sapiens
accctgcaagacc

SEQ ID NO: 720806 - DNA, 16 bp, Homo sapiens
accctgcacctgctgc

SEQ ID NO: 720807 - DNA, 12 bp, Homo sapiens
accctgcaggac

SEQ ID NO: 720808 - DNA, 14 bp, Homo sapiens
accctgcaggactt

SEQ ID NO: 720809 - DNA, 13 bp, Homo sapiens
accctgcaggttg

SEQ ID NO: 720810 - DNA, 15 bp, Homo sapiens
accctgcattttcct

SEQ ID NO: 720811 - DNA, 16 bp, Homo sapiens
accctgcattttcctc

SEQ ID NO: 720812 - DNA, 20 bp, Homo sapiens
accctgccaagactcctcag

SEQ ID NO: 720813 - DNA, 16 bp, Homo sapiens
accctgccacagccag

SEQ ID NO: 720814 - DNA, 17 bp, Homo sapiens
accctgccacagccaga

SEQ ID NO: 720815 - DNA, 20 bp, Homo sapiens
accctgccacagccagagga

SEQ ID NO: 720816 - DNA, 16 bp, Homo sapiens
accctgccagtgccag

SEQ ID NO: 720817 - DNA, 19 bp, Homo sapiens
accctgccagtgccagggt

SEQ ID NO: 720818 - DNA, 15 bp, Homo sapiens
accctgcccaccccc

SEQ ID NO: 720819 - DNA, 16 bp, Homo sapiens
accctgcccacccccg

SEQ ID NO: 720820 - DNA, 13 bp, Homo sapiens
accctgccccctg

SEQ ID NO: 720821 - DNA, 15 bp, Homo sapiens
accctgcccctgccc

SEQ ID NO: 720822 - DNA, 18 bp, Homo sapiens
accctgcccctgccccgt

SEQ ID NO: 720823 - DNA, 13 bp, Homo sapiens
accctgcccgctc

SEQ ID NO: 720824 - DNA, 16 bp, Homo sapiens
accctgcccgctccca

SEQ ID NO: 720825 - DNA, 17 bp, Homo sapiens
accctgcccgctcccaa

SEQ ID NO: 720826 - DNA, 19 bp, Homo sapiens
accctgcccgctcccaacc

SEQ ID NO: 720827 - DNA, 16 bp, Homo sapiens
accctgccctcatggg

SEQ ID NO: 720828 - DNA, 13 bp, Homo sapiens
accctgccctcct

SEQ ID NO: 720829 - DNA, 17 bp, Homo sapiens
accctgccgtcaccacc

SEQ ID NO: 720830 - DNA, 22 bp, Homo sapiens
accctgccgtcaccaccacccc

SEQ ID NO: 720831 - DNA, 13 bp, Homo sapiens
accctgcctgtca

SEQ ID NO: 720832 - DNA, 19 bp, Homo sapiens
accctgcctgtcacctggg

SEQ ID NO: 720833 - DNA, 14 bp, Homo sapiens
accctgccttatct

SEQ ID NO: 720834 - DNA, 19 bp, Homo sapiens
accctgcgaaggggccctg

SEQ ID NO: 720835 - DNA, 22 bp, Homo sapiens
accctgcgaaggggccctggtc

SEQ ID NO: 720836 - DNA, 14 bp, Homo sapiens
accctgcgcctcca

SEQ ID NO: 720837 - DNA, 19 bp, Homo sapiens
accctgcgcctccagaggt

SEQ ID NO: 720838 - DNA, 14 bp, Homo sapiens
accctgcgggccag

SEQ ID NO: 720839 - DNA, 18 bp, Homo sapiens
accctgcgggccagggtc

SEQ ID NO: 720840 - DNA, 21 bp, Homo sapiens
accctgcgggccagggtcctg

SEQ ID NO: 720841 - DNA, 14 bp, Homo sapiens
accctgctgaacac

SEQ ID NO: 720842 - DNA, 22 bp, Homo sapiens
accctgctgaacacagtgtctg

SEQ ID NO: 720843 - DNA, 14 bp, Homo sapiens
accctgctgactcg

SEQ ID NO: 720844 - DNA, 11 bp, Homo sapiens
accctgctgca

SEQ ID NO: 720845 - DNA, 12 bp, Homo sapiens
accctgcttctc

SEQ ID NO: 720846 - DNA, 13 bp, Homo sapiens
accctgcttctcc

SEQ ID NO: 720847 - DNA, 14 bp, Homo sapiens
accctgcttctccc

SEQ ID NO: 720848 - DNA, 21 bp, Homo sapiens
accctggaattcagcaccctg

SEQ ID NO: 720849 - DNA, 11 bp, Homo sapiens
accctggcccg

SEQ ID NO: 720850 - DNA, 21 bp, Homo sapiens
accctggccgagtccaagctg

SEQ ID NO: 720851 - DNA, 23 bp, Homo sapiens
accctggcctagaccagcagaca

SEQ ID NO: 720852 - DNA, 14 bp, Homo sapiens
accctggcctcact

SEQ ID NO: 720853 - DNA, 22 bp, Homo sapiens
accctggcctcacttgattcat

SEQ ID NO: 720854 - DNA, 16 bp, Homo sapiens
accctgggaagttgga

SEQ ID NO: 720855 - DNA, 12 bp, Homo sapiens
accctgggacct

SEQ ID NO: 720856 - DNA, 14 bp, Homo sapiens
accctgggagagaa

SEQ ID NO: 720857 - DNA, 22 bp, Homo sapiens
accctgggagccagtcctccac

SEQ ID NO: 720858 - DNA, 14 bp, Homo sapiens
accctgggccctgg

SEQ ID NO: 720859 - DNA, 22 bp, Homo sapiens
accctgggccctgggctggaat

SEQ ID NO: 720860 - DNA, 22 bp, Homo sapiens
accctgggctggggaggaggag

SEQ ID NO: 720861 - DNA, 19 bp, Homo sapiens
accctgggctgtccagcct

SEQ ID NO: 720862 - DNA, 17 bp, Homo sapiens
accctgggcttctgtac

SEQ ID NO: 720863 - DNA, 15 bp, Homo sapiens
accctggggaaggag

SEQ ID NO: 720864 - DNA, 14 bp, Homo sapiens
accctggggcctga

SEQ ID NO: 720865 - DNA, 17 bp, Homo sapiens
accctggggcctggacc

SEQ ID NO: 720866 - DNA, 21 bp, Homo sapiens
accctgggtcaggaaattact

SEQ ID NO: 720867 - DNA, 20 bp, Homo sapiens
accctgggtgccattcccag

SEQ ID NO: 720868 - DNA, 20 bp, Homo sapiens
accctgggtgggagcatagg

SEQ ID NO: 720869 - DNA, 18 bp, Homo sapiens
accctgggtgggctctgt

SEQ ID NO: 720870 - DNA, 20 bp, Homo sapiens
accctggtctgaggatgtag

SEQ ID NO: 720871 - DNA, 22 bp, Homo sapiens
accctggtgacctcctgtcact

SEQ ID NO: 720872 - DNA, 14 bp, Homo sapiens
accctggtgggctg

SEQ ID NO: 720873 - DNA, 22 bp, Homo sapiens
accctgtactgttctgtgtctt

SEQ ID NO: 720874 - DNA, 15 bp, Homo sapiens
accctgtatatagcc

SEQ ID NO: 720875 - DNA, 22 bp, Homo sapiens
accctgtcaagttaacaaggaa

SEQ ID NO: 720876 - DNA, 19 bp, Homo sapiens
accctgtcccccagctctg

SEQ ID NO: 720877 - DNA, 23 bp, Homo sapiens
accctgtccggcccagtgccact

SEQ ID NO: 720878 - DNA, 15 bp, Homo sapiens
accctgtcctgcagt

SEQ ID NO: 720879 - DNA, 21 bp, Homo sapiens
accctgtcctgcagtcccaca

SEQ ID NO: 720880 - DNA, 23 bp, Homo sapiens
accctgtcctgcagtcccacact

SEQ ID NO: 720881 - DNA, 14 bp, Homo sapiens
accctgtcctttgc

SEQ ID NO: 720882 - DNA, 17 bp, Homo sapiens
accctgtctgtcccttt

SEQ ID NO: 720883 - DNA, 21 bp, Homo sapiens
accctgtctgtcccttttctt

SEQ ID NO: 720884 - DNA, 19 bp, Homo sapiens
accccgggcccgggccccc

SEQ ID NO: 720885 - DNA, 20 bp, Homo sapiens
accccgggcccgggcccccg

SEQ ID NO: 720886 - DNA, 21 bp, Homo sapiens
accccgggcccgggcccccgc

SEQ ID NO: 720887 - DNA, 15 bp, Homo sapiens
accccggggaccctg

SEQ ID NO: 720888 - DNA, 17 bp, Homo sapiens
accccggggaccctgtg

SEQ ID NO: 720889 - DNA, 23 bp, Homo sapiens
accccggggcatggacagggcca

SEQ ID NO: 720890 - DNA, 19 bp, Homo sapiens
accccgtctctataccaac

SEQ ID NO: 720891 - DNA, 14 bp, Homo sapiens
accccgtgcccctg

SEQ ID NO: 720892 - DNA, 14 bp, Homo sapiens
accccgtggctctg

SEQ ID NO: 720893 - DNA, 15 bp, Homo sapiens
accccgtggctctgg

SEQ ID NO: 720894 - DNA, 16 bp, Homo sapiens
accccgtggctctggg

SEQ ID NO: 720895 - DNA, 16 bp, Homo sapiens
acccctaaactccagg

SEQ ID NO: 720896 - DNA, 17 bp, Homo sapiens
acccctaagactgcctt

SEQ ID NO: 720897 - DNA, 20 bp, Homo sapiens
acccctaagactgccttcag

SEQ ID NO: 720898 - DNA, 15 bp, Homo sapiens
acccctaatgtcagc

SEQ ID NO: 720899 - DNA, 15 bp, Homo sapiens
acccctacactgtga

SEQ ID NO: 720900 - DNA, 14 bp, Homo sapiens
acccctaccccctc

SEQ ID NO: 720901 - DNA, 13 bp, Homo sapiens
acccctacccctg

SEQ ID NO: 720902 - DNA, 20 bp, Homo sapiens
acccctaccgatggtcccag

SEQ ID NO: 720903 - DNA, 12 bp, Homo sapiens
acccctaggact

SEQ ID NO: 720904 - DNA, 14 bp, Homo sapiens
acccctcaaactgc

SEQ ID NO: 720905 - DNA, 20 bp, Homo sapiens
acccctcaaactgcacatct

SEQ ID NO: 720906 - DNA, 21 bp, Homo sapiens
acccctcaaactgcacatcta

SEQ ID NO: 720907 - DNA, 20 bp, Homo sapiens
acccctcacaggagcttact

SEQ ID NO: 720908 - DNA, 10 bp, Homo sapiens
acccctcacc

SEQ ID NO: 720909 - DNA, 16 bp, Homo sapiens
acccctcaccaccccc

SEQ ID NO: 720910 - DNA, 15 bp, Homo sapiens
acccctcaccttgca

SEQ ID NO: 720911 - DNA, 17 bp, Homo sapiens
acccctcactccccagg

SEQ ID NO: 720912 - DNA, 14 bp, Homo sapiens
acccctcagctccc

SEQ ID NO: 720913 - DNA, 12 bp, Homo sapiens
acccctccagga

SEQ ID NO: 720914 - DNA, 17 bp, Homo sapiens
acccctccctccctctt

SEQ ID NO: 720915 - DNA, 16 bp, Homo sapiens
acccctccctgcaggg

SEQ ID NO: 720916 - DNA, 14 bp, Homo sapiens
acccctcctggcct

SEQ ID NO: 720917 - DNA, 19 bp, Homo sapiens
acccctcgcaaccctgcct

SEQ ID NO: 720918 - DNA, 23 bp, Homo sapiens
acccctcgcaaccctgcctgtca

SEQ ID NO: 720919 - DNA, 13 bp, Homo sapiens
acccctctggcca

SEQ ID NO: 720920 - DNA, 15 bp, Homo sapiens
acccctctggccagg

SEQ ID NO: 720921 - DNA, 18 bp, Homo sapiens
acccctctggccaggatg

SEQ ID NO: 720922 - DNA, 17 bp, Homo sapiens
acccctctgtcttcaag

SEQ ID NO: 720923 - DNA, 23 bp, Homo sapiens
acccctcttagcttacaggaagc

SEQ ID NO: 720924 - DNA, 22 bp, Homo sapiens
acccctgagttgggcagccagg

SEQ ID NO: 720925 - DNA, 23 bp, Homo sapiens
acccctgagttgggcagccagga

SEQ ID NO: 720926 - DNA, 12 bp, Homo sapiens
acccctgcactt

SEQ ID NO: 720927 - DNA, 14 bp, Homo sapiens
acccctgccactca

SEQ ID NO: 720928 - DNA, 22 bp, Homo sapiens
acccctgccactcacccttcct

SEQ ID NO: 720929 - DNA, 11 bp, Homo sapiens
acccctgcccc

SEQ ID NO: 720930 - DNA, 17 bp, Homo sapiens
acccctgccctgctcct

SEQ ID NO: 720931 - DNA, 15 bp, Homo sapiens
acccctgcctcccat

SEQ ID NO: 720932 - DNA, 11 bp, Homo sapiens
acccctgcctg

SEQ ID NO: 720933 - DNA, 20 bp, Homo sapiens
acccctgccttcctctgagg

SEQ ID NO: 720934 - DNA, 18 bp, Homo sapiens
acccctgctcccagcctg

SEQ ID NO: 720935 - DNA, 23 bp, Homo sapiens
acccctgctcccattcctccctc

SEQ ID NO: 720936 - DNA, 19 bp, Homo sapiens
acccctggaagagcccagt

SEQ ID NO: 720937 - DNA, 11 bp, Homo sapiens
acccctggcca

SEQ ID NO: 720938 - DNA, 13 bp, Homo sapiens
acccctggccagc

SEQ ID NO: 720939 - DNA, 18 bp, Homo sapiens
acccctggccagctctga

SEQ ID NO: 720940 - DNA, 17 bp, Homo sapiens
acccctggcttttcact

SEQ ID NO: 720941 - DNA, 20 bp, Homo sapiens
acccctggcttttcactgct

SEQ ID NO: 720942 - DNA, 21 bp, Homo sapiens
acccctggcttttcactgctg

SEQ ID NO: 720943 - DNA, 17 bp, Homo sapiens
acccctgggggctctca

SEQ ID NO: 720944 - DNA, 18 bp, Homo sapiens
acccctgtacccagctcc

SEQ ID NO: 720945 - DNA, 17 bp, Homo sapiens
acccctgtaggcctcag

SEQ ID NO: 720946 - DNA, 11 bp, Homo sapiens
acccctgtccc

SEQ ID NO: 720947 - DNA, 16 bp, Homo sapiens
acccctgtcccaccca

SEQ ID NO: 720948 - DNA, 21 bp, Homo sapiens
acccctgtcccatgcaggccc

SEQ ID NO: 720949 - DNA, 16 bp, Homo sapiens
accccttagcctccct

SEQ ID NO: 720950 - DNA, 18 bp, Homo sapiens
accccttatccaggactc

SEQ ID NO: 720951 - DNA, 20 bp, Homo sapiens
accccttattaaggccccag

SEQ ID NO: 720952 - DNA, 20 bp, Homo sapiens
accccttccagatcactgcc

SEQ ID NO: 720953 - DNA, 12 bp, Homo sapiens
accccttcccca

SEQ ID NO: 720954 - DNA, 14 bp, Homo sapiens
accccttccccact

SEQ ID NO: 720955 - DNA, 21 bp, Homo sapiens
accccttccccactgcctgcc

SEQ ID NO: 720956 - DNA, 14 bp, Homo sapiens
accccttccccagg

SEQ ID NO: 720957 - DNA, 21 bp, Homo sapiens
accccttccccaggcccacca

SEQ ID NO: 720958 - DNA, 12 bp, Homo sapiens
accccttcctcc

SEQ ID NO: 720959 - DNA, 19 bp, Homo sapiens
accccttcctccccacact

SEQ ID NO: 720960 - DNA, 13 bp, Homo sapiens
accccttcctgtc

SEQ ID NO: 720961 - DNA, 14 bp, Homo sapiens
accccttcctgtcc

SEQ ID NO: 720962 - DNA, 17 bp, Homo sapiens
accccttcctgtcctgc

SEQ ID NO: 720963 - DNA, 18 bp, Homo sapiens
accccttcctttcctctg

SEQ ID NO: 720964 - DNA, 22 bp, Homo sapiens
accccttcgacatgctgccagg

SEQ ID NO: 720965 - DNA, 17 bp, Homo sapiens
accccttctctcctccc

SEQ ID NO: 720966 - DNA, 18 bp, Homo sapiens
accccttctctctccaga

SEQ ID NO: 720967 - DNA, 17 bp, Homo sapiens
accccttctttgcaggg

SEQ ID NO: 720968 - DNA, 23 bp, Homo sapiens
accccttggaaatgtctgctggt

SEQ ID NO: 720969 - DNA, 17 bp, Homo sapiens
accccttggcccctcac

SEQ ID NO: 720970 - DNA, 19 bp, Homo sapiens
accccttgttgcactgccc

SEQ ID NO: 720971 - DNA, 22 bp, Homo sapiens
accccttgttgcactgccccct

SEQ ID NO: 720972 - DNA, 12 bp, Homo sapiens
acccctttcctg

SEQ ID NO: 720973 - DNA, 19 bp, Homo sapiens
acccctttctagaccaata

SEQ ID NO: 720974 - DNA, 11 bp, Homo sapiens
acccctttctt

SEQ ID NO: 720975 - DNA, 15 bp, Homo sapiens
acccgaagtcctgtc

SEQ ID NO: 720976 - DNA, 17 bp, Homo sapiens
acccgacataagtcgag

SEQ ID NO: 720977 - DNA, 13 bp, Homo sapiens
acccgagcacata

SEQ ID NO: 720978 - DNA, 14 bp, Homo sapiens
acccgagcccagct

SEQ ID NO: 720979 - DNA, 18 bp, Homo sapiens
acccgagtacctccagtc

SEQ ID NO: 720980 - DNA, 13 bp, Homo sapiens
acccgccctcagg

SEQ ID NO: 720981 - DNA, 15 bp, Homo sapiens
acccgccctcagggg

SEQ ID NO: 720982 - DNA, 16 bp, Homo sapiens
acccgccgcctcccac

SEQ ID NO: 720983 - DNA, 15 bp, Homo sapiens
acccgcctagctgct

SEQ ID NO: 720984 - DNA, 13 bp, Homo sapiens
actcctctgggcc

SEQ ID NO: 720985 - DNA, 16 bp, Homo sapiens
actcctctgggcctgg

SEQ ID NO: 720986 - DNA, 17 bp, Homo sapiens
actcctctgggcctggg

SEQ ID NO: 720987 - DNA, 13 bp, Homo sapiens
actcctctgtcca

SEQ ID NO: 720988 - DNA, 23 bp, Homo sapiens
actcctcttggtgggtgtggcca

SEQ ID NO: 720989 - DNA, 19 bp, Homo sapiens
actcctgaattcagttgct

SEQ ID NO: 720990 - DNA, 15 bp, Homo sapiens
actcctgacagtctt

SEQ ID NO: 720991 - DNA, 21 bp, Homo sapiens
actcctgacagtcttgtgctt

SEQ ID NO: 720992 - DNA, 15 bp, Homo sapiens
actcctgacctcagg

SEQ ID NO: 720993 - DNA, 19 bp, Homo sapiens
actcctgacgtctgaagct

SEQ ID NO: 720994 - DNA, 23 bp, Homo sapiens
actcctgacgtctgaagcttgac

SEQ ID NO: 720995 - DNA, 23 bp, Homo sapiens
actcctgatgccctcttctcctt

SEQ ID NO: 720996 - DNA, 21 bp, Homo sapiens
actcctgattttgtagttaat

SEQ ID NO: 720997 - DNA, 23 bp, Homo sapiens
actcctgccaggcacacacagcc

SEQ ID NO: 720998 - DNA, 19 bp, Homo sapiens
actcctgcctgagtttcca

SEQ ID NO: 720999 - DNA, 21 bp, Homo sapiens
actcctgcctgagtttccagc

SEQ ID NO: 721000 - DNA, 16 bp, Homo sapiens
actcctggaagctgtg

SEQ ID NO: 721001 - DNA, 21 bp, Homo sapiens
actcctggactccggaggact

SEQ ID NO: 721002 - DNA, 23 bp, Homo sapiens
actcctggactccggaggactga

SEQ ID NO: 721003 - DNA, 14 bp, Homo sapiens
actcctggaggctg

SEQ ID NO: 721004 - DNA, 12 bp, Homo sapiens
actcctggcagg

SEQ ID NO: 721005 - DNA, 19 bp, Homo sapiens
actcctggcagggccacct

SEQ ID NO: 721006 - DNA, 17 bp, Homo sapiens
actcctggcctcaagca

SEQ ID NO: 721007 - DNA, 13 bp, Homo sapiens
actcctggctccg

SEQ ID NO: 721008 - DNA, 23 bp, Homo sapiens
actcctggctccgcaggggtttg

SEQ ID NO: 721009 - DNA, 15 bp, Homo sapiens
actcctgggtcagga

SEQ ID NO: 721010 - DNA, 23 bp, Homo sapiens
actcctgggtgggtggggtacag

SEQ ID NO: 721011 - DNA, 16 bp, Homo sapiens
actcctgggttgagct

SEQ ID NO: 721012 - DNA, 17 bp, Homo sapiens
actcctgggttgagctg

SEQ ID NO: 721013 - DNA, 17 bp, Homo sapiens
actcctgtacactgaat

SEQ ID NO: 721014 - DNA, 21 bp, Homo sapiens
actcctgtcccgccttcctcc

SEQ ID NO: 721015 - DNA, 21 bp, Homo sapiens
actcctgtccctgtagctcag

SEQ ID NO: 721016 - DNA, 22 bp, Homo sapiens
actcctgtccctgtagctcagt

SEQ ID NO: 721017 - DNA, 23 bp, Homo sapiens
actcctgtccctgtagctcagtc

SEQ ID NO: 721018 - DNA, 22 bp, Homo sapiens
actcctgtgctctggaggctgc

SEQ ID NO: 721019 - DNA, 16 bp, Homo sapiens
actcctgttacttacc

SEQ ID NO: 721020 - DNA, 22 bp, Homo sapiens
actccttatttggcgtgacccg

SEQ ID NO: 721021 - DNA, 18 bp, Homo sapiens
actccttattttgtatta

SEQ ID NO: 721022 - DNA, 19 bp, Homo sapiens
actccttccccacttctgt

SEQ ID NO: 721023 - DNA, 13 bp, Homo sapiens
actccttcctggc

SEQ ID NO: 721024 - DNA, 17 bp, Homo sapiens
actccttcctggcctga

SEQ ID NO: 721025 - DNA, 23 bp, Homo sapiens
actccttcctggcctgagagtca

SEQ ID NO: 721026 - DNA, 21 bp, Homo sapiens
actccttccttcaggactctg

SEQ ID NO: 721027 - DNA, 16 bp, Homo sapiens
actccttctccccaat

SEQ ID NO: 721028 - DNA, 14 bp, Homo sapiens
actccttctctcac

SEQ ID NO: 721029 - DNA, 16 bp, Homo sapiens
actcctttatctgtaa

SEQ ID NO: 721030 - DNA, 17 bp, Homo sapiens
actcctttccaatagaa

SEQ ID NO: 721031 - DNA, 23 bp, Homo sapiens
actcctttccaatagaaagaaac

SEQ ID NO: 721032 - DNA, 15 bp, Homo sapiens
actcctttcctctga

SEQ ID NO: 721033 - DNA, 20 bp, Homo sapiens
actcgacaaaggccacaggc

SEQ ID NO: 721034 - DNA, 22 bp, Homo sapiens
actcgacaaaggccacaggcag

SEQ ID NO: 721035 - DNA, 16 bp, Homo sapiens
actcgactctgctgct

SEQ ID NO: 721036 - DNA, 16 bp, Homo sapiens
actcgagaccatcctg

SEQ ID NO: 721037 - DNA, 22 bp, Homo sapiens
actcgagaccatcctggcccct

SEQ ID NO: 721038 - DNA, 16 bp, Homo sapiens
actcgagaccttttca

SEQ ID NO: 721039 - DNA, 23 bp, Homo sapiens
actcgagaccttttcaacttggc

SEQ ID NO: 721040 - DNA, 15 bp, Homo sapiens
actcgaggcctgcaa

SEQ ID NO: 721041 - DNA, 16 bp, Homo sapiens
actcgaggcctgcaaa

SEQ ID NO: 721042 - DNA, 19 bp, Homo sapiens
actcgattcatattgaata

SEQ ID NO: 721043 - DNA, 20 bp, Homo sapiens
actcgcaggaccaagggggc

SEQ ID NO: 721044 - DNA, 13 bp, Homo sapiens
actcgcagtcgca

SEQ ID NO: 721045 - DNA, 16 bp, Homo sapiens
actcgccatttcctca

SEQ ID NO: 721046 - DNA, 15 bp, Homo sapiens
actcgcccgcccact

SEQ ID NO: 721047 - DNA, 23 bp, Homo sapiens
actcgctcctagtgtttctttgt

SEQ ID NO: 721048 - DNA, 21 bp, Homo sapiens
actcgcttaggtagaaactat

SEQ ID NO: 721049 - DNA, 21 bp, Homo sapiens
actcggacttgaatgctgccc

SEQ ID NO: 721050 - DNA, 20 bp, Homo sapiens
actcggagactatggcctcg

SEQ ID NO: 721051 - DNA, 22 bp, Homo sapiens
actcggcagcccttccaaactc

SEQ ID NO: 721052 - DNA, 21 bp, Homo sapiens
actcggcctcccaaagtgctg

SEQ ID NO: 721053 - DNA, 22 bp, Homo sapiens
actcggcctcccaaagtgctgg

SEQ ID NO: 721054 - DNA, 14 bp, Homo sapiens
actcggcttcctgt

SEQ ID NO: 721055 - DNA, 13 bp, Homo sapiens
actcgggagctgc

SEQ ID NO: 721056 - DNA, 20 bp, Homo sapiens
actcgggaggctgagacagg

SEQ ID NO: 721057 - DNA, 19 bp, Homo sapiens
actcgggggcgcctggagg

SEQ ID NO: 721058 - DNA, 16 bp, Homo sapiens
actcgggggtgctggg

SEQ ID NO: 721059 - DNA, 23 bp, Homo sapiens
actcgggggtgctggggccaggg

SEQ ID NO: 721060 - DNA, 22 bp, Homo sapiens
actcgtgaccgcaggtgatcct

SEQ ID NO: 721061 - DNA, 16 bp, Homo sapiens
actcgtgtgcaacaga

SEQ ID NO: 721062 - DNA, 14 bp, Homo sapiens
actcgttttttaca

SEQ ID NO: 721063 - DNA, 12 bp, Homo sapiens
actctaaaaact

SEQ ID NO: 721064 - DNA, 14 bp, Homo sapiens
actctaaaagatcc

SEQ ID NO: 721065 - DNA, 15 bp, Homo sapiens
actctaaaagatcct

SEQ ID NO: 721066 - DNA, 15 bp, Homo sapiens
actctaaaattataa

SEQ ID NO: 721067 - DNA, 23 bp, Homo sapiens
actctaaactgcaaacagaaatc

SEQ ID NO: 721068 - DNA, 13 bp, Homo sapiens
actctaaagaaaa

SEQ ID NO: 721069 - DNA, 12 bp, Homo sapiens
actctaaagatt

SEQ ID NO: 721070 - DNA, 19 bp, Homo sapiens
actctaaagccaagcactt

SEQ ID NO: 721071 - DNA, 16 bp, Homo sapiens
actctaaatgcagttt

SEQ ID NO: 721072 - DNA, 14 bp, Homo sapiens
actctaaccctgtg

SEQ ID NO: 721073 - DNA, 16 bp, Homo sapiens
actctaaccctgtgga

SEQ ID NO: 721074 - DNA, 17 bp, Homo sapiens
actctaaccctgtggaa

SEQ ID NO: 721075 - DNA, 20 bp, Homo sapiens
actctaaccctgtggaagca

SEQ ID NO: 721076 - DNA, 14 bp, Homo sapiens
actctaactgtata

SEQ ID NO: 721077 - DNA, 22 bp, Homo sapiens
actctaagatacactgcacttt

SEQ ID NO: 721078 - DNA, 13 bp, Homo sapiens
actctaattagag

SEQ ID NO: 721079 - DNA, 21 bp, Homo sapiens
actctaattcccattttgcaa

SEQ ID NO: 721080 - DNA, 17 bp, Homo sapiens
actctacaattcctctg

SEQ ID NO: 721081 - DNA, 21 bp, Homo sapiens
actctacaattcctctgataa

SEQ ID NO: 721082 - DNA, 16 bp, Homo sapiens
actctacccctgctcc

SEQ ID NO: 721083 - DNA, 23 bp, Homo sapiens
actctacccctgctcccattcct

SEQ ID NO: 721084 - DNA, 13 bp, Homo sapiens
actctaccctccc

SEQ ID NO: 721085 - DNA, 15 bp, Homo sapiens
actctaccctcccac

SEQ ID NO: 721086 - DNA, 16 bp, Homo sapiens
actctaccctcccacc

SEQ ID NO: 721087 - DNA, 18 bp, Homo sapiens
actctaccctcttagaaa

SEQ ID NO: 721088 - DNA, 23 bp, Homo sapiens
actctacctaatgtctcactgtt

SEQ ID NO: 721089 - DNA, 15 bp, Homo sapiens
actctacgccaaagt

SEQ ID NO: 721090 - DNA, 16 bp, Homo sapiens
actctacgccaaagtg

SEQ ID NO: 721091 - DNA, 21 bp, Homo sapiens
actctacttagcatgtcccta

SEQ ID NO: 721092 - DNA, 17 bp, Homo sapiens
actctagaacatgcaca

SEQ ID NO: 721093 - DNA, 20 bp, Homo sapiens
actctagacaagatattgta

SEQ ID NO: 721094 - DNA, 14 bp, Homo sapiens
actgcaaaatgtct

SEQ ID NO: 721095 - DNA, 23 bp, Homo sapiens
actgcaaaatgtcttaatgcaaa

SEQ ID NO: 721096 - DNA, 23 bp, Homo sapiens
actgcaaacttttttatatcttt

SEQ ID NO: 721097 - DNA, 23 bp, Homo sapiens
actgcaaagctttggctgagacc

SEQ ID NO: 721098 - DNA, 16 bp, Homo sapiens
actgcaaataaagcct

SEQ ID NO: 721099 - DNA, 18 bp, Homo sapiens
actgcaaataaagccttt

SEQ ID NO: 721100 - DNA, 20 bp, Homo sapiens
actgcaaatggcagttttaa

SEQ ID NO: 721101 - DNA, 19 bp, Homo sapiens
actgcaacctccgcctctc

SEQ ID NO: 721102 - DNA, 16 bp, Homo sapiens
actgcaacctctgcct

SEQ ID NO: 721103 - DNA, 18 bp, Homo sapiens
actgcaacctctgcctcc

SEQ ID NO: 721104 - DNA, 14 bp, Homo sapiens
actgcaaccttgtt

SEQ ID NO: 721105 - DNA, 16 bp, Homo sapiens
actgcaacttgtgaac

SEQ ID NO: 721106 - DNA, 18 bp, Homo sapiens
actgcaacttgtgaactc

SEQ ID NO: 721107 - DNA, 23 bp, Homo sapiens
actgcaagaaaggggacccaaga

SEQ ID NO: 721108 - DNA, 19 bp, Homo sapiens
actgcaagcatttttccat

SEQ ID NO: 721109 - DNA, 19 bp, Homo sapiens
actgcaatagagactgtag

SEQ ID NO: 721110 - DNA, 21 bp, Homo sapiens
actgcaatagagactgtagat

SEQ ID NO: 721111 - DNA, 21 bp, Homo sapiens
actgcaatcctgtctttctga

SEQ ID NO: 721112 - DNA, 17 bp, Homo sapiens
actgcacaatcagttta

SEQ ID NO: 721113 - DNA, 15 bp, Homo sapiens
actgcacacacagct

SEQ ID NO: 721114 - DNA, 16 bp, Homo sapiens
actgcacacacagctc

SEQ ID NO: 721115 - DNA, 19 bp, Homo sapiens
actgcacagtgctgttggt

SEQ ID NO: 721116 - DNA, 16 bp, Homo sapiens
actgcacagtggcaca

SEQ ID NO: 721117 - DNA, 17 bp, Homo sapiens
actgcacatgaaagttt

SEQ ID NO: 721118 - DNA, 16 bp, Homo sapiens
actgcacccagctcca

SEQ ID NO: 721119 - DNA, 14 bp, Homo sapiens
actgcacctgccca

SEQ ID NO: 721120 - DNA, 20 bp, Homo sapiens
actgcacctgcccagctccc

SEQ ID NO: 721121 - DNA, 19 bp, Homo sapiens
actgcacctgggcagctcc

SEQ ID NO: 721122 - DNA, 21 bp, Homo sapiens
actgcacctgggcagctcctc

SEQ ID NO: 721123 - DNA, 9 bp, Homo sapiens
actgcactc

SEQ ID NO: 721124 - DNA, 19 bp, Homo sapiens
actgcactcatagggtgct

SEQ ID NO: 721125 - DNA, 13 bp, Homo sapiens
actgcactccagc

SEQ ID NO: 721126 - DNA, 14 bp, Homo sapiens
actgcactccagcc

SEQ ID NO: 721127 - DNA, 20 bp, Homo sapiens
actgcactccagcctgggca

SEQ ID NO: 721128 - DNA, 19 bp, Homo sapiens
actgcactccagcctgggg

SEQ ID NO: 721129 - DNA, 20 bp, Homo sapiens
actgcactttcccccttccc

SEQ ID NO: 721130 - DNA, 12 bp, Homo sapiens
actgcactttgt

SEQ ID NO: 721131 - DNA, 14 bp, Homo sapiens
actgcactttgttt

SEQ ID NO: 721132 - DNA, 17 bp, Homo sapiens
actgcacttttttattg

SEQ ID NO: 721133 - DNA, 23 bp, Homo sapiens
actgcactttttttacttcgtct

SEQ ID NO: 721134 - DNA, 13 bp, Homo sapiens
actgcagaagcaa

SEQ ID NO: 721135 - DNA, 17 bp, Homo sapiens
actgcagacattctcaa

SEQ ID NO: 721136 - DNA, 18 bp, Homo sapiens
actgcagacattctcaaa

SEQ ID NO: 721137 - DNA, 19 bp, Homo sapiens
actgcagacattctcaaag

SEQ ID NO: 721138 - DNA, 22 bp, Homo sapiens
actgcagacgggaatgcctagg

SEQ ID NO: 721139 - DNA, 20 bp, Homo sapiens
actgcagagactaatgttgg

SEQ ID NO: 721140 - DNA, 23 bp, Homo sapiens
actgcagatagcccaggagcaac

SEQ ID NO: 721141 - DNA, 14 bp, Homo sapiens
actgcagattgaga

SEQ ID NO: 721142 - DNA, 17 bp, Homo sapiens
actgcagattgagacct

SEQ ID NO: 721143 - DNA, 16 bp, Homo sapiens
actgcagcacctccag

SEQ ID NO: 721144 - DNA, 23 bp, Homo sapiens
actgcagcctcatactcctgggc

SEQ ID NO: 721145 - DNA, 13 bp, Homo sapiens
actgcagcctctc

SEQ ID NO: 721146 - DNA, 19 bp, Homo sapiens
actgcagccttgtcctccc

SEQ ID NO: 721147 - DNA, 18 bp, Homo sapiens
actgcagcgcgctcctga

SEQ ID NO: 721148 - DNA, 16 bp, Homo sapiens
actgcagctgtgagtg

SEQ ID NO: 721149 - DNA, 21 bp, Homo sapiens
actgcaggccccgcttgtcca

SEQ ID NO: 721150 - DNA, 23 bp, Homo sapiens
actgcaggccccgcttgtccagc

SEQ ID NO: 721151 - DNA, 19 bp, Homo sapiens
actgcaggccctggcctcc

SEQ ID NO: 721152 - DNA, 22 bp, Homo sapiens
actgcaggccctggcctcccct

SEQ ID NO: 721153 - DNA, 18 bp, Homo sapiens
actgcagggactgccagt

SEQ ID NO: 721154 - DNA, 22 bp, Homo sapiens
actgcaggggccactccaaact

SEQ ID NO: 721155 - DNA, 20 bp, Homo sapiens
actgcagtacatacgtctgc

SEQ ID NO: 721156 - DNA, 20 bp, Homo sapiens
actgcagtcggcatgccagg

SEQ ID NO: 721157 - DNA, 21 bp, Homo sapiens
actgcatacgttttggtgttg

SEQ ID NO: 721158 - DNA, 22 bp, Homo sapiens
actgcatgtggcttctctgtct

SEQ ID NO: 721159 - DNA, 15 bp, Homo sapiens
actgcatgtttgtga

SEQ ID NO: 721160 - DNA, 23 bp, Homo sapiens
actgcattaccgcgttgtaaaat

SEQ ID NO: 721161 - DNA, 16 bp, Homo sapiens
actgcattagaaatta

SEQ ID NO: 721162 - DNA, 16 bp, Homo sapiens
actgcattctctccca

SEQ ID NO: 721163 - DNA, 20 bp, Homo sapiens
actgcatttaaatttgattt

SEQ ID NO: 721164 - DNA, 23 bp, Homo sapiens
actgcatttaaatttgatttcca

SEQ ID NO: 721165 - DNA, 12 bp, Homo sapiens
actgcatttgtg

SEQ ID NO: 721166 - DNA, 18 bp, Homo sapiens
actgccaaaatgctctag

SEQ ID NO: 721167 - DNA, 16 bp, Homo sapiens
actgccaagcttcctg

SEQ ID NO: 721168 - DNA, 17 bp, Homo sapiens
actgccaagcttcctgt

SEQ ID NO: 721169 - DNA, 20 bp, Homo sapiens
actgccaagcttcctgtgcc

SEQ ID NO: 721170 - DNA, 23 bp, Homo sapiens
actgccaatatagaaaaataaaa

SEQ ID NO: 721171 - DNA, 15 bp, Homo sapiens
actgccaatgctgta

SEQ ID NO: 721172 - DNA, 16 bp, Homo sapiens
actgccaatgctgtac

SEQ ID NO: 721173 - DNA, 15 bp, Homo sapiens
actgccactgtgtgc

SEQ ID NO: 721174 - DNA, 21 bp, Homo sapiens
actgccagaagagaattcagt

SEQ ID NO: 721175 - DNA, 12 bp, Homo sapiens
actgccagcagc

SEQ ID NO: 721176 - DNA, 13 bp, Homo sapiens
actgccagcagca

SEQ ID NO: 721177 - DNA, 18 bp, Homo sapiens
actgccagcagcagcagg

SEQ ID NO: 721178 - DNA, 19 bp, Homo sapiens
actgccagcagcagcaggt

SEQ ID NO: 721179 - DNA, 16 bp, Homo sapiens
actggaagttttgcat

SEQ ID NO: 721180 - DNA, 10 bp, Homo sapiens
actggaataa

SEQ ID NO: 721181 - DNA, 19 bp, Homo sapiens
actggaataatttgtaaat

SEQ ID NO: 721182 - DNA, 20 bp, Homo sapiens
actggaataatttgtaaatg

SEQ ID NO: 721183 - DNA, 21 bp, Homo sapiens
actggaatcagctcaggactg

SEQ ID NO: 721184 - DNA, 20 bp, Homo sapiens
actggacacaataggtcttt

SEQ ID NO: 721185 - DNA, 23 bp, Homo sapiens
actggacacactaaactctgggg

SEQ ID NO: 721186 - DNA, 21 bp, Homo sapiens
actggacagctttgctccgct

SEQ ID NO: 721187 - DNA, 20 bp, Homo sapiens
actggaccactgggcaatga

SEQ ID NO: 721188 - DNA, 21 bp, Homo sapiens
actggaccccactggctgaga

SEQ ID NO: 721189 - DNA, 17 bp, Homo sapiens
actggaccgctgactgc

SEQ ID NO: 721190 - DNA, 16 bp, Homo sapiens
actggacgctgccctg

SEQ ID NO: 721191 - DNA, 14 bp, Homo sapiens
actggactccggcc

SEQ ID NO: 721192 - DNA, 16 bp, Homo sapiens
actggactccggccct

SEQ ID NO: 721193 - DNA, 19 bp, Homo sapiens
actggactccggccctcct

SEQ ID NO: 721194 - DNA, 23 bp, Homo sapiens
actggagaccgcttcacccctgc

SEQ ID NO: 721195 - DNA, 13 bp, Homo sapiens
actggagcatctg

SEQ ID NO: 721196 - DNA, 16 bp, Homo sapiens
actggagcatctgact

SEQ ID NO: 721197 - DNA, 16 bp, Homo sapiens
actggagcccaggagt

SEQ ID NO: 721198 - DNA, 15 bp, Homo sapiens
actggagctcatctg

SEQ ID NO: 721199 - DNA, 16 bp, Homo sapiens
actggagctgggaggt

SEQ ID NO: 721200 - DNA, 20 bp, Homo sapiens
actggaggagagaagaatga

SEQ ID NO: 721201 - DNA, 16 bp, Homo sapiens
actggaggagcagctt

SEQ ID NO: 721202 - DNA, 15 bp, Homo sapiens
actggaggcccctgg

SEQ ID NO: 721203 - DNA, 22 bp, Homo sapiens
actggaggcccctggagccaga

SEQ ID NO: 721204 - DNA, 14 bp, Homo sapiens
actggaggtgggca

SEQ ID NO: 721205 - DNA, 18 bp, Homo sapiens
actggaggttgaagccaa

SEQ ID NO: 721206 - DNA, 20 bp, Homo sapiens
actggagtctatgcttaaaa

SEQ ID NO: 721207 - DNA, 19 bp, Homo sapiens
actggagtgaggcttccag

SEQ ID NO: 721208 - DNA, 21 bp, Homo sapiens
actggagtgaggcttccaggc

SEQ ID NO: 721209 - DNA, 22 bp, Homo sapiens
actggagtgaggcttccaggct

SEQ ID NO: 721210 - DNA, 14 bp, Homo sapiens
actggagttacatt

SEQ ID NO: 721211 - DNA, 13 bp, Homo sapiens
actggagttctat

SEQ ID NO: 721212 - DNA, 19 bp, Homo sapiens
actggagttctatgctctc

SEQ ID NO: 721213 - DNA, 12 bp, Homo sapiens
actggatatgtt

SEQ ID NO: 721214 - DNA, 18 bp, Homo sapiens
actggatctcttaagaca

SEQ ID NO: 721215 - DNA, 14 bp, Homo sapiens
actggatcttctat

SEQ ID NO: 721216 - DNA, 10 bp, Homo sapiens
actggatgaa

SEQ ID NO: 721217 - DNA, 11 bp, Homo sapiens
actggatgaaa

SEQ ID NO: 721218 - DNA, 14 bp, Homo sapiens
actggatgaagatt

SEQ ID NO: 721219 - DNA, 10 bp, Homo sapiens
actggatgct

SEQ ID NO: 721220 - DNA, 22 bp, Homo sapiens
actggattaaacttaatctaaa

SEQ ID NO: 721221 - DNA, 13 bp, Homo sapiens
actggattggcca

SEQ ID NO: 721222 - DNA, 23 bp, Homo sapiens
actggattggccaaacatcagac

SEQ ID NO: 721223 - DNA, 12 bp, Homo sapiens
actggcaaaagg

SEQ ID NO: 721224 - DNA, 13 bp, Homo sapiens
actggcaaagcag

SEQ ID NO: 721225 - DNA, 12 bp, Homo sapiens
actggcaataaa

SEQ ID NO: 721226 - DNA, 19 bp, Homo sapiens
actggcaattgtctattta

SEQ ID NO: 721227 - DNA, 21 bp, Homo sapiens
actggcacactgctcttaaga

SEQ ID NO: 721228 - DNA, 12 bp, Homo sapiens
actggcacagag

SEQ ID NO: 721229 - DNA, 17 bp, Homo sapiens
actggcagactcaaggg

SEQ ID NO: 721230 - DNA, 13 bp, Homo sapiens
actggcagagcac

SEQ ID NO: 721231 - DNA, 12 bp, Homo sapiens
actggcaggtgc

SEQ ID NO: 721232 - DNA, 20 bp, Homo sapiens
actggcattaattattaata

SEQ ID NO: 721233 - DNA, 14 bp, Homo sapiens
actggccacccctc

SEQ ID NO: 721234 - DNA, 12 bp, Homo sapiens
actggccagaga

SEQ ID NO: 721235 - DNA, 20 bp, Homo sapiens
actggccagagagggcccag

SEQ ID NO: 721236 - DNA, 18 bp, Homo sapiens
actggccatttttctggg

SEQ ID NO: 721237 - DNA, 19 bp, Homo sapiens
actggccatttttctgggg

SEQ ID NO: 721238 - DNA, 19 bp, Homo sapiens
actggccccggatcagagc

SEQ ID NO: 721239 - DNA, 21 bp, Homo sapiens
actggcccctagaatcagcct

SEQ ID NO: 721240 - DNA, 14 bp, Homo sapiens
actggcctaaattt

SEQ ID NO: 721241 - DNA, 17 bp, Homo sapiens
actggcctaaatttctt

SEQ ID NO: 721242 - DNA, 15 bp, Homo sapiens
actggcctcaaagca

SEQ ID NO: 721243 - DNA, 14 bp, Homo sapiens
actggcctctgtga

SEQ ID NO: 721244 - DNA, 16 bp, Homo sapiens
actggcctctgtgatt

SEQ ID NO: 721245 - DNA, 17 bp, Homo sapiens
actggcctgccttcagc

SEQ ID NO: 721246 - DNA, 19 bp, Homo sapiens
actggccttctgatgaaat

SEQ ID NO: 721247 - DNA, 19 bp, Homo sapiens
actggcgacacgtagcagc

SEQ ID NO: 721248 - DNA, 20 bp, Homo sapiens
actggcgttcacctccctgc

SEQ ID NO: 721249 - DNA, 21 bp, Homo sapiens
actggcgttcacctccctgct

SEQ ID NO: 721250 - DNA, 14 bp, Homo sapiens
actggctctccaag

SEQ ID NO: 721251 - DNA, 16 bp, Homo sapiens
actggctctccaagtg

SEQ ID NO: 721252 - DNA, 20 bp, Homo sapiens
actggctctccaagtgccag

SEQ ID NO: 721253 - DNA, 21 bp, Homo sapiens
actggctctccaagtgccaga

SEQ ID NO: 721254 - DNA, 15 bp, Homo sapiens
actggctctctccag

SEQ ID NO: 721255 - DNA, 16 bp, Homo sapiens
actggctctctccagg

SEQ ID NO: 721256 - DNA, 23 bp, Homo sapiens
actggctctctccaggatccaga

SEQ ID NO: 721257 - DNA, 15 bp, Homo sapiens
actggctggcctgag

SEQ ID NO: 721258 - DNA, 16 bp, Homo sapiens
actggctggcctgagc

SEQ ID NO: 721259 - DNA, 16 bp, Homo sapiens
actggctggctgcagt

SEQ ID NO: 721260 - DNA, 13 bp, Homo sapiens
actggctgggagt

SEQ ID NO: 721261 - DNA, 13 bp, Homo sapiens
actggctgggccc

SEQ ID NO: 721262 - DNA, 11 bp, Homo sapiens
actggctgggg

SEQ ID NO: 721263 - DNA, 21 bp, Homo sapiens
actggctgtcagtatgacatt

SEQ ID NO: 721264 - DNA, 16 bp, Homo sapiens
actggctgtctgcctg

SEQ ID NO: 721265 - DNA, 21 bp, Homo sapiens
actggcttgaaggactgcaga

SEQ ID NO: 721266 - DNA, 15 bp, Homo sapiens
actggctttggcttc

SEQ ID NO: 721267 - DNA, 18 bp, Homo sapiens
actggcttttattaatgc

SEQ ID NO: 721268 - DNA, 23 bp, Homo sapiens
actgggaagataggctctgcaca

SEQ ID NO: 721269 - DNA, 22 bp, Homo sapiens
actgggaagctggagtgctgct

SEQ ID NO: 721270 - DNA, 13 bp, Homo sapiens
actgggaaggaaa

SEQ ID NO: 721271 - DNA, 23 bp, Homo sapiens
actgggaccaaccctggggaagg

SEQ ID NO: 721272 - DNA, 20 bp, Homo sapiens
actgggaccgtgcgagctgc

SEQ ID NO: 721273 - DNA, 18 bp, Homo sapiens
actgggactcccagcaga

SEQ ID NO: 721274 - DNA, 19 bp, Homo sapiens
actgggagaggtgccagca

SEQ ID NO: 721275 - DNA, 22 bp, Homo sapiens
actgggagaggtgccagcaact

SEQ ID NO: 721276 - DNA, 14 bp, Homo sapiens
actgggaggcaggg

SEQ ID NO: 721277 - DNA, 15 bp, Homo sapiens
actgggagtcagagc

SEQ ID NO: 721278 - DNA, 20 bp, Homo sapiens
actgggagtcagagccctgg

SEQ ID NO: 721279 - DNA, 22 bp, Homo sapiens
actgggatgggaggagaggaca

SEQ ID NO: 721280 - DNA, 13 bp, Homo sapiens
actgggcaatgat

SEQ ID NO: 721281 - DNA, 18 bp, Homo sapiens
actgggcaatgatggcaa

SEQ ID NO: 721282 - DNA, 16 bp, Homo sapiens
actgggcacagattga

SEQ ID NO: 721283 - DNA, 20 bp, Homo sapiens
actgggcacagattgaagaa

SEQ ID NO: 721284 - DNA, 20 bp, Homo sapiens
actgggcaggttcctggggc

SEQ ID NO: 721285 - DNA, 18 bp, Homo sapiens
actgggcatttcacgaac

SEQ ID NO: 721286 - DNA, 15 bp, Homo sapiens
actgggccagccctg

SEQ ID NO: 721287 - DNA, 15 bp, Homo sapiens
actgggcccaggcag

SEQ ID NO: 721288 - DNA, 16 bp, Homo sapiens
actggggcctccagaa

SEQ ID NO: 721289 - DNA, 13 bp, Homo sapiens
actggggctgggg

SEQ ID NO: 721290 - DNA, 15 bp, Homo sapiens
actggggttgagggc

SEQ ID NO: 721291 - DNA, 14 bp, Homo sapiens
actgggtaatgaaa

SEQ ID NO: 721292 - DNA, 17 bp, Homo sapiens
actgggtaatttataaa

SEQ ID NO: 721293 - DNA, 16 bp, Homo sapiens
actgggtctcactcct

SEQ ID NO: 721294 - DNA, 13 bp, Homo sapiens
actgggtgagaga

SEQ ID NO: 721295 - DNA, 16 bp, Homo sapiens
actgggtgtaaacaca

SEQ ID NO: 721296 - DNA, 22 bp, Homo sapiens
actgggtgtcatttcattccat

SEQ ID NO: 721297 - DNA, 21 bp, Homo sapiens
actgggtgttgatcttacaag

SEQ ID NO: 721298 - DNA, 17 bp, Homo sapiens
actgggttaatggctag

SEQ ID NO: 721299 - DNA, 22 bp, Homo sapiens
actgggttcttgttttatatac

SEQ ID NO: 721300 - DNA, 16 bp, Homo sapiens
actgggtttcaagaaa

SEQ ID NO: 721301 - DNA, 15 bp, Homo sapiens
actgggtttctagcc

SEQ ID NO: 721302 - DNA, 23 bp, Homo sapiens
actggtaaaaagatccagggatg

SEQ ID NO: 721303 - DNA, 16 bp, Homo sapiens
actggtaagattgtta

SEQ ID NO: 721304 - DNA, 19 bp, Homo sapiens
actggtaagcgatttgaaa

SEQ ID NO: 721305 - DNA, 17 bp, Homo sapiens
actggtacttagagttt

SEQ ID NO: 721306 - DNA, 14 bp, Homo sapiens
actggtacttcctt

SEQ ID NO: 721307 - DNA, 17 bp, Homo sapiens
actggtacttcctttct

SEQ ID NO: 721308 - DNA, 13 bp, Homo sapiens
actggtcagggca

SEQ ID NO: 721309 - DNA, 21 bp, Homo sapiens
actggtccaaaagattgctga

SEQ ID NO: 721310 - DNA, 15 bp, Homo sapiens
actggtccagctctg

SEQ ID NO: 721311 - DNA, 17 bp, Homo sapiens
actggtccagctctgac

SEQ ID NO: 721312 - DNA, 13 bp, Homo sapiens
actggtctgctgt

SEQ ID NO: 721313 - DNA, 23 bp, Homo sapiens
actggtgcaagttgaggacttct

SEQ ID NO: 721314 - DNA, 23 bp, Homo sapiens
actggtgcaattacagcaaaaag

SEQ ID NO: 721315 - DNA, 14 bp, Homo sapiens
actggtgctgagtg

SEQ ID NO: 721316 - DNA, 21 bp, Homo sapiens
actggtggcccgacagcctgg

SEQ ID NO: 721317 - DNA, 22 bp, Homo sapiens
actggtggcccgacagcctggc

SEQ ID NO: 721318 - DNA, 19 bp, Homo sapiens
actggtgggggttctggca

SEQ ID NO: 721319 - DNA, 20 bp, Homo sapiens
actggtgggggttctggcag

SEQ ID NO: 721320 - DNA, 20 bp, Homo sapiens
actggtgtcaccctttgcct

SEQ ID NO: 721321 - DNA, 14 bp, Homo sapiens
actggtgtccagct

SEQ ID NO: 721322 - DNA, 19 bp, Homo sapiens
actggtgtttgaaagtagg

SEQ ID NO: 721323 - DNA, 17 bp, Homo sapiens
actggttagtgtgaaat

SEQ ID NO: 721324 - DNA, 19 bp, Homo sapiens
actggttgcatggaaatca

SEQ ID NO: 721325 - DNA, 17 bp, Homo sapiens
actggtttacaggccct

SEQ ID NO: 721326 - DNA, 21 bp, Homo sapiens
actggtttccccagggaagga

SEQ ID NO: 721327 - DNA, 20 bp, Homo sapiens
actggtttgaagaatgttaa

SEQ ID NO: 721328 - DNA, 17 bp, Homo sapiens
actggtttgtttgctta

SEQ ID NO: 721329 - DNA, 15 bp, Homo sapiens
actggttttctgcca

SEQ ID NO: 721330 - DNA, 16 bp, Homo sapiens
actgtaaaagttataa

SEQ ID NO: 721331 - DNA, 20 bp, Homo sapiens
actgtaaaagttataataac

SEQ ID NO: 721332 - DNA, 14 bp, Homo sapiens
actgtaaacacaga

SEQ ID NO: 721333 - DNA, 18 bp, Homo sapiens
actgtaaagacaaataaa

SEQ ID NO: 721334 - DNA, 13 bp, Homo sapiens
actgtaaagatgt

SEQ ID NO: 721335 - DNA, 13 bp, Homo sapiens
actgtaaagcaaa

SEQ ID NO: 721336 - DNA, 15 bp, Homo sapiens
actgtaaataaaatg

SEQ ID NO: 721337 - DNA, 18 bp, Homo sapiens
actgtaaataaaatgtgt

SEQ ID NO: 721338 - DNA, 19 bp, Homo sapiens
actgtaaataaaatgtgta

SEQ ID NO: 721339 - DNA, 23 bp, Homo sapiens
actgtaaataaaatgtgtacagt

SEQ ID NO: 721340 - DNA, 14 bp, Homo sapiens
actgtaaatatccc

SEQ ID NO: 721341 - DNA, 22 bp, Homo sapiens
actgtaaatatttatttatgtg

SEQ ID NO: 721342 - DNA, 10 bp, Homo sapiens
actgtaacac

SEQ ID NO: 721343 - DNA, 13 bp, Homo sapiens
actgtaacacttt

SEQ ID NO: 721344 - DNA, 15 bp, Homo sapiens
actgtaacattcagg

SEQ ID NO: 721345 - DNA, 15 bp, Homo sapiens
actgtaactgctcag

SEQ ID NO: 721346 - DNA, 22 bp, Homo sapiens
actgtaacttccaaataaataa

SEQ ID NO: 721347 - DNA, 14 bp, Homo sapiens
actgtaactttttt

SEQ ID NO: 721348 - DNA, 19 bp, Homo sapiens
actgtaactttttttcagt

SEQ ID NO: 721349 - DNA, 21 bp, Homo sapiens
actgtaagactcattccctag

SEQ ID NO: 721350 - DNA, 13 bp, Homo sapiens
actgtaagggatt

SEQ ID NO: 721351 - DNA, 14 bp, Homo sapiens
actgtaagtttatt

SEQ ID NO: 721352 - DNA, 17 bp, Homo sapiens
actgtaatcttaaaagt

SEQ ID NO: 721353 - DNA, 12 bp, Homo sapiens
actgtaatttag

SEQ ID NO: 721354 - DNA, 14 bp, Homo sapiens
actgtacaaagtag

SEQ ID NO: 721355 - DNA, 11 bp, Homo sapiens
actgtacaata

SEQ ID NO: 721356 - DNA, 18 bp, Homo sapiens
actgtacaataaaaacat

SEQ ID NO: 721357 - DNA, 22 bp, Homo sapiens
actgtacaatgactttattgca

SEQ ID NO: 721358 - DNA, 12 bp, Homo sapiens
actgtacagtgt

SEQ ID NO: 721359 - DNA, 15 bp, Homo sapiens
actgtacagtgtctt

SEQ ID NO: 721360 - DNA, 16 bp, Homo sapiens
actgtacagtgtcttt

SEQ ID NO: 721361 - DNA, 21 bp, Homo sapiens
actgtacagtgtctttttttg

SEQ ID NO: 721362 - DNA, 19 bp, Homo sapiens
actgtacataaattccaga

SEQ ID NO: 721363 - DNA, 24 bp, Homo sapiens
actgtacataaattccagaggact

SEQ ID NO: 721364 - DNA, 23 bp, Homo sapiens
actgtacatgaaaacacattttt

SEQ ID NO: 721365 - DNA, 13 bp, Homo sapiens
actgtacattgtg

SEQ ID NO: 721366 - DNA, 15 bp, Homo sapiens
actgtacattgtgag

SEQ ID NO: 721367 - DNA, 19 bp, Homo sapiens
actgtacattgtgagctct

SEQ ID NO: 721368 - DNA, 21 bp, Homo sapiens
actgtaccacagacacaatat

SEQ ID NO: 721369 - DNA, 14 bp, Homo sapiens
actgtactcctccc

SEQ ID NO: 721370 - DNA, 20 bp, Homo sapiens
actgtactcctcccaggcgc

SEQ ID NO: 721371 - DNA, 19 bp, Homo sapiens
actgtactgcatgtgactt

SEQ ID NO: 721372 - DNA, 18 bp, Homo sapiens
actgtactggccagtgtc

SEQ ID NO: 721373 - DNA, 16 bp, Homo sapiens
actgtacttcactgtc

SEQ ID NO: 721374 - DNA, 22 bp, Homo sapiens
actgtactttgccatttttcta

SEQ ID NO: 721375 - DNA, 18 bp, Homo sapiens
actgtagaatgatttcat

SEQ ID NO: 721376 - DNA, 20 bp, Homo sapiens
actgtagaatgatttcatgc

SEQ ID NO: 721377 - DNA, 19 bp, Homo sapiens
actgtagagatttttatgt

SEQ ID NO: 721378 - DNA, 16 bp, Homo sapiens
actgtagattgcttct

SEQ ID NO: 721379 - DNA, 22 bp, Homo sapiens
actgtagattgcttctgtagta

SEQ ID NO: 721380 - DNA, 14 bp, Homo sapiens
actgtagccacagc

SEQ ID NO: 721381 - DNA, 15 bp, Homo sapiens
actgtagccacagct

SEQ ID NO: 721382 - DNA, 20 bp, Homo sapiens
actgtagcgaccccagactg

SEQ ID NO: 721383 - DNA, 18 bp, Homo sapiens
actgtagctcaagtttaa

SEQ ID NO: 721384 - DNA, 22 bp, Homo sapiens
actgtagctcaagtttaaaagc

SEQ ID NO: 721385 - DNA, 19 bp, Homo sapiens
actgtagcttttaggaata

SEQ ID NO: 721386 - DNA, 15 bp, Homo sapiens
actgtaggcacactt

SEQ ID NO: 721387 - DNA, 21 bp, Homo sapiens
acttctcttgttaggtaattt

SEQ ID NO: 721388 - DNA, 18 bp, Homo sapiens
acttctgaagactgagaa

SEQ ID NO: 721389 - DNA, 21 bp, Homo sapiens
acttctgaagactgagaactt

SEQ ID NO: 721390 - DNA, 14 bp, Homo sapiens
acttctgactttac

SEQ ID NO: 721391 - DNA, 12 bp, Homo sapiens
acttctgagatc

SEQ ID NO: 721392 - DNA, 13 bp, Homo sapiens
acttctgagtaat

SEQ ID NO: 721393 - DNA, 14 bp, Homo sapiens
acttctgagtaatt

SEQ ID NO: 721394 - DNA, 19 bp, Homo sapiens
acttctgatgtttattaaa

SEQ ID NO: 721395 - DNA, 12 bp, Homo sapiens
acttctgcagct

SEQ ID NO: 721396 - DNA, 13 bp, Homo sapiens
acttctgcctgga

SEQ ID NO: 721397 - DNA, 16 bp, Homo sapiens
acttctgcctggagac

SEQ ID NO: 721398 - DNA, 23 bp, Homo sapiens
acttctgccttgagtccccaggg

SEQ ID NO: 721399 - DNA, 20 bp, Homo sapiens
acttctgcgggctccctcct

SEQ ID NO: 721400 - DNA, 23 bp, Homo sapiens
acttctgcgggctccctcctctg

SEQ ID NO: 721401 - DNA, 11 bp, Homo sapiens
acttctgctga

SEQ ID NO: 721402 - DNA, 13 bp, Homo sapiens
acttctggaaggc

SEQ ID NO: 721403 - DNA, 13 bp, Homo sapiens
acttctggctcct

SEQ ID NO: 721404 - DNA, 22 bp, Homo sapiens
acttctgggtcatgcactgagg

SEQ ID NO: 721405 - DNA, 13 bp, Homo sapiens
acttctgtgggca

SEQ ID NO: 721406 - DNA, 17 bp, Homo sapiens
acttctgtgttcatttt

SEQ ID NO: 721407 - DNA, 12 bp, Homo sapiens
acttctgtttct

SEQ ID NO: 721408 - DNA, 19 bp, Homo sapiens
acttctgtttctcttttgg

SEQ ID NO: 721409 - DNA, 12 bp, Homo sapiens
acttctgtttgg

SEQ ID NO: 721410 - DNA, 14 bp, Homo sapiens
acttcttaaaattc

SEQ ID NO: 721411 - DNA, 21 bp, Homo sapiens
acttcttaaaggaattctaca

SEQ ID NO: 721412 - DNA, 18 bp, Homo sapiens
acttcttcacctcttcca

SEQ ID NO: 721413 - DNA, 20 bp, Homo sapiens
acttcttcacctcttccact

SEQ ID NO: 721414 - DNA, 17 bp, Homo sapiens
acttcttctccatccct

SEQ ID NO: 721415 - DNA, 13 bp, Homo sapiens
acttcttgaaaaa

SEQ ID NO: 721416 - DNA, 15 bp, Homo sapiens
acttcttgaaaaaga

SEQ ID NO: 721417 - DNA, 18 bp, Homo sapiens
acttcttgaaacagcctg

SEQ ID NO: 721418 - DNA, 24 bp, Homo sapiens
acttcttgaaacagcctgggtgac

SEQ ID NO: 721419 - DNA, 21 bp, Homo sapiens
acttcttgaatataaaaaatc

SEQ ID NO: 721420 - DNA, 19 bp, Homo sapiens
acttcttgcttctttctag

SEQ ID NO: 721421 - DNA, 22 bp, Homo sapiens
acttcttggcttggtgaggaaa

SEQ ID NO: 721422 - DNA, 20 bp, Homo sapiens
acttcttggttcctgggatg

SEQ ID NO: 721423 - DNA, 21 bp, Homo sapiens
acttcttggtttggggagaaa

SEQ ID NO: 721424 - DNA, 18 bp, Homo sapiens
acttcttggttttctctc

SEQ ID NO: 721425 - DNA, 20 bp, Homo sapiens
acttcttggttttctctctg

SEQ ID NO: 721426 - DNA, 21 bp, Homo sapiens
acttcttggttttctctctgg

SEQ ID NO: 721427 - DNA, 21 bp, Homo sapiens
acttctttagcatttttatgc

SEQ ID NO: 721428 - DNA, 13 bp, Homo sapiens
acttctttctatt

SEQ ID NO: 721429 - DNA, 15 bp, Homo sapiens
acttcttttgaacat

SEQ ID NO: 721430 - DNA, 23 bp, Homo sapiens
acttcttttttcaaaagaaagtc

SEQ ID NO: 721431 - DNA, 12 bp, Homo sapiens
acttgaaaattt

SEQ ID NO: 721432 - DNA, 18 bp, Homo sapiens
acttgaaagcatccatgt

SEQ ID NO: 721433 - DNA, 18 bp, Homo sapiens
acttgaaataccagtgaa

SEQ ID NO: 721434 - DNA, 11 bp, Homo sapiens
acttgaaatat

SEQ ID NO: 721435 - DNA, 17 bp, Homo sapiens
acttgaaatatataata

SEQ ID NO: 721436 - DNA, 22 bp, Homo sapiens
acttgaaatatataatattcag

SEQ ID NO: 721437 - DNA, 23 bp, Homo sapiens
acttgaaatgttagtcattgtta

SEQ ID NO: 721438 - DNA, 15 bp, Homo sapiens
acttgggtcttccct

SEQ ID NO: 721439 - DNA, 16 bp, Homo sapiens
acttgggtgacggcag

SEQ ID NO: 721440 - DNA, 22 bp, Homo sapiens
acttggtgcttattgatattct

SEQ ID NO: 721441 - DNA, 16 bp, Homo sapiens
acttggtgtgaagact

SEQ ID NO: 721442 - DNA, 16 bp, Homo sapiens
acttggttctgcttca

SEQ ID NO: 721443 - DNA, 17 bp, Homo sapiens
acttggttctgcttcaa

SEQ ID NO: 721444 - DNA, 19 bp, Homo sapiens
acttggtttttggctcttt

SEQ ID NO: 721445 - DNA, 21 bp, Homo sapiens
acttgtaaaaagggggctgca

SEQ ID NO: 721446 - DNA, 15 bp, Homo sapiens
acttgtaaaatgctt

SEQ ID NO: 721447 - DNA, 16 bp, Homo sapiens
acttgtaaaatgcttt

SEQ ID NO: 721448 - DNA, 13 bp, Homo sapiens
acttgtaaataca

SEQ ID NO: 721449 - DNA, 14 bp, Homo sapiens
acttgtaaatacac

SEQ ID NO: 721450 - DNA, 16 bp, Homo sapiens
acttgtaaatacacca

SEQ ID NO: 721451 - DNA, 14 bp, Homo sapiens
acttgtaaatgctg

SEQ ID NO: 721452 - DNA, 14 bp, Homo sapiens
acttgtacaaaata

SEQ ID NO: 721453 - DNA, 23 bp, Homo sapiens
acttgtacccacaggtgaggggc

SEQ ID NO: 721454 - DNA, 19 bp, Homo sapiens
acttgtaggaatctgcctt

SEQ ID NO: 721455 - DNA, 23 bp, Homo sapiens
acttgtaggataagtgaaatgga

SEQ ID NO: 721456 - DNA, 14 bp, Homo sapiens
acttgtatattcca

SEQ ID NO: 721457 - DNA, 18 bp, Homo sapiens
acttgtatatttgtacaa

SEQ ID NO: 721458 - DNA, 20 bp, Homo sapiens
acttgtatattttaagaaat

SEQ ID NO: 721459 - DNA, 10 bp, Homo sapiens
acttgtattt

SEQ ID NO: 721460 - DNA, 13 bp, Homo sapiens
acttgtcaaagaa

SEQ ID NO: 721461 - DNA, 14 bp, Homo sapiens
acttgtcaaagaag

SEQ ID NO: 721462 - DNA, 18 bp, Homo sapiens
acttgtcaagcctgtgca

SEQ ID NO: 721463 - DNA, 13 bp, Homo sapiens
acttgtcaatatt

SEQ ID NO: 721464 - DNA, 14 bp, Homo sapiens
acttgtcaatattt

SEQ ID NO: 721465 - DNA, 20 bp, Homo sapiens
acttgtcaatatttaaacat

SEQ ID NO: 721466 - DNA, 14 bp, Homo sapiens
acttgtcctcagct

SEQ ID NO: 721467 - DNA, 15 bp, Homo sapiens
acttgtctcctttct

SEQ ID NO: 721468 - DNA, 20 bp, Homo sapiens
acttgtctcctttctgactg

SEQ ID NO: 721469 - DNA, 12 bp, Homo sapiens
acttgtctgagg

SEQ ID NO: 721470 - DNA, 16 bp, Homo sapiens
acttgtctgaggcctc

SEQ ID NO: 721471 - DNA, 20 bp, Homo sapiens
acttgtctgtcaaatgtttc

SEQ ID NO: 721472 - DNA, 17 bp, Homo sapiens
acttgtcttgctcttag

SEQ ID NO: 721473 - DNA, 16 bp, Homo sapiens
acttgtctttttctgg

SEQ ID NO: 721474 - DNA, 16 bp, Homo sapiens
acttgtgactgaaggg

SEQ ID NO: 721475 - DNA, 13 bp, Homo sapiens
acttgtgcactta

SEQ ID NO: 721476 - DNA, 12 bp, Homo sapiens
acttgtgccagc

SEQ ID NO: 721477 - DNA, 15 bp, Homo sapiens
acttgtgctttgctc

SEQ ID NO: 721478 - DNA, 13 bp, Homo sapiens
acttgtggcctca

SEQ ID NO: 721479 - DNA, 15 bp, Homo sapiens
acttgtgggatggtg

SEQ ID NO: 721480 - DNA, 13 bp, Homo sapiens
acttgtgtatatt

SEQ ID NO: 721481 - DNA, 23 bp, Homo sapiens
acttgtgtcccatgatccctgtg

SEQ ID NO: 721482 - DNA, 22 bp, Homo sapiens
acttgtgtccctaatgtgttta

SEQ ID NO: 721483 - DNA, 22 bp, Homo sapiens
acttgtgtctctgtgcttttaa

SEQ ID NO: 721484 - DNA, 13 bp, Homo sapiens
acttgtgtttgct

SEQ ID NO: 721485 - DNA, 15 bp, Homo sapiens
acttgttatattata

SEQ ID NO: 721486 - DNA, 16 bp, Homo sapiens
acttgttccagctctt

SEQ ID NO: 721487 - DNA, 16 bp, Homo sapiens
acttgttctgagtaag

SEQ ID NO: 721488 - DNA, 13 bp, Homo sapiens
acttgttcttggt

SEQ ID NO: 721489 - DNA, 19 bp, Homo sapiens
acttgttgattaatggaaa

SEQ ID NO: 721490 - DNA, 21 bp, Homo sapiens
acttgttgattaatggaaatg

SEQ ID NO: 721491 - DNA, 15 bp, Homo sapiens
acttgttttcaatgt

SEQ ID NO: 721492 - DNA, 16 bp, Homo sapiens
actttaaaaaaacaat

SEQ ID NO: 721493 - DNA, 18 bp, Homo sapiens
actttaaaaaggaaattt

SEQ ID NO: 721494 - DNA, 12 bp, Homo sapiens
actttaaaacac

SEQ ID NO: 721495 - DNA, 12 bp, Homo sapiens
actttaaaactg

SEQ ID NO: 721496 - DNA, 14 bp, Homo sapiens
actttaaaagcatt

SEQ ID NO: 721497 - DNA, 14 bp, Homo sapiens
actttaaaaggcaa

SEQ ID NO: 721498 - DNA, 16 bp, Homo sapiens
actttaaaaggcaact

SEQ ID NO: 721499 - DNA, 12 bp, Homo sapiens
actttaaaatgc

SEQ ID NO: 721500 - DNA, 13 bp, Homo sapiens
actttaaaatgcg

SEQ ID NO: 721501 - DNA, 15 bp, Homo sapiens
actttaaacatctag

SEQ ID NO: 721502 - DNA, 15 bp, Homo sapiens
actttaaagaggctg

SEQ ID NO: 721503 - DNA, 23 bp, Homo sapiens
actttaaagaggctgtgtggcca

SEQ ID NO: 721504 - DNA, 12 bp, Homo sapiens
actttaaagcgt

SEQ ID NO: 721505 - DNA, 12 bp, Homo sapiens
actttaaaggaa

SEQ ID NO: 721506 - DNA, 20 bp, Homo sapiens
actttaaaggaaaaaatgtt

SEQ ID NO: 721507 - DNA, 18 bp, Homo sapiens
actttaaccctctcttcc

SEQ ID NO: 721508 - DNA, 20 bp, Homo sapiens
actttaaccctctcttccct

SEQ ID NO: 721509 - DNA, 13 bp, Homo sapiens
actttaagcacta

SEQ ID NO: 721510 - DNA, 14 bp, Homo sapiens
actttaagcactac

SEQ ID NO: 721511 - DNA, 16 bp, Homo sapiens
actttaaggtgaatga

SEQ ID NO: 721512 - DNA, 15 bp, Homo sapiens
actttaagtttcagg

SEQ ID NO: 721513 - DNA, 21 bp, Homo sapiens
actttaattatatattttcat

SEQ ID NO: 721514 - DNA, 12 bp, Homo sapiens
actttaattgaa

SEQ ID NO: 721515 - DNA, 20 bp, Homo sapiens
actttaattgcttaaaagac

SEQ ID NO: 721516 - DNA, 15 bp, Homo sapiens
actttacaaaccatt

SEQ ID NO: 721517 - DNA, 14 bp, Homo sapiens
actttacagaaatg

SEQ ID NO: 721518 - DNA, 15 bp, Homo sapiens
actttacagaaatgg

SEQ ID NO: 721519 - DNA, 22 bp, Homo sapiens
actttaccttttttatacataa

SEQ ID NO: 721520 - DNA, 15 bp, Homo sapiens
actttacgcccatct

SEQ ID NO: 721521 - DNA, 19 bp, Homo sapiens
actttacttgtggtgtgac

SEQ ID NO: 721522 - DNA, 13 bp, Homo sapiens
actttacttttgc

SEQ ID NO: 721523 - DNA, 18 bp, Homo sapiens
actttagaaagctgacat

SEQ ID NO: 721524 - DNA, 21 bp, Homo sapiens
actttagaagtagaattgaca

SEQ ID NO: 721525 - DNA, 15 bp, Homo sapiens
actttagggctgtaa

SEQ ID NO: 721526 - DNA, 23 bp, Homo sapiens
actttagggctgtaaaatgcatg

SEQ ID NO: 721527 - DNA, 19 bp, Homo sapiens
actttagggggtgggattc

SEQ ID NO: 721528 - DNA, 17 bp, Homo sapiens
actttagtgaaacataa

SEQ ID NO: 721529 - DNA, 20 bp, Homo sapiens
actttagtttgcctgcagtt

SEQ ID NO: 721530 - DNA, 21 bp, Homo sapiens
actttatcacattatttgcat

SEQ ID NO: 721531 - DNA, 15 bp, Homo sapiens
actttatcacttaaa

SEQ ID NO: 721532 - DNA, 13 bp, Homo sapiens
actttatcatgaa

SEQ ID NO: 721533 - DNA, 16 bp, Homo sapiens
actttatcatgaatgc

SEQ ID NO: 721534 - DNA, 18 bp, Homo sapiens
actttatcatgaatgctt

SEQ ID NO: 721535 - DNA, 13 bp, Homo sapiens
actttatgtagtt

SEQ ID NO: 721536 - DNA, 13 bp, Homo sapiens
actttatgtgtaa

SEQ ID NO: 721537 - DNA, 16 bp, Homo sapiens
actttatgtgtaaata

SEQ ID NO: 721538 - DNA, 15 bp, Homo sapiens
actttattaacttac

SEQ ID NO: 721539 - DNA, 17 bp, Homo sapiens
actttattaagtaaaat

SEQ ID NO: 721540 - DNA, 18 bp, Homo sapiens
actttattaagtaaaatc

SEQ ID NO: 721541 - DNA, 12 bp, Homo sapiens
actttattcttg

SEQ ID NO: 721542 - DNA, 12 bp, Homo sapiens
actttattgcat

SEQ ID NO: 721543 - DNA, 13 bp, Homo sapiens
actttattgcata

SEQ ID NO: 721544 - DNA, 15 bp, Homo sapiens
actttattgcttaat

SEQ ID NO: 721545 - DNA, 13 bp, Homo sapiens
actttatttaaat

SEQ ID NO: 721546 - DNA, 18 bp, Homo sapiens
actttatttaaatgcatg

SEQ ID NO: 721547 - DNA, 15 bp, Homo sapiens
actttatttatttct

SEQ ID NO: 721548 - DNA, 16 bp, Homo sapiens
actttatttatttcta

SEQ ID NO: 721549 - DNA, 14 bp, Homo sapiens
actttatttgtaaa

SEQ ID NO: 721550 - DNA, 21 bp, Homo sapiens
actttattttatataataaag

SEQ ID NO: 721551 - DNA, 20 bp, Homo sapiens
actttcacatagatgtccct

SEQ ID NO: 721552 - DNA, 23 bp, Homo sapiens
actttcacgtggcctccgcagtg

SEQ ID NO: 721553 - DNA, 21 bp, Homo sapiens
actttcactataatgtgaaat

SEQ ID NO: 721554 - DNA, 15 bp, Homo sapiens
actttcacttcttcc

SEQ ID NO: 721555 - DNA, 21 bp, Homo sapiens
actttcaggtactaaatacct

SEQ ID NO: 721556 - DNA, 22 bp, Homo sapiens
actttcatattttaaacagagg

SEQ ID NO: 721557 - DNA, 14 bp, Homo sapiens
actttcatcttaaa

SEQ ID NO: 721558 - DNA, 16 bp, Homo sapiens
actttcatcttaaact

SEQ ID NO: 721559 - DNA, 18 bp, Homo sapiens
actttcattccttcagat

SEQ ID NO: 721560 - DNA, 18 bp, Homo sapiens
actttccaccccctccct

SEQ ID NO: 721561 - DNA, 16 bp, Homo sapiens
actttcccaaatgtat

SEQ ID NO: 721562 - DNA, 16 bp, Homo sapiens
actttcccaggttctg

SEQ ID NO: 721563 - DNA, 21 bp, Homo sapiens
actttcccaggttctgtttat

SEQ ID NO: 721564 - DNA, 15 bp, Homo sapiens
actttcccccttccc

SEQ ID NO: 721565 - DNA, 15 bp, Homo sapiens
actttccctagaaag

SEQ ID NO: 721566 - DNA, 11 bp, Homo sapiens
actttcccttg

SEQ ID NO: 721567 - DNA, 13 bp, Homo sapiens
actttcccttgct

SEQ ID NO: 721568 - DNA, 17 bp, Homo sapiens
actttcccttgcttttc

SEQ ID NO: 721569 - DNA, 12 bp, Homo sapiens
actttcctcagt

SEQ ID NO: 721570 - DNA, 15 bp, Homo sapiens
actttccttctctgt

SEQ ID NO: 721571 - DNA, 17 bp, Homo sapiens
actttctaatgtttctg

SEQ ID NO: 721572 - DNA, 17 bp, Homo sapiens
actttctacaatgtgaa

SEQ ID NO: 721573 - DNA, 21 bp, Homo sapiens
actttctacaatgtgaacttt

SEQ ID NO: 721574 - DNA, 17 bp, Homo sapiens
actttctcagttttcat

SEQ ID NO: 721575 - DNA, 12 bp, Homo sapiens
actttctctaat

SEQ ID NO: 721576 - DNA, 14 bp, Homo sapiens
actttctctaataa

SEQ ID NO: 721577 - DNA, 15 bp, Homo sapiens
actttctctaataat

SEQ ID NO: 721578 - DNA, 18 bp, Homo sapiens
actttctctaataataaa

SEQ ID NO: 721579 - DNA, 22 bp, Homo sapiens
actttctcttaagattaatttt

SEQ ID NO: 721580 - DNA, 12 bp, Homo sapiens
actttctcttca

SEQ ID NO: 721581 - DNA, 13 bp, Homo sapiens
actttctgccgct

SEQ ID NO: 721582 - DNA, 13 bp, Homo sapiens
actttctgcctgg

SEQ ID NO: 721583 - DNA, 23 bp, Homo sapiens
actttctgtgacgcagacagagg

SEQ ID NO: 721584 - DNA, 13 bp, Homo sapiens
actttctgttcct

SEQ ID NO: 721585 - DNA, 12 bp, Homo sapiens
actttcttaaaa

SEQ ID NO: 721586 - DNA, 14 bp, Homo sapiens
actttcttcaggta

SEQ ID NO: 721587 - DNA, 10 bp, Homo sapiens
actttcttct

SEQ ID NO: 721588 - DNA, 18 bp, Homo sapiens
actttcttctgaatattt

SEQ ID NO: 721589 - DNA, 16 bp, Homo sapiens
actttctttctcacta

SEQ ID NO: 721590 - DNA, 14 bp, Homo sapiens
actttgaaaatatt

SEQ ID NO: 721591 - DNA, 18 bp, Homo sapiens
actttgaaaggagatgtc

SEQ ID NO: 721592 - DNA, 19 bp, Homo sapiens
actttgaaatgtgtttctg

SEQ ID NO: 721593 - DNA, 21 bp, Homo sapiens
actttgaactgaaacttttct

SEQ ID NO: 721594 - DNA, 19 bp, Homo sapiens
actttgaagggcaagaaat

SEQ ID NO: 721595 - DNA, 14 bp, Homo sapiens
actttgaagttagc

SEQ ID NO: 721596 - DNA, 23 bp, Homo sapiens
actttgacaaaaatggttttgaa

SEQ ID NO: 721597 - DNA, 14 bp, Homo sapiens
actttgacaaggaa

SEQ ID NO: 721598 - DNA, 17 bp, Homo sapiens
actttgacacttttcat

SEQ ID NO: 721599 - DNA, 14 bp, Homo sapiens
actttgacagtgtt

SEQ ID NO: 721600 - DNA, 20 bp, Homo sapiens
actttgacctaaattattta

SEQ ID NO: 721601 - DNA, 18 bp, Homo sapiens
actttgacctctgcagca

SEQ ID NO: 721602 - DNA, 19 bp, Homo sapiens
actttgacctctgcagcaa

SEQ ID NO: 721603 - DNA, 18 bp, Homo sapiens
actttgagcatttttaag

SEQ ID NO: 721604 - DNA, 17 bp, Homo sapiens
actttgagttaagtcta

SEQ ID NO: 721605 - DNA, 14 bp, Homo sapiens
actttgatccttgg

SEQ ID NO: 721606 - DNA, 16 bp, Homo sapiens
actttgatctctgctt

SEQ ID NO: 721607 - DNA, 18 bp, Homo sapiens
actttgatctctgcttac

SEQ ID NO: 721608 - DNA, 14 bp, Homo sapiens
actttgattctgat

SEQ ID NO: 721609 - DNA, 20 bp, Homo sapiens
actttgcaaattatttatta

SEQ ID NO: 721610 - DNA, 17 bp, Homo sapiens
actttgcactgatatat

SEQ ID NO: 721611 - DNA, 21 bp, Homo sapiens
actttgcactgatatatcatg

SEQ ID NO: 721612 - DNA, 22 bp, Homo sapiens
actttgcagcacagctgagagg

SEQ ID NO: 721613 - DNA, 21 bp, Homo sapiens
actttgcaggcggccctcagt

SEQ ID NO: 721614 - DNA, 16 bp, Homo sapiens
actttgcataaattaa

SEQ ID NO: 721615 - DNA, 16 bp, Homo sapiens
actttgcattgtctgt

SEQ ID NO: 721616 - DNA, 19 bp, Homo sapiens
actttgccagcttttcctc

SEQ ID NO: 721617 - DNA, 14 bp, Homo sapiens
actttgccattttt

SEQ ID NO: 721618 - DNA, 13 bp, Homo sapiens
acttttgaaaaga

SEQ ID NO: 721619 - DNA, 22 bp, Homo sapiens
acttttgaagaggcctaagtca

SEQ ID NO: 721620 - DNA, 12 bp, Homo sapiens
acttttgacaaa

SEQ ID NO: 721621 - DNA, 19 bp, Homo sapiens
acttttgactaagaatttt

SEQ ID NO: 721622 - DNA, 20 bp, Homo sapiens
acttttgagtgtgtgtgtgc

SEQ ID NO: 721623 - DNA, 21 bp, Homo sapiens
acttttgagtgtgtgtgtgca

SEQ ID NO: 721624 - DNA, 14 bp, Homo sapiens
acttttgcaaataa

SEQ ID NO: 721625 - DNA, 15 bp, Homo sapiens
acttttgccctttga

SEQ ID NO: 721626 - DNA, 20 bp, Homo sapiens
acttttgcttaccttttcct

SEQ ID NO: 721627 - DNA, 22 bp, Homo sapiens
acttttgcttaccttttcctat

SEQ ID NO: 721628 - DNA, 18 bp, Homo sapiens
acttttggaaccatgcct

SEQ ID NO: 721629 - DNA, 14 bp, Homo sapiens
acttttggaatcat

SEQ ID NO: 721630 - DNA, 13 bp, Homo sapiens
acttttgggcctt

SEQ ID NO: 721631 - DNA, 20 bp, Homo sapiens
acttttgtaatttgaattgg

SEQ ID NO: 721632 - DNA, 18 bp, Homo sapiens
acttttgtgtaatgaaaa

SEQ ID NO: 721633 - DNA, 15 bp, Homo sapiens
acttttgttaacagt

SEQ ID NO: 721634 - DNA, 13 bp, Homo sapiens
acttttgttctct

SEQ ID NO: 721635 - DNA, 13 bp, Homo sapiens
acttttgttctgc

SEQ ID NO: 721636 - DNA, 21 bp, Homo sapiens
acttttgttctgctttatctt

SEQ ID NO: 721637 - DNA, 13 bp, Homo sapiens
acttttgtttaaa

SEQ ID NO: 721638 - DNA, 14 bp, Homo sapiens
acttttgttttttg

SEQ ID NO: 721639 - DNA, 22 bp, Homo sapiens
actttttaaaaaactattttat

SEQ ID NO: 721640 - DNA, 13 bp, Homo sapiens
actttttaaaata

SEQ ID NO: 721641 - DNA, 18 bp, Homo sapiens
actttttaaagtaaatta

SEQ ID NO: 721642 - DNA, 11 bp, Homo sapiens
actttttacaa

SEQ ID NO: 721643 - DNA, 21 bp, Homo sapiens
actttttatactccatacata

SEQ ID NO: 721644 - DNA, 19 bp, Homo sapiens
actttttatttgaggagac

SEQ ID NO: 721645 - DNA, 20 bp, Homo sapiens
actttttccagcaaaatgga

SEQ ID NO: 721646 - DNA, 17 bp, Homo sapiens
actttttctaggtggca

SEQ ID NO: 721647 - DNA, 22 bp, Homo sapiens
actttttgatggaattaaatgt

SEQ ID NO: 721648 - DNA, 21 bp, Homo sapiens
actttttgcaccttattttct

SEQ ID NO: 721649 - DNA, 17 bp, Homo sapiens
actttttggaattcagc

SEQ ID NO: 721650 - DNA, 20 bp, Homo sapiens
actttttggaattcagcagt

SEQ ID NO: 721651 - DNA, 17 bp, Homo sapiens
actttttggaattgtct

SEQ ID NO: 721652 - DNA, 15 bp, Homo sapiens
actttttggctggag

SEQ ID NO: 721653 - DNA, 13 bp, Homo sapiens
actttttgtgaat

SEQ ID NO: 721654 - DNA, 18 bp, Homo sapiens
acttttttatccacctcc

SEQ ID NO: 721655 - DNA, 20 bp, Homo sapiens
acttttttatccacctccct

SEQ ID NO: 721656 - DNA, 16 bp, Homo sapiens
acttttttatgaagaa

SEQ ID NO: 721657 - DNA, 21 bp, Homo sapiens
acttttttgaaataataaatc

SEQ ID NO: 721658 - DNA, 21 bp, Homo sapiens
acttttttgagacatgggatc

SEQ ID NO: 721659 - DNA, 22 bp, Homo sapiens
acttttttgagtggatgatgtt

SEQ ID NO: 721660 - DNA, 22 bp, Homo sapiens
acttttttggtactataaaagc

SEQ ID NO: 721661 - DNA, 20 bp, Homo sapiens
acttttttgtggcaattagt

SEQ ID NO: 721662 - DNA, 17 bp, Homo sapiens
acttttttgtgtatgta

SEQ ID NO: 721663 - DNA, 21 bp, Homo sapiens
agaaaactcccaatacaaaga

SEQ ID NO: 721664 - DNA, 15 bp, Homo sapiens
agaaaactgaaaatc

SEQ ID NO: 721665 - DNA, 14 bp, Homo sapiens
agaaaacttctttt

SEQ ID NO: 721666 - DNA, 10 bp, Homo sapiens
agaaaagaaa

SEQ ID NO: 721667 - DNA, 17 bp, Homo sapiens
agaaaagaaaaaaaaag

SEQ ID NO: 721668 - DNA, 18 bp, Homo sapiens
agaaaagaaaaaaaaaga

SEQ ID NO: 721669 - DNA, 18 bp, Homo sapiens
agaaaagaccctgagact

SEQ ID NO: 721670 - DNA, 19 bp, Homo sapiens
agaaaagacggatggcagg

SEQ ID NO: 721671 - DNA, 14 bp, Homo sapiens
agaaaagacttttg

SEQ ID NO: 721672 - DNA, 13 bp, Homo sapiens
agaaaagagaaac

SEQ ID NO: 721673 - DNA, 23 bp, Homo sapiens
agaaaagagatattttaaaatga

SEQ ID NO: 721674 - DNA, 15 bp, Homo sapiens
agaaaagatgaattt

SEQ ID NO: 721675 - DNA, 19 bp, Homo sapiens
agaaaagatgaatttgtcc

SEQ ID NO: 721676 - DNA, 22 bp, Homo sapiens
agaaaagatgaatttgtccaat

SEQ ID NO: 721677 - DNA, 19 bp, Homo sapiens
agaaaagatgtagatttat

SEQ ID NO: 721678 - DNA, 18 bp, Homo sapiens
agaaaagattttaatcaa

SEQ ID NO: 721679 - DNA, 16 bp, Homo sapiens
agaaaagcacctgccg

SEQ ID NO: 721680 - DNA, 21 bp, Homo sapiens
agaaaagcagacgcagcagct

SEQ ID NO: 721681 - DNA, 23 bp, Homo sapiens
agaaaagcagtcccattcatatt

SEQ ID NO: 721682 - DNA, 12 bp, Homo sapiens
agaaaagcattt

SEQ ID NO: 721683 - DNA, 15 bp, Homo sapiens
agaaaagcattttca

SEQ ID NO: 721684 - DNA, 15 bp, Homo sapiens
agaaaagctcagagt

SEQ ID NO: 721685 - DNA, 18 bp, Homo sapiens
agaaaaggcaaaagactg

SEQ ID NO: 721686 - DNA, 21 bp, Homo sapiens
agaaaaggctggagagagatt

SEQ ID NO: 721687 - DNA, 15 bp, Homo sapiens
agaaaagggaaaaaa

SEQ ID NO: 721688 - DNA, 17 bp, Homo sapiens
agaaaagggaaaaaaga

SEQ ID NO: 721689 - DNA, 18 bp, Homo sapiens
agaaaagggaaaaaagaa

SEQ ID NO: 721690 - DNA, 22 bp, Homo sapiens
agaaaagggaaaaaagaaagaa

SEQ ID NO: 721691 - DNA, 15 bp, Homo sapiens
agaaaagtaatgaag

SEQ ID NO: 721692 - DNA, 16 bp, Homo sapiens
agaaaagtaatgaaga

SEQ ID NO: 721693 - DNA, 20 bp, Homo sapiens
agaaaagtaatgaagaatca

SEQ ID NO: 721694 - DNA, 21 bp, Homo sapiens
agaaaagtaatgaagaatcac

SEQ ID NO: 721695 - DNA, 17 bp, Homo sapiens
agaaaagtattctcaaa

SEQ ID NO: 721696 - DNA, 12 bp, Homo sapiens
agaaaagtgaat

SEQ ID NO: 721697 - DNA, 14 bp, Homo sapiens
agaaaagtgcctga

SEQ ID NO: 721698 - DNA, 13 bp, Homo sapiens
agaaaagtgggct

SEQ ID NO: 721699 - DNA, 16 bp, Homo sapiens
agaaaagtgttttgtt

SEQ ID NO: 721700 - DNA, 12 bp, Homo sapiens
agaaaagttatt

SEQ ID NO: 721701 - DNA, 18 bp, Homo sapiens
agaaaagttcaatactct

SEQ ID NO: 721702 - DNA, 20 bp, Homo sapiens
agaaactccgaagaaaagaa

SEQ ID NO: 721703 - DNA, 12 bp, Homo sapiens
agaaactgaaag

SEQ ID NO: 721704 - DNA, 17 bp, Homo sapiens
agaaactgaaagtgttt

SEQ ID NO: 721705 - DNA, 12 bp, Homo sapiens
agaaactgaacc

SEQ ID NO: 721706 - DNA, 20 bp, Homo sapiens
agaaactgaaccaacagaag

SEQ ID NO: 721707 - DNA, 15 bp, Homo sapiens
agaaactgaatgaat

SEQ ID NO: 721708 - DNA, 16 bp, Homo sapiens
agaaactgaggaattt

SEQ ID NO: 721709 - DNA, 19 bp, Homo sapiens
agaaactggattaaaacaa

SEQ ID NO: 721710 - DNA, 15 bp, Homo sapiens
agaaactggcaaagc

SEQ ID NO: 721711 - DNA, 16 bp, Homo sapiens
agaaactggcaaagca

SEQ ID NO: 721712 - DNA, 22 bp, Homo sapiens
agaaactggcaaagcagaatgt

SEQ ID NO: 721713 - DNA, 22 bp, Homo sapiens
agaaactgttcccacctgctgg

SEQ ID NO: 721714 - DNA, 20 bp, Homo sapiens
agaaacttaccaattgatgt

SEQ ID NO: 721715 - DNA, 19 bp, Homo sapiens
agaaacttccaaatcccct

SEQ ID NO: 721716 - DNA, 15 bp, Homo sapiens
agaaacttgaactcc

SEQ ID NO: 721717 - DNA, 16 bp, Homo sapiens
agaaacttggctggaa

SEQ ID NO: 721718 - DNA, 17 bp, Homo sapiens
agaaacttggctggaat

SEQ ID NO: 721719 - DNA, 22 bp, Homo sapiens
agaaactttgatctctgcttac

SEQ ID NO: 721720 - DNA, 15 bp, Homo sapiens
agaaacttttttatt

SEQ ID NO: 721721 - DNA, 21 bp, Homo sapiens
agaaagaaaagaccctgagac

SEQ ID NO: 721722 - DNA, 13 bp, Homo sapiens
agaaagaaaaggc

SEQ ID NO: 721723 - DNA, 17 bp, Homo sapiens
agaaccaccactgcctg

SEQ ID NO: 721724 - DNA, 12 bp, Homo sapiens
agaaccagaggg

SEQ ID NO: 721725 - DNA, 23 bp, Homo sapiens
agaaccagagggcatgctgaatg

SEQ ID NO: 721726 - DNA, 18 bp, Homo sapiens
agaagactagaggccagg

SEQ ID NO: 721727 - DNA, 22 bp, Homo sapiens
agaagactggctagtgtggaag

SEQ ID NO: 721728 - DNA, 15 bp, Homo sapiens
agaagactttaatta

SEQ ID NO: 721729 - DNA, 17 bp, Homo sapiens
agaagagaaatacagct

SEQ ID NO: 721730 - DNA, 17 bp, Homo sapiens
agaagagaagctgctga

SEQ ID NO: 721731 - DNA, 22 bp, Homo sapiens
agaagagaatattagctttact

SEQ ID NO: 721732 - DNA, 13 bp, Homo sapiens
agaagagaattca

SEQ ID NO: 721733 - DNA, 20 bp, Homo sapiens
agaagagaattcagtatttt

SEQ ID NO: 721734 - DNA, 21 bp, Homo sapiens
agaagagaattcagtattttt

SEQ ID NO: 721735 - DNA, 22 bp, Homo sapiens
agaagagaattcagtatttttt

SEQ ID NO: 721736 - DNA, 16 bp, Homo sapiens
agaaggcaaaaatagt

SEQ ID NO: 721737 - DNA, 19 bp, Homo sapiens
agaaggcaaaaatagtttg

SEQ ID NO: 721738 - DNA, 15 bp, Homo sapiens
agaaggcaaaaatgt

SEQ ID NO: 721739 - DNA, 13 bp, Homo sapiens
agaaggcacacag

SEQ ID NO: 721740 - DNA, 20 bp, Homo sapiens
agaaggcagcaaagaggggc

SEQ ID NO: 721741 - DNA, 14 bp, Homo sapiens
agaaggcaggcctc

SEQ ID NO: 721742 - DNA, 22 bp, Homo sapiens
agaaggcagggaatgcctggag

SEQ ID NO: 721743 - DNA, 18 bp, Homo sapiens
agaaggcagtagttttca

SEQ ID NO: 721744 - DNA, 20 bp, Homo sapiens
agaaggcagtagttttcaaa

SEQ ID NO: 721745 - DNA, 19 bp, Homo sapiens
agaaggccccagagagacc

SEQ ID NO: 721746 - DNA, 22 bp, Homo sapiens
agaaggcctcttgtgctcacgc

SEQ ID NO: 721747 - DNA, 13 bp, Homo sapiens
agaaggcgaggag

SEQ ID NO: 721748 - DNA, 14 bp, Homo sapiens
agaaggcttctctc

SEQ ID NO: 721749 - DNA, 18 bp, Homo sapiens
agaaggcttctctccaca

SEQ ID NO: 721750 - DNA, 21 bp, Homo sapiens
agaagggatatctactgtggt

SEQ ID NO: 721751 - DNA, 19 bp, Homo sapiens
agaagggccagtcctgcct

SEQ ID NO: 721752 - DNA, 20 bp, Homo sapiens
agaagggccagtcctgcctg

SEQ ID NO: 721753 - DNA, 15 bp, Homo sapiens
agaaggggaagcact

SEQ ID NO: 721754 - DNA, 16 bp, Homo sapiens
agaaggggaagcactc

SEQ ID NO: 721755 - DNA, 17 bp, Homo sapiens
agaaggggaggacactg

SEQ ID NO: 721756 - DNA, 17 bp, Homo sapiens
agaaggggctgcttgct

SEQ ID NO: 721757 - DNA, 21 bp, Homo sapiens
agaagggggctctgccccagg

SEQ ID NO: 721758 - DNA, 18 bp, Homo sapiens
agaagggggtctctgtta

SEQ ID NO: 721759 - DNA, 17 bp, Homo sapiens
agaagggggttgtggca

SEQ ID NO: 721760 - DNA, 22 bp, Homo sapiens
agaagggtggatgacagggcag

SEQ ID NO: 721761 - DNA, 20 bp, Homo sapiens
agaagggttatcctttcatt

SEQ ID NO: 721762 - DNA, 16 bp, Homo sapiens
agaagggttctgccct

SEQ ID NO: 721763 - DNA, 17 bp, Homo sapiens
agaagggttctgccctg

SEQ ID NO: 721764 - DNA, 20 bp, Homo sapiens
agaagggttttccaccctgg

SEQ ID NO: 721765 - DNA, 23 bp, Homo sapiens
agaaggtatcagttatatgatat

SEQ ID NO: 721766 - DNA, 21 bp, Homo sapiens
agaaggtattccttttgtgta

SEQ ID NO: 721767 - DNA, 14 bp, Homo sapiens
agaaggtatttttc

SEQ ID NO: 721768 - DNA, 14 bp, Homo sapiens
agaaggtccttaat

SEQ ID NO: 721769 - DNA, 20 bp, Homo sapiens
agaaggtccttaatgatccg

SEQ ID NO: 721770 - DNA, 21 bp, Homo sapiens
agaaggtccttaatgatccgt

SEQ ID NO: 721771 - DNA, 22 bp, Homo sapiens
agaaggtgcaggggccaggggt

SEQ ID NO: 721772 - DNA, 22 bp, Homo sapiens
agaaggtgtgtccttgaactga

SEQ ID NO: 721773 - DNA, 20 bp, Homo sapiens
agaaggttaccaagaagcct

SEQ ID NO: 721774 - DNA, 18 bp, Homo sapiens
agaaggtttctggagcag

SEQ ID NO: 721775 - DNA, 22 bp, Homo sapiens
agaaggtttggtccagcctggt

SEQ ID NO: 721776 - DNA, 13 bp, Homo sapiens
agacaatttgcac

SEQ ID NO: 721777 - DNA, 18 bp, Homo sapiens
agacaatttgcacatctt

SEQ ID NO: 721778 - DNA, 19 bp, Homo sapiens
agacacaatatgtatgctt

SEQ ID NO: 721779 - DNA, 13 bp, Homo sapiens
agacacacacaca

SEQ ID NO: 721780 - DNA, 14 bp, Homo sapiens
agacacacacacgc

SEQ ID NO: 721781 - DNA, 15 bp, Homo sapiens
agacacacacacgca

SEQ ID NO: 721782 - DNA, 20 bp, Homo sapiens
agacacacacacgcacgcac

SEQ ID NO: 721783 - DNA, 18 bp, Homo sapiens
agacacagatttttacac

SEQ ID NO: 721784 - DNA, 16 bp, Homo sapiens
agacacagcctccccc

SEQ ID NO: 721785 - DNA, 13 bp, Homo sapiens
agacacagctctt

SEQ ID NO: 721786 - DNA, 19 bp, Homo sapiens
agacacaggaaaaataaac

SEQ ID NO: 721787 - DNA, 16 bp, Homo sapiens
agacacagggacttga

SEQ ID NO: 721788 - DNA, 19 bp, Homo sapiens
agacacagggacttgaagt

SEQ ID NO: 721789 - DNA, 16 bp, Homo sapiens
agacacatactcattt

SEQ ID NO: 721790 - DNA, 18 bp, Homo sapiens
agacacatcaaatgcccc

SEQ ID NO: 721791 - DNA, 14 bp, Homo sapiens
agacacatgccagg

SEQ ID NO: 721792 - DNA, 16 bp, Homo sapiens
agacacatgctatgtt

SEQ ID NO: 721793 - DNA, 21 bp, Homo sapiens
agacacatgctatgttctgtc

SEQ ID NO: 721794 - DNA, 18 bp, Homo sapiens
agacacatgctgaggttt

SEQ ID NO: 721795 - DNA, 18 bp, Homo sapiens
agacacattatcttctgg

SEQ ID NO: 721796 - DNA, 15 bp, Homo sapiens
agacacattgccttc

SEQ ID NO: 721797 - DNA, 17 bp, Homo sapiens
agacaccacctggagtg

SEQ ID NO: 721798 - DNA, 23 bp, Homo sapiens
agacaccagactgaagtaaacag

SEQ ID NO: 721799 - DNA, 15 bp, Homo sapiens
agacaccatgtgcaa

SEQ ID NO: 721800 - DNA, 19 bp, Homo sapiens
agacaccctcaacctcttc

SEQ ID NO: 721801 - DNA, 21 bp, Homo sapiens
agacaccctcaacctcttctg

SEQ ID NO: 721802 - DNA, 17 bp, Homo sapiens
agacaccgttcattcag

SEQ ID NO: 721803 - DNA, 22 bp, Homo sapiens
agacacctccccctacccatat

SEQ ID NO: 721804 - DNA, 16 bp, Homo sapiens
agacacctgcacctcc

SEQ ID NO: 721805 - DNA, 21 bp, Homo sapiens
agacacgagcttaatcaacag

SEQ ID NO: 721806 - DNA, 21 bp, Homo sapiens
agacacgattgagaactgaca

SEQ ID NO: 721807 - DNA, 20 bp, Homo sapiens
agacacgcacggcagccaca

SEQ ID NO: 721808 - DNA, 15 bp, Homo sapiens
agacacggatctgag

SEQ ID NO: 721809 - DNA, 17 bp, Homo sapiens
agacactaaatgcagac

SEQ ID NO: 721810 - DNA, 15 bp, Homo sapiens
agacactaagttata

SEQ ID NO: 721811 - DNA, 16 bp, Homo sapiens
agacactacatatcta

SEQ ID NO: 721812 - DNA, 20 bp, Homo sapiens
agacactccccgaagtcttt

SEQ ID NO: 721813 - DNA, 16 bp, Homo sapiens
agacactctgctctgc

SEQ ID NO: 721814 - DNA, 17 bp, Homo sapiens
agacactctgctctgcc

SEQ ID NO: 721815 - DNA, 18 bp, Homo sapiens
agacactctgctctgccc

SEQ ID NO: 721816 - DNA, 17 bp, Homo sapiens
agacactgagcttctga

SEQ ID NO: 721817 - DNA, 19 bp, Homo sapiens
agacactgccgacatcagc

SEQ ID NO: 721818 - DNA, 23 bp, Homo sapiens
agacactgccgacatcagcattg

SEQ ID NO: 721819 - DNA, 11 bp, Homo sapiens
agacactggac

SEQ ID NO: 721820 - DNA, 15 bp, Homo sapiens
agacactggcccctc

SEQ ID NO: 721821 - DNA, 17 bp, Homo sapiens
agacactgttgataaaa

SEQ ID NO: 721822 - DNA, 18 bp, Homo sapiens
agacactgttgataaaaa

SEQ ID NO: 721823 - DNA, 13 bp, Homo sapiens
agacactgttgca

SEQ ID NO: 721824 - DNA, 15 bp, Homo sapiens
agacactgttgcaaa

SEQ ID NO: 721825 - DNA, 22 bp, Homo sapiens
agacactgtttacaagaaaaaa

SEQ ID NO: 721826 - DNA, 21 bp, Homo sapiens
agacacttatattttgatttt

SEQ ID NO: 721827 - DNA, 15 bp, Homo sapiens
agacacttcagatct

SEQ ID NO: 721828 - DNA, 13 bp, Homo sapiens
agacacttcccct

SEQ ID NO: 721829 - DNA, 15 bp, Homo sapiens
agacacttgccttct

SEQ ID NO: 721830 - DNA, 15 bp, Homo sapiens
agacagaaaagtgcc

SEQ ID NO: 721831 - DNA, 21 bp, Homo sapiens
agacagaaaagtgcctgagct

SEQ ID NO: 721832 - DNA, 12 bp, Homo sapiens
agacagaaaccc

SEQ ID NO: 721833 - DNA, 14 bp, Homo sapiens
agacagaacaccta

SEQ ID NO: 721834 - DNA, 14 bp, Homo sapiens
agacagaagaaaca

SEQ ID NO: 721835 - DNA, 15 bp, Homo sapiens
agacagaatggtgga

SEQ ID NO: 721836 - DNA, 17 bp, Homo sapiens
agacagaatgtatctgt

SEQ ID NO: 721837 - DNA, 19 bp, Homo sapiens
agacagaatgtatctgtga

SEQ ID NO: 721838 - DNA, 15 bp, Homo sapiens
agacagaatgtcacc

SEQ ID NO: 721839 - DNA, 17 bp, Homo sapiens
agacagacccagtgagt

SEQ ID NO: 721840 - DNA, 14 bp, Homo sapiens
agacagaccctctg

SEQ ID NO: 721841 - DNA, 14 bp, Homo sapiens
agacagagaatctt

SEQ ID NO: 721842 - DNA, 14 bp, Homo sapiens
agacagagacaagt

SEQ ID NO: 721843 - DNA, 15 bp, Homo sapiens
agacagagacaagta

SEQ ID NO: 721844 - DNA, 13 bp, Homo sapiens
agacagagacctg

SEQ ID NO: 721845 - DNA, 20 bp, Homo sapiens
agacagagaggactgtaggg

SEQ ID NO: 721846 - DNA, 16 bp, Homo sapiens
agacagagccaggaga

SEQ ID NO: 721847 - DNA, 17 bp, Homo sapiens
agacagtatatttatag

SEQ ID NO: 721848 - DNA, 13 bp, Homo sapiens
agacagtattgcc

SEQ ID NO: 721849 - DNA, 14 bp, Homo sapiens
agacagtattgcca

SEQ ID NO: 721850 - DNA, 18 bp, Homo sapiens
agacagtattgccacctc

SEQ ID NO: 721851 - DNA, 21 bp, Homo sapiens
agacagtattgccacctctgg

SEQ ID NO: 721852 - DNA, 18 bp, Homo sapiens
agacagtcgctcagtctg

SEQ ID NO: 721853 - DNA, 19 bp, Homo sapiens
agacagtcgctcagtctgt

SEQ ID NO: 721854 - DNA, 14 bp, Homo sapiens
agacagtctggaaa

SEQ ID NO: 721855 - DNA, 15 bp, Homo sapiens
agacagtctggaaag

SEQ ID NO: 721856 - DNA, 17 bp, Homo sapiens
agacagtctgttatgca

SEQ ID NO: 721857 - DNA, 22 bp, Homo sapiens
agacagtctgttatgcactgtg

SEQ ID NO: 721858 - DNA, 19 bp, Homo sapiens
agacagtgatattggaact

SEQ ID NO: 721859 - DNA, 18 bp, Homo sapiens
agacagtgatctccatat

SEQ ID NO: 721860 - DNA, 13 bp, Homo sapiens
agacagtgggaaa

SEQ ID NO: 721861 - DNA, 15 bp, Homo sapiens
agacagtgggaaata

SEQ ID NO: 721862 - DNA, 15 bp, Homo sapiens
agacagttcaagaaa

SEQ ID NO: 721863 - DNA, 20 bp, Homo sapiens
agacagtttactttgccaac

SEQ ID NO: 721864 - DNA, 22 bp, Homo sapiens
agacataaaactttaaaaggca

SEQ ID NO: 721865 - DNA, 23 bp, Homo sapiens
agacataaaactttaaaaggcaa

SEQ ID NO: 721866 - DNA, 16 bp, Homo sapiens
agacatacagctgcct

SEQ ID NO: 721867 - DNA, 22 bp, Homo sapiens
agacatactgcttgattttaat

SEQ ID NO: 721868 - DNA, 22 bp, Homo sapiens
agacatagccgattctctgccc

SEQ ID NO: 721869 - DNA, 18 bp, Homo sapiens
agacataggccatgaaaa

SEQ ID NO: 721870 - DNA, 19 bp, Homo sapiens
agacataggccatgaaaaa

SEQ ID NO: 721871 - DNA, 16 bp, Homo sapiens
agacatatttaactgg

SEQ ID NO: 721872 - DNA, 18 bp, Homo sapiens
agacatccatgtttgtaa

SEQ ID NO: 721873 - DNA, 20 bp, Homo sapiens
agacatctccagtgtgccag

SEQ ID NO: 721874 - DNA, 20 bp, Homo sapiens
agacatctctggagccagag

SEQ ID NO: 721875 - DNA, 19 bp, Homo sapiens
agacatctgaggttttatt

SEQ ID NO: 721876 - DNA, 15 bp, Homo sapiens
agacatctgcctgta

SEQ ID NO: 721877 - DNA, 19 bp, Homo sapiens
agacatctgcctgtaatta

SEQ ID NO: 721878 - DNA, 20 bp, Homo sapiens
agacatctgctgttatcacc

SEQ ID NO: 721879 - DNA, 22 bp, Homo sapiens
agacatcttgcctacttttctt

SEQ ID NO: 721880 - DNA, 18 bp, Homo sapiens
agacatgaatactatcca

SEQ ID NO: 721881 - DNA, 15 bp, Homo sapiens
agacatgatttcctt

SEQ ID NO: 721882 - DNA, 22 bp, Homo sapiens
agacatgatttccttgaatgtg

SEQ ID NO: 721883 - DNA, 16 bp, Homo sapiens
agacatgcccaaaact

SEQ ID NO: 721884 - DNA, 16 bp, Homo sapiens
agacatggaagagaga

SEQ ID NO: 721885 - DNA, 21 bp, Homo sapiens
agacatggaagagagagccat

SEQ ID NO: 721886 - DNA, 19 bp, Homo sapiens
agacatggagatgtaaaat

SEQ ID NO: 721887 - DNA, 22 bp, Homo sapiens
agacatgtaggtgtttgttcat

SEQ ID NO: 721888 - DNA, 20 bp, Homo sapiens
agacatgtctgttctacata

SEQ ID NO: 721889 - DNA, 12 bp, Homo sapiens
agacatgtgaca

SEQ ID NO: 721890 - DNA, 16 bp, Homo sapiens
agacatgtgacattta

SEQ ID NO: 721891 - DNA, 20 bp, Homo sapiens
agacatgtggaggggcagcc

SEQ ID NO: 721892 - DNA, 17 bp, Homo sapiens
agacatgtggtgggaca

SEQ ID NO: 721893 - DNA, 20 bp, Homo sapiens
agacattaactcattagact

SEQ ID NO: 721894 - DNA, 19 bp, Homo sapiens
agacattaagaagagcaga

SEQ ID NO: 721895 - DNA, 15 bp, Homo sapiens
agacattctcacata

SEQ ID NO: 721896 - DNA, 20 bp, Homo sapiens
agacattgctctatgtctgc

SEQ ID NO: 721897 - DNA, 21 bp, Homo sapiens
agacattgctctatgtctgcc

SEQ ID NO: 721898 - DNA, 13 bp, Homo sapiens
agacattgtcaat

SEQ ID NO: 721899 - DNA, 15 bp, Homo sapiens
agacatttatactct

SEQ ID NO: 721900 - DNA, 17 bp, Homo sapiens
agacatttatactcttt

SEQ ID NO: 721901 - DNA, 13 bp, Homo sapiens
agacatttatata

SEQ ID NO: 721902 - DNA, 17 bp, Homo sapiens
agacatttgctgaactc

SEQ ID NO: 721903 - DNA, 22 bp, Homo sapiens
agacatttgtaaatgtaaaact

SEQ ID NO: 721904 - DNA, 12 bp, Homo sapiens
agacatttgtat

SEQ ID NO: 721905 - DNA, 14 bp, Homo sapiens
agacatttgtatat

SEQ ID NO: 721906 - DNA, 17 bp, Homo sapiens
agacatttgtatattgt

SEQ ID NO: 721907 - DNA, 22 bp, Homo sapiens
agacattttaaaaaatggtcac

SEQ ID NO: 721908 - DNA, 14 bp, Homo sapiens
agacattttaagtt

SEQ ID NO: 721909 - DNA, 12 bp, Homo sapiens
agacattttgtt

SEQ ID NO: 721910 - DNA, 13 bp, Homo sapiens
agacattttgtta

SEQ ID NO: 721911 - DNA, 17 bp, Homo sapiens
agacatttttatttagt

SEQ ID NO: 721912 - DNA, 22 bp, Homo sapiens
agacatttttccgtttgctttt

SEQ ID NO: 721913 - DNA, 17 bp, Homo sapiens
agacatttttgtgccat

SEQ ID NO: 721914 - DNA, 15 bp, Homo sapiens
agaccaaagcaaaga

SEQ ID NO: 721915 - DNA, 16 bp, Homo sapiens
agaccaaaggaaggaa

SEQ ID NO: 721916 - DNA, 14 bp, Homo sapiens
agaccaaccctggg

SEQ ID NO: 721917 - DNA, 15 bp, Homo sapiens
agaccaaccctggga

SEQ ID NO: 721918 - DNA, 16 bp, Homo sapiens
agaccaaccctgggac

SEQ ID NO: 721919 - DNA, 17 bp, Homo sapiens
agaccaaccctgggacc

SEQ ID NO: 721920 - DNA, 14 bp, Homo sapiens
agaccaacctgacc

SEQ ID NO: 721921 - DNA, 18 bp, Homo sapiens
agaccaaggcctcggcag

SEQ ID NO: 721922 - DNA, 21 bp, Homo sapiens
agaccaaggcctcggcagaac

SEQ ID NO: 721923 - DNA, 17 bp, Homo sapiens
agaccaaggcgggagca

SEQ ID NO: 721924 - DNA, 19 bp, Homo sapiens
agaccaaggctttctctac

SEQ ID NO: 721925 - DNA, 16 bp, Homo sapiens
agaccacaaaaattga

SEQ ID NO: 721926 - DNA, 20 bp, Homo sapiens
agaccacagggttcaaaatg

SEQ ID NO: 721927 - DNA, 22 bp, Homo sapiens
agaccttaataaaggcccccac

SEQ ID NO: 721928 - DNA, 13 bp, Homo sapiens
agaccttccataa

SEQ ID NO: 721929 - DNA, 23 bp, Homo sapiens
agaccttctagtgagcctgggcc

SEQ ID NO: 721930 - DNA, 23 bp, Homo sapiens
agaccttggatcagatgaactct

SEQ ID NO: 721931 - DNA, 16 bp, Homo sapiens
agaccttggctgctca

SEQ ID NO: 721932 - DNA, 18 bp, Homo sapiens
agaccttggctgctcact

SEQ ID NO: 721933 - DNA, 19 bp, Homo sapiens
agaccttgttacttctgag

SEQ ID NO: 721934 - DNA, 22 bp, Homo sapiens
agaccttgttacttctgaggta

SEQ ID NO: 721935 - DNA, 13 bp, Homo sapiens
agacctttatcca

SEQ ID NO: 721936 - DNA, 17 bp, Homo sapiens
agacctttatttttcta

SEQ ID NO: 721937 - DNA, 21 bp, Homo sapiens
agaccttttttttttttccaa

SEQ ID NO: 721938 - DNA, 22 bp, Homo sapiens
agacgacacctggagactgtcc

SEQ ID NO: 721939 - DNA, 23 bp, Homo sapiens
agacgacacctggagactgtccc

SEQ ID NO: 721940 - DNA, 16 bp, Homo sapiens
agacgagcatccccct

SEQ ID NO: 721941 - DNA, 13 bp, Homo sapiens
agacgagctgtct

SEQ ID NO: 721942 - DNA, 12 bp, Homo sapiens
agacgcagtccg

SEQ ID NO: 721943 - DNA, 17 bp, Homo sapiens
agacgccactccctggg

SEQ ID NO: 721944 - DNA, 15 bp, Homo sapiens
agacgcctgaggaac

SEQ ID NO: 721945 - DNA, 14 bp, Homo sapiens
agacgccttactgg

SEQ ID NO: 721946 - DNA, 20 bp, Homo sapiens
agacgccttcatctgggaca

SEQ ID NO: 721947 - DNA, 19 bp, Homo sapiens
agacggatggcaggatcca

SEQ ID NO: 721948 - DNA, 12 bp, Homo sapiens
agacggcctagg

SEQ ID NO: 721949 - DNA, 13 bp, Homo sapiens
agacggggctgga

SEQ ID NO: 721950 - DNA, 21 bp, Homo sapiens
agacggtgttttgccatgttg

SEQ ID NO: 721951 - DNA, 15 bp, Homo sapiens
agacgtaaagaattt

SEQ ID NO: 721952 - DNA, 14 bp, Homo sapiens
agacgtatgtaaca

SEQ ID NO: 721953 - DNA, 23 bp, Homo sapiens
agacgtcgtacccagccatgtgt

SEQ ID NO: 721954 - DNA, 17 bp, Homo sapiens
agacgtgattttgctgt

SEQ ID NO: 721955 - DNA, 18 bp, Homo sapiens
agacgtggactcctcttg

SEQ ID NO: 721956 - DNA, 14 bp, Homo sapiens
agacgttgcctgag

SEQ ID NO: 721957 - DNA, 15 bp, Homo sapiens
agactaaaggatcca

SEQ ID NO: 721958 - DNA, 18 bp, Homo sapiens
agactaaaggatccagag

SEQ ID NO: 721959 - DNA, 22 bp, Homo sapiens
agactaaaggatccagagagca

SEQ ID NO: 721960 - DNA, 18 bp, Homo sapiens
agactaattaaaatctgg

SEQ ID NO: 721961 - DNA, 20 bp, Homo sapiens
agactaattaaaatctggaa

SEQ ID NO: 721962 - DNA, 15 bp, Homo sapiens
agactacacaggatg

SEQ ID NO: 721963 - DNA, 13 bp, Homo sapiens
agactactcaata

SEQ ID NO: 721964 - DNA, 16 bp, Homo sapiens
agactagatggacctg

SEQ ID NO: 721965 - DNA, 14 bp, Homo sapiens
agactaggtttatt

SEQ ID NO: 721966 - DNA, 15 bp, Homo sapiens
agactatctaaatgt

SEQ ID NO: 721967 - DNA, 17 bp, Homo sapiens
agactatctaaatgttg

SEQ ID NO: 721968 - DNA, 17 bp, Homo sapiens
agactatcttactattt

SEQ ID NO: 721969 - DNA, 15 bp, Homo sapiens
agactatgaaaatgc

SEQ ID NO: 721970 - DNA, 23 bp, Homo sapiens
agactatggcctcgcctccccac

SEQ ID NO: 721971 - DNA, 21 bp, Homo sapiens
agactatttttagattttctt

SEQ ID NO: 721972 - DNA, 14 bp, Homo sapiens
agactcaaaaaaac

SEQ ID NO: 721973 - DNA, 15 bp, Homo sapiens
agactcaaaacctgg

SEQ ID NO: 721974 - DNA, 15 bp, Homo sapiens
agactcaagacttat

SEQ ID NO: 721975 - DNA, 16 bp, Homo sapiens
agactcaaggggctgg

SEQ ID NO: 721976 - DNA, 16 bp, Homo sapiens
agactcaagggggtga

SEQ ID NO: 721977 - DNA, 23 bp, Homo sapiens
agactcaagtacccattctgttt

SEQ ID NO: 721978 - DNA, 12 bp, Homo sapiens
agactcaatcat

SEQ ID NO: 721979 - DNA, 18 bp, Homo sapiens
agactcacactctctgca

SEQ ID NO: 721980 - DNA, 19 bp, Homo sapiens
agactcacactctctgcag

SEQ ID NO: 721981 - DNA, 14 bp, Homo sapiens
agactcacaggaag

SEQ ID NO: 721982 - DNA, 20 bp, Homo sapiens
agactcactgggaagctccc

SEQ ID NO: 721983 - DNA, 18 bp, Homo sapiens
agactcacttacatcttc

SEQ ID NO: 721984 - DNA, 21 bp, Homo sapiens
agactcacttctcagctgaaa

SEQ ID NO: 721985 - DNA, 11 bp, Homo sapiens
agactcagcca

SEQ ID NO: 721986 - DNA, 20 bp, Homo sapiens
agactcagctctgacattct

SEQ ID NO: 721987 - DNA, 18 bp, Homo sapiens
agactcaggagtctgcca

SEQ ID NO: 721988 - DNA, 12 bp, Homo sapiens
agactcagggcc

SEQ ID NO: 721989 - DNA, 16 bp, Homo sapiens
agactcagggccccag

SEQ ID NO: 721990 - DNA, 12 bp, Homo sapiens
agactcagtttg

SEQ ID NO: 721991 - DNA, 16 bp, Homo sapiens
agactcagtttgtcag

SEQ ID NO: 721992 - DNA, 17 bp, Homo sapiens
agactcagtttgtcaga

SEQ ID NO: 721993 - DNA, 16 bp, Homo sapiens
agactcatcttactgt

SEQ ID NO: 721994 - DNA, 24 bp, Homo sapiens
agactccagaatctgctgttgcca

SEQ ID NO: 721995 - DNA, 17 bp, Homo sapiens
agactccagcccctgga

SEQ ID NO: 721996 - DNA, 19 bp, Homo sapiens
agactcccgccccgggctg

SEQ ID NO: 721997 - DNA, 14 bp, Homo sapiens
agactcctctgggc

SEQ ID NO: 721998 - DNA, 16 bp, Homo sapiens
agactcctctgggcct

SEQ ID NO: 721999 - DNA, 22 bp, Homo sapiens
agactcctgaggacagctgtcc

SEQ ID NO: 722000 - DNA, 16 bp, Homo sapiens
agactcctgccctgtt

SEQ ID NO: 722001 - DNA, 17 bp, Homo sapiens
agactcctggtctgtga

SEQ ID NO: 722002 - DNA, 12 bp, Homo sapiens
agactccttctc

SEQ ID NO: 722003 - DNA, 16 bp, Homo sapiens
agactccttctcccca

SEQ ID NO: 722004 - DNA, 15 bp, Homo sapiens
agactcctttcctct

SEQ ID NO: 722005 - DNA, 17 bp, Homo sapiens
agactcctttcctctga

SEQ ID NO: 722006 - DNA, 19 bp, Homo sapiens
agactctacccatattaca

SEQ ID NO: 722007 - DNA, 15 bp, Homo sapiens
agactctagggtcca

SEQ ID NO: 722008 - DNA, 17 bp, Homo sapiens
agactctattttaatgt

SEQ ID NO: 722009 - DNA, 20 bp, Homo sapiens
agactctgaaatctcagaat

SEQ ID NO: 722010 - DNA, 15 bp, Homo sapiens
agactctgagccaag

SEQ ID NO: 722011 - DNA, 20 bp, Homo sapiens
agactctgagccaagggagg

SEQ ID NO: 722012 - DNA, 17 bp, Homo sapiens
agactctgagctgctca

SEQ ID NO: 722013 - DNA, 20 bp, Homo sapiens
agactctgcagccctcggga

SEQ ID NO: 722014 - DNA, 20 bp, Homo sapiens
agactctgggtccctcggag

SEQ ID NO: 722015 - DNA, 16 bp, Homo sapiens
agactctgtggggcct

SEQ ID NO: 722016 - DNA, 20 bp, Homo sapiens
agactctttatttttctctt

SEQ ID NO: 722017 - DNA, 15 bp, Homo sapiens
agactctttgaaatg

SEQ ID NO: 722018 - DNA, 21 bp, Homo sapiens
agactcttttccttccctttt

SEQ ID NO: 722019 - DNA, 14 bp, Homo sapiens
agactgaaatttag

SEQ ID NO: 722020 - DNA, 12 bp, Homo sapiens
agactgaccaat

SEQ ID NO: 722021 - DNA, 21 bp, Homo sapiens
agactgaccaatattgtacag

SEQ ID NO: 722022 - DNA, 17 bp, Homo sapiens
agactgagcacctgctt

SEQ ID NO: 722023 - DNA, 17 bp, Homo sapiens
agactgagcagccgcca

SEQ ID NO: 722024 - DNA, 16 bp, Homo sapiens
agactgagctctccag

SEQ ID NO: 722025 - DNA, 17 bp, Homo sapiens
agactgagctctccagg

SEQ ID NO: 722026 - DNA, 22 bp, Homo sapiens
agactgagctctccaggccagg

SEQ ID NO: 722027 - DNA, 16 bp, Homo sapiens
agactgaggacaaagt

SEQ ID NO: 722028 - DNA, 20 bp, Homo sapiens
agactgagtacgttgtgcat

SEQ ID NO: 722029 - DNA, 13 bp, Homo sapiens
agactgatccaaa

SEQ ID NO: 722030 - DNA, 16 bp, Homo sapiens
agactgatgagcacat

SEQ ID NO: 722031 - DNA, 20 bp, Homo sapiens
agactgatgggacatcaaat

SEQ ID NO: 722032 - DNA, 16 bp, Homo sapiens
agactgcaaacttttt

SEQ ID NO: 722033 - DNA, 21 bp, Homo sapiens
agactgcaaacttttttatat

SEQ ID NO: 722034 - DNA, 20 bp, Homo sapiens
agactgcagacattctcaaa

SEQ ID NO: 722035 - DNA, 11 bp, Homo sapiens
agactgcagct

SEQ ID NO: 722036 - DNA, 15 bp, Homo sapiens
agactgcagctgctg

SEQ ID NO: 722037 - DNA, 16 bp, Homo sapiens
agactgcagctgctga

SEQ ID NO: 722038 - DNA, 18 bp, Homo sapiens
agactgcaggtgggctgg

SEQ ID NO: 722039 - DNA, 14 bp, Homo sapiens
agactgccaggtgg

SEQ ID NO: 722040 - DNA, 20 bp, Homo sapiens
agactgccatattaaatttt

SEQ ID NO: 722041 - DNA, 21 bp, Homo sapiens
agactgccccacggagacaga

SEQ ID NO: 722042 - DNA, 22 bp, Homo sapiens
agactgccccacggagacagag

SEQ ID NO: 722043 - DNA, 14 bp, Homo sapiens
agactgcccttctc

SEQ ID NO: 722044 - DNA, 11 bp, Homo sapiens
agactgcctcc

SEQ ID NO: 722045 - DNA, 12 bp, Homo sapiens
agactgccttca

SEQ ID NO: 722046 - DNA, 14 bp, Homo sapiens
agactgccttcagt

SEQ ID NO: 722047 - DNA, 18 bp, Homo sapiens
agactgccttcagtagga

SEQ ID NO: 722048 - DNA, 20 bp, Homo sapiens
agactgctgggactggccag

SEQ ID NO: 722049 - DNA, 22 bp, Homo sapiens
agactgctgggactggccaggt

SEQ ID NO: 722050 - DNA, 19 bp, Homo sapiens
agactgcttccaattttct

SEQ ID NO: 722051 - DNA, 14 bp, Homo sapiens
agactgcttcccat

SEQ ID NO: 722052 - DNA, 21 bp, Homo sapiens
agacccaaattataagggccc

SEQ ID NO: 722053 - DNA, 23 bp, Homo sapiens
agacccaaattataagggccctg

SEQ ID NO: 722054 - DNA, 15 bp, Homo sapiens
agacccaaggctcac

SEQ ID NO: 722055 - DNA, 13 bp, Homo sapiens
agacccacctgga

SEQ ID NO: 722056 - DNA, 17 bp, Homo sapiens
agacccagcccgcggcc

SEQ ID NO: 722057 - DNA, 21 bp, Homo sapiens
agacccagcccgcggcctgga

SEQ ID NO: 722058 - DNA, 19 bp, Homo sapiens
agacccagctgcagaccat

SEQ ID NO: 722059 - DNA, 18 bp, Homo sapiens
agacccaggagagacaga

SEQ ID NO: 722060 - DNA, 22 bp, Homo sapiens
agacccagtagctgcccttcct

SEQ ID NO: 722061 - DNA, 15 bp, Homo sapiens
agacccatagcagct

SEQ ID NO: 722062 - DNA, 15 bp, Homo sapiens
agacccatgtgctgg

SEQ ID NO: 722063 - DNA, 18 bp, Homo sapiens
agaccccaagaggaagtt

SEQ ID NO: 722064 - DNA, 12 bp, Homo sapiens
agaccccaccca

SEQ ID NO: 722065 - DNA, 13 bp, Homo sapiens
agaccccagggca

SEQ ID NO: 722066 - DNA, 15 bp, Homo sapiens
agaccccagggcagg

SEQ ID NO: 722067 - DNA, 17 bp, Homo sapiens
agaccccagttctaggg

SEQ ID NO: 722068 - DNA, 13 bp, Homo sapiens
agacccccacacc

SEQ ID NO: 722069 - DNA, 11 bp, Homo sapiens
agacccccacc

SEQ ID NO: 722070 - DNA, 14 bp, Homo sapiens
agacccccacccct

SEQ ID NO: 722071 - DNA, 12 bp, Homo sapiens
agacccccactc

SEQ ID NO: 722072 - DNA, 21 bp, Homo sapiens
agacccccatttgtcccagac

SEQ ID NO: 722073 - DNA, 20 bp, Homo sapiens
agacccccccatttcccgca

SEQ ID NO: 722074 - DNA, 22 bp, Homo sapiens
agacccccccatttcccgcaca

SEQ ID NO: 722075 - DNA, 20 bp, Homo sapiens
agaccccctcagccttggga

SEQ ID NO: 722076 - DNA, 22 bp, Homo sapiens
agaccccgggtctccttggctg

SEQ ID NO: 722077 - DNA, 16 bp, Homo sapiens
agaccccgtggctctg

SEQ ID NO: 722078 - DNA, 19 bp, Homo sapiens
agaccccgtggctctggga

SEQ ID NO: 722079 - DNA, 11 bp, Homo sapiens
agacccctgcc

SEQ ID NO: 722080 - DNA, 21 bp, Homo sapiens
agacccctggcttttcactgc

SEQ ID NO: 722081 - DNA, 13 bp, Homo sapiens
agaccccttcctt

SEQ ID NO: 722082 - DNA, 15 bp, Homo sapiens
agaccccttcctttc

SEQ ID NO: 722083 - DNA, 13 bp, Homo sapiens
agacccctttgag

SEQ ID NO: 722084 - DNA, 17 bp, Homo sapiens
agaccctaaacatccat

SEQ ID NO: 722085 - DNA, 16 bp, Homo sapiens
agaccctaccccacca

SEQ ID NO: 722086 - DNA, 18 bp, Homo sapiens
agaccctaccccaccacg

SEQ ID NO: 722087 - DNA, 20 bp, Homo sapiens
agaccctactgaagtggctg

SEQ ID NO: 722088 - DNA, 17 bp, Homo sapiens
agaccctcgcagaccta

SEQ ID NO: 722089 - DNA, 12 bp, Homo sapiens
agaccctcgggc

SEQ ID NO: 722090 - DNA, 19 bp, Homo sapiens
agaccctcttgcccatcct

SEQ ID NO: 722091 - DNA, 20 bp, Homo sapiens
agaccctcttgcccatcctg

SEQ ID NO: 722092 - DNA, 12 bp, Homo sapiens
agaccctgaggc

SEQ ID NO: 722093 - DNA, 20 bp, Homo sapiens
agaccctgaggccctgggct

SEQ ID NO: 722094 - DNA, 21 bp, Homo sapiens
agaccctgaggccctgggctg

SEQ ID NO: 722095 - DNA, 17 bp, Homo sapiens
agaccctgccacagcca

SEQ ID NO: 722096 - DNA, 24 bp, Homo sapiens
agaccctgccacagccagaggagg

SEQ ID NO: 722097 - DNA, 20 bp, Homo sapiens
agaccctgccccctgccagc

SEQ ID NO: 722098 - DNA, 21 bp, Homo sapiens
agaccctgccccctgccagcc

SEQ ID NO: 722099 - DNA, 14 bp, Homo sapiens
agaccctggaggcc

SEQ ID NO: 722100 - DNA, 17 bp, Homo sapiens
agaccctgggtgggctc

SEQ ID NO: 722101 - DNA, 20 bp, Homo sapiens
agaccctgggtgggctctgt

SEQ ID NO: 722102 - DNA, 22 bp, Homo sapiens
agaccctgggtgggctctgtgc

SEQ ID NO: 722103 - DNA, 14 bp, Homo sapiens
agaccctgtgttca

SEQ ID NO: 722104 - DNA, 17 bp, Homo sapiens
agacccttattacacgg

SEQ ID NO: 722105 - DNA, 18 bp, Homo sapiens
agacccttgacacctgct

SEQ ID NO: 722106 - DNA, 22 bp, Homo sapiens
agaccctttcttcagctctgaa

SEQ ID NO: 722107 - DNA, 15 bp, Homo sapiens
agacccttttctcag

SEQ ID NO: 722108 - DNA, 16 bp, Homo sapiens
agaccgagaggccagt

SEQ ID NO: 722109 - DNA, 14 bp, Homo sapiens
agaccgcagaggga

SEQ ID NO: 722110 - DNA, 12 bp, Homo sapiens
agaccgccccag

SEQ ID NO: 722111 - DNA, 17 bp, Homo sapiens
agaccgcttcacccctg

SEQ ID NO: 722112 - DNA, 18 bp, Homo sapiens
agaccgcttcacccctgc

SEQ ID NO: 722113 - DNA, 20 bp, Homo sapiens
agaccgcttcacccctgcac

SEQ ID NO: 722114 - DNA, 18 bp, Homo sapiens
agaccgtcgggggctgag

SEQ ID NO: 722115 - DNA, 19 bp, Homo sapiens
agacctaatctctgtaaag

SEQ ID NO: 722116 - DNA, 21 bp, Homo sapiens
agacctaatctctgtaaagct

SEQ ID NO: 722117 - DNA, 16 bp, Homo sapiens
agacctagcaggctgt

SEQ ID NO: 722118 - DNA, 22 bp, Homo sapiens
agacctatactgaaagatctct

SEQ ID NO: 722119 - DNA, 15 bp, Homo sapiens
agacctcagcctgtg

SEQ ID NO: 722120 - DNA, 20 bp, Homo sapiens
agacctcagcctgtgctgcc

SEQ ID NO: 722121 - DNA, 16 bp, Homo sapiens
agacctcatcaggatg

SEQ ID NO: 722122 - DNA, 19 bp, Homo sapiens
agacctcatcaggatgaac

SEQ ID NO: 722123 - DNA, 19 bp, Homo sapiens
agacctcatgcccagctct

SEQ ID NO: 722124 - DNA, 13 bp, Homo sapiens
agacctccacatt

SEQ ID NO: 722125 - DNA, 16 bp, Homo sapiens
agacctcgagcagatg

SEQ ID NO: 722126 - DNA, 20 bp, Homo sapiens
agacctgacccaacaccccc

SEQ ID NO: 722127 - DNA, 19 bp, Homo sapiens
agacctgacccttctctca

SEQ ID NO: 722128 - DNA, 17 bp, Homo sapiens
agacctgagggaccctt

SEQ ID NO: 722129 - DNA, 19 bp, Homo sapiens
agacctgcagcgggcaaag

SEQ ID NO: 722130 - DNA, 14 bp, Homo sapiens
agacctgcagtgag

SEQ ID NO: 722131 - DNA, 21 bp, Homo sapiens
agacctgcagtgaggggccct

SEQ ID NO: 722132 - DNA, 16 bp, Homo sapiens
agacctgcatttggca

SEQ ID NO: 722133 - DNA, 22 bp, Homo sapiens
agacctgccctcaagagcaaag

SEQ ID NO: 722134 - DNA, 13 bp, Homo sapiens
agacctgcgaagg

SEQ ID NO: 722135 - DNA, 14 bp, Homo sapiens
agacctgctctgga

SEQ ID NO: 722136 - DNA, 16 bp, Homo sapiens
agacctggaaccagag

SEQ ID NO: 722137 - DNA, 19 bp, Homo sapiens
agacctggagcccctgggt

SEQ ID NO: 722138 - DNA, 20 bp, Homo sapiens
agacctggagcccctgggtg

SEQ ID NO: 722139 - DNA, 15 bp, Homo sapiens
agacctggcctttca

SEQ ID NO: 722140 - DNA, 17 bp, Homo sapiens
agacctgggatttgaga

SEQ ID NO: 722141 - DNA, 13 bp, Homo sapiens
agacctgtaatca

SEQ ID NO: 722142 - DNA, 22 bp, Homo sapiens
agacctgtgctagttttacaga

SEQ ID NO: 722143 - DNA, 18 bp, Homo sapiens
agacctgttagcagacag

SEQ ID NO: 722144 - DNA, 19 bp, Homo sapiens
agacctgttggtataggaa

SEQ ID NO: 722145 - DNA, 19 bp, Homo sapiens
agaccttaagacactgtga

SEQ ID NO: 722146 - DNA, 18 bp, Homo sapiens
agactggaacttgaactg

SEQ ID NO: 722147 - DNA, 18 bp, Homo sapiens
agactggaagacacttca

SEQ ID NO: 722148 - DNA, 19 bp, Homo sapiens
agactggaagacacttcag

SEQ ID NO: 722149 - DNA, 11 bp, Homo sapiens
agactggacag

SEQ ID NO: 722150 - DNA, 13 bp, Homo sapiens
agactggacagct

SEQ ID NO: 722151 - DNA, 18 bp, Homo sapiens
agactggagcatctgact

SEQ ID NO: 722152 - DNA, 16 bp, Homo sapiens
agactggagtgaggct

SEQ ID NO: 722153 - DNA, 21 bp, Homo sapiens
agactggagtgaggcttccag

SEQ ID NO: 722154 - DNA, 23 bp, Homo sapiens
agactggagtgaggcttccaggc

SEQ ID NO: 722155 - DNA, 16 bp, Homo sapiens
agactggatactgccc

SEQ ID NO: 722156 - DNA, 17 bp, Homo sapiens
agactggcgtgaaccca

SEQ ID NO: 722157 - DNA, 18 bp, Homo sapiens
agactggcgtgaacccag

SEQ ID NO: 722158 - DNA, 18 bp, Homo sapiens
agactggcttttattaat

SEQ ID NO: 722159 - DNA, 19 bp, Homo sapiens
agactgggaaggcttggga

SEQ ID NO: 722160 - DNA, 21 bp, Homo sapiens
agactgggaaggcttgggatt

SEQ ID NO: 722161 - DNA, 22 bp, Homo sapiens
agactgggaaggcttgggattt

SEQ ID NO: 722162 - DNA, 23 bp, Homo sapiens
agactgggaaggcttgggatttg

SEQ ID NO: 722163 - DNA, 20 bp, Homo sapiens
agactgggaccttagaaatc

SEQ ID NO: 722164 - DNA, 17 bp, Homo sapiens
agactgggagccacttc

SEQ ID NO: 722165 - DNA, 15 bp, Homo sapiens
agactgggcccaggc

SEQ ID NO: 722166 - DNA, 19 bp, Homo sapiens
agactgggcccaggcaggt

SEQ ID NO: 722167 - DNA, 21 bp, Homo sapiens
agactgggcccaggcaggtct

SEQ ID NO: 722168 - DNA, 23 bp, Homo sapiens
agactgggcccaggcaggtctgc

SEQ ID NO: 722169 - DNA, 12 bp, Homo sapiens
agactgggctga

SEQ ID NO: 722170 - DNA, 15 bp, Homo sapiens
agactgggtttctag

SEQ ID NO: 722171 - DNA, 20 bp, Homo sapiens
agactggttccatggcctct

SEQ ID NO: 722172 - DNA, 20 bp, Homo sapiens
agactggtttgtttgcttaa

SEQ ID NO: 722173 - DNA, 14 bp, Homo sapiens
agactggttttctg

SEQ ID NO: 722174 - DNA, 20 bp, Homo sapiens
agactgtaactttttttcag

SEQ ID NO: 722175 - DNA, 15 bp, Homo sapiens
agactgtaagatgtt

SEQ ID NO: 722176 - DNA, 21 bp, Homo sapiens
agactgtaagatgttgtttta

SEQ ID NO: 722177 - DNA, 16 bp, Homo sapiens
agactgtacaaagtag

SEQ ID NO: 722178 - DNA, 12 bp, Homo sapiens
agactgtagaga

SEQ ID NO: 722179 - DNA, 22 bp, Homo sapiens
agactgtagattgcttctgtag

SEQ ID NO: 722180 - DNA, 23 bp, Homo sapiens
agactgtagattgcttctgtagt

SEQ ID NO: 722181 - DNA, 21 bp, Homo sapiens
agactgtcagcttccaaacat

SEQ ID NO: 722182 - DNA, 14 bp, Homo sapiens
agactgtcaggaag

SEQ ID NO: 722183 - DNA, 14 bp, Homo sapiens
agactgtgaacagc

SEQ ID NO: 722184 - DNA, 23 bp, Homo sapiens
agactgtgctctctgtggtgcct

SEQ ID NO: 722185 - DNA, 18 bp, Homo sapiens
agactgtggaaatgccaa

SEQ ID NO: 722186 - DNA, 16 bp, Homo sapiens
agactgtgggtgggga

SEQ ID NO: 722187 - DNA, 19 bp, Homo sapiens
agactgtggtaggggcagg

SEQ ID NO: 722188 - DNA, 21 bp, Homo sapiens
agactgtggtaggggcaggga

SEQ ID NO: 722189 - DNA, 18 bp, Homo sapiens
agactgttaaatgaaacc

SEQ ID NO: 722190 - DNA, 19 bp, Homo sapiens
agactgttttactgtttta

SEQ ID NO: 722191 - DNA, 20 bp, Homo sapiens
agacttaatgagactttaaa

SEQ ID NO: 722192 - DNA, 21 bp, Homo sapiens
agacttaatgagactttaaaa

SEQ ID NO: 722193 - DNA, 22 bp, Homo sapiens
agacttactgggtgaggaaatc

SEQ ID NO: 722194 - DNA, 19 bp, Homo sapiens
agacttacttgcattgctg

SEQ ID NO: 722195 - DNA, 12 bp, Homo sapiens
agacttactttc

SEQ ID NO: 722196 - DNA, 20 bp, Homo sapiens
agacttcaaaatattgagca

SEQ ID NO: 722197 - DNA, 13 bp, Homo sapiens
agacttcagtatg

SEQ ID NO: 722198 - DNA, 22 bp, Homo sapiens
agacttcagtatgttgtcaaag

SEQ ID NO: 722199 - DNA, 19 bp, Homo sapiens
agacttccaaacctgacag

SEQ ID NO: 722200 - DNA, 18 bp, Homo sapiens
agacttcccagcttctgc

SEQ ID NO: 722201 - DNA, 12 bp, Homo sapiens
agacttccccat

SEQ ID NO: 722202 - DNA, 14 bp, Homo sapiens
agacttccccatcc

SEQ ID NO: 722203 - DNA, 21 bp, Homo sapiens
agacttcctctctacccccca

SEQ ID NO: 722204 - DNA, 14 bp, Homo sapiens
agacttccttgaga

SEQ ID NO: 722205 - DNA, 16 bp, Homo sapiens
agacttcgactcagga

SEQ ID NO: 722206 - DNA, 22 bp, Homo sapiens
agacttctattttttaaagact

SEQ ID NO: 722207 - DNA, 16 bp, Homo sapiens
agacttctctgtaagt

SEQ ID NO: 722208 - DNA, 13 bp, Homo sapiens
agacttctggaag

SEQ ID NO: 722209 - DNA, 16 bp, Homo sapiens
agacttctggaaggct

SEQ ID NO: 722210 - DNA, 20 bp, Homo sapiens
agacttctggttgtatttct

SEQ ID NO: 722211 - DNA, 19 bp, Homo sapiens
agacttgaaagttttccag

SEQ ID NO: 722212 - DNA, 22 bp, Homo sapiens
agacttgacaacatcccacagt

SEQ ID NO: 722213 - DNA, 13 bp, Homo sapiens
agacttgacagtg

SEQ ID NO: 722214 - DNA, 14 bp, Homo sapiens
agacttgacagtgg

SEQ ID NO: 722215 - DNA, 15 bp, Homo sapiens
agacttgagaacttg

SEQ ID NO: 722216 - DNA, 22 bp, Homo sapiens
agacttgagcttgacctaagga

SEQ ID NO: 722217 - DNA, 19 bp, Homo sapiens
agacttggaagaggaggag

SEQ ID NO: 722218 - DNA, 20 bp, Homo sapiens
agacttggacatctctctgg

SEQ ID NO: 722219 - DNA, 15 bp, Homo sapiens
agacttggattcttt

SEQ ID NO: 722220 - DNA, 18 bp, Homo sapiens
agacttggcaacagaagc

SEQ ID NO: 722221 - DNA, 17 bp, Homo sapiens
agacttggcctccagct

SEQ ID NO: 722222 - DNA, 22 bp, Homo sapiens
agacttggcctccagctgttct

SEQ ID NO: 722223 - DNA, 16 bp, Homo sapiens
agacttggtgtgaaga

SEQ ID NO: 722224 - DNA, 12 bp, Homo sapiens
agactttagaaa

SEQ ID NO: 722225 - DNA, 16 bp, Homo sapiens
agactttagaaataaa

SEQ ID NO: 722226 - DNA, 16 bp, Homo sapiens
agactttatgtagttt

SEQ ID NO: 722227 - DNA, 17 bp, Homo sapiens
agactttatgtagtttt

SEQ ID NO: 722228 - DNA, 15 bp, Homo sapiens
agactttcacaccat

SEQ ID NO: 722229 - DNA, 17 bp, Homo sapiens
agactttcccaaatgta

SEQ ID NO: 722230 - DNA, 18 bp, Homo sapiens
agactttcccaaatgtat

SEQ ID NO: 722231 - DNA, 12 bp, Homo sapiens
agactttctgtt

SEQ ID NO: 722232 - DNA, 20 bp, Homo sapiens
agactttgagcctgcatctt

SEQ ID NO: 722233 - DNA, 20 bp, Homo sapiens
agactttgctgcattttaca

SEQ ID NO: 722234 - DNA, 13 bp, Homo sapiens
agactttgctgtt

SEQ ID NO: 722235 - DNA, 20 bp, Homo sapiens
agactttgctgttactgctt

SEQ ID NO: 722236 - DNA, 16 bp, Homo sapiens
agacttttaatatcac

SEQ ID NO: 722237 - DNA, 15 bp, Homo sapiens
agacttttatgtgag

SEQ ID NO: 722238 - DNA, 13 bp, Homo sapiens
agagaaaaagaaa

SEQ ID NO: 722239 - DNA, 14 bp, Homo sapiens
agagaaaaagaaat

SEQ ID NO: 722240 - DNA, 21 bp, Homo sapiens
agagaaaaagaaatgcaaaaa

SEQ ID NO: 722241 - DNA, 10 bp, Homo sapiens
agagaaaaga

SEQ ID NO: 722242 - DNA, 16 bp, Homo sapiens
agagaaaagggaaaaa

SEQ ID NO: 722243 - DNA, 20 bp, Homo sapiens
agagaaaagggaaaaaagaa

SEQ ID NO: 722244 - DNA, 23 bp, Homo sapiens
agagaaaataaatttaactttaa

SEQ ID NO: 722245 - DNA, 19 bp, Homo sapiens
agagaaaatatatgtattt

SEQ ID NO: 722246 - DNA, 13 bp, Homo sapiens
agagaaaatgaat

SEQ ID NO: 722247 - DNA, 20 bp, Homo sapiens
agagaaaatgcggttataaa

SEQ ID NO: 722248 - DNA, 16 bp, Homo sapiens
agagaaacttcaaagt

SEQ ID NO: 722249 - DNA, 23 bp, Homo sapiens
agagaaagaaaaggcaaaagact

SEQ ID NO: 722250 - DNA, 14 bp, Homo sapiens
agagaaagaagaga

SEQ ID NO: 722251 - DNA, 16 bp, Homo sapiens
agagaaagaagagaca

SEQ ID NO: 722252 - DNA, 18 bp, Homo sapiens
agagaaagcacgtgtctc

SEQ ID NO: 722253 - DNA, 19 bp, Homo sapiens
agagaaagcatattgactt

SEQ ID NO: 722254 - DNA, 14 bp, Homo sapiens
agagaaatacaaaa

SEQ ID NO: 722255 - DNA, 19 bp, Homo sapiens
agagaaatacagctggcta

SEQ ID NO: 722256 - DNA, 14 bp, Homo sapiens
agagaaatatgaag

SEQ ID NO: 722257 - DNA, 13 bp, Homo sapiens
agagaaatccttc

SEQ ID NO: 722258 - DNA, 21 bp, Homo sapiens
agagaaatttttatttttgaa

SEQ ID NO: 722259 - DNA, 21 bp, Homo sapiens
agagaacaatcactattctta

SEQ ID NO: 722260 - DNA, 23 bp, Homo sapiens
agagaacactggacaacatttta

SEQ ID NO: 722261 - DNA, 23 bp, Homo sapiens
agagaacagtcatgtatgcaagt

SEQ ID NO: 722262 - DNA, 15 bp, Homo sapiens
agagaaccgagcaaa

SEQ ID NO: 722263 - DNA, 19 bp, Homo sapiens
agagaacctttagaatatc

SEQ ID NO: 722264 - DNA, 18 bp, Homo sapiens
agagaactactaaggaaa

SEQ ID NO: 722265 - DNA, 23 bp, Homo sapiens
agagaactgcagacctcactgtc

SEQ ID NO: 722266 - DNA, 14 bp, Homo sapiens
agagaagaaagtgt

SEQ ID NO: 722267 - DNA, 15 bp, Homo sapiens
agagccagcctggct

SEQ ID NO: 722268 - DNA, 23 bp, Homo sapiens
agagccagcctggctctgccccc

SEQ ID NO: 722269 - DNA, 14 bp, Homo sapiens
agagccagcctggg

SEQ ID NO: 722270 - DNA, 17 bp, Homo sapiens
agagccagcctgggact

SEQ ID NO: 722271 - DNA, 12 bp, Homo sapiens
agagccagctct

SEQ ID NO: 722272 - DNA, 14 bp, Homo sapiens
agagccagctctct

SEQ ID NO: 722273 - DNA, 9 bp, Homo sapiens
agagccagg

SEQ ID NO: 722274 - DNA, 13 bp, Homo sapiens
agagccaggagaa

SEQ ID NO: 722275 - DNA, 22 bp, Homo sapiens
agagccaggagaagctcagctg

SEQ ID NO: 722276 - DNA, 21 bp, Homo sapiens
agagccaggatgcccagatga

SEQ ID NO: 722277 - DNA, 14 bp, Homo sapiens
agagccagggctgt

SEQ ID NO: 722278 - DNA, 15 bp, Homo sapiens
agagccagggctgtc

SEQ ID NO: 722279 - DNA, 19 bp, Homo sapiens
agagccagggctgtcctta

SEQ ID NO: 722280 - DNA, 15 bp, Homo sapiens
agagccatacataaa

SEQ ID NO: 722281 - DNA, 19 bp, Homo sapiens
agagccatacataaaagaa

SEQ ID NO: 722282 - DNA, 16 bp, Homo sapiens
agagccatgccaggct

SEQ ID NO: 722283 - DNA, 13 bp, Homo sapiens
agagccatgggcc

SEQ ID NO: 722284 - DNA, 14 bp, Homo sapiens
agagccatgggcct

SEQ ID NO: 722285 - DNA, 15 bp, Homo sapiens
agagccatgggcctg

SEQ ID NO: 722286 - DNA, 18 bp, Homo sapiens
agagtcatctccatcagc

SEQ ID NO: 722287 - DNA, 16 bp, Homo sapiens
agagtcatgtgagcct

SEQ ID NO: 722288 - DNA, 23 bp, Homo sapiens
agagtcatgtgagcctcgtgtca

SEQ ID NO: 722289 - DNA, 13 bp, Homo sapiens
agagtcattcata

SEQ ID NO: 722290 - DNA, 16 bp, Homo sapiens
agagtcattcatattt

SEQ ID NO: 722291 - DNA, 21 bp, Homo sapiens
agagtccaggaggccctggtc

SEQ ID NO: 722292 - DNA, 14 bp, Homo sapiens
agagtccaggcccc

SEQ ID NO: 722293 - DNA, 19 bp, Homo sapiens
agagtccagtgctctgcct

SEQ ID NO: 722294 - DNA, 23 bp, Homo sapiens
agagtccagtgctctgcctcaga

SEQ ID NO: 722295 - DNA, 21 bp, Homo sapiens
agagtccatttcccacatctt

SEQ ID NO: 722296 - DNA, 23 bp, Homo sapiens
agagtccatttcccacatctttc

SEQ ID NO: 722297 - DNA, 16 bp, Homo sapiens
agagtccggatttcta

SEQ ID NO: 722298 - DNA, 19 bp, Homo sapiens
agagtccggatttctaaca

SEQ ID NO: 722299 - DNA, 22 bp, Homo sapiens
agagtccgtactcggcttcctg

SEQ ID NO: 722300 - DNA, 13 bp, Homo sapiens
agagtcctcactc

SEQ ID NO: 722301 - DNA, 14 bp, Homo sapiens
agagtcctcactcc

SEQ ID NO: 722302 - DNA, 17 bp, Homo sapiens
agagtccttattcttct

SEQ ID NO: 722303 - DNA, 21 bp, Homo sapiens
agagtccttattcttctcata

SEQ ID NO: 722304 - DNA, 21 bp, Homo sapiens
agagtccttgcaaaattgtct

SEQ ID NO: 722305 - DNA, 15 bp, Homo sapiens
agagtcgctgtgcca

SEQ ID NO: 722306 - DNA, 19 bp, Homo sapiens
agagtcgctgtgccacagg

SEQ ID NO: 722307 - DNA, 15 bp, Homo sapiens
agagtctagggcaca

SEQ ID NO: 722308 - DNA, 21 bp, Homo sapiens
agagtctcagaaactcccctg

SEQ ID NO: 722309 - DNA, 15 bp, Homo sapiens
agagtctccatttaa

SEQ ID NO: 722310 - DNA, 13 bp, Homo sapiens
agagtctctgata

SEQ ID NO: 722311 - DNA, 13 bp, Homo sapiens
agagtctgaacag

SEQ ID NO: 722312 - DNA, 17 bp, Homo sapiens
agagtctgaacagctgt

SEQ ID NO: 722313 - DNA, 12 bp, Homo sapiens
agagtctgagcc

SEQ ID NO: 722314 - DNA, 13 bp, Homo sapiens
agagtctgagccc

SEQ ID NO: 722315 - DNA, 15 bp, Homo sapiens
agagtctgagccccc

SEQ ID NO: 722316 - DNA, 16 bp, Homo sapiens
agagtctgggcctctg

SEQ ID NO: 722317 - DNA, 18 bp, Homo sapiens
agagtctgggcctctgac

SEQ ID NO: 722318 - DNA, 18 bp, Homo sapiens
agagtctggtgaagctca

SEQ ID NO: 722319 - DNA, 10 bp, Homo sapiens
agagtcttcc

SEQ ID NO: 722320 - DNA, 17 bp, Homo sapiens
agagtcttgctctgtct

SEQ ID NO: 722321 - DNA, 16 bp, Homo sapiens
agagtgaaagggctat

SEQ ID NO: 722322 - DNA, 15 bp, Homo sapiens
agagtgaatttcagt

SEQ ID NO: 722323 - DNA, 23 bp, Homo sapiens
agagtgaatttcagtataaagat

SEQ ID NO: 722324 - DNA, 15 bp, Homo sapiens
agagtgaccctcagc

SEQ ID NO: 722325 - DNA, 21 bp, Homo sapiens
agagtgagaccatgtttcaaa

SEQ ID NO: 722326 - DNA, 15 bp, Homo sapiens
agagtgagaccctgt

SEQ ID NO: 722327 - DNA, 16 bp, Homo sapiens
agagtgattgcagctt

SEQ ID NO: 722328 - DNA, 15 bp, Homo sapiens
agagtgcactgacct

SEQ ID NO: 722329 - DNA, 13 bp, Homo sapiens
agagtgcactgct

SEQ ID NO: 722330 - DNA, 18 bp, Homo sapiens
agagtgcattgtgagggt

SEQ ID NO: 722331 - DNA, 21 bp, Homo sapiens
agagtgctctgaccctgggct

SEQ ID NO: 722332 - DNA, 16 bp, Homo sapiens
agagtgctgaggggca

SEQ ID NO: 722333 - DNA, 14 bp, Homo sapiens
agagtgctggactg

SEQ ID NO: 722334 - DNA, 13 bp, Homo sapiens
agagtgctgtcgg

SEQ ID NO: 722335 - DNA, 19 bp, Homo sapiens
agagtgctgtcgggaccac

SEQ ID NO: 722336 - DNA, 13 bp, Homo sapiens
agagtggaggtgg

SEQ ID NO: 722337 - DNA, 16 bp, Homo sapiens
agagtggagtctgagt

SEQ ID NO: 722338 - DNA, 17 bp, Homo sapiens
agagtggagtctgagtc

SEQ ID NO: 722339 - DNA, 12 bp, Homo sapiens
agagtggcctcc

SEQ ID NO: 722340 - DNA, 14 bp, Homo sapiens
agagtggcctccct

SEQ ID NO: 722341 - DNA, 16 bp, Homo sapiens
agagtggcctccctgc

SEQ ID NO: 722342 - DNA, 14 bp, Homo sapiens
agagtggcctggcc

SEQ ID NO: 722343 - DNA, 16 bp, Homo sapiens
agagtggcctggccag

SEQ ID NO: 722344 - DNA, 17 bp, Homo sapiens
agagtggcctggccagg

SEQ ID NO: 722345 - DNA, 20 bp, Homo sapiens
agagtggcgtgagctgcccg

SEQ ID NO: 722346 - DNA, 16 bp, Homo sapiens
agagtggctcactggc

SEQ ID NO: 722347 - DNA, 18 bp, Homo sapiens
agagtggctcactggctg

SEQ ID NO: 722348 - DNA, 21 bp, Homo sapiens
agagtggctcactggctggga

SEQ ID NO: 722349 - DNA, 23 bp, Homo sapiens
agagtggctcactggctgggagt

SEQ ID NO: 722350 - DNA, 12 bp, Homo sapiens
agagtggctcct

SEQ ID NO: 722351 - DNA, 14 bp, Homo sapiens
agagtggctcctcc

SEQ ID NO: 722352 - DNA, 23 bp, Homo sapiens
agagtggctcctcccggtgccca

SEQ ID NO: 722353 - DNA, 22 bp, Homo sapiens
agagtgggatccacttcttggt

SEQ ID NO: 722354 - DNA, 18 bp, Homo sapiens
agagtgggctgcatctgg

SEQ ID NO: 722355 - DNA, 18 bp, Homo sapiens
agagtgggggagagcagg

SEQ ID NO: 722356 - DNA, 22 bp, Homo sapiens
agagtgggggagagcaggctgg

SEQ ID NO: 722357 - DNA, 15 bp, Homo sapiens
agagtggggggagga

SEQ ID NO: 722358 - DNA, 16 bp, Homo sapiens
agagtgggtttcacaa

SEQ ID NO: 722359 - DNA, 16 bp, Homo sapiens
agagtggtcagttgaa

SEQ ID NO: 722360 - DNA, 16 bp, Homo sapiens
agagtgtacatcatgt

SEQ ID NO: 722361 - DNA, 23 bp, Homo sapiens
agagtgtagcctaaagggcaggg

SEQ ID NO: 722362 - DNA, 11 bp, Homo sapiens
agagtgtagct

SEQ ID NO: 722363 - DNA, 16 bp, Homo sapiens
agagtgtagggggcct

SEQ ID NO: 722364 - DNA, 19 bp, Homo sapiens
agagtgtaggtgaaatgaa

SEQ ID NO: 722365 - DNA, 20 bp, Homo sapiens
agagtgtaggtgaaatgaat

SEQ ID NO: 722366 - DNA, 15 bp, Homo sapiens
agagtgtctttccac

SEQ ID NO: 722367 - DNA, 18 bp, Homo sapiens
agagtgtgagcagggctt

SEQ ID NO: 722368 - DNA, 20 bp, Homo sapiens
agagtgtgatgtatgtgtaa

SEQ ID NO: 722369 - DNA, 16 bp, Homo sapiens
agagtgtgcagactga

SEQ ID NO: 722370 - DNA, 15 bp, Homo sapiens
agagtgtggaggctg

SEQ ID NO: 722371 - DNA, 14 bp, Homo sapiens
agagtgtgtgggca

SEQ ID NO: 722372 - DNA, 21 bp, Homo sapiens
agagtgttgttgctgaccagc

SEQ ID NO: 722373 - DNA, 11 bp, Homo sapiens
agagttacagt

SEQ ID NO: 722374 - DNA, 22 bp, Homo sapiens
agagttaccattatttaatttg

SEQ ID NO: 722375 - DNA, 13 bp, Homo sapiens
agagttagcatgt

SEQ ID NO: 722376 - DNA, 19 bp, Homo sapiens
agagttattcaaatgaagg

SEQ ID NO: 722377 - DNA, 15 bp, Homo sapiens
agagttattgaatct

SEQ ID NO: 722378 - DNA, 15 bp, Homo sapiens
agagttcaagaaata

SEQ ID NO: 722379 - DNA, 18 bp, Homo sapiens
agagttcaagaaataagt

SEQ ID NO: 722380 - DNA, 21 bp, Homo sapiens
agagttctcctggaggcaggg

SEQ ID NO: 722381 - DNA, 17 bp, Homo sapiens
agagttcttctttcttt

SEQ ID NO: 722382 - DNA, 14 bp, Homo sapiens
agagttctttgctg

SEQ ID NO: 722383 - DNA, 20 bp, Homo sapiens
agagttgatactacagtttg

SEQ ID NO: 722384 - DNA, 19 bp, Homo sapiens
agagttgctttgccagagc

SEQ ID NO: 722385 - DNA, 21 bp, Homo sapiens
agagttgctttgccagagcag

SEQ ID NO: 722386 - DNA, 16 bp, Homo sapiens
agagttgtctctgttg

SEQ ID NO: 722387 - DNA, 19 bp, Homo sapiens
agagttgttacatttttaa

SEQ ID NO: 722388 - DNA, 17 bp, Homo sapiens
agagtttaaagagaaaa

SEQ ID NO: 722389 - DNA, 19 bp, Homo sapiens
agagtttaaagagaaaagg

SEQ ID NO: 722390 - DNA, 12 bp, Homo sapiens
agagtttacagt

SEQ ID NO: 722391 - DNA, 16 bp, Homo sapiens
agagtttcaaaagcaa

SEQ ID NO: 722392 - DNA, 23 bp, Homo sapiens
agagtttggaattattgtagaca

SEQ ID NO: 722393 - DNA, 23 bp, Homo sapiens
agagtttgtaaggtcatgctggt

SEQ ID NO: 722394 - DNA, 16 bp, Homo sapiens
agagtttgtgtgtatt

SEQ ID NO: 722395 - DNA, 17 bp, Homo sapiens
agagtttgtgtgtattt

SEQ ID NO: 722396 - DNA, 16 bp, Homo sapiens
agagtttgtgtgttgt

SEQ ID NO: 722397 - DNA, 18 bp, Homo sapiens
agagtttgtgtgttgtct

SEQ ID NO: 722398 - DNA, 19 bp, Homo sapiens
agagtttgtgtgttgtctt

SEQ ID NO: 722399 - DNA, 20 bp, Homo sapiens
agagtttgttctgttctggg

SEQ ID NO: 722400 - DNA, 16 bp, Homo sapiens
agagttttatcaactt

SEQ ID NO: 722401 - DNA, 19 bp, Homo sapiens
agagttttgtcttgaatgt

SEQ ID NO: 722402 - DNA, 15 bp, Homo sapiens
agataaaaggtggag

SEQ ID NO: 722403 - DNA, 21 bp, Homo sapiens
agataaacacagctgctttct

SEQ ID NO: 722404 - DNA, 21 bp, Homo sapiens
agataaacaccaacccaggaa

SEQ ID NO: 722405 - DNA, 23 bp, Homo sapiens
agataaaccgtttttaacacata

SEQ ID NO: 722406 - DNA, 11 bp, Homo sapiens
agataaagatg

SEQ ID NO: 722407 - DNA, 14 bp, Homo sapiens
agataaagatttct

SEQ ID NO: 722408 - DNA, 19 bp, Homo sapiens
agataaagtcaaatgccaa

SEQ ID NO: 722409 - DNA, 16 bp, Homo sapiens
agataaatagaactat

SEQ ID NO: 722410 - DNA, 12 bp, Homo sapiens
agataaatgtgc

SEQ ID NO: 722411 - DNA, 13 bp, Homo sapiens
agataaattataa

SEQ ID NO: 722412 - DNA, 15 bp, Homo sapiens
agataacaactgtga

SEQ ID NO: 722413 - DNA, 21 bp, Homo sapiens
agataacaagatctttcagga

SEQ ID NO: 722414 - DNA, 22 bp, Homo sapiens
agataacagcctcttgcccgtc

SEQ ID NO: 722415 - DNA, 22 bp, Homo sapiens
agataactgaaaattatttaaa

SEQ ID NO: 722416 - DNA, 16 bp, Homo sapiens
agataacttcttgaaa

SEQ ID NO: 722417 - DNA, 17 bp, Homo sapiens
agataagatttctgtct

SEQ ID NO: 722418 - DNA, 21 bp, Homo sapiens
agataagatttctgtctacta

SEQ ID NO: 722419 - DNA, 16 bp, Homo sapiens
agataagcaagagaga

SEQ ID NO: 722420 - DNA, 22 bp, Homo sapiens
agataagcaagagagatgtttt

SEQ ID NO: 722421 - DNA, 17 bp, Homo sapiens
agataagtgtaaataga

SEQ ID NO: 722422 - DNA, 18 bp, Homo sapiens
agataagtgtatttttca

SEQ ID NO: 722423 - DNA, 16 bp, Homo sapiens
agataataaattgatt

SEQ ID NO: 722424 - DNA, 12 bp, Homo sapiens
agataataagat

SEQ ID NO: 722425 - DNA, 14 bp, Homo sapiens
agataatatttctg

SEQ ID NO: 722426 - DNA, 14 bp, Homo sapiens
agataatcagcctc

SEQ ID NO: 722427 - DNA, 15 bp, Homo sapiens
agataatcagcctct

SEQ ID NO: 722428 - DNA, 17 bp, Homo sapiens
agataatcagcctctta

SEQ ID NO: 722429 - DNA, 19 bp, Homo sapiens
agataatctcagtgctttc

SEQ ID NO: 722430 - DNA, 21 bp, Homo sapiens
agataatgttagaggttttaa

SEQ ID NO: 722431 - DNA, 17 bp, Homo sapiens
agataatgttctttaat

SEQ ID NO: 722432 - DNA, 20 bp, Homo sapiens
agataatgttctttaatgtt

SEQ ID NO: 722433 - DNA, 13 bp, Homo sapiens
agataattctgga

SEQ ID NO: 722434 - DNA, 20 bp, Homo sapiens
agataattctggaccagaga

SEQ ID NO: 722435 - DNA, 14 bp, Homo sapiens
agataattgctatt

SEQ ID NO: 722436 - DNA, 21 bp, Homo sapiens
agataattgtttcattcatcc

SEQ ID NO: 722437 - DNA, 15 bp, Homo sapiens
agataatttcagggt

SEQ ID NO: 722438 - DNA, 13 bp, Homo sapiens
agataatttgaaa

SEQ ID NO: 722439 - DNA, 18 bp, Homo sapiens
agatacaaattaatttta

SEQ ID NO: 722440 - DNA, 13 bp, Homo sapiens
agatacaataaat

SEQ ID NO: 722441 - DNA, 16 bp, Homo sapiens
agatacactgcacttt

SEQ ID NO: 722442 - DNA, 21 bp, Homo sapiens
agatacactgcactttgttta

SEQ ID NO: 722443 - DNA, 24 bp, Homo sapiens
agatacagaagcccatgtcttctg

SEQ ID NO: 722444 - DNA, 21 bp, Homo sapiens
agatacagatggagcaaatgt

SEQ ID NO: 722445 - DNA, 23 bp, Homo sapiens
agataccagcgaggaggctccag

SEQ ID NO: 722446 - DNA, 18 bp, Homo sapiens
agataccaggttgaaaga

SEQ ID NO: 722447 - DNA, 23 bp, Homo sapiens
agataccggtgcttctggaaact

SEQ ID NO: 722448 - DNA, 20 bp, Homo sapiens
agatacctccaaccctgccg

SEQ ID NO: 722449 - DNA, 18 bp, Homo sapiens
agataccttgaaaggaag

SEQ ID NO: 722450 - DNA, 19 bp, Homo sapiens
agatacgactttattttct

SEQ ID NO: 722451 - DNA, 20 bp, Homo sapiens
agatacgactttattttctg

SEQ ID NO: 722452 - DNA, 15 bp, Homo sapiens
agatactaaagcaaa

SEQ ID NO: 722453 - DNA, 12 bp, Homo sapiens
agatactggaaa

SEQ ID NO: 722454 - DNA, 21 bp, Homo sapiens
agatactggaagttttgcatt

SEQ ID NO: 722455 - DNA, 16 bp, Homo sapiens
agatacttaagtgctg

SEQ ID NO: 722456 - DNA, 19 bp, Homo sapiens
agatacttacatttccatt

SEQ ID NO: 722457 - DNA, 14 bp, Homo sapiens
agatactttgcatt

SEQ ID NO: 722458 - DNA, 16 bp, Homo sapiens
agatactttgcattgt

SEQ ID NO: 722459 - DNA, 17 bp, Homo sapiens
agatactttgctagccg

SEQ ID NO: 722460 - DNA, 22 bp, Homo sapiens
agatagaaataaatagctatat

SEQ ID NO: 722461 - DNA, 13 bp, Homo sapiens
agatagaagaact

SEQ ID NO: 722462 - DNA, 15 bp, Homo sapiens
agatagaagaactgc

SEQ ID NO: 722463 - DNA, 16 bp, Homo sapiens
agatagaagaactgca

SEQ ID NO: 722464 - DNA, 15 bp, Homo sapiens
agatagaatgacagt

SEQ ID NO: 722465 - DNA, 13 bp, Homo sapiens
agatagcatggga

SEQ ID NO: 722466 - DNA, 18 bp, Homo sapiens
agatagcattgtgaactg

SEQ ID NO: 722467 - DNA, 19 bp, Homo sapiens
agatagcattgtgaactga

SEQ ID NO: 722468 - DNA, 12 bp, Homo sapiens
agatagcccagg

SEQ ID NO: 722469 - DNA, 13 bp, Homo sapiens
agatagcccagga

SEQ ID NO: 722470 - DNA, 14 bp, Homo sapiens
agatagcccaggag

SEQ ID NO: 722471 - DNA, 16 bp, Homo sapiens
agatagcccaggagca

SEQ ID NO: 722472 - DNA, 18 bp, Homo sapiens
agatagcgcatatatttg

SEQ ID NO: 722473 - DNA, 14 bp, Homo sapiens
agatagctgcatgt

SEQ ID NO: 722474 - DNA, 21 bp, Homo sapiens
agatagctgcatgtggctttt

SEQ ID NO: 722475 - DNA, 12 bp, Homo sapiens
agatagctgggg

SEQ ID NO: 722476 - DNA, 15 bp, Homo sapiens
agatagctggggctt

SEQ ID NO: 722477 - DNA, 17 bp, Homo sapiens
agataggaccttgggcc

SEQ ID NO: 722478 - DNA, 16 bp, Homo sapiens
agataggagttctctg

SEQ ID NO: 722479 - DNA, 15 bp, Homo sapiens
agatagggaaaaggg

SEQ ID NO: 722480 - DNA, 22 bp, Homo sapiens
agatagggaaaaggggctcctt

SEQ ID NO: 722481 - DNA, 18 bp, Homo sapiens
agatagggggaagacaga

SEQ ID NO: 722482 - DNA, 15 bp, Homo sapiens
agataggtaaatacc

SEQ ID NO: 722483 - DNA, 21 bp, Homo sapiens
agatagtcttggaagctgttt

SEQ ID NO: 722484 - DNA, 19 bp, Homo sapiens
agatagtgtaacttgctta

SEQ ID NO: 722485 - DNA, 21 bp, Homo sapiens
agatagttaaaagactgcagc

SEQ ID NO: 722486 - DNA, 17 bp, Homo sapiens
agatataacattcagtt

SEQ ID NO: 722487 - DNA, 16 bp, Homo sapiens
agatataactgtcttg

SEQ ID NO: 722488 - DNA, 19 bp, Homo sapiens
agatataatgaacaaaatt

SEQ ID NO: 722489 - DNA, 15 bp, Homo sapiens
agatatacaaaaaca

SEQ ID NO: 722490 - DNA, 13 bp, Homo sapiens
agatatatatcat

SEQ ID NO: 722491 - DNA, 18 bp, Homo sapiens
agatatatgtgtatacat

SEQ ID NO: 722492 - DNA, 13 bp, Homo sapiens
agatatattaaaa

SEQ ID NO: 722493 - DNA, 17 bp, Homo sapiens
agatatattaaaaatat

SEQ ID NO: 722494 - DNA, 18 bp, Homo sapiens
agatatattaaaaatata

SEQ ID NO: 722495 - DNA, 19 bp, Homo sapiens
agatatattaaaaatataa

SEQ ID NO: 722496 - DNA, 22 bp, Homo sapiens
agatatatttcacttttgttct

SEQ ID NO: 722497 - DNA, 16 bp, Homo sapiens
agatatatttttcaca

SEQ ID NO: 722498 - DNA, 15 bp, Homo sapiens
agatatcagagctct

SEQ ID NO: 722499 - DNA, 16 bp, Homo sapiens
agatatccacataaat

SEQ ID NO: 722500 - DNA, 15 bp, Homo sapiens
agatatccatctttt

SEQ ID NO: 722501 - DNA, 12 bp, Homo sapiens
agatatcctctc

SEQ ID NO: 722502 - DNA, 21 bp, Homo sapiens
agatatcctctccccctcctc

SEQ ID NO: 722503 - DNA, 18 bp, Homo sapiens
agatatctgcatgtgtca

SEQ ID NO: 722504 - DNA, 19 bp, Homo sapiens
agatatcttggacaaatca

SEQ ID NO: 722505 - DNA, 20 bp, Homo sapiens
agatatgcttactaaatctt

SEQ ID NO: 722506 - DNA, 22 bp, Homo sapiens
agatatgcttactaaatcttca

SEQ ID NO: 722507 - DNA, 23 bp, Homo sapiens
agatatggagtgagtcacctgct

SEQ ID NO: 722508 - DNA, 21 bp, Homo sapiens
agatatggcattgcactgctt

SEQ ID NO: 722509 - DNA, 20 bp, Homo sapiens
agatatgttaagcatggatt

SEQ ID NO: 722510 - DNA, 19 bp, Homo sapiens
agatattaaaatttggtgc

SEQ ID NO: 722511 - DNA, 19 bp, Homo sapiens
agatattaggggggaaagt

SEQ ID NO: 722512 - DNA, 16 bp, Homo sapiens
agatattatttgtctt

SEQ ID NO: 722513 - DNA, 12 bp, Homo sapiens
agatattcaagt

SEQ ID NO: 722514 - DNA, 18 bp, Homo sapiens
agatattcctattgtgca

SEQ ID NO: 722515 - DNA, 13 bp, Homo sapiens
agatattctgctc

SEQ ID NO: 722516 - DNA, 13 bp, Homo sapiens
agatattcttatt

SEQ ID NO: 722517 - DNA, 19 bp, Homo sapiens
agatattgatcaaatatag

SEQ ID NO: 722518 - DNA, 23 bp, Homo sapiens
agatattgggaaggaaatatatt

SEQ ID NO: 722519 - DNA, 16 bp, Homo sapiens
agatattgtacataaa

SEQ ID NO: 722520 - DNA, 22 bp, Homo sapiens
agatattgtcagagttctgctc

SEQ ID NO: 722521 - DNA, 19 bp, Homo sapiens
agatatttagctctgtgga

SEQ ID NO: 722522 - DNA, 14 bp, Homo sapiens
agatatttatatat

SEQ ID NO: 722523 - DNA, 17 bp, Homo sapiens
agatatttatatatatt

SEQ ID NO: 722524 - DNA, 20 bp, Homo sapiens
agatatttatatttttattt

SEQ ID NO: 722525 - DNA, 23 bp, Homo sapiens
agatatttatatttttattttat

SEQ ID NO: 722526 - DNA, 23 bp, Homo sapiens
agatatttattgtttatttatca

SEQ ID NO: 722527 - DNA, 18 bp, Homo sapiens
agatattttaaaatgaga

SEQ ID NO: 722528 - DNA, 21 bp, Homo sapiens
agatattttgctttgtgattt

SEQ ID NO: 722529 - DNA, 20 bp, Homo sapiens
agatattttgtaaaatgtat

SEQ ID NO: 722530 - DNA, 19 bp, Homo sapiens
agatatttttatctttata

SEQ ID NO: 722531 - DNA, 14 bp, Homo sapiens
agatcaaaataaaa

SEQ ID NO: 722532 - DNA, 14 bp, Homo sapiens
agatcaaatagttg

SEQ ID NO: 722533 - DNA, 16 bp, Homo sapiens
agatcaacgcctcact

SEQ ID NO: 722534 - DNA, 18 bp, Homo sapiens
agatcaagaaaaaaaggg

SEQ ID NO: 722535 - DNA, 12 bp, Homo sapiens
agatcaagctgt

SEQ ID NO: 722536 - DNA, 14 bp, Homo sapiens
agatcaataaatgt

SEQ ID NO: 722537 - DNA, 19 bp, Homo sapiens
agatcacaccactgtactc

SEQ ID NO: 722538 - DNA, 12 bp, Homo sapiens
agatcacagcct

SEQ ID NO: 722539 - DNA, 16 bp, Homo sapiens
agatcacagcctccag

SEQ ID NO: 722540 - DNA, 20 bp, Homo sapiens
agatcacagcctccagggcc

SEQ ID NO: 722541 - DNA, 20 bp, Homo sapiens
agatcacatcttaaattcat

SEQ ID NO: 722542 - DNA, 15 bp, Homo sapiens
agatcacccactcct

SEQ ID NO: 722543 - DNA, 16 bp, Homo sapiens
agatcacccactccta

SEQ ID NO: 722544 - DNA, 14 bp, Homo sapiens
agatcactcctgga

SEQ ID NO: 722545 - DNA, 17 bp, Homo sapiens
agatcactcctggaggc

SEQ ID NO: 722546 - DNA, 14 bp, Homo sapiens
agatcactgccaca

SEQ ID NO: 722547 - DNA, 23 bp, Homo sapiens
agatcactgtagtttagttctgt

SEQ ID NO: 722548 - DNA, 11 bp, Homo sapiens
agatcactttc

SEQ ID NO: 722549 - DNA, 18 bp, Homo sapiens
agatcagaaagtgacatt

SEQ ID NO: 722550 - DNA, 22 bp, Homo sapiens
agatcagaaagtgacatttgct

SEQ ID NO: 722551 - DNA, 15 bp, Homo sapiens
agatcagaacatgaa

SEQ ID NO: 722552 - DNA, 13 bp, Homo sapiens
agatcagccatta

SEQ ID NO: 722553 - DNA, 13 bp, Homo sapiens
agatcagcctggg

SEQ ID NO: 722554 - DNA, 12 bp, Homo sapiens
agatcaggaacc

SEQ ID NO: 722555 - DNA, 18 bp, Homo sapiens
agatcaggaaccagggcc

SEQ ID NO: 722556 - DNA, 21 bp, Homo sapiens
agatcaggaaccagggcctcc

SEQ ID NO: 722557 - DNA, 22 bp, Homo sapiens
agatcaggaaccagggcctccc

SEQ ID NO: 722558 - DNA, 11 bp, Homo sapiens
agatcaggttt

SEQ ID NO: 722559 - DNA, 13 bp, Homo sapiens
agatcagtaaaga

SEQ ID NO: 722560 - DNA, 15 bp, Homo sapiens
agatcagtaaagaac

SEQ ID NO: 722561 - DNA, 15 bp, Homo sapiens
agatcagtgtaccat

SEQ ID NO: 722562 - DNA, 18 bp, Homo sapiens
agatcagtgtaccatttg

SEQ ID NO: 722563 - DNA, 18 bp, Homo sapiens
agatcataggaagtggct

SEQ ID NO: 722564 - DNA, 22 bp, Homo sapiens
agatcataggaagtggctggtc

SEQ ID NO: 722565 - DNA, 21 bp, Homo sapiens
agatcatccgtctgtgtgggg

SEQ ID NO: 722566 - DNA, 11 bp, Homo sapiens
agatcatgggt

SEQ ID NO: 722567 - DNA, 18 bp, Homo sapiens
agatccaaggccgcggcc

SEQ ID NO: 722568 - DNA, 17 bp, Homo sapiens
agatccacacacagagg

SEQ ID NO: 722569 - DNA, 15 bp, Homo sapiens
agatccacatcctct

SEQ ID NO: 722570 - DNA, 16 bp, Homo sapiens
agatccacatcctcta

SEQ ID NO: 722571 - DNA, 13 bp, Homo sapiens
agatccaccctca

SEQ ID NO: 722572 - DNA, 20 bp, Homo sapiens
agatccacgtgtggcctccg

SEQ ID NO: 722573 - DNA, 13 bp, Homo sapiens
agatccagactgt

SEQ ID NO: 722574 - DNA, 21 bp, Homo sapiens
agatccagactgtaagatgtt

SEQ ID NO: 722575 - DNA, 20 bp, Homo sapiens
agatccagatccagactgta

SEQ ID NO: 722576 - DNA, 19 bp, Homo sapiens
agatccagggatggagatg

SEQ ID NO: 722577 - DNA, 19 bp, Homo sapiens
agatcccatgtcacctcag

SEQ ID NO: 722578 - DNA, 21 bp, Homo sapiens
agatccccaaaacaggccagg

SEQ ID NO: 722579 - DNA, 15 bp, Homo sapiens
agatccccagggcag

SEQ ID NO: 722580 - DNA, 13 bp, Homo sapiens
agatcccccagaa

SEQ ID NO: 722581 - DNA, 17 bp, Homo sapiens
agatcccctctcctgcc

SEQ ID NO: 722582 - DNA, 14 bp, Homo sapiens
agatcccctgagcc

SEQ ID NO: 722583 - DNA, 22 bp, Homo sapiens
agatcccgcctcttcttcttca

SEQ ID NO: 722584 - DNA, 16 bp, Homo sapiens
agatccctgcagaacc

SEQ ID NO: 722585 - DNA, 20 bp, Homo sapiens
agatccgagcgacggctcct

SEQ ID NO: 722586 - DNA, 23 bp, Homo sapiens
agatccgcaatgtggagcagcag

SEQ ID NO: 722587 - DNA, 16 bp, Homo sapiens
agatcctaagatgtgt

SEQ ID NO: 722588 - DNA, 19 bp, Homo sapiens
agatcctctttactctggg

SEQ ID NO: 722589 - DNA, 13 bp, Homo sapiens
agatcctgcaccc

SEQ ID NO: 722590 - DNA, 12 bp, Homo sapiens
agatccttcaca

SEQ ID NO: 722591 - DNA, 23 bp, Homo sapiens
agatccttcacaggcagtgcatg

SEQ ID NO: 722592 - DNA, 19 bp, Homo sapiens
agatccttcgggtgctgga

SEQ ID NO: 722593 - DNA, 14 bp, Homo sapiens
agatcctttaaaaa

SEQ ID NO: 722594 - DNA, 17 bp, Homo sapiens
agatcgagaccatcctg

SEQ ID NO: 722595 - DNA, 20 bp, Homo sapiens
agatcgagaccatcctggct

SEQ ID NO: 722596 - DNA, 16 bp, Homo sapiens
agatcgcatcattgca

SEQ ID NO: 722597 - DNA, 15 bp, Homo sapiens
agatcgcgccactgc

SEQ ID NO: 722598 - DNA, 13 bp, Homo sapiens
agatcggccacag

SEQ ID NO: 722599 - DNA, 21 bp, Homo sapiens
agatcgtgccgttactctcca

SEQ ID NO: 722600 - DNA, 16 bp, Homo sapiens
agatcgttagtatcta

SEQ ID NO: 722601 - DNA, 17 bp, Homo sapiens
agatcgttagtatctaa

SEQ ID NO: 722602 - DNA, 16 bp, Homo sapiens
agatcgttctctgcct

SEQ ID NO: 722603 - DNA, 16 bp, Homo sapiens
agatcgtttaaaaaca

SEQ ID NO: 722604 - DNA, 20 bp, Homo sapiens
agatctaagcctttccataa

SEQ ID NO: 722605 - DNA, 22 bp, Homo sapiens
agatctaaggatgtcacagggc

SEQ ID NO: 722606 - DNA, 18 bp, Homo sapiens
agatctccacggtcagat

SEQ ID NO: 722607 - DNA, 14 bp, Homo sapiens
agatctctttctaa

SEQ ID NO: 722608 - DNA, 20 bp, Homo sapiens
agatctgatggtgagctggg

SEQ ID NO: 722609 - DNA, 18 bp, Homo sapiens
agatctgcctgggcctgt

SEQ ID NO: 722610 - DNA, 21 bp, Homo sapiens
agatctgcctgggcctgtgca

SEQ ID NO: 722611 - DNA, 22 bp, Homo sapiens
agatctgcctgggcctgtgcag

SEQ ID NO: 722612 - DNA, 23 bp, Homo sapiens
agatctgcctgggcctgtgcagc

SEQ ID NO: 722613 - DNA, 12 bp, Homo sapiens
agatctgggcat

SEQ ID NO: 722614 - DNA, 13 bp, Homo sapiens
agatctggggagg

SEQ ID NO: 722615 - DNA, 16 bp, Homo sapiens
agatctgtataaataa

SEQ ID NO: 722616 - DNA, 18 bp, Homo sapiens
agatctgtataaataaga

SEQ ID NO: 722617 - DNA, 13 bp, Homo sapiens
agatctgtgcctg

SEQ ID NO: 722618 - DNA, 16 bp, Homo sapiens
agatctgtgcctggga

SEQ ID NO: 722619 - DNA, 14 bp, Homo sapiens
agatctgttttgaa

SEQ ID NO: 722620 - DNA, 12 bp, Homo sapiens
agatcttaatat

SEQ ID NO: 722621 - DNA, 13 bp, Homo sapiens
agatcttaggtat

SEQ ID NO: 722622 - DNA, 19 bp, Homo sapiens
agatcttggcttaatttaa

SEQ ID NO: 722623 - DNA, 13 bp, Homo sapiens
agatctttcagga

SEQ ID NO: 722624 - DNA, 12 bp, Homo sapiens
agatctttctct

SEQ ID NO: 722625 - DNA, 17 bp, Homo sapiens
agatctttctcttccct

SEQ ID NO: 722626 - DNA, 20 bp, Homo sapiens
agatctttctcttccctgaa

SEQ ID NO: 722627 - DNA, 21 bp, Homo sapiens
agatctttctttccaaaacat

SEQ ID NO: 722628 - DNA, 22 bp, Homo sapiens
agatcttttagaagtgagagaa

SEQ ID NO: 722629 - DNA, 11 bp, Homo sapiens
agatgaacatt

SEQ ID NO: 722630 - DNA, 22 bp, Homo sapiens
agatgaactgactgaaggaaaa

SEQ ID NO: 722631 - DNA, 22 bp, Homo sapiens
agatgaactttgtcattatgat

SEQ ID NO: 722632 - DNA, 20 bp, Homo sapiens
agatgaagagtgagagggca

SEQ ID NO: 722633 - DNA, 16 bp, Homo sapiens
agatgaaggagaggca

SEQ ID NO: 722634 - DNA, 19 bp, Homo sapiens
agatgaagttttacattgt

SEQ ID NO: 722635 - DNA, 19 bp, Homo sapiens
agatgacaaaagaaaattt

SEQ ID NO: 722636 - DNA, 12 bp, Homo sapiens
agatgacaatgt

SEQ ID NO: 722637 - DNA, 20 bp, Homo sapiens
agatgaccaaagtcccttcc

SEQ ID NO: 722638 - DNA, 15 bp, Homo sapiens
agatgaccagggatg

SEQ ID NO: 722639 - DNA, 17 bp, Homo sapiens
agatgaccataattttt

SEQ ID NO: 722640 - DNA, 17 bp, Homo sapiens
agatgaccccagaaact

SEQ ID NO: 722641 - DNA, 13 bp, Homo sapiens
agatgacccctac

SEQ ID NO: 722642 - DNA, 19 bp, Homo sapiens
agatgacccctaccccctc

SEQ ID NO: 722643 - DNA, 21 bp, Homo sapiens
agatgacctacagtgctgtgt

SEQ ID NO: 722644 - DNA, 15 bp, Homo sapiens
agatgactattactt

SEQ ID NO: 722645 - DNA, 18 bp, Homo sapiens
agatgagaacaaagctgt

SEQ ID NO: 722646 - DNA, 15 bp, Homo sapiens
agatgagattggcat

SEQ ID NO: 722647 - DNA, 17 bp, Homo sapiens
agatgagatttgccagc

SEQ ID NO: 722648 - DNA, 20 bp, Homo sapiens
agatgagatttgccagcaca

SEQ ID NO: 722649 - DNA, 21 bp, Homo sapiens
agatgagatttgccagcacag

SEQ ID NO: 722650 - DNA, 14 bp, Homo sapiens
agatgaggccagac

SEQ ID NO: 722651 - DNA, 16 bp, Homo sapiens
agatgaggccagacca

SEQ ID NO: 722652 - DNA, 20 bp, Homo sapiens
agatgagggatgggcctggc

SEQ ID NO: 722653 - DNA, 16 bp, Homo sapiens
agatgaggggccactg

SEQ ID NO: 722654 - DNA, 20 bp, Homo sapiens
agatgaggggccactgaccc

SEQ ID NO: 722655 - DNA, 14 bp, Homo sapiens
agatgaggggttga

SEQ ID NO: 722656 - DNA, 17 bp, Homo sapiens
agatgagggtgactgtc

SEQ ID NO: 722657 - DNA, 13 bp, Homo sapiens
agatgaggtcaac

SEQ ID NO: 722658 - DNA, 21 bp, Homo sapiens
agatgagtaaaggagtaagaa

SEQ ID NO: 722659 - DNA, 12 bp, Homo sapiens
agatgagtgaaa

SEQ ID NO: 722660 - DNA, 14 bp, Homo sapiens
agatgagtgagcat

SEQ ID NO: 722661 - DNA, 15 bp, Homo sapiens
agatgagtgtgtgtt

SEQ ID NO: 722662 - DNA, 17 bp, Homo sapiens
agatgagtgtgtgttct

SEQ ID NO: 722663 - DNA, 16 bp, Homo sapiens
agatgagttgcagttt

SEQ ID NO: 722664 - DNA, 17 bp, Homo sapiens
agatgagttgcagtttt

SEQ ID NO: 722665 - DNA, 18 bp, Homo sapiens
agatgagttgcagttttt

SEQ ID NO: 722666 - DNA, 20 bp, Homo sapiens
agatgagttgcagtttttat

SEQ ID NO: 722667 - DNA, 20 bp, Homo sapiens
agatgataaaagagaagcca

SEQ ID NO: 722668 - DNA, 16 bp, Homo sapiens
agatgataaatattta

SEQ ID NO: 722669 - DNA, 16 bp, Homo sapiens
agatgatctactcaga

SEQ ID NO: 722670 - DNA, 15 bp, Homo sapiens
agatgatctctccac

SEQ ID NO: 722671 - DNA, 22 bp, Homo sapiens
agatgatctctccacggtagca

SEQ ID NO: 722672 - DNA, 19 bp, Homo sapiens
agatgatgcatgatgccct

SEQ ID NO: 722673 - DNA, 16 bp, Homo sapiens
agatgatggaaacgca

SEQ ID NO: 722674 - DNA, 23 bp, Homo sapiens
agatgatggaaacgcacttacaa

SEQ ID NO: 722675 - DNA, 13 bp, Homo sapiens
agatgatggattt

SEQ ID NO: 722676 - DNA, 18 bp, Homo sapiens
agatgatggccatttcta

SEQ ID NO: 722677 - DNA, 16 bp, Homo sapiens
agatgatttcccccct

SEQ ID NO: 722678 - DNA, 18 bp, Homo sapiens
agatgatttcccccctcc

SEQ ID NO: 722679 - DNA, 22 bp, Homo sapiens
agatgatttcccccctccgcct

SEQ ID NO: 722680 - DNA, 17 bp, Homo sapiens
agatgcaaatgttttga

SEQ ID NO: 722681 - DNA, 19 bp, Homo sapiens
agatgcaacctcactatgg

SEQ ID NO: 722682 - DNA, 16 bp, Homo sapiens
agatgcaagtctcttg

SEQ ID NO: 722683 - DNA, 13 bp, Homo sapiens
agatgcaatcaga

SEQ ID NO: 722684 - DNA, 18 bp, Homo sapiens
agatgcaatgtgctactg

SEQ ID NO: 722685 - DNA, 23 bp, Homo sapiens
agatgcactatatgtttacacaa

SEQ ID NO: 722686 - DNA, 22 bp, Homo sapiens
agatgcactgaaaacttagcca

SEQ ID NO: 722687 - DNA, 12 bp, Homo sapiens
agatgcagctgg

SEQ ID NO: 722688 - DNA, 13 bp, Homo sapiens
agatgcagctgga

SEQ ID NO: 722689 - DNA, 17 bp, Homo sapiens
agatgcaggtgatgcca

SEQ ID NO: 722690 - DNA, 17 bp, Homo sapiens
agatgccagcttctctc

SEQ ID NO: 722691 - DNA, 13 bp, Homo sapiens
agatgccagtgaa

SEQ ID NO: 722692 - DNA, 21 bp, Homo sapiens
agatgcccagagggcccaggc

SEQ ID NO: 722693 - DNA, 14 bp, Homo sapiens
agatgccccaaagt

SEQ ID NO: 722694 - DNA, 16 bp, Homo sapiens
agatgccccctccagg

SEQ ID NO: 722695 - DNA, 19 bp, Homo sapiens
agatgccccctccaggaga

SEQ ID NO: 722696 - DNA, 20 bp, Homo sapiens
agatgcctaaaaattccctt

SEQ ID NO: 722697 - DNA, 23 bp, Homo sapiens
agatgcctaaaaattcccttcct

SEQ ID NO: 722698 - DNA, 12 bp, Homo sapiens
agatgcctccac

SEQ ID NO: 722699 - DNA, 15 bp, Homo sapiens
agatgcctgttaatt

SEQ ID NO: 722700 - DNA, 14 bp, Homo sapiens
agatgcggggacag

SEQ ID NO: 722701 - DNA, 15 bp, Homo sapiens
agatgctccttgggc

SEQ ID NO: 722702 - DNA, 18 bp, Homo sapiens
agatgctgaatatctgtt

SEQ ID NO: 722703 - DNA, 20 bp, Homo sapiens
agatgctgatggagccttcc

SEQ ID NO: 722704 - DNA, 12 bp, Homo sapiens
agatgctgggct

SEQ ID NO: 722705 - DNA, 23 bp, Homo sapiens
agatgctgggttggtgcacagtg

SEQ ID NO: 722706 - DNA, 23 bp, Homo sapiens
agatgctgtcactggcagagcac

SEQ ID NO: 722707 - DNA, 23 bp, Homo sapiens
agatgcttcactttccttctctg

SEQ ID NO: 722708 - DNA, 15 bp, Homo sapiens
agatgcttctcactg

SEQ ID NO: 722709 - DNA, 13 bp, Homo sapiens
agatgcttctctc

SEQ ID NO: 722710 - DNA, 20 bp, Homo sapiens
agatgcttctctccttgccc

SEQ ID NO: 722711 - DNA, 12 bp, Homo sapiens
agatgcttctgg

SEQ ID NO: 722712 - DNA, 15 bp, Homo sapiens
agatgcttctgggag

SEQ ID NO: 722713 - DNA, 19 bp, Homo sapiens
agatgcttttctgtctctg

SEQ ID NO: 722714 - DNA, 17 bp, Homo sapiens
agatggaaaaacttgtg

SEQ ID NO: 722715 - DNA, 22 bp, Homo sapiens
agatggaaatttttacctttat

SEQ ID NO: 722716 - DNA, 17 bp, Homo sapiens
agatggaacactggaac

SEQ ID NO: 722717 - DNA, 22 bp, Homo sapiens
agatggaacccttttggccccc

SEQ ID NO: 722718 - DNA, 15 bp, Homo sapiens
agatggaatggaaaa

SEQ ID NO: 722719 - DNA, 17 bp, Homo sapiens
agatggacacgagccac

SEQ ID NO: 722720 - DNA, 23 bp, Homo sapiens
agatggacacgagccacaagctg

SEQ ID NO: 722721 - DNA, 18 bp, Homo sapiens
agatggacactgccaaga

SEQ ID NO: 722722 - DNA, 14 bp, Homo sapiens
agatggacatggct

SEQ ID NO: 722723 - DNA, 21 bp, Homo sapiens
agatggactcaggatccagtg

SEQ ID NO: 722724 - DNA, 22 bp, Homo sapiens
agatggactcaggatccagtga

SEQ ID NO: 722725 - DNA, 15 bp, Homo sapiens
agatggactctgaaa

SEQ ID NO: 722726 - DNA, 16 bp, Homo sapiens
agatggactgggaaaa

SEQ ID NO: 722727 - DNA, 15 bp, Homo sapiens
agatggagcaaatgt

SEQ ID NO: 722728 - DNA, 22 bp, Homo sapiens
agatggagggcttggcccagcg

SEQ ID NO: 722729 - DNA, 17 bp, Homo sapiens
agatggaggttctcaga

SEQ ID NO: 722730 - DNA, 19 bp, Homo sapiens
agatggagtttctctcttg

SEQ ID NO: 722731 - DNA, 17 bp, Homo sapiens
agatggattaaagactt

SEQ ID NO: 722732 - DNA, 14 bp, Homo sapiens
agatggcactttga

SEQ ID NO: 722733 - DNA, 15 bp, Homo sapiens
agatggcccctccac

SEQ ID NO: 722734 - DNA, 20 bp, Homo sapiens
agatggcgaccaccaaagtc

SEQ ID NO: 722735 - DNA, 13 bp, Homo sapiens
agatggcgatgtg

SEQ ID NO: 722736 - DNA, 15 bp, Homo sapiens
agatggctcctctca

SEQ ID NO: 722737 - DNA, 21 bp, Homo sapiens
agatggctggaaggggtccag

SEQ ID NO: 722738 - DNA, 18 bp, Homo sapiens
agatggctgtgcctctgc

SEQ ID NO: 722739 - DNA, 20 bp, Homo sapiens
agatggctgtgcctctgcct

SEQ ID NO: 722740 - DNA, 21 bp, Homo sapiens
agatggctgtgcctctgcctg

SEQ ID NO: 722741 - DNA, 22 bp, Homo sapiens
agatggctgtgcctctgcctgt

SEQ ID NO: 722742 - DNA, 23 bp, Homo sapiens
agatggctgtggcatttccaaac

SEQ ID NO: 722743 - DNA, 16 bp, Homo sapiens
agatggcttatgtcat

SEQ ID NO: 722744 - DNA, 18 bp, Homo sapiens
agatggcttattttttaa

SEQ ID NO: 722745 - DNA, 14 bp, Homo sapiens
agatggctttcagg

SEQ ID NO: 722746 - DNA, 17 bp, Homo sapiens
agatggctttcagggca

SEQ ID NO: 722747 - DNA, 13 bp, Homo sapiens
agatgggacaagc

SEQ ID NO: 722748 - DNA, 13 bp, Homo sapiens
agatgggaggaga

SEQ ID NO: 722749 - DNA, 23 bp, Homo sapiens
agatggggcgggggtgtgtctgt

SEQ ID NO: 722750 - DNA, 18 bp, Homo sapiens
agatgggggcttcttcct

SEQ ID NO: 722751 - DNA, 21 bp, Homo sapiens
agatggggtctgtgactggat

SEQ ID NO: 722752 - DNA, 22 bp, Homo sapiens
agatggggtctgtgactggatc

SEQ ID NO: 722753 - DNA, 13 bp, Homo sapiens
agatgggtccagg

SEQ ID NO: 722754 - DNA, 23 bp, Homo sapiens
agatgggtccaggggtctgtctg

SEQ ID NO: 722755 - DNA, 21 bp, Homo sapiens
agatgggtctgatattaatca

SEQ ID NO: 722756 - DNA, 17 bp, Homo sapiens
agatgggtctggctgag

SEQ ID NO: 722757 - DNA, 21 bp, Homo sapiens
agatgggtctggctgagctga

SEQ ID NO: 722758 - DNA, 21 bp, Homo sapiens
agatggtactgctgaggtccc

SEQ ID NO: 722759 - DNA, 14 bp, Homo sapiens
agatggtcagtgtg

SEQ ID NO: 722760 - DNA, 20 bp, Homo sapiens
agatggtccatttgttcctg

SEQ ID NO: 722761 - DNA, 15 bp, Homo sapiens
agatggtgctgctaa

SEQ ID NO: 722762 - DNA, 16 bp, Homo sapiens
agatggtggctgtgtc

SEQ ID NO: 722763 - DNA, 23 bp, Homo sapiens
agatggtggctgtgtctctcccc

SEQ ID NO: 722764 - DNA, 17 bp, Homo sapiens
agatggttaaacatttt

SEQ ID NO: 722765 - DNA, 18 bp, Homo sapiens
agatggttaaacattttc

SEQ ID NO: 722766 - DNA, 16 bp, Homo sapiens
agatggtttcaattca

SEQ ID NO: 722767 - DNA, 17 bp, Homo sapiens
agatggtttccacattt

SEQ ID NO: 722768 - DNA, 18 bp, Homo sapiens
agatggtttgagcctgag

SEQ ID NO: 722769 - DNA, 16 bp, Homo sapiens
agatgtaaaatgagtt

SEQ ID NO: 722770 - DNA, 17 bp, Homo sapiens
agatgtaaaatgagttt

SEQ ID NO: 722771 - DNA, 17 bp, Homo sapiens
agatgtaaatgatgtgt

SEQ ID NO: 722772 - DNA, 17 bp, Homo sapiens
agatgtaattttgtgta

SEQ ID NO: 722773 - DNA, 12 bp, Homo sapiens
agatgtacattt

SEQ ID NO: 722774 - DNA, 18 bp, Homo sapiens
agatgtacgacttgcata

SEQ ID NO: 722775 - DNA, 13 bp, Homo sapiens
agatgtactgcaa

SEQ ID NO: 722776 - DNA, 17 bp, Homo sapiens
agatgtagagtttttaa

SEQ ID NO: 722777 - DNA, 19 bp, Homo sapiens
agatgtagataaactcaga

SEQ ID NO: 722778 - DNA, 19 bp, Homo sapiens
agatgtagcattgttccac

SEQ ID NO: 722779 - DNA, 14 bp, Homo sapiens
agatgtagtatttt

SEQ ID NO: 722780 - DNA, 12 bp, Homo sapiens
agatgtatcctt

SEQ ID NO: 722781 - DNA, 20 bp, Homo sapiens
agatgtatgcacacacatat

SEQ ID NO: 722782 - DNA, 15 bp, Homo sapiens
agatgtattgactgt

SEQ ID NO: 722783 - DNA, 17 bp, Homo sapiens
agatgtcccccactgct

SEQ ID NO: 722784 - DNA, 12 bp, Homo sapiens
agatgtcccttg

SEQ ID NO: 722785 - DNA, 17 bp, Homo sapiens
agatgtctcagagcctt

SEQ ID NO: 722786 - DNA, 20 bp, Homo sapiens
agatgtctcctcaagcctgt

SEQ ID NO: 722787 - DNA, 13 bp, Homo sapiens
agatgtcttcatc

SEQ ID NO: 722788 - DNA, 15 bp, Homo sapiens
agatgtcttccctgg

SEQ ID NO: 722789 - DNA, 22 bp, Homo sapiens
agatgtcttccctgggctgcca

SEQ ID NO: 722790 - DNA, 16 bp, Homo sapiens
agatgtcttctgcctg

SEQ ID NO: 722791 - DNA, 18 bp, Homo sapiens
agatgtcttctgcctgtt

SEQ ID NO: 722792 - DNA, 15 bp, Homo sapiens
agatgtctttaggca

SEQ ID NO: 722793 - DNA, 23 bp, Homo sapiens
agatgtgaattattgacactgaa

SEQ ID NO: 722794 - DNA, 23 bp, Homo sapiens
agatgtgacggggtgtgtggccc

SEQ ID NO: 722795 - DNA, 20 bp, Homo sapiens
agatgtgagccaccgtgcct

SEQ ID NO: 722796 - DNA, 17 bp, Homo sapiens
agatgtgagtcctgttg

SEQ ID NO: 722797 - DNA, 19 bp, Homo sapiens
agatgtgagtcctgttgaa

SEQ ID NO: 722798 - DNA, 23 bp, Homo sapiens
agatgtgcatttcacctgtgaca

SEQ ID NO: 722799 - DNA, 23 bp, Homo sapiens
agatgtggcaaagtgctgtaccc

SEQ ID NO: 722800 - DNA, 16 bp, Homo sapiens
agatgtgtctatggct

SEQ ID NO: 722801 - DNA, 21 bp, Homo sapiens
agatgtgtgagcatcctgcaa

SEQ ID NO: 722802 - DNA, 15 bp, Homo sapiens
agatgtgttcttatt

SEQ ID NO: 722803 - DNA, 16 bp, Homo sapiens
agatgtgttcttattt

SEQ ID NO: 722804 - DNA, 19 bp, Homo sapiens
agatgtgttgctatcctga

SEQ ID NO: 722805 - DNA, 17 bp, Homo sapiens
agatgttaaaataaatg

SEQ ID NO: 722806 - DNA, 18 bp, Homo sapiens
agatgttaaaataaatgg

SEQ ID NO: 722807 - DNA, 15 bp, Homo sapiens
agatgttaaatggaa

SEQ ID NO: 722808 - DNA, 19 bp, Homo sapiens
agatgttaaatgttattat

SEQ ID NO: 722809 - DNA, 20 bp, Homo sapiens
agatgttactaccttatttt

SEQ ID NO: 722810 - DNA, 17 bp, Homo sapiens
agatgttattactgttt

SEQ ID NO: 722811 - DNA, 18 bp, Homo sapiens
agatgttattatgctaat

SEQ ID NO: 722812 - DNA, 23 bp, Homo sapiens
agatgttcatttttaaagcctgg

SEQ ID NO: 722813 - DNA, 17 bp, Homo sapiens
agatgttctaagtcttt

SEQ ID NO: 722814 - DNA, 21 bp, Homo sapiens
agatgttctaagtctttccat

SEQ ID NO: 722815 - DNA, 22 bp, Homo sapiens
agatgttctaagtctttccatt

SEQ ID NO: 722816 - DNA, 16 bp, Homo sapiens
agatgttgtcttggct

SEQ ID NO: 722817 - DNA, 13 bp, Homo sapiens
agatgttgtttta

SEQ ID NO: 722818 - DNA, 19 bp, Homo sapiens
agatgttgttttaggggct

SEQ ID NO: 722819 - DNA, 17 bp, Homo sapiens
agatgtttaacaaatct

SEQ ID NO: 722820 - DNA, 18 bp, Homo sapiens
agatgtttaacaaatcta

SEQ ID NO: 722821 - DNA, 17 bp, Homo sapiens
agatgtttattaataga

SEQ ID NO: 722822 - DNA, 15 bp, Homo sapiens
agatgtttatttcag

SEQ ID NO: 722823 - DNA, 16 bp, Homo sapiens
agatgtttatttcagg

SEQ ID NO: 722824 - DNA, 14 bp, Homo sapiens
agatgtttccagac

SEQ ID NO: 722825 - DNA, 21 bp, Homo sapiens
agatgtttccagacttccttg

SEQ ID NO: 722826 - DNA, 14 bp, Homo sapiens
agatgtttcttata

SEQ ID NO: 722827 - DNA, 21 bp, Homo sapiens
agatgtttcttttgtatgtaa

SEQ ID NO: 722828 - DNA, 15 bp, Homo sapiens
agatgtttgaaaatg

SEQ ID NO: 722829 - DNA, 19 bp, Homo sapiens
agatgtttgaaaatgctct

SEQ ID NO: 722830 - DNA, 19 bp, Homo sapiens
agatgtttgatagattttc

SEQ ID NO: 722831 - DNA, 17 bp, Homo sapiens
agatgttttacgtctgg

SEQ ID NO: 722832 - DNA, 21 bp, Homo sapiens
agatgttttgggatcaggagc

SEQ ID NO: 722833 - DNA, 16 bp, Homo sapiens
agatgtttttaaaagt

SEQ ID NO: 722834 - DNA, 18 bp, Homo sapiens
agatgtttttaaaagttt

SEQ ID NO: 722835 - DNA, 21 bp, Homo sapiens
agatgtttttaattctagtat

SEQ ID NO: 722836 - DNA, 12 bp, Homo sapiens
agattaaaggaa

SEQ ID NO: 722837 - DNA, 17 bp, Homo sapiens
agattaaaggaaggaaa

SEQ ID NO: 722838 - DNA, 13 bp, Homo sapiens
agattaagaaata

SEQ ID NO: 722839 - DNA, 14 bp, Homo sapiens
agattaagaaatag

SEQ ID NO: 722840 - DNA, 17 bp, Homo sapiens
agattaatactctattt

SEQ ID NO: 722841 - DNA, 20 bp, Homo sapiens
agattaatattgttctctgt

SEQ ID NO: 722842 - DNA, 12 bp, Homo sapiens
agattacactga

SEQ ID NO: 722843 - DNA, 19 bp, Homo sapiens
agattacctcttgcccttg

SEQ ID NO: 722844 - DNA, 14 bp, Homo sapiens
agattactgatgtg

SEQ ID NO: 722845 - DNA, 23 bp, Homo sapiens
agattactgatgtgatattctgt

SEQ ID NO: 722846 - DNA, 23 bp, Homo sapiens
agattacttaaataatttgggtg

SEQ ID NO: 722847 - DNA, 15 bp, Homo sapiens
agattagaagctgaa

SEQ ID NO: 722848 - DNA, 15 bp, Homo sapiens
agattagctctggac

SEQ ID NO: 722849 - DNA, 17 bp, Homo sapiens
agattagctctggacca

SEQ ID NO: 722850 - DNA, 20 bp, Homo sapiens
agattaggtagactttgctt

SEQ ID NO: 722851 - DNA, 21 bp, Homo sapiens
agattagtaaatatgtgaaga

SEQ ID NO: 722852 - DNA, 14 bp, Homo sapiens
agattatgtgactt

SEQ ID NO: 722853 - DNA, 17 bp, Homo sapiens
agattatgtgacttgca

SEQ ID NO: 722854 - DNA, 19 bp, Homo sapiens
agattattataaactataa

SEQ ID NO: 722855 - DNA, 23 bp, Homo sapiens
agattattataaactataaactt

SEQ ID NO: 722856 - DNA, 18 bp, Homo sapiens
agattattccttcttcta

SEQ ID NO: 722857 - DNA, 14 bp, Homo sapiens
agattattgaaata

SEQ ID NO: 722858 - DNA, 12 bp, Homo sapiens
agattatttaca

SEQ ID NO: 722859 - DNA, 13 bp, Homo sapiens
agattatttctgt

SEQ ID NO: 722860 - DNA, 16 bp, Homo sapiens
agattatttgtgcatt

SEQ ID NO: 722861 - DNA, 19 bp, Homo sapiens
agattatttgtgcatttta

SEQ ID NO: 722862 - DNA, 22 bp, Homo sapiens
agattcaataatgagagctcag

SEQ ID NO: 722863 - DNA, 21 bp, Homo sapiens
agattcactgtcttttgattc

SEQ ID NO: 722864 - DNA, 15 bp, Homo sapiens
agattcactttgaca

SEQ ID NO: 722865 - DNA, 21 bp, Homo sapiens
agattcaggccagcccagcca

SEQ ID NO: 722866 - DNA, 16 bp, Homo sapiens
agattcaggtaataca

SEQ ID NO: 722867 - DNA, 13 bp, Homo sapiens
agattcatattta

SEQ ID NO: 722868 - DNA, 16 bp, Homo sapiens
agattcattttctaga

SEQ ID NO: 722869 - DNA, 17 bp, Homo sapiens
agattcattttctagat

SEQ ID NO: 722870 - DNA, 12 bp, Homo sapiens
agattcattttt

SEQ ID NO: 722871 - DNA, 17 bp, Homo sapiens
agattcatttttctttc

SEQ ID NO: 722872 - DNA, 21 bp, Homo sapiens
agattccagagagtggctcct

SEQ ID NO: 722873 - DNA, 19 bp, Homo sapiens
agattcctcttgcctctct

SEQ ID NO: 722874 - DNA, 20 bp, Homo sapiens
agattcctcttgcctctctc

SEQ ID NO: 722875 - DNA, 15 bp, Homo sapiens
agattcctgggcctg

SEQ ID NO: 722876 - DNA, 17 bp, Homo sapiens
agattcctgggcctgtc

SEQ ID NO: 722877 - DNA, 17 bp, Homo sapiens
agattctaaagctcaat

SEQ ID NO: 722878 - DNA, 12 bp, Homo sapiens
agattctactaa

SEQ ID NO: 722879 - DNA, 14 bp, Homo sapiens
agattctactcttg

SEQ ID NO: 722880 - DNA, 17 bp, Homo sapiens
agattctatcctcatct

SEQ ID NO: 722881 - DNA, 20 bp, Homo sapiens
agattctcataacttgagac

SEQ ID NO: 722882 - DNA, 16 bp, Homo sapiens
agattctgcctctctg

SEQ ID NO: 722883 - DNA, 20 bp, Homo sapiens
agattctggatctcctgctg

SEQ ID NO: 722884 - DNA, 22 bp, Homo sapiens
agattctgtgatcttttaaagt

SEQ ID NO: 722885 - DNA, 20 bp, Homo sapiens
agattgaacctgaatattgc

SEQ ID NO: 722886 - DNA, 11 bp, Homo sapiens
agattgaagaa

SEQ ID NO: 722887 - DNA, 17 bp, Homo sapiens
agattgactaaataaaa

SEQ ID NO: 722888 - DNA, 16 bp, Homo sapiens
agattgagaaatgtgt

SEQ ID NO: 722889 - DNA, 18 bp, Homo sapiens
agattgagagaagagaca

SEQ ID NO: 722890 - DNA, 17 bp, Homo sapiens
agattgagctctctgcc

SEQ ID NO: 722891 - DNA, 13 bp, Homo sapiens
agattgaggcctg

SEQ ID NO: 722892 - DNA, 22 bp, Homo sapiens
agattgaggcctgccctcaggg

SEQ ID NO: 722893 - DNA, 14 bp, Homo sapiens
agattgattgtatt

SEQ ID NO: 722894 - DNA, 15 bp, Homo sapiens
agattgattgtattg

SEQ ID NO: 722895 - DNA, 12 bp, Homo sapiens
agattgcaaagc

SEQ ID NO: 722896 - DNA, 16 bp, Homo sapiens
agattgcagaaaattc

SEQ ID NO: 722897 - DNA, 20 bp, Homo sapiens
agattgcagaaaattctgtg

SEQ ID NO: 722898 - DNA, 14 bp, Homo sapiens
agattgctcaaatc

SEQ ID NO: 722899 - DNA, 16 bp, Homo sapiens
agattgctcaaatcag

SEQ ID NO: 722900 - DNA, 16 bp, Homo sapiens
agattgctctgcccca

SEQ ID NO: 722901 - DNA, 17 bp, Homo sapiens
agattgctctgccccac

SEQ ID NO: 722902 - DNA, 10 bp, Homo sapiens
agattgctga

SEQ ID NO: 722903 - DNA, 14 bp, Homo sapiens
agattgcttctgta

SEQ ID NO: 722904 - DNA, 16 bp, Homo sapiens
agattggaaaagggca

SEQ ID NO: 722905 - DNA, 19 bp, Homo sapiens
agattggagctgaagacct

SEQ ID NO: 722906 - DNA, 15 bp, Homo sapiens
agattggatttgctg

SEQ ID NO: 722907 - DNA, 17 bp, Homo sapiens
agattggatttgctgtg

SEQ ID NO: 722908 - DNA, 22 bp, Homo sapiens
agattggccagtgagaagctga

SEQ ID NO: 722909 - DNA, 23 bp, Homo sapiens
agattggggtaacgtgcactgta

SEQ ID NO: 722910 - DNA, 14 bp, Homo sapiens
agattgggtgccag

SEQ ID NO: 722911 - DNA, 12 bp, Homo sapiens
agattgtactta

SEQ ID NO: 722912 - DNA, 22 bp, Homo sapiens
agattgtccttttctcccattt

SEQ ID NO: 722913 - DNA, 20 bp, Homo sapiens
agattgtgatcccttgagat

SEQ ID NO: 722914 - DNA, 21 bp, Homo sapiens
agattgtggaatgttggataa

SEQ ID NO: 722915 - DNA, 21 bp, Homo sapiens
agattgtgtaacaattttaat

SEQ ID NO: 722916 - DNA, 20 bp, Homo sapiens
agattgttaagggcattttt

SEQ ID NO: 722917 - DNA, 22 bp, Homo sapiens
agattgttttatcatgacatgt

SEQ ID NO: 722918 - DNA, 20 bp, Homo sapiens
agatttaggagcagaaatgc

SEQ ID NO: 722919 - DNA, 18 bp, Homo sapiens
agatttatacagttgaaa

SEQ ID NO: 722920 - DNA, 19 bp, Homo sapiens
agatttatctttatacaga

SEQ ID NO: 722921 - DNA, 16 bp, Homo sapiens
agatttattttacatt

SEQ ID NO: 722922 - DNA, 18 bp, Homo sapiens
agatttattttacattta

SEQ ID NO: 722923 - DNA, 20 bp, Homo sapiens
agatttatttttcagttcca

SEQ ID NO: 722924 - DNA, 16 bp, Homo sapiens
agatttcagtaatgtc

SEQ ID NO: 722925 - DNA, 18 bp, Homo sapiens
agatttcagtaatgtctt

SEQ ID NO: 722926 - DNA, 12 bp, Homo sapiens
agatttcagtag

SEQ ID NO: 722927 - DNA, 14 bp, Homo sapiens
agatttcagtagaa

SEQ ID NO: 722928 - DNA, 17 bp, Homo sapiens
agatttcagtagaattt

SEQ ID NO: 722929 - DNA, 23 bp, Homo sapiens
agatttcagtagaattttagtcc

SEQ ID NO: 722930 - DNA, 18 bp, Homo sapiens
agatttcatagttcagaa

SEQ ID NO: 722931 - DNA, 19 bp, Homo sapiens
agatttcatagttcagaat

SEQ ID NO: 722932 - DNA, 22 bp, Homo sapiens
agatttcctccatggtggaagg

SEQ ID NO: 722933 - DNA, 20 bp, Homo sapiens
agatttccttaaaatctcta

SEQ ID NO: 722934 - DNA, 22 bp, Homo sapiens
agatttctcttgggcaggcaga

SEQ ID NO: 722935 - DNA, 15 bp, Homo sapiens
agatttctgaggaaa

SEQ ID NO: 722936 - DNA, 13 bp, Homo sapiens
agatttctggttg

SEQ ID NO: 722937 - DNA, 22 bp, Homo sapiens
agatttcttaaataatgcttca

SEQ ID NO: 722938 - DNA, 11 bp, Homo sapiens
agatttgaaaa

SEQ ID NO: 722939 - DNA, 13 bp, Homo sapiens
agatttgaccaaa

SEQ ID NO: 722940 - DNA, 14 bp, Homo sapiens
agatttgaccaaat

SEQ ID NO: 722941 - DNA, 13 bp, Homo sapiens
agatttgccagca

SEQ ID NO: 722942 - DNA, 12 bp, Homo sapiens
agatttggaata

SEQ ID NO: 722943 - DNA, 17 bp, Homo sapiens
agatttggcttgacaaa

SEQ ID NO: 722944 - DNA, 15 bp, Homo sapiens
agatttgggagctga

SEQ ID NO: 722945 - DNA, 12 bp, Homo sapiens
agatttgtcctt

SEQ ID NO: 722946 - DNA, 21 bp, Homo sapiens
agatttgtccttttatttctc

SEQ ID NO: 722947 - DNA, 18 bp, Homo sapiens
agatttgttactgtattt

SEQ ID NO: 722948 - DNA, 21 bp, Homo sapiens
agatttgtttttaaactgtac

SEQ ID NO: 722949 - DNA, 19 bp, Homo sapiens
agattttaaattcacaata

SEQ ID NO: 722950 - DNA, 22 bp, Homo sapiens
agattttaaattcacaatagaa

SEQ ID NO: 722951 - DNA, 19 bp, Homo sapiens
agattttaatcaagttgaa

SEQ ID NO: 722952 - DNA, 21 bp, Homo sapiens
agattttaatttatttgtttc

SEQ ID NO: 722953 - DNA, 18 bp, Homo sapiens
agattttacaaaagatgt

SEQ ID NO: 722954 - DNA, 14 bp, Homo sapiens
agattttagactta

SEQ ID NO: 722955 - DNA, 19 bp, Homo sapiens
agattttatattttctatt

SEQ ID NO: 722956 - DNA, 13 bp, Homo sapiens
agattttattgta

SEQ ID NO: 722957 - DNA, 17 bp, Homo sapiens
agattttatttatgcgt

SEQ ID NO: 722958 - DNA, 14 bp, Homo sapiens
agattttattttac

SEQ ID NO: 722959 - DNA, 15 bp, Homo sapiens
agattttattttact

SEQ ID NO: 722960 - DNA, 19 bp, Homo sapiens
agattttcagcaaactctt

SEQ ID NO: 722961 - DNA, 20 bp, Homo sapiens
agattttctattatggaaat

SEQ ID NO: 722962 - DNA, 12 bp, Homo sapiens
agattttctctg

SEQ ID NO: 722963 - DNA, 13 bp, Homo sapiens
agattttctctgg

SEQ ID NO: 722964 - DNA, 16 bp, Homo sapiens
agattttctgctactt

SEQ ID NO: 722965 - DNA, 12 bp, Homo sapiens
agattttcttaa

SEQ ID NO: 722966 - DNA, 15 bp, Homo sapiens
agattttggtaatga

SEQ ID NO: 722967 - DNA, 19 bp, Homo sapiens
agatttttaaaaaatattt

SEQ ID NO: 722968 - DNA, 21 bp, Homo sapiens
agatttttaaaaaatattttc

SEQ ID NO: 722969 - DNA, 16 bp, Homo sapiens
agatttttaacgaatg

SEQ ID NO: 722970 - DNA, 20 bp, Homo sapiens
agatttttaagaacttcatt

SEQ ID NO: 722971 - DNA, 23 bp, Homo sapiens
agatttttacactaatatatgga

SEQ ID NO: 722972 - DNA, 17 bp, Homo sapiens
agatttttatgttttct

SEQ ID NO: 722973 - DNA, 19 bp, Homo sapiens
agatttttcatacttttct

SEQ ID NO: 722974 - DNA, 21 bp, Homo sapiens
agatttttcatacttttctta

SEQ ID NO: 722975 - DNA, 21 bp, Homo sapiens
agatttttgaaaatcctgaat

SEQ ID NO: 722976 - DNA, 12 bp, Homo sapiens
agatttttgaat

SEQ ID NO: 722977 - DNA, 19 bp, Homo sapiens
agatttttgatatctcaat

SEQ ID NO: 722978 - DNA, 16 bp, Homo sapiens
agattttttcagactt

SEQ ID NO: 722979 - DNA, 20 bp, Homo sapiens
agatttttttttctctttta

SEQ ID NO: 722980 - DNA, 21 bp, Homo sapiens
agatttttttttctcttttaa

SEQ ID NO: 722981 - DNA, 22 bp, Homo sapiens
agattttttttttaagtgacat

SEQ ID NO: 722982 - DNA, 23 bp, Homo sapiens
agcaaaaaaaaaaaaaagcatct

SEQ ID NO: 722983 - DNA, 15 bp, Homo sapiens
agcaaaaaaggaaaa

SEQ ID NO: 722984 - DNA, 17 bp, Homo sapiens
agcaaaaagatgtatat

SEQ ID NO: 722985 - DNA, 18 bp, Homo sapiens
agcaaaacaaattcaaat

SEQ ID NO: 722986 - DNA, 18 bp, Homo sapiens
agcaaaaccattgcttca

SEQ ID NO: 722987 - DNA, 19 bp, Homo sapiens
agcaaaaccattgcttcac

SEQ ID NO: 722988 - DNA, 20 bp, Homo sapiens
agcaaaaccattgcttcact

SEQ ID NO: 722989 - DNA, 19 bp, Homo sapiens
agcaaaactcccaatggat

SEQ ID NO: 722990 - DNA, 13 bp, Homo sapiens
agcaaaagaaaaa

SEQ ID NO: 722991 - DNA, 16 bp, Homo sapiens
agcaaaagaccaaatc

SEQ ID NO: 722992 - DNA, 16 bp, Homo sapiens
agcaaaaggcagctca

SEQ ID NO: 722993 - DNA, 15 bp, Homo sapiens
agcaaaataaaacat

SEQ ID NO: 722994 - DNA, 15 bp, Homo sapiens
agcaaaatcatttta

SEQ ID NO: 722995 - DNA, 22 bp, Homo sapiens
agcaaaatggaagcaaagacaa

SEQ ID NO: 722996 - DNA, 21 bp, Homo sapiens
agcaaacaatggtgtctcttt

SEQ ID NO: 722997 - DNA, 19 bp, Homo sapiens
agcaaaccattatacctta

SEQ ID NO: 722998 - DNA, 18 bp, Homo sapiens
agcaaacccagaggtgga

SEQ ID NO: 722999 - DNA, 23 bp, Homo sapiens
agcaaactaaccagcattcccta

SEQ ID NO: 723000 - DNA, 19 bp, Homo sapiens
agcaaactaacttgacttt

SEQ ID NO: 723001 - DNA, 14 bp, Homo sapiens
agcaaactctgctg

SEQ ID NO: 723002 - DNA, 15 bp, Homo sapiens
agcaaactctgctgt

SEQ ID NO: 723003 - DNA, 12 bp, Homo sapiens
agcaaactgatg

SEQ ID NO: 723004 - DNA, 15 bp, Homo sapiens
agcaaactgatgctg

SEQ ID NO: 723005 - DNA, 15 bp, Homo sapiens
agcaaagaggggcgc

SEQ ID NO: 723006 - DNA, 12 bp, Homo sapiens
agcaaagagtgg

SEQ ID NO: 723007 - DNA, 12 bp, Homo sapiens
agcaaagatcaa

SEQ ID NO: 723008 - DNA, 15 bp, Homo sapiens
agcaaagatcaaaat

SEQ ID NO: 723009 - DNA, 23 bp, Homo sapiens
agcaaagattaaatgtgtcattg

SEQ ID NO: 723010 - DNA, 14 bp, Homo sapiens
agcaaagatttcaa

SEQ ID NO: 723011 - DNA, 15 bp, Homo sapiens
agcaaagatttcagt

SEQ ID NO: 723012 - DNA, 17 bp, Homo sapiens
agcaaagatttcagtag

SEQ ID NO: 723013 - DNA, 15 bp, Homo sapiens
agcaaagcaccagct

SEQ ID NO: 723014 - DNA, 16 bp, Homo sapiens
agcaaagcgcccaccc

SEQ ID NO: 723015 - DNA, 17 bp, Homo sapiens
agcaaagctacaggact

SEQ ID NO: 723016 - DNA, 18 bp, Homo sapiens
agcaaaggagacaaagca

SEQ ID NO: 723017 - DNA, 11 bp, Homo sapiens
agcaaaggcag

SEQ ID NO: 723018 - DNA, 13 bp, Homo sapiens
agcaaaggcccat

SEQ ID NO: 723019 - DNA, 17 bp, Homo sapiens
agcaaaggcccatgccc

SEQ ID NO: 723020 - DNA, 19 bp, Homo sapiens
agcaaaggcccatgccccc

SEQ ID NO: 723021 - DNA, 17 bp, Homo sapiens
agcaaaggggacagctg

SEQ ID NO: 723022 - DNA, 22 bp, Homo sapiens
agcaaagtagtacttcttctgt

SEQ ID NO: 723023 - DNA, 24 bp, Homo sapiens
agcaaagtagtacttcttctgtaa

SEQ ID NO: 723024 - DNA, 16 bp, Homo sapiens
agcaaagtatcaaaga

SEQ ID NO: 723025 - DNA, 19 bp, Homo sapiens
agcaaataaactaggaaat

SEQ ID NO: 723026 - DNA, 21 bp, Homo sapiens
agcaaatatcatactgttcaa

SEQ ID NO: 723027 - DNA, 16 bp, Homo sapiens
agcaaatcagaaactt

SEQ ID NO: 723028 - DNA, 19 bp, Homo sapiens
agcaaatcatttgtttaaa

SEQ ID NO: 723029 - DNA, 23 bp, Homo sapiens
agcaaatctgccaccgtggggga

SEQ ID NO: 723030 - DNA, 20 bp, Homo sapiens
agcaaatctttctgtaaaca

SEQ ID NO: 723031 - DNA, 14 bp, Homo sapiens
agcaaatgcaaaaa

SEQ ID NO: 723032 - DNA, 15 bp, Homo sapiens
agcaaatggcctcat

SEQ ID NO: 723033 - DNA, 13 bp, Homo sapiens
agcaaatggcgtt

SEQ ID NO: 723034 - DNA, 17 bp, Homo sapiens
agcaaatgtttctgcag

SEQ ID NO: 723035 - DNA, 15 bp, Homo sapiens
agcaaattttcagca

SEQ ID NO: 723036 - DNA, 13 bp, Homo sapiens
agcaacaaagaaa

SEQ ID NO: 723037 - DNA, 12 bp, Homo sapiens
agcaacaagact

SEQ ID NO: 723038 - DNA, 12 bp, Homo sapiens
agcaacaataaa

SEQ ID NO: 723039 - DNA, 18 bp, Homo sapiens
agcaacaataaatagaca

SEQ ID NO: 723040 - DNA, 15 bp, Homo sapiens
agcaacagactctca

SEQ ID NO: 723041 - DNA, 17 bp, Homo sapiens
agcaacatatctctgcc

SEQ ID NO: 723042 - DNA, 13 bp, Homo sapiens
agcaacatttgta

SEQ ID NO: 723043 - DNA, 20 bp, Homo sapiens
agcaacattttacccacaca

SEQ ID NO: 723044 - DNA, 22 bp, Homo sapiens
agcaacattttacccacacaca

SEQ ID NO: 723045 - DNA, 20 bp, Homo sapiens
agcaacccctgtacccagct

SEQ ID NO: 723046 - DNA, 21 bp, Homo sapiens
agcaacccctgtacccagctc

SEQ ID NO: 723047 - DNA, 22 bp, Homo sapiens
agcaacccctgtacccagctcc

SEQ ID NO: 723048 - DNA, 23 bp, Homo sapiens
agcaacccctgtacccagctcct

SEQ ID NO: 723049 - DNA, 18 bp, Homo sapiens
agcaacccgctggagccc

SEQ ID NO: 723050 - DNA, 20 bp, Homo sapiens
agcaacctgtaactcacatt

SEQ ID NO: 723051 - DNA, 19 bp, Homo sapiens
agcaacctttcacctttgt

SEQ ID NO: 723052 - DNA, 22 bp, Homo sapiens
agcaacctttcacctttgtgta

SEQ ID NO: 723053 - DNA, 21 bp, Homo sapiens
agcaactaaaatgtgtcttgc

SEQ ID NO: 723054 - DNA, 21 bp, Homo sapiens
agcaactaatgtttgaacaaa

SEQ ID NO: 723055 - DNA, 16 bp, Homo sapiens
agcaactacaacttct

SEQ ID NO: 723056 - DNA, 14 bp, Homo sapiens
agcaactcttgatt

SEQ ID NO: 723057 - DNA, 22 bp, Homo sapiens
agcaactgaacaaaagctcagg

SEQ ID NO: 723058 - DNA, 16 bp, Homo sapiens
agcaactgcccttcca

SEQ ID NO: 723059 - DNA, 23 bp, Homo sapiens
agcaactgcccttccaggtgggt

SEQ ID NO: 723060 - DNA, 16 bp, Homo sapiens
agcaactgctggggag

SEQ ID NO: 723061 - DNA, 13 bp, Homo sapiens
agcaactgttatg

SEQ ID NO: 723062 - DNA, 18 bp, Homo sapiens
agcaactgttatgaaata

SEQ ID NO: 723063 - DNA, 21 bp, Homo sapiens
agcaacttagaatagtttgaa

SEQ ID NO: 723064 - DNA, 18 bp, Homo sapiens
agcaacttcttctccatc

SEQ ID NO: 723065 - DNA, 18 bp, Homo sapiens
agcaacttgatggaagga

SEQ ID NO: 723066 - DNA, 20 bp, Homo sapiens
agcaacttgcccaattttaa

SEQ ID NO: 723067 - DNA, 13 bp, Homo sapiens
agcaacttgcttc

SEQ ID NO: 723068 - DNA, 14 bp, Homo sapiens
agcaacttgcttct

SEQ ID NO: 723069 - DNA, 15 bp, Homo sapiens
agcaacttttgtgta

SEQ ID NO: 723070 - DNA, 22 bp, Homo sapiens
agcaagaaagagggtcccaggg

SEQ ID NO: 723071 - DNA, 18 bp, Homo sapiens
agcaagaaataaatcaga

SEQ ID NO: 723072 - DNA, 21 bp, Homo sapiens
agcaagaccctaaacatccat

SEQ ID NO: 723073 - DNA, 19 bp, Homo sapiens
agcaagacctcatctgtgg

SEQ ID NO: 723074 - DNA, 18 bp, Homo sapiens
agcaagactctttcaaaa

SEQ ID NO: 723075 - DNA, 15 bp, Homo sapiens
agcaagagagatgtt

SEQ ID NO: 723076 - DNA, 21 bp, Homo sapiens
agcaagagagcagcgcccagg

SEQ ID NO: 723077 - DNA, 13 bp, Homo sapiens
agcaagagcacaa

SEQ ID NO: 723078 - DNA, 13 bp, Homo sapiens
agcaagagctggc

SEQ ID NO: 723079 - DNA, 17 bp, Homo sapiens
agcaagagctggcaaag

SEQ ID NO: 723080 - DNA, 19 bp, Homo sapiens
agcaagagggaacaaaact

SEQ ID NO: 723081 - DNA, 17 bp, Homo sapiens
agcaagagtaagcagtg

SEQ ID NO: 723082 - DNA, 16 bp, Homo sapiens
agcaagcaactgagat

SEQ ID NO: 723083 - DNA, 23 bp, Homo sapiens
agcaagcagtctaccctgtcctt

SEQ ID NO: 723084 - DNA, 21 bp, Homo sapiens
agcaagcattcagaagaaaaa

SEQ ID NO: 723085 - DNA, 22 bp, Homo sapiens
agcaagcattcagaagaaaaag

SEQ ID NO: 723086 - DNA, 13 bp, Homo sapiens
agcaagcgggagc

SEQ ID NO: 723087 - DNA, 21 bp, Homo sapiens
agcaaggaagatatacatgaa

SEQ ID NO: 723088 - DNA, 17 bp, Homo sapiens
agcaaggagaaaatata

SEQ ID NO: 723089 - DNA, 19 bp, Homo sapiens
agcaaggagatttacaact

SEQ ID NO: 723090 - DNA, 15 bp, Homo sapiens
agcaaggatatcaga

SEQ ID NO: 723091 - DNA, 9 bp, Homo sapiens
agcaaggcc

SEQ ID NO: 723092 - DNA, 16 bp, Homo sapiens
agcaaggctgctgccg

SEQ ID NO: 723093 - DNA, 16 bp, Homo sapiens
agcaagggctccagca

SEQ ID NO: 723094 - DNA, 18 bp, Homo sapiens
agcaagggctccagcatc

SEQ ID NO: 723095 - DNA, 13 bp, Homo sapiens
agcaagggggccc

SEQ ID NO: 723096 - DNA, 20 bp, Homo sapiens
agcaaggtgggtggaaacta

SEQ ID NO: 723097 - DNA, 21 bp, Homo sapiens
agcaaggtttaaatttgttat

SEQ ID NO: 723098 - DNA, 18 bp, Homo sapiens
agcaagtaaaaaggctaa

SEQ ID NO: 723099 - DNA, 14 bp, Homo sapiens
agcaagtgaatttt

SEQ ID NO: 723100 - DNA, 20 bp, Homo sapiens
agcaagtgagaccctgtctc

SEQ ID NO: 723101 - DNA, 21 bp, Homo sapiens
agcaagtgagtctggtggagg

SEQ ID NO: 723102 - DNA, 22 bp, Homo sapiens
agcaagtgtgctggcctctctg

SEQ ID NO: 723103 - DNA, 20 bp, Homo sapiens
agcaagttctagagaagagg

SEQ ID NO: 723104 - DNA, 15 bp, Homo sapiens
agcaagttttcttcc

SEQ ID NO: 723105 - DNA, 14 bp, Homo sapiens
agcaataaagaaga

SEQ ID NO: 723106 - DNA, 16 bp, Homo sapiens
agcaataaagaagagt

SEQ ID NO: 723107 - DNA, 18 bp, Homo sapiens
agcaataactccaagcag

SEQ ID NO: 723108 - DNA, 20 bp, Homo sapiens
agcaataactccaagcagac

SEQ ID NO: 723109 - DNA, 23 bp, Homo sapiens
agcaataactccaagcagactcc

SEQ ID NO: 723110 - DNA, 14 bp, Homo sapiens
agcaataacttcta

SEQ ID NO: 723111 - DNA, 21 bp, Homo sapiens
agcaataacttctatgttggt

SEQ ID NO: 723112 - DNA, 13 bp, Homo sapiens
agcaataagaaat

SEQ ID NO: 723113 - DNA, 16 bp, Homo sapiens
agcaataagaaatgaa

SEQ ID NO: 723114 - DNA, 17 bp, Homo sapiens
agcaataagaaatgaac

SEQ ID NO: 723115 - DNA, 20 bp, Homo sapiens
agcaataagaaatgaacaaa

SEQ ID NO: 723116 - DNA, 19 bp, Homo sapiens
agcaatactcatcagagca

SEQ ID NO: 723117 - DNA, 15 bp, Homo sapiens
agcaatatgtaaata

SEQ ID NO: 723118 - DNA, 19 bp, Homo sapiens
agcaatattgcctgtgctt

SEQ ID NO: 723119 - DNA, 13 bp, Homo sapiens
agcaatattgtat

SEQ ID NO: 723120 - DNA, 13 bp, Homo sapiens
agcaatcacagga

SEQ ID NO: 723121 - DNA, 16 bp, Homo sapiens
agcaatcacaggaaaa

SEQ ID NO: 723122 - DNA, 17 bp, Homo sapiens
agcaatccacctgcctt

SEQ ID NO: 723123 - DNA, 18 bp, Homo sapiens
agcaatccacctgccttg

SEQ ID NO: 723124 - DNA, 20 bp, Homo sapiens
agcaatccatgttagttttt

SEQ ID NO: 723125 - DNA, 22 bp, Homo sapiens
agcaatcctcctacctcagcct

SEQ ID NO: 723126 - DNA, 15 bp, Homo sapiens
agcaatcctcctgcc

SEQ ID NO: 723127 - DNA, 19 bp, Homo sapiens
agcaatcctcctgcctcag

SEQ ID NO: 723128 - DNA, 23 bp, Homo sapiens
agcaatctcttcattattctctg

SEQ ID NO: 723129 - DNA, 13 bp, Homo sapiens
agcaatctgaccc

SEQ ID NO: 723130 - DNA, 16 bp, Homo sapiens
agcaatctgaccctat

SEQ ID NO: 723131 - DNA, 20 bp, Homo sapiens
agcaatgaactcaagaagga

SEQ ID NO: 723132 - DNA, 18 bp, Homo sapiens
agcaatgatgtccagaag

SEQ ID NO: 723133 - DNA, 20 bp, Homo sapiens
agcaatgccatttcagtggc

SEQ ID NO: 723134 - DNA, 16 bp, Homo sapiens
agcaatggccagagcc

SEQ ID NO: 723135 - DNA, 16 bp, Homo sapiens
agcaatgggggcctcc

SEQ ID NO: 723136 - DNA, 16 bp, Homo sapiens
agcaatgggtcttagc

SEQ ID NO: 723137 - DNA, 19 bp, Homo sapiens
agcaatggtaactgcacct

SEQ ID NO: 723138 - DNA, 13 bp, Homo sapiens
agcaatgtctgtg

SEQ ID NO: 723139 - DNA, 14 bp, Homo sapiens
agcaatgtctgtgc

SEQ ID NO: 723140 - DNA, 16 bp, Homo sapiens
agcaatgtgttttttc

SEQ ID NO: 723141 - DNA, 16 bp, Homo sapiens
agcaattatttaaaga

SEQ ID NO: 723142 - DNA, 17 bp, Homo sapiens
agcaattatttaaagaa

SEQ ID NO: 723143 - DNA, 19 bp, Homo sapiens
agcaattatttaaagaaag

SEQ ID NO: 723144 - DNA, 20 bp, Homo sapiens
agcaattccatgctataaaa

SEQ ID NO: 723145 - DNA, 18 bp, Homo sapiens
agcaattctcctgcctca

SEQ ID NO: 723146 - DNA, 16 bp, Homo sapiens
agcaattctgactgtc

SEQ ID NO: 723147 - DNA, 13 bp, Homo sapiens
agcaatttaaatg

SEQ ID NO: 723148 - DNA, 14 bp, Homo sapiens
agcaattttctttg

SEQ ID NO: 723149 - DNA, 19 bp, Homo sapiens
agcaattttctttgtttct

SEQ ID NO: 723150 - DNA, 13 bp, Homo sapiens
agcacaaattagt

SEQ ID NO: 723151 - DNA, 19 bp, Homo sapiens
agcacaaccggtcccttcc

SEQ ID NO: 723152 - DNA, 21 bp, Homo sapiens
agcacaaccggtcccttccat

SEQ ID NO: 723153 - DNA, 19 bp, Homo sapiens
agcacaagaggaagagaga

SEQ ID NO: 723154 - DNA, 18 bp, Homo sapiens
agcacaagcgtgtttcta

SEQ ID NO: 723155 - DNA, 13 bp, Homo sapiens
agcacaaggaatt

SEQ ID NO: 723156 - DNA, 16 bp, Homo sapiens
agcacaaggagtgccc

SEQ ID NO: 723157 - DNA, 17 bp, Homo sapiens
agcacaagggcacattg

SEQ ID NO: 723158 - DNA, 18 bp, Homo sapiens
agcacaagttatttaaat

SEQ ID NO: 723159 - DNA, 19 bp, Homo sapiens
agcacaagttatttaaatc

SEQ ID NO: 723160 - DNA, 21 bp, Homo sapiens
agcacaagttatttaaatctg

SEQ ID NO: 723161 - DNA, 19 bp, Homo sapiens
agcacaatcactaaacttt

SEQ ID NO: 723162 - DNA, 20 bp, Homo sapiens
agcacaatcactaaacttta

SEQ ID NO: 723163 - DNA, 22 bp, Homo sapiens
agcacaatcactaaactttatt

SEQ ID NO: 723164 - DNA, 20 bp, Homo sapiens
agcacaatcctattactctt

SEQ ID NO: 723165 - DNA, 15 bp, Homo sapiens
agcacaattctgtcc

SEQ ID NO: 723166 - DNA, 16 bp, Homo sapiens
agcacaattctgtccc

SEQ ID NO: 723167 - DNA, 17 bp, Homo sapiens
agcacaattctgtccct

SEQ ID NO: 723168 - DNA, 20 bp, Homo sapiens
agcacaatttgagactgaaa

SEQ ID NO: 723169 - DNA, 22 bp, Homo sapiens
agcacacacaaacctactgccc

SEQ ID NO: 723170 - DNA, 23 bp, Homo sapiens
agcacacacaaacctactgccca

SEQ ID NO: 723171 - DNA, 14 bp, Homo sapiens
agcacacacatctg

SEQ ID NO: 723172 - DNA, 17 bp, Homo sapiens
agcacacacatctggcc

SEQ ID NO: 723173 - DNA, 19 bp, Homo sapiens
agcacacacatctggccct

SEQ ID NO: 723174 - DNA, 20 bp, Homo sapiens
agcacacacatctggccctg

SEQ ID NO: 723175 - DNA, 21 bp, Homo sapiens
agcacacacatctggccctga

SEQ ID NO: 723176 - DNA, 16 bp, Homo sapiens
agcacaccaagtggct

SEQ ID NO: 723177 - DNA, 17 bp, Homo sapiens
agcacaccaagtggctg

SEQ ID NO: 723178 - DNA, 18 bp, Homo sapiens
agcacaccagccgctgca

SEQ ID NO: 723179 - DNA, 23 bp, Homo sapiens
agcacacctcggccgaggcctgc

SEQ ID NO: 723180 - DNA, 13 bp, Homo sapiens
agcacacctctgg

SEQ ID NO: 723181 - DNA, 14 bp, Homo sapiens
agcacactggaata

SEQ ID NO: 723182 - DNA, 19 bp, Homo sapiens
agcacactggaatataaaa

SEQ ID NO: 723183 - DNA, 21 bp, Homo sapiens
agcacactttacacaagaatc

SEQ ID NO: 723184 - DNA, 11 bp, Homo sapiens
agcacagagag

SEQ ID NO: 723185 - DNA, 15 bp, Homo sapiens
agcacagagagggac

SEQ ID NO: 723186 - DNA, 14 bp, Homo sapiens
agcacagagcctgg

SEQ ID NO: 723187 - DNA, 15 bp, Homo sapiens
agcacagagcctggc

SEQ ID NO: 723188 - DNA, 17 bp, Homo sapiens
agcacagaggatttctt

SEQ ID NO: 723189 - DNA, 13 bp, Homo sapiens
agcacagcagcct

SEQ ID NO: 723190 - DNA, 15 bp, Homo sapiens
agcacagcagcctgg

SEQ ID NO: 723191 - DNA, 23 bp, Homo sapiens
agcacagcagcctggggctggcc

SEQ ID NO: 723192 - DNA, 12 bp, Homo sapiens
agcacagccaac

SEQ ID NO: 723193 - DNA, 13 bp, Homo sapiens
agcacagccacct

SEQ ID NO: 723194 - DNA, 14 bp, Homo sapiens
agcacagccacctc

SEQ ID NO: 723195 - DNA, 20 bp, Homo sapiens
agcacagcccagggcctgca

SEQ ID NO: 723196 - DNA, 15 bp, Homo sapiens
agcacagccctggga

SEQ ID NO: 723197 - DNA, 22 bp, Homo sapiens
agcacagccctgggagggggct

SEQ ID NO: 723198 - DNA, 16 bp, Homo sapiens
agcacagctcctgcca

SEQ ID NO: 723199 - DNA, 13 bp, Homo sapiens
agcacagctgtat

SEQ ID NO: 723200 - DNA, 16 bp, Homo sapiens
agcacagcttagattt

SEQ ID NO: 723201 - DNA, 18 bp, Homo sapiens
agcacagcttagatttca

SEQ ID NO: 723202 - DNA, 14 bp, Homo sapiens
agcacagcttcttc

SEQ ID NO: 723203 - DNA, 15 bp, Homo sapiens
agcacagcttcttct

SEQ ID NO: 723204 - DNA, 18 bp, Homo sapiens
agcacagcttgacctgag

SEQ ID NO: 723205 - DNA, 14 bp, Homo sapiens
agcacagcttgggt

SEQ ID NO: 723206 - DNA, 19 bp, Homo sapiens
agcacaggggccccagatc

SEQ ID NO: 723207 - DNA, 20 bp, Homo sapiens
agcacaggtgtctgcctaga

SEQ ID NO: 723208 - DNA, 17 bp, Homo sapiens
agcacaggttagggcat

SEQ ID NO: 723209 - DNA, 19 bp, Homo sapiens
agcacaggttagggtgtgt

SEQ ID NO: 723210 - DNA, 18 bp, Homo sapiens
agcacagtgttaaatgaa

SEQ ID NO: 723211 - DNA, 19 bp, Homo sapiens
agcacagtgttaaatgaaa

SEQ ID NO: 723212 - DNA, 14 bp, Homo sapiens
agcacagtttgaac

SEQ ID NO: 723213 - DNA, 18 bp, Homo sapiens
agcacatactgtgttcca

SEQ ID NO: 723214 - DNA, 19 bp, Homo sapiens
agcacatagagctttttaa

SEQ ID NO: 723215 - DNA, 20 bp, Homo sapiens
agcacatagtgtcctgccca

SEQ ID NO: 723216 - DNA, 16 bp, Homo sapiens
agcacatatggaattt

SEQ ID NO: 723217 - DNA, 13 bp, Homo sapiens
agcacatcacctc

SEQ ID NO: 723218 - DNA, 18 bp, Homo sapiens
agcacatcacctctttgc

SEQ ID NO: 723219 - DNA, 18 bp, Homo sapiens
agcacatctctctgccct

SEQ ID NO: 723220 - DNA, 15 bp, Homo sapiens
agcacatctgcattt

SEQ ID NO: 723221 - DNA, 16 bp, Homo sapiens
agcacatctgcatttt

SEQ ID NO: 723222 - DNA, 23 bp, Homo sapiens
agcacatgaaaccttattttttc

SEQ ID NO: 723223 - DNA, 20 bp, Homo sapiens
agcacatgcgggctcgccca

SEQ ID NO: 723224 - DNA, 23 bp, Homo sapiens
agcacatgcgtatatgtgcgtct

SEQ ID NO: 723225 - DNA, 15 bp, Homo sapiens
agcacatgtaataaa

SEQ ID NO: 723226 - DNA, 21 bp, Homo sapiens
agcacatgtaataaattcaaa

SEQ ID NO: 723227 - DNA, 20 bp, Homo sapiens
agcacatgttactgcttcat

SEQ ID NO: 723228 - DNA, 16 bp, Homo sapiens
agcacattccacggca

SEQ ID NO: 723229 - DNA, 19 bp, Homo sapiens
agcacattcgggaccaata

SEQ ID NO: 723230 - DNA, 16 bp, Homo sapiens
agcaccaaaataagaa

SEQ ID NO: 723231 - DNA, 14 bp, Homo sapiens
agcaccacactggg

SEQ ID NO: 723232 - DNA, 21 bp, Homo sapiens
agcaccacctacacaggagtc

SEQ ID NO: 723233 - DNA, 17 bp, Homo sapiens
agcaccactgctgagga

SEQ ID NO: 723234 - DNA, 14 bp, Homo sapiens
agcaccagaatgta

SEQ ID NO: 723235 - DNA, 11 bp, Homo sapiens
agcacccactg

SEQ ID NO: 723236 - DNA, 18 bp, Homo sapiens
agcacccccaagcctggg

SEQ ID NO: 723237 - DNA, 11 bp, Homo sapiens
agcacccccac

SEQ ID NO: 723238 - DNA, 19 bp, Homo sapiens
agcacccccacccacctcc

SEQ ID NO: 723239 - DNA, 14 bp, Homo sapiens
agcaccccctcatt

SEQ ID NO: 723240 - DNA, 16 bp, Homo sapiens
agcaccccctcattcc

SEQ ID NO: 723241 - DNA, 13 bp, Homo sapiens
agcaccccctgct

SEQ ID NO: 723242 - DNA, 14 bp, Homo sapiens
agcaccccctgctc

SEQ ID NO: 723243 - DNA, 21 bp, Homo sapiens
agcaccccctgctccaccagc

SEQ ID NO: 723244 - DNA, 14 bp, Homo sapiens
agcacccctctctg

SEQ ID NO: 723245 - DNA, 14 bp, Homo sapiens
agcaccccttccat

SEQ ID NO: 723246 - DNA, 24 bp, Homo sapiens
agcaccctataaatcaacacctta

SEQ ID NO: 723247 - DNA, 17 bp, Homo sapiens
agcaccctcgagaaggg

SEQ ID NO: 723248 - DNA, 19 bp, Homo sapiens
agcaccctctcctgggggt

SEQ ID NO: 723249 - DNA, 13 bp, Homo sapiens
agcaccctctgga

SEQ ID NO: 723250 - DNA, 13 bp, Homo sapiens
agcaccctgccct

SEQ ID NO: 723251 - DNA, 23 bp, Homo sapiens
agcaccgtgccaaccccacccag

SEQ ID NO: 723252 - DNA, 21 bp, Homo sapiens
agcaccgtgtcaagctgctct

SEQ ID NO: 723253 - DNA, 22 bp, Homo sapiens
agcaccgtgtcaagctgctctg

SEQ ID NO: 723254 - DNA, 15 bp, Homo sapiens
agcacctacagtgta

SEQ ID NO: 723255 - DNA, 19 bp, Homo sapiens
agcacctacagtgtacagt

SEQ ID NO: 723256 - DNA, 21 bp, Homo sapiens
agcacctacagtgtacagtct

SEQ ID NO: 723257 - DNA, 21 bp, Homo sapiens
agcacctactatgtgctgggt

SEQ ID NO: 723258 - DNA, 11 bp, Homo sapiens
agcacctgccg

SEQ ID NO: 723259 - DNA, 20 bp, Homo sapiens
agcacctgccgacctcgtcc

SEQ ID NO: 723260 - DNA, 21 bp, Homo sapiens
agcacctgccgacctcgtcct

SEQ ID NO: 723261 - DNA, 14 bp, Homo sapiens
agcacctgcctcct

SEQ ID NO: 723262 - DNA, 21 bp, Homo sapiens
agcacctgcctcctcgttcct

SEQ ID NO: 723263 - DNA, 20 bp, Homo sapiens
agcacctgcttcatgctcag

SEQ ID NO: 723264 - DNA, 23 bp, Homo sapiens
agcacctggaccccctgcccgcc

SEQ ID NO: 723265 - DNA, 20 bp, Homo sapiens
agcacctgggccccactgga

SEQ ID NO: 723266 - DNA, 22 bp, Homo sapiens
agcacctgggccccactggaca

SEQ ID NO: 723267 - DNA, 18 bp, Homo sapiens
agcaccttcagggctgag

SEQ ID NO: 723268 - DNA, 16 bp, Homo sapiens
agcaccttcctcactt

SEQ ID NO: 723269 - DNA, 19 bp, Homo sapiens
agcaccttctttctggact

SEQ ID NO: 723270 - DNA, 14 bp, Homo sapiens
agcaccttgcagat

SEQ ID NO: 723271 - DNA, 15 bp, Homo sapiens
agcaccttggcccag

SEQ ID NO: 723272 - DNA, 16 bp, Homo sapiens
agcaccttggcccagg

SEQ ID NO: 723273 - DNA, 20 bp, Homo sapiens
agcaccttggcccaggagct

SEQ ID NO: 723274 - DNA, 16 bp, Homo sapiens
agcacctttctctgag

SEQ ID NO: 723275 - DNA, 18 bp, Homo sapiens
agcacctttctctgagaa

SEQ ID NO: 723276 - DNA, 18 bp, Homo sapiens
agcacgaaatgttatttt

SEQ ID NO: 723277 - DNA, 14 bp, Homo sapiens
agcacgatttctgt

SEQ ID NO: 723278 - DNA, 15 bp, Homo sapiens
agcacgatttctgtt

SEQ ID NO: 723279 - DNA, 21 bp, Homo sapiens
agcacgatttctgtttagata

SEQ ID NO: 723280 - DNA, 15 bp, Homo sapiens
agcacgcctgccatc

SEQ ID NO: 723281 - DNA, 16 bp, Homo sapiens
agcacgcctgccatct

SEQ ID NO: 723282 - DNA, 23 bp, Homo sapiens
agcacgcggccttgtctgggtgc

SEQ ID NO: 723283 - DNA, 22 bp, Homo sapiens
agcacggcccggcccctcaccc

SEQ ID NO: 723284 - DNA, 23 bp, Homo sapiens
agcacggcccggcccctcaccct

SEQ ID NO: 723285 - DNA, 19 bp, Homo sapiens
agcactaaacttggtgctt

SEQ ID NO: 723286 - DNA, 20 bp, Homo sapiens
agcactaaagcagtggacac

SEQ ID NO: 723287 - DNA, 16 bp, Homo sapiens
agcactacaatcatgg

SEQ ID NO: 723288 - DNA, 17 bp, Homo sapiens
agcactactctgtgcca

SEQ ID NO: 723289 - DNA, 15 bp, Homo sapiens
agcactactgggtgt

SEQ ID NO: 723290 - DNA, 16 bp, Homo sapiens
agcactactgggtgtc

SEQ ID NO: 723291 - DNA, 18 bp, Homo sapiens
agcactactgggtgtcat

SEQ ID NO: 723292 - DNA, 19 bp, Homo sapiens
agcactactgggtgtcatt

SEQ ID NO: 723293 - DNA, 16 bp, Homo sapiens
agcactatttaaaata

SEQ ID NO: 723294 - DNA, 13 bp, Homo sapiens
agcactattttat

SEQ ID NO: 723295 - DNA, 17 bp, Homo sapiens
agcactattttatattt

SEQ ID NO: 723296 - DNA, 22 bp, Homo sapiens
agcactcaaacctggagctgag

SEQ ID NO: 723297 - DNA, 14 bp, Homo sapiens
agcactcacacagg

SEQ ID NO: 723298 - DNA, 20 bp, Homo sapiens
agcactccccagagctgtgc

SEQ ID NO: 723299 - DNA, 21 bp, Homo sapiens
agcactccccagagctgtgcc

SEQ ID NO: 723300 - DNA, 23 bp, Homo sapiens
agcactccctaatttatgtgcta

SEQ ID NO: 723301 - DNA, 21 bp, Homo sapiens
agcactcccttaggcattatt

SEQ ID NO: 723302 - DNA, 19 bp, Homo sapiens
agcactccgcatcacctca

SEQ ID NO: 723303 - DNA, 16 bp, Homo sapiens
agcactcctcaagact

SEQ ID NO: 723304 - DNA, 16 bp, Homo sapiens
agcactcgagaccatc

SEQ ID NO: 723305 - DNA, 20 bp, Homo sapiens
agcactctaattagagaact

SEQ ID NO: 723306 - DNA, 13 bp, Homo sapiens
agcactctctgca

SEQ ID NO: 723307 - DNA, 19 bp, Homo sapiens
agcactctgagtttaccat

SEQ ID NO: 723308 - DNA, 12 bp, Homo sapiens
agcactgacctg

SEQ ID NO: 723309 - DNA, 22 bp, Homo sapiens
agcactgacctgtcatgccccc

SEQ ID NO: 723310 - DNA, 12 bp, Homo sapiens
agcactgagcaa

SEQ ID NO: 723311 - DNA, 19 bp, Homo sapiens
agcactgcctctatgccct

SEQ ID NO: 723312 - DNA, 17 bp, Homo sapiens
agcactgcttgaggaaa

SEQ ID NO: 723313 - DNA, 12 bp, Homo sapiens
agcactggactc

SEQ ID NO: 723314 - DNA, 19 bp, Homo sapiens
agcactggagtgcagggag

SEQ ID NO: 723315 - DNA, 14 bp, Homo sapiens
agcactggccagag

SEQ ID NO: 723316 - DNA, 17 bp, Homo sapiens
agcactggctctctcca

SEQ ID NO: 723317 - DNA, 18 bp, Homo sapiens
agcactggctctctccag

SEQ ID NO: 723318 - DNA, 19 bp, Homo sapiens
agcactgggaagctggagt

SEQ ID NO: 723319 - DNA, 15 bp, Homo sapiens
agcactgtcccttgc

SEQ ID NO: 723320 - DNA, 19 bp, Homo sapiens
agcactgtcccttgcctca

SEQ ID NO: 723321 - DNA, 22 bp, Homo sapiens
agcactgtcccttgcctcaatg

SEQ ID NO: 723322 - DNA, 15 bp, Homo sapiens
agcacttaagagaat

SEQ ID NO: 723323 - DNA, 17 bp, Homo sapiens
agcacttacgtaaaaca

SEQ ID NO: 723324 - DNA, 12 bp, Homo sapiens
agcacttgcctg

SEQ ID NO: 723325 - DNA, 16 bp, Homo sapiens
agcacttgcctggaat

SEQ ID NO: 723326 - DNA, 22 bp, Homo sapiens
agcacttgcgtcctgcagagga

SEQ ID NO: 723327 - DNA, 19 bp, Homo sapiens
agcacttgcttacatcctc

SEQ ID NO: 723328 - DNA, 23 bp, Homo sapiens
agcacttggagccaagggttcag

SEQ ID NO: 723329 - DNA, 13 bp, Homo sapiens
agcacttgtatat

SEQ ID NO: 723330 - DNA, 21 bp, Homo sapiens
agcacttgtgggtttttgttt

SEQ ID NO: 723331 - DNA, 19 bp, Homo sapiens
agcacttgttttaaaatgc

SEQ ID NO: 723332 - DNA, 17 bp, Homo sapiens
agcactttaaagaggct

SEQ ID NO: 723333 - DNA, 23 bp, Homo sapiens
agcactttaaccctctcttccct

SEQ ID NO: 723334 - DNA, 21 bp, Homo sapiens
agcactttgaaaatatttcta

SEQ ID NO: 723335 - DNA, 15 bp, Homo sapiens
agcactttgggaggc

SEQ ID NO: 723336 - DNA, 16 bp, Homo sapiens
agcactttgggaggcc

SEQ ID NO: 723337 - DNA, 19 bp, Homo sapiens
agcactttgggaggccaag

SEQ ID NO: 723338 - DNA, 17 bp, Homo sapiens
agcactttgggaggccg

SEQ ID NO: 723339 - DNA, 20 bp, Homo sapiens
agcactttgggaggccgagg

SEQ ID NO: 723340 - DNA, 16 bp, Homo sapiens
agcactttgggaggct

SEQ ID NO: 723341 - DNA, 11 bp, Homo sapiens
agcagaaacag

SEQ ID NO: 723342 - DNA, 15 bp, Homo sapiens
agcagaaagtgcctt

SEQ ID NO: 723343 - DNA, 19 bp, Homo sapiens
agcagaaatgccttaccct

SEQ ID NO: 723344 - DNA, 22 bp, Homo sapiens
agcagaacaagtgcctcctgga

SEQ ID NO: 723345 - DNA, 18 bp, Homo sapiens
agcagaacctgcacacag

SEQ ID NO: 723346 - DNA, 19 bp, Homo sapiens
agcagaacctgcacacagg

SEQ ID NO: 723347 - DNA, 18 bp, Homo sapiens
agcagaactgaagccact

SEQ ID NO: 723348 - DNA, 13 bp, Homo sapiens
agcagaagcctcc

SEQ ID NO: 723349 - DNA, 21 bp, Homo sapiens
agcagaatggagaaagtaagt

SEQ ID NO: 723350 - DNA, 17 bp, Homo sapiens
agcagaatggaggcagg

SEQ ID NO: 723351 - DNA, 21 bp, Homo sapiens
agcagaatggtgatcactcca

SEQ ID NO: 723352 - DNA, 14 bp, Homo sapiens
agcagaattcattc

SEQ ID NO: 723353 - DNA, 15 bp, Homo sapiens
agcagaattcattca

SEQ ID NO: 723354 - DNA, 17 bp, Homo sapiens
agcagaattttaatgtg

SEQ ID NO: 723355 - DNA, 19 bp, Homo sapiens
agcagaattttaatgtgaa

SEQ ID NO: 723356 - DNA, 21 bp, Homo sapiens
agcagacaataacttcttaaa

SEQ ID NO: 723357 - DNA, 11 bp, Homo sapiens
agcagacacat

SEQ ID NO: 723358 - DNA, 18 bp, Homo sapiens
agcagacagaaactggat

SEQ ID NO: 723359 - DNA, 17 bp, Homo sapiens
agcagacagagccagga

SEQ ID NO: 723360 - DNA, 18 bp, Homo sapiens
agcagacagagccaggag

SEQ ID NO: 723361 - DNA, 23 bp, Homo sapiens
agcagacagagccaggagaagct

SEQ ID NO: 723362 - DNA, 12 bp, Homo sapiens
agcagacaggcc

SEQ ID NO: 723363 - DNA, 16 bp, Homo sapiens
agcagacgcagcagct

SEQ ID NO: 723364 - DNA, 20 bp, Homo sapiens
agcagactcagctctgacat

SEQ ID NO: 723365 - DNA, 18 bp, Homo sapiens
agcagactccagcccctg

SEQ ID NO: 723366 - DNA, 21 bp, Homo sapiens
agcagactccagcccctggac

SEQ ID NO: 723367 - DNA, 18 bp, Homo sapiens
agcagactggaaaagtga

SEQ ID NO: 723368 - DNA, 19 bp, Homo sapiens
agcagagaggtggccaccg

SEQ ID NO: 723369 - DNA, 17 bp, Homo sapiens
agcagagatgtactgca

SEQ ID NO: 723370 - DNA, 16 bp, Homo sapiens
agcagagccaaggcca

SEQ ID NO: 723371 - DNA, 18 bp, Homo sapiens
agcagagccaaggccacc

SEQ ID NO: 723372 - DNA, 20 bp, Homo sapiens
agcagagcccaccagccagc

SEQ ID NO: 723373 - DNA, 21 bp, Homo sapiens
agcagagcccaccagccagcc

SEQ ID NO: 723374 - DNA, 13 bp, Homo sapiens
agcagagcctcct

SEQ ID NO: 723375 - DNA, 17 bp, Homo sapiens
agcagagcctcctggga

SEQ ID NO: 723376 - DNA, 22 bp, Homo sapiens
agcagagcggggtcccctctgt

SEQ ID NO: 723377 - DNA, 21 bp, Homo sapiens
agcagagctctcccctcctgc

SEQ ID NO: 723378 - DNA, 19 bp, Homo sapiens
agcagaggaggggccgctg

SEQ ID NO: 723379 - DNA, 13 bp, Homo sapiens
agcagaggcagcg

SEQ ID NO: 723380 - DNA, 17 bp, Homo sapiens
agcagaggcaggctggg

SEQ ID NO: 723381 - DNA, 13 bp, Homo sapiens
agcagagggagga

SEQ ID NO: 723382 - DNA, 13 bp, Homo sapiens
agcagaggtctcc

SEQ ID NO: 723383 - DNA, 17 bp, Homo sapiens
agcagaggtttaaatgt

SEQ ID NO: 723384 - DNA, 15 bp, Homo sapiens
agcagagtctgggcc

SEQ ID NO: 723385 - DNA, 14 bp, Homo sapiens
agcagagtgaggat

SEQ ID NO: 723386 - DNA, 15 bp, Homo sapiens
agcagagtggactgc

SEQ ID NO: 723387 - DNA, 16 bp, Homo sapiens
agcagagtggactgca

SEQ ID NO: 723388 - DNA, 17 bp, Homo sapiens
agcagagtggactgcat

SEQ ID NO: 723389 - DNA, 19 bp, Homo sapiens
agcagagtggactgcattt

SEQ ID NO: 723390 - DNA, 16 bp, Homo sapiens
agcagagtgggacttg

SEQ ID NO: 723391 - DNA, 20 bp, Homo sapiens
agcagatacatatgagtgtg

SEQ ID NO: 723392 - DNA, 15 bp, Homo sapiens
agcagatactgtctt

SEQ ID NO: 723393 - DNA, 15 bp, Homo sapiens
agcagatgactgaga

SEQ ID NO: 723394 - DNA, 17 bp, Homo sapiens
agcagatgactgagaac

SEQ ID NO: 723395 - DNA, 16 bp, Homo sapiens
agcagatgccagtgaa

SEQ ID NO: 723396 - DNA, 17 bp, Homo sapiens
agcagatgccagtgaag

SEQ ID NO: 723397 - DNA, 13 bp, Homo sapiens
agcagattccaca

SEQ ID NO: 723398 - DNA, 15 bp, Homo sapiens
agcagattccacagg

SEQ ID NO: 723399 - DNA, 16 bp, Homo sapiens
agcagattccacagga

SEQ ID NO: 723400 - DNA, 17 bp, Homo sapiens
agcagattccacaggac

SEQ ID NO: 723401 - DNA, 15 bp, Homo sapiens
agcagcaagtgtgct

SEQ ID NO: 723402 - DNA, 18 bp, Homo sapiens
agcagcaccgttctgtgc

SEQ ID NO: 723403 - DNA, 19 bp, Homo sapiens
agcagcaccgttctgtgca

SEQ ID NO: 723404 - DNA, 18 bp, Homo sapiens
agcagcacctttctctga

SEQ ID NO: 723405 - DNA, 13 bp, Homo sapiens
agcagcagagagc

SEQ ID NO: 723406 - DNA, 18 bp, Homo sapiens
agcagcagagagccctgg

SEQ ID NO: 723407 - DNA, 22 bp, Homo sapiens
agcagcagaggtgagaactcag

SEQ ID NO: 723408 - DNA, 13 bp, Homo sapiens
agcagcagcacca

SEQ ID NO: 723409 - DNA, 13 bp, Homo sapiens
agcagcagcacct

SEQ ID NO: 723410 - DNA, 14 bp, Homo sapiens
agcagcagcagcag

SEQ ID NO: 723411 - DNA, 13 bp, Homo sapiens
agcagcagcaggt

SEQ ID NO: 723412 - DNA, 21 bp, Homo sapiens
agcagcagcccaagcttccct

SEQ ID NO: 723413 - DNA, 13 bp, Homo sapiens
agcagcagccctg

SEQ ID NO: 723414 - DNA, 16 bp, Homo sapiens
agcagcagcgctcggc

SEQ ID NO: 723415 - DNA, 13 bp, Homo sapiens
agcagcaggctca

SEQ ID NO: 723416 - DNA, 12 bp, Homo sapiens
agcagcaggtga

SEQ ID NO: 723417 - DNA, 14 bp, Homo sapiens
agcagcaggtgctg

SEQ ID NO: 723418 - DNA, 18 bp, Homo sapiens
agcagcaggtgtggccaa

SEQ ID NO: 723419 - DNA, 13 bp, Homo sapiens
agcagcatcccag

SEQ ID NO: 723420 - DNA, 18 bp, Homo sapiens
agcagcatcccagccttg

SEQ ID NO: 723421 - DNA, 19 bp, Homo sapiens
agcagcatggaaaaatggt

SEQ ID NO: 723422 - DNA, 22 bp, Homo sapiens
agcagcatggaaaaatggttga

SEQ ID NO: 723423 - DNA, 22 bp, Homo sapiens
agcagcattctggaggggagag

SEQ ID NO: 723424 - DNA, 10 bp, Homo sapiens
agcagccacg

SEQ ID NO: 723425 - DNA, 19 bp, Homo sapiens
agcagccagagctgtgcct

SEQ ID NO: 723426 - DNA, 22 bp, Homo sapiens
agcagccagagctgtgcctgct

SEQ ID NO: 723427 - DNA, 14 bp, Homo sapiens
agcagccagcacca

SEQ ID NO: 723428 - DNA, 22 bp, Homo sapiens
agcagccagcaccacctacaca

SEQ ID NO: 723429 - DNA, 11 bp, Homo sapiens
agcagccagcc

SEQ ID NO: 723430 - DNA, 14 bp, Homo sapiens
agcagccagccagt

SEQ ID NO: 723431 - DNA, 13 bp, Homo sapiens
agcagccagctct

SEQ ID NO: 723432 - DNA, 14 bp, Homo sapiens
agcagccagctctc

SEQ ID NO: 723433 - DNA, 19 bp, Homo sapiens
agcagccagctctcagcca

SEQ ID NO: 723434 - DNA, 13 bp, Homo sapiens
agcagccaggacc

SEQ ID NO: 723435 - DNA, 14 bp, Homo sapiens
agcagccaggaccc

SEQ ID NO: 723436 - DNA, 13 bp, Homo sapiens
agcagccaggagg

SEQ ID NO: 723437 - DNA, 13 bp, Homo sapiens
agcagccagtctc

SEQ ID NO: 723438 - DNA, 14 bp, Homo sapiens
agcagccagtctca

SEQ ID NO: 723439 - DNA, 19 bp, Homo sapiens
agcagcccaagcttccctc

SEQ ID NO: 723440 - DNA, 13 bp, Homo sapiens
agcagcccagctt

SEQ ID NO: 723441 - DNA, 19 bp, Homo sapiens
agcagcccccgggccgctg

SEQ ID NO: 723442 - DNA, 14 bp, Homo sapiens
agcagccccctgtg

SEQ ID NO: 723443 - DNA, 17 bp, Homo sapiens
agcagcccctcgaggcc

SEQ ID NO: 723444 - DNA, 14 bp, Homo sapiens
agcagccctaagga

SEQ ID NO: 723445 - DNA, 12 bp, Homo sapiens
agcagccctcct

SEQ ID NO: 723446 - DNA, 13 bp, Homo sapiens
agcagccctcctc

SEQ ID NO: 723447 - DNA, 14 bp, Homo sapiens
agcagccctcctca

SEQ ID NO: 723448 - DNA, 23 bp, Homo sapiens
agcagccctcctcaccccgtctg

SEQ ID NO: 723449 - DNA, 17 bp, Homo sapiens
agcagccctgccccaca

SEQ ID NO: 723450 - DNA, 20 bp, Homo sapiens
agcagccgccttaagctgat

SEQ ID NO: 723451 - DNA, 14 bp, Homo sapiens
agcagcctcagagt

SEQ ID NO: 723452 - DNA, 16 bp, Homo sapiens
agcagcctcagagtgg

SEQ ID NO: 723453 - DNA, 14 bp, Homo sapiens
agcagcctcgcaca

SEQ ID NO: 723454 - DNA, 17 bp, Homo sapiens
agcagcctcgcacaggc

SEQ ID NO: 723455 - DNA, 14 bp, Homo sapiens
agcagcctcgtgga

SEQ ID NO: 723456 - DNA, 14 bp, Homo sapiens
agcagcctctggac

SEQ ID NO: 723457 - DNA, 22 bp, Homo sapiens
agcagcctctggacagccagtg

SEQ ID NO: 723458 - DNA, 13 bp, Homo sapiens
agcagcctgatgg

SEQ ID NO: 723459 - DNA, 14 bp, Homo sapiens
agcagcctggagac

SEQ ID NO: 723460 - DNA, 15 bp, Homo sapiens
agcagcctggagact

SEQ ID NO: 723461 - DNA, 13 bp, Homo sapiens
agcagcctgtgag

SEQ ID NO: 723462 - DNA, 16 bp, Homo sapiens
agcagcctgtgaggga

SEQ ID NO: 723463 - DNA, 14 bp, Homo sapiens
agcagcctgtggca

SEQ ID NO: 723464 - DNA, 12 bp, Homo sapiens
agcagcctgttt

SEQ ID NO: 723465 - DNA, 18 bp, Homo sapiens
agcagcctttaatgcatc

SEQ ID NO: 723466 - DNA, 23 bp, Homo sapiens
agcagcgaccgccccctcctcta

SEQ ID NO: 723467 - DNA, 20 bp, Homo sapiens
tgcagaggggctttctggag

SEQ ID NO: 723468 - DNA, 21 bp, Homo sapiens
tgcagaggggctttctggaga

SEQ ID NO: 723469 - DNA, 19 bp, Homo sapiens
tgcagagggtactttaaga

SEQ ID NO: 723470 - DNA, 15 bp, Homo sapiens
tgcagaggtcagact

SEQ ID NO: 723471 - DNA, 14 bp, Homo sapiens
tgcagaggtctcca

SEQ ID NO: 723472 - DNA, 16 bp, Homo sapiens
tgcagaggtctccaaa

SEQ ID NO: 723473 - DNA, 16 bp, Homo sapiens
tgcagaggtctgtgct

SEQ ID NO: 723474 - DNA, 17 bp, Homo sapiens
tgcagaggtctgtgctg

SEQ ID NO: 723475 - DNA, 22 bp, Homo sapiens
tgcagaggtctgtgctgaggcc

SEQ ID NO: 723476 - DNA, 14 bp, Homo sapiens
tgcagagtccattt

SEQ ID NO: 723477 - DNA, 15 bp, Homo sapiens
tgcagatagcccagg

SEQ ID NO: 723478 - DNA, 17 bp, Homo sapiens
tgcagatagcccaggag

SEQ ID NO: 723479 - DNA, 19 bp, Homo sapiens
tgcagatagcccaggagca

SEQ ID NO: 723480 - DNA, 16 bp, Homo sapiens
tgcagatcatctgggg

SEQ ID NO: 723481 - DNA, 18 bp, Homo sapiens
tgcagatggggctcccgc

SEQ ID NO: 723482 - DNA, 21 bp, Homo sapiens
tgcagatgggtgctatcagag

SEQ ID NO: 723483 - DNA, 22 bp, Homo sapiens
tgcagattcataggcagcatct

SEQ ID NO: 723484 - DNA, 19 bp, Homo sapiens
tgcagattcctcagattca

SEQ ID NO: 723485 - DNA, 15 bp, Homo sapiens
tgcagattcctgggc

SEQ ID NO: 723486 - DNA, 19 bp, Homo sapiens
tgcagattcctgggcctgt

SEQ ID NO: 723487 - DNA, 23 bp, Homo sapiens
tgcagattgagacctacaggctg

SEQ ID NO: 723488 - DNA, 19 bp, Homo sapiens
tgcagcaaacactccaccc

SEQ ID NO: 723489 - DNA, 15 bp, Homo sapiens
tgcagcaataaagca

SEQ ID NO: 723490 - DNA, 22 bp, Homo sapiens
tgcagcacatgcgggctcgccc

SEQ ID NO: 723491 - DNA, 12 bp, Homo sapiens
tgcagcacctcc

SEQ ID NO: 723492 - DNA, 14 bp, Homo sapiens
tgcagcacctccag

SEQ ID NO: 723493 - DNA, 16 bp, Homo sapiens
tgcagcacctccaggc

SEQ ID NO: 723494 - DNA, 19 bp, Homo sapiens
tgcagcacctccaggcctg

SEQ ID NO: 723495 - DNA, 20 bp, Homo sapiens
tgcagcacctccaggcctgt

SEQ ID NO: 723496 - DNA, 11 bp, Homo sapiens
tgcagcagagg

SEQ ID NO: 723497 - DNA, 13 bp, Homo sapiens
ttttttattctgt

SEQ ID NO: 723498 - DNA, 12 bp, Homo sapiens
ttttttatttct

SEQ ID NO: 723499 - DNA, 11 bp, Homo sapiens
ttttttcatct

SEQ ID NO: 723500 - DNA, 14 bp, Homo sapiens
ttttttccaaaatc

SEQ ID NO: 723501 - DNA, 22 bp, Homo sapiens
ttttttccatctttacaaaact

SEQ ID NO: 723502 - DNA, 13 bp, Homo sapiens
ttttttccttttt

SEQ ID NO: 723503 - DNA, 13 bp, Homo sapiens
ttttttcgtttgt

SEQ ID NO: 723504 - DNA, 12 bp, Homo sapiens
ttttttctaaga

SEQ ID NO: 723505 - DNA, 11 bp, Homo sapiens
ttttttctacc

SEQ ID NO: 723506 - DNA, 15 bp, Homo sapiens
ttttttctacctata

SEQ ID NO: 723507 - DNA, 11 bp, Homo sapiens
ttttttctgaa

SEQ ID NO: 723508 - DNA, 9 bp, Homo sapiens
ttttttgaa

SEQ ID NO: 723509 - DNA, 13 bp, Homo sapiens
ttttttgactaaa

SEQ ID NO: 723510 - DNA, 17 bp, Homo sapiens
ttttttgagagagagtc

SEQ ID NO: 723511 - DNA, 13 bp, Homo sapiens
ttttttgcaagtt

SEQ ID NO: 723512 - DNA, 13 bp, Homo sapiens
ttttttgggttaa

SEQ ID NO: 723513 - DNA, 20 bp, Homo sapiens
ttttttgggttaaaagatgg

SEQ ID NO: 723514 - DNA, 21 bp, Homo sapiens
ttttttggtataatgtttaaa

SEQ ID NO: 723515 - DNA, 13 bp, Homo sapiens
ttttttgtaataa

SEQ ID NO: 723516 - DNA, 12 bp, Homo sapiens
ttttttgtacaa

SEQ ID NO: 723517 - DNA, 12 bp, Homo sapiens
ttttttgtatag

SEQ ID NO: 723518 - DNA, 17 bp, Homo sapiens
ttttttgtcttattgaa

SEQ ID NO: 723519 - DNA, 12 bp, Homo sapiens
ttttttgttcaa

SEQ ID NO: 723520 - DNA, 13 bp, Homo sapiens
ttttttgttcaat

SEQ ID NO: 723521 - DNA, 16 bp, Homo sapiens
ttttttgtttgtttct

SEQ ID NO: 723522 - DNA, 18 bp, Homo sapiens
ttttttgttttacaatgt

SEQ ID NO: 723523 - DNA, 19 bp, Homo sapiens
tttttttaaatgattccaa

SEQ ID NO: 723524 - DNA, 12 bp, Homo sapiens
tttttttaatgt

SEQ ID NO: 723525 - DNA, 12 bp, Homo sapiens
tttttttacatt

SEQ ID NO: 723526 - DNA, 13 bp, Homo sapiens
tttttttccaatt

SEQ ID NO: 723527 - DNA, 12 bp, Homo sapiens
tttttttccatt

SEQ ID NO: 723528 - DNA, 10 bp, Homo sapiens
tttttttcct

SEQ ID NO: 723529 - DNA, 11 bp, Homo sapiens
tttttttcctt

SEQ ID NO: 723530 - DNA, 13 bp, Homo sapiens
tttttttcctttt

SEQ ID NO: 723531 - DNA, 12 bp, Homo sapiens
tttttttctacc

SEQ ID NO: 723532 - DNA, 13 bp, Homo sapiens
tttttttctgtga

SEQ ID NO: 723533 - DNA, 13 bp, Homo sapiens
tttttttctgttt

SEQ ID NO: 723534 - DNA, 10 bp, Homo sapiens
tttttttgca

SEQ ID NO: 723535 - DNA, 12 bp, Homo sapiens
tttttttgcagg

SEQ ID NO: 723536 - DNA, 11 bp, Homo sapiens
tttttttgcca

SEQ ID NO: 723537 - DNA, 10 bp, Homo sapiens
tttttttggc

SEQ ID NO: 723538 - DNA, 14 bp, Homo sapiens
tttttttgttatta

SEQ ID NO: 723539 - DNA, 13 bp, Homo sapiens
ttttttttaacat

SEQ ID NO: 723540 - DNA, 13 bp, Homo sapiens
ttttttttctgaa

SEQ ID NO: 723541 - DNA, 13 bp, Homo sapiens
ttttttttgacaa

SEQ ID NO: 723542 - DNA, 13 bp, Homo sapiens
tttttttttgagg

SEQ ID NO: 723543 - DNA, 13 bp, Homo sapiens
ttttttttttcct

SEQ ID NO: 723544 - DNA, 22 bp, Homo sapiens
ttctccttagttggctggaaac

SEQ ID NO: 723545 - DNA, 21 bp, Homo sapiens
ttctccttgaatatctttcga

SEQ ID NO: 723546 - DNA, 21 bp, Homo sapiens
ttctccttgttgttggttgtt

SEQ ID NO: 723547 - DNA, 22 bp, Homo sapiens
ttctcctttcacaaccttctgt

SEQ ID NO: 723548 - DNA, 18 bp, Homo sapiens
ttctcgcctcactttcca

SEQ ID NO: 723549 - DNA, 16 bp, Homo sapiens
ttctcgtccccctccc

SEQ ID NO: 723550 - DNA, 18 bp, Homo sapiens
ttctcgtccccctccctg

SEQ ID NO: 723551 - DNA, 22 bp, Homo sapiens
ttctcgtccccctccctgccca

SEQ ID NO: 723552 - DNA, 17 bp, Homo sapiens
ttctcgtgcctccccac

SEQ ID NO: 723553 - DNA, 18 bp, Homo sapiens
ttctctaaagtcactagt

SEQ ID NO: 723554 - DNA, 22 bp, Homo sapiens
ttctctaagcctatacgtttct

SEQ ID NO: 723555 - DNA, 18 bp, Homo sapiens
ttctctaagttccactga

SEQ ID NO: 723556 - DNA, 20 bp, Homo sapiens
ttctctacatgctctttttc

SEQ ID NO: 723557 - DNA, 23 bp, Homo sapiens
ttctctacccatcttaaaaacaa

SEQ ID NO: 723558 - DNA, 20 bp, Homo sapiens
ttctctactttgaggaaacc

SEQ ID NO: 723559 - DNA, 20 bp, Homo sapiens
ttctctagctctctaggcct

SEQ ID NO: 723560 - DNA, 15 bp, Homo sapiens
ttctctagtttgatt

SEQ ID NO: 723561 - DNA, 20 bp, Homo sapiens
ttctctagtttgattaaatt

SEQ ID NO: 723562 - DNA, 22 bp, Homo sapiens
ttctctatcctctctctctcta

SEQ ID NO: 723563 - DNA, 15 bp, Homo sapiens
ttctctattaaaatg

SEQ ID NO: 723564 - DNA, 13 bp, Homo sapiens
ttctctcacttct

SEQ ID NO: 723565 - DNA, 18 bp, Homo sapiens
ttctctcacttctaaatt

SEQ ID NO: 723566 - DNA, 16 bp, Homo sapiens
ttctctccaatttaac

SEQ ID NO: 723567 - DNA, 16 bp, Homo sapiens
ttctctccacagtgtt

SEQ ID NO: 723568 - DNA, 22 bp, Homo sapiens
ttctctccacagtgttgtgccc

SEQ ID NO: 723569 - DNA, 15 bp, Homo sapiens
ttctctcccatcctg

SEQ ID NO: 723570 - DNA, 11 bp, Homo sapiens
ttctctcccct

SEQ ID NO: 723571 - DNA, 13 bp, Homo sapiens
ttctctcccctca

SEQ ID NO: 723572 - DNA, 19 bp, Homo sapiens
ttctctcccctcacatcct

SEQ ID NO: 723573 - DNA, 22 bp, Homo sapiens
ttctctcccctcacatcctcct

SEQ ID NO: 723574 - DNA, 17 bp, Homo sapiens
ttctctccgacttcccc

SEQ ID NO: 723575 - DNA, 11 bp, Homo sapiens
ttctctcctca

SEQ ID NO: 723576 - DNA, 12 bp, Homo sapiens
ttctctcctccc

SEQ ID NO: 723577 - DNA, 15 bp, Homo sapiens
ttctctcctccccaa

SEQ ID NO: 723578 - DNA, 17 bp, Homo sapiens
ttctctcctccccaaat

SEQ ID NO: 723579 - DNA, 13 bp, Homo sapiens
ttctctctatgca

SEQ ID NO: 723580 - DNA, 23 bp, Homo sapiens
ttctctctatgcaaaatgtctgt

SEQ ID NO: 723581 - DNA, 22 bp, Homo sapiens
ttctctctccctgtcacacact

SEQ ID NO: 723582 - DNA, 11 bp, Homo sapiens
ttctctctcct

SEQ ID NO: 723583 - DNA, 19 bp, Homo sapiens
ttctctctcctctctgctt

SEQ ID NO: 723584 - DNA, 15 bp, Homo sapiens
ttctctctgctgagc

SEQ ID NO: 723585 - DNA, 11 bp, Homo sapiens
ttctctctgga

SEQ ID NO: 723586 - DNA, 12 bp, Homo sapiens
ttctctctggat

SEQ ID NO: 723587 - DNA, 17 bp, Homo sapiens
ttctctctgttcccttc

SEQ ID NO: 723588 - DNA, 13 bp, Homo sapiens
ttctctcttaaca

SEQ ID NO: 723589 - DNA, 18 bp, Homo sapiens
ttctctctttatacagct

SEQ ID NO: 723590 - DNA, 17 bp, Homo sapiens
ttctctcttttaaagta

SEQ ID NO: 723591 - DNA, 17 bp, Homo sapiens
ttctctgacttctgcct

SEQ ID NO: 723592 - DNA, 17 bp, Homo sapiens
ttctctgagctgtgcag

SEQ ID NO: 723593 - DNA, 13 bp, Homo sapiens
ttctctgaggaca

SEQ ID NO: 723594 - DNA, 14 bp, Homo sapiens
ttctctgcaacact

SEQ ID NO: 723595 - DNA, 11 bp, Homo sapiens
ttctctgcagt

SEQ ID NO: 723596 - DNA, 14 bp, Homo sapiens
ttctctgcagtaaa

SEQ ID NO: 723597 - DNA, 23 bp, Homo sapiens
ttctctgccgctacctccctccc

SEQ ID NO: 723598 - DNA, 13 bp, Homo sapiens
ttctctgcctctg

SEQ ID NO: 723599 - DNA, 14 bp, Homo sapiens
ttctctgccttctt

SEQ ID NO: 723600 - DNA, 14 bp, Homo sapiens
ttctctgctcttgt

SEQ ID NO: 723601 - DNA, 15 bp, Homo sapiens
ttctctgctgcctct

SEQ ID NO: 723602 - DNA, 16 bp, Homo sapiens
ttctctgctgcctctg

SEQ ID NO: 723603 - DNA, 19 bp, Homo sapiens
ttctctgctgcctctgtgg

SEQ ID NO: 723604 - DNA, 10 bp, Homo sapiens
ttctctgctt

SEQ ID NO: 723605 - DNA, 20 bp, Homo sapiens
ttctctgcttacccttcacc

SEQ ID NO: 723606 - DNA, 21 bp, Homo sapiens
ttctctgcttacccttcacct

SEQ ID NO: 723607 - DNA, 11 bp, Homo sapiens
ttctctgcttg

SEQ ID NO: 723608 - DNA, 16 bp, Homo sapiens
ttctctgcttgacaga

SEQ ID NO: 723609 - DNA, 12 bp, Homo sapiens
ttctctgggaga

SEQ ID NO: 723610 - DNA, 15 bp, Homo sapiens
ttctctgggagaaaa

SEQ ID NO: 723611 - DNA, 16 bp, Homo sapiens
ttctctgggtcccggg

SEQ ID NO: 723612 - DNA, 16 bp, Homo sapiens
ttctctgggtctgatt

SEQ ID NO: 723613 - DNA, 23 bp, Homo sapiens
ttctctgggtctgattttctcac

SEQ ID NO: 723614 - DNA, 21 bp, Homo sapiens
ttctctgtacttttcattctc

SEQ ID NO: 723615 - DNA, 14 bp, Homo sapiens
ttctctgtatagta

SEQ ID NO: 723616 - DNA, 12 bp, Homo sapiens
ttctctgtctca

SEQ ID NO: 723617 - DNA, 17 bp, Homo sapiens
ttctctgtctcatccat

SEQ ID NO: 723618 - DNA, 12 bp, Homo sapiens
ttctctgtgaac

SEQ ID NO: 723619 - DNA, 16 bp, Homo sapiens
ttctctgtgctctgaa

SEQ ID NO: 723620 - DNA, 14 bp, Homo sapiens
ttctctgtgtgcac

SEQ ID NO: 723621 - DNA, 23 bp, Homo sapiens
ttctctgttgtcgtaaagatttg

SEQ ID NO: 723622 - DNA, 22 bp, Homo sapiens
ttctctgttgtttggttcaggg

SEQ ID NO: 723623 - DNA, 22 bp, Homo sapiens
ttctcttaaaatgacaaaaagt

SEQ ID NO: 723624 - DNA, 23 bp, Homo sapiens
tttattctgtggttctataataa

SEQ ID NO: 723625 - DNA, 12 bp, Homo sapiens
tttattctgtta

SEQ ID NO: 723626 - DNA, 17 bp, Homo sapiens
tttattcttattactat

SEQ ID NO: 723627 - DNA, 13 bp, Homo sapiens
tttattcttgctg

SEQ ID NO: 723628 - DNA, 17 bp, Homo sapiens
tttattctttactatta

SEQ ID NO: 723629 - DNA, 14 bp, Homo sapiens
tttattgaaatgta

SEQ ID NO: 723630 - DNA, 12 bp, Homo sapiens
tttattgacaca

SEQ ID NO: 723631 - DNA, 14 bp, Homo sapiens
tttattgagaaaga

SEQ ID NO: 723632 - DNA, 20 bp, Homo sapiens
tttattgagctgtacatgca

SEQ ID NO: 723633 - DNA, 16 bp, Homo sapiens
tttattgcagaatgtg

SEQ ID NO: 723634 - DNA, 23 bp, Homo sapiens
tttattgccatattaaaatctga

SEQ ID NO: 723635 - DNA, 22 bp, Homo sapiens
tttattgctcgcccagacacca

SEQ ID NO: 723636 - DNA, 18 bp, Homo sapiens
tttattggaagtgttcaa

SEQ ID NO: 723637 - DNA, 23 bp, Homo sapiens
tttattggcagccaaggaatgtg

SEQ ID NO: 723638 - DNA, 19 bp, Homo sapiens
tttattggggaattaaata

SEQ ID NO: 723639 - DNA, 23 bp, Homo sapiens
tttattggggaattaaatagtgt

SEQ ID NO: 723640 - DNA, 17 bp, Homo sapiens
tttattggggtgacctt

SEQ ID NO: 723641 - DNA, 17 bp, Homo sapiens
tttattggttttgcaga

SEQ ID NO: 723642 - DNA, 14 bp, Homo sapiens
tttattgttagaaa

SEQ ID NO: 723643 - DNA, 22 bp, Homo sapiens
tttatttaaaaaactaaaaact

SEQ ID NO: 723644 - DNA, 16 bp, Homo sapiens
tttatttaaaactctg

SEQ ID NO: 723645 - DNA, 12 bp, Homo sapiens
tttatttaaaag

SEQ ID NO: 723646 - DNA, 17 bp, Homo sapiens
tttatttaaatgcatgt

SEQ ID NO: 723647 - DNA, 19 bp, Homo sapiens
tttatttaatgctgtggca

SEQ ID NO: 723648 - DNA, 19 bp, Homo sapiens
tttatttaattaaatgtat

SEQ ID NO: 723649 - DNA, 14 bp, Homo sapiens
tttatttacaaatg

SEQ ID NO: 723650 - DNA, 20 bp, Homo sapiens
tttatttacagatgaatgta

SEQ ID NO: 723651 - DNA, 14 bp, Homo sapiens
tttatttacatttt

SEQ ID NO: 723652 - DNA, 19 bp, Homo sapiens
tttatttagttccttgagt

SEQ ID NO: 723653 - DNA, 17 bp, Homo sapiens
tttatttatacactgtc

SEQ ID NO: 723654 - DNA, 14 bp, Homo sapiens
tttatttatatctt

SEQ ID NO: 723655 - DNA, 14 bp, Homo sapiens
tttatttatcagtg

SEQ ID NO: 723656 - DNA, 14 bp, Homo sapiens
tttatttattcact

SEQ ID NO: 723657 - DNA, 13 bp, Homo sapiens
tttatttatttct

SEQ ID NO: 723658 - DNA, 15 bp, Homo sapiens
tttatttattttatc

SEQ ID NO: 723659 - DNA, 14 bp, Homo sapiens
tttatttcaatgta

SEQ ID NO: 723660 - DNA, 11 bp, Homo sapiens
tttatttcact

SEQ ID NO: 723661 - DNA, 12 bp, Homo sapiens
tttatttcatga

SEQ ID NO: 723662 - DNA, 20 bp, Homo sapiens
tttatttcatttttcaatag

SEQ ID NO: 723663 - DNA, 14 bp, Homo sapiens
tttatttccagagt

SEQ ID NO: 723664 - DNA, 14 bp, Homo sapiens
tttatttctactgt

SEQ ID NO: 723665 - DNA, 20 bp, Homo sapiens
tttatttcttcgtgaacata

SEQ ID NO: 723666 - DNA, 12 bp, Homo sapiens
tttatttgagaa

SEQ ID NO: 723667 - DNA, 15 bp, Homo sapiens
tttatttgagaattt

SEQ ID NO: 723668 - DNA, 19 bp, Homo sapiens
tttatttgtcgtgttggaa

SEQ ID NO: 723669 - DNA, 22 bp, Homo sapiens
tttcaatgtgttggaaactgta

SEQ ID NO: 723670 - DNA, 12 bp, Homo sapiens
tttcaattcaga

SEQ ID NO: 723671 - DNA, 22 bp, Homo sapiens
tttcaattcagattgtcttgca

SEQ ID NO: 723672 - DNA, 23 bp, Homo sapiens
tttcaattcagattgtcttgcaa

SEQ ID NO: 723673 - DNA, 14 bp, Homo sapiens
tttcaattctgtaa

SEQ ID NO: 723674 - DNA, 20 bp, Homo sapiens
tttcaattgcatctcccaga

SEQ ID NO: 723675 - DNA, 14 bp, Homo sapiens
tttcaattgtattt

SEQ ID NO: 723676 - DNA, 18 bp, Homo sapiens
tttcaattgtattttata

SEQ ID NO: 723677 - DNA, 22 bp, Homo sapiens
tttcaattgtattttatatgag

SEQ ID NO: 723678 - DNA, 13 bp, Homo sapiens
tttcacaacattt

SEQ ID NO: 723679 - DNA, 23 bp, Homo sapiens
tttcacacatctgggtgccctga

SEQ ID NO: 723680 - DNA, 14 bp, Homo sapiens
tttcacactgtctt

SEQ ID NO: 723681 - DNA, 17 bp, Homo sapiens
tttcacagaaaataagg

SEQ ID NO: 723682 - DNA, 22 bp, Homo sapiens
tttcacatagcccacttacatt

SEQ ID NO: 723683 - DNA, 16 bp, Homo sapiens
tttcacatagctgtct

SEQ ID NO: 723684 - DNA, 17 bp, Homo sapiens
tttcacattaggctgtt

SEQ ID NO: 723685 - DNA, 16 bp, Homo sapiens
tttcacattcttggct

SEQ ID NO: 723686 - DNA, 13 bp, Homo sapiens
tttcacattttcc

SEQ ID NO: 723687 - DNA, 19 bp, Homo sapiens
tttcaccaaaatttctaca

SEQ ID NO: 723688 - DNA, 17 bp, Homo sapiens
tttcaccctcatgaaaa

SEQ ID NO: 723689 - DNA, 17 bp, Homo sapiens
tttcacctactttgtaa

SEQ ID NO: 723690 - DNA, 18 bp, Homo sapiens
tttcacctggaagcattt

SEQ ID NO: 723691 - DNA, 13 bp, Homo sapiens
tttcacctgtaaa

SEQ ID NO: 723692 - DNA, 13 bp, Homo sapiens
tttcaccttccct

SEQ ID NO: 723693 - DNA, 18 bp, Homo sapiens
tttcaccttttcaggaaa

SEQ ID NO: 723694 - DNA, 21 bp, Homo sapiens
tttcaccttttcaggaaaata

SEQ ID NO: 723695 - DNA, 23 bp, Homo sapiens
tttcacgaactgttcacactgca

SEQ ID NO: 723696 - DNA, 20 bp, Homo sapiens
tttcacgcctgaggcaatta

SEQ ID NO: 723697 - DNA, 14 bp, Homo sapiens
tttcacggaaactc

SEQ ID NO: 723698 - DNA, 21 bp, Homo sapiens
tttcactagagacaaatcttt

SEQ ID NO: 723699 - DNA, 15 bp, Homo sapiens
tttcactaggaaaat

SEQ ID NO: 723700 - DNA, 15 bp, Homo sapiens
tttcactatttcctt

SEQ ID NO: 723701 - DNA, 15 bp, Homo sapiens
tttcactctaagtca

SEQ ID NO: 723702 - DNA, 22 bp, Homo sapiens
tttcactctaagtcatgtatgt

SEQ ID NO: 723703 - DNA, 22 bp, Homo sapiens
tttcactgagagctgcctcctg

SEQ ID NO: 723704 - DNA, 24 bp, Homo sapiens
tttcactgtagaatgatttcatgc

SEQ ID NO: 723705 - DNA, 20 bp, Homo sapiens
tttcacttcgggctgtgtaa

SEQ ID NO: 723706 - DNA, 20 bp, Homo sapiens
tttcacttgagcaagatgat

SEQ ID NO: 723707 - DNA, 21 bp, Homo sapiens
tttcatatctggtcaagttga

SEQ ID NO: 723708 - DNA, 22 bp, Homo sapiens
tttcatatgttgctcagtctcc

SEQ ID NO: 723709 - DNA, 12 bp, Homo sapiens
tttcatattgtg

SEQ ID NO: 723710 - DNA, 15 bp, Homo sapiens
tttcatattgtgcca

SEQ ID NO: 723711 - DNA, 15 bp, Homo sapiens
tttcatatttctacc

SEQ ID NO: 723712 - DNA, 16 bp, Homo sapiens
tttcatcatattatac

SEQ ID NO: 723713 - DNA, 14 bp, Homo sapiens
tttcatcatttcag

SEQ ID NO: 723714 - DNA, 21 bp, Homo sapiens
tttcatccactagtgcaaatc

SEQ ID NO: 723715 - DNA, 21 bp, Homo sapiens
tttcatccagtttgttctccg

SEQ ID NO: 723716 - DNA, 22 bp, Homo sapiens
tttcatcccatactcaaaatac

SEQ ID NO: 723717 - DNA, 19 bp, Homo sapiens
tttcatcccgtatcacagt

SEQ ID NO: 723718 - DNA, 21 bp, Homo sapiens
tttcatcccgtatcacagtgt

SEQ ID NO: 723719 - DNA, 23 bp, Homo sapiens
tttcatccctatgggattcagtg

SEQ ID NO: 723720 - DNA, 13 bp, Homo sapiens
tttcatccgtgtg

SEQ ID NO: 723721 - DNA, 14 bp, Homo sapiens
tttcatcctggcct

SEQ ID NO: 723722 - DNA, 13 bp, Homo sapiens
tttcatcctgtgt

SEQ ID NO: 723723 - DNA, 17 bp, Homo sapiens
tttcatccttttttctc

SEQ ID NO: 723724 - DNA, 20 bp, Homo sapiens
tttcatccttttttctcttc

SEQ ID NO: 723725 - DNA, 16 bp, Homo sapiens
tttcatcggtgcctgg

SEQ ID NO: 723726 - DNA, 18 bp, Homo sapiens
tttcatctatttctgaga

SEQ ID NO: 723727 - DNA, 12 bp, Homo sapiens
tttcatctcatt

SEQ ID NO: 723728 - DNA, 16 bp, Homo sapiens
tttcatctcttgtata

SEQ ID NO: 723729 - DNA, 19 bp, Homo sapiens
tttcatctgggaaagacat

SEQ ID NO: 723730 - DNA, 14 bp, Homo sapiens
tttcatctgttgtt

SEQ ID NO: 723731 - DNA, 16 bp, Homo sapiens
tttcatcttcagttgt

SEQ ID NO: 723732 - DNA, 15 bp, Homo sapiens
tttcatcttctggaa

SEQ ID NO: 723733 - DNA, 21 bp, Homo sapiens
tttcatcttctggaatattgt

SEQ ID NO: 723734 - DNA, 15 bp, Homo sapiens
tttcatcttttgaag

SEQ ID NO: 723735 - DNA, 20 bp, Homo sapiens
tttcatgaacgttattatat

SEQ ID NO: 723736 - DNA, 16 bp, Homo sapiens
tttcatgaatgtgctg

SEQ ID NO: 723737 - DNA, 22 bp, Homo sapiens
tttcatgataatgaacagaaca

SEQ ID NO: 723738 - DNA, 19 bp, Homo sapiens
tttcatgattggcttaaag

SEQ ID NO: 723739 - DNA, 21 bp, Homo sapiens
tttcatggtgaaaatgtactg

SEQ ID NO: 723740 - DNA, 14 bp, Homo sapiens
tttcatgtaaaaca

SEQ ID NO: 723741 - DNA, 19 bp, Homo sapiens
tttcatgtaaactgtgcac

SEQ ID NO: 723742 - DNA, 13 bp, Homo sapiens
tttcatgtagaac

SEQ ID NO: 723743 - DNA, 14 bp, Homo sapiens
tttcatgtatgtat

SEQ ID NO: 723744 - DNA, 15 bp, Homo sapiens
tttcatgtccataaa

SEQ ID NO: 723745 - DNA, 13 bp, Homo sapiens
tttcatgtcttgt

SEQ ID NO: 723746 - DNA, 17 bp, Homo sapiens
tttcatgtctttccact

SEQ ID NO: 723747 - DNA, 19 bp, Homo sapiens
tttcatgtgtgtgagtttg

SEQ ID NO: 723748 - DNA, 17 bp, Homo sapiens
tttcatgttcactgtga

SEQ ID NO: 723749 - DNA, 23 bp, Homo sapiens
tttcatgttggtttattttcaca

SEQ ID NO: 723750 - DNA, 17 bp, Homo sapiens
tttcatgttttgtgact

SEQ ID NO: 723751 - DNA, 18 bp, Homo sapiens
tttcatgttttgtgacta

SEQ ID NO: 723752 - DNA, 17 bp, Homo sapiens
tttcattaaataaattt

SEQ ID NO: 723753 - DNA, 19 bp, Homo sapiens
tttcattaaataaatttga

SEQ ID NO: 723754 - DNA, 20 bp, Homo sapiens
tttcattaggcaaagtacaa

SEQ ID NO: 723755 - DNA, 15 bp, Homo sapiens
tttcattatgttcat

SEQ ID NO: 723756 - DNA, 15 bp, Homo sapiens
tttcattattctcca

SEQ ID NO: 723757 - DNA, 14 bp, Homo sapiens
tttcattcaaatca

SEQ ID NO: 723758 - DNA, 18 bp, Homo sapiens
tttcattcaaatcagtga

SEQ ID NO: 723759 - DNA, 11 bp, Homo sapiens
tttcattccat

SEQ ID NO: 723760 - DNA, 13 bp, Homo sapiens
tttcattccttca

SEQ ID NO: 723761 - DNA, 15 bp, Homo sapiens
tttcattctcagaat

SEQ ID NO: 723762 - DNA, 15 bp, Homo sapiens
tttcattctcctgcc

SEQ ID NO: 723763 - DNA, 19 bp, Homo sapiens
tttcattgattatatgggt

SEQ ID NO: 723764 - DNA, 16 bp, Homo sapiens
tttcattgctaagact

SEQ ID NO: 723765 - DNA, 18 bp, Homo sapiens
tttcattgtatgatgtgt

SEQ ID NO: 723766 - DNA, 17 bp, Homo sapiens
tttcattgtgatttata

SEQ ID NO: 723767 - DNA, 20 bp, Homo sapiens
tttcattgtgatttatatat

SEQ ID NO: 723768 - DNA, 14 bp, Homo sapiens
tttcatttatctat

SEQ ID NO: 723769 - DNA, 19 bp, Homo sapiens
tttcatttggttcattaat

SEQ ID NO: 723770 - DNA, 15 bp, Homo sapiens
tttcatttgtacaag

SEQ ID NO: 723771 - DNA, 20 bp, Homo sapiens
tttcatttgtacaaggtaat

SEQ ID NO: 723772 - DNA, 14 bp, Homo sapiens
tttcattttaaaaa

SEQ ID NO: 723773 - DNA, 16 bp, Homo sapiens
tttcattttaacatga

SEQ ID NO: 723774 - DNA, 16 bp, Homo sapiens
tttcattttgcagaag

SEQ ID NO: 723775 - DNA, 23 bp, Homo sapiens
tttcattttgcagaaggaaatga

SEQ ID NO: 723776 - DNA, 22 bp, Homo sapiens
tttcattttgtaacaaatgaac

SEQ ID NO: 723777 - DNA, 17 bp, Homo sapiens
tttcatttttaaatgtg

SEQ ID NO: 723778 - DNA, 21 bp, Homo sapiens
tttccaaaacatttctggaca

SEQ ID NO: 723779 - DNA, 19 bp, Homo sapiens
tttccaaaatctcccattt

SEQ ID NO: 723780 - DNA, 14 bp, Homo sapiens
tttccaaaggcatt

SEQ ID NO: 723781 - DNA, 13 bp, Homo sapiens
tttccaaattaaa

SEQ ID NO: 723782 - DNA, 14 bp, Homo sapiens
tttccaaattaaaa

SEQ ID NO: 723783 - DNA, 17 bp, Homo sapiens
tttccaaattaaaacaa

SEQ ID NO: 723784 - DNA, 17 bp, Homo sapiens
tttccaaattattaatt

SEQ ID NO: 723785 - DNA, 13 bp, Homo sapiens
tttccaaattgcc

SEQ ID NO: 723786 - DNA, 12 bp, Homo sapiens
tttccaacagca

SEQ ID NO: 723787 - DNA, 14 bp, Homo sapiens
tttccaacttgtct

SEQ ID NO: 723788 - DNA, 15 bp, Homo sapiens
tttccaatagaaaga

SEQ ID NO: 723789 - DNA, 18 bp, Homo sapiens
tttccaatcacagtgtta

SEQ ID NO: 723790 - DNA, 17 bp, Homo sapiens
tttccaatgttttattg

SEQ ID NO: 723791 - DNA, 16 bp, Homo sapiens
tttccaattatttgac

SEQ ID NO: 723792 - DNA, 22 bp, Homo sapiens
tttccacaagattcccagagac

SEQ ID NO: 723793 - DNA, 13 bp, Homo sapiens
tttccacaattct

SEQ ID NO: 723794 - DNA, 17 bp, Homo sapiens
tttccacatttgtcaca

SEQ ID NO: 723795 - DNA, 22 bp, Homo sapiens
tttccaccaagtgtctagagtc

SEQ ID NO: 723796 - DNA, 19 bp, Homo sapiens
tttccaccacagccagcac

SEQ ID NO: 723797 - DNA, 22 bp, Homo sapiens
tttccaccccctccctggcctg

SEQ ID NO: 723798 - DNA, 19 bp, Homo sapiens
tttccacgatgaaaaactt

SEQ ID NO: 723799 - DNA, 19 bp, Homo sapiens
tttccacggaaacagaact

SEQ ID NO: 723800 - DNA, 20 bp, Homo sapiens
tttccacggaaacagaactc

SEQ ID NO: 723801 - DNA, 23 bp, Homo sapiens
tttccacggagccactcctctga

SEQ ID NO: 723802 - DNA, 14 bp, Homo sapiens
tttccactattttc

SEQ ID NO: 723803 - DNA, 18 bp, Homo sapiens
tttccactgaacaaaacc

SEQ ID NO: 723804 - DNA, 21 bp, Homo sapiens
tttccactggcttttgcctgt

SEQ ID NO: 723805 - DNA, 16 bp, Homo sapiens
tttccacttctctggg

SEQ ID NO: 723806 - DNA, 20 bp, Homo sapiens
tttccacttgccctgttctc

SEQ ID NO: 723807 - DNA, 21 bp, Homo sapiens
tttccagaaatacctgtctag

SEQ ID NO: 723808 - DNA, 18 bp, Homo sapiens
tttccagacttccttgag

SEQ ID NO: 723809 - DNA, 21 bp, Homo sapiens
tttccagagtccggaggcagc

SEQ ID NO: 723810 - DNA, 22 bp, Homo sapiens
tttccaggaaaaaataaaaaga

SEQ ID NO: 723811 - DNA, 18 bp, Homo sapiens
tttccaggactctttgaa

SEQ ID NO: 723812 - DNA, 17 bp, Homo sapiens
tttccaggagacatata

SEQ ID NO: 723813 - DNA, 18 bp, Homo sapiens
tttccaggatcctgcagg

SEQ ID NO: 723814 - DNA, 19 bp, Homo sapiens
tttccaggatcctgcagga

SEQ ID NO: 723815 - DNA, 18 bp, Homo sapiens
tttccaggcaccctcagg

SEQ ID NO: 723816 - DNA, 21 bp, Homo sapiens
tttccagtaaggaatgatatt

SEQ ID NO: 723817 - DNA, 20 bp, Homo sapiens
tttccagtattgaaaacttc

SEQ ID NO: 723818 - DNA, 14 bp, Homo sapiens
tttccagtctcttg

SEQ ID NO: 723819 - DNA, 18 bp, Homo sapiens
tttccagtgagtgtaaat

SEQ ID NO: 723820 - DNA, 19 bp, Homo sapiens
tttccatagcaacaggaaa

SEQ ID NO: 723821 - DNA, 14 bp, Homo sapiens
tttccatcatgtct

SEQ ID NO: 723822 - DNA, 17 bp, Homo sapiens
tttccatcatgtctgta

SEQ ID NO: 723823 - DNA, 18 bp, Homo sapiens
tttccatcttaatgttac

SEQ ID NO: 723824 - DNA, 12 bp, Homo sapiens
tttccatcttta

SEQ ID NO: 723825 - DNA, 16 bp, Homo sapiens
tttccatgaaaacgtt

SEQ ID NO: 723826 - DNA, 17 bp, Homo sapiens
tttccatgaagtttgaa

SEQ ID NO: 723827 - DNA, 20 bp, Homo sapiens
tttccatgactgcattttac

SEQ ID NO: 723828 - DNA, 23 bp, Homo sapiens
tttccatgcaccctcatacacag

SEQ ID NO: 723829 - DNA, 18 bp, Homo sapiens
tttccatggcaaatgggc

SEQ ID NO: 723830 - DNA, 17 bp, Homo sapiens
tttccatgttgctgcca

SEQ ID NO: 723831 - DNA, 20 bp, Homo sapiens
tttccattaaatcaatcagg

SEQ ID NO: 723832 - DNA, 19 bp, Homo sapiens
tttcgagtaaacttgaaaa

SEQ ID NO: 723833 - DNA, 20 bp, Homo sapiens
tttcgataaacaacaaggtg

SEQ ID NO: 723834 - DNA, 13 bp, Homo sapiens
tttcggaaaaaaa

SEQ ID NO: 723835 - DNA, 21 bp, Homo sapiens
tttcggaaaaaaaaaaagaaa

SEQ ID NO: 723836 - DNA, 18 bp, Homo sapiens
tttcgttaacattgacca

SEQ ID NO: 723837 - DNA, 14 bp, Homo sapiens
tttctaaaaaacag

SEQ ID NO: 723838 - DNA, 17 bp, Homo sapiens
tttctaaaaagctatgt

SEQ ID NO: 723839 - DNA, 15 bp, Homo sapiens
tttctaaaaagtcag

SEQ ID NO: 723840 - DNA, 16 bp, Homo sapiens
tttctaaaactgcctt

SEQ ID NO: 723841 - DNA, 17 bp, Homo sapiens
tttctaaacaagatttt

SEQ ID NO: 723842 - DNA, 12 bp, Homo sapiens
tttctaaagact

SEQ ID NO: 723843 - DNA, 23 bp, Homo sapiens
tttctaaagtaaaattgaagcaa

SEQ ID NO: 723844 - DNA, 17 bp, Homo sapiens
tttctaaagtgttggtc

SEQ ID NO: 723845 - DNA, 20 bp, Homo sapiens
tttctaaataaaaatatgta

SEQ ID NO: 723846 - DNA, 21 bp, Homo sapiens
tttctaaataaaaatatgtaa

SEQ ID NO: 723847 - DNA, 21 bp, Homo sapiens
tttctaaatgttggaatgtta

SEQ ID NO: 723848 - DNA, 13 bp, Homo sapiens
tttctaaatgttt

SEQ ID NO: 723849 - DNA, 19 bp, Homo sapiens
tttctaacaattttcagac

SEQ ID NO: 723850 - DNA, 13 bp, Homo sapiens
tttctaacatatg

SEQ ID NO: 723851 - DNA, 21 bp, Homo sapiens
tttctaacatatgtattaagc

SEQ ID NO: 723852 - DNA, 20 bp, Homo sapiens
tttctaaccaagaggctggt

SEQ ID NO: 723853 - DNA, 19 bp, Homo sapiens
tttctaaccttgaatgctg

SEQ ID NO: 723854 - DNA, 20 bp, Homo sapiens
tttctaaccttgaatgctgc

SEQ ID NO: 723855 - DNA, 19 bp, Homo sapiens
tttctaagaagttactttt

SEQ ID NO: 723856 - DNA, 22 bp, Homo sapiens
tttctaagaagttactttttgt

SEQ ID NO: 723857 - DNA, 18 bp, Homo sapiens
tttctaagtggcgtgtgc

SEQ ID NO: 723858 - DNA, 20 bp, Homo sapiens
tttctaagtgtaacctcagt

SEQ ID NO: 723859 - DNA, 18 bp, Homo sapiens
tttctaagtgttcgtctt

SEQ ID NO: 723860 - DNA, 21 bp, Homo sapiens
tttctaataaacttggattct

SEQ ID NO: 723861 - DNA, 20 bp, Homo sapiens
tttctaatggaatggtttgg

SEQ ID NO: 723862 - DNA, 13 bp, Homo sapiens
tttctaatgtggt

SEQ ID NO: 723863 - DNA, 21 bp, Homo sapiens
tttctacaatgtgaactttat

SEQ ID NO: 723864 - DNA, 22 bp, Homo sapiens
tttctacagaaataacagctgg

SEQ ID NO: 723865 - DNA, 12 bp, Homo sapiens
tttctacagaga

SEQ ID NO: 723866 - DNA, 21 bp, Homo sapiens
tttctacccaacggccctgca

SEQ ID NO: 723867 - DNA, 18 bp, Homo sapiens
tttctacctcttttttct

SEQ ID NO: 723868 - DNA, 16 bp, Homo sapiens
tttctacgtcatgtat

SEQ ID NO: 723869 - DNA, 23 bp, Homo sapiens
tttctactatatacatatatatt

SEQ ID NO: 723870 - DNA, 15 bp, Homo sapiens
tttctactctgaact

SEQ ID NO: 723871 - DNA, 20 bp, Homo sapiens
tttctactgtcaaatgatgt

SEQ ID NO: 723872 - DNA, 22 bp, Homo sapiens
tttctagacagtattgccacct

SEQ ID NO: 723873 - DNA, 13 bp, Homo sapiens
tttctagactcaa

SEQ ID NO: 723874 - DNA, 16 bp, Homo sapiens
tttctagacttgtgct

SEQ ID NO: 723875 - DNA, 15 bp, Homo sapiens
tttctagactttctg

SEQ ID NO: 723876 - DNA, 16 bp, Homo sapiens
tttctagccataataa

SEQ ID NO: 723877 - DNA, 18 bp, Homo sapiens
tttctagcccctctggat

SEQ ID NO: 723878 - DNA, 12 bp, Homo sapiens
tttctagcctta

SEQ ID NO: 723879 - DNA, 13 bp, Homo sapiens
tttctagccttag

SEQ ID NO: 723880 - DNA, 20 bp, Homo sapiens
tttctagctagaaatatgat

SEQ ID NO: 723881 - DNA, 14 bp, Homo sapiens
tttctagtgtcact

SEQ ID NO: 723882 - DNA, 14 bp, Homo sapiens
tttctataaatcag

SEQ ID NO: 723883 - DNA, 16 bp, Homo sapiens
tttctataaatcagta

SEQ ID NO: 723884 - DNA, 12 bp, Homo sapiens
tttctataaatt

SEQ ID NO: 723885 - DNA, 16 bp, Homo sapiens
tttctatatagttcct

SEQ ID NO: 723886 - DNA, 13 bp, Homo sapiens
tttctatatcaaa

SEQ ID NO: 723887 - DNA, 14 bp, Homo sapiens
tttctatcacatat

SEQ ID NO: 723888 - DNA, 14 bp, Homo sapiens
tttctatccccctt

SEQ ID NO: 723889 - DNA, 17 bp, Homo sapiens
tttctatcgttctctct

SEQ ID NO: 723890 - DNA, 15 bp, Homo sapiens
tttctatgacacatg

SEQ ID NO: 723891 - DNA, 21 bp, Homo sapiens
tttctatgacacatgcaaggt

SEQ ID NO: 723892 - DNA, 14 bp, Homo sapiens
tttctatgtaaatt

SEQ ID NO: 723893 - DNA, 17 bp, Homo sapiens
tttctatgtcattttta

SEQ ID NO: 723894 - DNA, 22 bp, Homo sapiens
tttctatgtcatttttaatgta

SEQ ID NO: 723895 - DNA, 22 bp, Homo sapiens
tttctattaatatcaactctga

SEQ ID NO: 723896 - DNA, 20 bp, Homo sapiens
tttctattatggaaaactgt

SEQ ID NO: 723897 - DNA, 14 bp, Homo sapiens
tttctattccaaag

SEQ ID NO: 723898 - DNA, 14 bp, Homo sapiens
tttctattgttact

SEQ ID NO: 723899 - DNA, 13 bp, Homo sapiens
tttctatttcata

SEQ ID NO: 723900 - DNA, 14 bp, Homo sapiens
tttctatttcataa

SEQ ID NO: 723901 - DNA, 15 bp, Homo sapiens
tttctatttttatct

SEQ ID NO: 723902 - DNA, 14 bp, Homo sapiens
tttctatttttgat

SEQ ID NO: 723903 - DNA, 13 bp, Homo sapiens
tttctcaatgtct

SEQ ID NO: 723904 - DNA, 23 bp, Homo sapiens
tttctcacaaaaaggcaaatatt

SEQ ID NO: 723905 - DNA, 21 bp, Homo sapiens
tttctcagggtcactgtcctt

SEQ ID NO: 723906 - DNA, 16 bp, Homo sapiens
tttctcagttttcata

SEQ ID NO: 723907 - DNA, 17 bp, Homo sapiens
tttctcataaaactgtg

SEQ ID NO: 723908 - DNA, 12 bp, Homo sapiens
tttctcatactt

SEQ ID NO: 723909 - DNA, 15 bp, Homo sapiens
tttctcatatttgag

SEQ ID NO: 723910 - DNA, 17 bp, Homo sapiens
tttctcatgcttcttct

SEQ ID NO: 723911 - DNA, 13 bp, Homo sapiens
tttctcattaaac

SEQ ID NO: 723912 - DNA, 15 bp, Homo sapiens
tttctcattgcctct

SEQ ID NO: 723913 - DNA, 21 bp, Homo sapiens
tttctccaagagctacataat

SEQ ID NO: 723914 - DNA, 23 bp, Homo sapiens
tttctccatattagatttaccca

SEQ ID NO: 723915 - DNA, 23 bp, Homo sapiens
tttctccatcccctccctgcctg

SEQ ID NO: 723916 - DNA, 14 bp, Homo sapiens
tttctccatcttta

SEQ ID NO: 723917 - DNA, 10 bp, Homo sapiens
tttctccatg

SEQ ID NO: 723918 - DNA, 23 bp, Homo sapiens
tttctccccacgatgatatctat

SEQ ID NO: 723919 - DNA, 23 bp, Homo sapiens
tttctccccatccccttcctaaa

SEQ ID NO: 723920 - DNA, 15 bp, Homo sapiens
tttctccccctgggc

SEQ ID NO: 723921 - DNA, 18 bp, Homo sapiens
tttctccggggtctgtgc

SEQ ID NO: 723922 - DNA, 15 bp, Homo sapiens
tttctcctcaggaca

SEQ ID NO: 723923 - DNA, 17 bp, Homo sapiens
tttctcctcatccattt

SEQ ID NO: 723924 - DNA, 16 bp, Homo sapiens
tttctcctccccacct

SEQ ID NO: 723925 - DNA, 20 bp, Homo sapiens
tttctcctccccacctgtag

SEQ ID NO: 723926 - DNA, 23 bp, Homo sapiens
tttctcctccccacctgtagctg

SEQ ID NO: 723927 - DNA, 13 bp, Homo sapiens
tttctcctctccc

SEQ ID NO: 723928 - DNA, 20 bp, Homo sapiens
tttctcctctgctatgcatt

SEQ ID NO: 723929 - DNA, 14 bp, Homo sapiens
tttctcctgtgccc

SEQ ID NO: 723930 - DNA, 14 bp, Homo sapiens
tttctccttgaaat

SEQ ID NO: 723931 - DNA, 11 bp, Homo sapiens
tttctccttgg

SEQ ID NO: 723932 - DNA, 18 bp, Homo sapiens
tttctcctttaattgtaa

SEQ ID NO: 723933 - DNA, 22 bp, Homo sapiens
tttctcctttaattgtaaagta

SEQ ID NO: 723934 - DNA, 14 bp, Homo sapiens
tttctcctttacca

SEQ ID NO: 723935 - DNA, 23 bp, Homo sapiens
tttctcgggtgcatttgagagaa

SEQ ID NO: 723936 - DNA, 15 bp, Homo sapiens
tttctcgttccagaa

SEQ ID NO: 723937 - DNA, 21 bp, Homo sapiens
tttctctaataataaatagtt

SEQ ID NO: 723938 - DNA, 15 bp, Homo sapiens
tttctctacactaag

SEQ ID NO: 723939 - DNA, 15 bp, Homo sapiens
tttcttaaatgggct

SEQ ID NO: 723940 - DNA, 15 bp, Homo sapiens
tttcttaaattattt

SEQ ID NO: 723941 - DNA, 23 bp, Homo sapiens
tttcttaacccctaagactgcct

SEQ ID NO: 723942 - DNA, 17 bp, Homo sapiens
tttcttaaggaattttg

SEQ ID NO: 723943 - DNA, 20 bp, Homo sapiens
tttcttaaggaattttgtct

SEQ ID NO: 723944 - DNA, 14 bp, Homo sapiens
tttcttaattttgt

SEQ ID NO: 723945 - DNA, 19 bp, Homo sapiens
tttcttacacacccccaga

SEQ ID NO: 723946 - DNA, 13 bp, Homo sapiens
tttcttaccaaaa

SEQ ID NO: 723947 - DNA, 18 bp, Homo sapiens
tttcttagggaaggatac

SEQ ID NO: 723948 - DNA, 23 bp, Homo sapiens
tttcttagggaaggatacaaaag

SEQ ID NO: 723949 - DNA, 19 bp, Homo sapiens
tttcttataatactctgtt

SEQ ID NO: 723950 - DNA, 13 bp, Homo sapiens
tttcttatgattt

SEQ ID NO: 723951 - DNA, 23 bp, Homo sapiens
tttcttatgatttttaaaagttg

SEQ ID NO: 723952 - DNA, 13 bp, Homo sapiens
tttcttattgcgc

SEQ ID NO: 723953 - DNA, 21 bp, Homo sapiens
tttcttcaacatcaatgttca

SEQ ID NO: 723954 - DNA, 15 bp, Homo sapiens
tttcttcagggctgc

SEQ ID NO: 723955 - DNA, 13 bp, Homo sapiens
tttcttcatccaa

SEQ ID NO: 723956 - DNA, 22 bp, Homo sapiens
tttcttcatctttgccatatgg

SEQ ID NO: 723957 - DNA, 19 bp, Homo sapiens
tttcttcatgcaatgacat

SEQ ID NO: 723958 - DNA, 17 bp, Homo sapiens
tttcttcccgcacaaat

SEQ ID NO: 723959 - DNA, 18 bp, Homo sapiens
tttcttccctgtattttc

SEQ ID NO: 723960 - DNA, 17 bp, Homo sapiens
tttcttcctaccaagtc

SEQ ID NO: 723961 - DNA, 22 bp, Homo sapiens
tttcttcctaccaagtcaaact

SEQ ID NO: 723962 - DNA, 14 bp, Homo sapiens
tttcttcctcttct

SEQ ID NO: 723963 - DNA, 13 bp, Homo sapiens
tttcttcgctgct

SEQ ID NO: 723964 - DNA, 16 bp, Homo sapiens
tttcttctagtatttt

SEQ ID NO: 723965 - DNA, 12 bp, Homo sapiens
tttcttctattt

SEQ ID NO: 723966 - DNA, 20 bp, Homo sapiens
tttcttctctctgttccctt

SEQ ID NO: 723967 - DNA, 17 bp, Homo sapiens
tttcttctctgtgaagt

SEQ ID NO: 723968 - DNA, 23 bp, Homo sapiens
tttcttctgtatttttttttcta

SEQ ID NO: 723969 - DNA, 17 bp, Homo sapiens
tttcttcttctaagaag

SEQ ID NO: 723970 - DNA, 13 bp, Homo sapiens
tttcttctttcct

SEQ ID NO: 723971 - DNA, 15 bp, Homo sapiens
tttcttcttttcctt

SEQ ID NO: 723972 - DNA, 17 bp, Homo sapiens
tttcttcttttttaagt

SEQ ID NO: 723973 - DNA, 20 bp, Homo sapiens
tttcttgacaaaacctaact

SEQ ID NO: 723974 - DNA, 23 bp, Homo sapiens
tttcttgacaagctgacttggca

SEQ ID NO: 723975 - DNA, 15 bp, Homo sapiens
tttcttgatcttaaa

SEQ ID NO: 723976 - DNA, 13 bp, Homo sapiens
tttcttgcactga

SEQ ID NO: 723977 - DNA, 15 bp, Homo sapiens
tttcttgcagattct

SEQ ID NO: 723978 - DNA, 23 bp, Homo sapiens
tttcttgccaatgaggtctgaaa

SEQ ID NO: 723979 - DNA, 18 bp, Homo sapiens
tttcttgccaccctctgg

SEQ ID NO: 723980 - DNA, 16 bp, Homo sapiens
tttcttgccccagtgt

SEQ ID NO: 723981 - DNA, 22 bp, Homo sapiens
tttcttgccttaaccagtctct

SEQ ID NO: 723982 - DNA, 20 bp, Homo sapiens
tttcttgctctctctccctg

SEQ ID NO: 723983 - DNA, 13 bp, Homo sapiens
tttcttggcaaat

SEQ ID NO: 723984 - DNA, 22 bp, Homo sapiens
tttcttggggtactcttgatgt

SEQ ID NO: 723985 - DNA, 14 bp, Homo sapiens
tttcttgtaaatgt

SEQ ID NO: 723986 - DNA, 19 bp, Homo sapiens
tttcttgtaaatgtttctt

SEQ ID NO: 723987 - DNA, 19 bp, Homo sapiens
tttcttgtaatttaaacag

SEQ ID NO: 723988 - DNA, 20 bp, Homo sapiens
tttcttgtctataaagcatt

SEQ ID NO: 723989 - DNA, 15 bp, Homo sapiens
tttcttgtgtagatt

SEQ ID NO: 723990 - DNA, 12 bp, Homo sapiens
tttctttaactg

SEQ ID NO: 723991 - DNA, 16 bp, Homo sapiens
tttctttaagaaagta

SEQ ID NO: 723992 - DNA, 15 bp, Homo sapiens
tttctttaatatgat

SEQ ID NO: 723993 - DNA, 18 bp, Homo sapiens
tttctttaatgcttttat

SEQ ID NO: 723994 - DNA, 14 bp, Homo sapiens
tttctttattagct

SEQ ID NO: 723995 - DNA, 15 bp, Homo sapiens
tttctttcacaaaaa

SEQ ID NO: 723996 - DNA, 16 bp, Homo sapiens
tttctttcacaaaaaa

SEQ ID NO: 723997 - DNA, 14 bp, Homo sapiens
tttctttccaaaac

SEQ ID NO: 723998 - DNA, 20 bp, Homo sapiens
tttctttccaaaacatttct

SEQ ID NO: 723999 - DNA, 13 bp, Homo sapiens
tttctttctaact

SEQ ID NO: 724000 - DNA, 16 bp, Homo sapiens
tttctttcttagtcca

SEQ ID NO: 724001 - DNA, 13 bp, Homo sapiens
tttctttcttcct

SEQ ID NO: 724002 - DNA, 12 bp, Homo sapiens
tttctttgagga

SEQ ID NO: 724003 - DNA, 14 bp, Homo sapiens
tttctttgtttctt

SEQ ID NO: 724004 - DNA, 13 bp, Homo sapiens
tttcttttaagca

SEQ ID NO: 724005 - DNA, 21 bp, Homo sapiens
tttcttttaagcatttgtata

SEQ ID NO: 724006 - DNA, 22 bp, Homo sapiens
tttcttttaagcatttgtatat

SEQ ID NO: 724007 - DNA, 17 bp, Homo sapiens
tttcttttacagactag

SEQ ID NO: 724008 - DNA, 15 bp, Homo sapiens
tttcttttattatca

SEQ ID NO: 724009 - DNA, 9 bp, Homo sapiens
tttcttttc

SEQ ID NO: 724010 - DNA, 14 bp, Homo sapiens
tttcttttcacata

SEQ ID NO: 724011 - DNA, 22 bp, Homo sapiens
tttcttttccttcattcatagg

SEQ ID NO: 724012 - DNA, 21 bp, Homo sapiens
tttcttttctaccctagccat

SEQ ID NO: 724013 - DNA, 23 bp, Homo sapiens
tttcttttggtaaagactggctt

SEQ ID NO: 724014 - DNA, 16 bp, Homo sapiens
tttcttttgtaattgt

SEQ ID NO: 724015 - DNA, 17 bp, Homo sapiens
tttcttttttaaaatca

SEQ ID NO: 724016 - DNA, 21 bp, Homo sapiens
tttcttttttaaagtaaactt

SEQ ID NO: 724017 - DNA, 18 bp, Homo sapiens
tttcttttttaaattaat

SEQ ID NO: 724018 - DNA, 15 bp, Homo sapiens
tttcttttttatgtg

SEQ ID NO: 724019 - DNA, 18 bp, Homo sapiens
tttctttttttctttaat

SEQ ID NO: 724020 - DNA, 19 bp, Homo sapiens
tttctttttttggtaaatt

SEQ ID NO: 724021 - DNA, 16 bp, Homo sapiens
tttgaaaaaaaataaa

SEQ ID NO: 724022 - DNA, 15 bp, Homo sapiens
tttgaaaaagagaac

SEQ ID NO: 724023 - DNA, 23 bp, Homo sapiens
tttgaaaaagcgaaaaaatcagg

SEQ ID NO: 724024 - DNA, 19 bp, Homo sapiens
tttgaaaacaattcagtgg

SEQ ID NO: 724025 - DNA, 13 bp, Homo sapiens
tttgaaaagcaga

SEQ ID NO: 724026 - DNA, 18 bp, Homo sapiens
tttgaaaagcagacattt

SEQ ID NO: 724027 - DNA, 13 bp, Homo sapiens
tttgaaaagctga

SEQ ID NO: 724028 - DNA, 22 bp, Homo sapiens
tttgaaaaggtctaagcaagtg

SEQ ID NO: 724029 - DNA, 17 bp, Homo sapiens
tttgaaaagttggaagg

SEQ ID NO: 724030 - DNA, 15 bp, Homo sapiens
tttgaaaatgctctt

SEQ ID NO: 724031 - DNA, 13 bp, Homo sapiens
tttgaaaattaca

SEQ ID NO: 724032 - DNA, 15 bp, Homo sapiens
tttgaaaattatgca

SEQ ID NO: 724033 - DNA, 15 bp, Homo sapiens
tttgaaacaaagtac

SEQ ID NO: 724034 - DNA, 17 bp, Homo sapiens
tttgaaactaaaataaa

SEQ ID NO: 724035 - DNA, 22 bp, Homo sapiens
tttgaaactaaaataaattaag

SEQ ID NO: 724036 - DNA, 20 bp, Homo sapiens
tttgaaagtcagctgaagga

SEQ ID NO: 724037 - DNA, 16 bp, Homo sapiens
tttgaaagtctgtcct

SEQ ID NO: 724038 - DNA, 19 bp, Homo sapiens
tttgaaagtctgtccttga

SEQ ID NO: 724039 - DNA, 19 bp, Homo sapiens
tttgaaatagtctgtgtga

SEQ ID NO: 724040 - DNA, 20 bp, Homo sapiens
tttgaaatagtctgtgtgaa

SEQ ID NO: 724041 - DNA, 20 bp, Homo sapiens
tttgaaatgacatgttcctt

SEQ ID NO: 724042 - DNA, 23 bp, Homo sapiens
tttgaaatgacatgttcctttaa

SEQ ID NO: 724043 - DNA, 21 bp, Homo sapiens
tttgaaatgtcgatcaagaga

SEQ ID NO: 724044 - DNA, 23 bp, Homo sapiens
tttgaaatgtggttttcctgaaa

SEQ ID NO: 724045 - DNA, 16 bp, Homo sapiens
tttgaaatgtgtttct

SEQ ID NO: 724046 - DNA, 19 bp, Homo sapiens
tttgaacacgaaagaaatg

SEQ ID NO: 724047 - DNA, 20 bp, Homo sapiens
tttgaacacgaaagaaatgt

SEQ ID NO: 724048 - DNA, 12 bp, Homo sapiens
tttgaacactgg

SEQ ID NO: 724049 - DNA, 14 bp, Homo sapiens
tttgaacactggct

SEQ ID NO: 724050 - DNA, 16 bp, Homo sapiens
tttgaaccaacatctt

SEQ ID NO: 724051 - DNA, 23 bp, Homo sapiens
tttgaacgcttaagtcatcatta

SEQ ID NO: 724052 - DNA, 17 bp, Homo sapiens
tttgaactgataaagat

SEQ ID NO: 724053 - DNA, 19 bp, Homo sapiens
tttgaactggtattgttta

SEQ ID NO: 724054 - DNA, 20 bp, Homo sapiens
tttgaactgttagatgctga

SEQ ID NO: 724055 - DNA, 18 bp, Homo sapiens
tttgaagaacatgtgaga

SEQ ID NO: 724056 - DNA, 18 bp, Homo sapiens
tttgaagacacagcctcc

SEQ ID NO: 724057 - DNA, 19 bp, Homo sapiens
tttgaagcacaactccctt

SEQ ID NO: 724058 - DNA, 16 bp, Homo sapiens
tttgaagctactgtgt

SEQ ID NO: 724059 - DNA, 23 bp, Homo sapiens
tttgaaggaaatgagtggccagc

SEQ ID NO: 724060 - DNA, 13 bp, Homo sapiens
tttgaaggcaaaa

SEQ ID NO: 724061 - DNA, 21 bp, Homo sapiens
tttgaagtgtaggcagacaca

SEQ ID NO: 724062 - DNA, 14 bp, Homo sapiens
tttgaataaaaagt

SEQ ID NO: 724063 - DNA, 17 bp, Homo sapiens
tttgaataaaaagtgaa

SEQ ID NO: 724064 - DNA, 23 bp, Homo sapiens
tttgaataccattaaaactgctt

SEQ ID NO: 724065 - DNA, 17 bp, Homo sapiens
tttgaatatttgtttta

SEQ ID NO: 724066 - DNA, 21 bp, Homo sapiens
tttgaatattttttgaaggtt

SEQ ID NO: 724067 - DNA, 19 bp, Homo sapiens
tttgaatcaataatatatt

SEQ ID NO: 724068 - DNA, 22 bp, Homo sapiens
tttgaatccaaatctgtcctct

SEQ ID NO: 724069 - DNA, 19 bp, Homo sapiens
tttgaatctgagtgaattg

SEQ ID NO: 724070 - DNA, 15 bp, Homo sapiens
tttgaatgaaaaatt

SEQ ID NO: 724071 - DNA, 17 bp, Homo sapiens
tttgaatgatttttctt

SEQ ID NO: 724072 - DNA, 22 bp, Homo sapiens
tttgaatgatttttctttacaa

SEQ ID NO: 724073 - DNA, 15 bp, Homo sapiens
tttgaatgcaaaaga

SEQ ID NO: 724074 - DNA, 11 bp, Homo sapiens
tttgaatgtgg

SEQ ID NO: 724075 - DNA, 16 bp, Homo sapiens
tttgaatgttaatttt

SEQ ID NO: 724076 - DNA, 20 bp, Homo sapiens
tttgaattagattatttctg

SEQ ID NO: 724077 - DNA, 16 bp, Homo sapiens
tttgaattctgtgata

SEQ ID NO: 724078 - DNA, 14 bp, Homo sapiens
tttgaattgttaca

SEQ ID NO: 724079 - DNA, 16 bp, Homo sapiens
tttgaatttaaataaa

SEQ ID NO: 724080 - DNA, 16 bp, Homo sapiens
tttgaatttttacatt

SEQ ID NO: 724081 - DNA, 14 bp, Homo sapiens
tttgacaaggggca

SEQ ID NO: 724082 - DNA, 22 bp, Homo sapiens
tttgacaatcaaagaaaagact

SEQ ID NO: 724083 - DNA, 16 bp, Homo sapiens
tttgacacaaagcttc

SEQ ID NO: 724084 - DNA, 22 bp, Homo sapiens
tttgacacttttaaaaaacaaa

SEQ ID NO: 724085 - DNA, 15 bp, Homo sapiens
tttgacactttttgt

SEQ ID NO: 724086 - DNA, 18 bp, Homo sapiens
tttgacagtgttgaaaat

SEQ ID NO: 724087 - DNA, 19 bp, Homo sapiens
tttgacagtgttgaaaatg

SEQ ID NO: 724088 - DNA, 15 bp, Homo sapiens
tttgacatgtgaagc

SEQ ID NO: 724089 - DNA, 13 bp, Homo sapiens
tttgacatgtgga

SEQ ID NO: 724090 - DNA, 19 bp, Homo sapiens
tttgaccagatctttctct

SEQ ID NO: 724091 - DNA, 14 bp, Homo sapiens
tttgacggatgatt

SEQ ID NO: 724092 - DNA, 17 bp, Homo sapiens
tttgactaaagctatgt

SEQ ID NO: 724093 - DNA, 19 bp, Homo sapiens
tttgactaacaagaatgta

SEQ ID NO: 724094 - DNA, 19 bp, Homo sapiens
tttgactagatgatggatg

SEQ ID NO: 724095 - DNA, 14 bp, Homo sapiens
tttgactcttccgt

SEQ ID NO: 724096 - DNA, 19 bp, Homo sapiens
tttgactctttcaaagaaa

SEQ ID NO: 724097 - DNA, 15 bp, Homo sapiens
tttgactgtcagcaa

SEQ ID NO: 724098 - DNA, 22 bp, Homo sapiens
tttgacttgaaccacaagtgaa

SEQ ID NO: 724099 - DNA, 13 bp, Homo sapiens
tttgacttttctg

SEQ ID NO: 724100 - DNA, 16 bp, Homo sapiens
tttgacttttctgtaa

SEQ ID NO: 724101 - DNA, 22 bp, Homo sapiens
tttgactttttttgtatgtgtg

SEQ ID NO: 724102 - DNA, 17 bp, Homo sapiens
tttgagaaaaaggaaaa

SEQ ID NO: 724103 - DNA, 14 bp, Homo sapiens
tttgagaaaaatag

SEQ ID NO: 724104 - DNA, 16 bp, Homo sapiens
tttgagaaaataaagc

SEQ ID NO: 724105 - DNA, 22 bp, Homo sapiens
tttgagaaaatataataaaaga

SEQ ID NO: 724106 - DNA, 23 bp, Homo sapiens
tttgagaaaatataataaaagaa

SEQ ID NO: 724107 - DNA, 15 bp, Homo sapiens
tttgagaatacataa

SEQ ID NO: 724108 - DNA, 14 bp, Homo sapiens
tttgagaattattc

SEQ ID NO: 724109 - DNA, 16 bp, Homo sapiens
tttgagacaagccctg

SEQ ID NO: 724110 - DNA, 18 bp, Homo sapiens
tttgagacaagccctggc

SEQ ID NO: 724111 - DNA, 13 bp, Homo sapiens
tttgagacaggag

SEQ ID NO: 724112 - DNA, 19 bp, Homo sapiens
tttgagaccagcctgggca

SEQ ID NO: 724113 - DNA, 17 bp, Homo sapiens
tttgagatactattttc

SEQ ID NO: 724114 - DNA, 16 bp, Homo sapiens
tttgagatcagcctgg

SEQ ID NO: 724115 - DNA, 17 bp, Homo sapiens
tttgagatcagcctggg

SEQ ID NO: 724116 - DNA, 20 bp, Homo sapiens
tttgagatggagtttctctc

SEQ ID NO: 724117 - DNA, 15 bp, Homo sapiens
tttgagcaattttcg

SEQ ID NO: 724118 - DNA, 18 bp, Homo sapiens
tttgagcctttattggta

SEQ ID NO: 724119 - DNA, 19 bp, Homo sapiens
tttgagcctttattggtaa

SEQ ID NO: 724120 - DNA, 19 bp, Homo sapiens
tttgagctattcacctcag

SEQ ID NO: 724121 - DNA, 21 bp, Homo sapiens
tttgaggaattatcatgggaa

SEQ ID NO: 724122 - DNA, 11 bp, Homo sapiens
tttgaggagac

SEQ ID NO: 724123 - DNA, 15 bp, Homo sapiens
tttgaggagagtgaa

SEQ ID NO: 724124 - DNA, 15 bp, Homo sapiens
tttgaggagccagcc

SEQ ID NO: 724125 - DNA, 19 bp, Homo sapiens
tttgaggcaaattaactgt

SEQ ID NO: 724126 - DNA, 20 bp, Homo sapiens
tttgaggcaaattaactgta

SEQ ID NO: 724127 - DNA, 15 bp, Homo sapiens
tttgaggctgcagcg

SEQ ID NO: 724128 - DNA, 18 bp, Homo sapiens
tttgagggcccagccagg

SEQ ID NO: 724129 - DNA, 18 bp, Homo sapiens
tttgaggggccaggggca

SEQ ID NO: 724130 - DNA, 23 bp, Homo sapiens
tttgaggtcaagtaagaagacat

SEQ ID NO: 724131 - DNA, 15 bp, Homo sapiens
tttgaggtctacatt

SEQ ID NO: 724132 - DNA, 16 bp, Homo sapiens
tttgaggtgaaattca

SEQ ID NO: 724133 - DNA, 17 bp, Homo sapiens
tttgaggtgaaattcag

SEQ ID NO: 724134 - DNA, 14 bp, Homo sapiens
tttgagtaaatatt

SEQ ID NO: 724135 - DNA, 23 bp, Homo sapiens
tttgagtaattcaagcctctaaa

SEQ ID NO: 724136 - DNA, 14 bp, Homo sapiens
tttgagtgctctga

SEQ ID NO: 724137 - DNA, 14 bp, Homo sapiens
tttgagtgtactgt

SEQ ID NO: 724138 - DNA, 17 bp, Homo sapiens
tttgagtgtatacatgt

SEQ ID NO: 724139 - DNA, 15 bp, Homo sapiens
tttgagtttgcctca

SEQ ID NO: 724140 - DNA, 20 bp, Homo sapiens
tttgataaaaatttagaaca

SEQ ID NO: 724141 - DNA, 19 bp, Homo sapiens
tttgataaagtaataatgt

SEQ ID NO: 724142 - DNA, 13 bp, Homo sapiens
tttgatacataat

SEQ ID NO: 724143 - DNA, 14 bp, Homo sapiens
tttgatacataata

SEQ ID NO: 724144 - DNA, 17 bp, Homo sapiens
tttgatacataataaaa

SEQ ID NO: 724145 - DNA, 14 bp, Homo sapiens
tttgatacattttt

SEQ ID NO: 724146 - DNA, 17 bp, Homo sapiens
tttgataccttcaatga

SEQ ID NO: 724147 - DNA, 17 bp, Homo sapiens
tttgatactaagcattg

SEQ ID NO: 724148 - DNA, 19 bp, Homo sapiens
tttgatagggaactgggga

SEQ ID NO: 724149 - DNA, 21 bp, Homo sapiens
tttgatataccaaattaaaaa

SEQ ID NO: 724150 - DNA, 18 bp, Homo sapiens
tttgatatttatttcctg

SEQ ID NO: 724151 - DNA, 14 bp, Homo sapiens
tttgatcatttctg

SEQ ID NO: 724152 - DNA, 13 bp, Homo sapiens
tttgatctttgtt

SEQ ID NO: 724153 - DNA, 16 bp, Homo sapiens
tttgatgaaagctgat

SEQ ID NO: 724154 - DNA, 22 bp, Homo sapiens
tttgatgaattcttcctctcct

SEQ ID NO: 724155 - DNA, 23 bp, Homo sapiens
tttgatgactacctcagaacata

SEQ ID NO: 724156 - DNA, 21 bp, Homo sapiens
tttgatgatgtctacagaaaa

SEQ ID NO: 724157 - DNA, 22 bp, Homo sapiens
tttgatgcagataaaatatttt

SEQ ID NO: 724158 - DNA, 16 bp, Homo sapiens
tttgatgcatgtcttt

SEQ ID NO: 724159 - DNA, 18 bp, Homo sapiens
tttgatgctggagaggtt

SEQ ID NO: 724160 - DNA, 13 bp, Homo sapiens
tttgatgctgtat

SEQ ID NO: 724161 - DNA, 19 bp, Homo sapiens
tttgatggagggtggaaat

SEQ ID NO: 724162 - DNA, 20 bp, Homo sapiens
tttgatgtaaagatgttctg

SEQ ID NO: 724163 - DNA, 14 bp, Homo sapiens
tttgatgtatgtgt

SEQ ID NO: 724164 - DNA, 19 bp, Homo sapiens
tttgatgtatgtgtgaaac

SEQ ID NO: 724165 - DNA, 23 bp, Homo sapiens
tttgatgtatgtgtgaaacaatg

SEQ ID NO: 724166 - DNA, 19 bp, Homo sapiens
tttgatgtccccaaagtac

SEQ ID NO: 724167 - DNA, 13 bp, Homo sapiens
tttgatgtgactt

SEQ ID NO: 724168 - DNA, 14 bp, Homo sapiens
tttgatgtgacttt

SEQ ID NO: 724169 - DNA, 18 bp, Homo sapiens
tttgattaaattcttgca

SEQ ID NO: 724170 - DNA, 23 bp, Homo sapiens
tttgattagtataatatttctta

SEQ ID NO: 724171 - DNA, 17 bp, Homo sapiens
tttgattatttaagact

SEQ ID NO: 724172 - DNA, 20 bp, Homo sapiens
tttgattatttgcatgttat

SEQ ID NO: 724173 - DNA, 23 bp, Homo sapiens
tttgattcagctcattatgaaaa

SEQ ID NO: 724174 - DNA, 15 bp, Homo sapiens
tttgattctgtgtgt

SEQ ID NO: 724175 - DNA, 12 bp, Homo sapiens
tttgatttatgc

SEQ ID NO: 724176 - DNA, 12 bp, Homo sapiens
tttgatttcaac

SEQ ID NO: 724177 - DNA, 21 bp, Homo sapiens
tttgatttccatcttaatgtt

SEQ ID NO: 724178 - DNA, 16 bp, Homo sapiens
tttgatttctaattgt

SEQ ID NO: 724179 - DNA, 13 bp, Homo sapiens
tttgatttctatt

SEQ ID NO: 724180 - DNA, 11 bp, Homo sapiens
tttgatttttg

SEQ ID NO: 724181 - DNA, 18 bp, Homo sapiens
tttgatttttgaagttgg

SEQ ID NO: 724182 - DNA, 20 bp, Homo sapiens
tttgcaaaaaatgtttttgg

SEQ ID NO: 724183 - DNA, 13 bp, Homo sapiens
tttgcaaaataag

SEQ ID NO: 724184 - DNA, 19 bp, Homo sapiens
tttgcaaagaaagaaaaaa

SEQ ID NO: 724185 - DNA, 16 bp, Homo sapiens
tttgcaaagaccacct

SEQ ID NO: 724186 - DNA, 19 bp, Homo sapiens
tttgcaaagaccacctcca

SEQ ID NO: 724187 - DNA, 14 bp, Homo sapiens
tttgcaaataggca

SEQ ID NO: 724188 - DNA, 14 bp, Homo sapiens
tttgcaaattattt

SEQ ID NO: 724189 - DNA, 19 bp, Homo sapiens
tttgcaaattatttattac

SEQ ID NO: 724190 - DNA, 14 bp, Homo sapiens
tttgcaacctcgct

SEQ ID NO: 724191 - DNA, 21 bp, Homo sapiens
tttgcaaggtgcatttttact

SEQ ID NO: 724192 - DNA, 14 bp, Homo sapiens
tttgcaagtgctgg

SEQ ID NO: 724193 - DNA, 19 bp, Homo sapiens
tttgcaataacagctgcaa

SEQ ID NO: 724194 - DNA, 19 bp, Homo sapiens
tttgcaatggctatatggc

SEQ ID NO: 724195 - DNA, 14 bp, Homo sapiens
tttgcaatgtcaca

SEQ ID NO: 724196 - DNA, 15 bp, Homo sapiens
tttgcaattcatgta

SEQ ID NO: 724197 - DNA, 14 bp, Homo sapiens
tttgcacaatattt

SEQ ID NO: 724198 - DNA, 19 bp, Homo sapiens
tttgcacagtgtgtgactt

SEQ ID NO: 724199 - DNA, 17 bp, Homo sapiens
tttgcaccaaagacatc

SEQ ID NO: 724200 - DNA, 12 bp, Homo sapiens
tttgcacccctc

SEQ ID NO: 724201 - DNA, 16 bp, Homo sapiens
tttgcacccctcccat

SEQ ID NO: 724202 - DNA, 17 bp, Homo sapiens
tttgcaccgcctgccct

SEQ ID NO: 724203 - DNA, 14 bp, Homo sapiens
tttgcactgagggc

SEQ ID NO: 724204 - DNA, 21 bp, Homo sapiens
tttgcacttgtgattatttat

SEQ ID NO: 724205 - DNA, 13 bp, Homo sapiens
tttgcagcagagg

SEQ ID NO: 724206 - DNA, 22 bp, Homo sapiens
tttgcagctgttttcaaagccc

SEQ ID NO: 724207 - DNA, 18 bp, Homo sapiens
tttgcaggattcccttct

SEQ ID NO: 724208 - DNA, 12 bp, Homo sapiens
tttgcaggctct

SEQ ID NO: 724209 - DNA, 22 bp, Homo sapiens
tttgcaggtctggtttatataa

SEQ ID NO: 724210 - DNA, 10 bp, Homo sapiens
tttgcagtaa

SEQ ID NO: 724211 - DNA, 20 bp, Homo sapiens
tttgcagttggactctcagg

SEQ ID NO: 724212 - DNA, 20 bp, Homo sapiens
tttgcataacaattcctcta

SEQ ID NO: 724213 - DNA, 22 bp, Homo sapiens
tttgcataacaattcctctact

SEQ ID NO: 724214 - DNA, 16 bp, Homo sapiens
tttgcatactgaaaat

SEQ ID NO: 724215 - DNA, 20 bp, Homo sapiens
tttgcatactgaaaatccaa

SEQ ID NO: 724216 - DNA, 17 bp, Homo sapiens
tttgcatattctattgt

SEQ ID NO: 724217 - DNA, 22 bp, Homo sapiens
tttgcatctgaccccggggggc

SEQ ID NO: 724218 - DNA, 17 bp, Homo sapiens
tttgcatggcagggcct

SEQ ID NO: 724219 - DNA, 14 bp, Homo sapiens
tttgcatgttatgt

SEQ ID NO: 724220 - DNA, 16 bp, Homo sapiens
tttgcattatgtattt

SEQ ID NO: 724221 - DNA, 14 bp, Homo sapiens
tttgcattcaaatt

SEQ ID NO: 724222 - DNA, 17 bp, Homo sapiens
tttgcattcaaattaag

SEQ ID NO: 724223 - DNA, 13 bp, Homo sapiens
tttgcattccaga

SEQ ID NO: 724224 - DNA, 14 bp, Homo sapiens
tttgcattcctaca

SEQ ID NO: 724225 - DNA, 19 bp, Homo sapiens
tttgcattccttacttgca

SEQ ID NO: 724226 - DNA, 14 bp, Homo sapiens
tttgcattgtctgt

SEQ ID NO: 724227 - DNA, 12 bp, Homo sapiens
tttgcattgtgt

SEQ ID NO: 724228 - DNA, 13 bp, Homo sapiens
tttgcatttaaga

SEQ ID NO: 724229 - DNA, 21 bp, Homo sapiens
tttgcatttaagaattgccag

SEQ ID NO: 724230 - DNA, 20 bp, Homo sapiens
tttgcatttgtttatgtaat

SEQ ID NO: 724231 - DNA, 13 bp, Homo sapiens
tttgcattttctg

SEQ ID NO: 724232 - DNA, 22 bp, Homo sapiens
tttgcattttgccgctgagata

SEQ ID NO: 724233 - DNA, 19 bp, Homo sapiens
tttgcatttttgttttgaa

SEQ ID NO: 724234 - DNA, 16 bp, Homo sapiens
tttgccaagctaatct

SEQ ID NO: 724235 - DNA, 20 bp, Homo sapiens
tttgccaagctaatctgcct

SEQ ID NO: 724236 - DNA, 18 bp, Homo sapiens
tttgccaaggctctcccc

SEQ ID NO: 724237 - DNA, 23 bp, Homo sapiens
tttgccaagttgctgtcactgtt

SEQ ID NO: 724238 - DNA, 18 bp, Homo sapiens
tttgccactttggcttct

SEQ ID NO: 724239 - DNA, 13 bp, Homo sapiens
tttgccagagcag

SEQ ID NO: 724240 - DNA, 14 bp, Homo sapiens
tttgccagctgctg

SEQ ID NO: 724241 - DNA, 20 bp, Homo sapiens
tttgccagctgctgctggat

SEQ ID NO: 724242 - DNA, 16 bp, Homo sapiens
tttgccagtgaagact

SEQ ID NO: 724243 - DNA, 22 bp, Homo sapiens
tttgccatgacatttcatctgg

SEQ ID NO: 724244 - DNA, 19 bp, Homo sapiens
tttgccatttttctataaa

SEQ ID NO: 724245 - DNA, 14 bp, Homo sapiens
tttgcccacccctc

SEQ ID NO: 724246 - DNA, 21 bp, Homo sapiens
tttgcccagggtcctgtgcct

SEQ ID NO: 724247 - DNA, 16 bp, Homo sapiens
tttgcccagtcctggg

SEQ ID NO: 724248 - DNA, 13 bp, Homo sapiens
tttgcccattttg

SEQ ID NO: 724249 - DNA, 14 bp, Homo sapiens
tttgcccctttata

SEQ ID NO: 724250 - DNA, 22 bp, Homo sapiens
tttgccctttagggctgttgct

SEQ ID NO: 724251 - DNA, 16 bp, Homo sapiens
tttgccgctgagatat

SEQ ID NO: 724252 - DNA, 18 bp, Homo sapiens
tttgccggatacaaactg

SEQ ID NO: 724253 - DNA, 18 bp, Homo sapiens
tttgcctatctttaaaca

SEQ ID NO: 724254 - DNA, 14 bp, Homo sapiens
tttgcctctgccca

SEQ ID NO: 724255 - DNA, 19 bp, Homo sapiens
tttgcctctgtcctcccat

SEQ ID NO: 724256 - DNA, 14 bp, Homo sapiens
tttgcctgagggcg

SEQ ID NO: 724257 - DNA, 14 bp, Homo sapiens
tttgcctgctgtat

SEQ ID NO: 724258 - DNA, 11 bp, Homo sapiens
tttgcctggct

SEQ ID NO: 724259 - DNA, 12 bp, Homo sapiens
tttgcctggctg

SEQ ID NO: 724260 - DNA, 12 bp, Homo sapiens
tttgcctgtgcc

SEQ ID NO: 724261 - DNA, 22 bp, Homo sapiens
tttgccttgcagaactgccatt

SEQ ID NO: 724262 - DNA, 21 bp, Homo sapiens
tttgccttgggctgctcctca

SEQ ID NO: 724263 - DNA, 13 bp, Homo sapiens
tttgcgctgctaa

SEQ ID NO: 724264 - DNA, 22 bp, Homo sapiens
tttgcgcttatttggaaatttt

SEQ ID NO: 724265 - DNA, 19 bp, Homo sapiens
tttgcgtacacagagaagg

SEQ ID NO: 724266 - DNA, 23 bp, Homo sapiens
tttgcgtggatcaagcttgtgta

SEQ ID NO: 724267 - DNA, 13 bp, Homo sapiens
tttgctaaaagaa

SEQ ID NO: 724268 - DNA, 16 bp, Homo sapiens
tttgctacaaatttat

SEQ ID NO: 724269 - DNA, 20 bp, Homo sapiens
tttgctacaaatttatgcat

SEQ ID NO: 724270 - DNA, 15 bp, Homo sapiens
tttgctagcagtaaa

SEQ ID NO: 724271 - DNA, 16 bp, Homo sapiens
tttgctataatcatta

SEQ ID NO: 724272 - DNA, 16 bp, Homo sapiens
tttgctattgtaaata

SEQ ID NO: 724273 - DNA, 23 bp, Homo sapiens
tttgctccctccccgctgccctt

SEQ ID NO: 724274 - DNA, 15 bp, Homo sapiens
tttgctccctctgtt

SEQ ID NO: 724275 - DNA, 21 bp, Homo sapiens
tttgctctggaggaagttctc

SEQ ID NO: 724276 - DNA, 22 bp, Homo sapiens
tttgctctttgacaactaaaat

SEQ ID NO: 724277 - DNA, 15 bp, Homo sapiens
tttgctgaattcctt

SEQ ID NO: 724278 - DNA, 19 bp, Homo sapiens
tttgctgcacagcaggacc

SEQ ID NO: 724279 - DNA, 19 bp, Homo sapiens
tttgctgcactttttactt

SEQ ID NO: 724280 - DNA, 17 bp, Homo sapiens
tttgctgcattttacac

SEQ ID NO: 724281 - DNA, 18 bp, Homo sapiens
tttgctgcattttacaca

SEQ ID NO: 724282 - DNA, 10 bp, Homo sapiens
tttgctgcca

SEQ ID NO: 724283 - DNA, 15 bp, Homo sapiens
tttgctgccaaatgc

SEQ ID NO: 724284 - DNA, 13 bp, Homo sapiens
tttgctgcccctg

SEQ ID NO: 724285 - DNA, 13 bp, Homo sapiens
tttgctgcttctg

SEQ ID NO: 724286 - DNA, 22 bp, Homo sapiens
tttgctggagggaagatcttga

SEQ ID NO: 724287 - DNA, 21 bp, Homo sapiens
tttgctgtagaagatggcact

SEQ ID NO: 724288 - DNA, 17 bp, Homo sapiens
tttgctgtgaggctgtc

SEQ ID NO: 724289 - DNA, 21 bp, Homo sapiens
tttgctgtgaggctgtcctgt

SEQ ID NO: 724290 - DNA, 16 bp, Homo sapiens
tttgctgttactgctt

SEQ ID NO: 724291 - DNA, 10 bp, Homo sapiens
tttgctgttt

SEQ ID NO: 724292 - DNA, 12 bp, Homo sapiens
tttgcttaaaat

SEQ ID NO: 724293 - DNA, 16 bp, Homo sapiens
tttgcttaaaatatgt

SEQ ID NO: 724294 - DNA, 14 bp, Homo sapiens
tttgcttaaacaaa

SEQ ID NO: 724295 - DNA, 12 bp, Homo sapiens
tttgtctgaaca

SEQ ID NO: 724296 - DNA, 13 bp, Homo sapiens
tttgtctgcagct

SEQ ID NO: 724297 - DNA, 14 bp, Homo sapiens
tttgtctggcctca

SEQ ID NO: 724298 - DNA, 12 bp, Homo sapiens
tttgtctgtaca

SEQ ID NO: 724299 - DNA, 14 bp, Homo sapiens
tttgtctgtacata

SEQ ID NO: 724300 - DNA, 13 bp, Homo sapiens
tttgtctgtctcc

SEQ ID NO: 724301 - DNA, 13 bp, Homo sapiens
tttgtcttaaaaa

SEQ ID NO: 724302 - DNA, 23 bp, Homo sapiens
tttgtcttaaaaagtggaaaaat

SEQ ID NO: 724303 - DNA, 16 bp, Homo sapiens
tttgtcttattcttaa

SEQ ID NO: 724304 - DNA, 14 bp, Homo sapiens
tttgtcttattgaa

SEQ ID NO: 724305 - DNA, 16 bp, Homo sapiens
tttgtcttgaatgtct

SEQ ID NO: 724306 - DNA, 13 bp, Homo sapiens
tttgtcttgtact

SEQ ID NO: 724307 - DNA, 14 bp, Homo sapiens
tttgtcttgtactt

SEQ ID NO: 724308 - DNA, 19 bp, Homo sapiens
tttgtcttgtacttctgtg

SEQ ID NO: 724309 - DNA, 20 bp, Homo sapiens
tttgtcttgtacttctgtgt

SEQ ID NO: 724310 - DNA, 23 bp, Homo sapiens
tttgtcttgtacttctgtgttca

SEQ ID NO: 724311 - DNA, 15 bp, Homo sapiens
tttgtctttaaacag

SEQ ID NO: 724312 - DNA, 14 bp, Homo sapiens
tttgtctttttcct

SEQ ID NO: 724313 - DNA, 18 bp, Homo sapiens
tttgtgaacgctgtgatg

SEQ ID NO: 724314 - DNA, 15 bp, Homo sapiens
tttgtgaatttgcaa

SEQ ID NO: 724315 - DNA, 14 bp, Homo sapiens
tttgtgactatata

SEQ ID NO: 724316 - DNA, 12 bp, Homo sapiens
tttgtgagagcg

SEQ ID NO: 724317 - DNA, 16 bp, Homo sapiens
tttgtgagcctatgat

SEQ ID NO: 724318 - DNA, 16 bp, Homo sapiens
tttgtgatacaatgct

SEQ ID NO: 724319 - DNA, 17 bp, Homo sapiens
tttgtgatcagcattgt

SEQ ID NO: 724320 - DNA, 22 bp, Homo sapiens
tttgtgatcagcattgtgactt

SEQ ID NO: 724321 - DNA, 15 bp, Homo sapiens
tttgtgcaaagccaa

SEQ ID NO: 724322 - DNA, 13 bp, Homo sapiens
tttgtgcattctt

SEQ ID NO: 724323 - DNA, 13 bp, Homo sapiens
tttgtgccagagg

SEQ ID NO: 724324 - DNA, 23 bp, Homo sapiens
tttgtgccattatatttgcatta

SEQ ID NO: 724325 - DNA, 21 bp, Homo sapiens
ttttaaaatagaatgatagaa

SEQ ID NO: 724326 - DNA, 21 bp, Homo sapiens
ttttaaaatattacacaggag

SEQ ID NO: 724327 - DNA, 21 bp, Homo sapiens
ttttaaaatatttgaatgaaa

SEQ ID NO: 724328 - DNA, 14 bp, Homo sapiens
ttttaaaatcagct

SEQ ID NO: 724329 - DNA, 22 bp, Homo sapiens
ttttaaaatcagctattttgtg

SEQ ID NO: 724330 - DNA, 21 bp, Homo sapiens
ttttaaaatctgagggaaatg

SEQ ID NO: 724331 - DNA, 23 bp, Homo sapiens
ttttaaaatctgagggaaatgtt

SEQ ID NO: 724332 - DNA, 19 bp, Homo sapiens
ttttaaaatctgatttaat

SEQ ID NO: 724333 - DNA, 20 bp, Homo sapiens
ttttaaaatctgatttaatg

SEQ ID NO: 724334 - DNA, 22 bp, Homo sapiens
ttttaaaatctgatttaatgtt

SEQ ID NO: 724335 - DNA, 17 bp, Homo sapiens
ttttaaaattcaaaagt

SEQ ID NO: 724336 - DNA, 15 bp, Homo sapiens
ttttaaaattgattt

SEQ ID NO: 724337 - DNA, 17 bp, Homo sapiens
ttttaaaatttgtctta

SEQ ID NO: 724338 - DNA, 15 bp, Homo sapiens
ttttaaaatttgttc

SEQ ID NO: 724339 - DNA, 20 bp, Homo sapiens
ttttaaaatttgttcttgta

SEQ ID NO: 724340 - DNA, 23 bp, Homo sapiens
ttttaaacaaaatagaagctgta

SEQ ID NO: 724341 - DNA, 21 bp, Homo sapiens
ttttaaacaaaatttcacagt

SEQ ID NO: 724342 - DNA, 19 bp, Homo sapiens
ttttaaacagtgagcctga

SEQ ID NO: 724343 - DNA, 15 bp, Homo sapiens
ttttaaactgtacag

SEQ ID NO: 724344 - DNA, 16 bp, Homo sapiens
ttttaaactgtacagt

SEQ ID NO: 724345 - DNA, 20 bp, Homo sapiens
ttttaaactgtacagtgtct

SEQ ID NO: 724346 - DNA, 23 bp, Homo sapiens
ttttaaactgtgtacataactga

SEQ ID NO: 724347 - DNA, 17 bp, Homo sapiens
ttttaaacttgaaatat

SEQ ID NO: 724348 - DNA, 11 bp, Homo sapiens
ttttaaagaaa

SEQ ID NO: 724349 - DNA, 19 bp, Homo sapiens
ttttaaagaaaaatatgat

SEQ ID NO: 724350 - DNA, 11 bp, Homo sapiens
ttttaaagaca

SEQ ID NO: 724351 - DNA, 19 bp, Homo sapiens
ttttaaagagatagcttct

SEQ ID NO: 724352 - DNA, 15 bp, Homo sapiens
ttttaaagcaagtca

SEQ ID NO: 724353 - DNA, 18 bp, Homo sapiens
ttttaaagcaagtcacct

SEQ ID NO: 724354 - DNA, 13 bp, Homo sapiens
ttttaaagcctgg

SEQ ID NO: 724355 - DNA, 17 bp, Homo sapiens
ttttaaagtaaacttgt

SEQ ID NO: 724356 - DNA, 22 bp, Homo sapiens
ttttaaagtaaacttgtgtatt

SEQ ID NO: 724357 - DNA, 17 bp, Homo sapiens
ttttaaagtaaattatt

SEQ ID NO: 724358 - DNA, 17 bp, Homo sapiens
ttttaaagttagtatct

SEQ ID NO: 724359 - DNA, 21 bp, Homo sapiens
ttttaaagttcttattttagt

SEQ ID NO: 724360 - DNA, 22 bp, Homo sapiens
ttttaaagttcttattttagta

SEQ ID NO: 724361 - DNA, 22 bp, Homo sapiens
ttttaaataacctctggccctt

SEQ ID NO: 724362 - DNA, 14 bp, Homo sapiens
ttttaaatataaat

SEQ ID NO: 724363 - DNA, 17 bp, Homo sapiens
ttttaaatattttctat

SEQ ID NO: 724364 - DNA, 17 bp, Homo sapiens
ttttaaatgaagtgatt

SEQ ID NO: 724365 - DNA, 18 bp, Homo sapiens
ttttaaatgattccaaat

SEQ ID NO: 724366 - DNA, 19 bp, Homo sapiens
ttttaaatgggtagagaaa

SEQ ID NO: 724367 - DNA, 13 bp, Homo sapiens
ttttaaattttat

SEQ ID NO: 724368 - DNA, 20 bp, Homo sapiens
ttttaacaaaacttcttaga

SEQ ID NO: 724369 - DNA, 20 bp, Homo sapiens
ttttaacaaaagcaagactg

SEQ ID NO: 724370 - DNA, 15 bp, Homo sapiens
ttttaacatgtgtta

SEQ ID NO: 724371 - DNA, 12 bp, Homo sapiens
ttttaaccaaag

SEQ ID NO: 724372 - DNA, 14 bp, Homo sapiens
ttttaaccaaaggt

SEQ ID NO: 724373 - DNA, 17 bp, Homo sapiens
ttttaaccctaatcttt

SEQ ID NO: 724374 - DNA, 20 bp, Homo sapiens
ttttaactaaattttaaagc

SEQ ID NO: 724375 - DNA, 24 bp, Homo sapiens
ttttaactaaattttaaagccatt

SEQ ID NO: 724376 - DNA, 16 bp, Homo sapiens
ttttaactagaattta

SEQ ID NO: 724377 - DNA, 16 bp, Homo sapiens
ttttaactctggattt

SEQ ID NO: 724378 - DNA, 19 bp, Homo sapiens
ttttaactgaaaatgtaaa

SEQ ID NO: 724379 - DNA, 14 bp, Homo sapiens
ttttaactgtggat

SEQ ID NO: 724380 - DNA, 11 bp, Homo sapiens
ttttaactttg

SEQ ID NO: 724381 - DNA, 18 bp, Homo sapiens
ttttaacttttggaatca

SEQ ID NO: 724382 - DNA, 12 bp, Homo sapiens
ttttaagaaaca

SEQ ID NO: 724383 - DNA, 11 bp, Homo sapiens
ttttaagaaag

SEQ ID NO: 724384 - DNA, 12 bp, Homo sapiens
ttttaagaaaga

SEQ ID NO: 724385 - DNA, 14 bp, Homo sapiens
ttttaagaaagaga

SEQ ID NO: 724386 - DNA, 21 bp, Homo sapiens
ttttaagaaagagaatgaact

SEQ ID NO: 724387 - DNA, 22 bp, Homo sapiens
ttttaagaaagagaatgaactg

SEQ ID NO: 724388 - DNA, 13 bp, Homo sapiens
ttttaagaatatc

SEQ ID NO: 724389 - DNA, 19 bp, Homo sapiens
ttttaagacgtgtttgtgt

SEQ ID NO: 724390 - DNA, 17 bp, Homo sapiens
ttttaagactgaatgtt

SEQ ID NO: 724391 - DNA, 17 bp, Homo sapiens
ttttaagactgtaatgt

SEQ ID NO: 724392 - DNA, 22 bp, Homo sapiens
ttttaagactgtaatgtgtact

SEQ ID NO: 724393 - DNA, 12 bp, Homo sapiens
ttttaagagaca

SEQ ID NO: 724394 - DNA, 20 bp, Homo sapiens
ttttaagaggctttggccca

SEQ ID NO: 724395 - DNA, 23 bp, Homo sapiens
ttttaaggataaatcataaagtc

SEQ ID NO: 724396 - DNA, 14 bp, Homo sapiens
ttttaagtatacaa

SEQ ID NO: 724397 - DNA, 20 bp, Homo sapiens
ttttaagtattgtttcctga

SEQ ID NO: 724398 - DNA, 21 bp, Homo sapiens
ttttaagtgaaagtgaggaaa

SEQ ID NO: 724399 - DNA, 19 bp, Homo sapiens
ttttaagtgcttcacattt

SEQ ID NO: 724400 - DNA, 19 bp, Homo sapiens
ttttaagtgctttgtaatg

SEQ ID NO: 724401 - DNA, 17 bp, Homo sapiens
ttttaagtgtatcttaa

SEQ ID NO: 724402 - DNA, 18 bp, Homo sapiens
ttttaagttaatagattt

SEQ ID NO: 724403 - DNA, 22 bp, Homo sapiens
ttttaagttacacatttttcag

SEQ ID NO: 724404 - DNA, 12 bp, Homo sapiens
ttttaagttctt

SEQ ID NO: 724405 - DNA, 13 bp, Homo sapiens
ttttaagttctta

SEQ ID NO: 724406 - DNA, 15 bp, Homo sapiens
ttttaagttcttatg

SEQ ID NO: 724407 - DNA, 23 bp, Homo sapiens
ttttaagttgtcaaagaagcttc

SEQ ID NO: 724408 - DNA, 21 bp, Homo sapiens
ttttaagtttaaaatgtgtat

SEQ ID NO: 724409 - DNA, 19 bp, Homo sapiens
ttttaagtttctctgcaga

SEQ ID NO: 724410 - DNA, 15 bp, Homo sapiens
ttttaataaactact

SEQ ID NO: 724411 - DNA, 19 bp, Homo sapiens
ttttaataaactactcttt

SEQ ID NO: 724412 - DNA, 21 bp, Homo sapiens
ttttaataaactactctttga

SEQ ID NO: 724413 - DNA, 15 bp, Homo sapiens
ttttaataaactttt

SEQ ID NO: 724414 - DNA, 15 bp, Homo sapiens
ttttaataagaacag

SEQ ID NO: 724415 - DNA, 15 bp, Homo sapiens
ttttaatagcactaa

SEQ ID NO: 724416 - DNA, 18 bp, Homo sapiens
ttttaatagtgctttttt

SEQ ID NO: 724417 - DNA, 15 bp, Homo sapiens
ttttaatattactgt

SEQ ID NO: 724418 - DNA, 18 bp, Homo sapiens
ttttaatattactgtctt

SEQ ID NO: 724419 - DNA, 19 bp, Homo sapiens
ttttaatattccagaagaa

SEQ ID NO: 724420 - DNA, 22 bp, Homo sapiens
ttttaatcccattgcaaacatt

SEQ ID NO: 724421 - DNA, 19 bp, Homo sapiens
ttttaatgaaaaggaatca

SEQ ID NO: 724422 - DNA, 16 bp, Homo sapiens
ttttaatgaacaaatg

SEQ ID NO: 724423 - DNA, 13 bp, Homo sapiens
ttttaatgaactt

SEQ ID NO: 724424 - DNA, 21 bp, Homo sapiens
ttttaatgaatattgatgtta

SEQ ID NO: 724425 - DNA, 21 bp, Homo sapiens
ttttaatgaatttaaggcaaa

SEQ ID NO: 724426 - DNA, 17 bp, Homo sapiens
ttttaatgatgacaaaa

SEQ ID NO: 724427 - DNA, 20 bp, Homo sapiens
ttttaatgctatttgaacaa

SEQ ID NO: 724428 - DNA, 23 bp, Homo sapiens
ttttaatggaaagttgtatccat

SEQ ID NO: 724429 - DNA, 20 bp, Homo sapiens
ttttaatgggggtagcagct

SEQ ID NO: 724430 - DNA, 21 bp, Homo sapiens
ttttaatgtatatttgctgca

SEQ ID NO: 724431 - DNA, 13 bp, Homo sapiens
ttttaatgtatct

SEQ ID NO: 724432 - DNA, 21 bp, Homo sapiens
ttttaatgtatctatttgtac

SEQ ID NO: 724433 - DNA, 11 bp, Homo sapiens
ttttaatgtga

SEQ ID NO: 724434 - DNA, 18 bp, Homo sapiens
ttttaatgttagaattta

SEQ ID NO: 724435 - DNA, 22 bp, Homo sapiens
ttttaatgtttattatttacat

SEQ ID NO: 724436 - DNA, 14 bp, Homo sapiens
ttttaattaaaaaa

SEQ ID NO: 724437 - DNA, 17 bp, Homo sapiens
ttttaattaaaaacttt

SEQ ID NO: 724438 - DNA, 11 bp, Homo sapiens
ttttaattatt

SEQ ID NO: 724439 - DNA, 16 bp, Homo sapiens
ttttaattattattct

SEQ ID NO: 724440 - DNA, 20 bp, Homo sapiens
ttttaattattatttatata

SEQ ID NO: 724441 - DNA, 18 bp, Homo sapiens
ttttaattccaatatgat

SEQ ID NO: 724442 - DNA, 14 bp, Homo sapiens
ttttaattgaaaag

SEQ ID NO: 724443 - DNA, 15 bp, Homo sapiens
ttttaatttaaagct

SEQ ID NO: 724444 - DNA, 16 bp, Homo sapiens
ttttaatttaaagctt

SEQ ID NO: 724445 - DNA, 12 bp, Homo sapiens
ttttaatttaac

SEQ ID NO: 724446 - DNA, 18 bp, Homo sapiens
ttttaatttagtaaatgt

SEQ ID NO: 724447 - DNA, 22 bp, Homo sapiens
ttttaatttatttattaagatg

SEQ ID NO: 724448 - DNA, 19 bp, Homo sapiens
ttttaatttatttgtttcc

SEQ ID NO: 724449 - DNA, 20 bp, Homo sapiens
tttcccccacagttttaata

SEQ ID NO: 724450 - DNA, 21 bp, Homo sapiens
tttcccccacagttttaataa

SEQ ID NO: 724451 - DNA, 22 bp, Homo sapiens
tttcccccaccctactccctcc

SEQ ID NO: 724452 - DNA, 22 bp, Homo sapiens
tttcccccagcaacgcccctcc

SEQ ID NO: 724453 - DNA, 12 bp, Homo sapiens
tttccccccact

SEQ ID NO: 724454 - DNA, 12 bp, Homo sapiens
tttcccccttcc

SEQ ID NO: 724455 - DNA, 21 bp, Homo sapiens
tttcccccttcccgccttcca

SEQ ID NO: 724456 - DNA, 15 bp, Homo sapiens
tttcccccttgagga

SEQ ID NO: 724457 - DNA, 21 bp, Homo sapiens
tttcccccttttctgcatttt

SEQ ID NO: 724458 - DNA, 20 bp, Homo sapiens
tttccccgaagagtcagccc

SEQ ID NO: 724459 - DNA, 16 bp, Homo sapiens
tttcccctcagagctc

SEQ ID NO: 724460 - DNA, 13 bp, Homo sapiens
tttcccctccctg

SEQ ID NO: 724461 - DNA, 22 bp, Homo sapiens
tttcccctccgtctttcccctc

SEQ ID NO: 724462 - DNA, 23 bp, Homo sapiens
tttcccctgtcctgatggtcagc

SEQ ID NO: 724463 - DNA, 12 bp, Homo sapiens
tttccccttcct

SEQ ID NO: 724464 - DNA, 14 bp, Homo sapiens
tttccctatcttct

SEQ ID NO: 724465 - DNA, 23 bp, Homo sapiens
tttccctcaaatgcgcgtgtgca

SEQ ID NO: 724466 - DNA, 19 bp, Homo sapiens
tttccctcaccccctccca

SEQ ID NO: 724467 - DNA, 14 bp, Homo sapiens
tttccctcagtgaa

SEQ ID NO: 724468 - DNA, 22 bp, Homo sapiens
tttccctcgtccgtctgtctcg

SEQ ID NO: 724469 - DNA, 22 bp, Homo sapiens
tttccctgccacatccagcttg

SEQ ID NO: 724470 - DNA, 11 bp, Homo sapiens
tttccctgccc

SEQ ID NO: 724471 - DNA, 23 bp, Homo sapiens
tttccctggacaggcagcctcct

SEQ ID NO: 724472 - DNA, 14 bp, Homo sapiens
tttcccttatcaaa

SEQ ID NO: 724473 - DNA, 22 bp, Homo sapiens
tttcccttcatttaaactaaat

SEQ ID NO: 724474 - DNA, 13 bp, Homo sapiens
tttcccttccaaa

SEQ ID NO: 724475 - DNA, 14 bp, Homo sapiens
tttcccttccagtt

SEQ ID NO: 724476 - DNA, 19 bp, Homo sapiens
tttcccttcctcttcggcc

SEQ ID NO: 724477 - DNA, 15 bp, Homo sapiens
tttcccttgaggaaa

SEQ ID NO: 724478 - DNA, 20 bp, Homo sapiens
tttcccttgcttttccctct

SEQ ID NO: 724479 - DNA, 23 bp, Homo sapiens
tttccctttgaggttgctttgtt

SEQ ID NO: 724480 - DNA, 21 bp, Homo sapiens
tttccgaaaggcaattatatc

SEQ ID NO: 724481 - DNA, 22 bp, Homo sapiens
tttccgacacatttaccaaatt

SEQ ID NO: 724482 - DNA, 22 bp, Homo sapiens
tttccgtaaaaatgatttcagt

SEQ ID NO: 724483 - DNA, 15 bp, Homo sapiens
tttccgttaaaatac

SEQ ID NO: 724484 - DNA, 17 bp, Homo sapiens
tttccgttaaaatacca

SEQ ID NO: 724485 - DNA, 22 bp, Homo sapiens
tttcctaaacataattgtggat

SEQ ID NO: 724486 - DNA, 13 bp, Homo sapiens
tttcctaaatgtt

SEQ ID NO: 724487 - DNA, 15 bp, Homo sapiens
tttcctaaggctgca

SEQ ID NO: 724488 - DNA, 14 bp, Homo sapiens
tttcctaatatgat

SEQ ID NO: 724489 - DNA, 23 bp, Homo sapiens
tttcctactatcatctcttaaat

SEQ ID NO: 724490 - DNA, 19 bp, Homo sapiens
tttcctactccgttcctgg

SEQ ID NO: 724491 - DNA, 20 bp, Homo sapiens
tttcctacttataaagtaga

SEQ ID NO: 724492 - DNA, 22 bp, Homo sapiens
tttcctagactaattaaaatct

SEQ ID NO: 724493 - DNA, 17 bp, Homo sapiens
tttcctagccctctcac

SEQ ID NO: 724494 - DNA, 15 bp, Homo sapiens
tttcctatgctattg

SEQ ID NO: 724495 - DNA, 17 bp, Homo sapiens
tttcctatgggaacaat

SEQ ID NO: 724496 - DNA, 15 bp, Homo sapiens
tttcctattctgttg

SEQ ID NO: 724497 - DNA, 13 bp, Homo sapiens
tttcctcactgcc

SEQ ID NO: 724498 - DNA, 15 bp, Homo sapiens
tttcctcactgcctg

SEQ ID NO: 724499 - DNA, 19 bp, Homo sapiens
tttcctcagcttatctctt

SEQ ID NO: 724500 - DNA, 12 bp, Homo sapiens
tttcctcatcct

SEQ ID NO: 724501 - DNA, 20 bp, Homo sapiens
tttcctcatgtaacattggt

SEQ ID NO: 724502 - DNA, 14 bp, Homo sapiens
tttcctccccacct

SEQ ID NO: 724503 - DNA, 17 bp, Homo sapiens
tttcctccccaccttcc

SEQ ID NO: 724504 - DNA, 18 bp, Homo sapiens
tttcctccccatacacac

SEQ ID NO: 724505 - DNA, 16 bp, Homo sapiens
tttcctccccctgcaa

SEQ ID NO: 724506 - DNA, 17 bp, Homo sapiens
tttcctcccttctgcta

SEQ ID NO: 724507 - DNA, 18 bp, Homo sapiens
tttcctcctcaggcacac

SEQ ID NO: 724508 - DNA, 11 bp, Homo sapiens
tttcctcctgg

SEQ ID NO: 724509 - DNA, 19 bp, Homo sapiens
tttcctcgcctaggcctgt

SEQ ID NO: 724510 - DNA, 17 bp, Homo sapiens
tttcctcggtctccctt

SEQ ID NO: 724511 - DNA, 18 bp, Homo sapiens
tttcctctatacatctct

SEQ ID NO: 724512 - DNA, 22 bp, Homo sapiens
tttcctctatacatctctcccc

SEQ ID NO: 724513 - DNA, 14 bp, Homo sapiens
tttcctctccctca

SEQ ID NO: 724514 - DNA, 16 bp, Homo sapiens
tttcctctccctcagg

SEQ ID NO: 724515 - DNA, 23 bp, Homo sapiens
tttcctctgttcaaagctgcctg

SEQ ID NO: 724516 - DNA, 16 bp, Homo sapiens
tttcctctgttcacaa

SEQ ID NO: 724517 - DNA, 13 bp, Homo sapiens
tttcctcttcaga

SEQ ID NO: 724518 - DNA, 15 bp, Homo sapiens
tttcctcttccaaag

SEQ ID NO: 724519 - DNA, 21 bp, Homo sapiens
tttcctcttctattttgtaaa

SEQ ID NO: 724520 - DNA, 19 bp, Homo sapiens
tttcctgaaataaatgttt

SEQ ID NO: 724521 - DNA, 15 bp, Homo sapiens
tttcctgaaatcaag

SEQ ID NO: 724522 - DNA, 15 bp, Homo sapiens
tttcctgaagcattt

SEQ ID NO: 724523 - DNA, 13 bp, Homo sapiens
tttcctgaatcta

SEQ ID NO: 724524 - DNA, 13 bp, Homo sapiens
tttcctgatctag

SEQ ID NO: 724525 - DNA, 13 bp, Homo sapiens
tttcctgcatgtt

SEQ ID NO: 724526 - DNA, 12 bp, Homo sapiens
tttcctgccctg

SEQ ID NO: 724527 - DNA, 18 bp, Homo sapiens
tttcctgctacaagtgtt

SEQ ID NO: 724528 - DNA, 16 bp, Homo sapiens
tttcctggacactcag

SEQ ID NO: 724529 - DNA, 20 bp, Homo sapiens
tttcctggacatcctcttct

SEQ ID NO: 724530 - DNA, 21 bp, Homo sapiens
tttcctggacatcctcttctg

SEQ ID NO: 724531 - DNA, 18 bp, Homo sapiens
tttcctggcagctgctgt

SEQ ID NO: 724532 - DNA, 18 bp, Homo sapiens
tttcctgggcctttgcaa

SEQ ID NO: 724533 - DNA, 12 bp, Homo sapiens
tttcctgtacaa

SEQ ID NO: 724534 - DNA, 20 bp, Homo sapiens
tttcctgtacaatcatgaac

SEQ ID NO: 724535 - DNA, 13 bp, Homo sapiens
tttcctgtttact

SEQ ID NO: 724536 - DNA, 17 bp, Homo sapiens
tttcctgtttactgatt

SEQ ID NO: 724537 - DNA, 13 bp, Homo sapiens
tttccttaaacat

SEQ ID NO: 724538 - DNA, 14 bp, Homo sapiens
tttccttaaacatg

SEQ ID NO: 724539 - DNA, 15 bp, Homo sapiens
tttccttaaacatga

SEQ ID NO: 724540 - DNA, 16 bp, Homo sapiens
tttccttaaactgtgt

SEQ ID NO: 724541 - DNA, 21 bp, Homo sapiens
tttccttaaatttttagccat

SEQ ID NO: 724542 - DNA, 16 bp, Homo sapiens
tttccttaatccagct

SEQ ID NO: 724543 - DNA, 15 bp, Homo sapiens
tttccttcaggtttt

SEQ ID NO: 724544 - DNA, 16 bp, Homo sapiens
tttccttcattcatag

SEQ ID NO: 724545 - DNA, 16 bp, Homo sapiens
tttccttccactgtag

SEQ ID NO: 724546 - DNA, 14 bp, Homo sapiens
tttccttccatccc

SEQ ID NO: 724547 - DNA, 15 bp, Homo sapiens
tttccttccatccct

SEQ ID NO: 724548 - DNA, 20 bp, Homo sapiens
tttccttcccttttctgttc

SEQ ID NO: 724549 - DNA, 18 bp, Homo sapiens
tttccttctgttaaaatg

SEQ ID NO: 724550 - DNA, 16 bp, Homo sapiens
ttttataagaaaaact

SEQ ID NO: 724551 - DNA, 13 bp, Homo sapiens
ttttataatgtta

SEQ ID NO: 724552 - DNA, 23 bp, Homo sapiens
ttttataattggtgctatttgaa

SEQ ID NO: 724553 - DNA, 13 bp, Homo sapiens
ttttatacataaa

SEQ ID NO: 724554 - DNA, 21 bp, Homo sapiens
ttttatacggaaaaaattgta

SEQ ID NO: 724555 - DNA, 12 bp, Homo sapiens
ttttatactgta

SEQ ID NO: 724556 - DNA, 22 bp, Homo sapiens
ttttatagcttaactaatttga

SEQ ID NO: 724557 - DNA, 17 bp, Homo sapiens
ttttatataataaagta

SEQ ID NO: 724558 - DNA, 22 bp, Homo sapiens
ttttatataatatctaaagtta

SEQ ID NO: 724559 - DNA, 15 bp, Homo sapiens
ttttatatatacagt

SEQ ID NO: 724560 - DNA, 15 bp, Homo sapiens
ttttatatcttccta

SEQ ID NO: 724561 - DNA, 17 bp, Homo sapiens
ttttatatgatggggga

SEQ ID NO: 724562 - DNA, 22 bp, Homo sapiens
ttttatattacttttgtaaata

SEQ ID NO: 724563 - DNA, 21 bp, Homo sapiens
ttttatatttaaaaaattaaa

SEQ ID NO: 724564 - DNA, 21 bp, Homo sapiens
ttttatatttcctttatgtga

SEQ ID NO: 724565 - DNA, 16 bp, Homo sapiens
ttttatcagccatgtt

SEQ ID NO: 724566 - DNA, 15 bp, Homo sapiens
ttttatcatgacatg

SEQ ID NO: 724567 - DNA, 19 bp, Homo sapiens
ttttatcattaaaaattac

SEQ ID NO: 724568 - DNA, 23 bp, Homo sapiens
ttttatcccatttagtgtgaata

SEQ ID NO: 724569 - DNA, 20 bp, Homo sapiens
ttttatcctggccttgtact

SEQ ID NO: 724570 - DNA, 16 bp, Homo sapiens
ttttatgaacattgta

SEQ ID NO: 724571 - DNA, 19 bp, Homo sapiens
ttttatgaacattgtactg

SEQ ID NO: 724572 - DNA, 13 bp, Homo sapiens
ttttatgaagaaa

SEQ ID NO: 724573 - DNA, 14 bp, Homo sapiens
ttttatgaagaaaa

SEQ ID NO: 724574 - DNA, 13 bp, Homo sapiens
ttttatgatcagt

SEQ ID NO: 724575 - DNA, 15 bp, Homo sapiens
ttttatgctcttgaa

SEQ ID NO: 724576 - DNA, 20 bp, Homo sapiens
ttttatgtacaaccctgacc

SEQ ID NO: 724577 - DNA, 12 bp, Homo sapiens
ttttatgttgat

SEQ ID NO: 724578 - DNA, 14 bp, Homo sapiens
ttttattaaaacat

SEQ ID NO: 724579 - DNA, 21 bp, Homo sapiens
ttttattaagccaggaaacat

SEQ ID NO: 724580 - DNA, 11 bp, Homo sapiens
ttttattaatg

SEQ ID NO: 724581 - DNA, 14 bp, Homo sapiens
ttttattacagaaa

SEQ ID NO: 724582 - DNA, 20 bp, Homo sapiens
ttttattagtattgttgtcc

SEQ ID NO: 724583 - DNA, 22 bp, Homo sapiens
ttttattagtattgttgtcctt

SEQ ID NO: 724584 - DNA, 23 bp, Homo sapiens
ttttattagtattgttgtccttt

SEQ ID NO: 724585 - DNA, 13 bp, Homo sapiens
ttttattatcagt

SEQ ID NO: 724586 - DNA, 14 bp, Homo sapiens
ttttattatgagct

SEQ ID NO: 724587 - DNA, 13 bp, Homo sapiens
ttttattatgcat

SEQ ID NO: 724588 - DNA, 19 bp, Homo sapiens
ttttattatttttacctaa

SEQ ID NO: 724589 - DNA, 14 bp, Homo sapiens
ttttattcaagtta

SEQ ID NO: 724590 - DNA, 20 bp, Homo sapiens
ttttattcagctagaatttc

SEQ ID NO: 724591 - DNA, 22 bp, Homo sapiens
ttttattcctcttattgggata

SEQ ID NO: 724592 - DNA, 15 bp, Homo sapiens
ttttattcctgtatg

SEQ ID NO: 724593 - DNA, 23 bp, Homo sapiens
ttttattcggcatttaacttaca

SEQ ID NO: 724594 - DNA, 16 bp, Homo sapiens
ttttattgaaatgtat

SEQ ID NO: 724595 - DNA, 19 bp, Homo sapiens
ttttattgaaatgtataat

SEQ ID NO: 724596 - DNA, 18 bp, Homo sapiens
ttttattgacacagaaaa

SEQ ID NO: 724597 - DNA, 21 bp, Homo sapiens
ttttattggggaattaaatag

SEQ ID NO: 724598 - DNA, 18 bp, Homo sapiens
ttttcattaaataaattt

SEQ ID NO: 724599 - DNA, 20 bp, Homo sapiens
ttttcattatgttcatgtaa

SEQ ID NO: 724600 - DNA, 17 bp, Homo sapiens
ttttcattcctaaagaa

SEQ ID NO: 724601 - DNA, 13 bp, Homo sapiens
ttttcatttgtaa

SEQ ID NO: 724602 - DNA, 23 bp, Homo sapiens
ttttcatttgttttgcttttgtt

SEQ ID NO: 724603 - DNA, 19 bp, Homo sapiens
ttttccaaaacaaaaagat

SEQ ID NO: 724604 - DNA, 18 bp, Homo sapiens
ttttccaaagaaaagtat

SEQ ID NO: 724605 - DNA, 21 bp, Homo sapiens
ttttccaaagaaaagtattgt

SEQ ID NO: 724606 - DNA, 11 bp, Homo sapiens
ttttccaaatg

SEQ ID NO: 724607 - DNA, 18 bp, Homo sapiens
ttttccaaatgcccaagg

SEQ ID NO: 724608 - DNA, 18 bp, Homo sapiens
ttttccaactactaatag

SEQ ID NO: 724609 - DNA, 15 bp, Homo sapiens
ttttccactactgct

SEQ ID NO: 724610 - DNA, 15 bp, Homo sapiens
ttttccacttagtat

SEQ ID NO: 724611 - DNA, 21 bp, Homo sapiens
ttttccagaaatacctgtcta

SEQ ID NO: 724612 - DNA, 13 bp, Homo sapiens
ttttccagcaaaa

SEQ ID NO: 724613 - DNA, 18 bp, Homo sapiens
ttttccagcaaaatggaa

SEQ ID NO: 724614 - DNA, 13 bp, Homo sapiens
ttttccagcaagt

SEQ ID NO: 724615 - DNA, 17 bp, Homo sapiens
ttttccagccttatgtg

SEQ ID NO: 724616 - DNA, 21 bp, Homo sapiens
ttttccagccttatgtgttac

SEQ ID NO: 724617 - DNA, 19 bp, Homo sapiens
ttttccaggtttaagctgt

SEQ ID NO: 724618 - DNA, 15 bp, Homo sapiens
ttttccagtctcttg

SEQ ID NO: 724619 - DNA, 16 bp, Homo sapiens
ttttccatatcctggt

SEQ ID NO: 724620 - DNA, 20 bp, Homo sapiens
ttttccatgcgtgtttctga

SEQ ID NO: 724621 - DNA, 13 bp, Homo sapiens
ttttccattgtca

SEQ ID NO: 724622 - DNA, 13 bp, Homo sapiens
ttttcccaaagcc

SEQ ID NO: 724623 - DNA, 14 bp, Homo sapiens
ttttcccaagtgta

SEQ ID NO: 724624 - DNA, 20 bp, Homo sapiens
ttttcccagatacttcccat

SEQ ID NO: 724625 - DNA, 23 bp, Homo sapiens
ttttcccatcatcctttgttctg

SEQ ID NO: 724626 - DNA, 22 bp, Homo sapiens
ttttcccccagcaacgcccctc

SEQ ID NO: 724627 - DNA, 19 bp, Homo sapiens
ttttccccccactctcccc

SEQ ID NO: 724628 - DNA, 21 bp, Homo sapiens
ttttcccccttgaggattgtg

SEQ ID NO: 724629 - DNA, 23 bp, Homo sapiens
ttttcccccttgaggattgtgga

SEQ ID NO: 724630 - DNA, 17 bp, Homo sapiens
ttttcccctacagaatt

SEQ ID NO: 724631 - DNA, 16 bp, Homo sapiens
ttttcccctgtcctga

SEQ ID NO: 724632 - DNA, 15 bp, Homo sapiens
ttttcccctttcctg

SEQ ID NO: 724633 - DNA, 21 bp, Homo sapiens
ttttccctccataagtttaac

SEQ ID NO: 724634 - DNA, 15 bp, Homo sapiens
ttttccctcctgaca

SEQ ID NO: 724635 - DNA, 22 bp, Homo sapiens
ttttccctctttggctcccctg

SEQ ID NO: 724636 - DNA, 15 bp, Homo sapiens
ttttccctcttttct

SEQ ID NO: 724637 - DNA, 13 bp, Homo sapiens
ttttcccttttta

SEQ ID NO: 724638 - DNA, 14 bp, Homo sapiens
ttttccctttttaa

SEQ ID NO: 724639 - DNA, 17 bp, Homo sapiens
ttttccctttttaaaaa

SEQ ID NO: 724640 - DNA, 19 bp, Homo sapiens
ttttccctttttaaaaaat

SEQ ID NO: 724641 - DNA, 19 bp, Homo sapiens
ttttccggagaagatttca

SEQ ID NO: 724642 - DNA, 14 bp, Homo sapiens
ttttcctaaatgca

SEQ ID NO: 724643 - DNA, 19 bp, Homo sapiens
ttttcctactatcatctct

SEQ ID NO: 724644 - DNA, 22 bp, Homo sapiens
ttttcctactccgttcctggca

SEQ ID NO: 724645 - DNA, 17 bp, Homo sapiens
ttttcctagccctctca

SEQ ID NO: 724646 - DNA, 19 bp, Homo sapiens
ttttcctatgctattgaca

SEQ ID NO: 724647 - DNA, 20 bp, Homo sapiens
ttttcctatgctattgacaa

SEQ ID NO: 724648 - DNA, 22 bp, Homo sapiens
ttttcctcaagcaataattgtt

SEQ ID NO: 724649 - DNA, 20 bp, Homo sapiens
ttttcctcatcctttccctc

SEQ ID NO: 724650 - DNA, 12 bp, Homo sapiens
ttttcctcccag

SEQ ID NO: 724651 - DNA, 20 bp, Homo sapiens
tttttccaatgcttcttata

SEQ ID NO: 724652 - DNA, 15 bp, Homo sapiens
tttttccaatgtttt

SEQ ID NO: 724653 - DNA, 17 bp, Homo sapiens
tttttccctcctgacaa

SEQ ID NO: 724654 - DNA, 10 bp, Homo sapiens
tttttccctt

SEQ ID NO: 724655 - DNA, 11 bp, Homo sapiens
tttttcccttt

SEQ ID NO: 724656 - DNA, 14 bp, Homo sapiens
tttttccgtaaaaa

SEQ ID NO: 724657 - DNA, 18 bp, Homo sapiens
tttttcctagccctctca

SEQ ID NO: 724658 - DNA, 15 bp, Homo sapiens
tttttcctcatgtaa

SEQ ID NO: 724659 - DNA, 11 bp, Homo sapiens
tttttccttta

SEQ ID NO: 724660 - DNA, 19 bp, Homo sapiens
tttttccttttcatctgtt

SEQ ID NO: 724661 - DNA, 11 bp, Homo sapiens
tttttctaaaa

SEQ ID NO: 724662 - DNA, 15 bp, Homo sapiens
tttttctaaaacatt

SEQ ID NO: 724663 - DNA, 21 bp, Homo sapiens
tttttctaaaacattcccctc

SEQ ID NO: 724664 - DNA, 15 bp, Homo sapiens
tttttctaagagaag

SEQ ID NO: 724665 - DNA, 14 bp, Homo sapiens
tttttctaagtgta

SEQ ID NO: 724666 - DNA, 18 bp, Homo sapiens
tttttctaccataagtga

SEQ ID NO: 724667 - DNA, 22 bp, Homo sapiens
tttttctacctgtacacattcc

SEQ ID NO: 724668 - DNA, 21 bp, Homo sapiens
tttttctagtttcagtaaata

SEQ ID NO: 724669 - DNA, 15 bp, Homo sapiens
tttttctatattatt

SEQ ID NO: 724670 - DNA, 14 bp, Homo sapiens
tttttctcatgtat

SEQ ID NO: 724671 - DNA, 11 bp, Homo sapiens
tttttctctaa

SEQ ID NO: 724672 - DNA, 10 bp, Homo sapiens
tttttctctt

SEQ ID NO: 724673 - DNA, 12 bp, Homo sapiens
tttttctcttca

SEQ ID NO: 724674 - DNA, 14 bp, Homo sapiens
tttttctcttctgt

SEQ ID NO: 724675 - DNA, 20 bp, Homo sapiens
tttttctgaataaaaaagat

SEQ ID NO: 724676 - DNA, 17 bp, Homo sapiens
tttttctgataaaagat

SEQ ID NO: 724677 - DNA, 11 bp, Homo sapiens
tttttctggaa

SEQ ID NO: 724678 - DNA, 16 bp, Homo sapiens
tttttctgtaccagtt

SEQ ID NO: 724679 - DNA, 20 bp, Homo sapiens
tttttctgtgataactctgc

SEQ ID NO: 724680 - DNA, 11 bp, Homo sapiens
tttttcttccc

SEQ ID NO: 724681 - DNA, 23 bp, Homo sapiens
tttttcttctattaatcaagaga

SEQ ID NO: 724682 - DNA, 18 bp, Homo sapiens
tttttcttgctgttcagt

SEQ ID NO: 724683 - DNA, 21 bp, Homo sapiens
tttttcttgctgttcagtgct

SEQ ID NO: 724684 - DNA, 17 bp, Homo sapiens
tttttcttgtctataaa

SEQ ID NO: 724685 - DNA, 12 bp, Homo sapiens
tttttctttaca

SEQ ID NO: 724686 - DNA, 16 bp, Homo sapiens
tttttctttataaact

SEQ ID NO: 724687 - DNA, 17 bp, Homo sapiens
tttttctttataaactt

SEQ ID NO: 724688 - DNA, 21 bp, Homo sapiens
tttttcttttcggaaatctta

SEQ ID NO: 724689 - DNA, 23 bp, Homo sapiens
tttttgaaaaagcgaaaaaatca

SEQ ID NO: 724690 - DNA, 13 bp, Homo sapiens
tttttgaaaacat

SEQ ID NO: 724691 - DNA, 16 bp, Homo sapiens
tttttgaaaagagaag

SEQ ID NO: 724692 - DNA, 19 bp, Homo sapiens
tttttgaaaattatgcaaa

SEQ ID NO: 724693 - DNA, 23 bp, Homo sapiens
tttttgaaaggcatgttcctctg

SEQ ID NO: 724694 - DNA, 23 bp, Homo sapiens
tttttgaaggcagaaagcaaaat

SEQ ID NO: 724695 - DNA, 23 bp, Homo sapiens
tttttgaagtaaattaaacattt

SEQ ID NO: 724696 - DNA, 13 bp, Homo sapiens
tttttgacactga

SEQ ID NO: 724697 - DNA, 15 bp, Homo sapiens
tttttgacactgaaa

SEQ ID NO: 724698 - DNA, 18 bp, Homo sapiens
tttttgacactgaaagtt

SEQ ID NO: 724699 - DNA, 22 bp, Homo sapiens
tttttgacactgaaagttttgt

SEQ ID NO: 724700 - DNA, 21 bp, Homo sapiens
tttttgataaagtaataatgt

SEQ ID NO: 724701 - DNA, 15 bp, Homo sapiens
tttttgataccttca

SEQ ID NO: 724702 - DNA, 18 bp, Homo sapiens
tttttgatgactacctca

SEQ ID NO: 724703 - DNA, 21 bp, Homo sapiens
tttttgatgactacctcagaa

SEQ ID NO: 724704 - DNA, 13 bp, Homo sapiens
tttttgatgtcag

SEQ ID NO: 724705 - DNA, 11 bp, Homo sapiens
tttttgcaaaa

SEQ ID NO: 724706 - DNA, 15 bp, Homo sapiens
tttttgcaagtgaag

SEQ ID NO: 724707 - DNA, 18 bp, Homo sapiens
tttttgcaagtgaaggtt

SEQ ID NO: 724708 - DNA, 20 bp, Homo sapiens
tttttgcacatgtttcctct

SEQ ID NO: 724709 - DNA, 18 bp, Homo sapiens
tttttgcaggagcagtat

SEQ ID NO: 724710 - DNA, 16 bp, Homo sapiens
tttttgcagtaactgt

SEQ ID NO: 724711 - DNA, 17 bp, Homo sapiens
tttttgcatttaaaaca

SEQ ID NO: 724712 - DNA, 16 bp, Homo sapiens
tttttgctataatcat

SEQ ID NO: 724713 - DNA, 20 bp, Homo sapiens
tttttgctataatcattagt

SEQ ID NO: 724714 - DNA, 14 bp, Homo sapiens
tttttgcttaacat

SEQ ID NO: 724715 - DNA, 15 bp, Homo sapiens
tttttggaaagtcag

SEQ ID NO: 724716 - DNA, 15 bp, Homo sapiens
tttttggaagtgaaa

SEQ ID NO: 724717 - DNA, 20 bp, Homo sapiens
tttttggagtgttatgtatt

SEQ ID NO: 724718 - DNA, 16 bp, Homo sapiens
tttttggcctgtttga

SEQ ID NO: 724719 - DNA, 19 bp, Homo sapiens
tttttggcctgtttgatgt

SEQ ID NO: 724720 - DNA, 23 bp, Homo sapiens
tttttggcctgtttgatgtatgt

SEQ ID NO: 724721 - DNA, 20 bp, Homo sapiens
tttttggcgtggctgactta

SEQ ID NO: 724722 - DNA, 20 bp, Homo sapiens
tttttgggcagcaatttaaa

SEQ ID NO: 724723 - DNA, 15 bp, Homo sapiens
tttttgggtttggcc

SEQ ID NO: 724724 - DNA, 20 bp, Homo sapiens
tttttggtataatgtttaaa

SEQ ID NO: 724725 - DNA, 22 bp, Homo sapiens
tttttggtcgaggagtaacaat

SEQ ID NO: 724726 - DNA, 15 bp, Homo sapiens
tttttggtttccaaa

SEQ ID NO: 724727 - DNA, 12 bp, Homo sapiens
tttttgtaaata

SEQ ID NO: 724728 - DNA, 15 bp, Homo sapiens
tttttgtaactacaa

SEQ ID NO: 724729 - DNA, 16 bp, Homo sapiens
tttttgtaatgcactg

SEQ ID NO: 724730 - DNA, 14 bp, Homo sapiens
tttttgtaccattt

SEQ ID NO: 724731 - DNA, 18 bp, Homo sapiens
tgccccgtccccctctgg

SEQ ID NO: 724732 - DNA, 20 bp, Homo sapiens
tgcccctaaagatgggagga

SEQ ID NO: 724733 - DNA, 18 bp, Homo sapiens
tgcccctaatctctgtag

SEQ ID NO: 724734 - DNA, 20 bp, Homo sapiens
tgcccctaatctctgtagga

SEQ ID NO: 724735 - DNA, 12 bp, Homo sapiens
tgcccctcaggg

SEQ ID NO: 724736 - DNA, 21 bp, Homo sapiens
tgcccctcagggggccagctg

SEQ ID NO: 724737 - DNA, 17 bp, Homo sapiens
tgcccctcccccaaccc

SEQ ID NO: 724738 - DNA, 15 bp, Homo sapiens
tgcccctccccgtcc

SEQ ID NO: 724739 - DNA, 15 bp, Homo sapiens
tgcccctcccttcaa

SEQ ID NO: 724740 - DNA, 13 bp, Homo sapiens
tgcccctcctgga

SEQ ID NO: 724741 - DNA, 22 bp, Homo sapiens
tgcccctcgcacacagggctca

SEQ ID NO: 724742 - DNA, 15 bp, Homo sapiens
tgcccctctcaccaa

SEQ ID NO: 724743 - DNA, 20 bp, Homo sapiens
tgcccctctccgaaagaaga

SEQ ID NO: 724744 - DNA, 16 bp, Homo sapiens
tgcccctgcagtttgg

SEQ ID NO: 724745 - DNA, 22 bp, Homo sapiens
tgcccctgcagtttggccctgg

SEQ ID NO: 724746 - DNA, 23 bp, Homo sapiens
tgcccctgcagtttggccctgga

SEQ ID NO: 724747 - DNA, 15 bp, Homo sapiens
tgcccctgcctccca

SEQ ID NO: 724748 - DNA, 16 bp, Homo sapiens
tgcccctgcctgacag

SEQ ID NO: 724749 - DNA, 13 bp, Homo sapiens
tgcccctgctgcc

SEQ ID NO: 724750 - DNA, 14 bp, Homo sapiens
tgcccctgctgcct

SEQ ID NO: 724751 - DNA, 23 bp, Homo sapiens
tgcccctgctgcctccccaaccc

SEQ ID NO: 724752 - DNA, 18 bp, Homo sapiens
tgcccctgctgtgctgct

SEQ ID NO: 724753 - DNA, 21 bp, Homo sapiens
tgcccctggcccatctcagcc

SEQ ID NO: 724754 - DNA, 17 bp, Homo sapiens
tgcccctgtctggaaga

SEQ ID NO: 724755 - DNA, 17 bp, Homo sapiens
tgccccttaaccccaag

SEQ ID NO: 724756 - DNA, 20 bp, Homo sapiens
tgccccttaaccccaaggac

SEQ ID NO: 724757 - DNA, 14 bp, Homo sapiens
tgccccttcactca

SEQ ID NO: 724758 - DNA, 12 bp, Homo sapiens
tgccccttctcc

SEQ ID NO: 724759 - DNA, 19 bp, Homo sapiens
tgccccttgcaagccataa

SEQ ID NO: 724760 - DNA, 22 bp, Homo sapiens
tgccccttgcaagccataacgt

SEQ ID NO: 724761 - DNA, 22 bp, Homo sapiens
tgccccttggctggatcaggga

SEQ ID NO: 724762 - DNA, 19 bp, Homo sapiens
tgccccttgtcctgaagcc

SEQ ID NO: 724763 - DNA, 13 bp, Homo sapiens
tgcccctttcctt

SEQ ID NO: 724764 - DNA, 17 bp, Homo sapiens
tgcccctttccttcact

SEQ ID NO: 724765 - DNA, 19 bp, Homo sapiens
tgcccgaaactaagccagg

SEQ ID NO: 724766 - DNA, 20 bp, Homo sapiens
tgcccgaaactaagccaggc

SEQ ID NO: 724767 - DNA, 14 bp, Homo sapiens
tgcccgagctggtg

SEQ ID NO: 724768 - DNA, 16 bp, Homo sapiens
tgcccgagctggtgca

SEQ ID NO: 724769 - DNA, 19 bp, Homo sapiens
tgcccgagctggtgcatta

SEQ ID NO: 724770 - DNA, 17 bp, Homo sapiens
tgcccgaggcgccagct

SEQ ID NO: 724771 - DNA, 21 bp, Homo sapiens
tgcccgagtccgcccatccct

SEQ ID NO: 724772 - DNA, 22 bp, Homo sapiens
tgcccgagtccgcccatccctg

SEQ ID NO: 724773 - DNA, 16 bp, Homo sapiens
tgcccgcagagcccac

SEQ ID NO: 724774 - DNA, 15 bp, Homo sapiens
tgcccgcatgtgtgc

SEQ ID NO: 724775 - DNA, 14 bp, Homo sapiens
tgcccgccagcctc

SEQ ID NO: 724776 - DNA, 16 bp, Homo sapiens
tgcccgccagcctcag

SEQ ID NO: 724777 - DNA, 12 bp, Homo sapiens
tgcccgcctagg

SEQ ID NO: 724778 - DNA, 21 bp, Homo sapiens
tgcccgcgggagacagcttct

SEQ ID NO: 724779 - DNA, 22 bp, Homo sapiens
tgcccgcgggagacagcttctc

SEQ ID NO: 724780 - DNA, 23 bp, Homo sapiens
tgcccgcgggagacagcttctct

SEQ ID NO: 724781 - DNA, 13 bp, Homo sapiens
tgcccgctcccaa

SEQ ID NO: 724782 - DNA, 14 bp, Homo sapiens
tgcccgctcccaac

SEQ ID NO: 724783 - DNA, 20 bp, Homo sapiens
tgcccgctcccaacccccct

SEQ ID NO: 724784 - DNA, 13 bp, Homo sapiens
tgcccgctcctcg

SEQ ID NO: 724785 - DNA, 21 bp, Homo sapiens
tgcccggagattggacggcct

SEQ ID NO: 724786 - DNA, 19 bp, Homo sapiens
tgcccggaggccgggccct

SEQ ID NO: 724787 - DNA, 15 bp, Homo sapiens
tgcccggattctggg

SEQ ID NO: 724788 - DNA, 16 bp, Homo sapiens
tgcccggattctggga

SEQ ID NO: 724789 - DNA, 17 bp, Homo sapiens
tgcccggattctgggag

SEQ ID NO: 724790 - DNA, 18 bp, Homo sapiens
tgcccggattctgggagg

SEQ ID NO: 724791 - DNA, 22 bp, Homo sapiens
tgcccggccccaccccctgggc

SEQ ID NO: 724792 - DNA, 16 bp, Homo sapiens
tgcccggcgcctgccc

SEQ ID NO: 724793 - DNA, 17 bp, Homo sapiens
tgcccggcgcctgccct

SEQ ID NO: 724794 - DNA, 24 bp, Homo sapiens
tgcccggcgcctgccctgcccaag

SEQ ID NO: 724795 - DNA, 22 bp, Homo sapiens
tgcccggggagctgcagagcag

SEQ ID NO: 724796 - DNA, 23 bp, Homo sapiens
tgcccggggcagctgccagagaa

SEQ ID NO: 724797 - DNA, 21 bp, Homo sapiens
tgcccggtggtttgccatgtc

SEQ ID NO: 724798 - DNA, 18 bp, Homo sapiens
tgcccgtcggccctgcgt

SEQ ID NO: 724799 - DNA, 18 bp, Homo sapiens
tgcccgtcttcagcctag

SEQ ID NO: 724800 - DNA, 20 bp, Homo sapiens
tgcccgtgaagcgtgttttt

SEQ ID NO: 724801 - DNA, 17 bp, Homo sapiens
tgccctaaagtgtattt

SEQ ID NO: 724802 - DNA, 23 bp, Homo sapiens
tgccctaagtgatttccacaggt

SEQ ID NO: 724803 - DNA, 15 bp, Homo sapiens
tgccctagaccctcc

SEQ ID NO: 724804 - DNA, 17 bp, Homo sapiens
tgccctagagcacactg

SEQ ID NO: 724805 - DNA, 23 bp, Homo sapiens
tgccctagagcacactgtagcat

SEQ ID NO: 724806 - DNA, 17 bp, Homo sapiens
tgccctagatcaacaga

SEQ ID NO: 724807 - DNA, 17 bp, Homo sapiens
tgccctagcccagactc

SEQ ID NO: 724808 - DNA, 20 bp, Homo sapiens
tgccctagcccagactctga

SEQ ID NO: 724809 - DNA, 16 bp, Homo sapiens
tgcctgctttttggaa

SEQ ID NO: 724810 - DNA, 21 bp, Homo sapiens
tgcctggacatttgccttgct

SEQ ID NO: 724811 - DNA, 22 bp, Homo sapiens
tgcctggagacgtggaacctct

SEQ ID NO: 724812 - DNA, 20 bp, Homo sapiens
tgcctggagacttagggcac

SEQ ID NO: 724813 - DNA, 10 bp, Homo sapiens
tgcctggagg

SEQ ID NO: 724814 - DNA, 14 bp, Homo sapiens
tgcctggagtgtcg

SEQ ID NO: 724815 - DNA, 22 bp, Homo sapiens
tgcctggagttgactgactgag

SEQ ID NO: 724816 - DNA, 22 bp, Homo sapiens
tgcctggatgaggcacttctgt

SEQ ID NO: 724817 - DNA, 18 bp, Homo sapiens
tgcctggatgggggtgca

SEQ ID NO: 724818 - DNA, 15 bp, Homo sapiens
tgcctggccactgct

SEQ ID NO: 724819 - DNA, 14 bp, Homo sapiens
tgcctggccagatt

SEQ ID NO: 724820 - DNA, 18 bp, Homo sapiens
tgcctggccatgctgtcc

SEQ ID NO: 724821 - DNA, 20 bp, Homo sapiens
tgcctggccatgtcacctgg

SEQ ID NO: 724822 - DNA, 14 bp, Homo sapiens
tgcctggccccagc

SEQ ID NO: 724823 - DNA, 16 bp, Homo sapiens
tgcctggccccagcct

SEQ ID NO: 724824 - DNA, 12 bp, Homo sapiens
tgcctggccccc

SEQ ID NO: 724825 - DNA, 19 bp, Homo sapiens
tgcctggcctgccagacac

SEQ ID NO: 724826 - DNA, 13 bp, Homo sapiens
tgcctggcctggc

SEQ ID NO: 724827 - DNA, 19 bp, Homo sapiens
tgcctggcctggctcccca

SEQ ID NO: 724828 - DNA, 15 bp, Homo sapiens
tgcctggctaacttt

SEQ ID NO: 724829 - DNA, 11 bp, Homo sapiens
tgcctggctgt

SEQ ID NO: 724830 - DNA, 12 bp, Homo sapiens
tgcctggctgtg

SEQ ID NO: 724831 - DNA, 14 bp, Homo sapiens
tgcctggctgtgga

SEQ ID NO: 724832 - DNA, 17 bp, Homo sapiens
tgcctggctgtggaggc

SEQ ID NO: 724833 - DNA, 20 bp, Homo sapiens
tgcctgggaagcccacccag

SEQ ID NO: 724834 - DNA, 21 bp, Homo sapiens
tgcctgggaaggcgagtctgg

SEQ ID NO: 724835 - DNA, 14 bp, Homo sapiens
tgcctgggaatgta

SEQ ID NO: 724836 - DNA, 20 bp, Homo sapiens
tgcctgggagccagggtgag

SEQ ID NO: 724837 - DNA, 20 bp, Homo sapiens
tgcctgggatgggctcccac

SEQ ID NO: 724838 - DNA, 22 bp, Homo sapiens
tgcctgggccatgcgaggggcc

SEQ ID NO: 724839 - DNA, 16 bp, Homo sapiens
tgcctgggcccctccc

SEQ ID NO: 724840 - DNA, 17 bp, Homo sapiens
tgcctgggcccctcccc

SEQ ID NO: 724841 - DNA, 22 bp, Homo sapiens
tgcctgggcccggaagggcttt

SEQ ID NO: 724842 - DNA, 17 bp, Homo sapiens
tgcctgggcctgtgcag

SEQ ID NO: 724843 - DNA, 20 bp, Homo sapiens
tgcctgggcctgtgcagcag

SEQ ID NO: 724844 - DNA, 21 bp, Homo sapiens
tgcctgggcctgtgcagcagc

SEQ ID NO: 724845 - DNA, 15 bp, Homo sapiens
tgcctgggctctgga

SEQ ID NO: 724846 - DNA, 18 bp, Homo sapiens
tgcctgggctctggaaga

SEQ ID NO: 724847 - DNA, 12 bp, Homo sapiens
tgcctgggctgt

SEQ ID NO: 724848 - DNA, 16 bp, Homo sapiens
tgcctgggctgttggc

SEQ ID NO: 724849 - DNA, 21 bp, Homo sapiens
tgcctggggcccaagttgcag

SEQ ID NO: 724850 - DNA, 20 bp, Homo sapiens
tgcctgggggagttttcctc

SEQ ID NO: 724851 - DNA, 16 bp, Homo sapiens
tgcctgggtggccatc

SEQ ID NO: 724852 - DNA, 23 bp, Homo sapiens
tgcctggtatatccaaaagcttt

SEQ ID NO: 724853 - DNA, 16 bp, Homo sapiens
tgcctggtattttcaa

SEQ ID NO: 724854 - DNA, 15 bp, Homo sapiens
tgcctggtcaccctg

SEQ ID NO: 724855 - DNA, 23 bp, Homo sapiens
tgcctggtcaccctggggctgct

SEQ ID NO: 724856 - DNA, 18 bp, Homo sapiens
tgcctggtctgtctggat

SEQ ID NO: 724857 - DNA, 19 bp, Homo sapiens
tgcctggtctgtctggatc

SEQ ID NO: 724858 - DNA, 18 bp, Homo sapiens
tgcctggtttgatttttt

SEQ ID NO: 724859 - DNA, 15 bp, Homo sapiens
tgcctgtaaacatag

SEQ ID NO: 724860 - DNA, 20 bp, Homo sapiens
tgcctgtagccccagtgaca

SEQ ID NO: 724861 - DNA, 21 bp, Homo sapiens
tgcctgtagccccagtgacag

SEQ ID NO: 724862 - DNA, 20 bp, Homo sapiens
tgcctgtagtcccagctact

SEQ ID NO: 724863 - DNA, 15 bp, Homo sapiens
tgcctgtagttagga

SEQ ID NO: 724864 - DNA, 19 bp, Homo sapiens
tgcctgtagttaggaaata

SEQ ID NO: 724865 - DNA, 22 bp, Homo sapiens
tgcctgtagttaggaaataaaa

SEQ ID NO: 724866 - DNA, 19 bp, Homo sapiens
tgcctgtcacctgggaggg

SEQ ID NO: 724867 - DNA, 18 bp, Homo sapiens
tgcctgtccagcctgggc

SEQ ID NO: 724868 - DNA, 22 bp, Homo sapiens
tgcctgtccccaaacaggacag

SEQ ID NO: 724869 - DNA, 11 bp, Homo sapiens
tgcctgtccct

SEQ ID NO: 724870 - DNA, 14 bp, Homo sapiens
tgcctgtccctctc

SEQ ID NO: 724871 - DNA, 22 bp, Homo sapiens
tgcctgtctaaagccttaacta

SEQ ID NO: 724872 - DNA, 13 bp, Homo sapiens
tgcctgtctgccc

SEQ ID NO: 724873 - DNA, 15 bp, Homo sapiens
tgcctgtctgcccca

SEQ ID NO: 724874 - DNA, 17 bp, Homo sapiens
tgcctgtctggctcagg

SEQ ID NO: 724875 - DNA, 17 bp, Homo sapiens
tgcctgtgaggcagggg

SEQ ID NO: 724876 - DNA, 15 bp, Homo sapiens
tgcctgtgcatgacc

SEQ ID NO: 724877 - DNA, 21 bp, Homo sapiens
tgcccactgtttctcttgagc

SEQ ID NO: 724878 - DNA, 19 bp, Homo sapiens
tgcccacttgattgagaaa

SEQ ID NO: 724879 - DNA, 19 bp, Homo sapiens
tgcccagaataagttattg

SEQ ID NO: 724880 - DNA, 23 bp, Homo sapiens
tgcccagacacagactggcaata

SEQ ID NO: 724881 - DNA, 16 bp, Homo sapiens
tgcccagactgatgag

SEQ ID NO: 724882 - DNA, 17 bp, Homo sapiens
tgcccagagatgcctcc

SEQ ID NO: 724883 - DNA, 15 bp, Homo sapiens
tgcccagagttgctg

SEQ ID NO: 724884 - DNA, 13 bp, Homo sapiens
tgcccagcagagg

SEQ ID NO: 724885 - DNA, 16 bp, Homo sapiens
tgcccagcagctcaag

SEQ ID NO: 724886 - DNA, 12 bp, Homo sapiens
tgcccagcaggc

SEQ ID NO: 724887 - DNA, 20 bp, Homo sapiens
tgcccagcaggcccagcatg

SEQ ID NO: 724888 - DNA, 13 bp, Homo sapiens
tgcccagccactc

SEQ ID NO: 724889 - DNA, 14 bp, Homo sapiens
tgcccagccactcc

SEQ ID NO: 724890 - DNA, 12 bp, Homo sapiens
tgcccagccagc

SEQ ID NO: 724891 - DNA, 15 bp, Homo sapiens
tgcccagccagccac

SEQ ID NO: 724892 - DNA, 23 bp, Homo sapiens
tgcccagccagccacccctgcca

SEQ ID NO: 724893 - DNA, 12 bp, Homo sapiens
tgcccagcccct

SEQ ID NO: 724894 - DNA, 22 bp, Homo sapiens
tgcccagccccttttctctgct

SEQ ID NO: 724895 - DNA, 20 bp, Homo sapiens
tgcccagcccggaccttggc

SEQ ID NO: 724896 - DNA, 14 bp, Homo sapiens
tgcccagctcctca

SEQ ID NO: 724897 - DNA, 21 bp, Homo sapiens
tgcccagctctctgacgcttg

SEQ ID NO: 724898 - DNA, 20 bp, Homo sapiens
tgcccagctgctcccctgcc

SEQ ID NO: 724899 - DNA, 13 bp, Homo sapiens
tgcccagcttggg

SEQ ID NO: 724900 - DNA, 18 bp, Homo sapiens
tgcccagcttgggcccag

SEQ ID NO: 724901 - DNA, 23 bp, Homo sapiens
tgcccagcttgggcccagctggg

SEQ ID NO: 724902 - DNA, 19 bp, Homo sapiens
tgcccaggagacagaccac

SEQ ID NO: 724903 - DNA, 19 bp, Homo sapiens
tgcccaggagagccagccc

SEQ ID NO: 724904 - DNA, 21 bp, Homo sapiens
tgcccaggagagccagccctc

SEQ ID NO: 724905 - DNA, 22 bp, Homo sapiens
tgcccaggagagccagccctcc

SEQ ID NO: 724906 - DNA, 23 bp, Homo sapiens
tgcccaggagagccagccctccc

SEQ ID NO: 724907 - DNA, 17 bp, Homo sapiens
tgcccaggcccttggct

SEQ ID NO: 724908 - DNA, 20 bp, Homo sapiens
tgcccaggcccttggctgca

SEQ ID NO: 724909 - DNA, 15 bp, Homo sapiens
tgcccaggcctgcct

SEQ ID NO: 724910 - DNA, 13 bp, Homo sapiens
tgcccaggctgga

SEQ ID NO: 724911 - DNA, 17 bp, Homo sapiens
tgcccagggctcagcct

SEQ ID NO: 724912 - DNA, 18 bp, Homo sapiens
tgcccagggctcagcctg

SEQ ID NO: 724913 - DNA, 12 bp, Homo sapiens
tgcctgtgccaa

SEQ ID NO: 724914 - DNA, 14 bp, Homo sapiens
tgcctgtgccaccc

SEQ ID NO: 724915 - DNA, 16 bp, Homo sapiens
tgcctgtgccacccac

SEQ ID NO: 724916 - DNA, 20 bp, Homo sapiens
tgcctgtgccacccaccagg

SEQ ID NO: 724917 - DNA, 16 bp, Homo sapiens
tgcctgtgccatgccc

SEQ ID NO: 724918 - DNA, 11 bp, Homo sapiens
tgcctgtggcg

SEQ ID NO: 724919 - DNA, 15 bp, Homo sapiens
tgcctgtgtatggaa

SEQ ID NO: 724920 - DNA, 21 bp, Homo sapiens
tgcctgtgtccatgcgctcag

SEQ ID NO: 724921 - DNA, 13 bp, Homo sapiens
tgcctgtgtcctg

SEQ ID NO: 724922 - DNA, 21 bp, Homo sapiens
tgcctgtgtgacatcagtggc

SEQ ID NO: 724923 - DNA, 22 bp, Homo sapiens
tgcctgttggcaggcccactcc

SEQ ID NO: 724924 - DNA, 16 bp, Homo sapiens
tgcctgtttcccaggc

SEQ ID NO: 724925 - DNA, 15 bp, Homo sapiens
tgccttaaaaccaaa

SEQ ID NO: 724926 - DNA, 18 bp, Homo sapiens
tgccttaaaaccaaagag

SEQ ID NO: 724927 - DNA, 19 bp, Homo sapiens
tgccttaaacactcacctt

SEQ ID NO: 724928 - DNA, 22 bp, Homo sapiens
tgccttaaacactcaccttcta

SEQ ID NO: 724929 - DNA, 17 bp, Homo sapiens
tgccttaaacctacctc

SEQ ID NO: 724930 - DNA, 18 bp, Homo sapiens
tgccttaaacctacctcc

SEQ ID NO: 724931 - DNA, 19 bp, Homo sapiens
tgccttaaacctgaagatg

SEQ ID NO: 724932 - DNA, 13 bp, Homo sapiens
tgccttaaatata

SEQ ID NO: 724933 - DNA, 23 bp, Homo sapiens
tgccttaagcagaacaaatgtgt

SEQ ID NO: 724934 - DNA, 18 bp, Homo sapiens
tgccttaataaatatgta

SEQ ID NO: 724935 - DNA, 17 bp, Homo sapiens
tgccttacctcctgccc

SEQ ID NO: 724936 - DNA, 20 bp, Homo sapiens
tgccttacctcctgcccagg

SEQ ID NO: 724937 - DNA, 22 bp, Homo sapiens
tgccttactggtttccccaggg

SEQ ID NO: 724938 - DNA, 22 bp, Homo sapiens
tgccttagaaatgtaaactgcc

SEQ ID NO: 724939 - DNA, 23 bp, Homo sapiens
tgccttagaaatgtaaactgcca

SEQ ID NO: 724940 - DNA, 17 bp, Homo sapiens
tgccttagaacctttct

SEQ ID NO: 724941 - DNA, 19 bp, Homo sapiens
tgccttagcctcttggaaa

SEQ ID NO: 724942 - DNA, 16 bp, Homo sapiens
tgccttaggcctacct

SEQ ID NO: 724943 - DNA, 17 bp, Homo sapiens
tgccttaggcctacctg

SEQ ID NO: 724944 - DNA, 14 bp, Homo sapiens
tgccttatcttgca

SEQ ID NO: 724945 - DNA, 14 bp, Homo sapiens
tgccttatttgtct

SEQ ID NO: 724946 - DNA, 15 bp, Homo sapiens
tgccttcaaggactg

SEQ ID NO: 724947 - DNA, 20 bp, Homo sapiens
tgccttcaaggactgtttca

SEQ ID NO: 724948 - DNA, 15 bp, Homo sapiens
tgccttcacaaatgt

SEQ ID NO: 724949 - DNA, 13 bp, Homo sapiens
tgccttcagctct

SEQ ID NO: 724950 - DNA, 13 bp, Homo sapiens
tgccttcaggaat

SEQ ID NO: 724951 - DNA, 18 bp, Homo sapiens
tgccttcatcttcactgc

SEQ ID NO: 724952 - DNA, 20 bp, Homo sapiens
tgccttccaaacctgagaat

SEQ ID NO: 724953 - DNA, 19 bp, Homo sapiens
tgccttccacgctgtctcc

SEQ ID NO: 724954 - DNA, 21 bp, Homo sapiens
tgccttccacgctgtctccag

SEQ ID NO: 724955 - DNA, 13 bp, Homo sapiens
tgccttccataat

SEQ ID NO: 724956 - DNA, 14 bp, Homo sapiens
tgccttccataatt

SEQ ID NO: 724957 - DNA, 14 bp, Homo sapiens
tgccttcctcctgg

SEQ ID NO: 724958 - DNA, 19 bp, Homo sapiens
tgccttcctcctgggccct

SEQ ID NO: 724959 - DNA, 20 bp, Homo sapiens
tgccttcctcctgggccctc

SEQ ID NO: 724960 - DNA, 14 bp, Homo sapiens
tgccttcctcgtgc

SEQ ID NO: 724961 - DNA, 16 bp, Homo sapiens
tgccttcctcgtgcag

SEQ ID NO: 724962 - DNA, 15 bp, Homo sapiens
tgccttcctctctct

SEQ ID NO: 724963 - DNA, 15 bp, Homo sapiens
tgccttcctctgagg

SEQ ID NO: 724964 - DNA, 12 bp, Homo sapiens
tgctcctctcca

SEQ ID NO: 724965 - DNA, 17 bp, Homo sapiens
tgctcctcttgattcct

SEQ ID NO: 724966 - DNA, 19 bp, Homo sapiens
tgctcctctttcccctcct

SEQ ID NO: 724967 - DNA, 16 bp, Homo sapiens
tgctcctgccaaccac

SEQ ID NO: 724968 - DNA, 16 bp, Homo sapiens
tgctcctgcccagcca

SEQ ID NO: 724969 - DNA, 17 bp, Homo sapiens
tgctcctgcccagccac

SEQ ID NO: 724970 - DNA, 21 bp, Homo sapiens
tgctcctgcccagccacccct

SEQ ID NO: 724971 - DNA, 13 bp, Homo sapiens
tgctcctgctttt

SEQ ID NO: 724972 - DNA, 19 bp, Homo sapiens
tgctcctgcttttctgtcc

SEQ ID NO: 724973 - DNA, 20 bp, Homo sapiens
tgctcctgcttttctgtcct

SEQ ID NO: 724974 - DNA, 21 bp, Homo sapiens
tgctcctggagcctttgaata

SEQ ID NO: 724975 - DNA, 14 bp, Homo sapiens
tgctcctggggaga

SEQ ID NO: 724976 - DNA, 22 bp, Homo sapiens
tgctcctggggagaaagagggg

SEQ ID NO: 724977 - DNA, 22 bp, Homo sapiens
tgctcctgtacttgtcctcagc

SEQ ID NO: 724978 - DNA, 17 bp, Homo sapiens
tgctccttcactgttcc

SEQ ID NO: 724979 - DNA, 17 bp, Homo sapiens
tgctccttgagaggaga

SEQ ID NO: 724980 - DNA, 15 bp, Homo sapiens
tgctccttggcttac

SEQ ID NO: 724981 - DNA, 19 bp, Homo sapiens
tgctccttggcttacctga

SEQ ID NO: 724982 - DNA, 18 bp, Homo sapiens
tgctccttgtggcctttt

SEQ ID NO: 724983 - DNA, 16 bp, Homo sapiens
tgctcctttaccctct

SEQ ID NO: 724984 - DNA, 18 bp, Homo sapiens
tgctcctttaccctcttg

SEQ ID NO: 724985 - DNA, 21 bp, Homo sapiens
tgctccttttgtatcttcctt

SEQ ID NO: 724986 - DNA, 17 bp, Homo sapiens
tgctcgagacacagtga

SEQ ID NO: 724987 - DNA, 18 bp, Homo sapiens
tgctcgagtcacattctg

SEQ ID NO: 724988 - DNA, 14 bp, Homo sapiens
tgctcgccccagca

SEQ ID NO: 724989 - DNA, 23 bp, Homo sapiens
tgctcgccctcctttctgtgccc

SEQ ID NO: 724990 - DNA, 20 bp, Homo sapiens
tgctcggagaagagcgcagt

SEQ ID NO: 724991 - DNA, 22 bp, Homo sapiens
tgctcggcttgatcacagctcc

SEQ ID NO: 724992 - DNA, 16 bp, Homo sapiens
tgctcgggaagggagg

SEQ ID NO: 724993 - DNA, 17 bp, Homo sapiens
tgctcgggaagggaggg

SEQ ID NO: 724994 - DNA, 21 bp, Homo sapiens
tgctctaatgagcatttcctt

SEQ ID NO: 724995 - DNA, 21 bp, Homo sapiens
tgctctaatgatcaaaacatg

SEQ ID NO: 724996 - DNA, 19 bp, Homo sapiens
tgctctacccatgagcctg

SEQ ID NO: 724997 - DNA, 23 bp, Homo sapiens
tgctctacccatgagcctgcccg

SEQ ID NO: 724998 - DNA, 14 bp, Homo sapiens
tgctctactttgag

SEQ ID NO: 724999 - DNA, 15 bp, Homo sapiens
tgctctactttgaga

SEQ ID NO: 725000 - DNA, 22 bp, Homo sapiens
tgctctagccaggagtctgtgc

SEQ ID NO: 725001 - DNA, 15 bp, Homo sapiens
tgctctagctggcag

SEQ ID NO: 725002 - DNA, 18 bp, Homo sapiens
tgctctagctggcaggac

SEQ ID NO: 725003 - DNA, 19 bp, Homo sapiens
tgctctagctggcaggaca

SEQ ID NO: 725004 - DNA, 15 bp, Homo sapiens
tgctctagggaatct

SEQ ID NO: 725005 - DNA, 14 bp, Homo sapiens
tgctctagtgcctt

SEQ ID NO: 725006 - DNA, 18 bp, Homo sapiens
tgctctagtgggacagcc

SEQ ID NO: 725007 - DNA, 17 bp, Homo sapiens
tgctctatgtctgcctt

SEQ ID NO: 725008 - DNA, 22 bp, Homo sapiens
tgctctatgtttgtatttggaa

SEQ ID NO: 725009 - DNA, 14 bp, Homo sapiens
tgctctattaagat

SEQ ID NO: 725010 - DNA, 22 bp, Homo sapiens
tgctctcactgtttgtttttat

SEQ ID NO: 725011 - DNA, 16 bp, Homo sapiens
tgctctcagcctccca

SEQ ID NO: 725012 - DNA, 17 bp, Homo sapiens
tgctctcagcctcccac

SEQ ID NO: 725013 - DNA, 18 bp, Homo sapiens
tgctctcagcctcccaca

SEQ ID NO: 725014 - DNA, 19 bp, Homo sapiens
tgctctcagcctcccacaa

SEQ ID NO: 725015 - DNA, 19 bp, Homo sapiens
tgctctccccggcaggcct

SEQ ID NO: 725016 - DNA, 22 bp, Homo sapiens
tgctctccccggcaggcctgag

SEQ ID NO: 725017 - DNA, 17 bp, Homo sapiens
tgctctcccctgccctg

SEQ ID NO: 725018 - DNA, 22 bp, Homo sapiens
tgctctccctcttctcaagtgc

SEQ ID NO: 725019 - DNA, 22 bp, Homo sapiens
tgctctcctcttgccactgcct

SEQ ID NO: 725020 - DNA, 17 bp, Homo sapiens
tgctctctcatcttgtt

SEQ ID NO: 725021 - DNA, 20 bp, Homo sapiens
tgctctctcatcttgttctt

SEQ ID NO: 725022 - DNA, 14 bp, Homo sapiens
tgctctctgcagcc

SEQ ID NO: 725023 - DNA, 13 bp, Homo sapiens
tgctctctgccac

SEQ ID NO: 725024 - DNA, 12 bp, Homo sapiens
tgctctctgctc

SEQ ID NO: 725025 - DNA, 17 bp, Homo sapiens
tgctctctgctcatggg

SEQ ID NO: 725026 - DNA, 12 bp, Homo sapiens
tgctctcttcag

SEQ ID NO: 725027 - DNA, 14 bp, Homo sapiens
tgctctcttcagga

SEQ ID NO: 725028 - DNA, 22 bp, Homo sapiens
tgctctcttgtgacgtgcactg

SEQ ID NO: 725029 - DNA, 15 bp, Homo sapiens
tgctctctttctgtc

SEQ ID NO: 725030 - DNA, 17 bp, Homo sapiens
tgctctgaagtgtccta

SEQ ID NO: 725031 - DNA, 19 bp, Homo sapiens
tgctctgaatctgtacatg

SEQ ID NO: 725032 - DNA, 15 bp, Homo sapiens
tgctctgaccttcca

SEQ ID NO: 725033 - DNA, 11 bp, Homo sapiens
tgctctgagaa

SEQ ID NO: 725034 - DNA, 14 bp, Homo sapiens
tgctctgagcacag

SEQ ID NO: 725035 - DNA, 16 bp, Homo sapiens
tgctctgagccacagt

SEQ ID NO: 725036 - DNA, 23 bp, Homo sapiens
tgctctgaggtcaataaagcaga

SEQ ID NO: 725037 - DNA, 16 bp, Homo sapiens
tgctctgatccctcta

SEQ ID NO: 725038 - DNA, 19 bp, Homo sapiens
tgctctgatccctctacag

SEQ ID NO: 725039 - DNA, 19 bp, Homo sapiens
tgctctgcaggctggggag

SEQ ID NO: 725040 - DNA, 15 bp, Homo sapiens
tgctctgcatgttac

SEQ ID NO: 725041 - DNA, 14 bp, Homo sapiens
tgctctgccatctt

SEQ ID NO: 725042 - DNA, 16 bp, Homo sapiens
tgctctgccccaagcc

SEQ ID NO: 725043 - DNA, 14 bp, Homo sapiens
tgctctgccccttg

SEQ ID NO: 725044 - DNA, 11 bp, Homo sapiens
tgctctgccct

SEQ ID NO: 725045 - DNA, 13 bp, Homo sapiens
tgctctgcctcag

SEQ ID NO: 725046 - DNA, 12 bp, Homo sapiens
tgctctgcctgg

SEQ ID NO: 725047 - DNA, 12 bp, Homo sapiens
tgctctggaata

SEQ ID NO: 725048 - DNA, 22 bp, Homo sapiens
tgctctggaataaagttgcaga

SEQ ID NO: 725049 - DNA, 12 bp, Homo sapiens
tgctctggagca

SEQ ID NO: 725050 - DNA, 13 bp, Homo sapiens
tgctctggagcag

SEQ ID NO: 725051 - DNA, 15 bp, Homo sapiens
tgctctggagcagcc

SEQ ID NO: 725052 - DNA, 17 bp, Homo sapiens
tgctctggagcagccaa

SEQ ID NO: 725053 - DNA, 17 bp, Homo sapiens
tgctctggagcctgcag

SEQ ID NO: 725054 - DNA, 20 bp, Homo sapiens
tgctctggagtgtgcatttc

SEQ ID NO: 725055 - DNA, 22 bp, Homo sapiens
tgctctggcggcttcctgtcca

SEQ ID NO: 725056 - DNA, 23 bp, Homo sapiens
tgctctggcggcttcctgtccac

SEQ ID NO: 725057 - DNA, 18 bp, Homo sapiens
tgctctgggctcactgca

SEQ ID NO: 725058 - DNA, 12 bp, Homo sapiens
tgctctggggat

SEQ ID NO: 725059 - DNA, 14 bp, Homo sapiens
tgctctggggattt

SEQ ID NO: 725060 - DNA, 18 bp, Homo sapiens
tgctctgggggtcccttg

SEQ ID NO: 725061 - DNA, 22 bp, Homo sapiens
tgctctggtggcttaagtgagc

SEQ ID NO: 725062 - DNA, 12 bp, Homo sapiens
tgctctgtcccc

SEQ ID NO: 725063 - DNA, 22 bp, Homo sapiens
tgctctgtcccccaggctggag

SEQ ID NO: 725064 - DNA, 13 bp, Homo sapiens
tgctctgtctccc

SEQ ID NO: 725065 - DNA, 14 bp, Homo sapiens
tgctcttaaaatat

SEQ ID NO: 725066 - DNA, 15 bp, Homo sapiens
tgctcttaaaatatc

SEQ ID NO: 725067 - DNA, 15 bp, Homo sapiens
tgctcttaagcctaa

SEQ ID NO: 725068 - DNA, 15 bp, Homo sapiens
tgctcttagctgtct

SEQ ID NO: 725069 - DNA, 17 bp, Homo sapiens
tgctcttagtcccaagc

SEQ ID NO: 725070 - DNA, 23 bp, Homo sapiens
tgctcttctgtggaccactgcat

SEQ ID NO: 725071 - DNA, 17 bp, Homo sapiens
tgctcttctttctgaga

SEQ ID NO: 725072 - DNA, 18 bp, Homo sapiens
tgctcttgtcctagcttg

SEQ ID NO: 725073 - DNA, 18 bp, Homo sapiens
tgctcttgttctgttcct

SEQ ID NO: 725074 - DNA, 14 bp, Homo sapiens
tgctcttgtttcac

SEQ ID NO: 725075 - DNA, 21 bp, Homo sapiens
tgctcttgtttcactccacca

SEQ ID NO: 725076 - DNA, 24 bp, Homo sapiens
tgctcttgtttcactccaccatca

SEQ ID NO: 725077 - DNA, 16 bp, Homo sapiens
tgctctttctactctg

SEQ ID NO: 725078 - DNA, 12 bp, Homo sapiens
tgctctttctct

SEQ ID NO: 725079 - DNA, 15 bp, Homo sapiens
tgctctttctctgcc

SEQ ID NO: 725080 - DNA, 18 bp, Homo sapiens
tgctctttctctgccagt

SEQ ID NO: 725081 - DNA, 19 bp, Homo sapiens
tgctctttgacaactaaaa

SEQ ID NO: 725082 - DNA, 22 bp, Homo sapiens
tgctctttgacaactaaaatta

SEQ ID NO: 725083 - DNA, 15 bp, Homo sapiens
tgctcttttaaaata

SEQ ID NO: 725084 - DNA, 15 bp, Homo sapiens
tgctcttttctcctc

SEQ ID NO: 725085 - DNA, 12 bp, Homo sapiens
tgctcttttgtg

SEQ ID NO: 725086 - DNA, 15 bp, Homo sapiens
tgctcttttgtgatg

SEQ ID NO: 725087 - DNA, 18 bp, Homo sapiens
tgctgaacacagtgtctg

SEQ ID NO: 725088 - DNA, 20 bp, Homo sapiens
tgctgaacacagtgtctgtt

SEQ ID NO: 725089 - DNA, 19 bp, Homo sapiens
tgctgaacattgcatataa

SEQ ID NO: 725090 - DNA, 17 bp, Homo sapiens
tgctgaacgcagaagaa

SEQ ID NO: 725091 - DNA, 19 bp, Homo sapiens
tgctgaactcagcacattc

SEQ ID NO: 725092 - DNA, 15 bp, Homo sapiens
tgctgaactgtgcat

SEQ ID NO: 725093 - DNA, 17 bp, Homo sapiens
tgctgaactgtgcatca

SEQ ID NO: 725094 - DNA, 17 bp, Homo sapiens
tgctgaagacatgtttc

SEQ ID NO: 725095 - DNA, 13 bp, Homo sapiens
tgctgaagagagg

SEQ ID NO: 725096 - DNA, 23 bp, Homo sapiens
tgctgaagagaggtgccggggag

SEQ ID NO: 725097 - DNA, 23 bp, Homo sapiens
tgctgaaggaataaattgctcct

SEQ ID NO: 725098 - DNA, 13 bp, Homo sapiens
tgctgaagggacc

SEQ ID NO: 725099 - DNA, 22 bp, Homo sapiens
tgctgaagggaccttgaagggt

SEQ ID NO: 725100 - DNA, 15 bp, Homo sapiens
tgctgaaggtccagg

SEQ ID NO: 725101 - DNA, 21 bp, Homo sapiens
tgctgaatacgctaagcctgg

SEQ ID NO: 725102 - DNA, 17 bp, Homo sapiens
tgctgaatggttttcaa

SEQ ID NO: 725103 - DNA, 18 bp, Homo sapiens
tgctgaatggttttcaaa

SEQ ID NO: 725104 - DNA, 20 bp, Homo sapiens
tgctgaatgttgggactgct

SEQ ID NO: 725105 - DNA, 14 bp, Homo sapiens
tgctgacagctctt

SEQ ID NO: 725106 - DNA, 20 bp, Homo sapiens
tgctgacaggtgatgctctg

SEQ ID NO: 725107 - DNA, 23 bp, Homo sapiens
tgctgacaggtgatgctctggct

SEQ ID NO: 725108 - DNA, 18 bp, Homo sapiens
tgctgacattcacctgcc

SEQ ID NO: 725109 - DNA, 17 bp, Homo sapiens
tgctgaccaaatggcca

SEQ ID NO: 725110 - DNA, 21 bp, Homo sapiens
tgctgaccaaatggccagttt

SEQ ID NO: 725111 - DNA, 14 bp, Homo sapiens
tgctgacccaggaa

SEQ ID NO: 725112 - DNA, 13 bp, Homo sapiens
tgctgaccccagg

SEQ ID NO: 725113 - DNA, 14 bp, Homo sapiens
tgctgacctgtgca

SEQ ID NO: 725114 - DNA, 22 bp, Homo sapiens
tgctgaccttggaggaatgaca

SEQ ID NO: 725115 - DNA, 20 bp, Homo sapiens
tgctgacgggacccacatgc

SEQ ID NO: 725116 - DNA, 18 bp, Homo sapiens
tgctgactggcttcagca

SEQ ID NO: 725117 - DNA, 22 bp, Homo sapiens
tgctgactgtactcctcccagg

SEQ ID NO: 725118 - DNA, 18 bp, Homo sapiens
tgctgactgtttcattca

SEQ ID NO: 725119 - DNA, 16 bp, Homo sapiens
tgctgactgttttctc

SEQ ID NO: 725120 - DNA, 10 bp, Homo sapiens
tgctgagact

SEQ ID NO: 725121 - DNA, 15 bp, Homo sapiens
tgctgagagacccaa

SEQ ID NO: 725122 - DNA, 22 bp, Homo sapiens
tgctgagagacccaaggaggaa

SEQ ID NO: 725123 - DNA, 12 bp, Homo sapiens
tgctgagccact

SEQ ID NO: 725124 - DNA, 19 bp, Homo sapiens
tgctgagcctcacagcagt

SEQ ID NO: 725125 - DNA, 13 bp, Homo sapiens
tgctgagctgggc

SEQ ID NO: 725126 - DNA, 14 bp, Homo sapiens
tgctgagctgggcc

SEQ ID NO: 725127 - DNA, 22 bp, Homo sapiens
tgctgagctgggcccagcccct

SEQ ID NO: 725128 - DNA, 13 bp, Homo sapiens
tgctgagctgtga

SEQ ID NO: 725129 - DNA, 17 bp, Homo sapiens
tgctgagcttagccttg

SEQ ID NO: 725130 - DNA, 16 bp, Homo sapiens
tgctgaggagtctgag

SEQ ID NO: 725131 - DNA, 18 bp, Homo sapiens
tgctgaggagtctgagga

SEQ ID NO: 725132 - DNA, 19 bp, Homo sapiens
tgctgaggagtctgaggac

SEQ ID NO: 725133 - DNA, 16 bp, Homo sapiens
tgctgaggccagggct

SEQ ID NO: 725134 - DNA, 12 bp, Homo sapiens
tgctgaggcctt

SEQ ID NO: 725135 - DNA, 15 bp, Homo sapiens
tgctgaggccttctc

SEQ ID NO: 725136 - DNA, 23 bp, Homo sapiens
tgctgagggtgtttcttcctgca

SEQ ID NO: 725137 - DNA, 18 bp, Homo sapiens
tgctgagtcccaggctga

SEQ ID NO: 725138 - DNA, 20 bp, Homo sapiens
tgctgagtgaccgggggctg

SEQ ID NO: 725139 - DNA, 23 bp, Homo sapiens
tgctgagtgaccgggggctgctg

SEQ ID NO: 725140 - DNA, 15 bp, Homo sapiens
tgctgagtgctgggc

SEQ ID NO: 725141 - DNA, 18 bp, Homo sapiens
tgctgagtttcccttcct

SEQ ID NO: 725142 - DNA, 21 bp, Homo sapiens
tgctgatcatcgccagaggtg

SEQ ID NO: 725143 - DNA, 16 bp, Homo sapiens
tgctgatcctaagaat

SEQ ID NO: 725144 - DNA, 20 bp, Homo sapiens
tgctgatcttttaaaatcat

SEQ ID NO: 725145 - DNA, 21 bp, Homo sapiens
tgctgatgaactcttaatcaa

SEQ ID NO: 725146 - DNA, 15 bp, Homo sapiens
tgctgatggctgcta

SEQ ID NO: 725147 - DNA, 14 bp, Homo sapiens
tgctgattcaaacc

SEQ ID NO: 725148 - DNA, 23 bp, Homo sapiens
tgctgattcaaaccaaagctgcc

SEQ ID NO: 725149 - DNA, 13 bp, Homo sapiens
tgctgatttctag

SEQ ID NO: 725150 - DNA, 16 bp, Homo sapiens
tgctgatttctagtgt

SEQ ID NO: 725151 - DNA, 21 bp, Homo sapiens
tgctgcaaatagccttcctga

SEQ ID NO: 725152 - DNA, 22 bp, Homo sapiens
tgctgcaaatagccttcctgac

SEQ ID NO: 725153 - DNA, 19 bp, Homo sapiens
tgctgcaagcacagccctt

SEQ ID NO: 725154 - DNA, 23 bp, Homo sapiens
tgctgcaaggtggcctctgcctg

SEQ ID NO: 725155 - DNA, 20 bp, Homo sapiens
tgctgcaccctgcgcctcca

SEQ ID NO: 725156 - DNA, 21 bp, Homo sapiens
tgctgcaccctgcgcctccag

SEQ ID NO: 725157 - DNA, 23 bp, Homo sapiens
tgctgcaccctgcgcctccagag

SEQ ID NO: 725158 - DNA, 16 bp, Homo sapiens
tgctgcactaggactt

SEQ ID NO: 725159 - DNA, 17 bp, Homo sapiens
tgctgcagccaaagaca

SEQ ID NO: 725160 - DNA, 20 bp, Homo sapiens
tgctgcagccaaagacagag

SEQ ID NO: 725161 - DNA, 21 bp, Homo sapiens
tgctgcaggacttgagaagac

SEQ ID NO: 725162 - DNA, 16 bp, Homo sapiens
tgctgcaggccctccc

SEQ ID NO: 725163 - DNA, 15 bp, Homo sapiens
tgctgcaggtggcag

SEQ ID NO: 725164 - DNA, 14 bp, Homo sapiens
tgctgcatactttg

SEQ ID NO: 725165 - DNA, 15 bp, Homo sapiens
tgctgcatactttga

SEQ ID NO: 725166 - DNA, 23 bp, Homo sapiens
tgctgcatactttgacaaggaaa

SEQ ID NO: 725167 - DNA, 21 bp, Homo sapiens
tgctgcatagctctattttaa

SEQ ID NO: 725168 - DNA, 18 bp, Homo sapiens
tgctgcatttaaaagata

SEQ ID NO: 725169 - DNA, 19 bp, Homo sapiens
tgctgcatttaaaagatac

SEQ ID NO: 725170 - DNA, 14 bp, Homo sapiens
tgctgccaaaacca

SEQ ID NO: 725171 - DNA, 18 bp, Homo sapiens
tgctgccaaaaccacatg

SEQ ID NO: 725172 - DNA, 23 bp, Homo sapiens
tgctgccaaaaccacatgggctg

SEQ ID NO: 725173 - DNA, 19 bp, Homo sapiens
tgctgccaaggtggaggga

SEQ ID NO: 725174 - DNA, 21 bp, Homo sapiens
tgctgccatgacagaggctgc

SEQ ID NO: 725175 - DNA, 16 bp, Homo sapiens
tgctgccatgatgtat

SEQ ID NO: 725176 - DNA, 12 bp, Homo sapiens
tgctgccatgcc

SEQ ID NO: 725177 - DNA, 15 bp, Homo sapiens
tgctgccatgccact

SEQ ID NO: 725178 - DNA, 23 bp, Homo sapiens
tgctgccatgccactgccaggca

SEQ ID NO: 725179 - DNA, 15 bp, Homo sapiens
tgctgccattcttga

SEQ ID NO: 725180 - DNA, 20 bp, Homo sapiens
tgctgccatttgatttttct

SEQ ID NO: 725181 - DNA, 14 bp, Homo sapiens
tgctgcccagcctc

SEQ ID NO: 725182 - DNA, 16 bp, Homo sapiens
tgctgcccatgtttca

SEQ ID NO: 725183 - DNA, 20 bp, Homo sapiens
tgctgcccccaccccgggga

SEQ ID NO: 725184 - DNA, 15 bp, Homo sapiens
tgctgcccccttccc

SEQ ID NO: 725185 - DNA, 18 bp, Homo sapiens
tgctgcccccttccccag

SEQ ID NO: 725186 - DNA, 23 bp, Homo sapiens
tgctgcccccttccccagccctt

SEQ ID NO: 725187 - DNA, 19 bp, Homo sapiens
tgctgccccgttccctgtc

SEQ ID NO: 725188 - DNA, 19 bp, Homo sapiens
tgctgcccctgtctggaag

SEQ ID NO: 725189 - DNA, 13 bp, Homo sapiens
tgctgccccttgc

SEQ ID NO: 725190 - DNA, 14 bp, Homo sapiens
tgctgccccttgca

SEQ ID NO: 725191 - DNA, 23 bp, Homo sapiens
tgctgccccttgcaagccataac

SEQ ID NO: 725192 - DNA, 22 bp, Homo sapiens
tgctgccctgaagaatggcgcc

SEQ ID NO: 725193 - DNA, 15 bp, Homo sapiens
tgctgccctgcccca

SEQ ID NO: 725194 - DNA, 14 bp, Homo sapiens
tgctgccctgtgta

SEQ ID NO: 725195 - DNA, 16 bp, Homo sapiens
tgctgccgcctcccag

SEQ ID NO: 725196 - DNA, 17 bp, Homo sapiens
tgctgccgcctcccagc

SEQ ID NO: 725197 - DNA, 14 bp, Homo sapiens
tgctgcctccagaa

SEQ ID NO: 725198 - DNA, 12 bp, Homo sapiens
tgctgcctcccc

SEQ ID NO: 725199 - DNA, 14 bp, Homo sapiens
tgctgcctccccaa

SEQ ID NO: 725200 - DNA, 23 bp, Homo sapiens
tgctgcctctacacaggggccct

SEQ ID NO: 725201 - DNA, 15 bp, Homo sapiens
tgctgcctctgtgga

SEQ ID NO: 725202 - DNA, 17 bp, Homo sapiens
tgctgcctctgtggaag

SEQ ID NO: 725203 - DNA, 14 bp, Homo sapiens
tgctgcctgcctgt

SEQ ID NO: 725204 - DNA, 16 bp, Homo sapiens
tgctgcctgcctgtct

SEQ ID NO: 725205 - DNA, 20 bp, Homo sapiens
tgctgccttgctcctagcag

SEQ ID NO: 725206 - DNA, 20 bp, Homo sapiens
tgctgcgcctgcaggcagag

SEQ ID NO: 725207 - DNA, 16 bp, Homo sapiens
tgctgcgtccccactc

SEQ ID NO: 725208 - DNA, 17 bp, Homo sapiens
tgctgcgtccccactcc

SEQ ID NO: 725209 - DNA, 13 bp, Homo sapiens
tgctgctatgaaa

SEQ ID NO: 725210 - DNA, 20 bp, Homo sapiens
tgctgctatgaaaatgagca

SEQ ID NO: 725211 - DNA, 18 bp, Homo sapiens
tgctgctcaggcccatgc

SEQ ID NO: 725212 - DNA, 14 bp, Homo sapiens
tgctgctccccacc

SEQ ID NO: 725213 - DNA, 20 bp, Homo sapiens
tgctgctctggtgcacgcct

SEQ ID NO: 725214 - DNA, 17 bp, Homo sapiens
tgctgctgcctctttcc

SEQ ID NO: 725215 - DNA, 16 bp, Homo sapiens
tgctgctgcctggcca

SEQ ID NO: 725216 - DNA, 15 bp, Homo sapiens
tgctgctgcgccctt

SEQ ID NO: 725217 - DNA, 17 bp, Homo sapiens
tgctgctgctgcgccct

SEQ ID NO: 725218 - DNA, 13 bp, Homo sapiens
tgctgctgtaaat

SEQ ID NO: 725219 - DNA, 14 bp, Homo sapiens
tgctgctgtaaata

SEQ ID NO: 725220 - DNA, 16 bp, Homo sapiens
tgctgctgtaaataca

SEQ ID NO: 725221 - DNA, 20 bp, Homo sapiens
tgctgctgtaactgctgagc

SEQ ID NO: 725222 - DNA, 19 bp, Homo sapiens
tgctgctgtgaatctgaaa

SEQ ID NO: 725223 - DNA, 16 bp, Homo sapiens
tgctgctgtgcctgcg

SEQ ID NO: 725224 - DNA, 22 bp, Homo sapiens
tgctgctgtgcttttgatctct

SEQ ID NO: 725225 - DNA, 12 bp, Homo sapiens
tgctgcttctgc

SEQ ID NO: 725226 - DNA, 13 bp, Homo sapiens
tgctgcttctgct

SEQ ID NO: 725227 - DNA, 19 bp, Homo sapiens
tgctgcttgaggcaactca

SEQ ID NO: 725228 - DNA, 20 bp, Homo sapiens
tgctgcttgggacgtgtaca

SEQ ID NO: 725229 - DNA, 18 bp, Homo sapiens
tgctgcttgtgcctccct

SEQ ID NO: 725230 - DNA, 22 bp, Homo sapiens
tgctgcttgtgcctcccttccc

SEQ ID NO: 725231 - DNA, 19 bp, Homo sapiens
tgctgctttcccctgtggg

SEQ ID NO: 725232 - DNA, 21 bp, Homo sapiens
tgctgctttcccctgtgggga

SEQ ID NO: 725233 - DNA, 19 bp, Homo sapiens
tgctgctttgtccaggtga

SEQ ID NO: 725234 - DNA, 18 bp, Homo sapiens
tgctggaaacacagtcac

SEQ ID NO: 725235 - DNA, 22 bp, Homo sapiens
tgctggaaaccaagtcaggcca

SEQ ID NO: 725236 - DNA, 16 bp, Homo sapiens
tgctggaaaccacact

SEQ ID NO: 725237 - DNA, 14 bp, Homo sapiens
tgctggaacccagg

SEQ ID NO: 725238 - DNA, 19 bp, Homo sapiens
tgctggaacctgcaaaaaa

SEQ ID NO: 725239 - DNA, 21 bp, Homo sapiens
tgctggaactttagtgaaaca

SEQ ID NO: 725240 - DNA, 14 bp, Homo sapiens
tgctggaagaaact

SEQ ID NO: 725241 - DNA, 17 bp, Homo sapiens
tgctggaagctgtcagg

SEQ ID NO: 725242 - DNA, 20 bp, Homo sapiens
tgctggaaggggcagcagga

SEQ ID NO: 725243 - DNA, 16 bp, Homo sapiens
tgctggaattctaaca

SEQ ID NO: 725244 - DNA, 17 bp, Homo sapiens
tgctggaattctaacaa

SEQ ID NO: 725245 - DNA, 19 bp, Homo sapiens
tgctggacggcattcctgc

SEQ ID NO: 725246 - DNA, 21 bp, Homo sapiens
tgctggactgttccaggccct

SEQ ID NO: 725247 - DNA, 22 bp, Homo sapiens
tgctggactgttccaggccctc

SEQ ID NO: 725248 - DNA, 21 bp, Homo sapiens
tgctggaggcctcaggtgctg

SEQ ID NO: 725249 - DNA, 21 bp, Homo sapiens
tgctggaggtgacatctctta

SEQ ID NO: 725250 - DNA, 16 bp, Homo sapiens
tgctggagtccagtgc

SEQ ID NO: 725251 - DNA, 18 bp, Homo sapiens
tgctggagtccagtgctt

SEQ ID NO: 725252 - DNA, 15 bp, Homo sapiens
tgctggataaaatga

SEQ ID NO: 725253 - DNA, 17 bp, Homo sapiens
tgctggatattttcaaa

SEQ ID NO: 725254 - DNA, 23 bp, Homo sapiens
tgctggatcacagctgctttctg

SEQ ID NO: 725255 - DNA, 13 bp, Homo sapiens
tgctggatgggac

SEQ ID NO: 725256 - DNA, 15 bp, Homo sapiens
tgctggcagggccag

SEQ ID NO: 725257 - DNA, 18 bp, Homo sapiens
tgctggcagggccagggc

SEQ ID NO: 725258 - DNA, 23 bp, Homo sapiens
tgctggcagggccagggcaatgc

SEQ ID NO: 725259 - DNA, 18 bp, Homo sapiens
tgctggcatcaagaggtg

SEQ ID NO: 725260 - DNA, 17 bp, Homo sapiens
tgctggcatcaggtctg

SEQ ID NO: 725261 - DNA, 20 bp, Homo sapiens
tgctggcatcaggtctgggc

SEQ ID NO: 725262 - DNA, 14 bp, Homo sapiens
tgctggccagcacc

SEQ ID NO: 725263 - DNA, 15 bp, Homo sapiens
tgctggccagcaccc

SEQ ID NO: 725264 - DNA, 17 bp, Homo sapiens
tgctggccagcaccctc

SEQ ID NO: 725265 - DNA, 20 bp, Homo sapiens
tgctggccagcaccctctcc

SEQ ID NO: 725266 - DNA, 13 bp, Homo sapiens
tgctggccccagc

SEQ ID NO: 725267 - DNA, 16 bp, Homo sapiens
tgctggccccagccct

SEQ ID NO: 725268 - DNA, 19 bp, Homo sapiens
tgctggccccagccctgct

SEQ ID NO: 725269 - DNA, 20 bp, Homo sapiens
tgctggccccagccctgctg

SEQ ID NO: 725270 - DNA, 11 bp, Homo sapiens
tgctggccccc

SEQ ID NO: 725271 - DNA, 15 bp, Homo sapiens
tgctggcccctcacc

SEQ ID NO: 725272 - DNA, 21 bp, Homo sapiens
tgctggcctctctgacatatg

SEQ ID NO: 725273 - DNA, 14 bp, Homo sapiens
tgctggcctggatc

SEQ ID NO: 725274 - DNA, 13 bp, Homo sapiens
tgctggcctggcc

SEQ ID NO: 725275 - DNA, 12 bp, Homo sapiens
tgctggccttgg

SEQ ID NO: 725276 - DNA, 16 bp, Homo sapiens
tgctggcggcgcagag

SEQ ID NO: 725277 - DNA, 14 bp, Homo sapiens
tgctggctctgaga

SEQ ID NO: 725278 - DNA, 18 bp, Homo sapiens
tgctggctctgagaatca

SEQ ID NO: 725279 - DNA, 17 bp, Homo sapiens
tgctggctgacctgggc

SEQ ID NO: 725280 - DNA, 14 bp, Homo sapiens
tgctggctgcccag

SEQ ID NO: 725281 - DNA, 15 bp, Homo sapiens
tgctggctgccttag

SEQ ID NO: 725282 - DNA, 11 bp, Homo sapiens
tgctgggaaat

SEQ ID NO: 725283 - DNA, 19 bp, Homo sapiens
tgctgggaaatgcagaaat

SEQ ID NO: 725284 - DNA, 20 bp, Homo sapiens
tgctgggaaatgcagaaatc

SEQ ID NO: 725285 - DNA, 21 bp, Homo sapiens
tgctgggaaccccgcagcccg

SEQ ID NO: 725286 - DNA, 23 bp, Homo sapiens
tgctgggaaccccgcagcccgtg

SEQ ID NO: 725287 - DNA, 18 bp, Homo sapiens
tgctgggaagagctcccc

SEQ ID NO: 725288 - DNA, 16 bp, Homo sapiens
tgctgggaagggaggg

SEQ ID NO: 725289 - DNA, 18 bp, Homo sapiens
tgctgggactcagccttc

SEQ ID NO: 725290 - DNA, 16 bp, Homo sapiens
tgctgggactgagcca

SEQ ID NO: 725291 - DNA, 15 bp, Homo sapiens
tgctgggagctccac

SEQ ID NO: 725292 - DNA, 20 bp, Homo sapiens
tgctgggagctccactctgc

SEQ ID NO: 725293 - DNA, 14 bp, Homo sapiens
tgctgggagctgaa

SEQ ID NO: 725294 - DNA, 17 bp, Homo sapiens
tgctgggaggagggaga

SEQ ID NO: 725295 - DNA, 18 bp, Homo sapiens
tgctgggaggagggagag

SEQ ID NO: 725296 - DNA, 23 bp, Homo sapiens
tgctgggaggtataggggtcctg

SEQ ID NO: 725297 - DNA, 18 bp, Homo sapiens
tgctgggataactggcca

SEQ ID NO: 725298 - DNA, 19 bp, Homo sapiens
tgctgggatgacaggtgtg

SEQ ID NO: 725299 - DNA, 12 bp, Homo sapiens
tgctgggcactg

SEQ ID NO: 725300 - DNA, 14 bp, Homo sapiens
tgctgggcactgct

SEQ ID NO: 725301 - DNA, 12 bp, Homo sapiens
tgctgggcagcc

SEQ ID NO: 725302 - DNA, 13 bp, Homo sapiens
tgctgggcagccc

SEQ ID NO: 725303 - DNA, 19 bp, Homo sapiens
tgctgggcattttcccaga

SEQ ID NO: 725304 - DNA, 16 bp, Homo sapiens
tgctgggccagggaaa

SEQ ID NO: 725305 - DNA, 18 bp, Homo sapiens
tgctgggcccccagcctg

SEQ ID NO: 725306 - DNA, 15 bp, Homo sapiens
tgcatgttggggttt

SEQ ID NO: 725307 - DNA, 12 bp, Homo sapiens
tgcatgtttact

SEQ ID NO: 725308 - DNA, 17 bp, Homo sapiens
tgcatgtttactttatt

SEQ ID NO: 725309 - DNA, 16 bp, Homo sapiens
tgccaatatgtattgt

SEQ ID NO: 725310 - DNA, 23 bp, Homo sapiens
tgccaatccttaaatatgtgaaa

SEQ ID NO: 725311 - DNA, 23 bp, Homo sapiens
tgccaatcggctacccctcgact

SEQ ID NO: 725312 - DNA, 16 bp, Homo sapiens
tgccaatgatgtgacc

SEQ ID NO: 725313 - DNA, 12 bp, Homo sapiens
tgccaatttcct

SEQ ID NO: 725314 - DNA, 14 bp, Homo sapiens
tgccaatttcctct

SEQ ID NO: 725315 - DNA, 23 bp, Homo sapiens
tgccacaatgcagttctgagcac

SEQ ID NO: 725316 - DNA, 18 bp, Homo sapiens
tgccacacattgtgcttg

SEQ ID NO: 725317 - DNA, 22 bp, Homo sapiens
tgccacaccaatcagagagcct

SEQ ID NO: 725318 - DNA, 21 bp, Homo sapiens
tgccacaccccccacccctag

SEQ ID NO: 725319 - DNA, 15 bp, Homo sapiens
tgccacacgcatggg

SEQ ID NO: 725320 - DNA, 17 bp, Homo sapiens
tgccacactcagtcccc

SEQ ID NO: 725321 - DNA, 19 bp, Homo sapiens
tgccacactgatggctcaa

SEQ ID NO: 725322 - DNA, 21 bp, Homo sapiens
tgccacactgatggctcaaga

SEQ ID NO: 725323 - DNA, 17 bp, Homo sapiens
tgccacagcctgctggc

SEQ ID NO: 725324 - DNA, 15 bp, Homo sapiens
tgccacagctcaact

SEQ ID NO: 725325 - DNA, 20 bp, Homo sapiens
tgccacaggcttagggacag

SEQ ID NO: 725326 - DNA, 17 bp, Homo sapiens
tgccacagtagaactgt

SEQ ID NO: 725327 - DNA, 21 bp, Homo sapiens
tgccacatacatagatcttca

SEQ ID NO: 725328 - DNA, 16 bp, Homo sapiens
tgccacatccagcttg

SEQ ID NO: 725329 - DNA, 21 bp, Homo sapiens
tgccacattgatttttctata

SEQ ID NO: 725330 - DNA, 19 bp, Homo sapiens
tgccaccaacttacaaaaa

SEQ ID NO: 725331 - DNA, 15 bp, Homo sapiens
tgccaccacgtctgc

SEQ ID NO: 725332 - DNA, 18 bp, Homo sapiens
tgccaccacgtctgccag

SEQ ID NO: 725333 - DNA, 20 bp, Homo sapiens
tgccaccacgtctgccaggc

SEQ ID NO: 725334 - DNA, 22 bp, Homo sapiens
tgccaccacgtctgccaggccc

SEQ ID NO: 725335 - DNA, 17 bp, Homo sapiens
tgccaccactagagctg

SEQ ID NO: 725336 - DNA, 13 bp, Homo sapiens
tgccaccagcccc

SEQ ID NO: 725337 - DNA, 22 bp, Homo sapiens
tgccaccagcccccgccccaga

SEQ ID NO: 725338 - DNA, 17 bp, Homo sapiens
tgccaccaggagaacca

SEQ ID NO: 725339 - DNA, 22 bp, Homo sapiens
tgccaccaggagaaccactaca

SEQ ID NO: 725340 - DNA, 13 bp, Homo sapiens
tgccaccaggcca

SEQ ID NO: 725341 - DNA, 12 bp, Homo sapiens
tgccaccaggga

SEQ ID NO: 725342 - DNA, 16 bp, Homo sapiens
tgccaccagtcactgt

SEQ ID NO: 725343 - DNA, 18 bp, Homo sapiens
tgccaccatggccagcca

SEQ ID NO: 725344 - DNA, 17 bp, Homo sapiens
tgccacccaccagggcg

SEQ ID NO: 725345 - DNA, 13 bp, Homo sapiens
tgccacccacctc

SEQ ID NO: 725346 - DNA, 19 bp, Homo sapiens
tgccacccacctccctgcc

SEQ ID NO: 725347 - DNA, 15 bp, Homo sapiens
tgccaccccaaccca

SEQ ID NO: 725348 - DNA, 16 bp, Homo sapiens
tgccaccccatgtgcc

SEQ ID NO: 725349 - DNA, 20 bp, Homo sapiens
tgccaccccatgtgccttta

SEQ ID NO: 725350 - DNA, 20 bp, Homo sapiens
tgccacccccaggtcttcct

SEQ ID NO: 725351 - DNA, 13 bp, Homo sapiens
tgccacccctaaa

SEQ ID NO: 725352 - DNA, 21 bp, Homo sapiens
tgccacccctaaactccaggg

SEQ ID NO: 725353 - DNA, 14 bp, Homo sapiens
tgccacccctcttc

SEQ ID NO: 725354 - DNA, 14 bp, Homo sapiens
tgccaccccttcct

SEQ ID NO: 725355 - DNA, 15 bp, Homo sapiens
tgccaccccttcctc

SEQ ID NO: 725356 - DNA, 17 bp, Homo sapiens
tgccaccccttcctccc

SEQ ID NO: 725357 - DNA, 22 bp, Homo sapiens
tgccacccgtaggcagcctctc

SEQ ID NO: 725358 - DNA, 14 bp, Homo sapiens
tgccaccctacctg

SEQ ID NO: 725359 - DNA, 13 bp, Homo sapiens
tgccaccctctgg

SEQ ID NO: 725360 - DNA, 15 bp, Homo sapiens
tgccaccgactgccc

SEQ ID NO: 725361 - DNA, 18 bp, Homo sapiens
tgccaccgactgcccagc

SEQ ID NO: 725362 - DNA, 13 bp, Homo sapiens
tgccacctatgcc

SEQ ID NO: 725363 - DNA, 17 bp, Homo sapiens
tgccacctatgcctgtg

SEQ ID NO: 725364 - DNA, 13 bp, Homo sapiens
tgccacctcccct

SEQ ID NO: 725365 - DNA, 22 bp, Homo sapiens
tgccacctcccctatccaccca

SEQ ID NO: 725366 - DNA, 14 bp, Homo sapiens
tgccacctccctga

SEQ ID NO: 725367 - DNA, 22 bp, Homo sapiens
tgccacctgtccggcccagtgc

SEQ ID NO: 725368 - DNA, 23 bp, Homo sapiens
tgccacctgtccggcccagtgcc

SEQ ID NO: 725369 - DNA, 19 bp, Homo sapiens
tgccacgctttgctgctac

SEQ ID NO: 725370 - DNA, 17 bp, Homo sapiens
tgccacgtcccgctgcc

SEQ ID NO: 725371 - DNA, 14 bp, Homo sapiens
tgccacgttccaca

SEQ ID NO: 725372 - DNA, 16 bp, Homo sapiens
tgccacgttccacagt

SEQ ID NO: 725373 - DNA, 13 bp, Homo sapiens
tgccactcaccct

SEQ ID NO: 725374 - DNA, 19 bp, Homo sapiens
tgccactcacccttcctgg

SEQ ID NO: 725375 - DNA, 20 bp, Homo sapiens
tgccactcacccttcctggc

SEQ ID NO: 725376 - DNA, 21 bp, Homo sapiens
tgccactcacccttcctggcc

SEQ ID NO: 725377 - DNA, 19 bp, Homo sapiens
tgccactcactaggccccc

SEQ ID NO: 725378 - DNA, 11 bp, Homo sapiens
tgccactccct

SEQ ID NO: 725379 - DNA, 13 bp, Homo sapiens
tgccactccctga

SEQ ID NO: 725380 - DNA, 15 bp, Homo sapiens
tgccactcctccctc

SEQ ID NO: 725381 - DNA, 18 bp, Homo sapiens
tgccactgacttgctgtg

SEQ ID NO: 725382 - DNA, 19 bp, Homo sapiens
tgccactgacttgctgtgt

SEQ ID NO: 725383 - DNA, 14 bp, Homo sapiens
tgccactgcactcc

SEQ ID NO: 725384 - DNA, 15 bp, Homo sapiens
tgccactgccaggca

SEQ ID NO: 725385 - DNA, 18 bp, Homo sapiens
tgccactgccaggcacct

SEQ ID NO: 725386 - DNA, 19 bp, Homo sapiens
tgccactgccaggcacctg

SEQ ID NO: 725387 - DNA, 18 bp, Homo sapiens
tgccactgccccccgagg

SEQ ID NO: 725388 - DNA, 19 bp, Homo sapiens
tgccactgcccgagctggt

SEQ ID NO: 725389 - DNA, 22 bp, Homo sapiens
tgccactgcccgagctggtgca

SEQ ID NO: 725390 - DNA, 20 bp, Homo sapiens
tgccactggcaaatgtaact

SEQ ID NO: 725391 - DNA, 11 bp, Homo sapiens
tgccactgggc

SEQ ID NO: 725392 - DNA, 13 bp, Homo sapiens
tgccactgggcac

SEQ ID NO: 725393 - DNA, 17 bp, Homo sapiens
tgccactgggctctgga

SEQ ID NO: 725394 - DNA, 19 bp, Homo sapiens
tgccactgggctctggacc

SEQ ID NO: 725395 - DNA, 19 bp, Homo sapiens
tgccactgtgtgccttctg

SEQ ID NO: 725396 - DNA, 12 bp, Homo sapiens
tgccactgttgt

SEQ ID NO: 725397 - DNA, 23 bp, Homo sapiens
tgccacttaatgtatgttaccaa

SEQ ID NO: 725398 - DNA, 18 bp, Homo sapiens
tgccacttagtattttaa

SEQ ID NO: 725399 - DNA, 20 bp, Homo sapiens
tgccacttcactccagcctg

SEQ ID NO: 725400 - DNA, 15 bp, Homo sapiens
tgccacttcctttta

SEQ ID NO: 725401 - DNA, 18 bp, Homo sapiens
tgccacttctgcgggctc

SEQ ID NO: 725402 - DNA, 23 bp, Homo sapiens
tgccacttctgcgggctccctcc

SEQ ID NO: 725403 - DNA, 20 bp, Homo sapiens
tgccacttcttaaaggcctg

SEQ ID NO: 725404 - DNA, 19 bp, Homo sapiens
tgccacttgacattccttg

SEQ ID NO: 725405 - DNA, 17 bp, Homo sapiens
tgccacttgtcaaagaa

SEQ ID NO: 725406 - DNA, 16 bp, Homo sapiens
tgccactttggcttct

SEQ ID NO: 725407 - DNA, 20 bp, Homo sapiens
tgccactttggcttctcctg

SEQ ID NO: 725408 - DNA, 23 bp, Homo sapiens
tgccactttggtacatggccagt

SEQ ID NO: 725409 - DNA, 13 bp, Homo sapiens
tgccagaaacagt

SEQ ID NO: 725410 - DNA, 18 bp, Homo sapiens
tgccagaaacagtgggag

SEQ ID NO: 725411 - DNA, 22 bp, Homo sapiens
tgccagaaacagtgggagccct

SEQ ID NO: 725412 - DNA, 13 bp, Homo sapiens
tgccagaagagaa

SEQ ID NO: 725413 - DNA, 21 bp, Homo sapiens
tgccagaagagaattcagtat

SEQ ID NO: 725414 - DNA, 14 bp, Homo sapiens
tgccagacactgag

SEQ ID NO: 725415 - DNA, 16 bp, Homo sapiens
tgccagacactgagct

SEQ ID NO: 725416 - DNA, 21 bp, Homo sapiens
tgccagacactgagcttctga

SEQ ID NO: 725417 - DNA, 21 bp, Homo sapiens
tgccagacattgctctcagtg

SEQ ID NO: 725418 - DNA, 13 bp, Homo sapiens
tgccagactctag

SEQ ID NO: 725419 - DNA, 19 bp, Homo sapiens
tgccagactctaggttata

SEQ ID NO: 725420 - DNA, 13 bp, Homo sapiens
tgccagagcagga

SEQ ID NO: 725421 - DNA, 13 bp, Homo sapiens
tgccagagggcca

SEQ ID NO: 725422 - DNA, 19 bp, Homo sapiens
tgccagagggccagcaggc

SEQ ID NO: 725423 - DNA, 18 bp, Homo sapiens
tgccagaggtgggcaggt

SEQ ID NO: 725424 - DNA, 19 bp, Homo sapiens
tgccagaggtgggcaggtg

SEQ ID NO: 725425 - DNA, 16 bp, Homo sapiens
tgccagatataactgt

SEQ ID NO: 725426 - DNA, 23 bp, Homo sapiens
tgccagatataactgtcttgttt

SEQ ID NO: 725427 - DNA, 17 bp, Homo sapiens
tgccagattctgcctct

SEQ ID NO: 725428 - DNA, 19 bp, Homo sapiens
tgccagattctgcctctct

SEQ ID NO: 725429 - DNA, 16 bp, Homo sapiens
tgccagcaaataaata

SEQ ID NO: 725430 - DNA, 12 bp, Homo sapiens
tgccagcaactg

SEQ ID NO: 725431 - DNA, 17 bp, Homo sapiens
tgagattggcatggctt

SEQ ID NO: 725432 - DNA, 22 bp, Homo sapiens
tgagatttaaatgcaaccagaa

SEQ ID NO: 725433 - DNA, 21 bp, Homo sapiens
tgagatttactgctctagaaa

SEQ ID NO: 725434 - DNA, 14 bp, Homo sapiens
tgagatttgccagc

SEQ ID NO: 725435 - DNA, 13 bp, Homo sapiens
tgagatttttaag

SEQ ID NO: 725436 - DNA, 16 bp, Homo sapiens
tgagatttttaagaac

SEQ ID NO: 725437 - DNA, 19 bp, Homo sapiens
tgagatttttttgtgtatg

SEQ ID NO: 725438 - DNA, 21 bp, Homo sapiens
tgagatttttttgtgtatgtt

SEQ ID NO: 725439 - DNA, 19 bp, Homo sapiens
tgagatttttttttctctt

SEQ ID NO: 725440 - DNA, 16 bp, Homo sapiens
tgagcaaatgtggctc

SEQ ID NO: 725441 - DNA, 19 bp, Homo sapiens
tgagcaaatgtggctcctg

SEQ ID NO: 725442 - DNA, 19 bp, Homo sapiens
tgagcaagactctttcaaa

SEQ ID NO: 725443 - DNA, 13 bp, Homo sapiens
tgagcaaggtgct

SEQ ID NO: 725444 - DNA, 15 bp, Homo sapiens
tgagcaataaagtgg

SEQ ID NO: 725445 - DNA, 17 bp, Homo sapiens
tgagcaataacttctat

SEQ ID NO: 725446 - DNA, 21 bp, Homo sapiens
tgagcaatggtaactgcacct

SEQ ID NO: 725447 - DNA, 17 bp, Homo sapiens
tgagcaatgtctgtgct

SEQ ID NO: 725448 - DNA, 20 bp, Homo sapiens
tgagcacaggtgacagatca

SEQ ID NO: 725449 - DNA, 22 bp, Homo sapiens
tgagcacagtcaggggctgggc

SEQ ID NO: 725450 - DNA, 13 bp, Homo sapiens
tgagcacatctct

SEQ ID NO: 725451 - DNA, 18 bp, Homo sapiens
tgagcacatctctctgcc

SEQ ID NO: 725452 - DNA, 21 bp, Homo sapiens
tgagcacatctctctgccctc

SEQ ID NO: 725453 - DNA, 13 bp, Homo sapiens
tgagcaccccctc

SEQ ID NO: 725454 - DNA, 23 bp, Homo sapiens
tgagcaccccctcattcccctcg

SEQ ID NO: 725455 - DNA, 14 bp, Homo sapiens
tgagcacctgggga

SEQ ID NO: 725456 - DNA, 13 bp, Homo sapiens
tgagcagaacagg

SEQ ID NO: 725457 - DNA, 14 bp, Homo sapiens
tgagcagaacaggt

SEQ ID NO: 725458 - DNA, 15 bp, Homo sapiens
tgagcagaattcatt

SEQ ID NO: 725459 - DNA, 19 bp, Homo sapiens
tgagcagagcgatggagca

SEQ ID NO: 725460 - DNA, 22 bp, Homo sapiens
tgagcagcctctggacagccag

SEQ ID NO: 725461 - DNA, 11 bp, Homo sapiens
tgagcagctac

SEQ ID NO: 725462 - DNA, 18 bp, Homo sapiens
tgagcagctactgtaact

SEQ ID NO: 725463 - DNA, 16 bp, Homo sapiens
tgagcaggctgtgggg

SEQ ID NO: 725464 - DNA, 18 bp, Homo sapiens
tgagcagggcttgctcct

SEQ ID NO: 725465 - DNA, 12 bp, Homo sapiens
tgagcaggggca

SEQ ID NO: 725466 - DNA, 19 bp, Homo sapiens
tgagcaggggcaggcgcag

SEQ ID NO: 725467 - DNA, 22 bp, Homo sapiens
tgagcagggtggggtctgggag

SEQ ID NO: 725468 - DNA, 23 bp, Homo sapiens
tgagcagtgagttacagcgagag

SEQ ID NO: 725469 - DNA, 14 bp, Homo sapiens
tgagcataactcca

SEQ ID NO: 725470 - DNA, 15 bp, Homo sapiens
tgagcataatgctcc

SEQ ID NO: 725471 - DNA, 13 bp, Homo sapiens
tgagcatattttc

SEQ ID NO: 725472 - DNA, 15 bp, Homo sapiens
tgagcatattttctt

SEQ ID NO: 725473 - DNA, 22 bp, Homo sapiens
tgagcatattttcttactttta

SEQ ID NO: 725474 - DNA, 21 bp, Homo sapiens
tgagcatcaatcttgttactg

SEQ ID NO: 725475 - DNA, 15 bp, Homo sapiens
tgagcatcctgagcc

SEQ ID NO: 725476 - DNA, 14 bp, Homo sapiens
tgagcatgatggga

SEQ ID NO: 725477 - DNA, 20 bp, Homo sapiens
tgagcatgcacagctgcttg

SEQ ID NO: 725478 - DNA, 13 bp, Homo sapiens
tgagcatttgcac

SEQ ID NO: 725479 - DNA, 17 bp, Homo sapiens
tgagccaaggaggcctg

SEQ ID NO: 725480 - DNA, 17 bp, Homo sapiens
tgagccaccgctgccag

SEQ ID NO: 725481 - DNA, 16 bp, Homo sapiens
tgagccaccgtgcctg

SEQ ID NO: 725482 - DNA, 21 bp, Homo sapiens
tgagccactcagtctcttcca

SEQ ID NO: 725483 - DNA, 22 bp, Homo sapiens
tgagccactcgcagtcgcagga

SEQ ID NO: 725484 - DNA, 22 bp, Homo sapiens
tgagccactgcacctgcccagc

SEQ ID NO: 725485 - DNA, 19 bp, Homo sapiens
tgagccactgcgcccagcc

SEQ ID NO: 725486 - DNA, 22 bp, Homo sapiens
tgagccagaaaaaaaaaataaa

SEQ ID NO: 725487 - DNA, 21 bp, Homo sapiens
tgagccagccaggccctgcca

SEQ ID NO: 725488 - DNA, 22 bp, Homo sapiens
tgagccagccaggccctgccag

SEQ ID NO: 725489 - DNA, 14 bp, Homo sapiens
tgagccagtaatct

SEQ ID NO: 725490 - DNA, 19 bp, Homo sapiens
tgagccagtcccaggggca

SEQ ID NO: 725491 - DNA, 21 bp, Homo sapiens
tgagccagtgctttaatggca

SEQ ID NO: 725492 - DNA, 21 bp, Homo sapiens
tgagccagttgtcctatggac

SEQ ID NO: 725493 - DNA, 21 bp, Homo sapiens
tgagccatattaattgcctgt

SEQ ID NO: 725494 - DNA, 17 bp, Homo sapiens
tgagccatcatttcctg

SEQ ID NO: 725495 - DNA, 16 bp, Homo sapiens
tgagccatgcctccct

SEQ ID NO: 725496 - DNA, 16 bp, Homo sapiens
tgagcccacaaagcct

SEQ ID NO: 725497 - DNA, 23 bp, Homo sapiens
tgagcccactgcccaccccctca

SEQ ID NO: 725498 - DNA, 14 bp, Homo sapiens
tgagcccaggagct

SEQ ID NO: 725499 - DNA, 13 bp, Homo sapiens
tgagcccaggccg

SEQ ID NO: 725500 - DNA, 18 bp, Homo sapiens
tgagcccatgttctgccc

SEQ ID NO: 725501 - DNA, 22 bp, Homo sapiens
tgagcccatgttctgcccccag

SEQ ID NO: 725502 - DNA, 23 bp, Homo sapiens
tgagcccatgttctgcccccagc

SEQ ID NO: 725503 - DNA, 14 bp, Homo sapiens
tgagccccaagtcc

SEQ ID NO: 725504 - DNA, 23 bp, Homo sapiens
tgagccccaagtcctgaagaggc

SEQ ID NO: 725505 - DNA, 20 bp, Homo sapiens
tgagccccacctctccaagt

SEQ ID NO: 725506 - DNA, 21 bp, Homo sapiens
tgagccccagggtgcccagaa

SEQ ID NO: 725507 - DNA, 17 bp, Homo sapiens
tgagccccagtgctgga

SEQ ID NO: 725508 - DNA, 23 bp, Homo sapiens
tgagcccccaccggaactgggct

SEQ ID NO: 725509 - DNA, 22 bp, Homo sapiens
tgagcccccccaacactgtgcc

SEQ ID NO: 725510 - DNA, 23 bp, Homo sapiens
tgagcccccccaacactgtgccc

SEQ ID NO: 725511 - DNA, 20 bp, Homo sapiens
tgagccccgccctcttcctg

SEQ ID NO: 725512 - DNA, 22 bp, Homo sapiens
tgagccccgccctcttcctgac

SEQ ID NO: 725513 - DNA, 17 bp, Homo sapiens
tgagcccctccccagcc

SEQ ID NO: 725514 - DNA, 15 bp, Homo sapiens
tgagcccctggtcct

SEQ ID NO: 725515 - DNA, 15 bp, Homo sapiens
tgagcccctggtctt

SEQ ID NO: 725516 - DNA, 15 bp, Homo sapiens
tgagcccgcagccca

SEQ ID NO: 725517 - DNA, 17 bp, Homo sapiens
tgagcccgggctgcctg

SEQ ID NO: 725518 - DNA, 19 bp, Homo sapiens
tgagccctactccctgcag

SEQ ID NO: 725519 - DNA, 20 bp, Homo sapiens
tgagccctactccctgcaga

SEQ ID NO: 725520 - DNA, 23 bp, Homo sapiens
tgagccctactccctgcagatgc

SEQ ID NO: 725521 - DNA, 13 bp, Homo sapiens
tgagccctctagg

SEQ ID NO: 725522 - DNA, 18 bp, Homo sapiens
tgagccctctagggcagg

SEQ ID NO: 725523 - DNA, 21 bp, Homo sapiens
tgagccctctcactccagcca

SEQ ID NO: 725524 - DNA, 12 bp, Homo sapiens
tgagccctggct

SEQ ID NO: 725525 - DNA, 22 bp, Homo sapiens
tgagccctgtacccaccccagc

SEQ ID NO: 725526 - DNA, 17 bp, Homo sapiens
tgagccgcatcttctcc

SEQ ID NO: 725527 - DNA, 21 bp, Homo sapiens
tgagccgcatcttctccatct

SEQ ID NO: 725528 - DNA, 22 bp, Homo sapiens
tgagccgcggggaagctggctt

SEQ ID NO: 725529 - DNA, 20 bp, Homo sapiens
tgagccgggcccctgggctt

SEQ ID NO: 725530 - DNA, 21 bp, Homo sapiens
tgagccggggccgtctgtgtg

SEQ ID NO: 725531 - DNA, 19 bp, Homo sapiens
tgagccgtgaactgtgcat

SEQ ID NO: 725532 - DNA, 16 bp, Homo sapiens
tgagcctacagatgaa

SEQ ID NO: 725533 - DNA, 22 bp, Homo sapiens
tgagcctcaatttcctcatctg

SEQ ID NO: 725534 - DNA, 15 bp, Homo sapiens
tgagcctcctgtgcc

SEQ ID NO: 725535 - DNA, 22 bp, Homo sapiens
tgagcctcctgtgcctggcccc

SEQ ID NO: 725536 - DNA, 20 bp, Homo sapiens
tgattattaacgatgtccaa

SEQ ID NO: 725537 - DNA, 15 bp, Homo sapiens
tgattattacttctg

SEQ ID NO: 725538 - DNA, 13 bp, Homo sapiens
tgattattatgtt

SEQ ID NO: 725539 - DNA, 21 bp, Homo sapiens
tgattattatgtttattacaa

SEQ ID NO: 725540 - DNA, 16 bp, Homo sapiens
tgattatttcacttta

SEQ ID NO: 725541 - DNA, 13 bp, Homo sapiens
tgattatttgcat

SEQ ID NO: 725542 - DNA, 15 bp, Homo sapiens
tgattatttgcatgt

SEQ ID NO: 725543 - DNA, 19 bp, Homo sapiens
tgattatttgcatgttatg

SEQ ID NO: 725544 - DNA, 14 bp, Homo sapiens
tgattattttcaag

SEQ ID NO: 725545 - DNA, 23 bp, Homo sapiens
tgattcaaaatatttaaaaatgt

SEQ ID NO: 725546 - DNA, 17 bp, Homo sapiens
tgattcaaaccaaagct

SEQ ID NO: 725547 - DNA, 22 bp, Homo sapiens
tgattcaaaccaaagctgcctg

SEQ ID NO: 725548 - DNA, 15 bp, Homo sapiens
tgattcaaatgtttt

SEQ ID NO: 725549 - DNA, 16 bp, Homo sapiens
tgattcaaatgtttta

SEQ ID NO: 725550 - DNA, 21 bp, Homo sapiens
tgattcaagccattccaaagt

SEQ ID NO: 725551 - DNA, 22 bp, Homo sapiens
tgattcaatctgtaaactgtgt

SEQ ID NO: 725552 - DNA, 22 bp, Homo sapiens
tgattcacatgctaaagccagg

SEQ ID NO: 725553 - DNA, 21 bp, Homo sapiens
tgattcacctcctaaaacaac

SEQ ID NO: 725554 - DNA, 18 bp, Homo sapiens
tgattcacctcttcctct

SEQ ID NO: 725555 - DNA, 16 bp, Homo sapiens
tgattcagaaattgga

SEQ ID NO: 725556 - DNA, 21 bp, Homo sapiens
tgattcagctcattatgaaaa

SEQ ID NO: 725557 - DNA, 20 bp, Homo sapiens
tgattcaggaggtcatctga

SEQ ID NO: 725558 - DNA, 14 bp, Homo sapiens
tgattcagtatctt

SEQ ID NO: 725559 - DNA, 12 bp, Homo sapiens
tgattcagtgtt

SEQ ID NO: 725560 - DNA, 17 bp, Homo sapiens
tgattcatactcctttt

SEQ ID NO: 725561 - DNA, 18 bp, Homo sapiens
tgattcatagtaacttct

SEQ ID NO: 725562 - DNA, 19 bp, Homo sapiens
tgattcatgccaattagca

SEQ ID NO: 725563 - DNA, 16 bp, Homo sapiens
tgattcattttcctgt

SEQ ID NO: 725564 - DNA, 17 bp, Homo sapiens
tgattcattttcctgtt

SEQ ID NO: 725565 - DNA, 12 bp, Homo sapiens
tgattccaaata

SEQ ID NO: 725566 - DNA, 14 bp, Homo sapiens
tgattccaaataaa

SEQ ID NO: 725567 - DNA, 15 bp, Homo sapiens
tgattccaaatatgt

SEQ ID NO: 725568 - DNA, 19 bp, Homo sapiens
tgattccaatctctgttct

SEQ ID NO: 725569 - DNA, 20 bp, Homo sapiens
tgattccactacacctggct

SEQ ID NO: 725570 - DNA, 16 bp, Homo sapiens
tgattccatccacctt

SEQ ID NO: 725571 - DNA, 14 bp, Homo sapiens
tgattcccgggctt

SEQ ID NO: 725572 - DNA, 16 bp, Homo sapiens
tgattccctgatttaa

SEQ ID NO: 725573 - DNA, 23 bp, Homo sapiens
tgattcctaagccacttgaaatg

SEQ ID NO: 725574 - DNA, 18 bp, Homo sapiens
tgattcctacccctcttc

SEQ ID NO: 725575 - DNA, 24 bp, Homo sapiens
tgattcctggacatcaccagtcct

SEQ ID NO: 725576 - DNA, 15 bp, Homo sapiens
tgattcctggctcta

SEQ ID NO: 725577 - DNA, 20 bp, Homo sapiens
tgattcctggctctaccctg

SEQ ID NO: 725578 - DNA, 11 bp, Homo sapiens
tgattcctggt

SEQ ID NO: 725579 - DNA, 12 bp, Homo sapiens
tgattcctggtt

SEQ ID NO: 725580 - DNA, 22 bp, Homo sapiens
tgattccttgatggagatattt

SEQ ID NO: 725581 - DNA, 15 bp, Homo sapiens
tgattccttttgatg

SEQ ID NO: 725582 - DNA, 23 bp, Homo sapiens
tgattccttttgatggggagaaa

SEQ ID NO: 725583 - DNA, 17 bp, Homo sapiens
tgattcggacggccaat

SEQ ID NO: 725584 - DNA, 18 bp, Homo sapiens
tgattcgggggctgacct

SEQ ID NO: 725585 - DNA, 18 bp, Homo sapiens
tgattctagtacataatt

SEQ ID NO: 725586 - DNA, 16 bp, Homo sapiens
tgattctcagggctgg

SEQ ID NO: 725587 - DNA, 13 bp, Homo sapiens
tgattctccattt

SEQ ID NO: 725588 - DNA, 21 bp, Homo sapiens
tgattctgataatgctcactt

SEQ ID NO: 725589 - DNA, 11 bp, Homo sapiens
tgattctgatt

SEQ ID NO: 725590 - DNA, 13 bp, Homo sapiens
tgattctgatttc

SEQ ID NO: 725591 - DNA, 14 bp, Homo sapiens
tgattctgatttca

SEQ ID NO: 725592 - DNA, 18 bp, Homo sapiens
tgattctgatttcagttt

SEQ ID NO: 725593 - DNA, 19 bp, Homo sapiens
tgattctgcttttaccatg

SEQ ID NO: 725594 - DNA, 13 bp, Homo sapiens
tgattctgtgtgt

SEQ ID NO: 725595 - DNA, 13 bp, Homo sapiens
tgattcttaacac

SEQ ID NO: 725596 - DNA, 20 bp, Homo sapiens
tgattcttaacacagccttc

SEQ ID NO: 725597 - DNA, 15 bp, Homo sapiens
tgattcttgattcct

SEQ ID NO: 725598 - DNA, 17 bp, Homo sapiens
tgattcttgattcctgg

SEQ ID NO: 725599 - DNA, 20 bp, Homo sapiens
tgattcttgtaaatcttttt

SEQ ID NO: 725600 - DNA, 19 bp, Homo sapiens
tgattctttgttacaggca

SEQ ID NO: 725601 - DNA, 19 bp, Homo sapiens
tgattgaaccatttgggat

SEQ ID NO: 725602 - DNA, 17 bp, Homo sapiens
tgattgacagctttgct

SEQ ID NO: 725603 - DNA, 15 bp, Homo sapiens
tgattgacctgctcc

SEQ ID NO: 725604 - DNA, 14 bp, Homo sapiens
tgattgagaaagat

SEQ ID NO: 725605 - DNA, 17 bp, Homo sapiens
tgattgaggagctgcac

SEQ ID NO: 725606 - DNA, 23 bp, Homo sapiens
tgattgaggataaaaaggaagga

SEQ ID NO: 725607 - DNA, 21 bp, Homo sapiens
tgattgatcacacagtgttag

SEQ ID NO: 725608 - DNA, 14 bp, Homo sapiens
tgattgatgtacag

SEQ ID NO: 725609 - DNA, 15 bp, Homo sapiens
tgattgattcagtat

SEQ ID NO: 725610 - DNA, 17 bp, Homo sapiens
tgattgattcagtatct

SEQ ID NO: 725611 - DNA, 14 bp, Homo sapiens
tgattgatttgaag

SEQ ID NO: 725612 - DNA, 13 bp, Homo sapiens
tgattgcacagaa

SEQ ID NO: 725613 - DNA, 18 bp, Homo sapiens
tgattgcacagaatttgt

SEQ ID NO: 725614 - DNA, 14 bp, Homo sapiens
tgattgcagcttta

SEQ ID NO: 725615 - DNA, 19 bp, Homo sapiens
tgattgctttgctgcacag

SEQ ID NO: 725616 - DNA, 16 bp, Homo sapiens
tgattggaatttctgg

SEQ ID NO: 725617 - DNA, 14 bp, Homo sapiens
tgattggattattc

SEQ ID NO: 725618 - DNA, 12 bp, Homo sapiens
tgattggctcac

SEQ ID NO: 725619 - DNA, 13 bp, Homo sapiens
tgattggcttaaa

SEQ ID NO: 725620 - DNA, 17 bp, Homo sapiens
tgattggcttaaagtga

SEQ ID NO: 725621 - DNA, 18 bp, Homo sapiens
tgattggcttaaagtgaa

SEQ ID NO: 725622 - DNA, 17 bp, Homo sapiens
tgattggtgcaaccctt

SEQ ID NO: 725623 - DNA, 19 bp, Homo sapiens
tgattggtgcaacccttac

SEQ ID NO: 725624 - DNA, 15 bp, Homo sapiens
tgatttcctaaacat

SEQ ID NO: 725625 - DNA, 18 bp, Homo sapiens
tgatttcctaaacataat

SEQ ID NO: 725626 - DNA, 22 bp, Homo sapiens
tgatttcctaaacataattgtg

SEQ ID NO: 725627 - DNA, 14 bp, Homo sapiens
tgatttcctctaaa

SEQ ID NO: 725628 - DNA, 18 bp, Homo sapiens
tgatttcctctaaagaaa

SEQ ID NO: 725629 - DNA, 16 bp, Homo sapiens
tgatttccttcaatgt

SEQ ID NO: 725630 - DNA, 14 bp, Homo sapiens
tgatttccttgaat

SEQ ID NO: 725631 - DNA, 21 bp, Homo sapiens
tgatttctagcaggcaggaag

SEQ ID NO: 725632 - DNA, 20 bp, Homo sapiens
tgatttctattcaaggtggc

SEQ ID NO: 725633 - DNA, 23 bp, Homo sapiens
tgatttctcagtgatttcctaca

SEQ ID NO: 725634 - DNA, 19 bp, Homo sapiens
tgatttcttgctttgggga

SEQ ID NO: 725635 - DNA, 20 bp, Homo sapiens
tgatttctttaaaagaatga

SEQ ID NO: 725636 - DNA, 15 bp, Homo sapiens
tgatttctttccaga

SEQ ID NO: 725637 - DNA, 14 bp, Homo sapiens
tgatttgcatggat

SEQ ID NO: 725638 - DNA, 12 bp, Homo sapiens
tgatttgcattg

SEQ ID NO: 725639 - DNA, 14 bp, Homo sapiens
tgatttgcattgaa

SEQ ID NO: 725640 - DNA, 20 bp, Homo sapiens
tgatttggaagagaggcacc

SEQ ID NO: 725641 - DNA, 21 bp, Homo sapiens
tgatttggggatgtttgcccc

SEQ ID NO: 725642 - DNA, 22 bp, Homo sapiens
tgatttgggggaggctttggga

SEQ ID NO: 725643 - DNA, 20 bp, Homo sapiens
tgatttggtgaccaactgtc

SEQ ID NO: 725644 - DNA, 15 bp, Homo sapiens
tgatttgtactgaaa

SEQ ID NO: 725645 - DNA, 20 bp, Homo sapiens
tgatttgtcccagcctgggg

SEQ ID NO: 725646 - DNA, 20 bp, Homo sapiens
tgatttgtgaaacagttgct

SEQ ID NO: 725647 - DNA, 12 bp, Homo sapiens
tgatttgttcat

SEQ ID NO: 725648 - DNA, 14 bp, Homo sapiens
tgatttgttttgaa

SEQ ID NO: 725649 - DNA, 13 bp, Homo sapiens
tgattttaacaat

SEQ ID NO: 725650 - DNA, 16 bp, Homo sapiens
tgattttaacaataac

SEQ ID NO: 725651 - DNA, 12 bp, Homo sapiens
tgattttatgat

SEQ ID NO: 725652 - DNA, 22 bp, Homo sapiens
tgattttattacagaaatgttt

SEQ ID NO: 725653 - DNA, 15 bp, Homo sapiens
tgattttgccctcct

SEQ ID NO: 725654 - DNA, 14 bp, Homo sapiens
tgattttgctgtag

SEQ ID NO: 725655 - DNA, 17 bp, Homo sapiens
tgattttgctgtagaag

SEQ ID NO: 725656 - DNA, 17 bp, Homo sapiens
tgattttggaaagatgt

SEQ ID NO: 725657 - DNA, 15 bp, Homo sapiens
tgattttgtatgtaa

SEQ ID NO: 725658 - DNA, 17 bp, Homo sapiens
tgattttgtatgtaaat

SEQ ID NO: 725659 - DNA, 16 bp, Homo sapiens
tgatttttaatggaaa

SEQ ID NO: 725660 - DNA, 19 bp, Homo sapiens
tgatttttatccatttctt

SEQ ID NO: 725661 - DNA, 13 bp, Homo sapiens
tgatttttccttt

SEQ ID NO: 725662 - DNA, 16 bp, Homo sapiens
tgatttttctcttcat

SEQ ID NO: 725663 - DNA, 14 bp, Homo sapiens
tgatttttctttac

SEQ ID NO: 725664 - DNA, 15 bp, Homo sapiens
tgatttttgaagttg

SEQ ID NO: 725665 - DNA, 21 bp, Homo sapiens
tgatttttgcctcttccagtc

SEQ ID NO: 725666 - DNA, 13 bp, Homo sapiens
tgattttttgcat

SEQ ID NO: 725667 - DNA, 16 bp, Homo sapiens
tgatttttttaaagta

SEQ ID NO: 725668 - DNA, 18 bp, Homo sapiens
tgatttttttaatagtgc

SEQ ID NO: 725669 - DNA, 21 bp, Homo sapiens
tgattttttttcttggtttct

SEQ ID NO: 725670 - DNA, 18 bp, Homo sapiens
tgatttttttttcataca

SEQ ID NO: 725671 - DNA, 16 bp, Homo sapiens
tgatttttttttttca

SEQ ID NO: 725672 - DNA, 20 bp, Homo sapiens
tgcaaaaaaaattagccggg

SEQ ID NO: 725673 - DNA, 16 bp, Homo sapiens
tgcaaaaaaagcctcc

SEQ ID NO: 725674 - DNA, 20 bp, Homo sapiens
tgcaaaaaaagcctccaagg

SEQ ID NO: 725675 - DNA, 21 bp, Homo sapiens
tgcaaaaaaagcctccaaggg

SEQ ID NO: 725676 - DNA, 18 bp, Homo sapiens
tgcaaaaaaattaaaatg

SEQ ID NO: 725677 - DNA, 12 bp, Homo sapiens
tgcaaaaaatag

SEQ ID NO: 725678 - DNA, 14 bp, Homo sapiens
tgcaaaaaattctt

SEQ ID NO: 725679 - DNA, 14 bp, Homo sapiens
tgcaaaaataatca

SEQ ID NO: 725680 - DNA, 12 bp, Homo sapiens
tgcaaaaatgga

SEQ ID NO: 725681 - DNA, 20 bp, Homo sapiens
tgcaaaaattcagagtcctt

SEQ ID NO: 725682 - DNA, 20 bp, Homo sapiens
tgcaaaaccttgtgaactga

SEQ ID NO: 725683 - DNA, 20 bp, Homo sapiens
tgcaaaacggatgagttatt

SEQ ID NO: 725684 - DNA, 14 bp, Homo sapiens
tgcaaaactgtgtc

SEQ ID NO: 725685 - DNA, 20 bp, Homo sapiens
tgcaaaagcagctaaatgta

SEQ ID NO: 725686 - DNA, 22 bp, Homo sapiens
tgcaaaaggttcactaaagcag

SEQ ID NO: 725687 - DNA, 13 bp, Homo sapiens
tgcaaaagtgggg

SEQ ID NO: 725688 - DNA, 16 bp, Homo sapiens
tgcaaaagtggggcta

SEQ ID NO: 725689 - DNA, 20 bp, Homo sapiens
tgcaaaagttctgacttgac

SEQ ID NO: 725690 - DNA, 14 bp, Homo sapiens
tgcaaaatacatga

SEQ ID NO: 725691 - DNA, 21 bp, Homo sapiens
tgcaaaatagggtaagaagat

SEQ ID NO: 725692 - DNA, 13 bp, Homo sapiens
tgcaaaattaaat

SEQ ID NO: 725693 - DNA, 21 bp, Homo sapiens
tgcaaaattaaatctagacat

SEQ ID NO: 725694 - DNA, 15 bp, Homo sapiens
tgcaaaattgttttc

SEQ ID NO: 725695 - DNA, 19 bp, Homo sapiens
tgcaaaattgttttcactt

SEQ ID NO: 725696 - DNA, 21 bp, Homo sapiens
tgcaaaatttccagtaccttt

SEQ ID NO: 725697 - DNA, 21 bp, Homo sapiens
tgcaaaatttgatgccaggac

SEQ ID NO: 725698 - DNA, 19 bp, Homo sapiens
tgcaaaatttttttaatct

SEQ ID NO: 725699 - DNA, 23 bp, Homo sapiens
tgcaaacaatgaagaattatgta

SEQ ID NO: 725700 - DNA, 14 bp, Homo sapiens
tgcaaacagaacag

SEQ ID NO: 725701 - DNA, 14 bp, Homo sapiens
tgcaaaccacttct

SEQ ID NO: 725702 - DNA, 21 bp, Homo sapiens
tgcaaacccaactaagccagg

SEQ ID NO: 725703 - DNA, 14 bp, Homo sapiens
tgcaaaccttcctg

SEQ ID NO: 725704 - DNA, 15 bp, Homo sapiens
tgcaaaccttcctgg

SEQ ID NO: 725705 - DNA, 15 bp, Homo sapiens
tgcaaactgctttat

SEQ ID NO: 725706 - DNA, 21 bp, Homo sapiens
tctgtggatacagtgcccacc

SEQ ID NO: 725707 - DNA, 21 bp, Homo sapiens
tctgtggccagagtcttggac

SEQ ID NO: 725708 - DNA, 18 bp, Homo sapiens
tctgtggccgccatctgc

SEQ ID NO: 725709 - DNA, 22 bp, Homo sapiens
tctgtggccgccatctgcgcag

SEQ ID NO: 725710 - DNA, 14 bp, Homo sapiens
tctgtggcctgtgt

SEQ ID NO: 725711 - DNA, 13 bp, Homo sapiens
tctgtggctggct

SEQ ID NO: 725712 - DNA, 19 bp, Homo sapiens
tctgtggctggctctacct

SEQ ID NO: 725713 - DNA, 16 bp, Homo sapiens
tctgtgggcttcagca

SEQ ID NO: 725714 - DNA, 16 bp, Homo sapiens
tctgtgggtctctgga

SEQ ID NO: 725715 - DNA, 16 bp, Homo sapiens
tctgtggtcacagtga

SEQ ID NO: 725716 - DNA, 22 bp, Homo sapiens
tctgtggttttcccctccctgg

SEQ ID NO: 725717 - DNA, 17 bp, Homo sapiens
tctgtggttttttttga

SEQ ID NO: 725718 - DNA, 15 bp, Homo sapiens
tctgtgtaaagactt

SEQ ID NO: 725719 - DNA, 20 bp, Homo sapiens
tctgtgtagaaactggaagc

SEQ ID NO: 725720 - DNA, 23 bp, Homo sapiens
tctgtgtcctctgcctgggctct

SEQ ID NO: 725721 - DNA, 11 bp, Homo sapiens
tctgtgtcctt

SEQ ID NO: 725722 - DNA, 17 bp, Homo sapiens
tctgtgtccttccctgc

SEQ ID NO: 725723 - DNA, 21 bp, Homo sapiens
tctgtgtctttcacagctcct

SEQ ID NO: 725724 - DNA, 19 bp, Homo sapiens
tctgtgtgaaactttcatt

SEQ ID NO: 725725 - DNA, 13 bp, Homo sapiens
tctgtgtgaatgt

SEQ ID NO: 725726 - DNA, 14 bp, Homo sapiens
tctgtgtgaatgtg

SEQ ID NO: 725727 - DNA, 22 bp, Homo sapiens
tctgtgtgaatgtgggcactgg

SEQ ID NO: 725728 - DNA, 20 bp, Homo sapiens
tctgtgtgatgaactttctc

SEQ ID NO: 725729 - DNA, 14 bp, Homo sapiens
tctgtgtgcacaaa

SEQ ID NO: 725730 - DNA, 14 bp, Homo sapiens
tctgtgtgcagcaa

SEQ ID NO: 725731 - DNA, 22 bp, Homo sapiens
tctgtgtggggttctcagtgcc

SEQ ID NO: 725732 - DNA, 13 bp, Homo sapiens
tctgtgtgtcagt

SEQ ID NO: 725733 - DNA, 12 bp, Homo sapiens
tctgtgttcatt

SEQ ID NO: 725734 - DNA, 14 bp, Homo sapiens
tctgtgttcatttt

SEQ ID NO: 725735 - DNA, 21 bp, Homo sapiens
tctgtgttcccagaggcaggc

SEQ ID NO: 725736 - DNA, 13 bp, Homo sapiens
tctgtgttgcttc

SEQ ID NO: 725737 - DNA, 20 bp, Homo sapiens
tctgttaactgaataccact

SEQ ID NO: 725738 - DNA, 15 bp, Homo sapiens
tctgttaagaaagga

SEQ ID NO: 725739 - DNA, 22 bp, Homo sapiens
tctgttaagatatgcacagtct

SEQ ID NO: 725740 - DNA, 19 bp, Homo sapiens
tctgttacactttttggaa

SEQ ID NO: 725741 - DNA, 20 bp, Homo sapiens
tctgttaccataagtctgat

SEQ ID NO: 725742 - DNA, 19 bp, Homo sapiens
tctgttaccatgtcactgt

SEQ ID NO: 725743 - DNA, 14 bp, Homo sapiens
tctgttagcagagt

SEQ ID NO: 725744 - DNA, 15 bp, Homo sapiens
tctgttattaacaaa

SEQ ID NO: 725745 - DNA, 12 bp, Homo sapiens
tctgttatttat

SEQ ID NO: 725746 - DNA, 20 bp, Homo sapiens
tctgttcaaagctgcctgtc

SEQ ID NO: 725747 - DNA, 12 bp, Homo sapiens
tctgttccaaat

SEQ ID NO: 725748 - DNA, 13 bp, Homo sapiens
tctgttccaaatt

SEQ ID NO: 725749 - DNA, 22 bp, Homo sapiens
tctgttccaaattcagtttcat

SEQ ID NO: 725750 - DNA, 23 bp, Homo sapiens
tctgttccaaattcagtttcata

SEQ ID NO: 725751 - DNA, 13 bp, Homo sapiens
tctgttcccaagg

SEQ ID NO: 725752 - DNA, 13 bp, Homo sapiens
tctgttccccctt

SEQ ID NO: 725753 - DNA, 19 bp, Homo sapiens
tctgttcctcaatggcctt

SEQ ID NO: 725754 - DNA, 15 bp, Homo sapiens
tctgttctaacatgt

SEQ ID NO: 725755 - DNA, 20 bp, Homo sapiens
tctgttctacatagatgctt

SEQ ID NO: 725756 - DNA, 20 bp, Homo sapiens
tctgttctagttttttactt

SEQ ID NO: 725757 - DNA, 15 bp, Homo sapiens
tctgttctctcccct

SEQ ID NO: 725758 - DNA, 17 bp, Homo sapiens
tctgttctctcccctca

SEQ ID NO: 725759 - DNA, 18 bp, Homo sapiens
tctgttctctcccctcac

SEQ ID NO: 725760 - DNA, 15 bp, Homo sapiens
tctgttctctgctga

SEQ ID NO: 725761 - DNA, 17 bp, Homo sapiens
tctgttctgcacacagc

SEQ ID NO: 725762 - DNA, 23 bp, Homo sapiens
tctgttctgttgatcccacttca

SEQ ID NO: 725763 - DNA, 16 bp, Homo sapiens
tctgttcttacaaatg

SEQ ID NO: 725764 - DNA, 22 bp, Homo sapiens
tctgttgaaaaggtgtcctttt

SEQ ID NO: 725765 - DNA, 13 bp, Homo sapiens
tctgttgaacagc

SEQ ID NO: 725766 - DNA, 13 bp, Homo sapiens
tctgttgacctgt

SEQ ID NO: 725767 - DNA, 17 bp, Homo sapiens
tctgttgacctgtgcac

SEQ ID NO: 725768 - DNA, 20 bp, Homo sapiens
tctgttgatcccacttcact

SEQ ID NO: 725769 - DNA, 23 bp, Homo sapiens
tctgttgatcccacttcactgtg

SEQ ID NO: 725770 - DNA, 22 bp, Homo sapiens
tctgttgatctacccgtgcctg

SEQ ID NO: 725771 - DNA, 23 bp, Homo sapiens
tctgttgatgttaactgagctac

SEQ ID NO: 725772 - DNA, 18 bp, Homo sapiens
tctgttgccacaaccctg

SEQ ID NO: 725773 - DNA, 19 bp, Homo sapiens
tctgttgccttatttctca

SEQ ID NO: 725774 - DNA, 13 bp, Homo sapiens
tctgttgctggag

SEQ ID NO: 725775 - DNA, 20 bp, Homo sapiens
tctgttggcaggctggccag

SEQ ID NO: 725776 - DNA, 18 bp, Homo sapiens
tctgttggtccactgtgt

SEQ ID NO: 725777 - DNA, 19 bp, Homo sapiens
tctgttgtaagtaataatt

SEQ ID NO: 725778 - DNA, 17 bp, Homo sapiens
tctgttgtactatggaa

SEQ ID NO: 725779 - DNA, 16 bp, Homo sapiens
tctgttgttctgtggt

SEQ ID NO: 725780 - DNA, 20 bp, Homo sapiens
tctgttgtttggttcaggga

SEQ ID NO: 725781 - DNA, 14 bp, Homo sapiens
tctgtttaaagtgg

SEQ ID NO: 725782 - DNA, 22 bp, Homo sapiens
tctgtttattcttccagaatgc

SEQ ID NO: 725783 - DNA, 20 bp, Homo sapiens
tctgtttcagagcataaaac

SEQ ID NO: 725784 - DNA, 12 bp, Homo sapiens
tctgtttcctga

SEQ ID NO: 725785 - DNA, 17 bp, Homo sapiens
tctgtttcctgaaatat

SEQ ID NO: 725786 - DNA, 15 bp, Homo sapiens
tctgtttctctgctg

SEQ ID NO: 725787 - DNA, 16 bp, Homo sapiens
tctgtttctctgctgt

SEQ ID NO: 725788 - DNA, 17 bp, Homo sapiens
tctgtttctctgctgtc

SEQ ID NO: 725789 - DNA, 15 bp, Homo sapiens
tctgtttgaggagag

SEQ ID NO: 725790 - DNA, 16 bp, Homo sapiens
tctgtttgattctttt

SEQ ID NO: 725791 - DNA, 14 bp, Homo sapiens
tctgtttgccactt

SEQ ID NO: 725792 - DNA, 13 bp, Homo sapiens
tctgtttgctgtg

SEQ ID NO: 725793 - DNA, 20 bp, Homo sapiens
tctgtttggcacttgtattt

SEQ ID NO: 725794 - DNA, 12 bp, Homo sapiens
tctgtttgtaaa

SEQ ID NO: 725795 - DNA, 17 bp, Homo sapiens
tctgtttgtctgaacaa

SEQ ID NO: 725796 - DNA, 15 bp, Homo sapiens
tctgtttgtgggact

SEQ ID NO: 725797 - DNA, 14 bp, Homo sapiens
tctgtttgttaaaa

SEQ ID NO: 725798 - DNA, 21 bp, Homo sapiens
tctgtttgttaaaactggcat

SEQ ID NO: 725799 - DNA, 14 bp, Homo sapiens
tctgtttgttgact

SEQ ID NO: 725800 - DNA, 13 bp, Homo sapiens
tctgtttgtttca

SEQ ID NO: 725801 - DNA, 24 bp, Homo sapiens
tctgttttagttggaatgactgaa

SEQ ID NO: 725802 - DNA, 21 bp, Homo sapiens
tctgttttcgtaccttcccac

SEQ ID NO: 725803 - DNA, 16 bp, Homo sapiens
tctgttttgcctgaag

SEQ ID NO: 725804 - DNA, 20 bp, Homo sapiens
tctgttttggtcccctccct

SEQ ID NO: 725805 - DNA, 21 bp, Homo sapiens
tctgttttggtcccctccctc

SEQ ID NO: 725806 - DNA, 19 bp, Homo sapiens
tctgttttgtggtttggaa

SEQ ID NO: 725807 - DNA, 22 bp, Homo sapiens
tctgttttgttaatatacccca

SEQ ID NO: 725808 - DNA, 16 bp, Homo sapiens
tctgtttttgtatctt

SEQ ID NO: 725809 - DNA, 16 bp, Homo sapiens
tcttaaaaaatgtgaa

SEQ ID NO: 725810 - DNA, 18 bp, Homo sapiens
tcttaaaaaatgtgaaat

SEQ ID NO: 725811 - DNA, 22 bp, Homo sapiens
tcttaaaaaatgtgaaatgctt

SEQ ID NO: 725812 - DNA, 13 bp, Homo sapiens
tcttaaaaacaac

SEQ ID NO: 725813 - DNA, 13 bp, Homo sapiens
tcttaaaaagtgg

SEQ ID NO: 725814 - DNA, 18 bp, Homo sapiens
tcttaaaaagtggaaaaa

SEQ ID NO: 725815 - DNA, 13 bp, Homo sapiens
tcttaaaaatatt

SEQ ID NO: 725816 - DNA, 20 bp, Homo sapiens
tcttaaaaatgttttttcat

SEQ ID NO: 725817 - DNA, 19 bp, Homo sapiens
tcttaaaagctatcttcat

SEQ ID NO: 725818 - DNA, 24 bp, Homo sapiens
tcttaaaagctatcttcatgtaaa

SEQ ID NO: 725819 - DNA, 15 bp, Homo sapiens
tcttaaaagtacttt

SEQ ID NO: 725820 - DNA, 17 bp, Homo sapiens
tcttaaaagtactttaa

SEQ ID NO: 725821 - DNA, 22 bp, Homo sapiens
tcttaaaagtactttaaaaagg

SEQ ID NO: 725822 - DNA, 23 bp, Homo sapiens
tcttaaaagttgtgattccagat

SEQ ID NO: 725823 - DNA, 19 bp, Homo sapiens
tcttaaaatatatttcaga

SEQ ID NO: 725824 - DNA, 20 bp, Homo sapiens
tcttaaaatatatttcagat

SEQ ID NO: 725825 - DNA, 15 bp, Homo sapiens
tcttaaaatatcttc

SEQ ID NO: 725826 - DNA, 12 bp, Homo sapiens
tcttaaactaaa

SEQ ID NO: 725827 - DNA, 20 bp, Homo sapiens
tcttaaagctgcctgtagtt

SEQ ID NO: 725828 - DNA, 18 bp, Homo sapiens
tcttaaagtattcttctc

SEQ ID NO: 725829 - DNA, 19 bp, Homo sapiens
tcttaaagtgccagtattt

SEQ ID NO: 725830 - DNA, 13 bp, Homo sapiens
tgcacacgggcga

SEQ ID NO: 725831 - DNA, 13 bp, Homo sapiens
tgcacacgtgtgt

SEQ ID NO: 725832 - DNA, 16 bp, Homo sapiens
tgcacacgtgtgtatg

SEQ ID NO: 725833 - DNA, 17 bp, Homo sapiens
tgcacacgtgtgtatga

SEQ ID NO: 725834 - DNA, 19 bp, Homo sapiens
tgcacactagcctctccag

SEQ ID NO: 725835 - DNA, 16 bp, Homo sapiens
tgcacactatttccct

SEQ ID NO: 725836 - DNA, 16 bp, Homo sapiens
tgcacacttccccatc

SEQ ID NO: 725837 - DNA, 23 bp, Homo sapiens
tgcacacttgtgtgtgggctgtg

SEQ ID NO: 725838 - DNA, 22 bp, Homo sapiens
tgcacactttgccatattttca

SEQ ID NO: 725839 - DNA, 12 bp, Homo sapiens
tgcacagaaaac

SEQ ID NO: 725840 - DNA, 19 bp, Homo sapiens
tgcacagaaaaccgagaat

SEQ ID NO: 725841 - DNA, 12 bp, Homo sapiens
tgcacagagaag

SEQ ID NO: 725842 - DNA, 19 bp, Homo sapiens
tgcacagagaagctgggga

SEQ ID NO: 725843 - DNA, 16 bp, Homo sapiens
tgcacagagcacactt

SEQ ID NO: 725844 - DNA, 17 bp, Homo sapiens
tgcacagagttgttaca

SEQ ID NO: 725845 - DNA, 10 bp, Homo sapiens
tgcacagata

SEQ ID NO: 725846 - DNA, 17 bp, Homo sapiens
tgcacagatacctcatc

SEQ ID NO: 725847 - DNA, 18 bp, Homo sapiens
tgcacagatacctcatca

SEQ ID NO: 725848 - DNA, 21 bp, Homo sapiens
tgcacagatacctcatcatcc

SEQ ID NO: 725849 - DNA, 19 bp, Homo sapiens
tgcacagatggatttgcct

SEQ ID NO: 725850 - DNA, 18 bp, Homo sapiens
tgcacagattgctgaaac

SEQ ID NO: 725851 - DNA, 16 bp, Homo sapiens
tgcacagcacaaatta

SEQ ID NO: 725852 - DNA, 23 bp, Homo sapiens
tgcacagcacaaattagttatat

SEQ ID NO: 725853 - DNA, 12 bp, Homo sapiens
tgcacagcagga

SEQ ID NO: 725854 - DNA, 22 bp, Homo sapiens
tgcacagcaggacctgtgcttt

SEQ ID NO: 725855 - DNA, 13 bp, Homo sapiens
tgcacagctgctt

SEQ ID NO: 725856 - DNA, 14 bp, Homo sapiens
tgcacagctgcttg

SEQ ID NO: 725857 - DNA, 23 bp, Homo sapiens
tgcacagctgcttgtcctgctct

SEQ ID NO: 725858 - DNA, 18 bp, Homo sapiens
tgcacaggaaagagtcac

SEQ ID NO: 725859 - DNA, 19 bp, Homo sapiens
tgcacagggattctcacaa

SEQ ID NO: 725860 - DNA, 22 bp, Homo sapiens
tgcacaggtggctgtttcttgt

SEQ ID NO: 725861 - DNA, 22 bp, Homo sapiens
tgcacagtccacagctgaagag

SEQ ID NO: 725862 - DNA, 13 bp, Homo sapiens
tgcacagtgattt

SEQ ID NO: 725863 - DNA, 18 bp, Homo sapiens
tgcacagtgcatctcagc

SEQ ID NO: 725864 - DNA, 19 bp, Homo sapiens
tgcacagtgcatctcagcc

SEQ ID NO: 725865 - DNA, 23 bp, Homo sapiens
tgcacagttttctggctggagcc

SEQ ID NO: 725866 - DNA, 16 bp, Homo sapiens
tgcacatatacacatt

SEQ ID NO: 725867 - DNA, 12 bp, Homo sapiens
tgcacatccctg

SEQ ID NO: 725868 - DNA, 18 bp, Homo sapiens
tgcacatctgtgtcttgt

SEQ ID NO: 725869 - DNA, 24 bp, Homo sapiens
tgcacatcttggctatgtaattct

SEQ ID NO: 725870 - DNA, 13 bp, Homo sapiens
tgcacatgaaagt

SEQ ID NO: 725871 - DNA, 23 bp, Homo sapiens
tgcacatgctgtctggccctggg

SEQ ID NO: 725872 - DNA, 19 bp, Homo sapiens
tgcacatgtgccacacagt

SEQ ID NO: 725873 - DNA, 18 bp, Homo sapiens
tgcacatgtttcctctag

SEQ ID NO: 725874 - DNA, 17 bp, Homo sapiens
tgcacattcctggcccc

SEQ ID NO: 725875 - DNA, 19 bp, Homo sapiens
tgcacattgcctgttctgc

SEQ ID NO: 725876 - DNA, 22 bp, Homo sapiens
tgcacattgcctgttctgcttc

SEQ ID NO: 725877 - DNA, 13 bp, Homo sapiens
tgcacatttattt

SEQ ID NO: 725878 - DNA, 14 bp, Homo sapiens
tgcacatttctgga

SEQ ID NO: 725879 - DNA, 21 bp, Homo sapiens
tgcacatttctggattgtggt

SEQ ID NO: 725880 - DNA, 18 bp, Homo sapiens
tgcacattttccacggaa

SEQ ID NO: 725881 - DNA, 15 bp, Homo sapiens
tgcacatttttttct

SEQ ID NO: 725882 - DNA, 22 bp, Homo sapiens
tgcacatttttttctatgcata

SEQ ID NO: 725883 - DNA, 14 bp, Homo sapiens
tgcaccaaagacat

SEQ ID NO: 725884 - DNA, 17 bp, Homo sapiens
tgcaccaacctcactgc

SEQ ID NO: 725885 - DNA, 15 bp, Homo sapiens
tgcaccacacctggc

SEQ ID NO: 725886 - DNA, 16 bp, Homo sapiens
tgcaccacacctggca

SEQ ID NO: 725887 - DNA, 18 bp, Homo sapiens
tgcaccaccaagccaagg

SEQ ID NO: 725888 - DNA, 14 bp, Homo sapiens
tgcaccaccatgcc

SEQ ID NO: 725889 - DNA, 15 bp, Homo sapiens
tgcaccaccatgccc

SEQ ID NO: 725890 - DNA, 16 bp, Homo sapiens
tgcaccaccatgccca

SEQ ID NO: 725891 - DNA, 23 bp, Homo sapiens
tgcaccagagcaacctctcactc

SEQ ID NO: 725892 - DNA, 21 bp, Homo sapiens
tgcaccagagtgaaagggcta

SEQ ID NO: 725893 - DNA, 23 bp, Homo sapiens
tgcaccagagtgaaagggctatg

SEQ ID NO: 725894 - DNA, 23 bp, Homo sapiens
tgcaccagggttgaccccagagg

SEQ ID NO: 725895 - DNA, 21 bp, Homo sapiens
tgcaccatccctttttgaagt

SEQ ID NO: 725896 - DNA, 16 bp, Homo sapiens
tgcacccacctgtttt

SEQ ID NO: 725897 - DNA, 20 bp, Homo sapiens
tgcacccacctgttttctga

SEQ ID NO: 725898 - DNA, 21 bp, Homo sapiens
tgcacccacctgttttctgaa

SEQ ID NO: 725899 - DNA, 18 bp, Homo sapiens
tctttaccaaaaaccatg

SEQ ID NO: 725900 - DNA, 19 bp, Homo sapiens
tctttacctgtatacagtg

SEQ ID NO: 725901 - DNA, 18 bp, Homo sapiens
tgaagaatagaaacaagc

SEQ ID NO: 725902 - DNA, 18 bp, Homo sapiens
tgaagaatctgcccctgt

SEQ ID NO: 725903 - DNA, 20 bp, Homo sapiens
tgaagaatctgcccctgttg

SEQ ID NO: 725904 - DNA, 11 bp, Homo sapiens
tgaagaatctt

SEQ ID NO: 725905 - DNA, 22 bp, Homo sapiens
tgaagaatgcacaagaatggat

SEQ ID NO: 725906 - DNA, 17 bp, Homo sapiens
tgaagaatgcattcaaa

SEQ ID NO: 725907 - DNA, 14 bp, Homo sapiens
tgaagaattaagat

SEQ ID NO: 725908 - DNA, 12 bp, Homo sapiens
tgaagaattttg

SEQ ID NO: 725909 - DNA, 20 bp, Homo sapiens
tgaagaattttgagtgaatt

SEQ ID NO: 725910 - DNA, 11 bp, Homo sapiens
tgaagacaatg

SEQ ID NO: 725911 - DNA, 13 bp, Homo sapiens
tgaagacaatttg

SEQ ID NO: 725912 - DNA, 20 bp, Homo sapiens
tgaagacaatttgatacata

SEQ ID NO: 725913 - DNA, 22 bp, Homo sapiens
tgaagacaatttgatacataat

SEQ ID NO: 725914 - DNA, 16 bp, Homo sapiens
tgaagacacagcctcc

SEQ ID NO: 725915 - DNA, 14 bp, Homo sapiens
tgaagacaggatgg

SEQ ID NO: 725916 - DNA, 21 bp, Homo sapiens
tgaagacatagccgattctct

SEQ ID NO: 725917 - DNA, 19 bp, Homo sapiens
tgaagacattttttgctat

SEQ ID NO: 725918 - DNA, 21 bp, Homo sapiens
tgaagaccattttctggttct

SEQ ID NO: 725919 - DNA, 18 bp, Homo sapiens
tgaagacctaaagtgctt

SEQ ID NO: 725920 - DNA, 15 bp, Homo sapiens
tgaagacctttaatg

SEQ ID NO: 725921 - DNA, 17 bp, Homo sapiens
tgaagacggaaaacaat

SEQ ID NO: 725922 - DNA, 16 bp, Homo sapiens
tgaagactatgaaaat

SEQ ID NO: 725923 - DNA, 15 bp, Homo sapiens
tgaagactgagaact

SEQ ID NO: 725924 - DNA, 16 bp, Homo sapiens
tgaagactgagaactt

SEQ ID NO: 725925 - DNA, 17 bp, Homo sapiens
tgaagactggaagctaa

SEQ ID NO: 725926 - DNA, 16 bp, Homo sapiens
tgaagacttcctctct

SEQ ID NO: 725927 - DNA, 23 bp, Homo sapiens
tgaagagaaccgagcaaagatca

SEQ ID NO: 725928 - DNA, 24 bp, Homo sapiens
tgaagagaaccgagcaaagatcaa

SEQ ID NO: 725929 - DNA, 21 bp, Homo sapiens
tgaagagacagagacaagtaa

SEQ ID NO: 725930 - DNA, 16 bp, Homo sapiens
tgaagagatccttctg

SEQ ID NO: 725931 - DNA, 22 bp, Homo sapiens
tgaagagcgctcctctgccttg

SEQ ID NO: 725932 - DNA, 19 bp, Homo sapiens
tgaagagctgtcttcccct

SEQ ID NO: 725933 - DNA, 16 bp, Homo sapiens
tgaagagcttgctttg

SEQ ID NO: 725934 - DNA, 18 bp, Homo sapiens
tgaagagcttgctttgat

SEQ ID NO: 725935 - DNA, 17 bp, Homo sapiens
tgaagagcttgtgtcct

SEQ ID NO: 725936 - DNA, 13 bp, Homo sapiens
tgaagaggaacag

SEQ ID NO: 725937 - DNA, 18 bp, Homo sapiens
tgaagaggagattggcca

SEQ ID NO: 725938 - DNA, 15 bp, Homo sapiens
tgaagaggcgggcca

SEQ ID NO: 725939 - DNA, 17 bp, Homo sapiens
tgaagaggcgggccagc

SEQ ID NO: 725940 - DNA, 21 bp, Homo sapiens
tgaagaggcgggccagccagg

SEQ ID NO: 725941 - DNA, 13 bp, Homo sapiens
tgaagaggggcag

SEQ ID NO: 725942 - DNA, 15 bp, Homo sapiens
tgaagaggggcagcc

SEQ ID NO: 725943 - DNA, 18 bp, Homo sapiens
tgaagaggggcagccctt

SEQ ID NO: 725944 - DNA, 20 bp, Homo sapiens
tgaagaggggcagcccttgc

SEQ ID NO: 725945 - DNA, 20 bp, Homo sapiens
tgaagagtatccttccttca

SEQ ID NO: 725946 - DNA, 17 bp, Homo sapiens
tgaagagtcctctgaat

SEQ ID NO: 725947 - DNA, 22 bp, Homo sapiens
tgaagagtttttttctgtttat

SEQ ID NO: 725948 - DNA, 17 bp, Homo sapiens
tgaagataatttgcata

SEQ ID NO: 725949 - DNA, 21 bp, Homo sapiens
tgaagatatcttgaaatgaaa

SEQ ID NO: 725950 - DNA, 22 bp, Homo sapiens
tgaagatcatatacgtgaaaat

SEQ ID NO: 725951 - DNA, 19 bp, Homo sapiens
tgaagatctgagatttttt

SEQ ID NO: 725952 - DNA, 20 bp, Homo sapiens
tgaagatgaaatatatattg

SEQ ID NO: 725953 - DNA, 18 bp, Homo sapiens
tgaagatgaaggggctct

SEQ ID NO: 725954 - DNA, 22 bp, Homo sapiens
tgaagatgcaatcagacaagtg

SEQ ID NO: 725955 - DNA, 17 bp, Homo sapiens
tgaagatgcccctgctc

SEQ ID NO: 725956 - DNA, 21 bp, Homo sapiens
tgaagatggcatcctgtgaag

SEQ ID NO: 725957 - DNA, 18 bp, Homo sapiens
tgaagatggtttcaattc

SEQ ID NO: 725958 - DNA, 23 bp, Homo sapiens
tgaagatggtttcaattcagatt

SEQ ID NO: 725959 - DNA, 13 bp, Homo sapiens
tgaagatgtctcc

SEQ ID NO: 725960 - DNA, 15 bp, Homo sapiens
tgaagatgttaaaat

SEQ ID NO: 725961 - DNA, 21 bp, Homo sapiens
tgaagattaggagaaacacat

SEQ ID NO: 725962 - DNA, 18 bp, Homo sapiens
tgaagattatatgaagtt

SEQ ID NO: 725963 - DNA, 15 bp, Homo sapiens
tgaagattctcctgt

SEQ ID NO: 725964 - DNA, 14 bp, Homo sapiens
tgaagcaaatcaga

SEQ ID NO: 725965 - DNA, 15 bp, Homo sapiens
tgaagcaaatcagaa

SEQ ID NO: 725966 - DNA, 20 bp, Homo sapiens
tgaagcaaatcgaatgaaat

SEQ ID NO: 725967 - DNA, 11 bp, Homo sapiens
tgaagcaaatg

SEQ ID NO: 725968 - DNA, 13 bp, Homo sapiens
tgaagcaaatgtg

SEQ ID NO: 725969 - DNA, 14 bp, Homo sapiens
tgaagcaaatgtgt

SEQ ID NO: 725970 - DNA, 13 bp, Homo sapiens
tgaagcaaggaag

SEQ ID NO: 725971 - DNA, 20 bp, Homo sapiens
tgaagcaaggaagatataca

SEQ ID NO: 725972 - DNA, 21 bp, Homo sapiens
tgaagcaaggaagatatacat

SEQ ID NO: 725973 - DNA, 13 bp, Homo sapiens
tgaagcaataact

SEQ ID NO: 725974 - DNA, 14 bp, Homo sapiens
tgaagcaataactc

SEQ ID NO: 725975 - DNA, 19 bp, Homo sapiens
tgaagcaataactccaagc

SEQ ID NO: 725976 - DNA, 20 bp, Homo sapiens
tgaagcaataactccaagca

SEQ ID NO: 725977 - DNA, 22 bp, Homo sapiens
tgaagcaataactccaagcaga

SEQ ID NO: 725978 - DNA, 18 bp, Homo sapiens
tgaagcaatggatatttg

SEQ ID NO: 725979 - DNA, 22 bp, Homo sapiens
tgaagcacttaagtcttcctta

SEQ ID NO: 725980 - DNA, 23 bp, Homo sapiens
tgaagcacttaagtcttccttaa

SEQ ID NO: 725981 - DNA, 12 bp, Homo sapiens
tgaagcagcact

SEQ ID NO: 725982 - DNA, 13 bp, Homo sapiens
tgaagcagcactg

SEQ ID NO: 725983 - DNA, 15 bp, Homo sapiens
tgaagcagcactgtg

SEQ ID NO: 725984 - DNA, 13 bp, Homo sapiens
tgaagcagcctct

SEQ ID NO: 725985 - DNA, 23 bp, Homo sapiens
tgaattataaatgtgtttatagc

SEQ ID NO: 725986 - DNA, 14 bp, Homo sapiens
tgaattataacagt

SEQ ID NO: 725987 - DNA, 17 bp, Homo sapiens
tgaattatgcttccaca

SEQ ID NO: 725988 - DNA, 13 bp, Homo sapiens
tgaattattcaat

SEQ ID NO: 725989 - DNA, 15 bp, Homo sapiens
tgaattattctgatt

SEQ ID NO: 725990 - DNA, 13 bp, Homo sapiens
tgaattattgaca

SEQ ID NO: 725991 - DNA, 14 bp, Homo sapiens
tgaattattgacac

SEQ ID NO: 725992 - DNA, 15 bp, Homo sapiens
tgaattattgacact

SEQ ID NO: 725993 - DNA, 13 bp, Homo sapiens
tgaattcattata

SEQ ID NO: 725994 - DNA, 14 bp, Homo sapiens
tgaattcccagact

SEQ ID NO: 725995 - DNA, 16 bp, Homo sapiens
tgaattcctaaaatta

SEQ ID NO: 725996 - DNA, 23 bp, Homo sapiens
tgaattcctaaaattatggaaac

SEQ ID NO: 725997 - DNA, 22 bp, Homo sapiens
tgaattcgatgcgtattctgtg

SEQ ID NO: 725998 - DNA, 19 bp, Homo sapiens
tgaattctgcaatgttttc

SEQ ID NO: 725999 - DNA, 12 bp, Homo sapiens
tgaattctgcct

SEQ ID NO: 726000 - DNA, 17 bp, Homo sapiens
tgaattcttatgcttat

SEQ ID NO: 726001 - DNA, 16 bp, Homo sapiens
tgaattctttaaatat

SEQ ID NO: 726002 - DNA, 13 bp, Homo sapiens
tgaattctttcaa

SEQ ID NO: 726003 - DNA, 22 bp, Homo sapiens
tgaattgaatctacaaaagtga

SEQ ID NO: 726004 - DNA, 16 bp, Homo sapiens
tgaattgcctgcagag

SEQ ID NO: 726005 - DNA, 17 bp, Homo sapiens
tgaattgtgaccaagtt

SEQ ID NO: 726006 - DNA, 20 bp, Homo sapiens
tgaattgtgtattgatgcaa

SEQ ID NO: 726007 - DNA, 13 bp, Homo sapiens
tgaattgttacat

SEQ ID NO: 726008 - DNA, 15 bp, Homo sapiens
tgaattgttatgaaa

SEQ ID NO: 726009 - DNA, 12 bp, Homo sapiens
tgaatttaaata

SEQ ID NO: 726010 - DNA, 13 bp, Homo sapiens
tgaatttaaataa

SEQ ID NO: 726011 - DNA, 14 bp, Homo sapiens
tgaatttaaataaa

SEQ ID NO: 726012 - DNA, 18 bp, Homo sapiens
tgaatttattgatattta

SEQ ID NO: 726013 - DNA, 13 bp, Homo sapiens
tgaatttcaggca

SEQ ID NO: 726014 - DNA, 20 bp, Homo sapiens
tgaatttctagacagtattg

SEQ ID NO: 726015 - DNA, 20 bp, Homo sapiens
tgaatttcttctaattattt

SEQ ID NO: 726016 - DNA, 15 bp, Homo sapiens
tgaatttcttttgcc

SEQ ID NO: 726017 - DNA, 13 bp, Homo sapiens
tgaatttgaatga

SEQ ID NO: 726018 - DNA, 15 bp, Homo sapiens
tgaatttgaatgaaa

SEQ ID NO: 726019 - DNA, 14 bp, Homo sapiens
tgaatttgataaaa

SEQ ID NO: 726020 - DNA, 16 bp, Homo sapiens
tgaatttgcaacagta

SEQ ID NO: 726021 - DNA, 20 bp, Homo sapiens
tgaatttggagactctgtgg

SEQ ID NO: 726022 - DNA, 14 bp, Homo sapiens
tgaatttgggcctc

SEQ ID NO: 726023 - DNA, 15 bp, Homo sapiens
tgaattttaaaatct

SEQ ID NO: 726024 - DNA, 13 bp, Homo sapiens
tgaattttaaagt

SEQ ID NO: 726025 - DNA, 23 bp, Homo sapiens
tgaattttaaatctaaatctatt

SEQ ID NO: 726026 - DNA, 19 bp, Homo sapiens
tgaattttataaataaaat

SEQ ID NO: 726027 - DNA, 16 bp, Homo sapiens
tgaattttatcagcca

SEQ ID NO: 726028 - DNA, 22 bp, Homo sapiens
tgaattttggggattttcaaaa

SEQ ID NO: 726029 - DNA, 18 bp, Homo sapiens
tgaattttgtatgctgaa

SEQ ID NO: 726030 - DNA, 20 bp, Homo sapiens
tgaattttgttctctgggag

SEQ ID NO: 726031 - DNA, 22 bp, Homo sapiens
tgaatttttaaaacccatttaa

SEQ ID NO: 726032 - DNA, 17 bp, Homo sapiens
tgaatttttacatttgt

SEQ ID NO: 726033 - DNA, 21 bp, Homo sapiens
tgaatttttatttctttttaa

SEQ ID NO: 726034 - DNA, 13 bp, Homo sapiens
tgaatttttctct

SEQ ID NO: 726035 - DNA, 15 bp, Homo sapiens
tgaatttttctctaa

SEQ ID NO: 726036 - DNA, 15 bp, Homo sapiens
tgaatttttctcttc

SEQ ID NO: 726037 - DNA, 21 bp, Homo sapiens
tgaatttttcttcctctccac

SEQ ID NO: 726038 - DNA, 13 bp, Homo sapiens
tgaatttttgcct

SEQ ID NO: 726039 - DNA, 16 bp, Homo sapiens
tgaatttttttgtaat

SEQ ID NO: 726040 - DNA, 21 bp, Homo sapiens
tgacaaaaaatgttttaaaga

SEQ ID NO: 726041 - DNA, 22 bp, Homo sapiens
tgacaaaaaggtgcagaaggca

SEQ ID NO: 726042 - DNA, 14 bp, Homo sapiens
tgacaaaaataaca

SEQ ID NO: 726043 - DNA, 16 bp, Homo sapiens
tgacaaaacctaactt

SEQ ID NO: 726044 - DNA, 14 bp, Homo sapiens
tgacaaaagaaaat

SEQ ID NO: 726045 - DNA, 20 bp, Homo sapiens
tgacaaaatgggaggaggaa

SEQ ID NO: 726046 - DNA, 18 bp, Homo sapiens
tgacaaaattcatttgct

SEQ ID NO: 726047 - DNA, 20 bp, Homo sapiens
tgacaaacctagcttttaaa

SEQ ID NO: 726048 - DNA, 17 bp, Homo sapiens
tgacaaagactcctctg

SEQ ID NO: 726049 - DNA, 21 bp, Homo sapiens
tgacaaagactcctctgggcc

SEQ ID NO: 726050 - DNA, 23 bp, Homo sapiens
tgacaaagatggctcagaggggg

SEQ ID NO: 726051 - DNA, 16 bp, Homo sapiens
tgacaaaggagccttg

SEQ ID NO: 726052 - DNA, 17 bp, Homo sapiens
tgacaaaggagccttga

SEQ ID NO: 726053 - DNA, 14 bp, Homo sapiens
tgacaaaggatgaa

SEQ ID NO: 726054 - DNA, 18 bp, Homo sapiens
tgacaaaggatgaagaac

SEQ ID NO: 726055 - DNA, 18 bp, Homo sapiens
tgacaaagtgttgaaaat

SEQ ID NO: 726056 - DNA, 23 bp, Homo sapiens
tgacaaagtgttgaaaatgtatt

SEQ ID NO: 726057 - DNA, 20 bp, Homo sapiens
tgacaaataaattaggacca

SEQ ID NO: 726058 - DNA, 17 bp, Homo sapiens
tgacaaattttaattat

SEQ ID NO: 726059 - DNA, 15 bp, Homo sapiens
tgacaacacttaata

SEQ ID NO: 726060 - DNA, 20 bp, Homo sapiens
tgacaacacttaatagcaac

SEQ ID NO: 726061 - DNA, 11 bp, Homo sapiens
tgacaacagaa

SEQ ID NO: 726062 - DNA, 16 bp, Homo sapiens
tgacaacagactgaat

SEQ ID NO: 726063 - DNA, 15 bp, Homo sapiens
tgacaacatcccaca

SEQ ID NO: 726064 - DNA, 19 bp, Homo sapiens
tgacaacatgaaacctatt

SEQ ID NO: 726065 - DNA, 20 bp, Homo sapiens
tgacaaccaccgctccccag

SEQ ID NO: 726066 - DNA, 21 bp, Homo sapiens
tgacaaccaccgctccccagc

SEQ ID NO: 726067 - DNA, 23 bp, Homo sapiens
tgacaaccaccgctccccagccc

SEQ ID NO: 726068 - DNA, 16 bp, Homo sapiens
tgacaaccattaaagt

SEQ ID NO: 726069 - DNA, 17 bp, Homo sapiens
tgacaaccattaaagtc

SEQ ID NO: 726070 - DNA, 15 bp, Homo sapiens
tgacaacgtctcttc

SEQ ID NO: 726071 - DNA, 13 bp, Homo sapiens
tgacaactaaaat

SEQ ID NO: 726072 - DNA, 18 bp, Homo sapiens
tgacaactgcacatgaaa

SEQ ID NO: 726073 - DNA, 20 bp, Homo sapiens
tgacaactgcacatgaaagt

SEQ ID NO: 726074 - DNA, 16 bp, Homo sapiens
tgacaactgtgactgt

SEQ ID NO: 726075 - DNA, 22 bp, Homo sapiens
tgacaacttagctcaggtgcct

SEQ ID NO: 726076 - DNA, 23 bp, Homo sapiens
tgacaagagcctgatctcttcct

SEQ ID NO: 726077 - DNA, 15 bp, Homo sapiens
tgacaagcactgcta

SEQ ID NO: 726078 - DNA, 17 bp, Homo sapiens
tgacaagccccaggcag

SEQ ID NO: 726079 - DNA, 15 bp, Homo sapiens
tgacaagctgacttg

SEQ ID NO: 726080 - DNA, 22 bp, Homo sapiens
tgacaagctgacttggcactta

SEQ ID NO: 726081 - DNA, 15 bp, Homo sapiens
tgacaaggccccaga

SEQ ID NO: 726082 - DNA, 16 bp, Homo sapiens
tgacaaggtcaaattt

SEQ ID NO: 726083 - DNA, 20 bp, Homo sapiens
tgacaataaaaatgttttga

SEQ ID NO: 726084 - DNA, 20 bp, Homo sapiens
tgacaataaaatattattga

SEQ ID NO: 726085 - DNA, 14 bp, Homo sapiens
tgacaataaatgtg

SEQ ID NO: 726086 - DNA, 17 bp, Homo sapiens
tgacaataatttcaggt

SEQ ID NO: 726087 - DNA, 22 bp, Homo sapiens
tgacaatactgctgccttaccc

SEQ ID NO: 726088 - DNA, 18 bp, Homo sapiens
tgacaatatcaatcacat

SEQ ID NO: 726089 - DNA, 23 bp, Homo sapiens
tgacaatcaaagaaaagactttt

SEQ ID NO: 726090 - DNA, 19 bp, Homo sapiens
tgacaatgcaatgaaacag

SEQ ID NO: 726091 - DNA, 15 bp, Homo sapiens
tgacaatggcagcta

SEQ ID NO: 726092 - DNA, 13 bp, Homo sapiens
tgacaattctgca

SEQ ID NO: 726093 - DNA, 15 bp, Homo sapiens
tgacaattctgcatg

SEQ ID NO: 726094 - DNA, 22 bp, Homo sapiens
tgacaattctgcatgtactagt

SEQ ID NO: 726095 - DNA, 16 bp, Homo sapiens
tgacaattctgggtgc

SEQ ID NO: 726096 - DNA, 16 bp, Homo sapiens
tgacaattctgttttt

SEQ ID NO: 726097 - DNA, 18 bp, Homo sapiens
tgacaattttgtacaaat

SEQ ID NO: 726098 - DNA, 19 bp, Homo sapiens
tgacacaaagcttctaaag

SEQ ID NO: 726099 - DNA, 18 bp, Homo sapiens
tgacacaaaggtggaata

SEQ ID NO: 726100 - DNA, 16 bp, Homo sapiens
tgacacaagtggacct

SEQ ID NO: 726101 - DNA, 19 bp, Homo sapiens
tgacacaagtggaccttag

SEQ ID NO: 726102 - DNA, 11 bp, Homo sapiens
tgacacaccag

SEQ ID NO: 726103 - DNA, 23 bp, Homo sapiens
tgacacaccaggcgctaattcaa

SEQ ID NO: 726104 - DNA, 23 bp, Homo sapiens
tgacacaggtcagggctcagagt

SEQ ID NO: 726105 - DNA, 16 bp, Homo sapiens
tgacacaggtctttcc

SEQ ID NO: 726106 - DNA, 22 bp, Homo sapiens
tgacacagtcttggctcactgc

SEQ ID NO: 726107 - DNA, 20 bp, Homo sapiens
tgacacagtgctcgaccttg

SEQ ID NO: 726108 - DNA, 17 bp, Homo sapiens
tgacacatagtttttca

SEQ ID NO: 726109 - DNA, 16 bp, Homo sapiens
tgacacatggcccctc

SEQ ID NO: 726110 - DNA, 19 bp, Homo sapiens
tgaagcttgcaccttttca

SEQ ID NO: 726111 - DNA, 21 bp, Homo sapiens
tgaaggaaaagcaagaaacag

SEQ ID NO: 726112 - DNA, 16 bp, Homo sapiens
tgaaggaaacagttaa

SEQ ID NO: 726113 - DNA, 12 bp, Homo sapiens
tgaaggaaataa

SEQ ID NO: 726114 - DNA, 15 bp, Homo sapiens
tgaaggaaataaagg

SEQ ID NO: 726115 - DNA, 20 bp, Homo sapiens
tgaaggaataaattgctcct

SEQ ID NO: 726116 - DNA, 15 bp, Homo sapiens
tgaaggaatatatgg

SEQ ID NO: 726117 - DNA, 20 bp, Homo sapiens
tgaaggaatcattccagtgc

SEQ ID NO: 726118 - DNA, 19 bp, Homo sapiens
tgaaggacacttcctgcct

SEQ ID NO: 726119 - DNA, 14 bp, Homo sapiens
tgaaggactgcaga

SEQ ID NO: 726120 - DNA, 17 bp, Homo sapiens
tgaaggactgcagacag

SEQ ID NO: 726121 - DNA, 18 bp, Homo sapiens
tgaaggactttggcccta

SEQ ID NO: 726122 - DNA, 16 bp, Homo sapiens
tgaaggagagcccttc

SEQ ID NO: 726123 - DNA, 19 bp, Homo sapiens
tgaaggagaggaggaatta

SEQ ID NO: 726124 - DNA, 22 bp, Homo sapiens
tgaaggagaggcaacatccaaa

SEQ ID NO: 726125 - DNA, 23 bp, Homo sapiens
tgaaggagccccattcctgggaa

SEQ ID NO: 726126 - DNA, 21 bp, Homo sapiens
tgaaggattatggaaaaataa

SEQ ID NO: 726127 - DNA, 22 bp, Homo sapiens
tgaaggattatggaaaaataaa

SEQ ID NO: 726128 - DNA, 17 bp, Homo sapiens
tgaaggattgcatcctg

SEQ ID NO: 726129 - DNA, 14 bp, Homo sapiens
tgaaggcaaaattg

SEQ ID NO: 726130 - DNA, 18 bp, Homo sapiens
tgaaggcagaaagcaaaa

SEQ ID NO: 726131 - DNA, 14 bp, Homo sapiens
tgaaggcagtctga

SEQ ID NO: 726132 - DNA, 19 bp, Homo sapiens
tgaaggcagtctgaaccct

SEQ ID NO: 726133 - DNA, 14 bp, Homo sapiens
tgaaggccctgctg

SEQ ID NO: 726134 - DNA, 18 bp, Homo sapiens
tgaaggctaaaaagcaac

SEQ ID NO: 726135 - DNA, 15 bp, Homo sapiens
tgaaggcttctctct

SEQ ID NO: 726136 - DNA, 23 bp, Homo sapiens
tgaaggctttaataaaggccaca

SEQ ID NO: 726137 - DNA, 20 bp, Homo sapiens
tgaagggaccttgaagggta

SEQ ID NO: 726138 - DNA, 17 bp, Homo sapiens
tgaagggagagccagct

SEQ ID NO: 726139 - DNA, 21 bp, Homo sapiens
tgaagggaggtgaagaggctg

SEQ ID NO: 726140 - DNA, 16 bp, Homo sapiens
tgaagggatgggggaa

SEQ ID NO: 726141 - DNA, 22 bp, Homo sapiens
tgaagggatgggggaagatttt

SEQ ID NO: 726142 - DNA, 12 bp, Homo sapiens
tgaagggctgga

SEQ ID NO: 726143 - DNA, 23 bp, Homo sapiens
tgaaggggcaaattcttttgaat

SEQ ID NO: 726144 - DNA, 22 bp, Homo sapiens
tgaaggggcacaccactgccct

SEQ ID NO: 726145 - DNA, 22 bp, Homo sapiens
tgaaggggtgcacccacctgtt

SEQ ID NO: 726146 - DNA, 14 bp, Homo sapiens
tgaagggtcctgcc

SEQ ID NO: 726147 - DNA, 14 bp, Homo sapiens
tgaaggtaaataaa

SEQ ID NO: 726148 - DNA, 20 bp, Homo sapiens
tgaaggtattttgtagatgt

SEQ ID NO: 726149 - DNA, 20 bp, Homo sapiens
tgaaggtctttgttatgaca

SEQ ID NO: 726150 - DNA, 15 bp, Homo sapiens
tgaaggtgccagacg

SEQ ID NO: 726151 - DNA, 17 bp, Homo sapiens
tgaaggtgccattttaa

SEQ ID NO: 726152 - DNA, 16 bp, Homo sapiens
tgaaggttaggattta

SEQ ID NO: 726153 - DNA, 15 bp, Homo sapiens
tgaaggttcccaagg

SEQ ID NO: 726154 - DNA, 16 bp, Homo sapiens
tgaaggttcccaagga

SEQ ID NO: 726155 - DNA, 21 bp, Homo sapiens
tgaaggtttacaatttacaaa

SEQ ID NO: 726156 - DNA, 20 bp, Homo sapiens
tgaaggttttttttttaagt

SEQ ID NO: 726157 - DNA, 18 bp, Homo sapiens
tgaagtaacatgcatact

SEQ ID NO: 726158 - DNA, 15 bp, Homo sapiens
tgaagtaatatgcac

SEQ ID NO: 726159 - DNA, 16 bp, Homo sapiens
tgaagtaatatgcaca

SEQ ID NO: 726160 - DNA, 14 bp, Homo sapiens
tgaagtacaaacat

SEQ ID NO: 726161 - DNA, 20 bp, Homo sapiens
tgaagtacatattaggaaaa

SEQ ID NO: 726162 - DNA, 13 bp, Homo sapiens
tgaagtagaagtt

SEQ ID NO: 726163 - DNA, 15 bp, Homo sapiens
tgaagtagaagttac

SEQ ID NO: 726164 - DNA, 14 bp, Homo sapiens
tgaagtaggtggct

SEQ ID NO: 726165 - DNA, 13 bp, Homo sapiens
tgaagtatattct

SEQ ID NO: 726166 - DNA, 22 bp, Homo sapiens
tgaagtatattcttattggaaa

SEQ ID NO: 726167 - DNA, 17 bp, Homo sapiens
tgaagtattaagcctac

SEQ ID NO: 726168 - DNA, 17 bp, Homo sapiens
tgaagtatttctcactc

SEQ ID NO: 726169 - DNA, 20 bp, Homo sapiens
tgaagtattttgctggaata

SEQ ID NO: 726170 - DNA, 15 bp, Homo sapiens
tgaagtcactgcaca

SEQ ID NO: 726171 - DNA, 21 bp, Homo sapiens
tgaagtcactgcacagtgcat

SEQ ID NO: 726172 - DNA, 12 bp, Homo sapiens
tgaagtcagcca

SEQ ID NO: 726173 - DNA, 23 bp, Homo sapiens
tgaagtcagccacactgggcctg

SEQ ID NO: 726174 - DNA, 22 bp, Homo sapiens
tgaagtccttcagtgagcccct

SEQ ID NO: 726175 - DNA, 23 bp, Homo sapiens
tgaagtccttcagtgagcccctc

SEQ ID NO: 726176 - DNA, 16 bp, Homo sapiens
tgaagtctagaatcat

SEQ ID NO: 726177 - DNA, 20 bp, Homo sapiens
tgaagtctctttttcttcct

SEQ ID NO: 726178 - DNA, 17 bp, Homo sapiens
tgaagtcttccctcaga

SEQ ID NO: 726179 - DNA, 13 bp, Homo sapiens
tgaagtgaatctg

SEQ ID NO: 726180 - DNA, 16 bp, Homo sapiens
tgaagtgcatccaaag

SEQ ID NO: 726181 - DNA, 13 bp, Homo sapiens
tgaagtgcgtgaa

SEQ ID NO: 726182 - DNA, 21 bp, Homo sapiens
tgaagtgcgtgaatgtatgta

SEQ ID NO: 726183 - DNA, 19 bp, Homo sapiens
tgaagtgctctttcttgga

SEQ ID NO: 726184 - DNA, 21 bp, Homo sapiens
tgaagtgctgggcaagtttac

SEQ ID NO: 726185 - DNA, 14 bp, Homo sapiens
tgaagtgcttgcag

SEQ ID NO: 726186 - DNA, 17 bp, Homo sapiens
tgaagtggcctcttgga

SEQ ID NO: 726187 - DNA, 19 bp, Homo sapiens
tgacacattaatgataaac

SEQ ID NO: 726188 - DNA, 17 bp, Homo sapiens
tgacaccaataaatgtt

SEQ ID NO: 726189 - DNA, 21 bp, Homo sapiens
tgacaccatcttttattcttt

SEQ ID NO: 726190 - DNA, 14 bp, Homo sapiens
tgacaccccctccc

SEQ ID NO: 726191 - DNA, 15 bp, Homo sapiens
tgacaccctggcctg

SEQ ID NO: 726192 - DNA, 18 bp, Homo sapiens
tgacaccctggcctgaac

SEQ ID NO: 726193 - DNA, 21 bp, Homo sapiens
tgacaccggggtggtgggaac

SEQ ID NO: 726194 - DNA, 17 bp, Homo sapiens
tgacaccgtccctcagt

SEQ ID NO: 726195 - DNA, 13 bp, Homo sapiens
tgacacctaccat

SEQ ID NO: 726196 - DNA, 19 bp, Homo sapiens
tgacacctcagtcatattt

SEQ ID NO: 726197 - DNA, 20 bp, Homo sapiens
tgacacgcaagtgtgtgagt

SEQ ID NO: 726198 - DNA, 17 bp, Homo sapiens
tgacacgcgctctccac

SEQ ID NO: 726199 - DNA, 19 bp, Homo sapiens
tgacacgcgctctccacca

SEQ ID NO: 726200 - DNA, 22 bp, Homo sapiens
tgacacgcgctctccaccaccc

SEQ ID NO: 726201 - DNA, 20 bp, Homo sapiens
tgacactaaaacaagaggac

SEQ ID NO: 726202 - DNA, 23 bp, Homo sapiens
tgacactagcccaatgaaatgaa

SEQ ID NO: 726203 - DNA, 14 bp, Homo sapiens
tgacactcccttgg

SEQ ID NO: 726204 - DNA, 22 bp, Homo sapiens
tgacactcccttgggctccctg

SEQ ID NO: 726205 - DNA, 10 bp, Homo sapiens
tgacactgaa

SEQ ID NO: 726206 - DNA, 12 bp, Homo sapiens
tgacactgaaag

SEQ ID NO: 726207 - DNA, 18 bp, Homo sapiens
tgacactgagccccacct

SEQ ID NO: 726208 - DNA, 20 bp, Homo sapiens
tgacactgatgagtttcact

SEQ ID NO: 726209 - DNA, 13 bp, Homo sapiens
tgacactgctcta

SEQ ID NO: 726210 - DNA, 15 bp, Homo sapiens
tgacactgttttcct

SEQ ID NO: 726211 - DNA, 16 bp, Homo sapiens
tgacacttcagagagc

SEQ ID NO: 726212 - DNA, 23 bp, Homo sapiens
tgacacttcagagagctggtagt

SEQ ID NO: 726213 - DNA, 14 bp, Homo sapiens
tgacacttccagtc

SEQ ID NO: 726214 - DNA, 22 bp, Homo sapiens
tgacactttaattaccaacctg

SEQ ID NO: 726215 - DNA, 21 bp, Homo sapiens
tgacacttttaaaaaacaaaa

SEQ ID NO: 726216 - DNA, 20 bp, Homo sapiens
tgacacttttcatatcattt

SEQ ID NO: 726217 - DNA, 23 bp, Homo sapiens
tgacactttttgtattttttcct

SEQ ID NO: 726218 - DNA, 20 bp, Homo sapiens
tgacagaaggtgccacttta

SEQ ID NO: 726219 - DNA, 16 bp, Homo sapiens
tgacagaatcttgtat

SEQ ID NO: 726220 - DNA, 14 bp, Homo sapiens
tgacagacaggctc

SEQ ID NO: 726221 - DNA, 17 bp, Homo sapiens
tgacagaccacatcttt

SEQ ID NO: 726222 - DNA, 19 bp, Homo sapiens
tgacagactcaagagaaac

SEQ ID NO: 726223 - DNA, 15 bp, Homo sapiens
tgacagactcactgg

SEQ ID NO: 726224 - DNA, 17 bp, Homo sapiens
tgacagactcctgagga

SEQ ID NO: 726225 - DNA, 19 bp, Homo sapiens
tgacagactcctgaggaca

SEQ ID NO: 726226 - DNA, 18 bp, Homo sapiens
tgacagagcaagactctg

SEQ ID NO: 726227 - DNA, 15 bp, Homo sapiens
tgacagagttcacta

SEQ ID NO: 726228 - DNA, 15 bp, Homo sapiens
tgacagatcaagctg

SEQ ID NO: 726229 - DNA, 19 bp, Homo sapiens
tgacagatcaagctgtgag

SEQ ID NO: 726230 - DNA, 18 bp, Homo sapiens
tgacagatgccaacttcc

SEQ ID NO: 726231 - DNA, 22 bp, Homo sapiens
tgacagatgtcagccgagccgg

SEQ ID NO: 726232 - DNA, 14 bp, Homo sapiens
tgacagattctgac

SEQ ID NO: 726233 - DNA, 22 bp, Homo sapiens
tgacagcactaaacttggtgct

SEQ ID NO: 726234 - DNA, 15 bp, Homo sapiens
tgacagcagcctgtg

SEQ ID NO: 726235 - DNA, 19 bp, Homo sapiens
tgacagcagcctgtgaggg

SEQ ID NO: 726236 - DNA, 20 bp, Homo sapiens
tgacagcaggccactagtga

SEQ ID NO: 726237 - DNA, 14 bp, Homo sapiens
tgacagcaggtggg

SEQ ID NO: 726238 - DNA, 23 bp, Homo sapiens
tgacagcatgtgccctcctgagg

SEQ ID NO: 726239 - DNA, 16 bp, Homo sapiens
tgacagcccgcaggat

SEQ ID NO: 726240 - DNA, 19 bp, Homo sapiens
tgacagcctcccaccccca

SEQ ID NO: 726241 - DNA, 15 bp, Homo sapiens
tgacagcctgcagca

SEQ ID NO: 726242 - DNA, 17 bp, Homo sapiens
tgacagccttccccagc

SEQ ID NO: 726243 - DNA, 17 bp, Homo sapiens
tgacagccttgggcctt

SEQ ID NO: 726244 - DNA, 16 bp, Homo sapiens
tgacagcgatggcagg

SEQ ID NO: 726245 - DNA, 15 bp, Homo sapiens
tgactcatggcagct

SEQ ID NO: 726246 - DNA, 23 bp, Homo sapiens
tgactcatggcagctgtttctca

SEQ ID NO: 726247 - DNA, 20 bp, Homo sapiens
tgactcattctgaaggagcc

SEQ ID NO: 726248 - DNA, 21 bp, Homo sapiens
tgactccagagtctgagcccc

SEQ ID NO: 726249 - DNA, 23 bp, Homo sapiens
tgactccagagtctgagcccccg

SEQ ID NO: 726250 - DNA, 18 bp, Homo sapiens
tgactccagtataatctc

SEQ ID NO: 726251 - DNA, 17 bp, Homo sapiens
tgactccctccccaccc

SEQ ID NO: 726252 - DNA, 18 bp, Homo sapiens
tgactccctccccaccca

SEQ ID NO: 726253 - DNA, 19 bp, Homo sapiens
tgactccctccccacccaa

SEQ ID NO: 726254 - DNA, 13 bp, Homo sapiens
tgactcctctggc

SEQ ID NO: 726255 - DNA, 16 bp, Homo sapiens
tgactcctctggcttt

SEQ ID NO: 726256 - DNA, 12 bp, Homo sapiens
tgactcctggac

SEQ ID NO: 726257 - DNA, 13 bp, Homo sapiens
tgactcctggact

SEQ ID NO: 726258 - DNA, 17 bp, Homo sapiens
tgactcctggactccgg

SEQ ID NO: 726259 - DNA, 22 bp, Homo sapiens
tgactccttagagacatcaaaa

SEQ ID NO: 726260 - DNA, 14 bp, Homo sapiens
tgactcctttccaa

SEQ ID NO: 726261 - DNA, 14 bp, Homo sapiens
tgactcgaaactga

SEQ ID NO: 726262 - DNA, 23 bp, Homo sapiens
tgactcgaaactgacagtattaa

SEQ ID NO: 726263 - DNA, 15 bp, Homo sapiens
tgactcgggagctgc

SEQ ID NO: 726264 - DNA, 17 bp, Homo sapiens
tgactcgggggtgggga

SEQ ID NO: 726265 - DNA, 15 bp, Homo sapiens
tgactcggtttctcc

SEQ ID NO: 726266 - DNA, 16 bp, Homo sapiens
tgactcggtttctcca

SEQ ID NO: 726267 - DNA, 14 bp, Homo sapiens
tgactctaaatgca

SEQ ID NO: 726268 - DNA, 15 bp, Homo sapiens
tgactctcacctgta

SEQ ID NO: 726269 - DNA, 19 bp, Homo sapiens
tgactctcacctgtactat

SEQ ID NO: 726270 - DNA, 12 bp, Homo sapiens
tgactctctcca

SEQ ID NO: 726271 - DNA, 17 bp, Homo sapiens
tgactctctgagctggg

SEQ ID NO: 726272 - DNA, 11 bp, Homo sapiens
tgactctgaaa

SEQ ID NO: 726273 - DNA, 18 bp, Homo sapiens
tgactctgagtccactgc

SEQ ID NO: 726274 - DNA, 17 bp, Homo sapiens
tgactctggcaaagctt

SEQ ID NO: 726275 - DNA, 13 bp, Homo sapiens
tgactctgggcag

SEQ ID NO: 726276 - DNA, 22 bp, Homo sapiens
tgactctgggttcgttggggac

SEQ ID NO: 726277 - DNA, 17 bp, Homo sapiens
tgactctttattgtctg

SEQ ID NO: 726278 - DNA, 14 bp, Homo sapiens
tgactctttcaaag

SEQ ID NO: 726279 - DNA, 22 bp, Homo sapiens
tgactctttctgaaggaagaga

SEQ ID NO: 726280 - DNA, 23 bp, Homo sapiens
tgactctttttagggccaggcag

SEQ ID NO: 726281 - DNA, 19 bp, Homo sapiens
tgactgaaagaagaacagc

SEQ ID NO: 726282 - DNA, 22 bp, Homo sapiens
tgactgaaagaagaacagctgt

SEQ ID NO: 726283 - DNA, 14 bp, Homo sapiens
tgacttgctgtcca

SEQ ID NO: 726284 - DNA, 15 bp, Homo sapiens
tgacttgctgtccag

SEQ ID NO: 726285 - DNA, 19 bp, Homo sapiens
tgacttgctgtccaggcag

SEQ ID NO: 726286 - DNA, 20 bp, Homo sapiens
tgacttgctgtccaggcagc

SEQ ID NO: 726287 - DNA, 22 bp, Homo sapiens
tgacttgctgtgtgaccctggg

SEQ ID NO: 726288 - DNA, 15 bp, Homo sapiens
tgacttggcacttaa

SEQ ID NO: 726289 - DNA, 20 bp, Homo sapiens
tgacttggcacttaagtgca

SEQ ID NO: 726290 - DNA, 14 bp, Homo sapiens
tgacttggccccag

SEQ ID NO: 726291 - DNA, 12 bp, Homo sapiens
tgacttgggttt

SEQ ID NO: 726292 - DNA, 23 bp, Homo sapiens
tgacttggtggcttttccttgaa

SEQ ID NO: 726293 - DNA, 18 bp, Homo sapiens
tgacttgtttgtcttcca

SEQ ID NO: 726294 - DNA, 16 bp, Homo sapiens
tgactttaaaagaaaa

SEQ ID NO: 726295 - DNA, 14 bp, Homo sapiens
tgactttacttgtg

SEQ ID NO: 726296 - DNA, 20 bp, Homo sapiens
tgactttagaaagctgacat

SEQ ID NO: 726297 - DNA, 21 bp, Homo sapiens
tgactttagaaagctgacatt

SEQ ID NO: 726298 - DNA, 12 bp, Homo sapiens
tgactttagaat

SEQ ID NO: 726299 - DNA, 18 bp, Homo sapiens
tgactttatatggatgat

SEQ ID NO: 726300 - DNA, 17 bp, Homo sapiens
tgactttatttttctaa

SEQ ID NO: 726301 - DNA, 15 bp, Homo sapiens
tgactttcaaaatat

SEQ ID NO: 726302 - DNA, 16 bp, Homo sapiens
tgactttgcttgcttt

SEQ ID NO: 726303 - DNA, 17 bp, Homo sapiens
tgactttgcttgctttg

SEQ ID NO: 726304 - DNA, 16 bp, Homo sapiens
tgacttttaaaaataa

SEQ ID NO: 726305 - DNA, 16 bp, Homo sapiens
tgacttttaaagattt

SEQ ID NO: 726306 - DNA, 20 bp, Homo sapiens
tgacttttaaggctaaaact

SEQ ID NO: 726307 - DNA, 14 bp, Homo sapiens
tgacttttctgatt

SEQ ID NO: 726308 - DNA, 13 bp, Homo sapiens
tgacttttctgta

SEQ ID NO: 726309 - DNA, 13 bp, Homo sapiens
tgactttttataa

SEQ ID NO: 726310 - DNA, 19 bp, Homo sapiens
tgactttttataaaatggc

SEQ ID NO: 726311 - DNA, 14 bp, Homo sapiens
tgactttttggaat

SEQ ID NO: 726312 - DNA, 20 bp, Homo sapiens
tgactttttggaattcagca

SEQ ID NO: 726313 - DNA, 17 bp, Homo sapiens
tgactttttttggtata

SEQ ID NO: 726314 - DNA, 18 bp, Homo sapiens
tgagactcacaggaagga

SEQ ID NO: 726315 - DNA, 21 bp, Homo sapiens
tgagactccactcaggtgcac

SEQ ID NO: 726316 - DNA, 21 bp, Homo sapiens
tgagactccagaatctgctgt

SEQ ID NO: 726317 - DNA, 22 bp, Homo sapiens
tgagactccagaatctgctgtt

SEQ ID NO: 726318 - DNA, 22 bp, Homo sapiens
tgagactctagggtccagtgga

SEQ ID NO: 726319 - DNA, 22 bp, Homo sapiens
tgagactgcgggatggtcctgg

SEQ ID NO: 726320 - DNA, 23 bp, Homo sapiens
tgagactggggccactacatttg

SEQ ID NO: 726321 - DNA, 16 bp, Homo sapiens
tgagactgtcaggaag

SEQ ID NO: 726322 - DNA, 21 bp, Homo sapiens
tgagactgtcggagaggctgt

SEQ ID NO: 726323 - DNA, 13 bp, Homo sapiens
tgagactgtgctg

SEQ ID NO: 726324 - DNA, 14 bp, Homo sapiens
tgagacttgctctc

SEQ ID NO: 726325 - DNA, 20 bp, Homo sapiens
tgagactttaaaagcatttt

SEQ ID NO: 726326 - DNA, 19 bp, Homo sapiens
tgagactttctaaatcaaa

SEQ ID NO: 726327 - DNA, 19 bp, Homo sapiens
tgagagaaaaagtgcccct

SEQ ID NO: 726328 - DNA, 20 bp, Homo sapiens
tgagagaaaaagtgcccctt

SEQ ID NO: 726329 - DNA, 21 bp, Homo sapiens
tgagagaagccacgctgtcct

SEQ ID NO: 726330 - DNA, 16 bp, Homo sapiens
tgagagaattggctca

SEQ ID NO: 726331 - DNA, 19 bp, Homo sapiens
tgagagaattgtatcattt

SEQ ID NO: 726332 - DNA, 18 bp, Homo sapiens
tgagagacattaactcat

SEQ ID NO: 726333 - DNA, 16 bp, Homo sapiens
tgagagaccacacatt

SEQ ID NO: 726334 - DNA, 18 bp, Homo sapiens
tgagagaccacacatttt

SEQ ID NO: 726335 - DNA, 15 bp, Homo sapiens
tgagagacccagctg

SEQ ID NO: 726336 - DNA, 16 bp, Homo sapiens
tgagagaccctggcct

SEQ ID NO: 726337 - DNA, 18 bp, Homo sapiens
tgagagacgccactccct

SEQ ID NO: 726338 - DNA, 22 bp, Homo sapiens
tgagagagaatagagctgccac

SEQ ID NO: 726339 - DNA, 23 bp, Homo sapiens
tgagagagaatagagctgccact

SEQ ID NO: 726340 - DNA, 12 bp, Homo sapiens
tgagagagactg

SEQ ID NO: 726341 - DNA, 17 bp, Homo sapiens
tgagagagactgatggg

SEQ ID NO: 726342 - DNA, 18 bp, Homo sapiens
tgagagagagtcttactc

SEQ ID NO: 726343 - DNA, 18 bp, Homo sapiens
tgagagatggggcggggg

SEQ ID NO: 726344 - DNA, 14 bp, Homo sapiens
tgagagattctgtg

SEQ ID NO: 726345 - DNA, 14 bp, Homo sapiens
tgagagcacccact

SEQ ID NO: 726346 - DNA, 13 bp, Homo sapiens
tgagagcataatt

SEQ ID NO: 726347 - DNA, 15 bp, Homo sapiens
tgagagcataattta

SEQ ID NO: 726348 - DNA, 14 bp, Homo sapiens
tgagagccagcagc

SEQ ID NO: 726349 - DNA, 16 bp, Homo sapiens
tgagagccagcagcaa

SEQ ID NO: 726350 - DNA, 16 bp, Homo sapiens
tgagagccccagctga

SEQ ID NO: 726351 - DNA, 19 bp, Homo sapiens
tgagagccctgctgtggga

SEQ ID NO: 726352 - DNA, 16 bp, Homo sapiens
tgagagcctttgcctt

SEQ ID NO: 726353 - DNA, 17 bp, Homo sapiens
tgagagcctttgccttt

SEQ ID NO: 726354 - DNA, 15 bp, Homo sapiens
tgagagcgacacaga

SEQ ID NO: 726355 - DNA, 19 bp, Homo sapiens
tgagagcgaggctgagcct

SEQ ID NO: 726356 - DNA, 19 bp, Homo sapiens
tgagagctgctctggaaaa

SEQ ID NO: 726357 - DNA, 17 bp, Homo sapiens
tgagagctttctgcctt

SEQ ID NO: 726358 - DNA, 18 bp, Homo sapiens
tgagaggagaaatgcaat

SEQ ID NO: 726359 - DNA, 19 bp, Homo sapiens
tgagaggagacttgtgaat

SEQ ID NO: 726360 - DNA, 13 bp, Homo sapiens
tgagaggcagcta

SEQ ID NO: 726361 - DNA, 15 bp, Homo sapiens
tgagaggcaggaatg

SEQ ID NO: 726362 - DNA, 23 bp, Homo sapiens
tgagaggcaggaatgggggtcag

SEQ ID NO: 726363 - DNA, 15 bp, Homo sapiens
tgagaggcctggagc

SEQ ID NO: 726364 - DNA, 17 bp, Homo sapiens
tgagaggcctggagccc

SEQ ID NO: 726365 - DNA, 20 bp, Homo sapiens
tgagaggcgagtcaccctcc

SEQ ID NO: 726366 - DNA, 14 bp, Homo sapiens
tgagaggctctccg

SEQ ID NO: 726367 - DNA, 19 bp, Homo sapiens
tgagaggctgtctgttgta

SEQ ID NO: 726368 - DNA, 22 bp, Homo sapiens
tgagagggcaatctttgccttt

SEQ ID NO: 726369 - DNA, 19 bp, Homo sapiens
tgagagggccctgcctgct

SEQ ID NO: 726370 - DNA, 12 bp, Homo sapiens
tgagaggggaag

SEQ ID NO: 726371 - DNA, 12 bp, Homo sapiens
tgagaggggagg

SEQ ID NO: 726372 - DNA, 13 bp, Homo sapiens
tgagaggggaggg

SEQ ID NO: 726373 - DNA, 17 bp, Homo sapiens
tgagaggggagggaggg

SEQ ID NO: 726374 - DNA, 19 bp, Homo sapiens
tgagaggggcgccttttca

SEQ ID NO: 726375 - DNA, 21 bp, Homo sapiens
tgagaggggcgccttttcagc

SEQ ID NO: 726376 - DNA, 21 bp, Homo sapiens
tgagaggtgaaagcataacat

SEQ ID NO: 726377 - DNA, 20 bp, Homo sapiens
tgagagtactcacttttcac

SEQ ID NO: 726378 - DNA, 19 bp, Homo sapiens
tgagagtatattatgtatt

SEQ ID NO: 726379 - DNA, 17 bp, Homo sapiens
tgagagtatcaggtctc

SEQ ID NO: 726380 - DNA, 23 bp, Homo sapiens
tgagagtatttaggcagattgaa

SEQ ID NO: 726381 - DNA, 16 bp, Homo sapiens
tgagagtcaaagctga

SEQ ID NO: 726382 - DNA, 17 bp, Homo sapiens
tgagagtcagctctctg

SEQ ID NO: 726383 - DNA, 21 bp, Homo sapiens
tgagagtcagctctctgccct

SEQ ID NO: 726384 - DNA, 22 bp, Homo sapiens
tgagagtcagctctctgccctg

SEQ ID NO: 726385 - DNA, 15 bp, Homo sapiens
tgagagtgcactgct

SEQ ID NO: 726386 - DNA, 12 bp, Homo sapiens
tgagagtgtgac

SEQ ID NO: 726387 - DNA, 14 bp, Homo sapiens
tgagagtgtgacca

SEQ ID NO: 726388 - DNA, 14 bp, Homo sapiens
tgagagttggctca

SEQ ID NO: 726389 - DNA, 19 bp, Homo sapiens
tgagagttggctcaggcag

SEQ ID NO: 726390 - DNA, 21 bp, Homo sapiens
tgagagttggctcaggcagac

SEQ ID NO: 726391 - DNA, 14 bp, Homo sapiens
tgagagtttcctca

SEQ ID NO: 726392 - DNA, 16 bp, Homo sapiens
tgagagtttcctcaga

SEQ ID NO: 726393 - DNA, 15 bp, Homo sapiens
tgagataaagtcaaa

SEQ ID NO: 726394 - DNA, 22 bp, Homo sapiens
tgagataaagtcaaatgccaaa

SEQ ID NO: 726395 - DNA, 22 bp, Homo sapiens
tgagataccacaaaccctgctg

SEQ ID NO: 726396 - DNA, 20 bp, Homo sapiens
tgagataccagcgaggaggc

SEQ ID NO: 726397 - DNA, 18 bp, Homo sapiens
tgagatactttgcattgt

SEQ ID NO: 726398 - DNA, 22 bp, Homo sapiens
tgagatactttgcattgtctgt

SEQ ID NO: 726399 - DNA, 18 bp, Homo sapiens
tgagatagaatacatgta

SEQ ID NO: 726400 - DNA, 18 bp, Homo sapiens
tgagatagcattgtgaac

SEQ ID NO: 726401 - DNA, 19 bp, Homo sapiens
tgagatagcattgtgaact

SEQ ID NO: 726402 - DNA, 23 bp, Homo sapiens
tgagatagcattgtgaactgaca

SEQ ID NO: 726403 - DNA, 17 bp, Homo sapiens
tgagatagttttcatcc

SEQ ID NO: 726404 - DNA, 18 bp, Homo sapiens
tgagatagttttcatcca

SEQ ID NO: 726405 - DNA, 19 bp, Homo sapiens
tgagatcacagcctccagg

SEQ ID NO: 726406 - DNA, 21 bp, Homo sapiens
tgagatcacagcctccagggc

SEQ ID NO: 726407 - DNA, 22 bp, Homo sapiens
tgagatcacagcctccagggcc

SEQ ID NO: 726408 - DNA, 18 bp, Homo sapiens
tgagatcactgactctga

SEQ ID NO: 726409 - DNA, 14 bp, Homo sapiens
tgagatcagcctgg

SEQ ID NO: 726410 - DNA, 12 bp, Homo sapiens
tgagatcccctg

SEQ ID NO: 726411 - DNA, 16 bp, Homo sapiens
tgagatcctctttact

SEQ ID NO: 726412 - DNA, 23 bp, Homo sapiens
tgagatcctggagtgatatgatc

SEQ ID NO: 726413 - DNA, 19 bp, Homo sapiens
tcttggcggcagcagccat

SEQ ID NO: 726414 - DNA, 13 bp, Homo sapiens
tcttggctgaccc

SEQ ID NO: 726415 - DNA, 16 bp, Homo sapiens
tcttggcttaatcatt

SEQ ID NO: 726416 - DNA, 19 bp, Homo sapiens
tcttggcttactgcagcct

SEQ ID NO: 726417 - DNA, 21 bp, Homo sapiens
tcttggcttccagaaggcagc

SEQ ID NO: 726418 - DNA, 15 bp, Homo sapiens
tcttggcttctcagc

SEQ ID NO: 726419 - DNA, 13 bp, Homo sapiens
tcttggcttctgg

SEQ ID NO: 726420 - DNA, 16 bp, Homo sapiens
tcttggcttctgggac

SEQ ID NO: 726421 - DNA, 15 bp, Homo sapiens
tcttggcttcttaaa

SEQ ID NO: 726422 - DNA, 17 bp, Homo sapiens
tcttcccgtgtgtattt

SEQ ID NO: 726423 - DNA, 22 bp, Homo sapiens
tcttccctacagttgaaaaaca

SEQ ID NO: 726424 - DNA, 14 bp, Homo sapiens
tcttccctacctca

SEQ ID NO: 726425 - DNA, 21 bp, Homo sapiens
tcttccctacctcaggcagga

SEQ ID NO: 726426 - DNA, 19 bp, Homo sapiens
tcttccctgaacgttttct

SEQ ID NO: 726427 - DNA, 16 bp, Homo sapiens
tcttcccttagcctct

SEQ ID NO: 726428 - DNA, 22 bp, Homo sapiens
tcttcccttttacatactgctg

SEQ ID NO: 726429 - DNA, 15 bp, Homo sapiens
tcttccgcccctgcc

SEQ ID NO: 726430 - DNA, 21 bp, Homo sapiens
tcttccgcccctgcctgccat

SEQ ID NO: 726431 - DNA, 21 bp, Homo sapiens
tcttccggagatgtagcaaaa

SEQ ID NO: 726432 - DNA, 15 bp, Homo sapiens
tcttccgggagctgg

SEQ ID NO: 726433 - DNA, 15 bp, Homo sapiens
tcttccgggcagaaa

SEQ ID NO: 726434 - DNA, 18 bp, Homo sapiens
tcttcctaccctgcctcc

SEQ ID NO: 726435 - DNA, 13 bp, Homo sapiens
tcttcctagaatt

SEQ ID NO: 726436 - DNA, 20 bp, Homo sapiens
tcttcctcacactgctgtcc

SEQ ID NO: 726437 - DNA, 23 bp, Homo sapiens
tcttcctcacactgctgtcctct

SEQ ID NO: 726438 - DNA, 16 bp, Homo sapiens
tcttcctcatcctgct

SEQ ID NO: 726439 - DNA, 21 bp, Homo sapiens
tcttcctcatcctgcttctct

SEQ ID NO: 726440 - DNA, 13 bp, Homo sapiens
tcttcctcccctc

SEQ ID NO: 726441 - DNA, 14 bp, Homo sapiens
tcttcctcccctca

SEQ ID NO: 726442 - DNA, 17 bp, Homo sapiens
tcttcctccgaggccag

SEQ ID NO: 726443 - DNA, 17 bp, Homo sapiens
tcttcctctaacatttt

SEQ ID NO: 726444 - DNA, 13 bp, Homo sapiens
tcttgaatttaat

SEQ ID NO: 726445 - DNA, 21 bp, Homo sapiens
tcttgaatttaataatctgta

SEQ ID NO: 726446 - DNA, 23 bp, Homo sapiens
tcttgaatttaataatctgtagg

SEQ ID NO: 726447 - DNA, 18 bp, Homo sapiens
tcttgaatttctaaaaaa

SEQ ID NO: 726448 - DNA, 14 bp, Homo sapiens
tcttgaatttctgc

SEQ ID NO: 726449 - DNA, 19 bp, Homo sapiens
tcttgacagtatatttgaa

SEQ ID NO: 726450 - DNA, 19 bp, Homo sapiens
tcttgacattcaaggcatt

SEQ ID NO: 726451 - DNA, 17 bp, Homo sapiens
tcttgaccctgcaccct

SEQ ID NO: 726452 - DNA, 23 bp, Homo sapiens
tcttgacgggagcattggcccct

SEQ ID NO: 726453 - DNA, 16 bp, Homo sapiens
tcttgactacagtcag

SEQ ID NO: 726454 - DNA, 18 bp, Homo sapiens
tcttgactcatggcagct

SEQ ID NO: 726455 - DNA, 17 bp, Homo sapiens
tcttgacttagacctat

SEQ ID NO: 726456 - DNA, 21 bp, Homo sapiens
tcttgagaggagacttgtgaa

SEQ ID NO: 726457 - DNA, 16 bp, Homo sapiens
tcttgagatgtcttct

SEQ ID NO: 726458 - DNA, 13 bp, Homo sapiens
tcttgagccagta

SEQ ID NO: 726459 - DNA, 17 bp, Homo sapiens
tcttgagccttgaactt

SEQ ID NO: 726460 - DNA, 18 bp, Homo sapiens
tcttgagccttgaacttt

SEQ ID NO: 726461 - DNA, 20 bp, Homo sapiens
tcttgagccttgaactttga

SEQ ID NO: 726462 - DNA, 13 bp, Homo sapiens
tcttgagctggcc

SEQ ID NO: 726463 - DNA, 17 bp, Homo sapiens
tcttgagctggcctctc

SEQ ID NO: 726464 - DNA, 21 bp, Homo sapiens
tcttgagctggcctctctagc

SEQ ID NO: 726465 - DNA, 18 bp, Homo sapiens
tcttgaggtaggagaggc

SEQ ID NO: 726466 - DNA, 18 bp, Homo sapiens
tcttgagttcctctgcag

SEQ ID NO: 726467 - DNA, 20 bp, Homo sapiens
tcttgagttcctctgcagtt

SEQ ID NO: 726468 - DNA, 13 bp, Homo sapiens
tcttgagtttgtc

SEQ ID NO: 726469 - DNA, 13 bp, Homo sapiens
tcttgatacattc

SEQ ID NO: 726470 - DNA, 14 bp, Homo sapiens
tcttgatacattca

SEQ ID NO: 726471 - DNA, 22 bp, Homo sapiens
tcttgatacccccctctgtctt

SEQ ID NO: 726472 - DNA, 16 bp, Homo sapiens
tcttgatcagttaaga

SEQ ID NO: 726473 - DNA, 17 bp, Homo sapiens
tcttgatcagttaagaa

SEQ ID NO: 726474 - DNA, 23 bp, Homo sapiens
tcttgatcagttaagaaatttca

SEQ ID NO: 726475 - DNA, 20 bp, Homo sapiens
tcttgatcctccaatgtcta

SEQ ID NO: 726476 - DNA, 14 bp, Homo sapiens
tcttgatctctaat

SEQ ID NO: 726477 - DNA, 15 bp, Homo sapiens
tcttgatcttaaaga

SEQ ID NO: 726478 - DNA, 15 bp, Homo sapiens
tcttgatgactgctg

SEQ ID NO: 726479 - DNA, 22 bp, Homo sapiens
tcttgatgtcatgtacttcctg

SEQ ID NO: 726480 - DNA, 16 bp, Homo sapiens
tcttgatgtgaagata

SEQ ID NO: 726481 - DNA, 13 bp, Homo sapiens
tcttgatgtttag

SEQ ID NO: 726482 - DNA, 23 bp, Homo sapiens
tcttgattataaatgtttggaaa

SEQ ID NO: 726483 - DNA, 14 bp, Homo sapiens
tcttgattcctggt

SEQ ID NO: 726484 - DNA, 18 bp, Homo sapiens
tcttgatttatttgcttc

SEQ ID NO: 726485 - DNA, 17 bp, Homo sapiens
tcttgattttcaagctt

SEQ ID NO: 726486 - DNA, 19 bp, Homo sapiens
tcttgattttcaagctttc

SEQ ID NO: 726487 - DNA, 21 bp, Homo sapiens
tcttgcaccaaattatcttga

SEQ ID NO: 726488 - DNA, 18 bp, Homo sapiens
tcttgcacccgcctctcc

SEQ ID NO: 726489 - DNA, 19 bp, Homo sapiens
tcttgcactgaatatataa

SEQ ID NO: 726490 - DNA, 22 bp, Homo sapiens
tcttgcagttttgtaagccctc

SEQ ID NO: 726491 - DNA, 14 bp, Homo sapiens
tcttgcatctaatg

SEQ ID NO: 726492 - DNA, 13 bp, Homo sapiens
tcttgccaccctc

SEQ ID NO: 726493 - DNA, 14 bp, Homo sapiens
tcttgccaccctct

SEQ ID NO: 726494 - DNA, 12 bp, Homo sapiens
tcttgccagcct

SEQ ID NO: 726495 - DNA, 14 bp, Homo sapiens
tcttgccagcctcc

SEQ ID NO: 726496 - DNA, 18 bp, Homo sapiens
tcttgccagcctccttgc

SEQ ID NO: 726497 - DNA, 14 bp, Homo sapiens
tcttgccatcactg

SEQ ID NO: 726498 - DNA, 15 bp, Homo sapiens
tcttgccatcctgat

SEQ ID NO: 726499 - DNA, 17 bp, Homo sapiens
tcttgccatcctgatgg

SEQ ID NO: 726500 - DNA, 12 bp, Homo sapiens
tcttgcccactg

SEQ ID NO: 726501 - DNA, 14 bp, Homo sapiens
tcttgcccagcagc

SEQ ID NO: 726502 - DNA, 20 bp, Homo sapiens
tcttgcccagcagctcaaga

SEQ ID NO: 726503 - DNA, 14 bp, Homo sapiens
tcttgcccatcctg

SEQ ID NO: 726504 - DNA, 17 bp, Homo sapiens
tcttgccccactccctg

SEQ ID NO: 726505 - DNA, 21 bp, Homo sapiens
tcttgccccatcactgcgcca

SEQ ID NO: 726506 - DNA, 11 bp, Homo sapiens
tcttgcccctt

SEQ ID NO: 726507 - DNA, 22 bp, Homo sapiens
tcttgccccttgtcctgaagcc

SEQ ID NO: 726508 - DNA, 22 bp, Homo sapiens
tcttgcccgcacccctccctgc

SEQ ID NO: 726509 - DNA, 19 bp, Homo sapiens
tcttgcccgtcggccctgc

SEQ ID NO: 726510 - DNA, 18 bp, Homo sapiens
tcttgcccttcctactcc

SEQ ID NO: 726511 - DNA, 20 bp, Homo sapiens
tcttgcctaagtattccttt

SEQ ID NO: 726512 - DNA, 16 bp, Homo sapiens
tcttgcctacttttct

SEQ ID NO: 726513 - DNA, 16 bp, Homo sapiens
tcttgcctctctcagg

SEQ ID NO: 726514 - DNA, 14 bp, Homo sapiens
tcttgcctctgtgc

SEQ ID NO: 726515 - DNA, 21 bp, Homo sapiens
tcttgcctgaactcctgccat

SEQ ID NO: 726516 - DNA, 16 bp, Homo sapiens
tcttgcctgtttccca

SEQ ID NO: 726517 - DNA, 22 bp, Homo sapiens
tcttgccttaaccagtctctca

SEQ ID NO: 726518 - DNA, 19 bp, Homo sapiens
tcttgcgaatccaagctcc

SEQ ID NO: 726519 - DNA, 23 bp, Homo sapiens
tcttgcgaatccaagctccctgc

SEQ ID NO: 726520 - DNA, 14 bp, Homo sapiens
tcttgcgggcctgg

SEQ ID NO: 726521 - DNA, 20 bp, Homo sapiens
tcttgctaccagtatttaga

SEQ ID NO: 726522 - DNA, 14 bp, Homo sapiens
tcttgctagctatt

SEQ ID NO: 726523 - DNA, 23 bp, Homo sapiens
tcttgctctctctccctgccttt

SEQ ID NO: 726524 - DNA, 13 bp, Homo sapiens
tcttgctctgcat

SEQ ID NO: 726525 - DNA, 18 bp, Homo sapiens
tcttgctctgtctcccag

SEQ ID NO: 726526 - DNA, 15 bp, Homo sapiens
tcttgctgaaagcca

SEQ ID NO: 726527 - DNA, 17 bp, Homo sapiens
tcttgctgatggctgct

SEQ ID NO: 726528 - DNA, 14 bp, Homo sapiens
tcttgctgccctgc

SEQ ID NO: 726529 - DNA, 15 bp, Homo sapiens
tcttgctgccctgcc

SEQ ID NO: 726530 - DNA, 22 bp, Homo sapiens
tcttgctggtctagtcacgcat

SEQ ID NO: 726531 - DNA, 15 bp, Homo sapiens
tcttgctgttcagtg

SEQ ID NO: 726532 - DNA, 22 bp, Homo sapiens
tcttgctgttcagtgctttttc

SEQ ID NO: 726533 - DNA, 21 bp, Homo sapiens
tcttgctgttgacatatttaa

SEQ ID NO: 726534 - DNA, 21 bp, Homo sapiens
tcttggaacattggaatgttc

SEQ ID NO: 726535 - DNA, 20 bp, Homo sapiens
tcttggaagctgtttggaaa

SEQ ID NO: 726536 - DNA, 15 bp, Homo sapiens
tcttggacaaatcac

SEQ ID NO: 726537 - DNA, 18 bp, Homo sapiens
tcttggacaacagctctc

SEQ ID NO: 726538 - DNA, 19 bp, Homo sapiens
tcttggaccagtttgcaga

SEQ ID NO: 726539 - DNA, 21 bp, Homo sapiens
tcttggacctctgctctgagg

SEQ ID NO: 726540 - DNA, 15 bp, Homo sapiens
tcttggaccttggcg

SEQ ID NO: 726541 - DNA, 19 bp, Homo sapiens
tcttggagaagtctcagct

SEQ ID NO: 726542 - DNA, 20 bp, Homo sapiens
tcttggagaagtctcagcta

SEQ ID NO: 726543 - DNA, 22 bp, Homo sapiens
tcttggagcctctttttccttc

SEQ ID NO: 726544 - DNA, 21 bp, Homo sapiens
tcttggagctgagcctctcac

SEQ ID NO: 726545 - DNA, 14 bp, Homo sapiens
tcttggagctgtga

SEQ ID NO: 726546 - DNA, 19 bp, Homo sapiens
tcttggagctttggaatat

SEQ ID NO: 726547 - DNA, 14 bp, Homo sapiens
tcttggcaaatttt

SEQ ID NO: 726548 - DNA, 21 bp, Homo sapiens
tcttggcagcttaacattgac

SEQ ID NO: 726549 - DNA, 13 bp, Homo sapiens
tcttggcagtcac

SEQ ID NO: 726550 - DNA, 14 bp, Homo sapiens
tcttggcattaaac

SEQ ID NO: 726551 - DNA, 13 bp, Homo sapiens
tcttggccagcca

SEQ ID NO: 726552 - DNA, 18 bp, Homo sapiens
tcttggccatgatgtcct

SEQ ID NO: 726553 - DNA, 20 bp, Homo sapiens
tcttaatataaattcacttt

SEQ ID NO: 726554 - DNA, 15 bp, Homo sapiens
tcttaatattgagaa

SEQ ID NO: 726555 - DNA, 16 bp, Homo sapiens
tcttaatattgagaat

SEQ ID NO: 726556 - DNA, 18 bp, Homo sapiens
tcttaatattgagaatca

SEQ ID NO: 726557 - DNA, 23 bp, Homo sapiens
tcttaatattgagaatcaggttg

SEQ ID NO: 726558 - DNA, 17 bp, Homo sapiens
tcttaatcactactgta

SEQ ID NO: 726559 - DNA, 14 bp, Homo sapiens
tcttaatctgtgtg

SEQ ID NO: 726560 - DNA, 21 bp, Homo sapiens
tcttaatgttcctcaaagctt

SEQ ID NO: 726561 - DNA, 12 bp, Homo sapiens
tcttaattatta

SEQ ID NO: 726562 - DNA, 22 bp, Homo sapiens
tcttaattattataaaaatatt

SEQ ID NO: 726563 - DNA, 18 bp, Homo sapiens
tcttaattctttgttctg

SEQ ID NO: 726564 - DNA, 20 bp, Homo sapiens
tcttaattctttgttctgtt

SEQ ID NO: 726565 - DNA, 23 bp, Homo sapiens
tcttaatttatttcttaaccttt

SEQ ID NO: 726566 - DNA, 15 bp, Homo sapiens
tcttaattttgtctt

SEQ ID NO: 726567 - DNA, 16 bp, Homo sapiens
tcttacaaaagctttg

SEQ ID NO: 726568 - DNA, 21 bp, Homo sapiens
tcttacaagatattgatgata

SEQ ID NO: 726569 - DNA, 19 bp, Homo sapiens
tcttacaagcttaaagctt

SEQ ID NO: 726570 - DNA, 16 bp, Homo sapiens
tcttacaattgcactg

SEQ ID NO: 726571 - DNA, 21 bp, Homo sapiens
tcttacaattgcactgctgtt

SEQ ID NO: 726572 - DNA, 18 bp, Homo sapiens
tcttacacacccccagag

SEQ ID NO: 726573 - DNA, 13 bp, Homo sapiens
tcttacacttctt

SEQ ID NO: 726574 - DNA, 14 bp, Homo sapiens
tcttacagaagagt

SEQ ID NO: 726575 - DNA, 17 bp, Homo sapiens
tcttacatttctcaccc

SEQ ID NO: 726576 - DNA, 16 bp, Homo sapiens
tcttaccagtctcctc

SEQ ID NO: 726577 - DNA, 18 bp, Homo sapiens
tcttaccattaacatttt

SEQ ID NO: 726578 - DNA, 19 bp, Homo sapiens
tcttaccattaacattttt

SEQ ID NO: 726579 - DNA, 13 bp, Homo sapiens
tcttacccaaagc

SEQ ID NO: 726580 - DNA, 16 bp, Homo sapiens
tcttacccaaagcaca

SEQ ID NO: 726581 - DNA, 17 bp, Homo sapiens
tcttacccaaagcacat

SEQ ID NO: 726582 - DNA, 16 bp, Homo sapiens
tcttacctaaactgag

SEQ ID NO: 726583 - DNA, 19 bp, Homo sapiens
tcttacctcccactaaagg

SEQ ID NO: 726584 - DNA, 14 bp, Homo sapiens
tcttacctctctgg

SEQ ID NO: 726585 - DNA, 18 bp, Homo sapiens
tcttacctctctgggacc

SEQ ID NO: 726586 - DNA, 21 bp, Homo sapiens
tcttacctgtatgtctccagt

SEQ ID NO: 726587 - DNA, 16 bp, Homo sapiens
tcttactaaaaagtat

SEQ ID NO: 726588 - DNA, 21 bp, Homo sapiens
tcttactattaagcagtaaaa

SEQ ID NO: 726589 - DNA, 15 bp, Homo sapiens
tcttactatttcaca

SEQ ID NO: 726590 - DNA, 15 bp, Homo sapiens
tcttactcctcctct

SEQ ID NO: 726591 - DNA, 18 bp, Homo sapiens
tcttactcctcctctttc

SEQ ID NO: 726592 - DNA, 20 bp, Homo sapiens
tcttactcctcctctttctc

SEQ ID NO: 726593 - DNA, 13 bp, Homo sapiens
tcttactctgccg

SEQ ID NO: 726594 - DNA, 13 bp, Homo sapiens
tcttactctttcc

SEQ ID NO: 726595 - DNA, 14 bp, Homo sapiens
tcttactctttcct

SEQ ID NO: 726596 - DNA, 16 bp, Homo sapiens
tcttactctttcctat

SEQ ID NO: 726597 - DNA, 15 bp, Homo sapiens
tcttactttgcttga

SEQ ID NO: 726598 - DNA, 22 bp, Homo sapiens
tcttactttgcttgagaatcct

SEQ ID NO: 726599 - DNA, 14 bp, Homo sapiens
tcttagaaatactt

SEQ ID NO: 726600 - DNA, 14 bp, Homo sapiens
tcttagaaatgaag

SEQ ID NO: 726601 - DNA, 19 bp, Homo sapiens
tcttagaagaatattgtat

SEQ ID NO: 726602 - DNA, 20 bp, Homo sapiens
tcttagaagaatattgtatt

SEQ ID NO: 726603 - DNA, 13 bp, Homo sapiens
tcttagaagccat

SEQ ID NO: 726604 - DNA, 14 bp, Homo sapiens
tcttagaagccatg

SEQ ID NO: 726605 - DNA, 14 bp, Homo sapiens
tcttagactacatt

SEQ ID NO: 726606 - DNA, 20 bp, Homo sapiens
tcttagagccaagtgtcttt

SEQ ID NO: 726607 - DNA, 21 bp, Homo sapiens
tcttagagccaagtgtctttt

SEQ ID NO: 726608 - DNA, 22 bp, Homo sapiens
tcttagagtttacagtttgtgt

SEQ ID NO: 726609 - DNA, 12 bp, Homo sapiens
tcttagataact

SEQ ID NO: 726610 - DNA, 18 bp, Homo sapiens
tcttagctgtctgctcag

SEQ ID NO: 726611 - DNA, 17 bp, Homo sapiens
tcttagcttacaggaag

SEQ ID NO: 726612 - DNA, 15 bp, Homo sapiens
tcttaggaagagaaa

SEQ ID NO: 726613 - DNA, 16 bp, Homo sapiens
tcttaggagcaagaag

SEQ ID NO: 726614 - DNA, 15 bp, Homo sapiens
tcttaggtcagatgg

SEQ ID NO: 726615 - DNA, 23 bp, Homo sapiens
tcttaggttggcaaaaaggcagg

SEQ ID NO: 726616 - DNA, 17 bp, Homo sapiens
tcttagtctaggtcctt

SEQ ID NO: 726617 - DNA, 18 bp, Homo sapiens
tcttagtgacacacactg

SEQ ID NO: 726618 - DNA, 22 bp, Homo sapiens
tcttagtggaagacaatactcc

SEQ ID NO: 726619 - DNA, 14 bp, Homo sapiens
tcttagtgtatgat

SEQ ID NO: 726620 - DNA, 18 bp, Homo sapiens
tcttagttcatatatcaa

SEQ ID NO: 726621 - DNA, 20 bp, Homo sapiens
tcttatacagataaaacatg

SEQ ID NO: 726622 - DNA, 14 bp, Homo sapiens
tcttatacatttga

SEQ ID NO: 726623 - DNA, 19 bp, Homo sapiens
tcttataccttctgacagc

SEQ ID NO: 726624 - DNA, 16 bp, Homo sapiens
tcttatacgcttttct

SEQ ID NO: 726625 - DNA, 15 bp, Homo sapiens
tcttatactgtacaa

SEQ ID NO: 726626 - DNA, 19 bp, Homo sapiens
tcttatagaatatttatta

SEQ ID NO: 726627 - DNA, 17 bp, Homo sapiens
tcttatagggtaaaaaa

SEQ ID NO: 726628 - DNA, 23 bp, Homo sapiens
tcttatcacataagagagatgag

SEQ ID NO: 726629 - DNA, 17 bp, Homo sapiens
tcttatccacaaagtac

SEQ ID NO: 726630 - DNA, 19 bp, Homo sapiens
tcttatccacaaagtactc

SEQ ID NO: 726631 - DNA, 19 bp, Homo sapiens
tcttatcccccccagcctg

SEQ ID NO: 726632 - DNA, 14 bp, Homo sapiens
tcttatctgttcag

SEQ ID NO: 726633 - DNA, 20 bp, Homo sapiens
tcttatgactaaattttctt

SEQ ID NO: 726634 - DNA, 16 bp, Homo sapiens
tcttatgatgttttcc

SEQ ID NO: 726635 - DNA, 12 bp, Homo sapiens
tcttatgatttt

SEQ ID NO: 726636 - DNA, 13 bp, Homo sapiens
tcttatgatttta

SEQ ID NO: 726637 - DNA, 15 bp, Homo sapiens
tcttatgattttatt

SEQ ID NO: 726638 - DNA, 20 bp, Homo sapiens
tcttatgatttttaaaagtt

SEQ ID NO: 726639 - DNA, 14 bp, Homo sapiens
tcttatgcaatttc

SEQ ID NO: 726640 - DNA, 21 bp, Homo sapiens
tcttatgctctcactgtttgt

SEQ ID NO: 726641 - DNA, 18 bp, Homo sapiens
tcttatggtccagaaact

SEQ ID NO: 726642 - DNA, 17 bp, Homo sapiens
tcttatggtcttgatcc

SEQ ID NO: 726643 - DNA, 22 bp, Homo sapiens
tcttatggtcttgatcctccaa

SEQ ID NO: 726644 - DNA, 12 bp, Homo sapiens
tcttatgtgaca

SEQ ID NO: 726645 - DNA, 16 bp, Homo sapiens
tcttatgtgacattaa

SEQ ID NO: 726646 - DNA, 19 bp, Homo sapiens
tcttattaaggaaatactt

SEQ ID NO: 726647 - DNA, 19 bp, Homo sapiens
tcttattaattcttcacct

SEQ ID NO: 726648 - DNA, 20 bp, Homo sapiens
tcttattaatttcagtcttg

SEQ ID NO: 726649 - DNA, 19 bp, Homo sapiens
tcttattactattattgtt

SEQ ID NO: 726650 - DNA, 21 bp, Homo sapiens
tcttattaggataatacataa

SEQ ID NO: 726651 - DNA, 17 bp, Homo sapiens
tcttattagggagaaaa

SEQ ID NO: 726652 - DNA, 15 bp, Homo sapiens
tcttattcattttct

SEQ ID NO: 726653 - DNA, 16 bp, Homo sapiens
tcttattcattttctc

SEQ ID NO: 726654 - DNA, 22 bp, Homo sapiens
tcttattgaaaaaaaaaatgtt

SEQ ID NO: 726655 - DNA, 16 bp, Homo sapiens
tcttattgaataaaga

SEQ ID NO: 726656 - DNA, 21 bp, Homo sapiens
tcttattgcaaggcagtctct

SEQ ID NO: 726657 - DNA, 13 bp, Homo sapiens
tcttatttattat

SEQ ID NO: 726658 - DNA, 22 bp, Homo sapiens
tcttatttcactaaatgtaaaa

SEQ ID NO: 726659 - DNA, 15 bp, Homo sapiens
tcttattttagtata

SEQ ID NO: 726660 - DNA, 21 bp, Homo sapiens
tcttattttgcattccagaat

SEQ ID NO: 726661 - DNA, 17 bp, Homo sapiens
tcttattttttaaaaag

SEQ ID NO: 726662 - DNA, 19 bp, Homo sapiens
tcttcaaaaagcagagtgg

SEQ ID NO: 726663 - DNA, 15 bp, Homo sapiens
tcttcaaatatctct

SEQ ID NO: 726664 - DNA, 11 bp, Homo sapiens
tcttcaacaga

SEQ ID NO: 726665 - DNA, 21 bp, Homo sapiens
tcttcaacatcaatgttcatt

SEQ ID NO: 726666 - DNA, 14 bp, Homo sapiens
tcttcaacatgaca

SEQ ID NO: 726667 - DNA, 20 bp, Homo sapiens
tcttcaacatgctccaaata

SEQ ID NO: 726668 - DNA, 22 bp, Homo sapiens
tcttcaacatgctccaaatata

SEQ ID NO: 726669 - DNA, 12 bp, Homo sapiens
tcttcaaccagt

SEQ ID NO: 726670 - DNA, 15 bp, Homo sapiens
tcttcaactccctgc

SEQ ID NO: 726671 - DNA, 16 bp, Homo sapiens
tcttcaactgaccagc

SEQ ID NO: 726672 - DNA, 18 bp, Homo sapiens
tcttcaagcatcctcaga

SEQ ID NO: 726673 - DNA, 19 bp, Homo sapiens
tcttcaagggaagaaacac

SEQ ID NO: 726674 - DNA, 14 bp, Homo sapiens
tcttcaatctctgg

SEQ ID NO: 726675 - DNA, 18 bp, Homo sapiens
tggcccagaaagctgcgg

SEQ ID NO: 726676 - DNA, 13 bp, Homo sapiens
tggcccagcaggc

SEQ ID NO: 726677 - DNA, 14 bp, Homo sapiens
tggcccagcaggca

SEQ ID NO: 726678 - DNA, 21 bp, Homo sapiens
tggcccagcaggcaggcactg

SEQ ID NO: 726679 - DNA, 22 bp, Homo sapiens
tggcccagccaaaccctgtctg

SEQ ID NO: 726680 - DNA, 17 bp, Homo sapiens
tggcccagccggcctct

SEQ ID NO: 726681 - DNA, 16 bp, Homo sapiens
tggcccagcggcccct

SEQ ID NO: 726682 - DNA, 21 bp, Homo sapiens
tggcccagcggcccctcccac

SEQ ID NO: 726683 - DNA, 15 bp, Homo sapiens
tggcccaggagctct

SEQ ID NO: 726684 - DNA, 12 bp, Homo sapiens
tggcccaggcag

SEQ ID NO: 726685 - DNA, 13 bp, Homo sapiens
tggcccaggcccc

SEQ ID NO: 726686 - DNA, 20 bp, Homo sapiens
tggcccaggccttgctgact

SEQ ID NO: 726687 - DNA, 19 bp, Homo sapiens
tggcccagtcctctcccaa

SEQ ID NO: 726688 - DNA, 12 bp, Homo sapiens
tggcccagtgtc

SEQ ID NO: 726689 - DNA, 13 bp, Homo sapiens
tggcccagtgtca

SEQ ID NO: 726690 - DNA, 15 bp, Homo sapiens
tggcccatctcagcc

SEQ ID NO: 726691 - DNA, 16 bp, Homo sapiens
tggcccatctcagcct

SEQ ID NO: 726692 - DNA, 19 bp, Homo sapiens
tggcccatctcagcctcct

SEQ ID NO: 726693 - DNA, 21 bp, Homo sapiens
tggccccaagaggggcgggct

SEQ ID NO: 726694 - DNA, 16 bp, Homo sapiens
tggccccaccctgggc

SEQ ID NO: 726695 - DNA, 16 bp, Homo sapiens
tggccccactttgaag

SEQ ID NO: 726696 - DNA, 19 bp, Homo sapiens
tggccccactttgaagggc

SEQ ID NO: 726697 - DNA, 18 bp, Homo sapiens
tggccccagcacagcttg

SEQ ID NO: 726698 - DNA, 19 bp, Homo sapiens
tggccccagcacagcttga

SEQ ID NO: 726699 - DNA, 19 bp, Homo sapiens
tggccccagccctgctggg

SEQ ID NO: 726700 - DNA, 21 bp, Homo sapiens
tggccccagccctgctgggga

SEQ ID NO: 726701 - DNA, 18 bp, Homo sapiens
tggccccagcctaggtgg

SEQ ID NO: 726702 - DNA, 13 bp, Homo sapiens
tggccccagcctg

SEQ ID NO: 726703 - DNA, 12 bp, Homo sapiens
tggccccaggac

SEQ ID NO: 726704 - DNA, 19 bp, Homo sapiens
tggccccaggccccagaca

SEQ ID NO: 726705 - DNA, 15 bp, Homo sapiens
tggccccaggctgtc

SEQ ID NO: 726706 - DNA, 21 bp, Homo sapiens
tggccccatgtctctcagaat

SEQ ID NO: 726707 - DNA, 18 bp, Homo sapiens
tggcccccaataaaggca

SEQ ID NO: 726708 - DNA, 19 bp, Homo sapiens
tggcccccagccctggggg

SEQ ID NO: 726709 - DNA, 21 bp, Homo sapiens
tggcccccaggattcccccag

SEQ ID NO: 726710 - DNA, 15 bp, Homo sapiens
tggcccccatacttg

SEQ ID NO: 726711 - DNA, 15 bp, Homo sapiens
tggccccccactccc

SEQ ID NO: 726712 - DNA, 23 bp, Homo sapiens
tggccccccactcccccttccct

SEQ ID NO: 726713 - DNA, 14 bp, Homo sapiens
tggcccccgagctg

SEQ ID NO: 726714 - DNA, 15 bp, Homo sapiens
tggcccccgagctgg

SEQ ID NO: 726715 - DNA, 17 bp, Homo sapiens
tggcccccgagctgggg

SEQ ID NO: 726716 - DNA, 19 bp, Homo sapiens
tggcccccgagctgggggc

SEQ ID NO: 726717 - DNA, 16 bp, Homo sapiens
tggcccccgggcctgc

SEQ ID NO: 726718 - DNA, 18 bp, Homo sapiens
tggcccccgggcctgcac

SEQ ID NO: 726719 - DNA, 21 bp, Homo sapiens
tggcccccgggcctgcacaga

SEQ ID NO: 726720 - DNA, 19 bp, Homo sapiens
tggccccctcattcagaga

SEQ ID NO: 726721 - DNA, 20 bp, Homo sapiens
tggccccctcattcagagac

SEQ ID NO: 726722 - DNA, 13 bp, Homo sapiens
tggccccctgtcc

SEQ ID NO: 726723 - DNA, 23 bp, Homo sapiens
tggccccctttcccgggctgtcc

SEQ ID NO: 726724 - DNA, 15 bp, Homo sapiens
tggccccgccgcctg

SEQ ID NO: 726725 - DNA, 21 bp, Homo sapiens
tggccccgccgcctggtactc

SEQ ID NO: 726726 - DNA, 20 bp, Homo sapiens
tggccccgggctctggccac

SEQ ID NO: 726727 - DNA, 21 bp, Homo sapiens
tggccccgggctctggccacc

SEQ ID NO: 726728 - DNA, 23 bp, Homo sapiens
tggccccgggctctggccaccct

SEQ ID NO: 726729 - DNA, 23 bp, Homo sapiens
tggcccctactttgtggcaatct

SEQ ID NO: 726730 - DNA, 21 bp, Homo sapiens
tggcccctcaaatcgtccagc

SEQ ID NO: 726731 - DNA, 19 bp, Homo sapiens
tggcccctcacccaccatg

SEQ ID NO: 726732 - DNA, 19 bp, Homo sapiens
tggcccctcacctgggcct

SEQ ID NO: 726733 - DNA, 19 bp, Homo sapiens
tggcccctccttgcaacca

SEQ ID NO: 726734 - DNA, 13 bp, Homo sapiens
tggcccctcgcct

SEQ ID NO: 726735 - DNA, 14 bp, Homo sapiens
tggcccctctgacc

SEQ ID NO: 726736 - DNA, 14 bp, Homo sapiens
tggcccctgaacaa

SEQ ID NO: 726737 - DNA, 16 bp, Homo sapiens
tggcccctgagcccag

SEQ ID NO: 726738 - DNA, 20 bp, Homo sapiens
tggcccctgctgtctctctg

SEQ ID NO: 726739 - DNA, 11 bp, Homo sapiens
tggccccttca

SEQ ID NO: 726740 - DNA, 14 bp, Homo sapiens
tggcccgacagcct

SEQ ID NO: 726741 - DNA, 15 bp, Homo sapiens
tggcccgcagtggct

SEQ ID NO: 726742 - DNA, 13 bp, Homo sapiens
tggcccgcccctc

SEQ ID NO: 726743 - DNA, 22 bp, Homo sapiens
tggcccgcccctcgctgctgct

SEQ ID NO: 726744 - DNA, 14 bp, Homo sapiens
tggcccgccctcac

SEQ ID NO: 726745 - DNA, 15 bp, Homo sapiens
tggcccgcggcctgc

SEQ ID NO: 726746 - DNA, 23 bp, Homo sapiens
tggccctccctccctagcccttc

SEQ ID NO: 726747 - DNA, 16 bp, Homo sapiens
tggccctcggtggctg

SEQ ID NO: 726748 - DNA, 21 bp, Homo sapiens
tggccctgccatcttcccagc

SEQ ID NO: 726749 - DNA, 13 bp, Homo sapiens
tggccctgccctt

SEQ ID NO: 726750 - DNA, 17 bp, Homo sapiens
tggccctgcccttggca

SEQ ID NO: 726751 - DNA, 11 bp, Homo sapiens
tggccctgcct

SEQ ID NO: 726752 - DNA, 14 bp, Homo sapiens
tggccctggcctgc

SEQ ID NO: 726753 - DNA, 18 bp, Homo sapiens
tggccctggcctgctggg

SEQ ID NO: 726754 - DNA, 22 bp, Homo sapiens
tggccctgggagaatcgctcct

SEQ ID NO: 726755 - DNA, 20 bp, Homo sapiens
gtcaaaacagattgtttgca

SEQ ID NO: 726756 - DNA, 15 bp, Homo sapiens
gtcaaaagctggatt

SEQ ID NO: 726757 - DNA, 12 bp, Homo sapiens
gtcaaacaaata

SEQ ID NO: 726758 - DNA, 17 bp, Homo sapiens
gtcaaacattcgtgagc

SEQ ID NO: 726759 - DNA, 13 bp, Homo sapiens
gtcaaaccgcact

SEQ ID NO: 726760 - DNA, 16 bp, Homo sapiens
gtcaaagaaatgctga

SEQ ID NO: 726761 - DNA, 11 bp, Homo sapiens
gtcaaagaagg

SEQ ID NO: 726762 - DNA, 20 bp, Homo sapiens
gtcaaagacagaatggtgga

SEQ ID NO: 726763 - DNA, 22 bp, Homo sapiens
gtcaaagctttgactctataag

SEQ ID NO: 726764 - DNA, 18 bp, Homo sapiens
gtcaaaggcatctccctt

SEQ ID NO: 726765 - DNA, 16 bp, Homo sapiens
gtcaaagtacagaata

SEQ ID NO: 726766 - DNA, 15 bp, Homo sapiens
gtcaaatcaaggcaa

SEQ ID NO: 726767 - DNA, 22 bp, Homo sapiens
gtcaaatgcatacaagtttcat

SEQ ID NO: 726768 - DNA, 15 bp, Homo sapiens
gtcaaatgtttcctt

SEQ ID NO: 726769 - DNA, 23 bp, Homo sapiens
gtcaaatgtttccttaaacatga

SEQ ID NO: 726770 - DNA, 17 bp, Homo sapiens
gtcaacactcttcttga

SEQ ID NO: 726771 - DNA, 16 bp, Homo sapiens
gtcaacctttgtgtgg

SEQ ID NO: 726772 - DNA, 21 bp, Homo sapiens
gtcaactaaatgagattatat

SEQ ID NO: 726773 - DNA, 15 bp, Homo sapiens
gtcaactggctggcc

SEQ ID NO: 726774 - DNA, 12 bp, Homo sapiens
gtcaacttctgg

SEQ ID NO: 726775 - DNA, 15 bp, Homo sapiens
gtcaacttctggctc

SEQ ID NO: 726776 - DNA, 20 bp, Homo sapiens
gtcaagaaaggaggggagaa

SEQ ID NO: 726777 - DNA, 12 bp, Homo sapiens
gtcaagaagaaa

SEQ ID NO: 726778 - DNA, 15 bp, Homo sapiens
gtcaagaagaaaaag

SEQ ID NO: 726779 - DNA, 16 bp, Homo sapiens
gtcaagaagaatgaac

SEQ ID NO: 726780 - DNA, 16 bp, Homo sapiens
gtcaagaccagcctgg

SEQ ID NO: 726781 - DNA, 16 bp, Homo sapiens
gtcaagagcatgcaca

SEQ ID NO: 726782 - DNA, 17 bp, Homo sapiens
gtcaagagtagttatat

SEQ ID NO: 726783 - DNA, 16 bp, Homo sapiens
gtcaagcatattggaa

SEQ ID NO: 726784 - DNA, 14 bp, Homo sapiens
gtcaagcatgtatt

SEQ ID NO: 726785 - DNA, 13 bp, Homo sapiens
gtcaagcccagaa

SEQ ID NO: 726786 - DNA, 13 bp, Homo sapiens
gtcaagctcctcc

SEQ ID NO: 726787 - DNA, 17 bp, Homo sapiens
gtcaagctcctcctccc

SEQ ID NO: 726788 - DNA, 19 bp, Homo sapiens
gtcaagctcctcctccctg

SEQ ID NO: 726789 - DNA, 21 bp, Homo sapiens
gtcaagctcctcctccctgca

SEQ ID NO: 726790 - DNA, 19 bp, Homo sapiens
gtcaagctgctctgagcca

SEQ ID NO: 726791 - DNA, 23 bp, Homo sapiens
gtcaagctgctctgagccacagt

SEQ ID NO: 726792 - DNA, 23 bp, Homo sapiens
gtcaaggccgagggccaggcaga

SEQ ID NO: 726793 - DNA, 14 bp, Homo sapiens
gtcaagtaagaaga

SEQ ID NO: 726794 - DNA, 15 bp, Homo sapiens
gtcaagtaataaaaa

SEQ ID NO: 726795 - DNA, 14 bp, Homo sapiens
gtcaagtctctgct

SEQ ID NO: 726796 - DNA, 18 bp, Homo sapiens
gtcaagtgaaaaaggagg

SEQ ID NO: 726797 - DNA, 18 bp, Homo sapiens
tggcctacaaatcagtaa

SEQ ID NO: 726798 - DNA, 12 bp, Homo sapiens
tggcctacattc

SEQ ID NO: 726799 - DNA, 17 bp, Homo sapiens
tggcctacattctttat

SEQ ID NO: 726800 - DNA, 18 bp, Homo sapiens
tggcctagaccagcagac

SEQ ID NO: 726801 - DNA, 20 bp, Homo sapiens
tggcctagcatacgtacaca

SEQ ID NO: 726802 - DNA, 23 bp, Homo sapiens
tggcctagcatacgtacacattt

SEQ ID NO: 726803 - DNA, 22 bp, Homo sapiens
tggcctaggagatatctgaggg

SEQ ID NO: 726804 - DNA, 16 bp, Homo sapiens
tggcctatgtggtcta

SEQ ID NO: 726805 - DNA, 19 bp, Homo sapiens
tggcctatgtggtctaagg

SEQ ID NO: 726806 - DNA, 20 bp, Homo sapiens
tggcctattatattaaaata

SEQ ID NO: 726807 - DNA, 19 bp, Homo sapiens
tggcctcaaaacagaagca

SEQ ID NO: 726808 - DNA, 23 bp, Homo sapiens
tggcctcaaaacagaagcagctt

SEQ ID NO: 726809 - DNA, 16 bp, Homo sapiens
tggcctcaaccctccc

SEQ ID NO: 726810 - DNA, 22 bp, Homo sapiens
tggcctcaaccctccctcagcc

SEQ ID NO: 726811 - DNA, 19 bp, Homo sapiens
tggcctcaagaaaggcccg

SEQ ID NO: 726812 - DNA, 16 bp, Homo sapiens
tggcctcactggctgg

SEQ ID NO: 726813 - DNA, 19 bp, Homo sapiens
tggcctcactggctggggc

SEQ ID NO: 726814 - DNA, 22 bp, Homo sapiens
tggcctcacttgattcatctct

SEQ ID NO: 726815 - DNA, 12 bp, Homo sapiens
tggcctcagccc

SEQ ID NO: 726816 - DNA, 14 bp, Homo sapiens
tggcctcagccctc

SEQ ID NO: 726817 - DNA, 16 bp, Homo sapiens
tggcctcagttcccag

SEQ ID NO: 726818 - DNA, 20 bp, Homo sapiens
tggcctcatgctggagggag

SEQ ID NO: 726819 - DNA, 15 bp, Homo sapiens
tggcctccagctgtt

SEQ ID NO: 726820 - DNA, 18 bp, Homo sapiens
tggcctcccaaagtgctg

SEQ ID NO: 726821 - DNA, 11 bp, Homo sapiens
tggcctcccac

SEQ ID NO: 726822 - DNA, 22 bp, Homo sapiens
tggcctcccacccgatgctgct

SEQ ID NO: 726823 - DNA, 17 bp, Homo sapiens
tggcctccccatgggca

SEQ ID NO: 726824 - DNA, 12 bp, Homo sapiens
tggcctccccca

SEQ ID NO: 726825 - DNA, 14 bp, Homo sapiens
tggcctcccctgcc

SEQ ID NO: 726826 - DNA, 21 bp, Homo sapiens
tggcctcccctgccaccaggc

SEQ ID NO: 726827 - DNA, 13 bp, Homo sapiens
tggcctccctggc

SEQ ID NO: 726828 - DNA, 18 bp, Homo sapiens
tggcctccctggctcctc

SEQ ID NO: 726829 - DNA, 22 bp, Homo sapiens
tggcctccctggctcctccgtc

SEQ ID NO: 726830 - DNA, 18 bp, Homo sapiens
tggcctccgcagtgtctc

SEQ ID NO: 726831 - DNA, 12 bp, Homo sapiens
tggcctccggcc

SEQ ID NO: 726832 - DNA, 22 bp, Homo sapiens
tggcctccgtcctgtcactgat

SEQ ID NO: 726833 - DNA, 19 bp, Homo sapiens
tggcctcgggacacctgcc

SEQ ID NO: 726834 - DNA, 19 bp, Homo sapiens
tggcctcgtgatctgccct

SEQ ID NO: 726835 - DNA, 23 bp, Homo sapiens
tggcctctctatcctctcttcct

SEQ ID NO: 726836 - DNA, 13 bp, Homo sapiens
tggcctctctctc

SEQ ID NO: 726837 - DNA, 19 bp, Homo sapiens
tggcctctgcaactgctca

SEQ ID NO: 726838 - DNA, 13 bp, Homo sapiens
tggcctctgcctg

SEQ ID NO: 726839 - DNA, 12 bp, Homo sapiens
tggcctctgctt

SEQ ID NO: 726840 - DNA, 20 bp, Homo sapiens
tggcctctgcttacttttta

SEQ ID NO: 726841 - DNA, 16 bp, Homo sapiens
tggcctctggctctca

SEQ ID NO: 726842 - DNA, 15 bp, Homo sapiens
tggcctctgtgatta

SEQ ID NO: 726843 - DNA, 13 bp, Homo sapiens
tggcctcttcaga

SEQ ID NO: 726844 - DNA, 15 bp, Homo sapiens
tggcctcttgtccct

SEQ ID NO: 726845 - DNA, 20 bp, Homo sapiens
tggcctctttcctcagcctt

SEQ ID NO: 726846 - DNA, 17 bp, Homo sapiens
tggcctgaactgaggag

SEQ ID NO: 726847 - DNA, 18 bp, Homo sapiens
tggcctgaactgaggaga

SEQ ID NO: 726848 - DNA, 21 bp, Homo sapiens
tggcctgaagagtcctctgaa

SEQ ID NO: 726849 - DNA, 21 bp, Homo sapiens
tggcctgactggttgtcagaa

SEQ ID NO: 726850 - DNA, 19 bp, Homo sapiens
tggcctgagagtcagctct

SEQ ID NO: 726851 - DNA, 11 bp, Homo sapiens
tggcctgagct

SEQ ID NO: 726852 - DNA, 18 bp, Homo sapiens
tggcctgatgatggtggg

SEQ ID NO: 726853 - DNA, 17 bp, Homo sapiens
tggcctgccagacactg

SEQ ID NO: 726854 - DNA, 22 bp, Homo sapiens
tggcctgccagacactgcgccc

SEQ ID NO: 726855 - DNA, 11 bp, Homo sapiens
tggcctgccca

SEQ ID NO: 726856 - DNA, 13 bp, Homo sapiens
tggcctgcccagc

SEQ ID NO: 726857 - DNA, 17 bp, Homo sapiens
tggcctgcccagcctca

SEQ ID NO: 726858 - DNA, 12 bp, Homo sapiens
tggcctgctggg

SEQ ID NO: 726859 - DNA, 15 bp, Homo sapiens
tggcctgctgggaac

SEQ ID NO: 726860 - DNA, 22 bp, Homo sapiens
tggcctgctgggaaccccgcag

SEQ ID NO: 726861 - DNA, 20 bp, Homo sapiens
tggcctgctgggctctccac

SEQ ID NO: 726862 - DNA, 22 bp, Homo sapiens
tggcctgctgggctctccacct

SEQ ID NO: 726863 - DNA, 11 bp, Homo sapiens
tggcctgctgt

SEQ ID NO: 726864 - DNA, 16 bp, Homo sapiens
tggcctggaccattcc

SEQ ID NO: 726865 - DNA, 13 bp, Homo sapiens
tggcctggactgt

SEQ ID NO: 726866 - DNA, 14 bp, Homo sapiens
tggcctggaggctc

SEQ ID NO: 726867 - DNA, 15 bp, Homo sapiens
tggcctggcatctgt

SEQ ID NO: 726868 - DNA, 16 bp, Homo sapiens
tggcctggcatctgtg

SEQ ID NO: 726869 - DNA, 15 bp, Homo sapiens
tggcctggccaggag

SEQ ID NO: 726870 - DNA, 18 bp, Homo sapiens
tggcctggccaggagctc

SEQ ID NO: 726871 - DNA, 21 bp, Homo sapiens
tggcctggccaggagctcttc

SEQ ID NO: 726872 - DNA, 15 bp, Homo sapiens
tggcctggccctcct

SEQ ID NO: 726873 - DNA, 17 bp, Homo sapiens
tggcctggccctcctgg

SEQ ID NO: 726874 - DNA, 16 bp, Homo sapiens
tggcctggccggcaac

SEQ ID NO: 726875 - DNA, 15 bp, Homo sapiens
tggcctggctgcctg

SEQ ID NO: 726876 - DNA, 16 bp, Homo sapiens
tggcctggctgcctgg

SEQ ID NO: 726877 - DNA, 21 bp, Homo sapiens
tggcctggtgggtcaggggga

SEQ ID NO: 726878 - DNA, 12 bp, Homo sapiens
tggcctgtctca

SEQ ID NO: 726879 - DNA, 16 bp, Homo sapiens
tggcctgtctcatccc

SEQ ID NO: 726880 - DNA, 20 bp, Homo sapiens
tggcctgtctcatccccagg

SEQ ID NO: 726881 - DNA, 17 bp, Homo sapiens
tggcctgtctccctagg

SEQ ID NO: 726882 - DNA, 12 bp, Homo sapiens
tggcctgtgggc

SEQ ID NO: 726883 - DNA, 20 bp, Homo sapiens
tggcctgtgggcctcacctg

SEQ ID NO: 726884 - DNA, 16 bp, Homo sapiens
tggcctgtgtccagca

SEQ ID NO: 726885 - DNA, 19 bp, Homo sapiens
tggcctgtgtccagcagct

SEQ ID NO: 726886 - DNA, 21 bp, Homo sapiens
tggcctgtgtccagcagctgc

SEQ ID NO: 726887 - DNA, 22 bp, Homo sapiens
tggcctgtgtccagcagctgcg

SEQ ID NO: 726888 - DNA, 21 bp, Homo sapiens
tggcctgtgtcccatgaccca

SEQ ID NO: 726889 - DNA, 19 bp, Homo sapiens
tggcctgttatgattctga

SEQ ID NO: 726890 - DNA, 23 bp, Homo sapiens
tggcctgttcaacaatcagtcat

SEQ ID NO: 726891 - DNA, 18 bp, Homo sapiens
tggcctgtttcaacacag

SEQ ID NO: 726892 - DNA, 23 bp, Homo sapiens
tggccttaaaaggggcccaagcc

SEQ ID NO: 726893 - DNA, 20 bp, Homo sapiens
tggccttaagaactgtgtct

SEQ ID NO: 726894 - DNA, 23 bp, Homo sapiens
tggccttaagaactgtgtctggc

SEQ ID NO: 726895 - DNA, 18 bp, Homo sapiens
tggccttccatttatatg

SEQ ID NO: 726896 - DNA, 23 bp, Homo sapiens
tggccttccccagcatgcaccac

SEQ ID NO: 726897 - DNA, 23 bp, Homo sapiens
tggccttccccttttgcctggct

SEQ ID NO: 726898 - DNA, 16 bp, Homo sapiens
tggccttcctgcccta

SEQ ID NO: 726899 - DNA, 13 bp, Homo sapiens
tggccttgaaaca

SEQ ID NO: 726900 - DNA, 23 bp, Homo sapiens
tggccttgaaacagttccattta

SEQ ID NO: 726901 - DNA, 18 bp, Homo sapiens
tggccttgaaaccacctt

SEQ ID NO: 726902 - DNA, 18 bp, Homo sapiens
tggccttggtatgtgcca

SEQ ID NO: 726903 - DNA, 22 bp, Homo sapiens
tggccttggtatgtgccaggct

SEQ ID NO: 726904 - DNA, 14 bp, Homo sapiens
tggcctttcacttt

SEQ ID NO: 726905 - DNA, 24 bp, Homo sapiens
tggcctttcaggtccaggccagtg

SEQ ID NO: 726906 - DNA, 17 bp, Homo sapiens
tggcctttccttccctc

SEQ ID NO: 726907 - DNA, 22 bp, Homo sapiens
tggcctttccttccctctctga

SEQ ID NO: 726908 - DNA, 15 bp, Homo sapiens
tggcctttccttgta

SEQ ID NO: 726909 - DNA, 16 bp, Homo sapiens
tggcctttcttgggga

SEQ ID NO: 726910 - DNA, 14 bp, Homo sapiens
tggcctttggaccc

SEQ ID NO: 726911 - DNA, 17 bp, Homo sapiens
tggcctttggacccagg

SEQ ID NO: 726912 - DNA, 17 bp, Homo sapiens
tggcctttgtaagtgca

SEQ ID NO: 726913 - DNA, 24 bp, Homo sapiens
tggcctttgtgctgcgcctgcagg

SEQ ID NO: 726914 - DNA, 20 bp, Homo sapiens
tggcgacactcagggcagct

SEQ ID NO: 726915 - DNA, 13 bp, Homo sapiens
tggcgatgtgtta

SEQ ID NO: 726916 - DNA, 14 bp, Homo sapiens
tggcgcaagcctgt

SEQ ID NO: 726917 - DNA, 16 bp, Homo sapiens
tggcgcagccaaggcc

SEQ ID NO: 726918 - DNA, 18 bp, Homo sapiens
gtcactctgccctctgct

SEQ ID NO: 726919 - DNA, 20 bp, Homo sapiens
gtcactctgccctctgctgc

SEQ ID NO: 726920 - DNA, 22 bp, Homo sapiens
gtcactctgccctctgctgctg

SEQ ID NO: 726921 - DNA, 20 bp, Homo sapiens
gtcactcttcctgcaaggac

SEQ ID NO: 726922 - DNA, 15 bp, Homo sapiens
gtcactgaaccactg

SEQ ID NO: 726923 - DNA, 16 bp, Homo sapiens
gtcactgaaccactgc

SEQ ID NO: 726924 - DNA, 18 bp, Homo sapiens
gtcactgaaccactgctt

SEQ ID NO: 726925 - DNA, 21 bp, Homo sapiens
gtcactgaaccactgcttctc

SEQ ID NO: 726926 - DNA, 23 bp, Homo sapiens
gtcactgaaccactgcttctctt

SEQ ID NO: 726927 - DNA, 12 bp, Homo sapiens
gtcactgccaac

SEQ ID NO: 726928 - DNA, 21 bp, Homo sapiens
gtcactgccgacatccctccc

SEQ ID NO: 726929 - DNA, 18 bp, Homo sapiens
gtcactgcctgcagaggt

SEQ ID NO: 726930 - DNA, 18 bp, Homo sapiens
gtcactgctgctactgcc

SEQ ID NO: 726931 - DNA, 21 bp, Homo sapiens
gtcactgcttaacttcacata

SEQ ID NO: 726932 - DNA, 15 bp, Homo sapiens
gtcactggaaagggg

SEQ ID NO: 726933 - DNA, 18 bp, Homo sapiens
gtcactggaaaggggaga

SEQ ID NO: 726934 - DNA, 20 bp, Homo sapiens
gtcactggaaaggggagagc

SEQ ID NO: 726935 - DNA, 23 bp, Homo sapiens
gtcactggaaaggggagagcctg

SEQ ID NO: 726936 - DNA, 20 bp, Homo sapiens
gtcactggaggttgaagcca

SEQ ID NO: 726937 - DNA, 14 bp, Homo sapiens
gtcactggcagagc

SEQ ID NO: 726938 - DNA, 19 bp, Homo sapiens
gtcactggcagagcacagc

SEQ ID NO: 726939 - DNA, 22 bp, Homo sapiens
gtcactggcagagcacagccca

SEQ ID NO: 726940 - DNA, 14 bp, Homo sapiens
gtcactggctctcc

SEQ ID NO: 726941 - DNA, 14 bp, Homo sapiens
gtcactggtcaggg

SEQ ID NO: 726942 - DNA, 17 bp, Homo sapiens
gtcactggtcagggcag

SEQ ID NO: 726943 - DNA, 23 bp, Homo sapiens
gtcactggtcagggcagtggcca

SEQ ID NO: 726944 - DNA, 19 bp, Homo sapiens
gtcactgtttattttttta

SEQ ID NO: 726945 - DNA, 14 bp, Homo sapiens
gtcactgtttcctg

SEQ ID NO: 726946 - DNA, 15 bp, Homo sapiens
gtcactgtttctctg

SEQ ID NO: 726947 - DNA, 15 bp, Homo sapiens
gtcacttatttcata

SEQ ID NO: 726948 - DNA, 24 bp, Homo sapiens
gtcacttcgcgtgccctcgctgct

SEQ ID NO: 726949 - DNA, 21 bp, Homo sapiens
gtcacttctcctgctgctcct

SEQ ID NO: 726950 - DNA, 14 bp, Homo sapiens
gtcacttgccacat

SEQ ID NO: 726951 - DNA, 22 bp, Homo sapiens
gtcacttgggagctgctgggct

SEQ ID NO: 726952 - DNA, 23 bp, Homo sapiens
gtcacttgggagctgctgggcta

SEQ ID NO: 726953 - DNA, 19 bp, Homo sapiens
gtcacttgtcgggggccca

SEQ ID NO: 726954 - DNA, 24 bp, Homo sapiens
gtcacttgtgctttgctcttgtcc

SEQ ID NO: 726955 - DNA, 17 bp, Homo sapiens
gtcactttgctctgggt

SEQ ID NO: 726956 - DNA, 19 bp, Homo sapiens
gtcactttttttctttttc

SEQ ID NO: 726957 - DNA, 15 bp, Homo sapiens
gtcagaaaaaatatg

SEQ ID NO: 726958 - DNA, 19 bp, Homo sapiens
gtcagaaacaatgacatcc

SEQ ID NO: 726959 - DNA, 14 bp, Homo sapiens
gtcagaacatgtta

SEQ ID NO: 726960 - DNA, 23 bp, Homo sapiens
gtcagaagaagtgggagcagctt

SEQ ID NO: 726961 - DNA, 15 bp, Homo sapiens
gtcagaagcaggttc

SEQ ID NO: 726962 - DNA, 17 bp, Homo sapiens
gtcagaagcaggttctt

SEQ ID NO: 726963 - DNA, 22 bp, Homo sapiens
gtcagaagcaggttcttgatgt

SEQ ID NO: 726964 - DNA, 21 bp, Homo sapiens
gtcagaagggggttgtggcaa

SEQ ID NO: 726965 - DNA, 13 bp, Homo sapiens
gtcagaatcagaa

SEQ ID NO: 726966 - DNA, 18 bp, Homo sapiens
gtcagacatccatgtttg

SEQ ID NO: 726967 - DNA, 18 bp, Homo sapiens
gtcagaccagtactggga

SEQ ID NO: 726968 - DNA, 17 bp, Homo sapiens
gtcagacgcctgaggaa

SEQ ID NO: 726969 - DNA, 14 bp, Homo sapiens
gtcagactgctggg

SEQ ID NO: 726970 - DNA, 22 bp, Homo sapiens
gtcagactttgctgcattttac

SEQ ID NO: 726971 - DNA, 10 bp, Homo sapiens
gtcagagaca

SEQ ID NO: 726972 - DNA, 13 bp, Homo sapiens
gtcagagccctgg

SEQ ID NO: 726973 - DNA, 18 bp, Homo sapiens
gtcagagccctggctggg

SEQ ID NO: 726974 - DNA, 22 bp, Homo sapiens
gtcagagccctggctgggttca

SEQ ID NO: 726975 - DNA, 15 bp, Homo sapiens
gtcagagcctacctt

SEQ ID NO: 726976 - DNA, 10 bp, Homo sapiens
gtcagagcta

SEQ ID NO: 726977 - DNA, 19 bp, Homo sapiens
gtcagagctatgttccctc

SEQ ID NO: 726978 - DNA, 13 bp, Homo sapiens
gtcagagctggga

SEQ ID NO: 726979 - DNA, 22 bp, Homo sapiens
gtcagaggaacagtcctgttca

SEQ ID NO: 726980 - DNA, 13 bp, Homo sapiens
gtcagaggacccc

SEQ ID NO: 726981 - DNA, 13 bp, Homo sapiens
gtcagagtccagt

SEQ ID NO: 726982 - DNA, 22 bp, Homo sapiens
gtcagagtccagtgctctgcct

SEQ ID NO: 726983 - DNA, 18 bp, Homo sapiens
gtcagatgagaacaaagc

SEQ ID NO: 726984 - DNA, 16 bp, Homo sapiens
gtcagatgcgtgccca

SEQ ID NO: 726985 - DNA, 12 bp, Homo sapiens
gtcagatgtggc

SEQ ID NO: 726986 - DNA, 12 bp, Homo sapiens
gtcagatgtttg

SEQ ID NO: 726987 - DNA, 16 bp, Homo sapiens
gtcagcaaaaagcaaa

SEQ ID NO: 726988 - DNA, 22 bp, Homo sapiens
gtcagcaccttggcccaggagc

SEQ ID NO: 726989 - DNA, 19 bp, Homo sapiens
gtcagcagatgccagtgaa

SEQ ID NO: 726990 - DNA, 20 bp, Homo sapiens
gtcagcagatgccagtgaag

SEQ ID NO: 726991 - DNA, 16 bp, Homo sapiens
gtcagcatctggctgt

SEQ ID NO: 726992 - DNA, 15 bp, Homo sapiens
gtcagccaaatgtaa

SEQ ID NO: 726993 - DNA, 20 bp, Homo sapiens
gtcagccacactgggcctgg

SEQ ID NO: 726994 - DNA, 12 bp, Homo sapiens
gtcagccacctc

SEQ ID NO: 726995 - DNA, 12 bp, Homo sapiens
gtcagccagccg

SEQ ID NO: 726996 - DNA, 21 bp, Homo sapiens
gtcagccagccgccctgggct

SEQ ID NO: 726997 - DNA, 15 bp, Homo sapiens
gtcagccaggagctg

SEQ ID NO: 726998 - DNA, 17 bp, Homo sapiens
gtcagccatcagccatg

SEQ ID NO: 726999 - DNA, 12 bp, Homo sapiens
gtcagccatttt

SEQ ID NO: 727000 - DNA, 19 bp, Homo sapiens
gtcagccccaagggctggg

SEQ ID NO: 727001 - DNA, 20 bp, Homo sapiens
gtcagcccctcttcccttcc

SEQ ID NO: 727002 - DNA, 16 bp, Homo sapiens
gtcagcccgtttcaga

SEQ ID NO: 727003 - DNA, 17 bp, Homo sapiens
gtcagcccgtttcagaa

SEQ ID NO: 727004 - DNA, 13 bp, Homo sapiens
gtcagccctaggg

SEQ ID NO: 727005 - DNA, 16 bp, Homo sapiens
gtcagccctgtgtctg

SEQ ID NO: 727006 - DNA, 22 bp, Homo sapiens
gtcagccctgtgtctgtcacag

SEQ ID NO: 727007 - DNA, 20 bp, Homo sapiens
gtcagccgagccgggcctgg

SEQ ID NO: 727008 - DNA, 21 bp, Homo sapiens
gtcagcgttctaccaggcaaa

SEQ ID NO: 727009 - DNA, 14 bp, Homo sapiens
gtcagctactaatg

SEQ ID NO: 727010 - DNA, 17 bp, Homo sapiens
tggctctaccctgtctg

SEQ ID NO: 727011 - DNA, 21 bp, Homo sapiens
tggctctaccttcctgtccct

SEQ ID NO: 727012 - DNA, 18 bp, Homo sapiens
tggctctcaggggccagt

SEQ ID NO: 727013 - DNA, 15 bp, Homo sapiens
tggctctccaagtgc

SEQ ID NO: 727014 - DNA, 14 bp, Homo sapiens
tggctctcccaccc

SEQ ID NO: 727015 - DNA, 15 bp, Homo sapiens
tggctctcccacccc

SEQ ID NO: 727016 - DNA, 20 bp, Homo sapiens
tggctctgaggtgcctgtcc

SEQ ID NO: 727017 - DNA, 13 bp, Homo sapiens
tggctctgccccc

SEQ ID NO: 727018 - DNA, 19 bp, Homo sapiens
tggctctgccccctccccc

SEQ ID NO: 727019 - DNA, 13 bp, Homo sapiens
tggctctgcccct

SEQ ID NO: 727020 - DNA, 17 bp, Homo sapiens
tggctctgcccctcagg

SEQ ID NO: 727021 - DNA, 19 bp, Homo sapiens
tggctctgcccctcagggg

SEQ ID NO: 727022 - DNA, 18 bp, Homo sapiens
tggctctgggagagccag

SEQ ID NO: 727023 - DNA, 19 bp, Homo sapiens
tggctctgggagagccagc

SEQ ID NO: 727024 - DNA, 23 bp, Homo sapiens
tggctctgggagagccagctttg

SEQ ID NO: 727025 - DNA, 18 bp, Homo sapiens
tggctctggggtatgtgt

SEQ ID NO: 727026 - DNA, 19 bp, Homo sapiens
tggctctggggtatgtgtg

SEQ ID NO: 727027 - DNA, 20 bp, Homo sapiens
tggctctgggtgaggtaggc

SEQ ID NO: 727028 - DNA, 20 bp, Homo sapiens
tggctcttgatacccccctc

SEQ ID NO: 727029 - DNA, 21 bp, Homo sapiens
tggctcttgatacccccctct

SEQ ID NO: 727030 - DNA, 16 bp, Homo sapiens
tggctcttggcttcca

SEQ ID NO: 727031 - DNA, 14 bp, Homo sapiens
tggctctttcagag

SEQ ID NO: 727032 - DNA, 15 bp, Homo sapiens
tggctctttcagaga

SEQ ID NO: 727033 - DNA, 18 bp, Homo sapiens
tggctgaaattctcctgg

SEQ ID NO: 727034 - DNA, 18 bp, Homo sapiens
tggctgaaccctgtgctg

SEQ ID NO: 727035 - DNA, 23 bp, Homo sapiens
tggctgaaccctgtgctggtgtc

SEQ ID NO: 727036 - DNA, 16 bp, Homo sapiens
tggctgaagctggagc

SEQ ID NO: 727037 - DNA, 17 bp, Homo sapiens
tggctgaagctggagca

SEQ ID NO: 727038 - DNA, 20 bp, Homo sapiens
tggctgaagctggagcagcg

SEQ ID NO: 727039 - DNA, 13 bp, Homo sapiens
gtcattctttatt

SEQ ID NO: 727040 - DNA, 15 bp, Homo sapiens
gtcattgagggacca

SEQ ID NO: 727041 - DNA, 22 bp, Homo sapiens
gtcattgatgtaatttaaaact

SEQ ID NO: 727042 - DNA, 22 bp, Homo sapiens
gtcattgcacctatctcagcca

SEQ ID NO: 727043 - DNA, 23 bp, Homo sapiens
gtcattgcacctatctcagccat

SEQ ID NO: 727044 - DNA, 18 bp, Homo sapiens
gtcattgccttcgctcca

SEQ ID NO: 727045 - DNA, 13 bp, Homo sapiens
gtcattgctaaaa

SEQ ID NO: 727046 - DNA, 15 bp, Homo sapiens
gtcattgctgctgct

SEQ ID NO: 727047 - DNA, 14 bp, Homo sapiens
gtcatttaaatgtg

SEQ ID NO: 727048 - DNA, 15 bp, Homo sapiens
gtcatttaaatgtgt

SEQ ID NO: 727049 - DNA, 20 bp, Homo sapiens
gtcatttcattccattgcct

SEQ ID NO: 727050 - DNA, 21 bp, Homo sapiens
gtcatttcattccattgccta

SEQ ID NO: 727051 - DNA, 16 bp, Homo sapiens
gtcatttgttaaaata

SEQ ID NO: 727052 - DNA, 17 bp, Homo sapiens
gtcattttaaaatctga

SEQ ID NO: 727053 - DNA, 21 bp, Homo sapiens
gtcattttaactttatcacat

SEQ ID NO: 727054 - DNA, 14 bp, Homo sapiens
gtcattttgtaata

SEQ ID NO: 727055 - DNA, 22 bp, Homo sapiens
gtcattttgtaatatttgaatt

SEQ ID NO: 727056 - DNA, 23 bp, Homo sapiens
gtcatttttaatattactgtctt

SEQ ID NO: 727057 - DNA, 15 bp, Homo sapiens
gtccaaaaaaaggaa

SEQ ID NO: 727058 - DNA, 17 bp, Homo sapiens
gtccaaaaaaaggaaaa

SEQ ID NO: 727059 - DNA, 18 bp, Homo sapiens
gtccaaaaaaaggaaaaa

SEQ ID NO: 727060 - DNA, 20 bp, Homo sapiens
gtccaaaaaaaggaaaaata

SEQ ID NO: 727061 - DNA, 16 bp, Homo sapiens
gtccaaaggaggctgg

SEQ ID NO: 727062 - DNA, 22 bp, Homo sapiens
gtccaaatgtcctccagaagcc

SEQ ID NO: 727063 - DNA, 19 bp, Homo sapiens
gtccaaatgtgatcaactg

SEQ ID NO: 727064 - DNA, 15 bp, Homo sapiens
gtccaaccagaaaca

SEQ ID NO: 727065 - DNA, 22 bp, Homo sapiens
gtccaaccccggggcatggaca

SEQ ID NO: 727066 - DNA, 17 bp, Homo sapiens
gtccaacctaacccctt

SEQ ID NO: 727067 - DNA, 14 bp, Homo sapiens
gtccaagagacatg

SEQ ID NO: 727068 - DNA, 18 bp, Homo sapiens
gtccaaggccagtcccca

SEQ ID NO: 727069 - DNA, 21 bp, Homo sapiens
gtccaagggccatacttttga

SEQ ID NO: 727070 - DNA, 17 bp, Homo sapiens
gtccaaggtggcagatg

SEQ ID NO: 727071 - DNA, 23 bp, Homo sapiens
gtccaaggtggcagatgtcttcc

SEQ ID NO: 727072 - DNA, 16 bp, Homo sapiens
gtccaagtgtgtgtgc

SEQ ID NO: 727073 - DNA, 19 bp, Homo sapiens
gtccaagttcttcacctct

SEQ ID NO: 727074 - DNA, 17 bp, Homo sapiens
gtccaatcctatgtttt

SEQ ID NO: 727075 - DNA, 12 bp, Homo sapiens
gtccaatgtggc

SEQ ID NO: 727076 - DNA, 15 bp, Homo sapiens
gtccaatttaaggaa

SEQ ID NO: 727077 - DNA, 19 bp, Homo sapiens
gtccaatttgtaaaaacag

SEQ ID NO: 727078 - DNA, 14 bp, Homo sapiens
gtccaatttttact

SEQ ID NO: 727079 - DNA, 16 bp, Homo sapiens
gtccacaggggcaggc

SEQ ID NO: 727080 - DNA, 21 bp, Homo sapiens
gtccacaggggcaggcctggg

SEQ ID NO: 727081 - DNA, 16 bp, Homo sapiens
gtccacatccccagag

SEQ ID NO: 727082 - DNA, 23 bp, Homo sapiens
gtccacatccccagagcccagct

SEQ ID NO: 727083 - DNA, 14 bp, Homo sapiens
gtccacatctgcct

SEQ ID NO: 727084 - DNA, 15 bp, Homo sapiens
gtccacatctgcctc

SEQ ID NO: 727085 - DNA, 18 bp, Homo sapiens
gtccacatctgcctcctc

SEQ ID NO: 727086 - DNA, 17 bp, Homo sapiens
gtccacatgacctccat

SEQ ID NO: 727087 - DNA, 22 bp, Homo sapiens
gtccacatgacctccatttccc

SEQ ID NO: 727088 - DNA, 20 bp, Homo sapiens
gtccacattttacaggcaag

SEQ ID NO: 727089 - DNA, 13 bp, Homo sapiens
gtccaccaggcct

SEQ ID NO: 727090 - DNA, 21 bp, Homo sapiens
gtccaccaggcctcactggct

SEQ ID NO: 727091 - DNA, 16 bp, Homo sapiens
gtccaccagtgtgtgg

SEQ ID NO: 727092 - DNA, 20 bp, Homo sapiens
gtccaccagtgtgtggggga

SEQ ID NO: 727093 - DNA, 23 bp, Homo sapiens
gtccaccagtgtgtgggggagat

SEQ ID NO: 727094 - DNA, 15 bp, Homo sapiens
gtccaccagtttata

SEQ ID NO: 727095 - DNA, 17 bp, Homo sapiens
gtccaccagtttataca

SEQ ID NO: 727096 - DNA, 18 bp, Homo sapiens
gtccaccatccccagctg

SEQ ID NO: 727097 - DNA, 12 bp, Homo sapiens
gtccaccatgaa

SEQ ID NO: 727098 - DNA, 11 bp, Homo sapiens
gtccacccagc

SEQ ID NO: 727099 - DNA, 19 bp, Homo sapiens
gtccacccaggctgcactg

SEQ ID NO: 727100 - DNA, 14 bp, Homo sapiens
gtccaccctgccaa

SEQ ID NO: 727101 - DNA, 14 bp, Homo sapiens
gtccacccttccat

SEQ ID NO: 727102 - DNA, 16 bp, Homo sapiens
gtccaccggcccctgg

SEQ ID NO: 727103 - DNA, 21 bp, Homo sapiens
gtccacctggccccatgtctc

SEQ ID NO: 727104 - DNA, 13 bp, Homo sapiens
gtccacctgtgct

SEQ ID NO: 727105 - DNA, 16 bp, Homo sapiens
gtccacctgtgctgct

SEQ ID NO: 727106 - DNA, 17 bp, Homo sapiens
gtccacctgtgctgctg

SEQ ID NO: 727107 - DNA, 18 bp, Homo sapiens
gtccacctgtgctgctgc

SEQ ID NO: 727108 - DNA, 23 bp, Homo sapiens
gtccacctgtgggtgtagccagg

SEQ ID NO: 727109 - DNA, 18 bp, Homo sapiens
gtccacgactgtctccat

SEQ ID NO: 727110 - DNA, 15 bp, Homo sapiens
gtccactccctgctc

SEQ ID NO: 727111 - DNA, 17 bp, Homo sapiens
gtccactccctgctcca

SEQ ID NO: 727112 - DNA, 20 bp, Homo sapiens
gtccactgtcactgtttctc

SEQ ID NO: 727113 - DNA, 14 bp, Homo sapiens
gtccactgtgtata

SEQ ID NO: 727114 - DNA, 20 bp, Homo sapiens
gtccactgtgtttagttgca

SEQ ID NO: 727115 - DNA, 19 bp, Homo sapiens
gtccactgttgagccccag

SEQ ID NO: 727116 - DNA, 20 bp, Homo sapiens
gtccactgttgagccccagt

SEQ ID NO: 727117 - DNA, 19 bp, Homo sapiens
gtccagagaccacaccact

SEQ ID NO: 727118 - DNA, 12 bp, Homo sapiens
gtccagagccgg

SEQ ID NO: 727119 - DNA, 12 bp, Homo sapiens
gtccagagcttg

SEQ ID NO: 727120 - DNA, 13 bp, Homo sapiens
gtccagagcttgt

SEQ ID NO: 727121 - DNA, 15 bp, Homo sapiens
gtccagatttacact

SEQ ID NO: 727122 - DNA, 19 bp, Homo sapiens
gtccagatttacactggga

SEQ ID NO: 727123 - DNA, 21 bp, Homo sapiens
gtccagatttacactgggaga

SEQ ID NO: 727124 - DNA, 12 bp, Homo sapiens
gtccagcacagc

SEQ ID NO: 727125 - DNA, 13 bp, Homo sapiens
gtccagcagctgc

SEQ ID NO: 727126 - DNA, 12 bp, Homo sapiens
gtccagccaccc

SEQ ID NO: 727127 - DNA, 19 bp, Homo sapiens
gtccagcccatctcggagc

SEQ ID NO: 727128 - DNA, 10 bp, Homo sapiens
gtccagccct

SEQ ID NO: 727129 - DNA, 22 bp, Homo sapiens
gtccagccgccattgccaccag

SEQ ID NO: 727130 - DNA, 11 bp, Homo sapiens
gtccagcctgg

SEQ ID NO: 727131 - DNA, 21 bp, Homo sapiens
gtccagccttgatcagtgaca

SEQ ID NO: 727132 - DNA, 18 bp, Homo sapiens
gtccagctcagccctggc

SEQ ID NO: 727133 - DNA, 11 bp, Homo sapiens
gtccagctcta

SEQ ID NO: 727134 - DNA, 12 bp, Homo sapiens
gtccagctctga

SEQ ID NO: 727135 - DNA, 20 bp, Homo sapiens
gtccagctctgacatccctt

SEQ ID NO: 727136 - DNA, 22 bp, Homo sapiens
gtccagctgcccttccgcagtg

SEQ ID NO: 727137 - DNA, 13 bp, Homo sapiens
gtccagctggcct

SEQ ID NO: 727138 - DNA, 17 bp, Homo sapiens
gtccagctggcctggac

SEQ ID NO: 727139 - DNA, 19 bp, Homo sapiens
gtccagctggcctggacag

SEQ ID NO: 727140 - DNA, 14 bp, Homo sapiens
tggctgtgtctaaa

SEQ ID NO: 727141 - DNA, 17 bp, Homo sapiens
tggctgtgtctaaactg

SEQ ID NO: 727142 - DNA, 13 bp, Homo sapiens
tggctgtgtctct

SEQ ID NO: 727143 - DNA, 16 bp, Homo sapiens
tggctgtgtctctccc

SEQ ID NO: 727144 - DNA, 22 bp, Homo sapiens
tggctgtgttcgggggagcaga

SEQ ID NO: 727145 - DNA, 14 bp, Homo sapiens
tggctgttccagac

SEQ ID NO: 727146 - DNA, 19 bp, Homo sapiens
tggcttaaagtgaaggaaa

SEQ ID NO: 727147 - DNA, 20 bp, Homo sapiens
tggcttaaagtgaaggaaat

SEQ ID NO: 727148 - DNA, 17 bp, Homo sapiens
tggcttaagtgagcaga

SEQ ID NO: 727149 - DNA, 19 bp, Homo sapiens
tggcttaagtgagcagaac

SEQ ID NO: 727150 - DNA, 22 bp, Homo sapiens
tggcttaagtgagcagaacagg

SEQ ID NO: 727151 - DNA, 15 bp, Homo sapiens
tggcttaatcatttt

SEQ ID NO: 727152 - DNA, 15 bp, Homo sapiens
tggcttaatgtttat

SEQ ID NO: 727153 - DNA, 23 bp, Homo sapiens
tggcttagacaccacctggagtg

SEQ ID NO: 727154 - DNA, 16 bp, Homo sapiens
tggcttatttttctga

SEQ ID NO: 727155 - DNA, 17 bp, Homo sapiens
tggcttcaagttgtaaa

SEQ ID NO: 727156 - DNA, 18 bp, Homo sapiens
tggcttcaagttgtaaaa

SEQ ID NO: 727157 - DNA, 17 bp, Homo sapiens
tggcttcacggaagagc

SEQ ID NO: 727158 - DNA, 23 bp, Homo sapiens
tggcttcactctccctgacggct

SEQ ID NO: 727159 - DNA, 16 bp, Homo sapiens
tggcttcagcccccac

SEQ ID NO: 727160 - DNA, 17 bp, Homo sapiens
tggcttccagaaggcag

SEQ ID NO: 727161 - DNA, 17 bp, Homo sapiens
gtccaggccccaaaacc

SEQ ID NO: 727162 - DNA, 19 bp, Homo sapiens
gtccaggcccgtgggcgca

SEQ ID NO: 727163 - DNA, 17 bp, Homo sapiens
gtccaggccctgtggca

SEQ ID NO: 727164 - DNA, 21 bp, Homo sapiens
gtccaggcctctctctgctcc

SEQ ID NO: 727165 - DNA, 14 bp, Homo sapiens
gtccaggctctggg

SEQ ID NO: 727166 - DNA, 16 bp, Homo sapiens
gtccaggctctgggca

SEQ ID NO: 727167 - DNA, 22 bp, Homo sapiens
gtccaggctctgggcacagtgc

SEQ ID NO: 727168 - DNA, 16 bp, Homo sapiens
gtccaggctgccgtgg

SEQ ID NO: 727169 - DNA, 20 bp, Homo sapiens
gtccaggctgccgtggggcc

SEQ ID NO: 727170 - DNA, 15 bp, Homo sapiens
gtccagggccctgag

SEQ ID NO: 727171 - DNA, 17 bp, Homo sapiens
gtccagggccctgagct

SEQ ID NO: 727172 - DNA, 16 bp, Homo sapiens
gtccagggcctgacac

SEQ ID NO: 727173 - DNA, 18 bp, Homo sapiens
gtccagggctagtgactt

SEQ ID NO: 727174 - DNA, 22 bp, Homo sapiens
gtccaggggtctgtctgctttg

SEQ ID NO: 727175 - DNA, 16 bp, Homo sapiens
gtccagggtttctctg

SEQ ID NO: 727176 - DNA, 17 bp, Homo sapiens
gtccagggtttctctgc

SEQ ID NO: 727177 - DNA, 19 bp, Homo sapiens
gtccaggtgagaacatcca

SEQ ID NO: 727178 - DNA, 21 bp, Homo sapiens
gtccaggtgaggcccaagagc

SEQ ID NO: 727179 - DNA, 23 bp, Homo sapiens
gtccagtcatcctgccctgcagc

SEQ ID NO: 727180 - DNA, 14 bp, Homo sapiens
gtccagtgctctgc

SEQ ID NO: 727181 - DNA, 16 bp, Homo sapiens
gtccagtgctctgcct

SEQ ID NO: 727182 - DNA, 21 bp, Homo sapiens
gtccagtggaagttcttcaag

SEQ ID NO: 727183 - DNA, 17 bp, Homo sapiens
gtccatcagccaggaca

SEQ ID NO: 727184 - DNA, 18 bp, Homo sapiens
gtccatcccccttcttcc

SEQ ID NO: 727185 - DNA, 19 bp, Homo sapiens
gtccatccccttcccccat

SEQ ID NO: 727186 - DNA, 14 bp, Homo sapiens
gtccatctgtctgt

SEQ ID NO: 727187 - DNA, 17 bp, Homo sapiens
gtccatctgtctgtcct

SEQ ID NO: 727188 - DNA, 19 bp, Homo sapiens
gtccatgctaacaaagaca

SEQ ID NO: 727189 - DNA, 14 bp, Homo sapiens
gtccatggcaccag

SEQ ID NO: 727190 - DNA, 15 bp, Homo sapiens
gtccatggcaccagc

SEQ ID NO: 727191 - DNA, 18 bp, Homo sapiens
gtccatggcaccagcccc

SEQ ID NO: 727192 - DNA, 19 bp, Homo sapiens
gtccatggcaccagccccc

SEQ ID NO: 727193 - DNA, 16 bp, Homo sapiens
gtccatgggcagagcc

SEQ ID NO: 727194 - DNA, 23 bp, Homo sapiens
gtccatgggcagagcccaaggga

SEQ ID NO: 727195 - DNA, 19 bp, Homo sapiens
gtccatgtggttcttcaaa

SEQ ID NO: 727196 - DNA, 13 bp, Homo sapiens
gtccatgtgtgtg

SEQ ID NO: 727197 - DNA, 16 bp, Homo sapiens
gtccattcagaaagct

SEQ ID NO: 727198 - DNA, 18 bp, Homo sapiens
gtccattcagaaagcttc

SEQ ID NO: 727199 - DNA, 15 bp, Homo sapiens
gtccattctcccagg

SEQ ID NO: 727200 - DNA, 22 bp, Homo sapiens
gtccattcttcagtgtctctgt

SEQ ID NO: 727201 - DNA, 22 bp, Homo sapiens
gtccattgtaaatctgaagaaa

SEQ ID NO: 727202 - DNA, 16 bp, Homo sapiens
gtccattgtccaatcc

SEQ ID NO: 727203 - DNA, 13 bp, Homo sapiens
gtccatttcctaa

SEQ ID NO: 727204 - DNA, 19 bp, Homo sapiens
gtccattttgcaaacccaa

SEQ ID NO: 727205 - DNA, 20 bp, Homo sapiens
gtccattttgcaaacccaac

SEQ ID NO: 727206 - DNA, 16 bp, Homo sapiens
gtcccaaaatcccctc

SEQ ID NO: 727207 - DNA, 17 bp, Homo sapiens
gtcccaaaatcccctca

SEQ ID NO: 727208 - DNA, 21 bp, Homo sapiens
gtcccaaatatgtattttcct

SEQ ID NO: 727209 - DNA, 18 bp, Homo sapiens
gtcccaagcctgatactt

SEQ ID NO: 727210 - DNA, 16 bp, Homo sapiens
gtcccaaggaaagccc

SEQ ID NO: 727211 - DNA, 23 bp, Homo sapiens
gtcccaaggaaagccccagcact

SEQ ID NO: 727212 - DNA, 14 bp, Homo sapiens
gtcccaaggagctg

SEQ ID NO: 727213 - DNA, 15 bp, Homo sapiens
gtcccaaggagctga

SEQ ID NO: 727214 - DNA, 17 bp, Homo sapiens
gtcccaattcggggcct

SEQ ID NO: 727215 - DNA, 17 bp, Homo sapiens
gtcccacaaatgggcgc

SEQ ID NO: 727216 - DNA, 16 bp, Homo sapiens
gtcccaccaactctgc

SEQ ID NO: 727217 - DNA, 20 bp, Homo sapiens
gtcccaccaactctgcactc

SEQ ID NO: 727218 - DNA, 22 bp, Homo sapiens
gtcccaccaactctgcactcca

SEQ ID NO: 727219 - DNA, 23 bp, Homo sapiens
gtcccaccaactctgcactccat

SEQ ID NO: 727220 - DNA, 19 bp, Homo sapiens
gtcccacccacacagctgc

SEQ ID NO: 727221 - DNA, 12 bp, Homo sapiens
gtcccaccccca

SEQ ID NO: 727222 - DNA, 13 bp, Homo sapiens
gtcccacccccaa

SEQ ID NO: 727223 - DNA, 14 bp, Homo sapiens
gtcccacccccaac

SEQ ID NO: 727224 - DNA, 20 bp, Homo sapiens
gtcccacccccaacccccag

SEQ ID NO: 727225 - DNA, 23 bp, Homo sapiens
gtcccacccccaacccccagagg

SEQ ID NO: 727226 - DNA, 22 bp, Homo sapiens
gtcccacccccacccccagctc

SEQ ID NO: 727227 - DNA, 18 bp, Homo sapiens
gtcccaccgggagcctcc

SEQ ID NO: 727228 - DNA, 15 bp, Homo sapiens
gtcccacctccagcc

SEQ ID NO: 727229 - DNA, 16 bp, Homo sapiens
gtcccacctccagccc

SEQ ID NO: 727230 - DNA, 17 bp, Homo sapiens
gtcccacctccagcccg

SEQ ID NO: 727231 - DNA, 12 bp, Homo sapiens
gtcccacctctt

SEQ ID NO: 727232 - DNA, 16 bp, Homo sapiens
gtcccacctggctccc

SEQ ID NO: 727233 - DNA, 22 bp, Homo sapiens
gtcccacgaatttgctggggaa

SEQ ID NO: 727234 - DNA, 17 bp, Homo sapiens
gtcccacgtctggccag

SEQ ID NO: 727235 - DNA, 21 bp, Homo sapiens
gtcccagactaaaggatccag

SEQ ID NO: 727236 - DNA, 18 bp, Homo sapiens
gtcccagagcaggaggcc

SEQ ID NO: 727237 - DNA, 13 bp, Homo sapiens
gtcccagagccct

SEQ ID NO: 727238 - DNA, 22 bp, Homo sapiens
gtcccagagcttattggccact

SEQ ID NO: 727239 - DNA, 21 bp, Homo sapiens
gtcccagaggttatctgcctg

SEQ ID NO: 727240 - DNA, 24 bp, Homo sapiens
gtcccagaggttatctgcctggcc

SEQ ID NO: 727241 - DNA, 15 bp, Homo sapiens
gtcccagatgctgtc

SEQ ID NO: 727242 - DNA, 18 bp, Homo sapiens
gtcccagcatccctggag

SEQ ID NO: 727243 - DNA, 19 bp, Homo sapiens
gtcccagcatccctggagc

SEQ ID NO: 727244 - DNA, 22 bp, Homo sapiens
gtcccagcatccctggagcagg

SEQ ID NO: 727245 - DNA, 15 bp, Homo sapiens
gtcccagccaccccg

SEQ ID NO: 727246 - DNA, 18 bp, Homo sapiens
gtcccagccaccccgggc

SEQ ID NO: 727247 - DNA, 23 bp, Homo sapiens
gtcccagccaccccgggctctct

SEQ ID NO: 727248 - DNA, 19 bp, Homo sapiens
gtcccagccccaggcctgg

SEQ ID NO: 727249 - DNA, 20 bp, Homo sapiens
gtcccagccccaggcctggc

SEQ ID NO: 727250 - DNA, 20 bp, Homo sapiens
gtcccagcctggggctccct

SEQ ID NO: 727251 - DNA, 23 bp, Homo sapiens
gtcccagcctggggctccctctc

SEQ ID NO: 727252 - DNA, 17 bp, Homo sapiens
gtcccagcggcctcagg

SEQ ID NO: 727253 - DNA, 19 bp, Homo sapiens
gtcccagcggcctcagggt

SEQ ID NO: 727254 - DNA, 23 bp, Homo sapiens
gtcccagctacttgggagcctga

SEQ ID NO: 727255 - DNA, 11 bp, Homo sapiens
gtcccagctcc

SEQ ID NO: 727256 - DNA, 15 bp, Homo sapiens
gtcccagctccctgg

SEQ ID NO: 727257 - DNA, 18 bp, Homo sapiens
gtcccaggactcaccctc

SEQ ID NO: 727258 - DNA, 23 bp, Homo sapiens
gtcccaggactcaccctccacaa

SEQ ID NO: 727259 - DNA, 15 bp, Homo sapiens
gtcccaggctgagcc

SEQ ID NO: 727260 - DNA, 17 bp, Homo sapiens
gtcccaggctgagcctc

SEQ ID NO: 727261 - DNA, 20 bp, Homo sapiens
gtcccagggaaggtggggcc

SEQ ID NO: 727262 - DNA, 12 bp, Homo sapiens
gtcccagggccc

SEQ ID NO: 727263 - DNA, 15 bp, Homo sapiens
gtcccagggccctcc

SEQ ID NO: 727264 - DNA, 19 bp, Homo sapiens
gtcccagggccctcccagc

SEQ ID NO: 727265 - DNA, 21 bp, Homo sapiens
tgctgggcccccagcctggcc

SEQ ID NO: 727266 - DNA, 14 bp, Homo sapiens
tgctgggcggctgt

SEQ ID NO: 727267 - DNA, 16 bp, Homo sapiens
tgctgggcggctgtgc

SEQ ID NO: 727268 - DNA, 20 bp, Homo sapiens
tgctgggcgtgtgtgacact

SEQ ID NO: 727269 - DNA, 14 bp, Homo sapiens
tgctgggctctcca

SEQ ID NO: 727270 - DNA, 16 bp, Homo sapiens
tgctgggctctccacc

SEQ ID NO: 727271 - DNA, 22 bp, Homo sapiens
tgctgggctctccacctcagcc

SEQ ID NO: 727272 - DNA, 20 bp, Homo sapiens
tgctgggctgtctctccctt

SEQ ID NO: 727273 - DNA, 23 bp, Homo sapiens
tgctgggctgtctctcccttcca

SEQ ID NO: 727274 - DNA, 18 bp, Homo sapiens
tgctggggcaagtccctg

SEQ ID NO: 727275 - DNA, 18 bp, Homo sapiens
tgctggggcatgtgtgcc

SEQ ID NO: 727276 - DNA, 16 bp, Homo sapiens
tgctggggccagggca

SEQ ID NO: 727277 - DNA, 20 bp, Homo sapiens
tgctggggctcacggggcct

SEQ ID NO: 727278 - DNA, 23 bp, Homo sapiens
tgctgggggaatgagcccagaga

SEQ ID NO: 727279 - DNA, 22 bp, Homo sapiens
tgctgggggaggccatccaaga

SEQ ID NO: 727280 - DNA, 15 bp, Homo sapiens
tgctgggggcaactg

SEQ ID NO: 727281 - DNA, 20 bp, Homo sapiens
tgctgggggcaactggccat

SEQ ID NO: 727282 - DNA, 16 bp, Homo sapiens
tgctgggggcacagct

SEQ ID NO: 727283 - DNA, 17 bp, Homo sapiens
tgctgggggcacagctg

SEQ ID NO: 727284 - DNA, 16 bp, Homo sapiens
tgctggggtccagggc

SEQ ID NO: 727285 - DNA, 19 bp, Homo sapiens
tgctgggttggtgcacagt

SEQ ID NO: 727286 - DNA, 21 bp, Homo sapiens
tgctgggttggtgcacagtga

SEQ ID NO: 727287 - DNA, 14 bp, Homo sapiens
tgctggtagctgag

SEQ ID NO: 727288 - DNA, 23 bp, Homo sapiens
tgctggtagctgaggggacgggc

SEQ ID NO: 727289 - DNA, 15 bp, Homo sapiens
tgctggtcaggtccc

SEQ ID NO: 727290 - DNA, 14 bp, Homo sapiens
tgctggtgaacact

SEQ ID NO: 727291 - DNA, 13 bp, Homo sapiens
tgctggtggctgg

SEQ ID NO: 727292 - DNA, 20 bp, Homo sapiens
tgctggtggtttttcagctc

SEQ ID NO: 727293 - DNA, 14 bp, Homo sapiens
tgctggtgtcctga

SEQ ID NO: 727294 - DNA, 15 bp, Homo sapiens
tgctggtgtcctgac

SEQ ID NO: 727295 - DNA, 16 bp, Homo sapiens
tgctggtgtcctgacc

SEQ ID NO: 727296 - DNA, 17 bp, Homo sapiens
tgctggtgtcctgacca

SEQ ID NO: 727297 - DNA, 22 bp, Homo sapiens
tgctggtgtcctgaccaccctc

SEQ ID NO: 727298 - DNA, 14 bp, Homo sapiens
tgctgtaaaatttg

SEQ ID NO: 727299 - DNA, 22 bp, Homo sapiens
tgctgtaaaatttgtgtaaatt

SEQ ID NO: 727300 - DNA, 20 bp, Homo sapiens
tgctgtaaagagttgctttt

SEQ ID NO: 727301 - DNA, 22 bp, Homo sapiens
tgctgtaactcagacattccaa

SEQ ID NO: 727302 - DNA, 18 bp, Homo sapiens
tgctgtaactgctgagcc

SEQ ID NO: 727303 - DNA, 20 bp, Homo sapiens
tgctgtaactgctgagccac

SEQ ID NO: 727304 - DNA, 14 bp, Homo sapiens
tgctgtacaaaagc

SEQ ID NO: 727305 - DNA, 15 bp, Homo sapiens
tgctgtacccttcca

SEQ ID NO: 727306 - DNA, 19 bp, Homo sapiens
tgctgtacccttccacctc

SEQ ID NO: 727307 - DNA, 20 bp, Homo sapiens
tgctgtacgtactgcatttg

SEQ ID NO: 727308 - DNA, 16 bp, Homo sapiens
tgctgtagacatctgt

SEQ ID NO: 727309 - DNA, 22 bp, Homo sapiens
tgctgtatatggaattctttta

SEQ ID NO: 727310 - DNA, 18 bp, Homo sapiens
tgctgtatggcccaggca

SEQ ID NO: 727311 - DNA, 16 bp, Homo sapiens
tgctgtattgccccca

SEQ ID NO: 727312 - DNA, 17 bp, Homo sapiens
tgctgtattttaacact

SEQ ID NO: 727313 - DNA, 23 bp, Homo sapiens
tgctgtattttaacactttgtat

SEQ ID NO: 727314 - DNA, 24 bp, Homo sapiens
tgctgtcaataaatgacacccaga

SEQ ID NO: 727315 - DNA, 17 bp, Homo sapiens
tgctgtcactggcagag

SEQ ID NO: 727316 - DNA, 19 bp, Homo sapiens
tgctgtcactggcagagca

SEQ ID NO: 727317 - DNA, 13 bp, Homo sapiens
tgctgtccaggca

SEQ ID NO: 727318 - DNA, 16 bp, Homo sapiens
tgctgtccctccccct

SEQ ID NO: 727319 - DNA, 18 bp, Homo sapiens
tgctgtccctgcactgtg

SEQ ID NO: 727320 - DNA, 13 bp, Homo sapiens
tgctgtccctgtc

SEQ ID NO: 727321 - DNA, 14 bp, Homo sapiens
tgctgtccctgtca

SEQ ID NO: 727322 - DNA, 14 bp, Homo sapiens
tgctgtcctaggcc

SEQ ID NO: 727323 - DNA, 16 bp, Homo sapiens
tgctgtcctaggccac

SEQ ID NO: 727324 - DNA, 14 bp, Homo sapiens
tgctgtcctctccc

SEQ ID NO: 727325 - DNA, 15 bp, Homo sapiens
tgctgtcctctcccc

SEQ ID NO: 727326 - DNA, 22 bp, Homo sapiens
tgctgtcctctcccccttcagc

SEQ ID NO: 727327 - DNA, 16 bp, Homo sapiens
tgctgtcctgatctgt

SEQ ID NO: 727328 - DNA, 22 bp, Homo sapiens
tgctgtctccatgctggatact

SEQ ID NO: 727329 - DNA, 14 bp, Homo sapiens
tgctgtctctctgg

SEQ ID NO: 727330 - DNA, 14 bp, Homo sapiens
tgctgtctggccct

SEQ ID NO: 727331 - DNA, 16 bp, Homo sapiens
tgctgtctggccctgg

SEQ ID NO: 727332 - DNA, 13 bp, Homo sapiens
tgctgtcttaaac

SEQ ID NO: 727333 - DNA, 21 bp, Homo sapiens
tgctgtcttaaactaaatgtg

SEQ ID NO: 727334 - DNA, 14 bp, Homo sapiens
tgctgtcttgcccc

SEQ ID NO: 727335 - DNA, 15 bp, Homo sapiens
tgctgtctttctcta

SEQ ID NO: 727336 - DNA, 14 bp, Homo sapiens
tgctgtctttgtgg

SEQ ID NO: 727337 - DNA, 20 bp, Homo sapiens
tgctgtcttttgttctctga

SEQ ID NO: 727338 - DNA, 21 bp, Homo sapiens
tgctgtgaaccctggggcctg

SEQ ID NO: 727339 - DNA, 22 bp, Homo sapiens
tgctgtgacaataagtttgaac

SEQ ID NO: 727340 - DNA, 23 bp, Homo sapiens
tgctgtgaggaatgctctgtgcc

SEQ ID NO: 727341 - DNA, 16 bp, Homo sapiens
tgctgtgaggctgtcc

SEQ ID NO: 727342 - DNA, 17 bp, Homo sapiens
tgctgtgagtgcgcctc

SEQ ID NO: 727343 - DNA, 22 bp, Homo sapiens
tgctgtgatacgatgcttcaag

SEQ ID NO: 727344 - DNA, 22 bp, Homo sapiens
tgctgtgcattagatattaggg

SEQ ID NO: 727345 - DNA, 16 bp, Homo sapiens
tgctgtgcccagcctc

SEQ ID NO: 727346 - DNA, 15 bp, Homo sapiens
tgctgtgccccacca

SEQ ID NO: 727347 - DNA, 15 bp, Homo sapiens
tgctgtgcctcccaa

SEQ ID NO: 727348 - DNA, 16 bp, Homo sapiens
tgctgtgcgcccaggg

SEQ ID NO: 727349 - DNA, 18 bp, Homo sapiens
tgctgtgcgcccagggct

SEQ ID NO: 727350 - DNA, 22 bp, Homo sapiens
tgctgtggaactacattactgt

SEQ ID NO: 727351 - DNA, 12 bp, Homo sapiens
tgctgtggccag

SEQ ID NO: 727352 - DNA, 16 bp, Homo sapiens
tgctgtggccaggcct

SEQ ID NO: 727353 - DNA, 19 bp, Homo sapiens
tgctgtggccaggcctgca

SEQ ID NO: 727354 - DNA, 14 bp, Homo sapiens
tgctgtggccaggg

SEQ ID NO: 727355 - DNA, 17 bp, Homo sapiens
tgctgtggccccctgtc

SEQ ID NO: 727356 - DNA, 23 bp, Homo sapiens
tgctgtggccccctgtccccaag

SEQ ID NO: 727357 - DNA, 12 bp, Homo sapiens
tgctgtggcctg

SEQ ID NO: 727358 - DNA, 10 bp, Homo sapiens
tgctgtgggc

SEQ ID NO: 727359 - DNA, 17 bp, Homo sapiens
tgctgtggtgtgtcccc

SEQ ID NO: 727360 - DNA, 16 bp, Homo sapiens
tgctgtgtaacactgt

SEQ ID NO: 727361 - DNA, 17 bp, Homo sapiens
tgctgtgtccttcctcc

SEQ ID NO: 727362 - DNA, 11 bp, Homo sapiens
tgctgtgtgcc

SEQ ID NO: 727363 - DNA, 14 bp, Homo sapiens
tgctgtgtgcccaa

SEQ ID NO: 727364 - DNA, 15 bp, Homo sapiens
tgctgtgtgcttttt

SEQ ID NO: 727365 - DNA, 15 bp, Homo sapiens
tgctgttactgcttc

SEQ ID NO: 727366 - DNA, 18 bp, Homo sapiens
tgctgttcctgctccatg

SEQ ID NO: 727367 - DNA, 15 bp, Homo sapiens
tgctgttccttactt

SEQ ID NO: 727368 - DNA, 14 bp, Homo sapiens
tgctgttctcagga

SEQ ID NO: 727369 - DNA, 21 bp, Homo sapiens
tgctgttcttcacttctggga

SEQ ID NO: 727370 - DNA, 17 bp, Homo sapiens
tgctgttgatgttttgt

SEQ ID NO: 727371 - DNA, 17 bp, Homo sapiens
tgctgttgccatagccc

SEQ ID NO: 727372 - DNA, 14 bp, Homo sapiens
tgctgttgcctcat

SEQ ID NO: 727373 - DNA, 20 bp, Homo sapiens
tgctgttgggtttttgctgt

SEQ ID NO: 727374 - DNA, 17 bp, Homo sapiens
tgctgttggtcctctct

SEQ ID NO: 727375 - DNA, 20 bp, Homo sapiens
tgctgttggtcctctctctg

SEQ ID NO: 727376 - DNA, 14 bp, Homo sapiens
tgctgttgttctcg

SEQ ID NO: 727377 - DNA, 24 bp, Homo sapiens
tgctgtttaaagtcacatccctgt

SEQ ID NO: 727378 - DNA, 21 bp, Homo sapiens
tgctgtttagcttcctccaga

SEQ ID NO: 727379 - DNA, 15 bp, Homo sapiens
tgctgtttatacttg

SEQ ID NO: 727380 - DNA, 16 bp, Homo sapiens
tgctgtttatacttga

SEQ ID NO: 727381 - DNA, 14 bp, Homo sapiens
tgctgtttgaaaat

SEQ ID NO: 727382 - DNA, 17 bp, Homo sapiens
tgctgtttgacacctct

SEQ ID NO: 727383 - DNA, 21 bp, Homo sapiens
tgctgtttgtagtgaaataat

SEQ ID NO: 727384 - DNA, 23 bp, Homo sapiens
tgctgttttaaacattaatagca

SEQ ID NO: 727385 - DNA, 15 bp, Homo sapiens
tgctgttttcctccc

SEQ ID NO: 727386 - DNA, 22 bp, Homo sapiens
tgctgttttcctcccttctgct

SEQ ID NO: 727387 - DNA, 13 bp, Homo sapiens
tgctgttttctag

SEQ ID NO: 727388 - DNA, 12 bp, Homo sapiens
tgctgttttgtt

SEQ ID NO: 727389 - DNA, 18 bp, Homo sapiens
tgctgttttgttatataa

SEQ ID NO: 727390 - DNA, 16 bp, Homo sapiens
tgccgctacctccctc

SEQ ID NO: 727391 - DNA, 14 bp, Homo sapiens
tgccgctcctgctt

SEQ ID NO: 727392 - DNA, 18 bp, Homo sapiens
tgccgctgccgctgcacc

SEQ ID NO: 727393 - DNA, 13 bp, Homo sapiens
tgccgctgtcaag

SEQ ID NO: 727394 - DNA, 20 bp, Homo sapiens
tgccgctgtcaaggccgagg

SEQ ID NO: 727395 - DNA, 13 bp, Homo sapiens
tgccggaggcctt

SEQ ID NO: 727396 - DNA, 22 bp, Homo sapiens
tgccggaggccttggggtgggg

SEQ ID NO: 727397 - DNA, 16 bp, Homo sapiens
tgccggcaggatgcag

SEQ ID NO: 727398 - DNA, 16 bp, Homo sapiens
tgccggccggggctga

SEQ ID NO: 727399 - DNA, 17 bp, Homo sapiens
tgccggcggcagcccca

SEQ ID NO: 727400 - DNA, 17 bp, Homo sapiens
tgccggctgtggagcaa

SEQ ID NO: 727401 - DNA, 19 bp, Homo sapiens
tgccgggcgccaggacagc

SEQ ID NO: 727402 - DNA, 17 bp, Homo sapiens
tgccggggaggggcaga

SEQ ID NO: 727403 - DNA, 18 bp, Homo sapiens
tgccgggttttatatttt

SEQ ID NO: 727404 - DNA, 16 bp, Homo sapiens
tgccggtcgggcagcc

SEQ ID NO: 727405 - DNA, 18 bp, Homo sapiens
tgccggtcgggcagccag

SEQ ID NO: 727406 - DNA, 19 bp, Homo sapiens
tgccggtcgggcagccagc

SEQ ID NO: 727407 - DNA, 15 bp, Homo sapiens
tgccgtcaccaccac

SEQ ID NO: 727408 - DNA, 13 bp, Homo sapiens
tgccgtctctcct

SEQ ID NO: 727409 - DNA, 23 bp, Homo sapiens
tgccgtgggcctgtcgtgccagt

SEQ ID NO: 727410 - DNA, 23 bp, Homo sapiens
tgccgtggggccgccgcctcttt

SEQ ID NO: 727411 - DNA, 21 bp, Homo sapiens
tgccgtgtccaagggccgtgc

SEQ ID NO: 727412 - DNA, 23 bp, Homo sapiens
tgccgtgtgagtgtgacagggcc

SEQ ID NO: 727413 - DNA, 19 bp, Homo sapiens
tgcctaaatcccaagaaat

SEQ ID NO: 727414 - DNA, 21 bp, Homo sapiens
tgcctaaatcccaagaaatgg

SEQ ID NO: 727415 - DNA, 13 bp, Homo sapiens
tgcctaacagaaa

SEQ ID NO: 727416 - DNA, 20 bp, Homo sapiens
tgcctaagaagttattttct

SEQ ID NO: 727417 - DNA, 17 bp, Homo sapiens
tgcctaagtattccttt

SEQ ID NO: 727418 - DNA, 15 bp, Homo sapiens
tgcctaagtggctgc

SEQ ID NO: 727419 - DNA, 18 bp, Homo sapiens
tgcctaataaacatcctt

SEQ ID NO: 727420 - DNA, 16 bp, Homo sapiens
tgcctaatggagaaga

SEQ ID NO: 727421 - DNA, 23 bp, Homo sapiens
tgcctaattcctggcatgacact

SEQ ID NO: 727422 - DNA, 15 bp, Homo sapiens
tgcctaattttctat

SEQ ID NO: 727423 - DNA, 17 bp, Homo sapiens
tgcctacaataaaaaga

SEQ ID NO: 727424 - DNA, 19 bp, Homo sapiens
tgcctacaataaaaagaaa

SEQ ID NO: 727425 - DNA, 17 bp, Homo sapiens
tgcctacagaacttcag

SEQ ID NO: 727426 - DNA, 21 bp, Homo sapiens
tgcctacgtgacaacacaaat

SEQ ID NO: 727427 - DNA, 22 bp, Homo sapiens
tgcctactggggggctttggcc

SEQ ID NO: 727428 - DNA, 16 bp, Homo sapiens
tgcctactgttactct

SEQ ID NO: 727429 - DNA, 24 bp, Homo sapiens
tgcctactgttactctaaatagaa

SEQ ID NO: 727430 - DNA, 14 bp, Homo sapiens
tgcctacttttctt

SEQ ID NO: 727431 - DNA, 16 bp, Homo sapiens
tgcctagaaatatctt

SEQ ID NO: 727432 - DNA, 18 bp, Homo sapiens
tgcctagaaatatctttc

SEQ ID NO: 727433 - DNA, 22 bp, Homo sapiens
tgcctagaaatatctttctctt

SEQ ID NO: 727434 - DNA, 22 bp, Homo sapiens
tgcctagacttcccaacagcct

SEQ ID NO: 727435 - DNA, 13 bp, Homo sapiens
tgcctagagtgta

SEQ ID NO: 727436 - DNA, 22 bp, Homo sapiens
tgcctagagtgtagcctaaagg

SEQ ID NO: 727437 - DNA, 23 bp, Homo sapiens
tgcctagattaggtagactttgc

SEQ ID NO: 727438 - DNA, 23 bp, Homo sapiens
tgcctagcatggggtcagcccca

SEQ ID NO: 727439 - DNA, 23 bp, Homo sapiens
tgcctaggccaaatgcacaagct

SEQ ID NO: 727440 - DNA, 19 bp, Homo sapiens
tgcctaggttggtttcccc

SEQ ID NO: 727441 - DNA, 22 bp, Homo sapiens
tgcctaggttggtttcccctgc

SEQ ID NO: 727442 - DNA, 22 bp, Homo sapiens
tgcctagtcgggacttgtaaca

SEQ ID NO: 727443 - DNA, 14 bp, Homo sapiens
tgcctatctttaaa

SEQ ID NO: 727444 - DNA, 18 bp, Homo sapiens
tgcctatctttaaacatt

SEQ ID NO: 727445 - DNA, 21 bp, Homo sapiens
tgcctattatctgtcagctgc

SEQ ID NO: 727446 - DNA, 20 bp, Homo sapiens
tggaggcattgatgcatgct

SEQ ID NO: 727447 - DNA, 18 bp, Homo sapiens
tggaggccagagtctccc

SEQ ID NO: 727448 - DNA, 19 bp, Homo sapiens
tggaggccagagtctccca

SEQ ID NO: 727449 - DNA, 22 bp, Homo sapiens
tggaggccattgtgtgagccta

SEQ ID NO: 727450 - DNA, 14 bp, Homo sapiens
tggaggcccaggct

SEQ ID NO: 727451 - DNA, 18 bp, Homo sapiens
tggaggccccaaccctgt

SEQ ID NO: 727452 - DNA, 16 bp, Homo sapiens
tggaggcctctggccc

SEQ ID NO: 727453 - DNA, 19 bp, Homo sapiens
tggaggcctgatgctgccc

SEQ ID NO: 727454 - DNA, 20 bp, Homo sapiens
tggaggccttccagctgctg

SEQ ID NO: 727455 - DNA, 22 bp, Homo sapiens
tggaggctacctcacctgggca

SEQ ID NO: 727456 - DNA, 15 bp, Homo sapiens
tggaggctcagccca

SEQ ID NO: 727457 - DNA, 15 bp, Homo sapiens
tggaggcttcctgcg

SEQ ID NO: 727458 - DNA, 17 bp, Homo sapiens
tggaggcttttcactgc

SEQ ID NO: 727459 - DNA, 17 bp, Homo sapiens
tggagggaaccaccagc

SEQ ID NO: 727460 - DNA, 20 bp, Homo sapiens
tggagggaaccaccagcgtt

SEQ ID NO: 727461 - DNA, 22 bp, Homo sapiens
tggagggaaccaccagcgttcc

SEQ ID NO: 727462 - DNA, 16 bp, Homo sapiens
tggagggaagacaggt

SEQ ID NO: 727463 - DNA, 13 bp, Homo sapiens
tggagggagggaa

SEQ ID NO: 727464 - DNA, 16 bp, Homo sapiens
tggagggatgccccca

SEQ ID NO: 727465 - DNA, 21 bp, Homo sapiens
tggagggatgcccccaggcag

SEQ ID NO: 727466 - DNA, 13 bp, Homo sapiens
tggagggcacttc

SEQ ID NO: 727467 - DNA, 16 bp, Homo sapiens
tggagggcacttcagg

SEQ ID NO: 727468 - DNA, 13 bp, Homo sapiens
tggagggcttggc

SEQ ID NO: 727469 - DNA, 17 bp, Homo sapiens
tggaggggaaatgggga

SEQ ID NO: 727470 - DNA, 22 bp, Homo sapiens
tggaggggaaatggggaaagca

SEQ ID NO: 727471 - DNA, 18 bp, Homo sapiens
tggaggggcagagccagg

SEQ ID NO: 727472 - DNA, 23 bp, Homo sapiens
tggaggggcagagccaggaagat

SEQ ID NO: 727473 - DNA, 22 bp, Homo sapiens
tggaggggcagcctgtgcctgc

SEQ ID NO: 727474 - DNA, 16 bp, Homo sapiens
tggaggggctgtcctc

SEQ ID NO: 727475 - DNA, 21 bp, Homo sapiens
tggaggggctgtcctccttcc

SEQ ID NO: 727476 - DNA, 22 bp, Homo sapiens
tggaggggctgtcctccttcct

SEQ ID NO: 727477 - DNA, 19 bp, Homo sapiens
tggagggtaactggggggc

SEQ ID NO: 727478 - DNA, 18 bp, Homo sapiens
tggagggtctgggggcag

SEQ ID NO: 727479 - DNA, 20 bp, Homo sapiens
tggagggtgggagagcccag

SEQ ID NO: 727480 - DNA, 15 bp, Homo sapiens
tggaggtactgagac

SEQ ID NO: 727481 - DNA, 22 bp, Homo sapiens
tggaggtagttgggtagaaaaa

SEQ ID NO: 727482 - DNA, 20 bp, Homo sapiens
tggaggtcagcatttgatct

SEQ ID NO: 727483 - DNA, 14 bp, Homo sapiens
tggaggtgggcatg

SEQ ID NO: 727484 - DNA, 17 bp, Homo sapiens
tggaggtgggctgatgg

SEQ ID NO: 727485 - DNA, 23 bp, Homo sapiens
tggaggtgggctgatggcctggc

SEQ ID NO: 727486 - DNA, 15 bp, Homo sapiens
tggaggtggggttgg

SEQ ID NO: 727487 - DNA, 17 bp, Homo sapiens
tggaggtggggttggga

SEQ ID NO: 727488 - DNA, 14 bp, Homo sapiens
tggaggtgtgggag

SEQ ID NO: 727489 - DNA, 15 bp, Homo sapiens
tggaggttctcagag

SEQ ID NO: 727490 - DNA, 17 bp, Homo sapiens
tggaggttctcagagcc

SEQ ID NO: 727491 - DNA, 15 bp, Homo sapiens
tggaggttgaagcca

SEQ ID NO: 727492 - DNA, 22 bp, Homo sapiens
tggaggttgaagccaagtgggg

SEQ ID NO: 727493 - DNA, 20 bp, Homo sapiens
tggaggttgagtgagccggg

SEQ ID NO: 727494 - DNA, 13 bp, Homo sapiens
tggaggttgcagt

SEQ ID NO: 727495 - DNA, 17 bp, Homo sapiens
tggagtatagtgcaaat

SEQ ID NO: 727496 - DNA, 22 bp, Homo sapiens
tggagtcagtaggtccaagggc

SEQ ID NO: 727497 - DNA, 14 bp, Homo sapiens
tggagtccagctct

SEQ ID NO: 727498 - DNA, 13 bp, Homo sapiens
tggagtccagtgc

SEQ ID NO: 727499 - DNA, 15 bp, Homo sapiens
tggagtccagtgctt

SEQ ID NO: 727500 - DNA, 14 bp, Homo sapiens
tggagtcccacccg

SEQ ID NO: 727501 - DNA, 19 bp, Homo sapiens
tggagtcccctcacctcct

SEQ ID NO: 727502 - DNA, 21 bp, Homo sapiens
tggagtcccctcacctcctct

SEQ ID NO: 727503 - DNA, 16 bp, Homo sapiens
tggagtcggagtggac

SEQ ID NO: 727504 - DNA, 17 bp, Homo sapiens
tggagtctccagtggtt

SEQ ID NO: 727505 - DNA, 13 bp, Homo sapiens
tggagtctcctga

SEQ ID NO: 727506 - DNA, 14 bp, Homo sapiens
tggagtctcctgag

SEQ ID NO: 727507 - DNA, 16 bp, Homo sapiens
tggagtgagagccttt

SEQ ID NO: 727508 - DNA, 20 bp, Homo sapiens
tggagtgaggcttccaggct

SEQ ID NO: 727509 - DNA, 21 bp, Homo sapiens
tggagtgaggcttccaggctc

SEQ ID NO: 727510 - DNA, 19 bp, Homo sapiens
tggagtgagggcctcagag

SEQ ID NO: 727511 - DNA, 21 bp, Homo sapiens
tggagtgagggcctcagagcc

SEQ ID NO: 727512 - DNA, 16 bp, Homo sapiens
tggagtgccctgcagg

SEQ ID NO: 727513 - DNA, 20 bp, Homo sapiens
tggagtgccctgcaggcaca

SEQ ID NO: 727514 - DNA, 23 bp, Homo sapiens
tggagtgcgctcttggtccctgg

SEQ ID NO: 727515 - DNA, 17 bp, Homo sapiens
tggagtgctgcttgtgc

SEQ ID NO: 727516 - DNA, 16 bp, Homo sapiens
tggagtgctgttttgt

SEQ ID NO: 727517 - DNA, 16 bp, Homo sapiens
tggagtggagtgagag

SEQ ID NO: 727518 - DNA, 13 bp, Homo sapiens
tggagtggccact

SEQ ID NO: 727519 - DNA, 13 bp, Homo sapiens
tggagtgtaaacc

SEQ ID NO: 727520 - DNA, 14 bp, Homo sapiens
tggagtgtatgact

SEQ ID NO: 727521 - DNA, 21 bp, Homo sapiens
tggagtgtgcagacagccatg

SEQ ID NO: 727522 - DNA, 19 bp, Homo sapiens
tggagtgtgtattgttccc

SEQ ID NO: 727523 - DNA, 20 bp, Homo sapiens
tggagtgtgtattgttccca

SEQ ID NO: 727524 - DNA, 17 bp, Homo sapiens
tggagttccggcctggg

SEQ ID NO: 727525 - DNA, 19 bp, Homo sapiens
tggagttccggcctgggca

SEQ ID NO: 727526 - DNA, 15 bp, Homo sapiens
tggagttcctgctcc

SEQ ID NO: 727527 - DNA, 16 bp, Homo sapiens
tggagttcctgctccg

SEQ ID NO: 727528 - DNA, 22 bp, Homo sapiens
tggagttgaaagagttaagaat

SEQ ID NO: 727529 - DNA, 14 bp, Homo sapiens
tggagttggggctg

SEQ ID NO: 727530 - DNA, 14 bp, Homo sapiens
tggagtttctctgt

SEQ ID NO: 727531 - DNA, 14 bp, Homo sapiens
tggagtttgtattt

SEQ ID NO: 727532 - DNA, 17 bp, Homo sapiens
tggagttttaactgtaa

SEQ ID NO: 727533 - DNA, 16 bp, Homo sapiens
tggagttttgtttcct

SEQ ID NO: 727534 - DNA, 22 bp, Homo sapiens
tggataaaccaccctctgggga

SEQ ID NO: 727535 - DNA, 23 bp, Homo sapiens
tggataaaccaccctctggggac

SEQ ID NO: 727536 - DNA, 15 bp, Homo sapiens
tggataaactgagcc

SEQ ID NO: 727537 - DNA, 14 bp, Homo sapiens
tggataaatcattt

SEQ ID NO: 727538 - DNA, 18 bp, Homo sapiens
tggataaatcatttcagt

SEQ ID NO: 727539 - DNA, 13 bp, Homo sapiens
tggataagtttct

SEQ ID NO: 727540 - DNA, 23 bp, Homo sapiens
tggataataaagatactagagaa

SEQ ID NO: 727541 - DNA, 15 bp, Homo sapiens
tggataataggaatt

SEQ ID NO: 727542 - DNA, 19 bp, Homo sapiens
tggatctccccactctagg

SEQ ID NO: 727543 - DNA, 17 bp, Homo sapiens
tggatctctggttgtct

SEQ ID NO: 727544 - DNA, 14 bp, Homo sapiens
tggatctcttaaga

SEQ ID NO: 727545 - DNA, 17 bp, Homo sapiens
tggatctgaccctccca

SEQ ID NO: 727546 - DNA, 19 bp, Homo sapiens
tggatctgaccctcccagt

SEQ ID NO: 727547 - DNA, 16 bp, Homo sapiens
tggatctgcttctcca

SEQ ID NO: 727548 - DNA, 19 bp, Homo sapiens
tggatctgggaccctttcc

SEQ ID NO: 727549 - DNA, 16 bp, Homo sapiens
tggatctgtccaagga

SEQ ID NO: 727550 - DNA, 18 bp, Homo sapiens
tggatcttcaatggcttt

SEQ ID NO: 727551 - DNA, 16 bp, Homo sapiens
tggatcttctatcatt

SEQ ID NO: 727552 - DNA, 21 bp, Homo sapiens
tggatcttctatcattccaat

SEQ ID NO: 727553 - DNA, 15 bp, Homo sapiens
tggatcttgaatgtg

SEQ ID NO: 727554 - DNA, 16 bp, Homo sapiens
tggatcttgaatgtgg

SEQ ID NO: 727555 - DNA, 19 bp, Homo sapiens
tggatcttgaatgtggtct

SEQ ID NO: 727556 - DNA, 21 bp, Homo sapiens
tggatcttttactttaaagta

SEQ ID NO: 727557 - DNA, 22 bp, Homo sapiens
tggatgaagattctcctgtgct

SEQ ID NO: 727558 - DNA, 23 bp, Homo sapiens
tggatgaagattctcctgtgcta

SEQ ID NO: 727559 - DNA, 16 bp, Homo sapiens
tggatgacagggcaga

SEQ ID NO: 727560 - DNA, 20 bp, Homo sapiens
tggatgacagggcagagcag

SEQ ID NO: 727561 - DNA, 16 bp, Homo sapiens
tggatgatactaataa

SEQ ID NO: 727562 - DNA, 16 bp, Homo sapiens
tggatgatatacacag

SEQ ID NO: 727563 - DNA, 16 bp, Homo sapiens
tggatgatgctgtgct

SEQ ID NO: 727564 - DNA, 14 bp, Homo sapiens
tggatgatgtttcg

SEQ ID NO: 727565 - DNA, 15 bp, Homo sapiens
tggatgatttcatct

SEQ ID NO: 727566 - DNA, 17 bp, Homo sapiens
tggatgatttcatcttc

SEQ ID NO: 727567 - DNA, 21 bp, Homo sapiens
tggatgatttcatcttctgga

SEQ ID NO: 727568 - DNA, 20 bp, Homo sapiens
tggatgccaatattaaatct

SEQ ID NO: 727569 - DNA, 21 bp, Homo sapiens
tggatgccaatattaaatctg

SEQ ID NO: 727570 - DNA, 20 bp, Homo sapiens
tggatgccacagcccagctt

SEQ ID NO: 727571 - DNA, 13 bp, Homo sapiens
tggatgcccagga

SEQ ID NO: 727572 - DNA, 20 bp, Homo sapiens
tggatgcctcattatgtcaa

SEQ ID NO: 727573 - DNA, 14 bp, Homo sapiens
tggatgccttcccc

SEQ ID NO: 727574 - DNA, 16 bp, Homo sapiens
tggatgctagtgctgt

SEQ ID NO: 727575 - DNA, 17 bp, Homo sapiens
tggatgctgagctgtga

SEQ ID NO: 727576 - DNA, 14 bp, Homo sapiens
tggatggaaatgta

SEQ ID NO: 727577 - DNA, 16 bp, Homo sapiens
tggatggaacatgccc

SEQ ID NO: 727578 - DNA, 22 bp, Homo sapiens
tggatggaacgggcatgggcct

SEQ ID NO: 727579 - DNA, 15 bp, Homo sapiens
tggatggacagacac

SEQ ID NO: 727580 - DNA, 18 bp, Homo sapiens
tggatggacagacacctc

SEQ ID NO: 727581 - DNA, 23 bp, Homo sapiens
tggatggacttggcttcagactc

SEQ ID NO: 727582 - DNA, 13 bp, Homo sapiens
tggatggcacaat

SEQ ID NO: 727583 - DNA, 19 bp, Homo sapiens
tggatggcacaatgaatgt

SEQ ID NO: 727584 - DNA, 20 bp, Homo sapiens
tggatggcacctcaggctga

SEQ ID NO: 727585 - DNA, 15 bp, Homo sapiens
tggatggcagactct

SEQ ID NO: 727586 - DNA, 18 bp, Homo sapiens
tggatggccccagcacag

SEQ ID NO: 727587 - DNA, 20 bp, Homo sapiens
tggatggcccctccttgcaa

SEQ ID NO: 727588 - DNA, 15 bp, Homo sapiens
tggatgggaatttgt

SEQ ID NO: 727589 - DNA, 18 bp, Homo sapiens
tggatgggaggagagcca

SEQ ID NO: 727590 - DNA, 21 bp, Homo sapiens
tggatgggaggagagccactg

SEQ ID NO: 727591 - DNA, 14 bp, Homo sapiens
tggatgggagtggg

SEQ ID NO: 727592 - DNA, 20 bp, Homo sapiens
tggatgggagtgggcacctc

SEQ ID NO: 727593 - DNA, 22 bp, Homo sapiens
tggatgggcattgggctgacac

SEQ ID NO: 727594 - DNA, 18 bp, Homo sapiens
tggatgtagtctgaggcc

SEQ ID NO: 727595 - DNA, 15 bp, Homo sapiens
tggatgtcttccttg

SEQ ID NO: 727596 - DNA, 24 bp, Homo sapiens
tggatgtgaagctcacactgatgg

SEQ ID NO: 727597 - DNA, 14 bp, Homo sapiens
tggatgtgtgtgtg

SEQ ID NO: 727598 - DNA, 16 bp, Homo sapiens
tggatgttatgaacag

SEQ ID NO: 727599 - DNA, 17 bp, Homo sapiens
tggatgttatgaacagc

SEQ ID NO: 727600 - DNA, 15 bp, Homo sapiens
tggatgttgtgtgta

SEQ ID NO: 727601 - DNA, 14 bp, Homo sapiens
tggattaaactcag

SEQ ID NO: 727602 - DNA, 15 bp, Homo sapiens
tggattaaatacata

SEQ ID NO: 727603 - DNA, 21 bp, Homo sapiens
tggattaaattagtttgtgaa

SEQ ID NO: 727604 - DNA, 18 bp, Homo sapiens
tggattaaattctgggtg

SEQ ID NO: 727605 - DNA, 20 bp, Homo sapiens
tggattactgccattcactt

SEQ ID NO: 727606 - DNA, 20 bp, Homo sapiens
tggattacttctctataaaa

SEQ ID NO: 727607 - DNA, 21 bp, Homo sapiens
tggattataaaaaatgtaaca

SEQ ID NO: 727608 - DNA, 22 bp, Homo sapiens
tggattataaaaaatgtaacat

SEQ ID NO: 727609 - DNA, 17 bp, Homo sapiens
tggattataatcagaat

SEQ ID NO: 727610 - DNA, 14 bp, Homo sapiens
tggattattcattt

SEQ ID NO: 727611 - DNA, 17 bp, Homo sapiens
tggattattcatttaaa

SEQ ID NO: 727612 - DNA, 18 bp, Homo sapiens
tggattattcatttaaaa

SEQ ID NO: 727613 - DNA, 23 bp, Homo sapiens
tggattcattctcataattccta

SEQ ID NO: 727614 - DNA, 14 bp, Homo sapiens
tggattcattgtct

SEQ ID NO: 727615 - DNA, 17 bp, Homo sapiens
tggattcatttcctgcc

SEQ ID NO: 727616 - DNA, 18 bp, Homo sapiens
tggattcatttcctgccc

SEQ ID NO: 727617 - DNA, 19 bp, Homo sapiens
tggattcatttcctgccct

SEQ ID NO: 727618 - DNA, 13 bp, Homo sapiens
tggattccctttt

SEQ ID NO: 727619 - DNA, 15 bp, Homo sapiens
tggattcccttttga

SEQ ID NO: 727620 - DNA, 23 bp, Homo sapiens
tggattcccttttgactcttccg

SEQ ID NO: 727621 - DNA, 15 bp, Homo sapiens
tggattctaaaatgc

SEQ ID NO: 727622 - DNA, 12 bp, Homo sapiens
tggattctcaga

SEQ ID NO: 727623 - DNA, 14 bp, Homo sapiens
tggattctcagata

SEQ ID NO: 727624 - DNA, 17 bp, Homo sapiens
tggattcttatgtagca

SEQ ID NO: 727625 - DNA, 14 bp, Homo sapiens
tggattctttccat

SEQ ID NO: 727626 - DNA, 13 bp, Homo sapiens
tggattgagggta

SEQ ID NO: 727627 - DNA, 16 bp, Homo sapiens
tggattgccacagctc

SEQ ID NO: 727628 - DNA, 18 bp, Homo sapiens
tggattgcgcctttgtat

SEQ ID NO: 727629 - DNA, 20 bp, Homo sapiens
tggattgcgcctttgtatta

SEQ ID NO: 727630 - DNA, 14 bp, Homo sapiens
tggattggggtccc

SEQ ID NO: 727631 - DNA, 22 bp, Homo sapiens
tggatttatagtatgtgacttt

SEQ ID NO: 727632 - DNA, 14 bp, Homo sapiens
tggatttcagaaag

SEQ ID NO: 727633 - DNA, 13 bp, Homo sapiens
tggatttgaagca

SEQ ID NO: 727634 - DNA, 13 bp, Homo sapiens
tggcaaggacttt

SEQ ID NO: 727635 - DNA, 20 bp, Homo sapiens
tggcaaggactttgtacatt

SEQ ID NO: 727636 - DNA, 20 bp, Homo sapiens
tggcaaggcagccctgtctg

SEQ ID NO: 727637 - DNA, 15 bp, Homo sapiens
tggcaagtcacatgc

SEQ ID NO: 727638 - DNA, 16 bp, Homo sapiens
tggcaagtcacatgcg

SEQ ID NO: 727639 - DNA, 20 bp, Homo sapiens
tggcaagtcggggcctggga

SEQ ID NO: 727640 - DNA, 16 bp, Homo sapiens
tggcaatagtgtgttc

SEQ ID NO: 727641 - DNA, 18 bp, Homo sapiens
tggcaatagtgtgttctg

SEQ ID NO: 727642 - DNA, 19 bp, Homo sapiens
tggcaatctcagatgcagt

SEQ ID NO: 727643 - DNA, 16 bp, Homo sapiens
tggcaatgcttaaact

SEQ ID NO: 727644 - DNA, 20 bp, Homo sapiens
tggcaatgggatttgggcta

SEQ ID NO: 727645 - DNA, 14 bp, Homo sapiens
tggcaattaaaaat

SEQ ID NO: 727646 - DNA, 16 bp, Homo sapiens
tggcaattctggaagc

SEQ ID NO: 727647 - DNA, 19 bp, Homo sapiens
tggcaattctggaagctga

SEQ ID NO: 727648 - DNA, 13 bp, Homo sapiens
tggcaattgtcta

SEQ ID NO: 727649 - DNA, 18 bp, Homo sapiens
tggcaattgtctatttat

SEQ ID NO: 727650 - DNA, 17 bp, Homo sapiens
tggcaatttctttagat

SEQ ID NO: 727651 - DNA, 18 bp, Homo sapiens
tggcaattttatgttttt

SEQ ID NO: 727652 - DNA, 22 bp, Homo sapiens
tggcacagaaacctctactaaa

SEQ ID NO: 727653 - DNA, 21 bp, Homo sapiens
tggcacagacttctggaaggc

SEQ ID NO: 727654 - DNA, 13 bp, Homo sapiens
tggcacagctggg

SEQ ID NO: 727655 - DNA, 20 bp, Homo sapiens
tggcacagctgggagcctgg

SEQ ID NO: 727656 - DNA, 14 bp, Homo sapiens
tggcacaggacatg

SEQ ID NO: 727657 - DNA, 14 bp, Homo sapiens
tggcacaggcactg

SEQ ID NO: 727658 - DNA, 15 bp, Homo sapiens
tggcacagggcagtg

SEQ ID NO: 727659 - DNA, 18 bp, Homo sapiens
tggcacagggcagtggga

SEQ ID NO: 727660 - DNA, 18 bp, Homo sapiens
tggcacagtgatgccggg

SEQ ID NO: 727661 - DNA, 15 bp, Homo sapiens
tggcacatcagaaag

SEQ ID NO: 727662 - DNA, 20 bp, Homo sapiens
tggcacatcagcacgatttc

SEQ ID NO: 727663 - DNA, 13 bp, Homo sapiens
tggcaccactctc

SEQ ID NO: 727664 - DNA, 18 bp, Homo sapiens
tggcaccactgcactcca

SEQ ID NO: 727665 - DNA, 21 bp, Homo sapiens
tggcaccactgcactccagcc

SEQ ID NO: 727666 - DNA, 14 bp, Homo sapiens
tggcaccagaggct

SEQ ID NO: 727667 - DNA, 12 bp, Homo sapiens
tggcaccagccc

SEQ ID NO: 727668 - DNA, 15 bp, Homo sapiens
tggcaccagccccct

SEQ ID NO: 727669 - DNA, 16 bp, Homo sapiens
tggcaccagccccctg

SEQ ID NO: 727670 - DNA, 18 bp, Homo sapiens
tggcaccagccccctgga

SEQ ID NO: 727671 - DNA, 22 bp, Homo sapiens
tggcaccatggtgactgccaca

SEQ ID NO: 727672 - DNA, 20 bp, Homo sapiens
tggcacccaccgtggaggag

SEQ ID NO: 727673 - DNA, 22 bp, Homo sapiens
tggcacccaccgtggaggagga

SEQ ID NO: 727674 - DNA, 14 bp, Homo sapiens
tggcacccccatgc

SEQ ID NO: 727675 - DNA, 15 bp, Homo sapiens
tggcacccccatgct

SEQ ID NO: 727676 - DNA, 18 bp, Homo sapiens
tggcacccccatgctgcc

SEQ ID NO: 727677 - DNA, 15 bp, Homo sapiens
tggcaccgccttctc

SEQ ID NO: 727678 - DNA, 22 bp, Homo sapiens
tggcacctcaggctgagggccc

SEQ ID NO: 727679 - DNA, 14 bp, Homo sapiens
tggcacctcctgag

SEQ ID NO: 727680 - DNA, 17 bp, Homo sapiens
tggcacctcctgagaag

SEQ ID NO: 727681 - DNA, 18 bp, Homo sapiens
tggcacctcctgagaagg

SEQ ID NO: 727682 - DNA, 15 bp, Homo sapiens
tggcacctctgccct

SEQ ID NO: 727683 - DNA, 16 bp, Homo sapiens
tggcacctctgccctt

SEQ ID NO: 727684 - DNA, 19 bp, Homo sapiens
tggcacctgaaattaattt

SEQ ID NO: 727685 - DNA, 13 bp, Homo sapiens
tggcaccttcccc

SEQ ID NO: 727686 - DNA, 22 bp, Homo sapiens
tggcacgcacctgtagtcccag

SEQ ID NO: 727687 - DNA, 20 bp, Homo sapiens
tggcacggagagaaggccca

SEQ ID NO: 727688 - DNA, 13 bp, Homo sapiens
tggcacgggccct

SEQ ID NO: 727689 - DNA, 14 bp, Homo sapiens
tggcacgggccctc

SEQ ID NO: 727690 - DNA, 17 bp, Homo sapiens
tggcacgggccctccct

SEQ ID NO: 727691 - DNA, 21 bp, Homo sapiens
tggcacgggccctccctccca

SEQ ID NO: 727692 - DNA, 19 bp, Homo sapiens
tggcacggtggctcaggcc

SEQ ID NO: 727693 - DNA, 15 bp, Homo sapiens
tggcacgtattgctg

SEQ ID NO: 727694 - DNA, 15 bp, Homo sapiens
tggcacgtgacaggc

SEQ ID NO: 727695 - DNA, 21 bp, Homo sapiens
tggcactaaaccacttctctg

SEQ ID NO: 727696 - DNA, 23 bp, Homo sapiens
tggcactaaaccacttctctgct

SEQ ID NO: 727697 - DNA, 22 bp, Homo sapiens
tggcactaacgttgagcccctg

SEQ ID NO: 727698 - DNA, 21 bp, Homo sapiens
tggcactataatgtaagctct

SEQ ID NO: 727699 - DNA, 17 bp, Homo sapiens
tggcactcacagacctg

SEQ ID NO: 727700 - DNA, 22 bp, Homo sapiens
tggcactcacagacctggagcc

SEQ ID NO: 727701 - DNA, 17 bp, Homo sapiens
tggcactctgttgtatt

SEQ ID NO: 727702 - DNA, 14 bp, Homo sapiens
tggcactgaagtgg

SEQ ID NO: 727703 - DNA, 18 bp, Homo sapiens
tggcactgaagtggccct

SEQ ID NO: 727704 - DNA, 15 bp, Homo sapiens
tggcactgagccccc

SEQ ID NO: 727705 - DNA, 17 bp, Homo sapiens
tggcactgagccccccc

SEQ ID NO: 727706 - DNA, 19 bp, Homo sapiens
tggcactgcatacaatctg

SEQ ID NO: 727707 - DNA, 13 bp, Homo sapiens
tggcactggatgc

SEQ ID NO: 727708 - DNA, 20 bp, Homo sapiens
tggcactggcattgtccctg

SEQ ID NO: 727709 - DNA, 13 bp, Homo sapiens
tggcactggccac

SEQ ID NO: 727710 - DNA, 17 bp, Homo sapiens
tggcactggggcacttg

SEQ ID NO: 727711 - DNA, 20 bp, Homo sapiens
tggcactggggcacttggca

SEQ ID NO: 727712 - DNA, 21 bp, Homo sapiens
tggcactggtaggttgggaca

SEQ ID NO: 727713 - DNA, 17 bp, Homo sapiens
tggcactgttaatacac

SEQ ID NO: 727714 - DNA, 20 bp, Homo sapiens
tggcacttagcccaagaggt

SEQ ID NO: 727715 - DNA, 11 bp, Homo sapiens
tggcacttgta

SEQ ID NO: 727716 - DNA, 13 bp, Homo sapiens
tggcagaaaagag

SEQ ID NO: 727717 - DNA, 17 bp, Homo sapiens
tggcagaaaagaggaga

SEQ ID NO: 727718 - DNA, 14 bp, Homo sapiens
tggcagaactgagc

SEQ ID NO: 727719 - DNA, 16 bp, Homo sapiens
tggcagaactgagctc

SEQ ID NO: 727720 - DNA, 20 bp, Homo sapiens
tggcagaactgagctcctct

SEQ ID NO: 727721 - DNA, 19 bp, Homo sapiens
tggcagaagggaattgctc

SEQ ID NO: 727722 - DNA, 23 bp, Homo sapiens
tggcagcccggctgctgcttgga

SEQ ID NO: 727723 - DNA, 11 bp, Homo sapiens
tggcagccctg

SEQ ID NO: 727724 - DNA, 12 bp, Homo sapiens
tggcagccctgt

SEQ ID NO: 727725 - DNA, 14 bp, Homo sapiens
tggcagccctgtag

SEQ ID NO: 727726 - DNA, 17 bp, Homo sapiens
tggcagccgtgccttca

SEQ ID NO: 727727 - DNA, 19 bp, Homo sapiens
tggcagccgtgccttcagc

SEQ ID NO: 727728 - DNA, 20 bp, Homo sapiens
tggcagccgtgccttcagct

SEQ ID NO: 727729 - DNA, 21 bp, Homo sapiens
tggcagccgtgccttcagctc

SEQ ID NO: 727730 - DNA, 23 bp, Homo sapiens
tggcagccgtgccttcagctcta

SEQ ID NO: 727731 - DNA, 22 bp, Homo sapiens
tggcagcctcccatccagggcc

SEQ ID NO: 727732 - DNA, 15 bp, Homo sapiens
tggcagctagactgg

SEQ ID NO: 727733 - DNA, 22 bp, Homo sapiens
tggcagctagactggagtgagg

SEQ ID NO: 727734 - DNA, 13 bp, Homo sapiens
tggcagctctagc

SEQ ID NO: 727735 - DNA, 12 bp, Homo sapiens
tggcagctctcc

SEQ ID NO: 727736 - DNA, 12 bp, Homo sapiens
tggcagctgccc

SEQ ID NO: 727737 - DNA, 18 bp, Homo sapiens
tggcagctgcccctcctg

SEQ ID NO: 727738 - DNA, 23 bp, Homo sapiens
tggcagctgcccctcctggagca

SEQ ID NO: 727739 - DNA, 11 bp, Homo sapiens
tggcagctgct

SEQ ID NO: 727740 - DNA, 14 bp, Homo sapiens
tggcagctgtttct

SEQ ID NO: 727741 - DNA, 17 bp, Homo sapiens
tggcagctgtttctcat

SEQ ID NO: 727742 - DNA, 21 bp, Homo sapiens
tggcagctgtttctcatgaag

SEQ ID NO: 727743 - DNA, 17 bp, Homo sapiens
tggcagcttaacattga

SEQ ID NO: 727744 - DNA, 13 bp, Homo sapiens
tggcagctttttc

SEQ ID NO: 727745 - DNA, 18 bp, Homo sapiens
tggcagctttttctgtgg

SEQ ID NO: 727746 - DNA, 20 bp, Homo sapiens
tggcaggacaaattgcgccc

SEQ ID NO: 727747 - DNA, 12 bp, Homo sapiens
tggcaggacaca

SEQ ID NO: 727748 - DNA, 11 bp, Homo sapiens
tggcaggacca

SEQ ID NO: 727749 - DNA, 14 bp, Homo sapiens
tggcaggaccagga

SEQ ID NO: 727750 - DNA, 17 bp, Homo sapiens
tggcaggaccaggacta

SEQ ID NO: 727751 - DNA, 14 bp, Homo sapiens
tggcaggacctgcc

SEQ ID NO: 727752 - DNA, 16 bp, Homo sapiens
tggcaggacctgccta

SEQ ID NO: 727753 - DNA, 17 bp, Homo sapiens
tggcaggacctgcctag

SEQ ID NO: 727754 - DNA, 19 bp, Homo sapiens
tggcaggacctgcctagca

SEQ ID NO: 727755 - DNA, 14 bp, Homo sapiens
tggcaggactcctg

SEQ ID NO: 727756 - DNA, 15 bp, Homo sapiens
tggcaggactcctgg

SEQ ID NO: 727757 - DNA, 19 bp, Homo sapiens
tggcaggactcctggcagg

SEQ ID NO: 727758 - DNA, 14 bp, Homo sapiens
tggcaggagaatca

SEQ ID NO: 727759 - DNA, 17 bp, Homo sapiens
tggcaggaggagctgcc

SEQ ID NO: 727760 - DNA, 12 bp, Homo sapiens
tggcaggaggct

SEQ ID NO: 727761 - DNA, 21 bp, Homo sapiens
tggcaggcacacagcagcccc

SEQ ID NO: 727762 - DNA, 19 bp, Homo sapiens
tggcaggcccactccccag

SEQ ID NO: 727763 - DNA, 15 bp, Homo sapiens
tggcaggcctgaccc

SEQ ID NO: 727764 - DNA, 16 bp, Homo sapiens
tggcaggcctgaccca

SEQ ID NO: 727765 - DNA, 15 bp, Homo sapiens
tggcaggctggccag

SEQ ID NO: 727766 - DNA, 16 bp, Homo sapiens
tggcaggcttccccct

SEQ ID NO: 727767 - DNA, 20 bp, Homo sapiens
tggcagggccacctgcagga

SEQ ID NO: 727768 - DNA, 13 bp, Homo sapiens
tggcagggccagg

SEQ ID NO: 727769 - DNA, 22 bp, Homo sapiens
tggcagggccagggcaatgcca

SEQ ID NO: 727770 - DNA, 21 bp, Homo sapiens
tggcagggcctcatctcacct

SEQ ID NO: 727771 - DNA, 22 bp, Homo sapiens
tggcagggcctcatctcacctc

SEQ ID NO: 727772 - DNA, 19 bp, Homo sapiens
tggcagggctcacactcct

SEQ ID NO: 727773 - DNA, 21 bp, Homo sapiens
tggcaggtcactgtcactgcc

SEQ ID NO: 727774 - DNA, 22 bp, Homo sapiens
tggcaggtcactgtcactgccg

SEQ ID NO: 727775 - DNA, 18 bp, Homo sapiens
tggcaggtgcagatgggc

SEQ ID NO: 727776 - DNA, 14 bp, Homo sapiens
tggcaggtgggctg

SEQ ID NO: 727777 - DNA, 19 bp, Homo sapiens
tggcaggtgggctgcctgc

SEQ ID NO: 727778 - DNA, 15 bp, Homo sapiens
tggcaggtgggggtg

SEQ ID NO: 727779 - DNA, 20 bp, Homo sapiens
tggcaggtgggggtgggctg

SEQ ID NO: 727780 - DNA, 12 bp, Homo sapiens
tggcagtggagg

SEQ ID NO: 727781 - DNA, 17 bp, Homo sapiens
tggcagtggctctcaga

SEQ ID NO: 727782 - DNA, 18 bp, Homo sapiens
tggcagtggctctcagag

SEQ ID NO: 727783 - DNA, 11 bp, Homo sapiens
tggcagtgttt

SEQ ID NO: 727784 - DNA, 23 bp, Homo sapiens
tggcagttgaacagagggagaga

SEQ ID NO: 727785 - DNA, 20 bp, Homo sapiens
tggcagtttatatttaactc

SEQ ID NO: 727786 - DNA, 20 bp, Homo sapiens
tggcataatagtcaatttct

SEQ ID NO: 727787 - DNA, 11 bp, Homo sapiens
tggcatacaaa

SEQ ID NO: 727788 - DNA, 17 bp, Homo sapiens
tggcatactttttaaaa

SEQ ID NO: 727789 - DNA, 21 bp, Homo sapiens
tggcatataattttcacttct

SEQ ID NO: 727790 - DNA, 15 bp, Homo sapiens
tggcatatttatatt

SEQ ID NO: 727791 - DNA, 18 bp, Homo sapiens
tggcatcacagggcagag

SEQ ID NO: 727792 - DNA, 20 bp, Homo sapiens
tggcatcacagggcagagcc

SEQ ID NO: 727793 - DNA, 13 bp, Homo sapiens
tggcatcacgtca

SEQ ID NO: 727794 - DNA, 19 bp, Homo sapiens
tggcatcccagtggcctca

SEQ ID NO: 727795 - DNA, 17 bp, Homo sapiens
tggcatcctgtgaagtc

SEQ ID NO: 727796 - DNA, 22 bp, Homo sapiens
tggcatcgcaccattctgactc

SEQ ID NO: 727797 - DNA, 19 bp, Homo sapiens
tggcatcgcagcttcctgt

SEQ ID NO: 727798 - DNA, 23 bp, Homo sapiens
tggcatcgtagaagagatgtggc

SEQ ID NO: 727799 - DNA, 12 bp, Homo sapiens
tggcatctctgt

SEQ ID NO: 727800 - DNA, 15 bp, Homo sapiens
tggcatctctgtccc

SEQ ID NO: 727801 - DNA, 21 bp, Homo sapiens
tggcatgaatcgggctaaggt

SEQ ID NO: 727802 - DNA, 14 bp, Homo sapiens
tggcatgacaacta

SEQ ID NO: 727803 - DNA, 20 bp, Homo sapiens
tggcatgatttatatatggc

SEQ ID NO: 727804 - DNA, 21 bp, Homo sapiens
tggcatgatttatatatggca

SEQ ID NO: 727805 - DNA, 18 bp, Homo sapiens
tggcatgcttaaatttta

SEQ ID NO: 727806 - DNA, 19 bp, Homo sapiens
tggccatgtcacctggctg

SEQ ID NO: 727807 - DNA, 19 bp, Homo sapiens
tggccatttgctagttctg

SEQ ID NO: 727808 - DNA, 22 bp, Homo sapiens
tggccatttgctagttctgctg

SEQ ID NO: 727809 - DNA, 14 bp, Homo sapiens
tggccatttgcttt

SEQ ID NO: 727810 - DNA, 16 bp, Homo sapiens
tggccattttaaaatg

SEQ ID NO: 727811 - DNA, 16 bp, Homo sapiens
tggccatttttctggg

SEQ ID NO: 727812 - DNA, 17 bp, Homo sapiens
tggccatttttctgggg

SEQ ID NO: 727813 - DNA, 22 bp, Homo sapiens
tggcccaagactgggctgtagt

SEQ ID NO: 727814 - DNA, 15 bp, Homo sapiens
tggcccaccccccag

SEQ ID NO: 727815 - DNA, 21 bp, Homo sapiens
tggcccaccccccagcctcca

SEQ ID NO: 727816 - DNA, 14 bp, Homo sapiens
tggcccaccgtggc

SEQ ID NO: 727817 - DNA, 22 bp, Homo sapiens
tggcccagaaagcctctctctc

SEQ ID NO: 727818 - DNA, 13 bp, Homo sapiens
tggcccagccggc

SEQ ID NO: 727819 - DNA, 18 bp, Homo sapiens
tggcccagccggcctctc

SEQ ID NO: 727820 - DNA, 12 bp, Homo sapiens
tggcccagcctt

SEQ ID NO: 727821 - DNA, 20 bp, Homo sapiens
tggcccagcggcccctccca

SEQ ID NO: 727822 - DNA, 19 bp, Homo sapiens
tggcccaggagctctgcgc

SEQ ID NO: 727823 - DNA, 12 bp, Homo sapiens
tggcccaggccc

SEQ ID NO: 727824 - DNA, 22 bp, Homo sapiens
tggcccaggccgggaagagcca

SEQ ID NO: 727825 - DNA, 23 bp, Homo sapiens
tggcccaggccgggaagagccac

SEQ ID NO: 727826 - DNA, 22 bp, Homo sapiens
tggcccaggccttgctgactct

SEQ ID NO: 727827 - DNA, 15 bp, Homo sapiens
tggcccagtcctctc

SEQ ID NO: 727828 - DNA, 14 bp, Homo sapiens
tggcccagttctga

SEQ ID NO: 727829 - DNA, 15 bp, Homo sapiens
tggcccatcaactgt

SEQ ID NO: 727830 - DNA, 18 bp, Homo sapiens
tggcccatctcagcctcc

SEQ ID NO: 727831 - DNA, 19 bp, Homo sapiens
tggcccatgggagccaggc

SEQ ID NO: 727832 - DNA, 16 bp, Homo sapiens
tggccccacctgagcc

SEQ ID NO: 727833 - DNA, 12 bp, Homo sapiens
tggccccagcac

SEQ ID NO: 727834 - DNA, 13 bp, Homo sapiens
tggccccagcaca

SEQ ID NO: 727835 - DNA, 17 bp, Homo sapiens
tggccccagcacagctt

SEQ ID NO: 727836 - DNA, 16 bp, Homo sapiens
tggccccagccctgct

SEQ ID NO: 727837 - DNA, 20 bp, Homo sapiens
tggccccaggacctggctgc

SEQ ID NO: 727838 - DNA, 12 bp, Homo sapiens
tggccccaggcc

SEQ ID NO: 727839 - DNA, 21 bp, Homo sapiens
tggccccaggccccagacagg

SEQ ID NO: 727840 - DNA, 22 bp, Homo sapiens
tggcccccaataaaggcagctg

SEQ ID NO: 727841 - DNA, 22 bp, Homo sapiens
tggcccccatacttggctgctt

SEQ ID NO: 727842 - DNA, 21 bp, Homo sapiens
tggccccccaaagtgctggga

SEQ ID NO: 727843 - DNA, 14 bp, Homo sapiens
tggccccccactcc

SEQ ID NO: 727844 - DNA, 14 bp, Homo sapiens
tggcccccgggcct

SEQ ID NO: 727845 - DNA, 15 bp, Homo sapiens
tggcccccgggcctg

SEQ ID NO: 727846 - DNA, 20 bp, Homo sapiens
tggcccccgggcctgcacag

SEQ ID NO: 727847 - DNA, 15 bp, Homo sapiens
tggccccctccgtga

SEQ ID NO: 727848 - DNA, 19 bp, Homo sapiens
tggccccgacaggtcttcc

SEQ ID NO: 727849 - DNA, 13 bp, Homo sapiens
tggccccgccgcc

SEQ ID NO: 727850 - DNA, 20 bp, Homo sapiens
tggccccgccgcctggtact

SEQ ID NO: 727851 - DNA, 19 bp, Homo sapiens
tggccccgggctctggcca

SEQ ID NO: 727852 - DNA, 15 bp, Homo sapiens
tggccccgtttctgg

SEQ ID NO: 727853 - DNA, 15 bp, Homo sapiens
tggcccctactttgt

SEQ ID NO: 727854 - DNA, 21 bp, Homo sapiens
tggcccctcacatcctctcca

SEQ ID NO: 727855 - DNA, 12 bp, Homo sapiens
tggcccctcacc

SEQ ID NO: 727856 - DNA, 21 bp, Homo sapiens
tggcccctcacctgggcacct

SEQ ID NO: 727857 - DNA, 21 bp, Homo sapiens
tggcccctccagaccctgcct

SEQ ID NO: 727858 - DNA, 20 bp, Homo sapiens
tggcccctgaacaagaattg

SEQ ID NO: 727859 - DNA, 21 bp, Homo sapiens
tggcccctgctgtctctctgg

SEQ ID NO: 727860 - DNA, 22 bp, Homo sapiens
tggcccctgctgtctctctggg

SEQ ID NO: 727861 - DNA, 13 bp, Homo sapiens
tggccccttcact

SEQ ID NO: 727862 - DNA, 16 bp, Homo sapiens
tggcccgacagcctgg

SEQ ID NO: 727863 - DNA, 18 bp, Homo sapiens
tggcccgacagcctggca

SEQ ID NO: 727864 - DNA, 19 bp, Homo sapiens
tggcccgacagcctggcac

SEQ ID NO: 727865 - DNA, 19 bp, Homo sapiens
tggcccgccctcacctctg

SEQ ID NO: 727866 - DNA, 14 bp, Homo sapiens
tggcccgcggcctg

SEQ ID NO: 727867 - DNA, 23 bp, Homo sapiens
tggcccgtgacagactcctgagg

SEQ ID NO: 727868 - DNA, 13 bp, Homo sapiens
tggcccgtggcct

SEQ ID NO: 727869 - DNA, 22 bp, Homo sapiens
tggcccgtggcttggcatctgt

SEQ ID NO: 727870 - DNA, 21 bp, Homo sapiens
tggccctcaaagcgagccgtt

SEQ ID NO: 727871 - DNA, 14 bp, Homo sapiens
tggccctccccaca

SEQ ID NO: 727872 - DNA, 23 bp, Homo sapiens
tggccctccctcagcggaggggt

SEQ ID NO: 727873 - DNA, 14 bp, Homo sapiens
tggccctccctccc

SEQ ID NO: 727874 - DNA, 16 bp, Homo sapiens
tggccctccctcccta

SEQ ID NO: 727875 - DNA, 22 bp, Homo sapiens
tggccctgactgtcagggaggg

SEQ ID NO: 727876 - DNA, 17 bp, Homo sapiens
tggccctgacttctgga

SEQ ID NO: 727877 - DNA, 18 bp, Homo sapiens
tggccctgaggtgtgggg

SEQ ID NO: 727878 - DNA, 15 bp, Homo sapiens
tggccctgcaaaagg

SEQ ID NO: 727879 - DNA, 14 bp, Homo sapiens
tggccctgcccttg

SEQ ID NO: 727880 - DNA, 17 bp, Homo sapiens
tggccctgcttcctgct

SEQ ID NO: 727881 - DNA, 14 bp, Homo sapiens
tggccctggagcca

SEQ ID NO: 727882 - DNA, 17 bp, Homo sapiens
tggccctggagccaggg

SEQ ID NO: 727883 - DNA, 19 bp, Homo sapiens
tggccctggagccagggca

SEQ ID NO: 727884 - DNA, 13 bp, Homo sapiens
tggccctggccct

SEQ ID NO: 727885 - DNA, 13 bp, Homo sapiens
tggccctggcctg

SEQ ID NO: 727886 - DNA, 17 bp, Homo sapiens
tggccctggcctgctgg

SEQ ID NO: 727887 - DNA, 23 bp, Homo sapiens
tggccctgggagaatcgctcctg

SEQ ID NO: 727888 - DNA, 13 bp, Homo sapiens
tggccctggggat

SEQ ID NO: 727889 - DNA, 19 bp, Homo sapiens
tggccctggggatcttccc

SEQ ID NO: 727890 - DNA, 12 bp, Homo sapiens
tggccctggggg

SEQ ID NO: 727891 - DNA, 20 bp, Homo sapiens
tggccctgggggtctgggcg

SEQ ID NO: 727892 - DNA, 12 bp, Homo sapiens
tggccctggggt

SEQ ID NO: 727893 - DNA, 13 bp, Homo sapiens
tggccctgtccca

SEQ ID NO: 727894 - DNA, 15 bp, Homo sapiens
tggccctgtcccagg

SEQ ID NO: 727895 - DNA, 16 bp, Homo sapiens
tggccctgtcccaggc

SEQ ID NO: 727896 - DNA, 13 bp, Homo sapiens
tggccctgtgcag

SEQ ID NO: 727897 - DNA, 17 bp, Homo sapiens
tggccctgtgcagacct

SEQ ID NO: 727898 - DNA, 15 bp, Homo sapiens
tggccctgtgcctgg

SEQ ID NO: 727899 - DNA, 21 bp, Homo sapiens
tggcccttacttgcttctcta

SEQ ID NO: 727900 - DNA, 16 bp, Homo sapiens
tggcccttcagtctgc

SEQ ID NO: 727901 - DNA, 17 bp, Homo sapiens
tggcccttcagtctgct

SEQ ID NO: 727902 - DNA, 20 bp, Homo sapiens
tggcccttcagtctgctcca

SEQ ID NO: 727903 - DNA, 22 bp, Homo sapiens
tggcccttgcagttcagcacca

SEQ ID NO: 727904 - DNA, 23 bp, Homo sapiens
tggcccttgcagttcagcaccac

SEQ ID NO: 727905 - DNA, 19 bp, Homo sapiens
tggcccttggaataaagtt

SEQ ID NO: 727906 - DNA, 23 bp, Homo sapiens
tggcccttggtggggagcacaga

SEQ ID NO: 727907 - DNA, 22 bp, Homo sapiens
tggcccttgtttacagtgagga

SEQ ID NO: 727908 - DNA, 22 bp, Homo sapiens
tggccgaagccccttggagaga

SEQ ID NO: 727909 - DNA, 15 bp, Homo sapiens
tggccgagctcctgg

SEQ ID NO: 727910 - DNA, 19 bp, Homo sapiens
tggccgagggtcctggctc

SEQ ID NO: 727911 - DNA, 19 bp, Homo sapiens
tggccgcacgcctctccct

SEQ ID NO: 727912 - DNA, 21 bp, Homo sapiens
tggccgcacgcctctccctgc

SEQ ID NO: 727913 - DNA, 20 bp, Homo sapiens
tggccgcataggcccagcca

SEQ ID NO: 727914 - DNA, 12 bp, Homo sapiens
tggccgccaccc

SEQ ID NO: 727915 - DNA, 13 bp, Homo sapiens
tggccgccacccc

SEQ ID NO: 727916 - DNA, 14 bp, Homo sapiens
tggccgccaccccc

SEQ ID NO: 727917 - DNA, 18 bp, Homo sapiens
tggccgccacccccatct

SEQ ID NO: 727918 - DNA, 18 bp, Homo sapiens
tggccgccatctgcgcag

SEQ ID NO: 727919 - DNA, 21 bp, Homo sapiens
tggccgccccctgccccccag

SEQ ID NO: 727920 - DNA, 19 bp, Homo sapiens
tggccgctaagttgctgat

SEQ ID NO: 727921 - DNA, 12 bp, Homo sapiens
tggccgctccgt

SEQ ID NO: 727922 - DNA, 15 bp, Homo sapiens
tggccggctgtgctc

SEQ ID NO: 727923 - DNA, 17 bp, Homo sapiens
tggccggctgtgctcag

SEQ ID NO: 727924 - DNA, 23 bp, Homo sapiens
tggccgggcgcggtggctcacgc

SEQ ID NO: 727925 - DNA, 17 bp, Homo sapiens
tggccgtggatgcgcag

SEQ ID NO: 727926 - DNA, 17 bp, Homo sapiens
tggctggagagctgcta

SEQ ID NO: 727927 - DNA, 18 bp, Homo sapiens
tggctggagcggagatga

SEQ ID NO: 727928 - DNA, 17 bp, Homo sapiens
tggctggaggagcagca

SEQ ID NO: 727929 - DNA, 23 bp, Homo sapiens
tggctggaggagcagcagcttgg

SEQ ID NO: 727930 - DNA, 19 bp, Homo sapiens
tggctggcctcacccaccc

SEQ ID NO: 727931 - DNA, 20 bp, Homo sapiens
tggctgggaacatgacccag

SEQ ID NO: 727932 - DNA, 18 bp, Homo sapiens
tggctgggcccctgggga

SEQ ID NO: 727933 - DNA, 19 bp, Homo sapiens
tggctgggcccctggggac

SEQ ID NO: 727934 - DNA, 20 bp, Homo sapiens
tggctgggcccctggggaca

SEQ ID NO: 727935 - DNA, 22 bp, Homo sapiens
tggctgggcgtgctagaggttg

SEQ ID NO: 727936 - DNA, 23 bp, Homo sapiens
tggctgggctacaatttgttaat

SEQ ID NO: 727937 - DNA, 17 bp, Homo sapiens
tggctggggaggaccag

SEQ ID NO: 727938 - DNA, 14 bp, Homo sapiens
tggctggggcagag

SEQ ID NO: 727939 - DNA, 16 bp, Homo sapiens
tggctggggcagaggg

SEQ ID NO: 727940 - DNA, 15 bp, Homo sapiens
tggctgggtgccctc

SEQ ID NO: 727941 - DNA, 16 bp, Homo sapiens
tggctgggtgggccca

SEQ ID NO: 727942 - DNA, 19 bp, Homo sapiens
tggctgggttcaggtccca

SEQ ID NO: 727943 - DNA, 22 bp, Homo sapiens
tggctggtaacagttcatgttt

SEQ ID NO: 727944 - DNA, 15 bp, Homo sapiens
tggctggtagaaaaa

SEQ ID NO: 727945 - DNA, 21 bp, Homo sapiens
tggctggtagcagcaggctca

SEQ ID NO: 727946 - DNA, 13 bp, Homo sapiens
tggctggtccagg

SEQ ID NO: 727947 - DNA, 22 bp, Homo sapiens
tggctggtgagaccccgcactg

SEQ ID NO: 727948 - DNA, 15 bp, Homo sapiens
tggctggtgcccatg

SEQ ID NO: 727949 - DNA, 18 bp, Homo sapiens
tggctggtgcccatgaag

SEQ ID NO: 727950 - DNA, 12 bp, Homo sapiens
tggctggtgtcc

SEQ ID NO: 727951 - DNA, 14 bp, Homo sapiens
tggctggtttctga

SEQ ID NO: 727952 - DNA, 17 bp, Homo sapiens
tggctgtaatcagttat

SEQ ID NO: 727953 - DNA, 16 bp, Homo sapiens
tggctgtaatcatttg

SEQ ID NO: 727954 - DNA, 22 bp, Homo sapiens
tggctgtaatcatttgtttaca

SEQ ID NO: 727955 - DNA, 18 bp, Homo sapiens
tggctgtagatcccaaga

SEQ ID NO: 727956 - DNA, 19 bp, Homo sapiens
tggctgtctagaatgtgga

SEQ ID NO: 727957 - DNA, 10 bp, Homo sapiens
tggctgtctg

SEQ ID NO: 727958 - DNA, 12 bp, Homo sapiens
tggctgtgaaag

SEQ ID NO: 727959 - DNA, 17 bp, Homo sapiens
tggctgtgaaagaaaat

SEQ ID NO: 727960 - DNA, 20 bp, Homo sapiens
tggctgtgcccagcaggccc

SEQ ID NO: 727961 - DNA, 21 bp, Homo sapiens
tggctgtgcccagcaggccca

SEQ ID NO: 727962 - DNA, 14 bp, Homo sapiens
tggctgtgcctctg

SEQ ID NO: 727963 - DNA, 15 bp, Homo sapiens
tggctgtgcctctgc

SEQ ID NO: 727964 - DNA, 17 bp, Homo sapiens
tggctgtgcctctgcct

SEQ ID NO: 727965 - DNA, 18 bp, Homo sapiens
tggctgtgcctctgcctg

SEQ ID NO: 727966 - DNA, 16 bp, Homo sapiens
tggctgtggaggcctg

SEQ ID NO: 727967 - DNA, 17 bp, Homo sapiens
tggctgtggaggcctga

SEQ ID NO: 727968 - DNA, 20 bp, Homo sapiens
tggctgtggaggcctgatgc

SEQ ID NO: 727969 - DNA, 14 bp, Homo sapiens
tggctgtggcacag

SEQ ID NO: 727970 - DNA, 15 bp, Homo sapiens
tggctgtggcacaga

SEQ ID NO: 727971 - DNA, 17 bp, Homo sapiens
tggctgtggcacagact

SEQ ID NO: 727972 - DNA, 23 bp, Homo sapiens
tggctgtggcacagacttctgga

SEQ ID NO: 727973 - DNA, 19 bp, Homo sapiens
tggctgtggcatttccaaa

SEQ ID NO: 727974 - DNA, 22 bp, Homo sapiens
tggctgtggttcctaagcctgt

SEQ ID NO: 727975 - DNA, 23 bp, Homo sapiens
tggctgtggttcctaagcctgtt

SEQ ID NO: 727976 - DNA, 15 bp, Homo sapiens
tggctgtgtctaaac

SEQ ID NO: 727977 - DNA, 19 bp, Homo sapiens
tggctgtgtctaaactgca

SEQ ID NO: 727978 - DNA, 15 bp, Homo sapiens
tggctgtgtgacaga

SEQ ID NO: 727979 - DNA, 21 bp, Homo sapiens
tggctgtgttcgggggagcag

SEQ ID NO: 727980 - DNA, 23 bp, Homo sapiens
tggctgtgttcgggggagcagag

SEQ ID NO: 727981 - DNA, 21 bp, Homo sapiens
tggctgtgtttgcagcctgct

SEQ ID NO: 727982 - DNA, 15 bp, Homo sapiens
tggctgttccagact

SEQ ID NO: 727983 - DNA, 22 bp, Homo sapiens
tggctgtttcttgtctgttatg

SEQ ID NO: 727984 - DNA, 14 bp, Homo sapiens
tggctgtttgagat

SEQ ID NO: 727985 - DNA, 15 bp, Homo sapiens
tggcttaaagtgaag

SEQ ID NO: 727986 - DNA, 17 bp, Homo sapiens
tggcttaaagtgaagga

SEQ ID NO: 727987 - DNA, 21 bp, Homo sapiens
tggcttaaagtgaaggaaata

SEQ ID NO: 727988 - DNA, 14 bp, Homo sapiens
tggcttaatgttta

SEQ ID NO: 727989 - DNA, 22 bp, Homo sapiens
tggcttagacaccacctggagt

SEQ ID NO: 727990 - DNA, 21 bp, Homo sapiens
tggcttaggaatgacttactt

SEQ ID NO: 727991 - DNA, 16 bp, Homo sapiens
tggcttataaacacat

SEQ ID NO: 727992 - DNA, 16 bp, Homo sapiens
tggcttataggtgttg

SEQ ID NO: 727993 - DNA, 15 bp, Homo sapiens
tggcttatgtcatca

SEQ ID NO: 727994 - DNA, 21 bp, Homo sapiens
tggcttatttttctgacttct

SEQ ID NO: 727995 - DNA, 22 bp, Homo sapiens
tggcttcacggaagagccttgc

SEQ ID NO: 727996 - DNA, 20 bp, Homo sapiens
tggcttcagcccccaccagg

SEQ ID NO: 727997 - DNA, 23 bp, Homo sapiens
tggcttcagcccccaccagggga

SEQ ID NO: 727998 - DNA, 13 bp, Homo sapiens
tggcttcatgtgg

SEQ ID NO: 727999 - DNA, 18 bp, Homo sapiens
tggcttcatgtggcactt

SEQ ID NO: 728000 - DNA, 12 bp, Homo sapiens
tggcttcatttt

SEQ ID NO: 728001 - DNA, 22 bp, Homo sapiens
tggcttccagaaaaccccagca

SEQ ID NO: 728002 - DNA, 14 bp, Homo sapiens
tggcttccaggtat

SEQ ID NO: 728003 - DNA, 20 bp, Homo sapiens
tggcttccaggtatctccag

SEQ ID NO: 728004 - DNA, 23 bp, Homo sapiens
tggcttccaggtatctccaggat

SEQ ID NO: 728005 - DNA, 20 bp, Homo sapiens
tggcttcccatagtggggcc

SEQ ID NO: 728006 - DNA, 19 bp, Homo sapiens
tggcttcccgctcagccct

SEQ ID NO: 728007 - DNA, 21 bp, Homo sapiens
tggcttccctaaactgcagcc

SEQ ID NO: 728008 - DNA, 21 bp, Homo sapiens
tggcttcctccgtccacccag

SEQ ID NO: 728009 - DNA, 13 bp, Homo sapiens
tggcttcctgaga

SEQ ID NO: 728010 - DNA, 23 bp, Homo sapiens
tggcttcctgagaaagcccacct

SEQ ID NO: 728011 - DNA, 18 bp, Homo sapiens
tggcttcggacaaaatat

SEQ ID NO: 728012 - DNA, 20 bp, Homo sapiens
tggcttcggacaaaatatct

SEQ ID NO: 728013 - DNA, 13 bp, Homo sapiens
tggcttctcctgt

SEQ ID NO: 728014 - DNA, 16 bp, Homo sapiens
tggcttctcctgtgac

SEQ ID NO: 728015 - DNA, 22 bp, Homo sapiens
tggcttctgaagagcctgaagc

SEQ ID NO: 728016 - DNA, 14 bp, Homo sapiens
tggcttctgggacc

SEQ ID NO: 728017 - DNA, 16 bp, Homo sapiens
tggcttctgggacctg

SEQ ID NO: 728018 - DNA, 17 bp, Homo sapiens
tggcttctgtgatgagc

SEQ ID NO: 728019 - DNA, 12 bp, Homo sapiens
tggcttctgtgc

SEQ ID NO: 728020 - DNA, 13 bp, Homo sapiens
tggcttctgtgca

SEQ ID NO: 728021 - DNA, 22 bp, Homo sapiens
tggcttctgtgcactagcctgt

SEQ ID NO: 728022 - DNA, 18 bp, Homo sapiens
tggcttcttaaaaactgt

SEQ ID NO: 728023 - DNA, 17 bp, Homo sapiens
tggcttgacatgtgcaa

SEQ ID NO: 728024 - DNA, 15 bp, Homo sapiens
tggcttgagaaatat

SEQ ID NO: 728025 - DNA, 15 bp, Homo sapiens
tggcttgagctagag

SEQ ID NO: 728026 - DNA, 17 bp, Homo sapiens
tggcttgccccaggact

SEQ ID NO: 728027 - DNA, 16 bp, Homo sapiens
tggcttggaagattct

SEQ ID NO: 728028 - DNA, 12 bp, Homo sapiens
tggcttggagga

SEQ ID NO: 728029 - DNA, 17 bp, Homo sapiens
tggcttggagtggccaa

SEQ ID NO: 728030 - DNA, 18 bp, Homo sapiens
tggcttggcatctgtgtg

SEQ ID NO: 728031 - DNA, 16 bp, Homo sapiens
tggcttggccttggca

SEQ ID NO: 728032 - DNA, 13 bp, Homo sapiens
tggcttgtagaat

SEQ ID NO: 728033 - DNA, 22 bp, Homo sapiens
tggcttgttattgcctctactt

SEQ ID NO: 728034 - DNA, 21 bp, Homo sapiens
tggcttgttcatcatccagat

SEQ ID NO: 728035 - DNA, 16 bp, Homo sapiens
tggcttgttctctgga

SEQ ID NO: 728036 - DNA, 18 bp, Homo sapiens
tggcttgttctctggaac

SEQ ID NO: 728037 - DNA, 15 bp, Homo sapiens
tggcttgtttgattt

SEQ ID NO: 728038 - DNA, 13 bp, Homo sapiens
tggctttaaataa

SEQ ID NO: 728039 - DNA, 21 bp, Homo sapiens
tggctttaaataaattaagat

SEQ ID NO: 728040 - DNA, 17 bp, Homo sapiens
tggctttaggagcagtg

SEQ ID NO: 728041 - DNA, 20 bp, Homo sapiens
tggctttaggagcagtggga

SEQ ID NO: 728042 - DNA, 23 bp, Homo sapiens
tggctttcaaggctggggcatgg

SEQ ID NO: 728043 - DNA, 15 bp, Homo sapiens
tggctttcagggcag

SEQ ID NO: 728044 - DNA, 13 bp, Homo sapiens
tggctttcatcct

SEQ ID NO: 728045 - DNA, 16 bp, Homo sapiens
tggctttcatcctgtg

SEQ ID NO: 728046 - DNA, 20 bp, Homo sapiens
tggctttcatcctgtgtccc

SEQ ID NO: 728047 - DNA, 21 bp, Homo sapiens
tggctttccaggagacatata

SEQ ID NO: 728048 - DNA, 14 bp, Homo sapiens
tggctttccaggca

SEQ ID NO: 728049 - DNA, 12 bp, Homo sapiens
tggctttctccc

SEQ ID NO: 728050 - DNA, 21 bp, Homo sapiens
tggctatgaaaatgagccctg

SEQ ID NO: 728051 - DNA, 14 bp, Homo sapiens
tggctatgaacaga

SEQ ID NO: 728052 - DNA, 16 bp, Homo sapiens
tggctatgatggtgac

SEQ ID NO: 728053 - DNA, 14 bp, Homo sapiens
tggctatgcatttg

SEQ ID NO: 728054 - DNA, 14 bp, Homo sapiens
tggctatggccacc

SEQ ID NO: 728055 - DNA, 18 bp, Homo sapiens
tggctatgtttttaatgt

SEQ ID NO: 728056 - DNA, 17 bp, Homo sapiens
tggctcaagacaaggct

SEQ ID NO: 728057 - DNA, 19 bp, Homo sapiens
tggctcaagacaaggctgg

SEQ ID NO: 728058 - DNA, 18 bp, Homo sapiens
tggctcaagtagaaaagc

SEQ ID NO: 728059 - DNA, 22 bp, Homo sapiens
tggctcacagtacagcatgtgc

SEQ ID NO: 728060 - DNA, 15 bp, Homo sapiens
tggctcacgccccgc

SEQ ID NO: 728061 - DNA, 21 bp, Homo sapiens
tggctcacgccccgctgtgtc

SEQ ID NO: 728062 - DNA, 19 bp, Homo sapiens
tggctcacgcctgtaatcc

SEQ ID NO: 728063 - DNA, 12 bp, Homo sapiens
tggctcactact

SEQ ID NO: 728064 - DNA, 14 bp, Homo sapiens
tggctcactactga

SEQ ID NO: 728065 - DNA, 16 bp, Homo sapiens
tggctcactggctggg

SEQ ID NO: 728066 - DNA, 19 bp, Homo sapiens
tggctcactggctgggagt

SEQ ID NO: 728067 - DNA, 18 bp, Homo sapiens
tggctcagagcttgaaga

SEQ ID NO: 728068 - DNA, 13 bp, Homo sapiens
tggctcagagggg

SEQ ID NO: 728069 - DNA, 15 bp, Homo sapiens
tggctcagcctgtct

SEQ ID NO: 728070 - DNA, 16 bp, Homo sapiens
tggctcagcctgtctc

SEQ ID NO: 728071 - DNA, 17 bp, Homo sapiens
tggctcagcctgtctcg

SEQ ID NO: 728072 - DNA, 22 bp, Homo sapiens
tggctcagcctgtctcgggctg

SEQ ID NO: 728073 - DNA, 13 bp, Homo sapiens
tggctcaggcaag

SEQ ID NO: 728074 - DNA, 14 bp, Homo sapiens
tggctcaggcaagc

SEQ ID NO: 728075 - DNA, 19 bp, Homo sapiens
tggctcaggcaagcccctc

SEQ ID NO: 728076 - DNA, 21 bp, Homo sapiens
tggctcagggtcaaagacaga

SEQ ID NO: 728077 - DNA, 14 bp, Homo sapiens
tggctcagtgccac

SEQ ID NO: 728078 - DNA, 22 bp, Homo sapiens
tggctcatggcgtaatgggcct

SEQ ID NO: 728079 - DNA, 20 bp, Homo sapiens
tggctccagatgcagggcag

SEQ ID NO: 728080 - DNA, 20 bp, Homo sapiens
tggctccagtctgctgccct

SEQ ID NO: 728081 - DNA, 16 bp, Homo sapiens
tggctcccacaggagt

SEQ ID NO: 728082 - DNA, 13 bp, Homo sapiens
tggctcccagggt

SEQ ID NO: 728083 - DNA, 14 bp, Homo sapiens
tggctcccagggtg

SEQ ID NO: 728084 - DNA, 19 bp, Homo sapiens
tggctccccacctggacac

SEQ ID NO: 728085 - DNA, 21 bp, Homo sapiens
tggctccccacctggacacac

SEQ ID NO: 728086 - DNA, 18 bp, Homo sapiens
tggctccccctccccagg

SEQ ID NO: 728087 - DNA, 21 bp, Homo sapiens
tggctccccctccccaggctg

SEQ ID NO: 728088 - DNA, 19 bp, Homo sapiens
tggctccccctctgcttct

SEQ ID NO: 728089 - DNA, 13 bp, Homo sapiens
tggctcccctcta

SEQ ID NO: 728090 - DNA, 14 bp, Homo sapiens
tggctcccctctat

SEQ ID NO: 728091 - DNA, 21 bp, Homo sapiens
tggctcccctctatttagcat

SEQ ID NO: 728092 - DNA, 17 bp, Homo sapiens
tggctccctcctccagg

SEQ ID NO: 728093 - DNA, 20 bp, Homo sapiens
tggctccctcctccaggcct

SEQ ID NO: 728094 - DNA, 21 bp, Homo sapiens
tggctccctcctccaggcctg

SEQ ID NO: 728095 - DNA, 14 bp, Homo sapiens
tggctccctgcccc

SEQ ID NO: 728096 - DNA, 15 bp, Homo sapiens
tggctccctgcccct

SEQ ID NO: 728097 - DNA, 15 bp, Homo sapiens
tggctccctgggcag

SEQ ID NO: 728098 - DNA, 16 bp, Homo sapiens
tggctcccttacttta

SEQ ID NO: 728099 - DNA, 18 bp, Homo sapiens
tggctcctatctgtgttt

SEQ ID NO: 728100 - DNA, 19 bp, Homo sapiens
tggctcctcccggtgccca

SEQ ID NO: 728101 - DNA, 12 bp, Homo sapiens
tggctcctccta

SEQ ID NO: 728102 - DNA, 17 bp, Homo sapiens
tggctcctgtctggctc

SEQ ID NO: 728103 - DNA, 19 bp, Homo sapiens
tggctcgaatctctgtgcc

SEQ ID NO: 728104 - DNA, 20 bp, Homo sapiens
tggctcggacccaccccaac

SEQ ID NO: 728105 - DNA, 21 bp, Homo sapiens
tggctcggacccaccccaact

SEQ ID NO: 728106 - DNA, 22 bp, Homo sapiens
tggctcggacccaccccaactc

SEQ ID NO: 728107 - DNA, 21 bp, Homo sapiens
tggctcggggtaaaaagtggc

SEQ ID NO: 728108 - DNA, 19 bp, Homo sapiens
tggctctaattcacagtgc

SEQ ID NO: 728109 - DNA, 19 bp, Homo sapiens
tggctctaccctgtctgtc

SEQ ID NO: 728110 - DNA, 21 bp, Homo sapiens
tggctctaccctgtctgtccc

SEQ ID NO: 728111 - DNA, 17 bp, Homo sapiens
tggctctaccttcctgt

SEQ ID NO: 728112 - DNA, 23 bp, Homo sapiens
tggctctaccttcctgtccctga

SEQ ID NO: 728113 - DNA, 19 bp, Homo sapiens
tggctctcattgacttcct

SEQ ID NO: 728114 - DNA, 16 bp, Homo sapiens
tgggaagcctgtgcca

SEQ ID NO: 728115 - DNA, 24 bp, Homo sapiens
tgggaagctgtactcagagcagag

SEQ ID NO: 728116 - DNA, 14 bp, Homo sapiens
tgggaaggaaacaa

SEQ ID NO: 728117 - DNA, 18 bp, Homo sapiens
tgggaaggacacagcagt

SEQ ID NO: 728118 - DNA, 12 bp, Homo sapiens
tgggaaggactt

SEQ ID NO: 728119 - DNA, 21 bp, Homo sapiens
tgggaaggcgagtctggggac

SEQ ID NO: 728120 - DNA, 12 bp, Homo sapiens
tgggaaggggag

SEQ ID NO: 728121 - DNA, 16 bp, Homo sapiens
tgggaaggggatggac

SEQ ID NO: 728122 - DNA, 18 bp, Homo sapiens
tgggaaggggtcctgcag

SEQ ID NO: 728123 - DNA, 21 bp, Homo sapiens
tgggaataatagacactgggg

SEQ ID NO: 728124 - DNA, 15 bp, Homo sapiens
tgggaatagggagac

SEQ ID NO: 728125 - DNA, 15 bp, Homo sapiens
tgggaatgagacata

SEQ ID NO: 728126 - DNA, 14 bp, Homo sapiens
tgggaatggaataa

SEQ ID NO: 728127 - DNA, 17 bp, Homo sapiens
tgggaatggaggggcag

SEQ ID NO: 728128 - DNA, 19 bp, Homo sapiens
tgggaatggaggggcagag

SEQ ID NO: 728129 - DNA, 12 bp, Homo sapiens
tgggaatgggag

SEQ ID NO: 728130 - DNA, 14 bp, Homo sapiens
tgggaatgggagag

SEQ ID NO: 728131 - DNA, 10 bp, Homo sapiens
tgggaatgtt

SEQ ID NO: 728132 - DNA, 15 bp, Homo sapiens
tgggaattggggagg

SEQ ID NO: 728133 - DNA, 13 bp, Homo sapiens
tgggaatttcaat

SEQ ID NO: 728134 - DNA, 16 bp, Homo sapiens
tgggacaagcagtccc

SEQ ID NO: 728135 - DNA, 15 bp, Homo sapiens
tgggacaatggcaat

SEQ ID NO: 728136 - DNA, 18 bp, Homo sapiens
tgggacaatggcaatagg

SEQ ID NO: 728137 - DNA, 17 bp, Homo sapiens
tgggacacagacccagg

SEQ ID NO: 728138 - DNA, 20 bp, Homo sapiens
tgggacacagacccaggacc

SEQ ID NO: 728139 - DNA, 21 bp, Homo sapiens
tgggacacctgggagaaggtc

SEQ ID NO: 728140 - DNA, 20 bp, Homo sapiens
tgggacacttccctgggcct

SEQ ID NO: 728141 - DNA, 18 bp, Homo sapiens
tgggacagaggagcaagg

SEQ ID NO: 728142 - DNA, 12 bp, Homo sapiens
tgggacagccag

SEQ ID NO: 728143 - DNA, 18 bp, Homo sapiens
tgggacagccagagctgg

SEQ ID NO: 728144 - DNA, 23 bp, Homo sapiens
tgggacagccagagctgggtggg

SEQ ID NO: 728145 - DNA, 18 bp, Homo sapiens
tgggacagggagggccgg

SEQ ID NO: 728146 - DNA, 17 bp, Homo sapiens
tgggacatggcacaggc

SEQ ID NO: 728147 - DNA, 16 bp, Homo sapiens
tgggaccaaaggggga

SEQ ID NO: 728148 - DNA, 18 bp, Homo sapiens
tgggaccacaggcatgca

SEQ ID NO: 728149 - DNA, 23 bp, Homo sapiens
tgggaccacaggcatgcaccact

SEQ ID NO: 728150 - DNA, 20 bp, Homo sapiens
tgggacccaaaacacaggaa

SEQ ID NO: 728151 - DNA, 23 bp, Homo sapiens
tgggacccagctactctgtccag

SEQ ID NO: 728152 - DNA, 20 bp, Homo sapiens
tgggacccatagatcttctg

SEQ ID NO: 728153 - DNA, 16 bp, Homo sapiens
tgggaccccctcgcca

SEQ ID NO: 728154 - DNA, 17 bp, Homo sapiens
tgggaccccctcgccag

SEQ ID NO: 728155 - DNA, 22 bp, Homo sapiens
tgggaccctgtccggcccagtg

SEQ ID NO: 728156 - DNA, 17 bp, Homo sapiens
tgggaccctttccttcc

SEQ ID NO: 728157 - DNA, 16 bp, Homo sapiens
tgggaccgcctggccc

SEQ ID NO: 728158 - DNA, 17 bp, Homo sapiens
tgggaccgcctggccct

SEQ ID NO: 728159 - DNA, 22 bp, Homo sapiens
tgggaccgcctggccctccctc

SEQ ID NO: 728160 - DNA, 16 bp, Homo sapiens
tgggaccgtgccccac

SEQ ID NO: 728161 - DNA, 20 bp, Homo sapiens
tgggaccgtgccccacctcc

SEQ ID NO: 728162 - DNA, 17 bp, Homo sapiens
tgggaccgtgcgagctg

SEQ ID NO: 728163 - DNA, 20 bp, Homo sapiens
tgggaccgtgcgagctgccg

SEQ ID NO: 728164 - DNA, 17 bp, Homo sapiens
tgggacctaaaaaggtc

SEQ ID NO: 728165 - DNA, 12 bp, Homo sapiens
tgggacctcctc

SEQ ID NO: 728166 - DNA, 17 bp, Homo sapiens
tgggacctgccaggcag

SEQ ID NO: 728167 - DNA, 14 bp, Homo sapiens
tgggacctggcccc

SEQ ID NO: 728168 - DNA, 23 bp, Homo sapiens
tgggacgggatggttctggctgt

SEQ ID NO: 728169 - DNA, 23 bp, Homo sapiens
tgggacggtgcccaagccagagg

SEQ ID NO: 728170 - DNA, 18 bp, Homo sapiens
tgggactagagctttctt

SEQ ID NO: 728171 - DNA, 13 bp, Homo sapiens
tgggactcagcct

SEQ ID NO: 728172 - DNA, 17 bp, Homo sapiens
tgggactcagccttcag

SEQ ID NO: 728173 - DNA, 14 bp, Homo sapiens
tgggactcaggtct

SEQ ID NO: 728174 - DNA, 17 bp, Homo sapiens
tgggactcattgtagaa

SEQ ID NO: 728175 - DNA, 19 bp, Homo sapiens
tgggactcccagcagagcc

SEQ ID NO: 728176 - DNA, 15 bp, Homo sapiens
tgggactctcctcct

SEQ ID NO: 728177 - DNA, 16 bp, Homo sapiens
tgggactctcctcctc

SEQ ID NO: 728178 - DNA, 23 bp, Homo sapiens
tgggactggccaggtttctgccc

SEQ ID NO: 728179 - DNA, 18 bp, Homo sapiens
tgggacttccatgcctta

SEQ ID NO: 728180 - DNA, 19 bp, Homo sapiens
tgggacttccttgctctcc

SEQ ID NO: 728181 - DNA, 16 bp, Homo sapiens
tgggacttggagagca

SEQ ID NO: 728182 - DNA, 18 bp, Homo sapiens
tgggacttttctttctta

SEQ ID NO: 728183 - DNA, 15 bp, Homo sapiens
tgggagaaaatcatc

SEQ ID NO: 728184 - DNA, 22 bp, Homo sapiens
tgggagaaagaccatgcattta

SEQ ID NO: 728185 - DNA, 21 bp, Homo sapiens
tgggaggcaagaaaaggacaa

SEQ ID NO: 728186 - DNA, 14 bp, Homo sapiens
tgggaggcagaggt

SEQ ID NO: 728187 - DNA, 20 bp, Homo sapiens
tgggaggcagggctctcccg

SEQ ID NO: 728188 - DNA, 13 bp, Homo sapiens
tgggaggccaagg

SEQ ID NO: 728189 - DNA, 14 bp, Homo sapiens
tgggaggccaaggc

SEQ ID NO: 728190 - DNA, 17 bp, Homo sapiens
tgggaggccaaggcagg

SEQ ID NO: 728191 - DNA, 18 bp, Homo sapiens
tgggaggccaaggcaggt

SEQ ID NO: 728192 - DNA, 20 bp, Homo sapiens
tgggaggccaaggtgggcgg

SEQ ID NO: 728193 - DNA, 14 bp, Homo sapiens
tgggaggccaggcg

SEQ ID NO: 728194 - DNA, 21 bp, Homo sapiens
tgggaggccaggcgagcctga

SEQ ID NO: 728195 - DNA, 14 bp, Homo sapiens
tgggaggcgtgccc

SEQ ID NO: 728196 - DNA, 16 bp, Homo sapiens
tgggaggcgtgccccc

SEQ ID NO: 728197 - DNA, 14 bp, Homo sapiens
tgggaggcttcccc

SEQ ID NO: 728198 - DNA, 14 bp, Homo sapiens
tgggagggcagcag

SEQ ID NO: 728199 - DNA, 16 bp, Homo sapiens
tgggaggggcaggctg

SEQ ID NO: 728200 - DNA, 19 bp, Homo sapiens
tgggaggggcaggctgaca

SEQ ID NO: 728201 - DNA, 14 bp, Homo sapiens
tgggagggggagga

SEQ ID NO: 728202 - DNA, 19 bp, Homo sapiens
tgggagggggcgttggatt

SEQ ID NO: 728203 - DNA, 23 bp, Homo sapiens
tgggagggggcttgaagccaaag

SEQ ID NO: 728204 - DNA, 20 bp, Homo sapiens
tgggagggggtgagaggcag

SEQ ID NO: 728205 - DNA, 24 bp, Homo sapiens
tgggagggggttggggtggttgag

SEQ ID NO: 728206 - DNA, 15 bp, Homo sapiens
tgggagggttcccct

SEQ ID NO: 728207 - DNA, 17 bp, Homo sapiens
tgggagggttcccctgg

SEQ ID NO: 728208 - DNA, 18 bp, Homo sapiens
tgggaggtcaaggctgca

SEQ ID NO: 728209 - DNA, 20 bp, Homo sapiens
tgggaggtctcgtcccagcc

SEQ ID NO: 728210 - DNA, 18 bp, Homo sapiens
tgggaggtgcgtgttcag

SEQ ID NO: 728211 - DNA, 18 bp, Homo sapiens
tgggaggtggaagaaggg

SEQ ID NO: 728212 - DNA, 16 bp, Homo sapiens
tgggagtaacagggca

SEQ ID NO: 728213 - DNA, 18 bp, Homo sapiens
tgggagtaacagggcaga

SEQ ID NO: 728214 - DNA, 16 bp, Homo sapiens
tgggagtatgttgtca

SEQ ID NO: 728215 - DNA, 13 bp, Homo sapiens
tgggagtcagagc

SEQ ID NO: 728216 - DNA, 14 bp, Homo sapiens
tgggagtcagagcc

SEQ ID NO: 728217 - DNA, 19 bp, Homo sapiens
tgggagtcattaccacgcc

SEQ ID NO: 728218 - DNA, 12 bp, Homo sapiens
tgggagtccagg

SEQ ID NO: 728219 - DNA, 20 bp, Homo sapiens
tgggagtccccttttctttt

SEQ ID NO: 728220 - DNA, 15 bp, Homo sapiens
tgggagtccctacct

SEQ ID NO: 728221 - DNA, 19 bp, Homo sapiens
tgggagtccttacctcggg

SEQ ID NO: 728222 - DNA, 17 bp, Homo sapiens
tgggagtcttgggtggc

SEQ ID NO: 728223 - DNA, 19 bp, Homo sapiens
tgggagtcttgggtggcgc

SEQ ID NO: 728224 - DNA, 15 bp, Homo sapiens
tgggagtgggcacct

SEQ ID NO: 728225 - DNA, 17 bp, Homo sapiens
tgggagtgggcacctca

SEQ ID NO: 728226 - DNA, 22 bp, Homo sapiens
tgggagtgggcacctcagaaag

SEQ ID NO: 728227 - DNA, 16 bp, Homo sapiens
tgggagtgtgtctgct

SEQ ID NO: 728228 - DNA, 17 bp, Homo sapiens
tgggagtgtgtctgctg

SEQ ID NO: 728229 - DNA, 16 bp, Homo sapiens
tgggataaagcaaggg

SEQ ID NO: 728230 - DNA, 13 bp, Homo sapiens
tgggataggaaaa

SEQ ID NO: 728231 - DNA, 21 bp, Homo sapiens
tgggatagtgttctgctcctg

SEQ ID NO: 728232 - DNA, 22 bp, Homo sapiens
tgggatatatggaggattcttt

SEQ ID NO: 728233 - DNA, 15 bp, Homo sapiens
tgggatcatccagag

SEQ ID NO: 728234 - DNA, 16 bp, Homo sapiens
tgggatcatttttcca

SEQ ID NO: 728235 - DNA, 17 bp, Homo sapiens
tgggatccacttcttgg

SEQ ID NO: 728236 - DNA, 12 bp, Homo sapiens
tgggatccagtg

SEQ ID NO: 728237 - DNA, 15 bp, Homo sapiens
tgggatcctccctca

SEQ ID NO: 728238 - DNA, 14 bp, Homo sapiens
tgggatctaggaga

SEQ ID NO: 728239 - DNA, 23 bp, Homo sapiens
tgggatctggtggtcagccctag

SEQ ID NO: 728240 - DNA, 15 bp, Homo sapiens
tgggatctgtcttgg

SEQ ID NO: 728241 - DNA, 20 bp, Homo sapiens
tgggatctgtcttggcatta

SEQ ID NO: 728242 - DNA, 20 bp, Homo sapiens
tgggatgccaatttcctctc

SEQ ID NO: 728243 - DNA, 15 bp, Homo sapiens
tgggatgcctcacca

SEQ ID NO: 728244 - DNA, 23 bp, Homo sapiens
tgggatggagagtggggagaggc

SEQ ID NO: 728245 - DNA, 16 bp, Homo sapiens
tgggatggaggagaag

SEQ ID NO: 728246 - DNA, 18 bp, Homo sapiens
tgggatgggctctacctc

SEQ ID NO: 728247 - DNA, 17 bp, Homo sapiens
tgggatgggttccagag

SEQ ID NO: 728248 - DNA, 21 bp, Homo sapiens
tgggatggtcggatctcacag

SEQ ID NO: 728249 - DNA, 16 bp, Homo sapiens
tgggatggtggagggc

SEQ ID NO: 728250 - DNA, 17 bp, Homo sapiens
tgggatggtggagggcc

SEQ ID NO: 728251 - DNA, 13 bp, Homo sapiens
tgggatgtagaac

SEQ ID NO: 728252 - DNA, 14 bp, Homo sapiens
tgggatgtcacagt

SEQ ID NO: 728253 - DNA, 17 bp, Homo sapiens
tgggatgtcacagtcca

SEQ ID NO: 728254 - DNA, 21 bp, Homo sapiens
tgggatgttcagcactgtccc

SEQ ID NO: 728255 - DNA, 22 bp, Homo sapiens
tgggatgttcagcactgtccct

SEQ ID NO: 728256 - DNA, 13 bp, Homo sapiens
tgggattattctt

SEQ ID NO: 728257 - DNA, 17 bp, Homo sapiens
tgggattcctgacccag

SEQ ID NO: 728258 - DNA, 21 bp, Homo sapiens
tgggattcctgacccaggccg

SEQ ID NO: 728259 - DNA, 17 bp, Homo sapiens
tgggattctactttaag

SEQ ID NO: 728260 - DNA, 19 bp, Homo sapiens
tgggattgagtctgtgcca

SEQ ID NO: 728261 - DNA, 21 bp, Homo sapiens
tgggattgggggctggtgcca

SEQ ID NO: 728262 - DNA, 17 bp, Homo sapiens
tgggattggggggaaag

SEQ ID NO: 728263 - DNA, 19 bp, Homo sapiens
tgggatttcttcgctgctc

SEQ ID NO: 728264 - DNA, 14 bp, Homo sapiens
tgggcaaagcttgt

SEQ ID NO: 728265 - DNA, 15 bp, Homo sapiens
tgggcaaaggcaggg

SEQ ID NO: 728266 - DNA, 16 bp, Homo sapiens
tgggcaacagagcaag

SEQ ID NO: 728267 - DNA, 15 bp, Homo sapiens
tgggcaactggctga

SEQ ID NO: 728268 - DNA, 15 bp, Homo sapiens
tgggcaagtcactta

SEQ ID NO: 728269 - DNA, 15 bp, Homo sapiens
tgggcaagtgattga

SEQ ID NO: 728270 - DNA, 19 bp, Homo sapiens
tgggcaatgatggcaattt

SEQ ID NO: 728271 - DNA, 22 bp, Homo sapiens
tgggcacacgcctcccactggg

SEQ ID NO: 728272 - DNA, 15 bp, Homo sapiens
tgggcacagtgctgc

SEQ ID NO: 728273 - DNA, 18 bp, Homo sapiens
tgggcaccacaaaatata

SEQ ID NO: 728274 - DNA, 19 bp, Homo sapiens
tgggcacccacctccaccc

SEQ ID NO: 728275 - DNA, 16 bp, Homo sapiens
tgggcaccccactgca

SEQ ID NO: 728276 - DNA, 16 bp, Homo sapiens
tgggcaccgtgtcctc

SEQ ID NO: 728277 - DNA, 18 bp, Homo sapiens
tgggcaccgtgtcctcct

SEQ ID NO: 728278 - DNA, 15 bp, Homo sapiens
tgggcacctcagaaa

SEQ ID NO: 728279 - DNA, 21 bp, Homo sapiens
tgggcacctcagaaagtcacc

SEQ ID NO: 728280 - DNA, 16 bp, Homo sapiens
tgggcacctgacttgg

SEQ ID NO: 728281 - DNA, 16 bp, Homo sapiens
tgggcacgcctgctgg

SEQ ID NO: 728282 - DNA, 20 bp, Homo sapiens
tgggcactatttatttacaa

SEQ ID NO: 728283 - DNA, 16 bp, Homo sapiens
tgggcactgctccaag

SEQ ID NO: 728284 - DNA, 19 bp, Homo sapiens
tgggcactgctccaaggga

SEQ ID NO: 728285 - DNA, 16 bp, Homo sapiens
tgggcactgggatgag

SEQ ID NO: 728286 - DNA, 15 bp, Homo sapiens
tgggcagaagggaga

SEQ ID NO: 728287 - DNA, 22 bp, Homo sapiens
tgggcagagcctgtccccgcct

SEQ ID NO: 728288 - DNA, 20 bp, Homo sapiens
tgggcagagctggctctgag

SEQ ID NO: 728289 - DNA, 13 bp, Homo sapiens
tgggcagcaaggc

SEQ ID NO: 728290 - DNA, 14 bp, Homo sapiens
tgggcagcaaggct

SEQ ID NO: 728291 - DNA, 20 bp, Homo sapiens
tgggcagcaaggctgctgcc

SEQ ID NO: 728292 - DNA, 21 bp, Homo sapiens
tgggcagcaatttaaatgtta

SEQ ID NO: 728293 - DNA, 12 bp, Homo sapiens
tgggcagcaccc

SEQ ID NO: 728294 - DNA, 16 bp, Homo sapiens
tgggcagcatagcaag

SEQ ID NO: 728295 - DNA, 13 bp, Homo sapiens
tgggcagccagac

SEQ ID NO: 728296 - DNA, 12 bp, Homo sapiens
tgggcagcccca

SEQ ID NO: 728297 - DNA, 14 bp, Homo sapiens
tgggcagccccaca

SEQ ID NO: 728298 - DNA, 12 bp, Homo sapiens
tgggcagcccgc

SEQ ID NO: 728299 - DNA, 22 bp, Homo sapiens
tgggcagcctgctttggccttt

SEQ ID NO: 728300 - DNA, 21 bp, Homo sapiens
tgggcagctatccagtgactt

SEQ ID NO: 728301 - DNA, 18 bp, Homo sapiens
tgggcagctccatcctct

SEQ ID NO: 728302 - DNA, 14 bp, Homo sapiens
tgggcagctgggcc

SEQ ID NO: 728303 - DNA, 21 bp, Homo sapiens
tgggcagcttagggccctgga

SEQ ID NO: 728304 - DNA, 22 bp, Homo sapiens
tggggattcaggggctttgggc

SEQ ID NO: 728305 - DNA, 17 bp, Homo sapiens
tggggatttctcccagc

SEQ ID NO: 728306 - DNA, 16 bp, Homo sapiens
tggggcaaagcctcct

SEQ ID NO: 728307 - DNA, 12 bp, Homo sapiens
tggggcaagcca

SEQ ID NO: 728308 - DNA, 13 bp, Homo sapiens
tggggcaagccag

SEQ ID NO: 728309 - DNA, 14 bp, Homo sapiens
tggggcaagccagg

SEQ ID NO: 728310 - DNA, 16 bp, Homo sapiens
tggggcaagccagggc

SEQ ID NO: 728311 - DNA, 17 bp, Homo sapiens
tggggcaagccagggcc

SEQ ID NO: 728312 - DNA, 18 bp, Homo sapiens
tggggcaagccagggccc

SEQ ID NO: 728313 - DNA, 14 bp, Homo sapiens
tggggcactgggcg

SEQ ID NO: 728314 - DNA, 23 bp, Homo sapiens
tggggcactgggcgtctgactcc

SEQ ID NO: 728315 - DNA, 14 bp, Homo sapiens
tggggcagaggggc

SEQ ID NO: 728316 - DNA, 16 bp, Homo sapiens
tggggcagaggggcag

SEQ ID NO: 728317 - DNA, 17 bp, Homo sapiens
tggggcagaggggcagc

SEQ ID NO: 728318 - DNA, 17 bp, Homo sapiens
tggggcaggctgggcca

SEQ ID NO: 728319 - DNA, 15 bp, Homo sapiens
tggggcatcagccag

SEQ ID NO: 728320 - DNA, 24 bp, Homo sapiens
tggggcatggcaaatcaggggcca

SEQ ID NO: 728321 - DNA, 17 bp, Homo sapiens
tggggcatgtgtgcctg

SEQ ID NO: 728322 - DNA, 19 bp, Homo sapiens
tggggccactttcagagcc

SEQ ID NO: 728323 - DNA, 19 bp, Homo sapiens
tggggccatgcctcctcag

SEQ ID NO: 728324 - DNA, 21 bp, Homo sapiens
tggggccatgcctcctcagga

SEQ ID NO: 728325 - DNA, 15 bp, Homo sapiens
tggggccatggtgga

SEQ ID NO: 728326 - DNA, 21 bp, Homo sapiens
tggggccatggtggagggcac

SEQ ID NO: 728327 - DNA, 17 bp, Homo sapiens
tggggcccaagttgcag

SEQ ID NO: 728328 - DNA, 22 bp, Homo sapiens
tggggcccaagttgcagtgagc

SEQ ID NO: 728329 - DNA, 19 bp, Homo sapiens
tggggccccatcagctgcc

SEQ ID NO: 728330 - DNA, 22 bp, Homo sapiens
tggggcccctttttactcccct

SEQ ID NO: 728331 - DNA, 14 bp, Homo sapiens
tggggccctctatg

SEQ ID NO: 728332 - DNA, 14 bp, Homo sapiens
tggggccctcttgc

SEQ ID NO: 728333 - DNA, 22 bp, Homo sapiens
tggggccctcttgccagcctcc

SEQ ID NO: 728334 - DNA, 12 bp, Homo sapiens
tggggccctgcc

SEQ ID NO: 728335 - DNA, 15 bp, Homo sapiens
tggggccctgcccct

SEQ ID NO: 728336 - DNA, 12 bp, Homo sapiens
tggggccctggg

SEQ ID NO: 728337 - DNA, 17 bp, Homo sapiens
tggggccctgggcctca

SEQ ID NO: 728338 - DNA, 19 bp, Homo sapiens
tggggccctgggcctcagt

SEQ ID NO: 728339 - DNA, 15 bp, Homo sapiens
tggggcccttggccc

SEQ ID NO: 728340 - DNA, 20 bp, Homo sapiens
tggggcccttggccccagag

SEQ ID NO: 728341 - DNA, 16 bp, Homo sapiens
tggggccgcctgccct

SEQ ID NO: 728342 - DNA, 17 bp, Homo sapiens
tggggccgcctgccctg

SEQ ID NO: 728343 - DNA, 20 bp, Homo sapiens
tggggccgcctgccctgcct

SEQ ID NO: 728344 - DNA, 21 bp, Homo sapiens
tggggccgcctgccctgcctt

SEQ ID NO: 728345 - DNA, 22 bp, Homo sapiens
tggggccgcctgccctgccttg

SEQ ID NO: 728346 - DNA, 15 bp, Homo sapiens
tggggccggggctga

SEQ ID NO: 728347 - DNA, 21 bp, Homo sapiens
tggggcctagcgatctctcct

SEQ ID NO: 728348 - DNA, 14 bp, Homo sapiens
tggggcctcagacc

SEQ ID NO: 728349 - DNA, 14 bp, Homo sapiens
tggggcctcagcct

SEQ ID NO: 728350 - DNA, 15 bp, Homo sapiens
tggggcctcagcctg

SEQ ID NO: 728351 - DNA, 17 bp, Homo sapiens
tggggcctcagcctggg

SEQ ID NO: 728352 - DNA, 19 bp, Homo sapiens
tggggcctcagcctggggc

SEQ ID NO: 728353 - DNA, 11 bp, Homo sapiens
tggggcctgag

SEQ ID NO: 728354 - DNA, 14 bp, Homo sapiens
tggggcctgagaga

SEQ ID NO: 728355 - DNA, 18 bp, Homo sapiens
tggggcctgagagaattg

SEQ ID NO: 728356 - DNA, 16 bp, Homo sapiens
tggggcctggacctgc

SEQ ID NO: 728357 - DNA, 11 bp, Homo sapiens
tggggcctggc

SEQ ID NO: 728358 - DNA, 16 bp, Homo sapiens
tggggcctggcttgct

SEQ ID NO: 728359 - DNA, 23 bp, Homo sapiens
tggggcctggcttgctccagggt

SEQ ID NO: 728360 - DNA, 20 bp, Homo sapiens
tggggccttcgggaccctgg

SEQ ID NO: 728361 - DNA, 22 bp, Homo sapiens
tggggcgaattcatcccctccc

SEQ ID NO: 728362 - DNA, 19 bp, Homo sapiens
tggggcggagctggggtct

SEQ ID NO: 728363 - DNA, 19 bp, Homo sapiens
tggggcggtgtgtgtgcca

SEQ ID NO: 728364 - DNA, 14 bp, Homo sapiens
tggggcgtggggag

SEQ ID NO: 728365 - DNA, 15 bp, Homo sapiens
tggggctacaggatg

SEQ ID NO: 728366 - DNA, 20 bp, Homo sapiens
tggggctagggggagcccct

SEQ ID NO: 728367 - DNA, 17 bp, Homo sapiens
tggggctcacacacctg

SEQ ID NO: 728368 - DNA, 19 bp, Homo sapiens
tggggctcacggggcctcc

SEQ ID NO: 728369 - DNA, 21 bp, Homo sapiens
tggggctcacggggcctccaa

SEQ ID NO: 728370 - DNA, 15 bp, Homo sapiens
tggggctccctctct

SEQ ID NO: 728371 - DNA, 21 bp, Homo sapiens
tggggctcctttctccagcca

SEQ ID NO: 728372 - DNA, 13 bp, Homo sapiens
tggggctcgccat

SEQ ID NO: 728373 - DNA, 15 bp, Homo sapiens
tggggctcgtggcct

SEQ ID NO: 728374 - DNA, 21 bp, Homo sapiens
tggggctcgtggccttcccct

SEQ ID NO: 728375 - DNA, 20 bp, Homo sapiens
tggggctgaacatgcctgcc

SEQ ID NO: 728376 - DNA, 16 bp, Homo sapiens
tggggctgcaggcagg

SEQ ID NO: 728377 - DNA, 20 bp, Homo sapiens
tggggctgcagttggtctcc

SEQ ID NO: 728378 - DNA, 15 bp, Homo sapiens
tggggctgccagcct

SEQ ID NO: 728379 - DNA, 22 bp, Homo sapiens
tggggctgccatagggtctgca

SEQ ID NO: 728380 - DNA, 13 bp, Homo sapiens
tggggctgccgga

SEQ ID NO: 728381 - DNA, 23 bp, Homo sapiens
tggggctgccggatctgggctgt

SEQ ID NO: 728382 - DNA, 14 bp, Homo sapiens
tggggctgctcctc

SEQ ID NO: 728383 - DNA, 15 bp, Homo sapiens
tggggctgctcctcc

SEQ ID NO: 728384 - DNA, 21 bp, Homo sapiens
tggggctgctcctccagggcc

SEQ ID NO: 728385 - DNA, 18 bp, Homo sapiens
tggggctggggaagagga

SEQ ID NO: 728386 - DNA, 22 bp, Homo sapiens
tggggctgtatttatctctgag

SEQ ID NO: 728387 - DNA, 18 bp, Homo sapiens
tggggcttcacagccaca

SEQ ID NO: 728388 - DNA, 20 bp, Homo sapiens
tggggcttcaccagtctgtc

SEQ ID NO: 728389 - DNA, 18 bp, Homo sapiens
tggggcttctcctgaccc

SEQ ID NO: 728390 - DNA, 18 bp, Homo sapiens
tgggggaaaaaaaagaaa

SEQ ID NO: 728391 - DNA, 15 bp, Homo sapiens
tgggggaaaaaaagt

SEQ ID NO: 728392 - DNA, 21 bp, Homo sapiens
tgggggaaggggaggagggga

SEQ ID NO: 728393 - DNA, 14 bp, Homo sapiens
tgggggacagagaa

SEQ ID NO: 728394 - DNA, 20 bp, Homo sapiens
tgggggaccctgtgcatctg

SEQ ID NO: 728395 - DNA, 17 bp, Homo sapiens
tgggggacgtttctcat

SEQ ID NO: 728396 - DNA, 11 bp, Homo sapiens
tgggggagaga

SEQ ID NO: 728397 - DNA, 13 bp, Homo sapiens
tgggggagagcag

SEQ ID NO: 728398 - DNA, 20 bp, Homo sapiens
tgggggagattctgggtttg

SEQ ID NO: 728399 - DNA, 17 bp, Homo sapiens
tgggggaggcagggctg

SEQ ID NO: 728400 - DNA, 16 bp, Homo sapiens
tgggggagggaagacc

SEQ ID NO: 728401 - DNA, 20 bp, Homo sapiens
tgggggatcacagcctctga

SEQ ID NO: 728402 - DNA, 23 bp, Homo sapiens
tgggggcaccgggctccatgcct

SEQ ID NO: 728403 - DNA, 14 bp, Homo sapiens
tgggggcagcccag

SEQ ID NO: 728404 - DNA, 22 bp, Homo sapiens
tgggggcaggaaagccacatct

SEQ ID NO: 728405 - DNA, 22 bp, Homo sapiens
tgggggcaggagggccctacct

SEQ ID NO: 728406 - DNA, 20 bp, Homo sapiens
tgggggcagtgactggcagg

SEQ ID NO: 728407 - DNA, 18 bp, Homo sapiens
tgggggccacctgcctgc

SEQ ID NO: 728408 - DNA, 13 bp, Homo sapiens
tgggggccaggcc

SEQ ID NO: 728409 - DNA, 14 bp, Homo sapiens
tgggggccaggcct

SEQ ID NO: 728410 - DNA, 16 bp, Homo sapiens
tgggggccagggctgg

SEQ ID NO: 728411 - DNA, 22 bp, Homo sapiens
tgggggcccgacaggtgggcct

SEQ ID NO: 728412 - DNA, 14 bp, Homo sapiens
tgggggctagggag

SEQ ID NO: 728413 - DNA, 21 bp, Homo sapiens
tgggggctgcagcatgttgct

SEQ ID NO: 728414 - DNA, 16 bp, Homo sapiens
tgggggctggaggtgc

SEQ ID NO: 728415 - DNA, 20 bp, Homo sapiens
tgggggctggctcccagggt

SEQ ID NO: 728416 - DNA, 13 bp, Homo sapiens
tgggggctggtgc

SEQ ID NO: 728417 - DNA, 15 bp, Homo sapiens
tgggggctggtgcca

SEQ ID NO: 728418 - DNA, 22 bp, Homo sapiens
tgggggctgtctttgcagggca

SEQ ID NO: 728419 - DNA, 20 bp, Homo sapiens
tgggggctttccttttattt

SEQ ID NO: 728420 - DNA, 21 bp, Homo sapiens
tgggggctttcggggagggcg

SEQ ID NO: 728421 - DNA, 20 bp, Homo sapiens
tggggggccaaagaaggcag

SEQ ID NO: 728422 - DNA, 17 bp, Homo sapiens
tggggggccaacaccag

SEQ ID NO: 728423 - DNA, 13 bp, Homo sapiens
tggtaattgttgc

SEQ ID NO: 728424 - DNA, 22 bp, Homo sapiens
tggtaatttaagattccagaga

SEQ ID NO: 728425 - DNA, 15 bp, Homo sapiens
tggtacaaaaataaa

SEQ ID NO: 728426 - DNA, 19 bp, Homo sapiens
tggtacaaaaataaattta

SEQ ID NO: 728427 - DNA, 21 bp, Homo sapiens
tggtacaaaaataaatttata

SEQ ID NO: 728428 - DNA, 15 bp, Homo sapiens
tggtacatggtgttt

SEQ ID NO: 728429 - DNA, 18 bp, Homo sapiens
tggtacatggtgtttgtg

SEQ ID NO: 728430 - DNA, 13 bp, Homo sapiens
tggtacatgtctt

SEQ ID NO: 728431 - DNA, 15 bp, Homo sapiens
tggtaccctcctggc

SEQ ID NO: 728432 - DNA, 16 bp, Homo sapiens
tggtaccctcctggct

SEQ ID NO: 728433 - DNA, 21 bp, Homo sapiens
tggtaccctcctggctcttga

SEQ ID NO: 728434 - DNA, 15 bp, Homo sapiens
tggtacctatttgac

SEQ ID NO: 728435 - DNA, 14 bp, Homo sapiens
tggtaccttcagcc

SEQ ID NO: 728436 - DNA, 22 bp, Homo sapiens
tggtcccctccctcgtgggctt

SEQ ID NO: 728437 - DNA, 19 bp, Homo sapiens
tggtccctcttctctcctc

SEQ ID NO: 728438 - DNA, 23 bp, Homo sapiens
tggtccctggaagcttaaagtat

SEQ ID NO: 728439 - DNA, 22 bp, Homo sapiens
tggtccctgttttcccacgagg

SEQ ID NO: 728440 - DNA, 20 bp, Homo sapiens
tggtccgtgggacggtgccc

SEQ ID NO: 728441 - DNA, 23 bp, Homo sapiens
tggtcctcacaagcctcttctga

SEQ ID NO: 728442 - DNA, 12 bp, Homo sapiens
tggtcctccact

SEQ ID NO: 728443 - DNA, 19 bp, Homo sapiens
tggtcctccactttgctgg

SEQ ID NO: 728444 - DNA, 15 bp, Homo sapiens
tggtcctctctctgt

SEQ ID NO: 728445 - DNA, 16 bp, Homo sapiens
tggtcctctctctgtg

SEQ ID NO: 728446 - DNA, 22 bp, Homo sapiens
tggtcctctctctgtggggctg

SEQ ID NO: 728447 - DNA, 19 bp, Homo sapiens
tggtcctgactcaacatgt

SEQ ID NO: 728448 - DNA, 20 bp, Homo sapiens
tggtcctgagggtccccacc

SEQ ID NO: 728449 - DNA, 17 bp, Homo sapiens
tggtcctggacacctcc

SEQ ID NO: 728450 - DNA, 20 bp, Homo sapiens
tggtcctggacacctcccag

SEQ ID NO: 728451 - DNA, 13 bp, Homo sapiens
tggtcctggctgc

SEQ ID NO: 728452 - DNA, 16 bp, Homo sapiens
tggtcctggggctctg

SEQ ID NO: 728453 - DNA, 12 bp, Homo sapiens
tggtcctgtctg

SEQ ID NO: 728454 - DNA, 16 bp, Homo sapiens
tggtcctgtctgtcct

SEQ ID NO: 728455 - DNA, 13 bp, Homo sapiens
tggtcctgtggat

SEQ ID NO: 728456 - DNA, 23 bp, Homo sapiens
tggtccttccaggcccccaccac

SEQ ID NO: 728457 - DNA, 15 bp, Homo sapiens
tggtccttctgaccc

SEQ ID NO: 728458 - DNA, 21 bp, Homo sapiens
tggtcctttacactcaggctt

SEQ ID NO: 728459 - DNA, 21 bp, Homo sapiens
tggtcgagtctttgtgtgtta

SEQ ID NO: 728460 - DNA, 14 bp, Homo sapiens
tggtcgagtgacac

SEQ ID NO: 728461 - DNA, 20 bp, Homo sapiens
tggtcggatctcacaggctg

SEQ ID NO: 728462 - DNA, 18 bp, Homo sapiens
tggtctaaagtgtttagc

SEQ ID NO: 728463 - DNA, 21 bp, Homo sapiens
tggtctaaagtgtttagctgt

SEQ ID NO: 728464 - DNA, 21 bp, Homo sapiens
tggtctataaaataaacttct

SEQ ID NO: 728465 - DNA, 23 bp, Homo sapiens
tggtctataaaataaacttctta

SEQ ID NO: 728466 - DNA, 19 bp, Homo sapiens
tggtctatctttgagcgcc

SEQ ID NO: 728467 - DNA, 18 bp, Homo sapiens
tggtctattttctgcaga

SEQ ID NO: 728468 - DNA, 21 bp, Homo sapiens
tggtctcaaacttgtggcctc

SEQ ID NO: 728469 - DNA, 12 bp, Homo sapiens
tggtctcagaaa

SEQ ID NO: 728470 - DNA, 17 bp, Homo sapiens
tggtctcaggcagcacc

SEQ ID NO: 728471 - DNA, 20 bp, Homo sapiens
tggtctcaggcagcaccaca

SEQ ID NO: 728472 - DNA, 17 bp, Homo sapiens
tggtctcgaactcctgg

SEQ ID NO: 728473 - DNA, 20 bp, Homo sapiens
tggtctcgaactcctggcct

SEQ ID NO: 728474 - DNA, 22 bp, Homo sapiens
tggtctcgaactcctggcctcg

SEQ ID NO: 728475 - DNA, 23 bp, Homo sapiens
tggtctctagagggttgctgcct

SEQ ID NO: 728476 - DNA, 20 bp, Homo sapiens
tggtctctctccctctgtct

SEQ ID NO: 728477 - DNA, 10 bp, Homo sapiens
tggtctctgc

SEQ ID NO: 728478 - DNA, 13 bp, Homo sapiens
tggtctctgctgg

SEQ ID NO: 728479 - DNA, 17 bp, Homo sapiens
tggtctgaatgttctga

SEQ ID NO: 728480 - DNA, 18 bp, Homo sapiens
tggtctgagcaccccctc

SEQ ID NO: 728481 - DNA, 16 bp, Homo sapiens
tggtctggaaacagct

SEQ ID NO: 728482 - DNA, 19 bp, Homo sapiens
tggtctggagtcccacccg

SEQ ID NO: 728483 - DNA, 17 bp, Homo sapiens
tggtctgggacttcctt

SEQ ID NO: 728484 - DNA, 13 bp, Homo sapiens
tggtctggggaga

SEQ ID NO: 728485 - DNA, 16 bp, Homo sapiens
tggtctggtaaatatg

SEQ ID NO: 728486 - DNA, 17 bp, Homo sapiens
tggtctggttgggcagc

SEQ ID NO: 728487 - DNA, 20 bp, Homo sapiens
tggtctgtggatcagcattt

SEQ ID NO: 728488 - DNA, 22 bp, Homo sapiens
tggtctgtttgtctgaacaaag

SEQ ID NO: 728489 - DNA, 21 bp, Homo sapiens
tggtctgttttggtcccctcc

SEQ ID NO: 728490 - DNA, 17 bp, Homo sapiens
tggtcttcagcctccct

SEQ ID NO: 728491 - DNA, 19 bp, Homo sapiens
tggtcttcagcctccctca

SEQ ID NO: 728492 - DNA, 15 bp, Homo sapiens
tggtcttgagccagt

SEQ ID NO: 728493 - DNA, 23 bp, Homo sapiens
tggtcttgagccagtaatcttta

SEQ ID NO: 728494 - DNA, 17 bp, Homo sapiens
tggtcttgatcctccaa

SEQ ID NO: 728495 - DNA, 20 bp, Homo sapiens
tggtcttgatcctccaatgt

SEQ ID NO: 728496 - DNA, 16 bp, Homo sapiens
tggtcttgtggaattg

SEQ ID NO: 728497 - DNA, 14 bp, Homo sapiens
tggtcttgtttcca

SEQ ID NO: 728498 - DNA, 17 bp, Homo sapiens
tggtctttgctccagat

SEQ ID NO: 728499 - DNA, 15 bp, Homo sapiens
tggtctttgctgctg

SEQ ID NO: 728500 - DNA, 17 bp, Homo sapiens
tggtctttgctgctgct

SEQ ID NO: 728501 - DNA, 15 bp, Homo sapiens
tggtctttgtttgag

SEQ ID NO: 728502 - DNA, 13 bp, Homo sapiens
tggtcttttctcc

SEQ ID NO: 728503 - DNA, 21 bp, Homo sapiens
tggtctttttctaccttgttg

SEQ ID NO: 728504 - DNA, 21 bp, Homo sapiens
tggtgaaatcccatctctaca

SEQ ID NO: 728505 - DNA, 22 bp, Homo sapiens
tggtgaaatcccatctctacaa

SEQ ID NO: 728506 - DNA, 14 bp, Homo sapiens
tggtgaacactgtg

SEQ ID NO: 728507 - DNA, 15 bp, Homo sapiens
tggtgaacactgtga

SEQ ID NO: 728508 - DNA, 15 bp, Homo sapiens
tggtgaagtgcttgg

SEQ ID NO: 728509 - DNA, 13 bp, Homo sapiens
tggtgaagtgtgg

SEQ ID NO: 728510 - DNA, 14 bp, Homo sapiens
tggtgaagtgtggc

SEQ ID NO: 728511 - DNA, 17 bp, Homo sapiens
tggtgaagtgtggctgg

SEQ ID NO: 728512 - DNA, 18 bp, Homo sapiens
tggtgacacctccccctt

SEQ ID NO: 728513 - DNA, 21 bp, Homo sapiens
tggtgacagccttgggccttt

SEQ ID NO: 728514 - DNA, 16 bp, Homo sapiens
tggtgaccaccccctg

SEQ ID NO: 728515 - DNA, 14 bp, Homo sapiens
tggtgaccagactt

SEQ ID NO: 728516 - DNA, 22 bp, Homo sapiens
tggtgacctcctgtcactcact

SEQ ID NO: 728517 - DNA, 22 bp, Homo sapiens
tggtgacgatgggtgttgctgt

SEQ ID NO: 728518 - DNA, 15 bp, Homo sapiens
tggtgactcacttca

SEQ ID NO: 728519 - DNA, 21 bp, Homo sapiens
tggtgactcacttcaatgtgt

SEQ ID NO: 728520 - DNA, 18 bp, Homo sapiens
tggtgactgcgatcttca

SEQ ID NO: 728521 - DNA, 14 bp, Homo sapiens
tggtgactgtccca

SEQ ID NO: 728522 - DNA, 19 bp, Homo sapiens
tggtgactgtcccaccggg

SEQ ID NO: 728523 - DNA, 23 bp, Homo sapiens
tggtgagaccccgcactgcagac

SEQ ID NO: 728524 - DNA, 16 bp, Homo sapiens
tggtgagatgcagctg

SEQ ID NO: 728525 - DNA, 17 bp, Homo sapiens
tggtgagatgcagctgg

SEQ ID NO: 728526 - DNA, 20 bp, Homo sapiens
tggtgagatgcagctggaaa

SEQ ID NO: 728527 - DNA, 19 bp, Homo sapiens
tggtgagcctagccctggg

SEQ ID NO: 728528 - DNA, 18 bp, Homo sapiens
tggtgagctgggaagctg

SEQ ID NO: 728529 - DNA, 15 bp, Homo sapiens
tggtgaggggctttc

SEQ ID NO: 728530 - DNA, 16 bp, Homo sapiens
tggtgaggggctttct

SEQ ID NO: 728531 - DNA, 17 bp, Homo sapiens
tggtgaggggctttctc

SEQ ID NO: 728532 - DNA, 20 bp, Homo sapiens
tggtgaggggctttctcttc

SEQ ID NO: 728533 - DNA, 12 bp, Homo sapiens
tggtgaggtggc

SEQ ID NO: 728534 - DNA, 13 bp, Homo sapiens
tggtgaggtggcc

SEQ ID NO: 728535 - DNA, 16 bp, Homo sapiens
tggtgaggtggcccag

SEQ ID NO: 728536 - DNA, 17 bp, Homo sapiens
tggtgaggtggcccagg

SEQ ID NO: 728537 - DNA, 19 bp, Homo sapiens
tggtgaggtggcccaggcc

SEQ ID NO: 728538 - DNA, 20 bp, Homo sapiens
tggtgaggtggcccaggccc

SEQ ID NO: 728539 - DNA, 21 bp, Homo sapiens
tggtgaggtggcccaggcccc

SEQ ID NO: 728540 - DNA, 20 bp, Homo sapiens
tggtgagtcttggcggcagc

SEQ ID NO: 728541 - DNA, 13 bp, Homo sapiens
tggtgataaaaat

SEQ ID NO: 728542 - DNA, 14 bp, Homo sapiens
tggtgatgtaaaaa

SEQ ID NO: 728543 - DNA, 17 bp, Homo sapiens
tggtgatgtaaaaatgc

SEQ ID NO: 728544 - DNA, 22 bp, Homo sapiens
tggtgatgttgaaatatgcata

SEQ ID NO: 728545 - DNA, 12 bp, Homo sapiens
tggtgcaaaaaa

SEQ ID NO: 728546 - DNA, 17 bp, Homo sapiens
tggtgcaaaaaaaaact

SEQ ID NO: 728547 - DNA, 19 bp, Homo sapiens
tggtgcaaaaaaaaactta

SEQ ID NO: 728548 - DNA, 15 bp, Homo sapiens
tggtgcacagtgatt

SEQ ID NO: 728549 - DNA, 16 bp, Homo sapiens
tggtgcacgcctgagc

SEQ ID NO: 728550 - DNA, 15 bp, Homo sapiens
tggtgcactttgtaa

SEQ ID NO: 728551 - DNA, 17 bp, Homo sapiens
tggtgcactttgtaaat

SEQ ID NO: 728552 - DNA, 18 bp, Homo sapiens
tggtgcagccttcccctc

SEQ ID NO: 728553 - DNA, 19 bp, Homo sapiens
tggtgcagccttcccctcc

SEQ ID NO: 728554 - DNA, 22 bp, Homo sapiens
tggtgcagccttcccctccctg

SEQ ID NO: 728555 - DNA, 19 bp, Homo sapiens
tggtgcagggagacatctg

SEQ ID NO: 728556 - DNA, 15 bp, Homo sapiens
tggtgcattctgttt

SEQ ID NO: 728557 - DNA, 20 bp, Homo sapiens
tggtgcattctgtttcctct

SEQ ID NO: 728558 - DNA, 20 bp, Homo sapiens
tggtgccaaatagccccaga

SEQ ID NO: 728559 - DNA, 21 bp, Homo sapiens
tggtgccaaatagccccagac

SEQ ID NO: 728560 - DNA, 17 bp, Homo sapiens
tggtgccccacagctac

SEQ ID NO: 728561 - DNA, 21 bp, Homo sapiens
tggtgcctctgtgcacagtgg

SEQ ID NO: 728562 - DNA, 15 bp, Homo sapiens
tggtgcctgagaggc

SEQ ID NO: 728563 - DNA, 23 bp, Homo sapiens
tggtgccttaccaagttgtgctt

SEQ ID NO: 728564 - DNA, 16 bp, Homo sapiens
tggtgcggatggacac

SEQ ID NO: 728565 - DNA, 22 bp, Homo sapiens
tggtgctatttgaagaaaaaaa

SEQ ID NO: 728566 - DNA, 18 bp, Homo sapiens
tggtgctcctgcccagcc

SEQ ID NO: 728567 - DNA, 15 bp, Homo sapiens
tggtgctctctgcca

SEQ ID NO: 728568 - DNA, 16 bp, Homo sapiens
tggtgctctctgccac

SEQ ID NO: 728569 - DNA, 22 bp, Homo sapiens
tggtgctctgtgttcccagagg

SEQ ID NO: 728570 - DNA, 15 bp, Homo sapiens
tggtgctcttgcttt

SEQ ID NO: 728571 - DNA, 12 bp, Homo sapiens
tggtgctggata

SEQ ID NO: 728572 - DNA, 21 bp, Homo sapiens
tggtgctggatattttcaaat

SEQ ID NO: 728573 - DNA, 13 bp, Homo sapiens
tggtgctgggact

SEQ ID NO: 728574 - DNA, 12 bp, Homo sapiens
tggtgctgtggc

SEQ ID NO: 728575 - DNA, 17 bp, Homo sapiens
tggtgctgtggccaggg

SEQ ID NO: 728576 - DNA, 17 bp, Homo sapiens
tggtgcttcagccctgg

SEQ ID NO: 728577 - DNA, 18 bp, Homo sapiens
tggtgcttcagccctggc

SEQ ID NO: 728578 - DNA, 19 bp, Homo sapiens
tggtgcttccaaatattgt

SEQ ID NO: 728579 - DNA, 13 bp, Homo sapiens
tggtgcttccccc

SEQ ID NO: 728580 - DNA, 18 bp, Homo sapiens
tggtgcttcccccacccc

SEQ ID NO: 728581 - DNA, 23 bp, Homo sapiens
tggtgcttctcagatttctgagg

SEQ ID NO: 728582 - DNA, 17 bp, Homo sapiens
tggtgcttgactctcac

SEQ ID NO: 728583 - DNA, 17 bp, Homo sapiens
tggtgctttttataaaa

SEQ ID NO: 728584 - DNA, 17 bp, Homo sapiens
tggtggagccagggcct

SEQ ID NO: 728585 - DNA, 13 bp, Homo sapiens
tggtggagggcca

SEQ ID NO: 728586 - DNA, 13 bp, Homo sapiens
tggtggaggggcg

SEQ ID NO: 728587 - DNA, 15 bp, Homo sapiens
tggtggcacaggcac

SEQ ID NO: 728588 - DNA, 17 bp, Homo sapiens
tggtggcacaggcactg

SEQ ID NO: 728589 - DNA, 15 bp, Homo sapiens
tggtggcacaggccc

SEQ ID NO: 728590 - DNA, 21 bp, Homo sapiens
tggtggcaccagatgcaacct

SEQ ID NO: 728591 - DNA, 19 bp, Homo sapiens
tggtggcactgagcccccc

SEQ ID NO: 728592 - DNA, 17 bp, Homo sapiens
tggtggcagtggaggtg

SEQ ID NO: 728593 - DNA, 16 bp, Homo sapiens
tggtggccgcccaccc

SEQ ID NO: 728594 - DNA, 10 bp, Homo sapiens
tggtggcctc

SEQ ID NO: 728595 - DNA, 12 bp, Homo sapiens
tggtggcctcag

SEQ ID NO: 728596 - DNA, 18 bp, Homo sapiens
tggtggcgttatggcagc

SEQ ID NO: 728597 - DNA, 19 bp, Homo sapiens
tggtggcgttatggcagcc

SEQ ID NO: 728598 - DNA, 16 bp, Homo sapiens
tggtggctcatgcctg

SEQ ID NO: 728599 - DNA, 22 bp, Homo sapiens
tggtggctccccctctgcttct

SEQ ID NO: 728600 - DNA, 20 bp, Homo sapiens
tggtggctttttttaaaatt

SEQ ID NO: 728601 - DNA, 21 bp, Homo sapiens
tggtgggaagcgtctgtccgt

SEQ ID NO: 728602 - DNA, 22 bp, Homo sapiens
tggtgggacactgggcagcaag

SEQ ID NO: 728603 - DNA, 20 bp, Homo sapiens
tggtgggcagctgaggacac

SEQ ID NO: 728604 - DNA, 18 bp, Homo sapiens
tggtgggcttctgcgtcc

SEQ ID NO: 728605 - DNA, 11 bp, Homo sapiens
tggtggggagg

SEQ ID NO: 728606 - DNA, 13 bp, Homo sapiens
tggtggggagggg

SEQ ID NO: 728607 - DNA, 19 bp, Homo sapiens
tggtgggggttctggcagg

SEQ ID NO: 728608 - DNA, 17 bp, Homo sapiens
tggtggggttggcttcc

SEQ ID NO: 728609 - DNA, 21 bp, Homo sapiens
tggtgggttcaggggactcag

SEQ ID NO: 728610 - DNA, 13 bp, Homo sapiens
tggtgggttgatg

SEQ ID NO: 728611 - DNA, 14 bp, Homo sapiens
tggtggtactttat

SEQ ID NO: 728612 - DNA, 22 bp, Homo sapiens
tggtggtactttattcttgctg

SEQ ID NO: 728613 - DNA, 14 bp, Homo sapiens
tggtggtattctgt

SEQ ID NO: 728614 - DNA, 15 bp, Homo sapiens
tggtggtctgttggc

SEQ ID NO: 728615 - DNA, 23 bp, Homo sapiens
tggtggtcttctccaccagcccc

SEQ ID NO: 728616 - DNA, 21 bp, Homo sapiens
tggtggttaaaagggaacaca

SEQ ID NO: 728617 - DNA, 20 bp, Homo sapiens
tggtggttaaggccagggcc

SEQ ID NO: 728618 - DNA, 20 bp, Homo sapiens
tggtggttttcagagcagga

SEQ ID NO: 728619 - DNA, 22 bp, Homo sapiens
tggtggttttcagagcaggagg

SEQ ID NO: 728620 - DNA, 16 bp, Homo sapiens
tggtggtttttcagct

SEQ ID NO: 728621 - DNA, 21 bp, Homo sapiens
tggtgtactgggttaatggct

SEQ ID NO: 728622 - DNA, 21 bp, Homo sapiens
tggtgtagaacactaattcat

SEQ ID NO: 728623 - DNA, 15 bp, Homo sapiens
tggtgtatatcatga

SEQ ID NO: 728624 - DNA, 15 bp, Homo sapiens
tggtgtatttgagaa

SEQ ID NO: 728625 - DNA, 11 bp, Homo sapiens
tggtgtcatgg

SEQ ID NO: 728626 - DNA, 15 bp, Homo sapiens
tggtgtcatggctga

SEQ ID NO: 728627 - DNA, 15 bp, Homo sapiens
tggtgtcctgaccac

SEQ ID NO: 728628 - DNA, 19 bp, Homo sapiens
tggtgtcctgaccaccctc

SEQ ID NO: 728629 - DNA, 21 bp, Homo sapiens
tggtgtcctgaccaccctccc

SEQ ID NO: 728630 - DNA, 11 bp, Homo sapiens
tggtgtctccc

SEQ ID NO: 728631 - DNA, 17 bp, Homo sapiens
tggtgtctcttctttag

SEQ ID NO: 728632 - DNA, 15 bp, Homo sapiens
tggtgtgaaagtcag

SEQ ID NO: 728633 - DNA, 15 bp, Homo sapiens
tggtgtgaagaaagc

SEQ ID NO: 728634 - DNA, 13 bp, Homo sapiens
tggtgtgaagact

SEQ ID NO: 728635 - DNA, 19 bp, Homo sapiens
tggtgtgaccatgttcatt

SEQ ID NO: 728636 - DNA, 12 bp, Homo sapiens
tggtgtgatctt

SEQ ID NO: 728637 - DNA, 22 bp, Homo sapiens
tggtgtgatcttaatatatttg

SEQ ID NO: 728638 - DNA, 20 bp, Homo sapiens
tggtgtgcggaggcaggagc

SEQ ID NO: 728639 - DNA, 16 bp, Homo sapiens
tggtgtggattttcta

SEQ ID NO: 728640 - DNA, 20 bp, Homo sapiens
tggtgtgggtaaagggacag

SEQ ID NO: 728641 - DNA, 22 bp, Homo sapiens
tggtgtgtcccattggtgttgt

SEQ ID NO: 728642 - DNA, 21 bp, Homo sapiens
tggtgtgttggacagagaagg

SEQ ID NO: 728643 - DNA, 16 bp, Homo sapiens
tggtgttaaagctgta

SEQ ID NO: 728644 - DNA, 14 bp, Homo sapiens
tggtgttcctggaa

SEQ ID NO: 728645 - DNA, 19 bp, Homo sapiens
tggtgttctgaagtgggaa

SEQ ID NO: 728646 - DNA, 16 bp, Homo sapiens
tggtgtttcccttcct

SEQ ID NO: 728647 - DNA, 16 bp, Homo sapiens
tggtgtttgtaggctg

SEQ ID NO: 728648 - DNA, 21 bp, Homo sapiens
tggtgtttgtaggctgtgggg

SEQ ID NO: 728649 - DNA, 17 bp, Homo sapiens
tggtgttttatttccta

SEQ ID NO: 728650 - DNA, 22 bp, Homo sapiens
tggtgttttttgttactgtttt

SEQ ID NO: 728651 - DNA, 16 bp, Homo sapiens
tggttaaaaaggccaa

SEQ ID NO: 728652 - DNA, 21 bp, Homo sapiens
tggttaaaaaggccaaagata

SEQ ID NO: 728653 - DNA, 16 bp, Homo sapiens
tggttaagaactgtga

SEQ ID NO: 728654 - DNA, 21 bp, Homo sapiens
tggttaaggccagggcctctc

SEQ ID NO: 728655 - DNA, 22 bp, Homo sapiens
tggttaataaaactgcacagtg

SEQ ID NO: 728656 - DNA, 12 bp, Homo sapiens
tggttaattttt

SEQ ID NO: 728657 - DNA, 21 bp, Homo sapiens
tggttaatttttcctgcatgt

SEQ ID NO: 728658 - DNA, 23 bp, Homo sapiens
tggttaccactcttttgctgtgc

SEQ ID NO: 728659 - DNA, 15 bp, Homo sapiens
tggttaccatgtctt

SEQ ID NO: 728660 - DNA, 20 bp, Homo sapiens
tggttaccgagtatctgtaa

SEQ ID NO: 728661 - DNA, 22 bp, Homo sapiens
tggttaccgagtatctgtaacc

SEQ ID NO: 728662 - DNA, 20 bp, Homo sapiens
tggttacctgacctaaatta

SEQ ID NO: 728663 - DNA, 16 bp, Homo sapiens
tggttacctgttccat

SEQ ID NO: 728664 - DNA, 14 bp, Homo sapiens
tggttacttcttct

SEQ ID NO: 728665 - DNA, 13 bp, Homo sapiens
tggttagaaatgc

SEQ ID NO: 728666 - DNA, 17 bp, Homo sapiens
tggttagaatcttgttt

SEQ ID NO: 728667 - DNA, 23 bp, Homo sapiens
tggttagacgccttccaggtcag

SEQ ID NO: 728668 - DNA, 15 bp, Homo sapiens
tggttagaggaaggc

SEQ ID NO: 728669 - DNA, 14 bp, Homo sapiens
tggttagtgatgca

SEQ ID NO: 728670 - DNA, 15 bp, Homo sapiens
tggttagtgatgcag

SEQ ID NO: 728671 - DNA, 16 bp, Homo sapiens
tggttagtgatgcagt

SEQ ID NO: 728672 - DNA, 16 bp, Homo sapiens
tggttataacttaatg

SEQ ID NO: 728673 - DNA, 17 bp, Homo sapiens
tgtaaaagcattttgta

SEQ ID NO: 728674 - DNA, 18 bp, Homo sapiens
tgtaaaagcattttgtaa

SEQ ID NO: 728675 - DNA, 19 bp, Homo sapiens
tgtaaaagcattttgtaat

SEQ ID NO: 728676 - DNA, 14 bp, Homo sapiens
tgtaaaagttataa

SEQ ID NO: 728677 - DNA, 13 bp, Homo sapiens
tgtaactgctcag

SEQ ID NO: 728678 - DNA, 19 bp, Homo sapiens
tgtaactgctgagccactc

SEQ ID NO: 728679 - DNA, 14 bp, Homo sapiens
tgtaacttagcttt

SEQ ID NO: 728680 - DNA, 15 bp, Homo sapiens
tgtaacttagcttta

SEQ ID NO: 728681 - DNA, 16 bp, Homo sapiens
tgtaacttagctttat

SEQ ID NO: 728682 - DNA, 17 bp, Homo sapiens
tgtaacttatattgaag

SEQ ID NO: 728683 - DNA, 20 bp, Homo sapiens
tgtaacttatattgaagaca

SEQ ID NO: 728684 - DNA, 16 bp, Homo sapiens
tgtaacttcctgctgc

SEQ ID NO: 728685 - DNA, 23 bp, Homo sapiens
tgtaacttcctgctgcaccctgc

SEQ ID NO: 728686 - DNA, 19 bp, Homo sapiens
tgtaatttcgccttaaact

SEQ ID NO: 728687 - DNA, 15 bp, Homo sapiens
tgtaatttgaattgg

SEQ ID NO: 728688 - DNA, 19 bp, Homo sapiens
tgtaatttgatgaggtatt

SEQ ID NO: 728689 - DNA, 16 bp, Homo sapiens
tgtaatttgcattact

SEQ ID NO: 728690 - DNA, 15 bp, Homo sapiens
tgtaatttgtacagg

SEQ ID NO: 728691 - DNA, 16 bp, Homo sapiens
tgtaattttatatgaa

SEQ ID NO: 728692 - DNA, 20 bp, Homo sapiens
tgtaattttattttaaaatt

SEQ ID NO: 728693 - DNA, 23 bp, Homo sapiens
tgtaattttattttaaaatttca

SEQ ID NO: 728694 - DNA, 20 bp, Homo sapiens
tgtacaaaactgtaaataaa

SEQ ID NO: 728695 - DNA, 17 bp, Homo sapiens
tgtacaaaataaacaaa

SEQ ID NO: 728696 - DNA, 15 bp, Homo sapiens
tgtacaaccctgacc

SEQ ID NO: 728697 - DNA, 15 bp, Homo sapiens
tgtacaaggatgaaa

SEQ ID NO: 728698 - DNA, 17 bp, Homo sapiens
tgtacaaggtaattgtt

SEQ ID NO: 728699 - DNA, 18 bp, Homo sapiens
tgtacaaggtaattgttt

SEQ ID NO: 728700 - DNA, 15 bp, Homo sapiens
tgtacaagttgttat

SEQ ID NO: 728701 - DNA, 19 bp, Homo sapiens
tgtacaagttttgtataaa

SEQ ID NO: 728702 - DNA, 16 bp, Homo sapiens
tgtacaataaaaacat

SEQ ID NO: 728703 - DNA, 20 bp, Homo sapiens
tgtacaataaaaacattgcc

SEQ ID NO: 728704 - DNA, 16 bp, Homo sapiens
tgtacaatacaatgta

SEQ ID NO: 728705 - DNA, 22 bp, Homo sapiens
tgtacaatcatgaacagctctg

SEQ ID NO: 728706 - DNA, 18 bp, Homo sapiens
tgtacaatgactttattg

SEQ ID NO: 728707 - DNA, 18 bp, Homo sapiens
tgtacaatggtttattcc

SEQ ID NO: 728708 - DNA, 20 bp, Homo sapiens
tgtacacatctattctcaaa

SEQ ID NO: 728709 - DNA, 13 bp, Homo sapiens
tgtacacgggact

SEQ ID NO: 728710 - DNA, 14 bp, Homo sapiens
tgtacacgggactg

SEQ ID NO: 728711 - DNA, 17 bp, Homo sapiens
tgtacactgacttgaga

SEQ ID NO: 728712 - DNA, 22 bp, Homo sapiens
tgtacagaacacatttctctga

SEQ ID NO: 728713 - DNA, 20 bp, Homo sapiens
tgtacagacatatttaactg

SEQ ID NO: 728714 - DNA, 21 bp, Homo sapiens
tgtacagactgttttactgtt

SEQ ID NO: 728715 - DNA, 15 bp, Homo sapiens
tgtacagatcaagaa

SEQ ID NO: 728716 - DNA, 14 bp, Homo sapiens
tgtacagattttat

SEQ ID NO: 728717 - DNA, 15 bp, Homo sapiens
tgtacagcacagaat

SEQ ID NO: 728718 - DNA, 16 bp, Homo sapiens
tgtacagcacagaatg

SEQ ID NO: 728719 - DNA, 17 bp, Homo sapiens
tgtacagcacagaatga

SEQ ID NO: 728720 - DNA, 18 bp, Homo sapiens
tgtacagctcccttccct

SEQ ID NO: 728721 - DNA, 11 bp, Homo sapiens
tgtacagctct

SEQ ID NO: 728722 - DNA, 20 bp, Homo sapiens
tgtacagctctcccctccct

SEQ ID NO: 728723 - DNA, 20 bp, Homo sapiens
tgtacaggactgtaaagatt

SEQ ID NO: 728724 - DNA, 15 bp, Homo sapiens
tgtacaggggccatg

SEQ ID NO: 728725 - DNA, 20 bp, Homo sapiens
tgtacagtaatatgtttaat

SEQ ID NO: 728726 - DNA, 23 bp, Homo sapiens
tgtacagtaatatgtttaatgtt

SEQ ID NO: 728727 - DNA, 17 bp, Homo sapiens
tgtacagtagattttcc

SEQ ID NO: 728728 - DNA, 14 bp, Homo sapiens
tgtacagtcttgta

SEQ ID NO: 728729 - DNA, 18 bp, Homo sapiens
tgtacagtgaattgtctt

SEQ ID NO: 728730 - DNA, 15 bp, Homo sapiens
tgtacagtgtctttt

SEQ ID NO: 728731 - DNA, 22 bp, Homo sapiens
tgtacagtgtctttttttgtat

SEQ ID NO: 728732 - DNA, 23 bp, Homo sapiens
tgtacagttaactctcccaggtg

SEQ ID NO: 728733 - DNA, 19 bp, Homo sapiens
tgtacataaactgtcactc

SEQ ID NO: 728734 - DNA, 23 bp, Homo sapiens
tgtacataactctgtaaaaacac

SEQ ID NO: 728735 - DNA, 19 bp, Homo sapiens
tgtacataactgaaaatgt

SEQ ID NO: 728736 - DNA, 14 bp, Homo sapiens
tgtacatacaaatt

SEQ ID NO: 728737 - DNA, 15 bp, Homo sapiens
tgtacatacattgta

SEQ ID NO: 728738 - DNA, 14 bp, Homo sapiens
tgtacatagattta

SEQ ID NO: 728739 - DNA, 18 bp, Homo sapiens
tgtacatagttatttatt

SEQ ID NO: 728740 - DNA, 19 bp, Homo sapiens
tgtacatatgtaaaataaa

SEQ ID NO: 728741 - DNA, 20 bp, Homo sapiens
tgtacatatgtgctggaatt

SEQ ID NO: 728742 - DNA, 16 bp, Homo sapiens
tgtacatgaaaacaca

SEQ ID NO: 728743 - DNA, 22 bp, Homo sapiens
tgtacatgaagaagctaaatcc

SEQ ID NO: 728744 - DNA, 16 bp, Homo sapiens
tgtacatgagaaggaa

SEQ ID NO: 728745 - DNA, 21 bp, Homo sapiens
tgtacatggaataacatgtaa

SEQ ID NO: 728746 - DNA, 12 bp, Homo sapiens
tgtacatgtgta

SEQ ID NO: 728747 - DNA, 16 bp, Homo sapiens
tgtacattctgcctag

SEQ ID NO: 728748 - DNA, 19 bp, Homo sapiens
tgtacattgtgagctctgg

SEQ ID NO: 728749 - DNA, 15 bp, Homo sapiens
tgtacatttaaaatt

SEQ ID NO: 728750 - DNA, 14 bp, Homo sapiens
tgtacatttattca

SEQ ID NO: 728751 - DNA, 19 bp, Homo sapiens
tgtacatttatttattact

SEQ ID NO: 728752 - DNA, 22 bp, Homo sapiens
tgtacatttatttattactgtc

SEQ ID NO: 728753 - DNA, 20 bp, Homo sapiens
tgtacattttgtaaaatatt

SEQ ID NO: 728754 - DNA, 18 bp, Homo sapiens
tgtacatttttgggggga

SEQ ID NO: 728755 - DNA, 23 bp, Homo sapiens
tgtaccacagacacaatatgtat

SEQ ID NO: 728756 - DNA, 21 bp, Homo sapiens
tgtaccacttctgtgggcatg

SEQ ID NO: 728757 - DNA, 22 bp, Homo sapiens
tgtaccacttctgtgggcatgg

SEQ ID NO: 728758 - DNA, 17 bp, Homo sapiens
tgtaccacttttgcaaa

SEQ ID NO: 728759 - DNA, 17 bp, Homo sapiens
tgtaccagcccagatgt

SEQ ID NO: 728760 - DNA, 15 bp, Homo sapiens
tgtaccagttaattt

SEQ ID NO: 728761 - DNA, 21 bp, Homo sapiens
tgtaccagttaatttttccaa

SEQ ID NO: 728762 - DNA, 22 bp, Homo sapiens
tgtaccagttaatttttccaac

SEQ ID NO: 728763 - DNA, 14 bp, Homo sapiens
tgtaccatagaaaa

SEQ ID NO: 728764 - DNA, 15 bp, Homo sapiens
tgtaccattccttca

SEQ ID NO: 728765 - DNA, 18 bp, Homo sapiens
tgtaccattccttcaaat

SEQ ID NO: 728766 - DNA, 18 bp, Homo sapiens
tgtaccattttaaagtta

SEQ ID NO: 728767 - DNA, 16 bp, Homo sapiens
tgtacccttccacctc

SEQ ID NO: 728768 - DNA, 22 bp, Homo sapiens
tgtacccttccacctcctagag

SEQ ID NO: 728769 - DNA, 22 bp, Homo sapiens
tgtaccgtaggctttgtattca

SEQ ID NO: 728770 - DNA, 14 bp, Homo sapiens
tgtacctaacttga

SEQ ID NO: 728771 - DNA, 15 bp, Homo sapiens
tgtacctatttctga

SEQ ID NO: 728772 - DNA, 19 bp, Homo sapiens
tgtacctatttctgatgat

SEQ ID NO: 728773 - DNA, 15 bp, Homo sapiens
tgtacctgttcctcc

SEQ ID NO: 728774 - DNA, 15 bp, Homo sapiens
tgtaccttgaccatc

SEQ ID NO: 728775 - DNA, 23 bp, Homo sapiens
tgtacgacacgggtggggaaagg

SEQ ID NO: 728776 - DNA, 18 bp, Homo sapiens
tgtacggattttcagtta

SEQ ID NO: 728777 - DNA, 16 bp, Homo sapiens
tgtactaactagcatt

SEQ ID NO: 728778 - DNA, 15 bp, Homo sapiens
tgtactaagccagga

SEQ ID NO: 728779 - DNA, 17 bp, Homo sapiens
tgtactaagccaggagg

SEQ ID NO: 728780 - DNA, 18 bp, Homo sapiens
tgtactaagccaggaggc

SEQ ID NO: 728781 - DNA, 16 bp, Homo sapiens
tgtactaatctgagat

SEQ ID NO: 728782 - DNA, 14 bp, Homo sapiens
tgtactacctgtgt

SEQ ID NO: 728783 - DNA, 19 bp, Homo sapiens
tgtactagtcctctagaaa

SEQ ID NO: 728784 - DNA, 19 bp, Homo sapiens
tgtactatggaaaatcagc

SEQ ID NO: 728785 - DNA, 21 bp, Homo sapiens
tgtactatggaaaatcagctg

SEQ ID NO: 728786 - DNA, 12 bp, Homo sapiens
tgtactatgtta

SEQ ID NO: 728787 - DNA, 15 bp, Homo sapiens
tgtactattgcagac

SEQ ID NO: 728788 - DNA, 18 bp, Homo sapiens
tgtactattgcagacctg

SEQ ID NO: 728789 - DNA, 19 bp, Homo sapiens
tgtactcagagcagagcaa

SEQ ID NO: 728790 - DNA, 14 bp, Homo sapiens
tgtactcatcggca

SEQ ID NO: 728791 - DNA, 15 bp, Homo sapiens
tgtaggtgtctctgg

SEQ ID NO: 728792 - DNA, 18 bp, Homo sapiens
tgtaggttatctttttaa

SEQ ID NO: 728793 - DNA, 13 bp, Homo sapiens
tgtagtaaagaaa

SEQ ID NO: 728794 - DNA, 22 bp, Homo sapiens
tgtagtaacacagattattcat

SEQ ID NO: 728795 - DNA, 17 bp, Homo sapiens
tgtagtaacactaatat

SEQ ID NO: 728796 - DNA, 20 bp, Homo sapiens
tgtagtaacactaatatatt

SEQ ID NO: 728797 - DNA, 14 bp, Homo sapiens
tgtagtaagagctt

SEQ ID NO: 728798 - DNA, 19 bp, Homo sapiens
tgtagtaattgacatgtgc

SEQ ID NO: 728799 - DNA, 21 bp, Homo sapiens
tgtagtagcgttttttaaatg

SEQ ID NO: 728800 - DNA, 15 bp, Homo sapiens
tgtagtataaagaaa

SEQ ID NO: 728801 - DNA, 14 bp, Homo sapiens
tgtagtatggtata

SEQ ID NO: 728802 - DNA, 18 bp, Homo sapiens
tgtagtcaaaaaaggaaa

SEQ ID NO: 728803 - DNA, 15 bp, Homo sapiens
tgtagtcaataaaac

SEQ ID NO: 728804 - DNA, 15 bp, Homo sapiens
tgtagtcccagccac

SEQ ID NO: 728805 - DNA, 22 bp, Homo sapiens
tgtagtccgtgctgacagctgc

SEQ ID NO: 728806 - DNA, 17 bp, Homo sapiens
tgtagtcctcataaaaa

SEQ ID NO: 728807 - DNA, 16 bp, Homo sapiens
tgtagtgagaaactga

SEQ ID NO: 728808 - DNA, 17 bp, Homo sapiens
tgtagtgagatagcatt

SEQ ID NO: 728809 - DNA, 15 bp, Homo sapiens
tgtagtgagccgaga

SEQ ID NO: 728810 - DNA, 20 bp, Homo sapiens
tgtagtgcatttttaaactt

SEQ ID NO: 728811 - DNA, 19 bp, Homo sapiens
tgtagtggaagagcagcct

SEQ ID NO: 728812 - DNA, 23 bp, Homo sapiens
tgtagtgtgtgcttacagtaact

SEQ ID NO: 728813 - DNA, 16 bp, Homo sapiens
tgtagttctgtgtact

SEQ ID NO: 728814 - DNA, 19 bp, Homo sapiens
tgtagttcttgtgcatgtt

SEQ ID NO: 728815 - DNA, 20 bp, Homo sapiens
tgtagttgacaattctgcat

SEQ ID NO: 728816 - DNA, 19 bp, Homo sapiens
tgtagtttacctctttaaa

SEQ ID NO: 728817 - DNA, 15 bp, Homo sapiens
tgtagtttagttctg

SEQ ID NO: 728818 - DNA, 14 bp, Homo sapiens
tgtagttttgtata

SEQ ID NO: 728819 - DNA, 17 bp, Homo sapiens
tgtagtttttaattaaa

SEQ ID NO: 728820 - DNA, 13 bp, Homo sapiens
tgtataaaaagga

SEQ ID NO: 728821 - DNA, 16 bp, Homo sapiens
tgtataaaaaggaaat

SEQ ID NO: 728822 - DNA, 19 bp, Homo sapiens
tgtataaaaaggaaattag

SEQ ID NO: 728823 - DNA, 20 bp, Homo sapiens
tgtataaaaattatcaaaaa

SEQ ID NO: 728824 - DNA, 18 bp, Homo sapiens
tgtataaaagtgtgaaat

SEQ ID NO: 728825 - DNA, 21 bp, Homo sapiens
tgtataaaagtgtgaaataaa

SEQ ID NO: 728826 - DNA, 20 bp, Homo sapiens
tgtataaaatccaaaatgaa

SEQ ID NO: 728827 - DNA, 12 bp, Homo sapiens
tgtataaagatt

SEQ ID NO: 728828 - DNA, 14 bp, Homo sapiens
tgtataaagattgt

SEQ ID NO: 728829 - DNA, 18 bp, Homo sapiens
tgtataaagattgtactt

SEQ ID NO: 728830 - DNA, 19 bp, Homo sapiens
tgtataaagcaactgttat

SEQ ID NO: 728831 - DNA, 13 bp, Homo sapiens
tgtataaataata

SEQ ID NO: 728832 - DNA, 17 bp, Homo sapiens
tgtataaatccaatatc

SEQ ID NO: 728833 - DNA, 21 bp, Homo sapiens
tgtataaatctttcttttgat

SEQ ID NO: 728834 - DNA, 15 bp, Homo sapiens
tgtataaatgtacat

SEQ ID NO: 728835 - DNA, 18 bp, Homo sapiens
tgtataaattaatacaga

SEQ ID NO: 728836 - DNA, 19 bp, Homo sapiens
tgtataaattaatacagag

SEQ ID NO: 728837 - DNA, 21 bp, Homo sapiens
tgtataagaagatacactgca

SEQ ID NO: 728838 - DNA, 15 bp, Homo sapiens
tgtataagtcaagca

SEQ ID NO: 728839 - DNA, 21 bp, Homo sapiens
tgtataagtggaggcacttta

SEQ ID NO: 728840 - DNA, 22 bp, Homo sapiens
tgtataatactttgtatacaag

SEQ ID NO: 728841 - DNA, 14 bp, Homo sapiens
tgtataatattgaa

SEQ ID NO: 728842 - DNA, 20 bp, Homo sapiens
tgtataatattgaaaattga

SEQ ID NO: 728843 - DNA, 14 bp, Homo sapiens
tgtataattaactt

SEQ ID NO: 728844 - DNA, 23 bp, Homo sapiens
tgtataattaacttaactgaaga

SEQ ID NO: 728845 - DNA, 19 bp, Homo sapiens
tgtataattggatttccta

SEQ ID NO: 728846 - DNA, 21 bp, Homo sapiens
tgtataattggatttcctaat

SEQ ID NO: 728847 - DNA, 13 bp, Homo sapiens
tgtatacacacat

SEQ ID NO: 728848 - DNA, 18 bp, Homo sapiens
tgtatacacacatataca

SEQ ID NO: 728849 - DNA, 16 bp, Homo sapiens
tgtatacagtgcagag

SEQ ID NO: 728850 - DNA, 14 bp, Homo sapiens
tgtatacatacatg

SEQ ID NO: 728851 - DNA, 15 bp, Homo sapiens
tgtatacatgccagt

SEQ ID NO: 728852 - DNA, 18 bp, Homo sapiens
tgtatacatgtgtgggtg

SEQ ID NO: 728853 - DNA, 16 bp, Homo sapiens
tgtatacattttgtta

SEQ ID NO: 728854 - DNA, 17 bp, Homo sapiens
tgtatacattttgttat

SEQ ID NO: 728855 - DNA, 18 bp, Homo sapiens
tgtatacattttgttata

SEQ ID NO: 728856 - DNA, 19 bp, Homo sapiens
tgtatacattttgttatag

SEQ ID NO: 728857 - DNA, 21 bp, Homo sapiens
tgtatacattttgttatagaa

SEQ ID NO: 728858 - DNA, 15 bp, Homo sapiens
tgtataccaatgtgt

SEQ ID NO: 728859 - DNA, 16 bp, Homo sapiens
tgtataccaatgtgtt

SEQ ID NO: 728860 - DNA, 17 bp, Homo sapiens
tgtataccacctgtaca

SEQ ID NO: 728861 - DNA, 19 bp, Homo sapiens
tgtataccacctgtacata

SEQ ID NO: 728862 - DNA, 21 bp, Homo sapiens
tgtataccagcctactgtact

SEQ ID NO: 728863 - DNA, 14 bp, Homo sapiens
tgtatactatagta

SEQ ID NO: 728864 - DNA, 15 bp, Homo sapiens
tgtatactatagtac

SEQ ID NO: 728865 - DNA, 17 bp, Homo sapiens
tgtatactatagtacca

SEQ ID NO: 728866 - DNA, 15 bp, Homo sapiens
tgtatactcctgtca

SEQ ID NO: 728867 - DNA, 17 bp, Homo sapiens
tgtatactgtaaaagtt

SEQ ID NO: 728868 - DNA, 20 bp, Homo sapiens
tgtatacttgtattccctta

SEQ ID NO: 728869 - DNA, 16 bp, Homo sapiens
tgtatagaccaaagca

SEQ ID NO: 728870 - DNA, 20 bp, Homo sapiens
tgtatagaccaaagcaaaga

SEQ ID NO: 728871 - DNA, 22 bp, Homo sapiens
tgtatagagaatttaagtagaa

SEQ ID NO: 728872 - DNA, 20 bp, Homo sapiens
tgtatagatgcaagatattt

SEQ ID NO: 728873 - DNA, 19 bp, Homo sapiens
tgtatagcatgaaataaaa

SEQ ID NO: 728874 - DNA, 22 bp, Homo sapiens
tgtatagcatgtgtattaatgt

SEQ ID NO: 728875 - DNA, 17 bp, Homo sapiens
tgtataggccatctgta

SEQ ID NO: 728876 - DNA, 18 bp, Homo sapiens
tgtataggccatctgtaa

SEQ ID NO: 728877 - DNA, 23 bp, Homo sapiens
tgtataggccatctgtaaatatc

SEQ ID NO: 728878 - DNA, 19 bp, Homo sapiens
tgtatagtattggaaaata

SEQ ID NO: 728879 - DNA, 23 bp, Homo sapiens
tgtatagtgagagaggaggcctg

SEQ ID NO: 728880 - DNA, 15 bp, Homo sapiens
tgtatagtgtaaaat

SEQ ID NO: 728881 - DNA, 16 bp, Homo sapiens
tgtatagtgtaaaata

SEQ ID NO: 728882 - DNA, 16 bp, Homo sapiens
tgtatagtgttcacaa

SEQ ID NO: 728883 - DNA, 19 bp, Homo sapiens
tgtatagtgttcacaaact

SEQ ID NO: 728884 - DNA, 22 bp, Homo sapiens
tgtatagtgttcacaaactgtg

SEQ ID NO: 728885 - DNA, 17 bp, Homo sapiens
tgtatagttaacacact

SEQ ID NO: 728886 - DNA, 14 bp, Homo sapiens
tgtatagttcacgt

SEQ ID NO: 728887 - DNA, 11 bp, Homo sapiens
tgtatgccttt

SEQ ID NO: 728888 - DNA, 21 bp, Homo sapiens
tgtatgcctttaaatctgtga

SEQ ID NO: 728889 - DNA, 22 bp, Homo sapiens
tgtatgcctttaaatctgtgat

SEQ ID NO: 728890 - DNA, 14 bp, Homo sapiens
tgtatgctaaatga

SEQ ID NO: 728891 - DNA, 14 bp, Homo sapiens
tgtatgctgatgat

SEQ ID NO: 728892 - DNA, 14 bp, Homo sapiens
tgtatgctttgaat

SEQ ID NO: 728893 - DNA, 15 bp, Homo sapiens
tgtatgctttgaatg

SEQ ID NO: 728894 - DNA, 17 bp, Homo sapiens
tgtatggaatacagtgt

SEQ ID NO: 728895 - DNA, 16 bp, Homo sapiens
tgtatggcccaggcag

SEQ ID NO: 728896 - DNA, 17 bp, Homo sapiens
tgtatggcccaggcagc

SEQ ID NO: 728897 - DNA, 18 bp, Homo sapiens
tgtatgggagcttaactt

SEQ ID NO: 728898 - DNA, 15 bp, Homo sapiens
tgtatgtaaataggt

SEQ ID NO: 728899 - DNA, 14 bp, Homo sapiens
tgtatgtacaatac

SEQ ID NO: 728900 - DNA, 17 bp, Homo sapiens
tgtatgtacaatacaat

SEQ ID NO: 728901 - DNA, 23 bp, Homo sapiens
tgtatgtacaatacaatgtacaa

SEQ ID NO: 728902 - DNA, 15 bp, Homo sapiens
tgtatgtataattca

SEQ ID NO: 728903 - DNA, 23 bp, Homo sapiens
tgtatgtatacacacatatacat

SEQ ID NO: 728904 - DNA, 11 bp, Homo sapiens
tgtatgtgcac

SEQ ID NO: 728905 - DNA, 17 bp, Homo sapiens
tgtatgtggaagtatac

SEQ ID NO: 728906 - DNA, 11 bp, Homo sapiens
tgtatgtggtt

SEQ ID NO: 728907 - DNA, 14 bp, Homo sapiens
tgtatgtgtaagta

SEQ ID NO: 728908 - DNA, 13 bp, Homo sapiens
tgtatgtgtgaaa

SEQ ID NO: 728909 - DNA, 19 bp, Homo sapiens
tgtatgtgtgaaacaatgt

SEQ ID NO: 728910 - DNA, 16 bp, Homo sapiens
tgtatgtgtggctgtg

SEQ ID NO: 728911 - DNA, 19 bp, Homo sapiens
tgtatgtgtgtagactgta

SEQ ID NO: 728912 - DNA, 22 bp, Homo sapiens
tgtatgtgtgtaggttatcttt
